United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 163

SEQ ID NO: 6847315 - DNA, 68 bp, Homo sapiens
gctgtctgtgagaggtcactgccaagcatggcacagccattgctccaggtgtgcctctcatggaaggc

SEQ ID NO: 6847316 - DNA, 74 bp, Homo sapiens
cctgctaattgtgtccctggagcttctgtgcggactgaggactgcacagtcctacagagatcagagtgagaagg

SEQ ID NO: 6847317 - DNA, 96 bp, Homo sapiens
tcttttctacatcctgtatctcctagacacttatggaagtgagtgaagacacatttatgacagtggcagtgtctatggacaagaagtagccaaaga

SEQ ID NO: 6847318 - DNA, 98 bp, Homo sapiens
ctgagcttagtatgtaagatggcaatagtaccaagtgtaagtcaaggaacctatgctccaaagacatgttgccacttttctttctatcctaggtcaag

SEQ ID NO: 6847319 - DNA, 73 bp, Homo sapiens
gagacagaggaaacttacttggcagtgtcttacttagatcttgcttttaaacaaagtgggtttattctttttc

SEQ ID NO: 6847320 - DNA, 61 bp, Homo sapiens
acaaagataatcacagaatacccaagttatctcaggtcttcgggtatagtggttactttgt

SEQ ID NO: 6847321 - DNA, 67 bp, Homo sapiens
ttctccgaggcaccctgaggttcacttccagacacagatgtcttttatttcatggtgcttttaagaa

SEQ ID NO: 6847322 - DNA, 66 bp, Homo sapiens
tatttgtccaggtaaatttcagatattattctctcttaaattatctgaaatctgatgggacaaatg

SEQ ID NO: 6847323 - DNA, 84 bp, Homo sapiens
gccaccgaggagccccaggcagccaggggacctgtccttcaccctagaggatagaagcccaaaggctgcggctgctgcagtggc

SEQ ID NO: 6847324 - DNA, 80 bp, Homo sapiens
ctcctgcgtcaggttccataggaatcctttccccgccagtggaggaggctctcccgtcttttggaaatgatgtgcaggag

SEQ ID NO: 6847325 - DNA, 89 bp, Homo sapiens
tgtgatcttgaactaattactctctctaatctcagtactctcctttgtagagagctgttgtaagtattagaagagttggggtatgcaca

SEQ ID NO: 6847326 - DNA, 129 bp, Homo sapiens
tttagacgagcatctcgacggcaggggctcttgttcacttatgttctcccattgtgagtagcataatgcctggaataccgtaagtgctgaagaaaggtttgtggggttgattaattattgaactctgaa

SEQ ID NO: 6847327 - DNA, 128 bp, Homo sapiens
cttccctacacatcccgttggccagaacagtcaacagccatatgtagctgccagagagttgcacacgtcattttgattctgggcagccatgtgcctggctaacgtttgggcttctggaagggtagaag

SEQ ID NO: 6847328 - DNA, 57 bp, Homo sapiens
cctgcgggggtgtggggagcctggcctggcccaggtcctctcctcacccgtgtcagg

SEQ ID NO: 6847329 - DNA, 76 bp, Homo sapiens
catctgatgtttcaaaggttatacagtcaaaattgaatcaatgtgattgtaatgtgcctttccaaaaaagaagatg

SEQ ID NO: 6847330 - DNA, 64 bp, Homo sapiens
ctacttatgggaaattttattttggaagacgaaattgttaaacaaagaaatctcccattggtag

SEQ ID NO: 6847331 - DNA, 76 bp, Homo sapiens
tccaacagtgagttgatgactgaattaaaaaccgagtgtagatttgactgatttaatcatcactgctcaactggga

SEQ ID NO: 6847332 - DNA, 60 bp, Homo sapiens
tctgtatatattgtggcagagaaattgtcccatgataatcttggttgcagtatatccggg

SEQ ID NO: 6847333 - DNA, 66 bp, Homo sapiens
cccaccccatgtgcaggaagctggttccaagcagggacccttggccccgctttccacgtgggtggg

SEQ ID NO: 6847334 - DNA, 58 bp, Homo sapiens
ggtccaggtatgtggtgtgaatgaatacttgaccaggtcccacaatataacttggact

SEQ ID NO: 6847335 - DNA, 99 bp, Homo sapiens
gaaatttatttctggctacatattccagattgttagttggataacttctatttgacaatataagaatctattaggaatatgtagcccctcattaatttc

SEQ ID NO: 6847336 - DNA, 79 bp, Homo sapiens
tgccagtgagagaggtcggggacactgcaaatggattctgattctctgccccatttgtatgtccttgggcctcctggta

SEQ ID NO: 6847337 - DNA, 63 bp, Homo sapiens
aaagctgatgtcccagtttgaaggtaggaggagttcttccttccttaggtgaggctcagcttt

SEQ ID NO: 6847338 - DNA, 68 bp, Homo sapiens
ctgggcgtcctcagaggccatccgaaaataaagtggttttcgggtggaaattcgaggttgtaaattgg

SEQ ID NO: 6847339 - DNA, 57 bp, Homo sapiens
gagctggaagggaaatctcttggcaagctgtggttgccacccttctcttcccagctt

SEQ ID NO: 6847340 - DNA, 60 bp, Homo sapiens
ttccttccagaggtgatgttggttcttatcttcataagttggttttcactctggaaggga

SEQ ID NO: 6847341 - DNA, 62 bp, Homo sapiens
ttcctggcttgtcacatctacgtgggacatttagactatccacgggctggataccttaggaa

SEQ ID NO: 6847342 - DNA, 89 bp, Homo sapiens
atcttgtctcaaatggcctttgggcactgtgggcagagatgatcgactgctgtcccttctgtgccctcggtgctgggcctgagcaggat

SEQ ID NO: 6847343 - DNA, 58 bp, Homo sapiens
ggtggcggcctgggaataaccttggcacttgttaccttggaaatcaccaggctccacc

SEQ ID NO: 6847344 - DNA, 55 bp, Homo sapiens
acagctggtgaatgttctctgtgtcctgtgggacacatatgacaaggccagttgt

SEQ ID NO: 6847345 - DNA, 68 bp, Homo sapiens
ttgttagttgggaagatgctgtgaggcctgagttaattttggactaacatgtctcttctgaaagacaa

SEQ ID NO: 6847346 - DNA, 74 bp, Homo sapiens
gggggccgatcagcgaaggtcttgactgtgaagctcaggagtcagggaacaattgcagatttttgaaagctcct

SEQ ID NO: 6847347 - DNA, 64 bp, Homo sapiens
agctattgcctagtatttgcagagaaatataaatgattctgaatggcaagcattaggcaaggtt

SEQ ID NO: 6847348 - DNA, 64 bp, Homo sapiens
cggcagagccctgagtcagcctcgtaaattgtgtgacaggcaagaccagaaagggctgatgttg

SEQ ID NO: 6847349 - DNA, 77 bp, Homo sapiens
cccagggacacccagttattaggccatcttcagtagccaatggccagtaatagcttctggtgtcccctcttcttggg

SEQ ID NO: 6847350 - DNA, 59 bp, Homo sapiens
tatttcattgccataaggtgggatggacacaccagaccccctttaatggaagtgctatg

SEQ ID NO: 6847351 - DNA, 65 bp, Homo sapiens
ggctatgggagggacattttggaggcaagccttccatggaaacctccaaatcccattctgtagtc

SEQ ID NO: 6847352 - DNA, 62 bp, Homo sapiens
gccaccacacccagcctgggtgacagagtcttactctgtcacccaggctggagtgcaatggc

SEQ ID NO: 6847353 - DNA, 66 bp, Homo sapiens
ggaaatatgttgagtctatctttatggatccatctcctttctataaagaagagttaatatattttt

SEQ ID NO: 6847354 - DNA, 74 bp, Homo sapiens
tttcatgattgagggtatctttgctcattattcctatgaaagacgtgagcttctgcctctcagtccaaatgaag

SEQ ID NO: 6847355 - DNA, 106 bp, Homo sapiens
ggcccctcccctgagccttgtgggtaattggagggctgcctgctctgggctagtcggtcagcatgggctctccagtgcccactcatcgcctcatcacagaaggatc

SEQ ID NO: 6847356 - DNA, 73 bp, Homo sapiens
tgtgcttcaaccaggttaattcactacttttaacaatttaatgaagaagttgatgatattctggttgtttaca

SEQ ID NO: 6847357 - DNA, 88 bp, Homo sapiens
gctggtctcgagctcctggcttcaggtgatcctcccatctcagcctcccaaaatgctgagagggcagctgtgagccactgtgaccagc

SEQ ID NO: 6847358 - DNA, 67 bp, Homo sapiens
ggccctctgctctgagatgaagccctggacctgcagaagcccttcccctctcagagccctagaggcc

SEQ ID NO: 6847359 - DNA, 76 bp, Homo sapiens
gagaatatacactttctggagctcttctctcctgaacaaaggtaagcagcagatccaaaaaatgtgaatgtttctc

SEQ ID NO: 6847360 - DNA, 123 bp, Homo sapiens
atatacatttatttacattttaaggtcctgtcagaactatttctttcaggatgcattcagctttaatgtatcaagggaaagagagtaggtttgatgacttgttatgtaaaacattatgtgtgt

SEQ ID NO: 6847361 - DNA, 64 bp, Homo sapiens
tagtgggtcttataattttagggcctccaaaggtcttaatcaggctctgatggtgagctcatta

SEQ ID NO: 6847362 - DNA, 63 bp, Homo sapiens
atcaggatcactgggagtcttgttaaaacacagattattacgcccactcccagaaattttgat

SEQ ID NO: 6847363 - DNA, 92 bp, Homo sapiens
tgctacagataccacacagatttgtgaactagaaaaatcatgaacactagttgctttaagacactaagtttgaggtggtttgtcttgtagca

SEQ ID NO: 6847364 - DNA, 82 bp, Homo sapiens
ctcttctaatcaaattgcacatgggtgcttctagttactttgagctggtatctttgcatccatcagcagattgactggagag

SEQ ID NO: 6847365 - DNA, 68 bp, Homo sapiens
gtgatcaatggtctacagccagagacctgcagaggcagcaggtgaccctcagtgtggacttagagcac

SEQ ID NO: 6847366 - DNA, 63 bp, Homo sapiens
ggcttcatgtattagtcactgtcccatttgcaagataaagcctggaacactggtgctggagtc

SEQ ID NO: 6847367 - DNA, 56 bp, Homo sapiens
ggcaacatgatgtcaaccaggatgtagtgaaccacactagttaatgtcatgatgtc

SEQ ID NO: 6847368 - DNA, 67 bp, Homo sapiens
cttaatctcacctgcaaagtcccttttgccatggaaggtcacctcttcacaggttcaggggattaag

SEQ ID NO: 6847369 - DNA, 129 bp, Homo sapiens
gaggctgaggcaggagaatcgcttgaacctgaaggcagagcttgcagtgagctgagatctcaccattgtactccagcctgggtgacacaagtggaactctgtctcaaaaaaaaaaaaaaaatggcaatt

SEQ ID NO: 6847370 - DNA, 76 bp, Homo sapiens
ttagatgattttaagtgaaggaccaatatgactcatgttacatgagcagatatggattttagagaggtcaatctga

SEQ ID NO: 6847371 - DNA, 70 bp, Homo sapiens
ggtactatgaggcacgtgttactggcctagttggagaccactggagaggtcagttatattgcccaaggcc

SEQ ID NO: 6847372 - DNA, 79 bp, Homo sapiens
ggtgctgggagaggagaaggaggcccctcacactctcgatcaagggtgtttgttcatcctctcttctctccccgccacc

SEQ ID NO: 6847373 - DNA, 60 bp, Homo sapiens
ggtgagcactgccctgggtctcttagggcataaccttgggattcagggagttgctatgcc

SEQ ID NO: 6847374 - DNA, 58 bp, Homo sapiens
gtaggggtgtgggtactaggactggctaaatcagatctgacctaaccccaccaccagc

SEQ ID NO: 6847375 - DNA, 79 bp, Homo sapiens
gctcatgggcttcttgctgggggcctcagtgctgtccgctaaagcacctactgtgtgcccagccgagctgcccctgagc

SEQ ID NO: 6847376 - DNA, 96 bp, Homo sapiens
caaattacgtagctgatcctgaggacagggactgtttctaacttggttttataaactttgtcttccaggcacagttctttatacacagtaggtttg

SEQ ID NO: 6847377 - DNA, 113 bp, Homo sapiens
aacttacagtttactttggctttccaataaggctaggaattctctgaagtcatatagagcttattcttcacagagtccctgattgttggcagaattgctgaacaatgtaagtt

SEQ ID NO: 6847378 - DNA, 64 bp, Homo sapiens
gggattccgttcctggactatagaacttacaccatgcgggtgctgttcccaggaattgaagacc

SEQ ID NO: 6847379 - DNA, 97 bp, Homo sapiens
ctaggcatggccaatattaaaatgcaaacattgtaggagatgtaacagagcaaccttatgtttcatttagatatcaggcttatatttctatgaatag

SEQ ID NO: 6847380 - DNA, 81 bp, Homo sapiens
ggagcatgagaaacctgagtgcagatcaggaaaattattaatttccaactgtctgccatcagtatcatttctctttgtttc

SEQ ID NO: 6847381 - DNA, 69 bp, Homo sapiens
catttgctctgtatgagatgtccatgtatgagctcccataaaatgatgcataatttatacatgcaaatg

SEQ ID NO: 6847382 - DNA, 77 bp, Homo sapiens
gcaaggtacagggaaggagcaagacttagactttggaaaagctggcttcaaattctgactctatccttgtgctttgt

SEQ ID NO: 6847383 - DNA, 67 bp, Homo sapiens
gaaaacagagggagtcacatataagcctaatgaaccaaggctcaaatgaggccaccttctacatttc

SEQ ID NO: 6847384 - DNA, 78 bp, Homo sapiens
atgccagaaactaacaaggcaaaaattgttttgtcaccaatcagtgatgtttcaatttcagcttaagttgtttggtat

SEQ ID NO: 6847385 - DNA, 64 bp, Homo sapiens
acacagccagtgactgcagaccctggccatgcagctctagggtctgtgttcttggccactgtgt

SEQ ID NO: 6847386 - DNA, 67 bp, Homo sapiens
gatggggtagccctgcccatttggcctgggattgctgcccctgtggctctctgcagggtccccactc

SEQ ID NO: 6847387 - DNA, 86 bp, Homo sapiens
gacaccttgccccttacctgacattctgagtttccttcagaaagcttcaaggaaactcaaagtgtcaggtaaggggcaaacttgtc

SEQ ID NO: 6847388 - DNA, 116 bp, Homo sapiens
acttccctgcccccagcatggcagcaagtgcctgctcagacctagcaggcctggaacaaagatgtctttgtggctgcggagtcagagcaggcctcccgtcctcaaggcaggagagt

SEQ ID NO: 6847389 - DNA, 72 bp, Homo sapiens
cttagttttagagttgctgagtatatacccaagattagaattgctgggtcatttggtaactgtacgtttaag

SEQ ID NO: 6847390 - DNA, 73 bp, Homo sapiens
gtttaacaacttgcgttcagagatgtcctgtaaggcataggtgtgcactcttgaatgctggttgttcacaaac

SEQ ID NO: 6847391 - DNA, 80 bp, Homo sapiens
gcacctgtgatatagctgacgctaaataaatgttgaatttgaatgaaaatgcactacgttgtgtcggcagtattcaggtc

SEQ ID NO: 6847392 - DNA, 86 bp, Homo sapiens
aaggtatgagttgaagaagaaccagcacagcagaggaagcagatatgaagtctgagccacctgccagtgctgtttactcattcctt

SEQ ID NO: 6847393 - DNA, 87 bp, Homo sapiens
ctctgcctcatatcgggaaagtttataatgctctcttcatcaggtgatagcagaagaacgtcttataaattcactgattagacagag

SEQ ID NO: 6847394 - DNA, 69 bp, Homo sapiens
cacttaccagagatgtctaataggggcagcctgagaattgtccagacggcctcaggcatcctgcaggtg

SEQ ID NO: 6847395 - DNA, 82 bp, Homo sapiens
gcccgccaggtcgggtgcggcggcagcctctaagcgaaatcggctgtgggccctaggcacccgagttatgttcagggcgggt

SEQ ID NO: 6847396 - DNA, 58 bp, Homo sapiens
cctttaattgtctgaagaaaatgattgagaagcagcaatcttcaaaaacaattgaggg

SEQ ID NO: 6847397 - DNA, 89 bp, Homo sapiens
gtgggacctggggctagtagagtcttcctcaggaagcccgtcttggcccgtgcttgtctgaatctggagctctcttgtccttgtcttgc

SEQ ID NO: 6847398 - DNA, 65 bp, Homo sapiens
agagaacaggctctggagtcagacaactgtgttctcatcaacagactctgatgagcccgttttct

SEQ ID NO: 6847399 - DNA, 106 bp, Homo sapiens
tatctcccctggaacacagagtatttgaagcatttgaagaatttttttcaggttatgtttaaaattaaaaccaactcatgttgtgaaaaactcaagggcacggata

SEQ ID NO: 6847400 - DNA, 83 bp, Homo sapiens
tgggctaataaatagagatatcaatttcatggtgatcgtcactgatctttactttaaaaactgataattcattttttggttca

SEQ ID NO: 6847401 - DNA, 95 bp, Homo sapiens
gaactgagcagagtacaccacattggaactcattagcccatagagcagaatgtttacactgcctgtggtctgtgatctaaacggttgtttggttt

SEQ ID NO: 6847402 - DNA, 67 bp, Homo sapiens
ttctcacagctctggaggcagggaagtccaagatcagggcatcagcagattcagagtctggtgagga

SEQ ID NO: 6847403 - DNA, 86 bp, Homo sapiens
gctccttcatgctcctgccctttttggggggtgtagttacaaagaaaacaatccccaaatagggctcagggcatgactcaggcagt

SEQ ID NO: 6847404 - DNA, 84 bp, Homo sapiens
agtctgtgccacatggcctaatagagaagaatttaatataaaaattcctagtaatttatctttgtttccccataatggtttgct

SEQ ID NO: 6847405 - DNA, 89 bp, Homo sapiens
gtgccctggttctcgactcatcagcctctaggaaagaagcagcttgctggtccatcccaggctgctgggaggcccgagaaacaggtcac

SEQ ID NO: 6847406 - DNA, 59 bp, Homo sapiens
ggaaatttctgatatccaactatttttgacctacaagaatggtaatttgcagaaagtcc

SEQ ID NO: 6847407 - DNA, 89 bp, Homo sapiens
gagaatgaacgactggatgctggaagtgctgatcttgtcactctaggttttcccatggcgtcaggaccactagtatcccattcattttc

SEQ ID NO: 6847408 - DNA, 73 bp, Homo sapiens
tctcatatccagtgtttttcttcacaggttttgcacactagggaccaagaagccctcggggacactgctgaga

SEQ ID NO: 6847409 - DNA, 117 bp, Homo sapiens
gtgaaagtatatgcatcaaaaattaacagcagttatgagtagaatagttgagagcttccaaaatatatattgcttttgcttgctgatgtgcttgtttacattatgttttgcttttat

SEQ ID NO: 6847410 - DNA, 77 bp, Homo sapiens
ccagggacatgctaaaagagtgctcagatgcatgtcttcattccaagaccctgcccagcccctctggcaatccctgg

SEQ ID NO: 6847411 - DNA, 63 bp, Homo sapiens
ttaggtaaattcctctctttgggcctcacttgcaacaccaataaagagaggaagttatactag

SEQ ID NO: 6847412 - DNA, 68 bp, Homo sapiens
cccttactaaaccctcgatggatcttaaatctggagtttaggatcaatcacctgagggattttaaggg

SEQ ID NO: 6847413 - DNA, 69 bp, Homo sapiens
caaagtcattctacacaacatgatgatggagccattcttcattttttcactggtctggaaaagactttg

SEQ ID NO: 6847414 - DNA, 63 bp, Homo sapiens
tctgctttagtgcaaagtcttaggtgtgtggctccacctaagactttgcactaaagtccaaga

SEQ ID NO: 6847415 - DNA, 67 bp, Homo sapiens
ccgtgcaggtgttttggctgccagccctggctaaggtctcagctgtcagccagtagcatttgcaagg

SEQ ID NO: 6847416 - DNA, 90 bp, Homo sapiens
gaggtggagtctacagaggcaggcaggcttccttgaactgtggtggactccacccagttcaagcttcctggctgctttgtttacctactc

SEQ ID NO: 6847417 - DNA, 86 bp, Homo sapiens
ctctttggtgtggagggaaaacagttatctcacatatggaagggaaagttcatcttccttggtgtaactgctcctatggcaaagag

SEQ ID NO: 6847418 - DNA, 73 bp, Homo sapiens
cacctgggactttgttaatatctcacattcctggttcacaggaatctgtggttttaacaggcacctccaggtg

SEQ ID NO: 6847419 - DNA, 71 bp, Homo sapiens
ctggaatgctctcaggtcagctttagagtgaaggcaatctttacaaatcatacatctgtcctggagctcag

SEQ ID NO: 6847420 - DNA, 56 bp, Homo sapiens
gagctaagacctgagggcaagtccaaggattcgcagccccctgccaggatcagctc

SEQ ID NO: 6847421 - DNA, 77 bp, Homo sapiens
aaatgcctggaatgcaggaccggaaccatgggatatgcagacatagataaaccatatttcctttctgctgggcattt

SEQ ID NO: 6847422 - DNA, 87 bp, Homo sapiens
taatttgttggaaatggtcttctcaagcaacactgggaatagtttgttttctccagtgctgccaaagggaccttggtcaggaggtta

SEQ ID NO: 6847423 - DNA, 71 bp, Homo sapiens
ggggtagatctagaatgtaaatccagacacagctcaaaattgatgtctctctatactctaactctttcccc

SEQ ID NO: 6847424 - DNA, 70 bp, Homo sapiens
ggctgtttgttcttttgtacctaaggcattaactaataaatcctcaggtcaaagcaggagaatctatgcc

SEQ ID NO: 6847425 - DNA, 130 bp, Homo sapiens
ttgagaggaatattacaggtcactgtttaacactagtttctttaactaccccaaacaaatgtccagttatggaagagtcagtgaaaactagaatgttgcttgcctgctgtttttctctacatttcattaa

SEQ ID NO: 6847426 - DNA, 56 bp, Homo sapiens
atacccagctctttcgttttgggtcctcacaaatggtaaaagtgtgagctgggtgt

SEQ ID NO: 6847427 - DNA, 129 bp, Homo sapiens
ttgaatgatatagctcatattttcatagttttgaatgccatttatctgacttagttcatgaccaaaaatgtgtgtgactagggagatcaattgtgcagccagaacgtggaagttaaatagactattcaa

SEQ ID NO: 6847428 - DNA, 55 bp, Homo sapiens
ctgccagttggcacagagggttctgaccctttccaaaaccctttccaaactgcag

SEQ ID NO: 6847429 - DNA, 77 bp, Homo sapiens
atctactggcgactctggtcatttggaagagcatgttttgaaaagatgagctttttgatggctgtattcgggtagat

SEQ ID NO: 6847430 - DNA, 77 bp, Homo sapiens
tggggaaggaatcagatgcactgcagtatatactgtaggattctatttatataaagtattgtattagtccattctca

SEQ ID NO: 6847431 - DNA, 127 bp, Homo sapiens
gtgtgcatatgcagtgtgtgtggtgggcatatgaagtgcatggttatgcaaacatgatgcatgtaagtgtatgtgaatctgtgtgattatgcgtgtgtgtgtgcatagtgcatttgtgtgtgtacat

SEQ ID NO: 6847432 - DNA, 70 bp, Homo sapiens
gcttcttaaattctcagaatactcttcttgtggtagatgctacaagttccattttgaaagtgaaggaagc

SEQ ID NO: 6847433 - DNA, 76 bp, Homo sapiens
tctcctgagctcaaagggtgcctggtgatatttaagctttattgcctaagctcctggcatcttcagtttaggtaga

SEQ ID NO: 6847434 - DNA, 56 bp, Homo sapiens
tgtgctgcatgacttgctcctgagcatatctgagctatgaaagtcctgcatgccca

SEQ ID NO: 6847435 - DNA, 58 bp, Homo sapiens
gtcagggcatctcttaagtggtgggtatgtgcctacagcagagtgggatgcatctggc

SEQ ID NO: 6847436 - DNA, 121 bp, Homo sapiens
gctatatcttactttgtatctctactgttctttgattatcggtgtgaatgttttaatgaagttctcaaattaacttccattataatgaaaggcagtgatctttttaactttaaattatggc

SEQ ID NO: 6847437 - DNA, 69 bp, Homo sapiens
ttatcaatattatgttttggtgtaatgtagtaccatttctaacttacactttacagaatgttttgatag

SEQ ID NO: 6847438 - DNA, 58 bp, Homo sapiens
gaccctgaggattccctgctgatccatgtcttccgatggggagggtgtcctcagtgtc

SEQ ID NO: 6847439 - DNA, 78 bp, Homo sapiens
tttacatataccatttctgtatacttaggatttaagggtaatgtaatcctgaacagtgtagcagagaggattagtgaa

SEQ ID NO: 6847440 - DNA, 104 bp, Homo sapiens
taaacatttgtttaagtgaatactaaggatggagcaatagtgttattttcctcaggaactgaagtctcatgctgaagtattttctccttaaaattaaattttta

SEQ ID NO: 6847441 - DNA, 92 bp, Homo sapiens
tggtgagccaataagtctctgccaagggtcaacactttaaacatatagttataagacattttagagtgtgactggccttttggaaaacacca

SEQ ID NO: 6847442 - DNA, 78 bp, Homo sapiens
gagaactgttcttttgcttctaattaaaacagtcaggggtattactgattaaaggtggggaagcagagaactgttttc

SEQ ID NO: 6847443 - DNA, 69 bp, Homo sapiens
tgccctgcctgagagacagtaattgtgttttcaaccacatttcacagcacttttcaacctggcaaggca

SEQ ID NO: 6847444 - DNA, 114 bp, Homo sapiens
ccctgaagctgggatttaggtaaggggaggacctttccaaggcttgtttacagctcagatttgcagaggaccaggtatttgggaactcctcttctgaagaaccagattgcaggg

SEQ ID NO: 6847445 - DNA, 57 bp, Homo sapiens
ccctgagcacacctggcagacaatcagtgaggccgtagggtcaggatgggctgaggg

SEQ ID NO: 6847446 - DNA, 78 bp, Homo sapiens
ggcccagagctgggcgggagggagacaggcagatagcagggaagaatgagccatctctgtcccctcagctggggtgcc

SEQ ID NO: 6847447 - DNA, 69 bp, Homo sapiens
gatgctgaggagatggcttgctctcacgtgggcagctgctcctttgagaaacaagccatgcgcagtgtt

SEQ ID NO: 6847448 - DNA, 73 bp, Homo sapiens
tctgtgcgggagggcaacgcggcattttcccgctttctacgaaaatctgttgatgcaaacctcccgcttcaga

SEQ ID NO: 6847449 - DNA, 62 bp, Homo sapiens
ctatttcccagggcctgggatttgagttttccctgcactcaagtccttttccctacaaatag

SEQ ID NO: 6847450 - DNA, 68 bp, Homo sapiens
tagataacttgcacctacaggatgtaccaagagcctctcacattactctgtaagtgttggttattcta

SEQ ID NO: 6847451 - DNA, 60 bp, Homo sapiens
tgagttcatgcttgtagttctagacttatcccatgttgaggaatagcctccttgaactca

SEQ ID NO: 6847452 - DNA, 84 bp, Homo sapiens
ttgtattcctgctttaccaaactcttggattcatgtatcttttgttccactcattcatcctgactatgggaagtaggaagccaa

SEQ ID NO: 6847453 - DNA, 94 bp, Homo sapiens
gcaaataaatatatactgttctgtgaggtaatgtgacagagatagtgcgtaacaaatgtacatatgctcatctgcattcccttgcattatttgc

SEQ ID NO: 6847454 - DNA, 78 bp, Homo sapiens
tgcatctcttgaggcctcagtttgtcatctgtaaagtgagagcattgtactagatgatctctgaggcctttccctgta

SEQ ID NO: 6847455 - DNA, 64 bp, Homo sapiens
ctttttggaaagacacacagttttaattctttaattgaaatttggtgagtttttgccatgaaag

SEQ ID NO: 6847456 - DNA, 128 bp, Homo sapiens
gatttggcttcccctgggcagatgtggcttcccctgggcaggtacagaccctctgggaaggtgtggctccccctgggcaggtgtggcttcccctgggcagatgcgtctgtccttgggcaggtggggtt

SEQ ID NO: 6847457 - DNA, 62 bp, Homo sapiens
gcctgtttctcctccttggccccagatccgcgactggcggcaaggtgaggacgaacacaggc

SEQ ID NO: 6847458 - DNA, 69 bp, Homo sapiens
gctattaaagtcgatgtcttaattaagcctagcattagccaaggaattacaggcatccgaaggcttagc

SEQ ID NO: 6847459 - DNA, 75 bp, Homo sapiens
ttgctgctcttaaattattttgaattgtggcttgattgacaagcttcatagaacagaaatttaatagctgagtaa

SEQ ID NO: 6847460 - DNA, 62 bp, Homo sapiens
agttctcttctcatcacccaggaccactggacagaagtggcagggagacaagaagtagagct

SEQ ID NO: 6847461 - DNA, 78 bp, Homo sapiens
gtcctgcggctgcaagggcttcaagtggccaagaggcactcctggtcttaaggcccttgctcagaagtgatgcaggcc

SEQ ID NO: 6847462 - DNA, 68 bp, Homo sapiens
gtttgcctttctggtgaagataccatgcatgataacatttcaacttattagggccaggactggcaaat

SEQ ID NO: 6847463 - DNA, 80 bp, Homo sapiens
cttacttttattcccgtactgtttatctttgaggaagtttctatttcaagtattattacagatgtaggaataaaggtgag

SEQ ID NO: 6847464 - DNA, 72 bp, Homo sapiens
gctgagtactccagctgccttctgcgggaagtcatttaatgatgttctgttctaggataggtggcactcggt

SEQ ID NO: 6847465 - DNA, 87 bp, Homo sapiens
ctgttagcattcccagtgccagctctccccacatctgtgcagcttttgtcctgtggcaggggaggatttggaatggtctgctggcag

SEQ ID NO: 6847466 - DNA, 72 bp, Homo sapiens
aaaagctaaatgtcatggagttgtagaaaaaagttattctggtctaattcattctgtgatgtttcttctttt

SEQ ID NO: 6847467 - DNA, 72 bp, Homo sapiens
gtggcactgttgagtcaaaagaaaaccaggtttgaaatcagaaaacctggcttctaatcatggctctgccac

SEQ ID NO: 6847468 - DNA, 72 bp, Homo sapiens
aagataagaggccagtatacaaacttccggtgtgctgggcactgggactgtatgtgctggactgaaaatctt

SEQ ID NO: 6847469 - DNA, 71 bp, Homo sapiens
ggctggagtgcagtggcgtgagctcggctcactgcaagctccgcctcccgggttcacgccattctcctgcc

SEQ ID NO: 6847470 - DNA, 86 bp, Homo sapiens
tgttctctgtgtgcaacaaatagtcctgatttaatctggggcagaaaatcccctagctttgccagtgatctgcttgttggagaata

SEQ ID NO: 6847471 - DNA, 56 bp, Homo sapiens
ctatttctacacagggtcggcgtggcgaaggacggctagccttggagggaaagtag

SEQ ID NO: 6847472 - DNA, 60 bp, Homo sapiens
gcctggcaggggaggtgcttgcttagagggtggaacgtctagctctgtacaacctgaggc

SEQ ID NO: 6847473 - DNA, 65 bp, Homo sapiens
acgagattaggtaattacagcaaatgtggtcattagcctcatctgctcttattatcttattatgt

SEQ ID NO: 6847474 - DNA, 102 bp, Homo sapiens
tgaggcagagtttcactcttgttgcccaggctggagtgcaatagcgagatctcggctcactgcaacctccacctcccaggttcaagtgattctcctgcctca

SEQ ID NO: 6847475 - DNA, 77 bp, Homo sapiens
tgaaggccactcagggagtagcacatgtggaacttttatgtggttctatagagccttttattaccctgtgggcctca

SEQ ID NO: 6847476 - DNA, 93 bp, Homo sapiens
ggattatggttcatccaacttcaaagttgttatcatgggtatctaaaatttctaaaatactttgccaagttcgaagaaccaactgtataatcc

SEQ ID NO: 6847477 - DNA, 57 bp, Homo sapiens
ttctcctcactgcagcctttcatgagcactccacagaaaggaacttgtgagtgggag

SEQ ID NO: 6847478 - DNA, 70 bp, Homo sapiens
cttactggagaaggaaccccaggaggagcacctgagaagccagttcatcatgatgttcccctctagttag

SEQ ID NO: 6847479 - DNA, 93 bp, Homo sapiens
ctgcagagccaagcagaaagcaggttcccatttctacagcagcctttatcgcactgcattgtaattgcttgtttacctgctggctcaccgcag

SEQ ID NO: 6847480 - DNA, 68 bp, Homo sapiens
cagaaatgaagcagttttcatcaagttatgctcagagacagcttatttggttgcttgcttcatttttg

SEQ ID NO: 6847481 - DNA, 55 bp, Homo sapiens
catgatctggtcctactgtgggcagcgctgctgcccagagcctgagaggattatg

SEQ ID NO: 6847482 - DNA, 62 bp, Homo sapiens
gaggggtgagtggataaacaaaaatgtggtctatccacacagtggagtattactcagccttc

SEQ ID NO: 6847483 - DNA, 129 bp, Homo sapiens
taaaaggcatttcaacatggtgaagccagtagctgagaggccaattgaacttttaaaacagtgaacagcatgcatctgggccttatcttccaagttcttgttttattacgttgctataccttcaaagtg

SEQ ID NO: 6847484 - DNA, 65 bp, Homo sapiens
actgttggcttggctctaggtgccatgtctatctttagtacctagcacagtgccaggcacacagt

SEQ ID NO: 6847485 - DNA, 59 bp, Homo sapiens
tttccaagttgagcgattttcctttcaacgttttagtagagggtcttcagctttggaaa

SEQ ID NO: 6847486 - DNA, 66 bp, Homo sapiens
agactgcattaagaatttctgaggatgtggcatttgagttgcaatctgatggttcatagtgggtct

SEQ ID NO: 6847487 - DNA, 73 bp, Homo sapiens
gccacccagcacacatgtgagcagagaggcgctgtgaaggagtgtgtgtgtgtgtgcgtgtgtgtgtgtgtgc

SEQ ID NO: 6847488 - DNA, 72 bp, Homo sapiens
gcaagcaggcaagcgtgagttctctaaacaaagagcggctttaagcagggaattttaggcttccaagctggc

SEQ ID NO: 6847489 - DNA, 89 bp, Homo sapiens
cccagtttattccagggctgacctaagctccacttctacccaccactccctaaagaggtgatagagtaggcagcaaggagggggctggg

SEQ ID NO: 6847490 - DNA, 83 bp, Homo sapiens
gggactcagcaagagtgcagcttgccaggtcctcccactgcagccagggcctgggaacttgcatttagtgatgcgtgtgtccc

SEQ ID NO: 6847491 - DNA, 93 bp, Homo sapiens
gccaaatgctgtacacctgcgggaaggttcgttattatctgatgaatgaatcaatgaaatgtagcttatccatacaatgaaatggcattcggc

SEQ ID NO: 6847492 - DNA, 61 bp, Homo sapiens
ttgaggacaggagactcactgtttgcctatttgagccaatcaccatctctcttgtccccaa

SEQ ID NO: 6847493 - DNA, 71 bp, Homo sapiens
gtcatattggatagttttagtagatacttggagactttctcaataaagtactacagagctaaatgaatgac

SEQ ID NO: 6847494 - DNA, 60 bp, Homo sapiens
agcaattcattcttctctgcacagaagtcccccactctgacccagagcagtatgaatgtt

SEQ ID NO: 6847495 - DNA, 77 bp, Homo sapiens
gacattcagctctaggccactgcagcccctccctgcccccagcatggacacagctaatggcttaggactgaattgtt

SEQ ID NO: 6847496 - DNA, 61 bp, Homo sapiens
tgggcagacaggccccgtctgggggtggtgaggtcaagcccctaaggacacctgctgtcca

SEQ ID NO: 6847497 - DNA, 79 bp, Homo sapiens
ctgaggtccctgagagagcagtttcagaggagtaacgaggacccttgctttgggtttgactctcatgtggggaaaaaag

SEQ ID NO: 6847498 - DNA, 62 bp, Homo sapiens
caagctatgtagtctccctgcgtccccttcctgtccttaagatgcagagatgtggtagcttg

SEQ ID NO: 6847499 - DNA, 97 bp, Homo sapiens
gttctacttttctacataagctctgggagtagttccacctggattccaatgggcctctttccctgggggaaacttagaaaaggaaagttaatgggac

SEQ ID NO: 6847500 - DNA, 68 bp, Homo sapiens
tacttcctgtttttgatttcagaagtgcaaccatgcagtgcttctatgaaaaactgaatagttgagta

SEQ ID NO: 6847501 - DNA, 63 bp, Homo sapiens
ccagacaattgatgcaattatataagaaggaacctcccatttttcttgggcatggatgtctgg

SEQ ID NO: 6847502 - DNA, 71 bp, Homo sapiens
tcctccccgcgctgccagactcactcggagccaccaacgacctgggaggtgatggcaagcagcgggttgga

SEQ ID NO: 6847503 - DNA, 84 bp, Homo sapiens
aggtcagctggatccacagtgggctttgtatgatcaaaaaataagcttttaattatgttaagccactgagatttggttgtgctt

SEQ ID NO: 6847504 - DNA, 76 bp, Homo sapiens
gtgccacaatttctgggcagtggctcaggtatgaaagttctcatgtcaaatgcatctgtccagtaattcctggcac

SEQ ID NO: 6847505 - DNA, 68 bp, Homo sapiens
gcacttaactacaagggcggtctctgtttcttcaccagagagagaagattttcctgtgtaatttgtgc

SEQ ID NO: 6847506 - DNA, 95 bp, Homo sapiens
gttattttcttagagagggtacaaaaaattatcatagttcctgatgacttctgtctcacagctctgtcaattttatatttgtttttcaagatagc

SEQ ID NO: 6847507 - DNA, 77 bp, Homo sapiens
gaatgttgtcacatggaattgactagagtcagaatcagtagattcaacactagtatttctataagtgaattacattc

SEQ ID NO: 6847508 - DNA, 73 bp, Homo sapiens
attttcagaacttcttcccaaatgctaccaggaatctcttttttggtcctaggctggggaaggctctgaaggt

SEQ ID NO: 6847509 - DNA, 108 bp, Homo sapiens
cctctggtcactgcaacgctagcccaacttgacagaagctggacacagggtcgctgcacagtgtgcaaacctgtcagttgctgtcagggataggtagtgcacttcagg

SEQ ID NO: 6847510 - DNA, 64 bp, Homo sapiens
ggcagtttgctggactaatgaaggtcaccaggccacgtgtccctcatcattcagcagactagcc

SEQ ID NO: 6847511 - DNA, 68 bp, Homo sapiens
gccagtgtgtcatccggctgcagattaccaacaaatgtgccagccagtcaggcatgaccgcatatggc

SEQ ID NO: 6847512 - DNA, 81 bp, Homo sapiens
gtttatatgcaaatactatgacattttgtatcagggacttgagtctgtggattttagtgttcatgggagtgagatgtgggc

SEQ ID NO: 6847513 - DNA, 67 bp, Homo sapiens
ggagacgcagtgcatgtggcactctccaggtggccaccctcagccactcacatgcatattcgtttct

SEQ ID NO: 6847514 - DNA, 61 bp, Homo sapiens
agtctagggattgaagcatgattgattacaactagccatcttcatcttatttcccttgact

SEQ ID NO: 6847515 - DNA, 106 bp, Homo sapiens
attcaagtgattttgtttgcaaagtttttaagcaagaccctttttttaaagaaaggttctgtttttaagaaagaccctttgttttgaatgcaactcttactcgaat

SEQ ID NO: 6847516 - DNA, 56 bp, Homo sapiens
ggtgcagctcaggtgtgccatcactcttctagttgagggcacccccgctgcctacc

SEQ ID NO: 6847517 - DNA, 60 bp, Homo sapiens
gccactcatgggaggtgtgcaattcttaaatcgatgtgtactacctgaacattagtaggc

SEQ ID NO: 6847518 - DNA, 59 bp, Homo sapiens
ccagaagtgccttctctcctctagcagaagaggagctgtgaatgggaggggttttctgg

SEQ ID NO: 6847519 - DNA, 58 bp, Homo sapiens
aggcatcttttcctagaatctgtcaattctcaaggacagctttaggaaatatgtgcct

SEQ ID NO: 6847520 - DNA, 80 bp, Homo sapiens
gaaaaatgttcaacagatggatatttctaaagcctaccaccctttgcttttttgaagctacacatctgttgggtatgatc

SEQ ID NO: 6847521 - DNA, 93 bp, Homo sapiens
gggctctggttgggggcagctgtggctgccactgctccctctgtcctggggaagctcagccccagcgtgttccatttcccccattccggatcc

SEQ ID NO: 6847522 - DNA, 90 bp, Homo sapiens
tgtctacagtgctgagtatcttgatgaatttgaaatgttcagttaattaaaacatttcaaaacagctagatattggatgtcactgagata

SEQ ID NO: 6847523 - DNA, 84 bp, Homo sapiens
tcactatgattgtggtatgtggtgatggaatagggaatatgtgtttgcagtgggtttgttcactatgactgtggtatgtggtga

SEQ ID NO: 6847524 - DNA, 58 bp, Homo sapiens
ctctcctcttgggaatacctttctagacgttcttttggattgtgagtaagaggatgag

SEQ ID NO: 6847525 - DNA, 95 bp, Homo sapiens
cttcacttttagcgtgatggctctgtatttaattacactgtatattttcttctttagtgctgtgatacagaaagacagagacacagagggtgaag

SEQ ID NO: 6847526 - DNA, 87 bp, Homo sapiens
gagctaaattgccttttcatgttttattcagtaattatagatactataatttcactgatatgaagtcattctacaggcagttggctc

SEQ ID NO: 6847527 - DNA, 73 bp, Homo sapiens
tctaggcaggtggtcactcatccccagctcagaagtgggttgtgggtaaacaattagtagatcagcctgaaga

SEQ ID NO: 6847528 - DNA, 60 bp, Homo sapiens
gctcttctaaagaatgtacaggtcttcgatgttctatggcctgggtacatcctgaggggc

SEQ ID NO: 6847529 - DNA, 68 bp, Homo sapiens
cagagttcacactcagtgcacccggtatatacaggaagcactcagggtgtgagcacatcatgcatctg

SEQ ID NO: 6847530 - DNA, 73 bp, Homo sapiens
atctacaaaagatagtgtacatttatcagatatcaacaaggtattttctgtaaaaaggcactaaactgtaggt

SEQ ID NO: 6847531 - DNA, 105 bp, Homo sapiens
cagcagtttgggaagccgaggcgggtagatcacctgaggtcaggagttcgagaccagactggccaacatggtgaaaccccgtctctactatacacaaattagctg

SEQ ID NO: 6847532 - DNA, 70 bp, Homo sapiens
taaatctcctgtttttcatctacacagaagatgttgtgtttagccaccagatggcgaaagaggatattta

SEQ ID NO: 6847533 - DNA, 71 bp, Homo sapiens
tgcagctttagattttcttttagcccaagctgggggctcatgtttggtgttgaacaaaactaaatgttgta

SEQ ID NO: 6847534 - DNA, 84 bp, Homo sapiens
gggaagaggaaggaatgcagtgtatgcccctttccttttataggaacaccctagaaattgcacacactgttttcctcacatccc

SEQ ID NO: 6847535 - DNA, 73 bp, Homo sapiens
gtcacttgtacatagagaagaagccttccattactcctatactaggttaggttcctctcctgtgcactgtcac

SEQ ID NO: 6847536 - DNA, 93 bp, Homo sapiens
accagtaattgacagagctgcaacttgaacataaatctggataataataaagtctgtgtttattctaacttgctgctctagtggaatacttgt

SEQ ID NO: 6847537 - DNA, 83 bp, Homo sapiens
gtctccaaggccttgagtcaaataccctttatgaatactttatagaaagtagatttcactcagaagtaacatgctttggagat

SEQ ID NO: 6847538 - DNA, 92 bp, Homo sapiens
ggaatcaactatagcagtggtccccaacctttctggcacaagggacttttttcagagggagtgggggcatgcttttaggatgaaactgttcc

SEQ ID NO: 6847539 - DNA, 56 bp, Homo sapiens
agacctggtttatcaccagcatttataaaaacagacgtagggaaagaactaggtct

SEQ ID NO: 6847540 - DNA, 68 bp, Homo sapiens
tttgagaccagcctgggcaacacagcaagacccccatctaccaagtggaacccaggttggcctacaga

SEQ ID NO: 6847541 - DNA, 62 bp, Homo sapiens
gtgagaggtacggaaagagcgtgggaagcatcagagattccacattaattcctaacttttgc

SEQ ID NO: 6847542 - DNA, 63 bp, Homo sapiens
taactattgttctggtgactttagtctacaaattgaggccaaagtttgaagcaacagtagttg

SEQ ID NO: 6847543 - DNA, 69 bp, Homo sapiens
ggccacctccgtgaaggaatgacattgctgaagactgagtttgcacttcacctctaccagagtgtggcc

SEQ ID NO: 6847544 - DNA, 64 bp, Homo sapiens
catcagaatagctctgtggatacaagagcaaagggaaatgttatccaccacagctgttgtgctg

SEQ ID NO: 6847545 - DNA, 77 bp, Homo sapiens
ggcagattgggctggtgcctccatctcagttagattgctttcttgcctcatgcagatttggaggtatttctgctgcc

SEQ ID NO: 6847546 - DNA, 88 bp, Homo sapiens
tggcagaattgtactagttattctttgtatggtacatctaaaactcagggtgttagtattaaggagtaaatgtcaacatctctagcca

SEQ ID NO: 6847547 - DNA, 66 bp, Homo sapiens
catcgctcagcaagagaggcagcctgtgatcctggtttcatggcattgtcctgcttctgagtgttg

SEQ ID NO: 6847548 - DNA, 58 bp, Homo sapiens
atgagagctctatgatctgtttgtgactcacttctcacagacagatgtagctctacat

SEQ ID NO: 6847549 - DNA, 63 bp, Homo sapiens
ctcaaatatgtggtcagaaagccaggtgcgtgcccaggcatttgtaataaccgcgtaagtggg

SEQ ID NO: 6847550 - DNA, 64 bp, Homo sapiens
tggcctcagcctcatcactctgacccttccaggtctccagtggcacaaatgggtgctcaggcca

SEQ ID NO: 6847551 - DNA, 70 bp, Homo sapiens
gtagaagctcctgggacaagccgtggaagtcccctcaggaggcttccgcgatgtcctaggtggctgctcc

SEQ ID NO: 6847552 - DNA, 120 bp, Homo sapiens
tcgactgtcatggatttggagctttccttgccagtggctgagttacgaacagagcaaacatagagcccgctatgctttgtagtaatatggcggataaagagcttttgtcctggtagctga

SEQ ID NO: 6847553 - DNA, 109 bp, Homo sapiens
gcccattgggaatggcttatccatctcacacagcattaactgggacagctcagtgatgtggctggcaagtcagtgctgatgatggatctgatggaagctcaaccagggc

SEQ ID NO: 6847554 - DNA, 83 bp, Homo sapiens
ctcaggcacagggcagaggccagcctgccagaagcttccccatccctagcatctctgggctccttcagcccttttagccggag

SEQ ID NO: 6847555 - DNA, 71 bp, Homo sapiens
cgtcttcctggctcagtgttgaaggggtgctccaacatgcacccagagcccttagcacagacttggagatg

SEQ ID NO: 6847556 - DNA, 59 bp, Homo sapiens
acagacttatcaagcctaggagccccaggtttggctgaggtggggcttgctgagtgtgt

SEQ ID NO: 6847557 - DNA, 70 bp, Homo sapiens
ggcagtgtggacagctcttcccatatgaattgcacctgggtcatggggactgggaagctgtgcatgcgcc

SEQ ID NO: 6847558 - DNA, 77 bp, Homo sapiens
gtggtcaagcttgtttctcctggggtgctcttctgaggatatctgggctgcctctggagtcgcagcgtcttggccac

SEQ ID NO: 6847559 - DNA, 68 bp, Homo sapiens
taggtgtttaatgatttcagcaagtaaacatttatgactgttgatttgccttgtgaattggatattta

SEQ ID NO: 6847560 - DNA, 100 bp, Homo sapiens
cctctattgttgggcctctgagacctggggactgctgtttctgttttctctgactcatacagtctgtcccccaggtgctacagctgaacataaaaccagg

SEQ ID NO: 6847561 - DNA, 87 bp, Homo sapiens
acaaatgctatatgtgaatgaggcagcaagaggccatggacacgcatattgcctggatctcctctattcatatatgtgccccattgt

SEQ ID NO: 6847562 - DNA, 74 bp, Homo sapiens
tcaggaatgcaggcagactttgagaatgatgtatctttgcttactcttcttgacaggtttcctattattcatgg

SEQ ID NO: 6847563 - DNA, 59 bp, Homo sapiens
acagttggttttgaggctgtactggatactcagcagctccctcctcagccacccactgt

SEQ ID NO: 6847564 - DNA, 89 bp, Homo sapiens
gagaaatggtttgagcaaaataaattctgacaaacccaaaagatcactggtatttgtcttaaatcttgttactgtgcaaatcttttttc

SEQ ID NO: 6847565 - DNA, 73 bp, Homo sapiens
tagtcaggatttccaggtaacctgttgagtggtgtgctagagacagctcatacaagcttggaagaactgattg

SEQ ID NO: 6847566 - DNA, 57 bp, Homo sapiens
gactatctcttcaatttgaatgaatggcaaaggatcctcaggcatttgaggagagtc

SEQ ID NO: 6847567 - DNA, 57 bp, Homo sapiens
ttcacagaacacaaatgccactttcttcactccttgggcaagaggctgttctgtggg

SEQ ID NO: 6847568 - DNA, 84 bp, Homo sapiens
tagactagagtggctctttgagactgaattaaaatgtttgaactttgttacatgcagtgaggatcttagaaatcaccttgtcta

SEQ ID NO: 6847569 - DNA, 60 bp, Homo sapiens
gtgtgtgtgtgtgcgcgcacgcatatgagtgtgtgtgtgtgtgtgtgcacgtatgtgtgc

SEQ ID NO: 6847570 - DNA, 130 bp, Homo sapiens
attataatgaaatcatgttatcagggagtatgtcatccaaggattttattgcatattttattattagggagaatgacaatatagctttgattttatacttacagtgcttgatatatagtgatattataat

SEQ ID NO: 6847571 - DNA, 130 bp, Homo sapiens
tctttccttcgttttataacaggctttgtcttctgttgctctgtgcaaatagcaccccttgacaagtcataaggccgtgatatgtgcacggtacatcgcagtgaaagagcagctttatgcgaggggagga

SEQ ID NO: 6847572 - DNA, 57 bp, Homo sapiens
ccagagccggattgtgaagtgcctgtatgcaaggtaggcatttggattctgctctgg

SEQ ID NO: 6847573 - DNA, 79 bp, Homo sapiens
gaagctcagagaagggtgtgatttgcctgagaccacacagccggtaacaggcaaggtcacaccttgaacccgtgtcttc

SEQ ID NO: 6847574 - DNA, 93 bp, Homo sapiens
gtggagtggggagacaaggagaaccaaagaaatgccttgcaagcaagtttttggtctgtctcctgtccaaccacccctaatccccacctccat

SEQ ID NO: 6847575 - DNA, 126 bp, Homo sapiens
gatggcagctctgagagagggcttgccttatattacaaagtctgagaaatgaaacctacatcgttagcctcgagatctttgtccctgatgatattctgcagatgccctctcaagggtaagtccatt

SEQ ID NO: 6847576 - DNA, 71 bp, Homo sapiens
ggccctgagcagctgagccccagctgtgatcatccagcatgatgcagcgtgaggacagctgagcagggacc

SEQ ID NO: 6847577 - DNA, 62 bp, Homo sapiens
tatgtgcattattaccagtggacacatccatcatcatgaagccatgggtattaatgcatatg

SEQ ID NO: 6847578 - DNA, 105 bp, Homo sapiens
cccccaaaaattcatatgttgaagccttaactcccgatatgattgtatttggagatggagtctttagaaggtagttgaggttagatgaggtcatgagggtggggg

SEQ ID NO: 6847579 - DNA, 86 bp, Homo sapiens
tgctgatagattagtcaggaaaaagagttgctgccttcatctccccttgtgggctttggcctctttctcccaattgtcctttggca

SEQ ID NO: 6847580 - DNA, 78 bp, Homo sapiens
agattttcatatgcttgactctttcacatcgccttcctcagagaaatgtgatgagaactgtgcataatgtgaagatct

SEQ ID NO: 6847581 - DNA, 59 bp, Homo sapiens
agccctaactcccagtatcttggaatgtgacattattcagaaattgggttgttacagtt

SEQ ID NO: 6847582 - DNA, 89 bp, Homo sapiens
agatttttattggtttaatttatttggaaattttcatccagacatgtaatttatgtctattaattccacataaaataactttaaaatct

SEQ ID NO: 6847583 - DNA, 76 bp, Homo sapiens
agtctgaataggatctgggagtctgtattttctgaagttgcatagaatgcattctcttagcatctagtacagagct

SEQ ID NO: 6847584 - DNA, 56 bp, Homo sapiens
ttgatgggatagcaagttactccttggagccagcctaatgcttttcccaaagtcag

SEQ ID NO: 6847585 - DNA, 67 bp, Homo sapiens
cagtctctctccttgcaggcgtgcaggcgacagtcagccccagcatgttctgtggcagagtcagctg

SEQ ID NO: 6847586 - DNA, 65 bp, Homo sapiens
tttcttccttaccttactagagtagaaaagaggagcgcatacaaaaggtggggaaaaggaagaag

SEQ ID NO: 6847587 - DNA, 90 bp, Homo sapiens
ccaagaaagggcatcctgggtgaatttgaaggaaaggatagtctgagcctttatttttcaccttgaagataggtttgtcttcttacttgg

SEQ ID NO: 6847588 - DNA, 56 bp, Homo sapiens
ttgagtatctattctatatccagataaatattttggatatttcagagatacttcag

SEQ ID NO: 6847589 - DNA, 69 bp, Homo sapiens
ctgtcattctgagatatgggctgaaggaacatcctctccctgaggctttgctagtgtttcagtagacag

SEQ ID NO: 6847590 - DNA, 63 bp, Homo sapiens
ggcccagggttgctttagattctgaagcaacttcagggtttaaaggcatccctgaaatgggtc

SEQ ID NO: 6847591 - DNA, 100 bp, Homo sapiens
gggactgaaatacagcaggagagaagcagaactgggaagtagtgggtctgatatgccccagtgctaaggtagcctctgctgctctgctggcttcagtctc

SEQ ID NO: 6847592 - DNA, 57 bp, Homo sapiens
aaacggagcaaggtgtgcctggaacttttcttgagtggggcatctttgctcctgttt

SEQ ID NO: 6847593 - DNA, 58 bp, Homo sapiens
ccagctccattgcttagtgtaagcagcttcactgcttagtgtaaggccatgcagctgg

SEQ ID NO: 6847594 - DNA, 113 bp, Homo sapiens
gtgattagagtcttaaatattttgtcctgtctggatcagtgggtgcttggttccttaacaaatcagctgcctcagtgattgggaaggcaggatggtaagagcttttagatcac

SEQ ID NO: 6847595 - DNA, 80 bp, Homo sapiens
gtttgcgtgtaatctaattacagaggtttgccagttcctactcaggagctcccctggtgactttctgtggtactgcagac

SEQ ID NO: 6847596 - DNA, 68 bp, Homo sapiens
catggccacatttagtaactggtttgcaaacattctgaaaaagtagcaattggctcttgtgggccatg

SEQ ID NO: 6847597 - DNA, 88 bp, Homo sapiens
actgaatactcatctgaacagtcatatattttgtttgtgcatgagactgtgtgtgacagtgtgtgtgagtgtgtgtgtgggtgtgtgt

SEQ ID NO: 6847598 - DNA, 66 bp, Homo sapiens
actggggccttggtactgtaaaccgagcagtcagggttccaatgcagtccaaggctgctttccagt

SEQ ID NO: 6847599 - DNA, 81 bp, Homo sapiens
aaattatgctgggcttcacagagcctttaatatgttagtctacattgtaaagcttcgggaggagagataatagcataattt

SEQ ID NO: 6847600 - DNA, 65 bp, Homo sapiens
tctcaaaaacagtgaccccagttacatatgaatcccaaattcagatgctggagtcacttttgaga

SEQ ID NO: 6847601 - DNA, 56 bp, Homo sapiens
acacaaactgctagaaaattggaaattcccttcggtgttcatgtgcgtgtttgtgt

SEQ ID NO: 6847602 - DNA, 56 bp, Homo sapiens
gtttcacatgaaacttggggaaccgatttcattcccccagtatcaccctgtggcgc

SEQ ID NO: 6847603 - DNA, 64 bp, Homo sapiens
cagccccgtgtcccacaagcagcccactatcctggctgcccctctgtgaggagcatggccgctg

SEQ ID NO: 6847604 - DNA, 116 bp, Homo sapiens
tcagtccaatttgatttggatttctgtcacttgcaatcaagagttgtcactactacacagtctcatttgatggcaggaggatataattcatgtattattttaaagggggaaactga

SEQ ID NO: 6847605 - DNA, 56 bp, Homo sapiens
ggcctggccctcccgggttcaagccgtccaggcaggggcccctcagggccaggacc

SEQ ID NO: 6847606 - DNA, 99 bp, Homo sapiens
ggaatatgtataaggttctttctctcccatgaagcttctattcagagggaggaagactaaaaaggagacaaataagctaatacatcaaaaaataattcc

SEQ ID NO: 6847607 - DNA, 87 bp, Homo sapiens
cagagcaccttatggaatagtagcagagggcactgccactaacagaagggccctttattagagctgccattccattctcagtgactg

SEQ ID NO: 6847608 - DNA, 58 bp, Homo sapiens
tcagagaaataattgctgagttccttctatgtttaaggaactgggctagtttctgtga

SEQ ID NO: 6847609 - DNA, 83 bp, Homo sapiens
gattttttctggtcacgtgccatatttcctgatccattgtgtttggcaccaggaaacaacttggcatgagccagtaagaaatc

SEQ ID NO: 6847610 - DNA, 79 bp, Homo sapiens
ggccttgcttgggttatatgccatccttggatcaattacaaaagacagaatatggcattctaggccaaaatcaggagcc

SEQ ID NO: 6847611 - DNA, 120 bp, Homo sapiens
cagaagagcacaggaaggctaccttttcagaaaagtattttgagcactttatgatattagcttccttgtagggtaaggtgccaaggtaatttcagtctcccctgtgatataaagcttctg

SEQ ID NO: 6847612 - DNA, 72 bp, Homo sapiens
tttgtgctcttagtcatttttattctatctctacactgattgaggttgttacatgaatactgagagcacaaa

SEQ ID NO: 6847613 - DNA, 76 bp, Homo sapiens
actgagttagactttggtgatccagaactcttttcctttctgagatgcctgggccatggaagtctctgcccccagt

SEQ ID NO: 6847614 - DNA, 82 bp, Homo sapiens
gcccctggaaaagtctgccagtgagcggggaattagccaggctcctgcttcctccgagtgaacactgtagcaatcctggggt

SEQ ID NO: 6847615 - DNA, 80 bp, Homo sapiens
cacagtcttcaattatccctgcaactgagcatatgattatgaaatatggcccagaggtgaaggaggtgggaggtactgtg

SEQ ID NO: 6847616 - DNA, 82 bp, Homo sapiens
ggtcatgcagctagttagtggtagaatcaggatgaggacccaagtcttctgacccctggtctacagctgtctctgctagatc

SEQ ID NO: 6847617 - DNA, 63 bp, Homo sapiens
gggtgagtccaggctcagaaacccgtcgtccatgggggcaccacggcttgcctggcctcggcc

SEQ ID NO: 6847618 - DNA, 83 bp, Homo sapiens
tcacagaactacagtgggcagaggcaatatttaaaccaatttctttccagaaactcattgtctttccactgagaagttcatga

SEQ ID NO: 6847619 - DNA, 77 bp, Homo sapiens
catagtgggtcattaggttggaaatgtagagccatgctagaattagctgtggctctccagagcctatggtaactatg

SEQ ID NO: 6847620 - DNA, 81 bp, Homo sapiens
gaatgatcacctgatggaatctctatgccaattgaaatataaagtcacatggtagcacattgcattaggagatactcgttc

SEQ ID NO: 6847621 - DNA, 56 bp, Homo sapiens
ctctgtttctgctgctagctcagtgtagcgtgcacttcagctattcagaaggggag

SEQ ID NO: 6847622 - DNA, 82 bp, Homo sapiens
cagccaagttagaaaatagagcagctcggggctgtgtcgatgtgacaactgaagtctcttttgttctctcaggcagggtctg

SEQ ID NO: 6847623 - DNA, 63 bp, Homo sapiens
gccaggcaggtgaggagggctcagggaatgccaagctggtcactcctccacctgctttacggc

SEQ ID NO: 6847624 - DNA, 94 bp, Homo sapiens
tatagctggtctctggtataagctttcagtaaattataatttggccacatgccaaattgtggcgtctgtaagagtttactgtgaggcctctata

SEQ ID NO: 6847625 - DNA, 58 bp, Homo sapiens
agatcacagagccaagattccacttgaggcagcatggctatggctggctctgtcatct

SEQ ID NO: 6847626 - DNA, 77 bp, Homo sapiens
ggaaaggcaaaagaggtgtcatcacagaagtcctatggggatgggtgatgaggaatcttattaagttttgctttttc

SEQ ID NO: 6847627 - DNA, 77 bp, Homo sapiens
gccaattaactattatttactataactcttggttgttgtcagagacatcaactatatagaaattgattgtaagaggt

SEQ ID NO: 6847628 - DNA, 64 bp, Homo sapiens
agtggatctggggtcagagtgggttggaggagactcctgaccctccttagagtccagtttccct

SEQ ID NO: 6847629 - DNA, 65 bp, Homo sapiens
gtgttggatcctgttatgaatgctttattatctcaaattttgcagcattcctaggaggtaagcat

SEQ ID NO: 6847630 - DNA, 112 bp, Homo sapiens
cccaccccgcaccccagccagctcccagccctcaggctttgctgggccccctgcagggatggctcagcaccagacctagggcgtgggcctggtgaccaggtctgggggtggg

SEQ ID NO: 6847631 - DNA, 63 bp, Homo sapiens
ctcatctgtgaaagggttagataagattcagtgagataatgtgtgactctggcacatggtgag

SEQ ID NO: 6847632 - DNA, 65 bp, Homo sapiens
ttcttctccgaggagggctggtgcaggttgaggttgaggttggaccagtaggagttggagaggaa

SEQ ID NO: 6847633 - DNA, 65 bp, Homo sapiens
ggccttgatggatatggtggatgaaaatggcccccagcagggggctttcactaggtcacaaggtc

SEQ ID NO: 6847634 - DNA, 63 bp, Homo sapiens
actctccaagaggctcactgggcaaagactcaggttagttctcctggccttgagctggagggt

SEQ ID NO: 6847635 - DNA, 62 bp, Homo sapiens
ctactcctgccacacagatgctgtcttgtccccaagatggtccctacatgtggcatgattag

SEQ ID NO: 6847636 - DNA, 77 bp, Homo sapiens
actgctccggggccacagatctcttgctctctgtcattcctttctgggacaggagaccctgctggttctggaggagt

SEQ ID NO: 6847637 - DNA, 77 bp, Homo sapiens
gggttgggccctgctgtcccaggaacctgtgatagtgaaactacacactaaagcaactgagacacatagttcagccc

SEQ ID NO: 6847638 - DNA, 72 bp, Homo sapiens
gattcaacttggttctcatgttttactgtaatgtcaaattagcttggaataaaatgagaataattctgagtc

SEQ ID NO: 6847639 - DNA, 116 bp, Homo sapiens
tctgccttaattttcagtcacttctttggcttactgaggagcatatctgagtcagttttgtgtaagcattcatgatagtttctgagtaatttgaaatgaatcagagttaactaaga

SEQ ID NO: 6847640 - DNA, 129 bp, Homo sapiens
ttattttttatacatgtgtatttcttgcatttagtgaacaaagaatatctgttttatttaggttggtgccttaattagaatgatgttcctctaactggaaagtaaaagtacaatttaaacagaaaataa

SEQ ID NO: 6847641 - DNA, 65 bp, Homo sapiens
cctgataatttcaaaaatcttcagaaatcccacttggggctgctgaaggtgaaatttcacccagg

SEQ ID NO: 6847642 - DNA, 67 bp, Homo sapiens
gttaagtggttttctcattgaacaaatgttaagcactgacataaaccagtgagcaaaactgcttggc

SEQ ID NO: 6847643 - DNA, 83 bp, Homo sapiens
tcctaccagactgtgccagccctgggagacttatggaaagacactttgatcacaggagcccaggggagctgtagcaagtggga

SEQ ID NO: 6847644 - DNA, 61 bp, Homo sapiens
aggagattctctagcattttcctccattgttccggtccagcatggaagaagctggactcct

SEQ ID NO: 6847645 - DNA, 63 bp, Homo sapiens
agaattgttggggtaataaaagaggtgaatagattttcattcattttaattctcaggagtttt

SEQ ID NO: 6847646 - DNA, 79 bp, Homo sapiens
tctcacctccagatggtgcaggtgaagtgctggtggtcttcgctggtccccagactcatctgccattgctggggagaga

SEQ ID NO: 6847647 - DNA, 55 bp, Homo sapiens
gggaataggacaaatgaaggagagtaaaacttcatcctttattgctttttttccc

SEQ ID NO: 6847648 - DNA, 75 bp, Homo sapiens
ggtctctgctcatattttttatctttcctgcatctattcaacaggtgacaaagacaaagatatgtccaaatgacc

SEQ ID NO: 6847649 - DNA, 83 bp, Homo sapiens
tttttccaggacaatatttattgtatatgatattcacttcttcaaaattattgacaatctactatgttctggttctgggaaaa

SEQ ID NO: 6847650 - DNA, 101 bp, Homo sapiens
gaatttagtattccagtccaaatgttttcctgagctctaggcaaaataaataaaaagaaaccaacacttagaaacatcttggcaactggaagaaaaaattc

SEQ ID NO: 6847651 - DNA, 70 bp, Homo sapiens
gcctctgaaatatttgggcagatgtttcctgtggaaaatattccatagcgctgccctctgttatatgggt

SEQ ID NO: 6847652 - DNA, 130 bp, Homo sapiens
ctaagactcagtttcttcatctgtatagtggaggtgatgttagtgccagccttaggtattacttgtgaacttggggcagtgcttggcacatgactgaacacccactgatttctgagactaagagtttcag

SEQ ID NO: 6847653 - DNA, 66 bp, Homo sapiens
gtagtaaattcaaggggagttaaagtggatgatttctatggcaacttccaggccttgaattattat

SEQ ID NO: 6847654 - DNA, 76 bp, Homo sapiens
caccactcttttctcttacaagctcccgatataaatagagaaatcaattgtatggcccttgaagagaaagtgtgtg

SEQ ID NO: 6847655 - DNA, 67 bp, Homo sapiens
cttatgtgttatcagatatctctgctgtttttttaaatgtagaatgagagatctgaagaaccattag

SEQ ID NO: 6847656 - DNA, 81 bp, Homo sapiens
agagcctgactgccaggcaggcaggggtatctttggggctctgggagccccagcctctggattctgccctcagtgagcttt

SEQ ID NO: 6847657 - DNA, 62 bp, Homo sapiens
aatagcaaacactggtaaagttttcaagagctcattccttgggatttaataagtttgctgtt

SEQ ID NO: 6847658 - DNA, 60 bp, Homo sapiens
tgtgaccgcatttgaaggtagggtctttaaagaggtaattaagtgcacaatgaggtcaca

SEQ ID NO: 6847659 - DNA, 57 bp, Homo sapiens
ggagaggattaatcaaggttttgatgccacacagacctggattccaatcctacctcc

SEQ ID NO: 6847660 - DNA, 58 bp, Homo sapiens
ggtctatggggccaagaaggtctcatgtgcatccccatatgggactagggcccaggcc

SEQ ID NO: 6847661 - DNA, 73 bp, Homo sapiens
tgcttcctgatcaacttgttcctcagtgacaccaaacatcaatgactcaggaacataatgtgagtcaggagca

SEQ ID NO: 6847662 - DNA, 83 bp, Homo sapiens
aggttatgacagaaaactgctgacaggatggaaatgtaccaaagatgtgtttcttctgtttgtagttacactgtcatttttct

SEQ ID NO: 6847663 - DNA, 93 bp, Homo sapiens
caatttagagagaatagagcacacagttgttaaggtcacggtgacagaaagaaagtgtttctgacctgcaacagtttacttttctccaaattg

SEQ ID NO: 6847664 - DNA, 87 bp, Homo sapiens
ctgttacaagtgatgcaccaatactgacacattgttatttactaaagtgcgtagcttacatcagagttggttccttgtgttgtacag

SEQ ID NO: 6847665 - DNA, 60 bp, Homo sapiens
cagggagcagtgtgctaactatgtgacatgtgactttagcctgcaggtacattgctactg

SEQ ID NO: 6847666 - DNA, 80 bp, Homo sapiens
aggcctctttggctaggctggaagggctcaaggtatcttgctcatccccactgtgtcttttctgtctagcacaatggcct

SEQ ID NO: 6847667 - DNA, 70 bp, Homo sapiens
gctgtgtctgcttggtcatctttcactgggccagagaaagaatccctgagggttggacaaggggagcagc

SEQ ID NO: 6847668 - DNA, 75 bp, Homo sapiens
tggttagggagctatctgtattctgacagtcactttagggtatggggtgaccagggtcagtagctttctttgcca

SEQ ID NO: 6847669 - DNA, 61 bp, Homo sapiens
cagtattttttagaacctggcctgattgcagggcaatcaaccaatgtctgagggaatgctg

SEQ ID NO: 6847670 - DNA, 61 bp, Homo sapiens
gtctggctagagacaccctccctctctggggagcaagttgggggtgtctctgtttccaggc

SEQ ID NO: 6847671 - DNA, 130 bp, Homo sapiens
cagctcaatgtggcacataggcactcactagagggagcaaggtggccttctgctgggggtgaggggtctccccaggagatgggagcatctaaaaagcagtcccagtgttgcctgctgccaagaggacagg

SEQ ID NO: 6847672 - DNA, 130 bp, Homo sapiens
attagatttttgagtatctttctgctcaggtaagttatgcttttaagtcttgcttctttccctaaatatcacagctttgcttgcaagataggttacttaaatagcagatttctgttcttttgattgtagt

SEQ ID NO: 6847673 - DNA, 55 bp, Homo sapiens
cacagcagccagaacatttttggtaaaatggaagtcaaattatgtctctgctgtg

SEQ ID NO: 6847674 - DNA, 63 bp, Homo sapiens
ctggcgcatgtgtgttcaatgtctgttaaacaggtgagtagacaaatgaacaaatatgtgaag

SEQ ID NO: 6847675 - DNA, 65 bp, Homo sapiens
tctggtcattaattcttacctttaagcttactgaaaagataaaggcctagtaagttgagactgga

SEQ ID NO: 6847676 - DNA, 75 bp, Homo sapiens
gttttggcctgaattatggcagatctttatatgtgctcagtaagatttaaatttgctacaattctaggcttgtac

SEQ ID NO: 6847677 - DNA, 72 bp, Homo sapiens
gcttaggactgtggggttcatagtgtcatgtcagacctgctggcccaagacgttacctccttcttcctgagc

SEQ ID NO: 6847678 - DNA, 73 bp, Homo sapiens
agagcctgtgccccgtccccatcccagcttggggggccccggcctccagctggggacatgggcttcaggctct

SEQ ID NO: 6847679 - DNA, 55 bp, Homo sapiens
gtggaatggggcagagatgttgtgagcaggcatgacattataattcatattccac

SEQ ID NO: 6847680 - DNA, 93 bp, Homo sapiens
tgcccttaacttgtgtgtttacaacaatgccaacagcatgctgggggacattatagactcttccagttttgccatggtaacacttgtggggca

SEQ ID NO: 6847681 - DNA, 61 bp, Homo sapiens
tgagctagaagcagtaatagaaataggagcatgtatggaactctcctttattgtttgctca

SEQ ID NO: 6847682 - DNA, 60 bp, Homo sapiens
ctattgcccaaatctcaaccgcaactccccttgaggggcgccgtgaggtttgtgcagtag

SEQ ID NO: 6847683 - DNA, 63 bp, Homo sapiens
agagctgttaattttgcactggcttgccttatgcacgtatgacattccaaagttgatggctct

SEQ ID NO: 6847684 - DNA, 88 bp, Homo sapiens
cacagtgtttaagcttcagcttcaataatggctgatggtgatacatttgagtaattctattaccagttgaatgagggaagctgctgtg

SEQ ID NO: 6847685 - DNA, 65 bp, Homo sapiens
aaggccaaaagcataatcctcacaaatgcaataatgcacattgtcagcttagtttttctggtctt

SEQ ID NO: 6847686 - DNA, 56 bp, Homo sapiens
gtgtgtgtgtgtgcgcacacacgcatgtgcatgtgtgtgtgtgcaggcacacacac

SEQ ID NO: 6847687 - DNA, 61 bp, Homo sapiens
cccacaggtccccatgaactcgttcctgcttctcagcctctgaccttcaggtgaccgtggg

SEQ ID NO: 6847688 - DNA, 74 bp, Homo sapiens
ttgaggaaaattccacttgattttaggggaaatgattcattttagagtaggttctagattatagtggtcctcaa

SEQ ID NO: 6847689 - DNA, 61 bp, Homo sapiens
tccaggtctcagaccaccctctttggcccagggtgggtcaaacctactgtctgagtctgga

SEQ ID NO: 6847690 - DNA, 91 bp, Homo sapiens
gcagaagcctattatttattgacatgtaggctacaaggaggttaaaagaaaacctccttccttgatgtcaaataagtgatacaaaaactgc

SEQ ID NO: 6847691 - DNA, 77 bp, Homo sapiens
actgagtaagcagaggcatttttatctggaaggaggtgagtcccataagataaattgcactttttcttacattgagt

SEQ ID NO: 6847692 - DNA, 63 bp, Homo sapiens
tgtgttgcagtagcagtagttgcagtggatgctgcttctgattcatggttattgccaaacaca

SEQ ID NO: 6847693 - DNA, 86 bp, Homo sapiens
gcgccaacgccgcagcgccggcgcgtccccatggaaacccgcgcgcggggcctcctgggaagcgccggcctgcgggggctgggcgc

SEQ ID NO: 6847694 - DNA, 81 bp, Homo sapiens
gagggcattcaaagcctctgtgcctcttgcgctgttgcttttgtcgggggagttgaggcacatggggagatggacaccttt

SEQ ID NO: 6847695 - DNA, 85 bp, Homo sapiens
catgaaaatgggcttttcctgtttcatagaaaactgaacaatttatttcagtcattgatggagtaggtcagtgtttatcttcatg

SEQ ID NO: 6847696 - DNA, 58 bp, Homo sapiens
gcctgtgcctcagcctgcagcctgcacctctatgtagctgtgtggccacgggccaggt

SEQ ID NO: 6847697 - DNA, 55 bp, Homo sapiens
gggcattgtgggtaagaggaaacgctggggccggcccgctcccccccacgtgtcc

SEQ ID NO: 6847698 - DNA, 123 bp, Homo sapiens
aaacattgagctacactttctagacttctttcctgttgacttttagttagattctgccactgaagcactagtattagactaaaagtcagaataaagggagaagagataatctgccttatgttt

SEQ ID NO: 6847699 - DNA, 55 bp, Homo sapiens
cactgagttgggctttgttttgcttacctagcattgggacagtctcagcctcatg

SEQ ID NO: 6847700 - DNA, 55 bp, Homo sapiens
tcataaattgggttggctgggtacttcatgtgttcattccacccatatttatcga

SEQ ID NO: 6847701 - DNA, 63 bp, Homo sapiens
aggaggtgaggctaagtgacacaggggcatggaaagctccttgtggctgtggcctcagctgct

SEQ ID NO: 6847702 - DNA, 86 bp, Homo sapiens
gggcatggggtaaactacttacagtctggattaggaaacatagaaacgaatttattaattaatgtgccagattgtgtctagtgtct

SEQ ID NO: 6847703 - DNA, 56 bp, Homo sapiens
ctatacagagcatccttaacttttctcaaggttaggctctgaagtgttctgtgtgg

SEQ ID NO: 6847704 - DNA, 130 bp, Homo sapiens
aatagtacttagctcattaattagatattcattaggcacttgctttgtgttcagctttgtactacatcctgttattggaataaagtaagtctctattatggctgatccctctcaacaagcttgtacactt

SEQ ID NO: 6847705 - DNA, 72 bp, Homo sapiens
ccaggaaagtggcactatccatggcttcccagggagaaaacaatggaagctctgtgatgggttctttcctgg

SEQ ID NO: 6847706 - DNA, 129 bp, Homo sapiens
atggagtgacgagggagaattgacctatggaaacctctggctcagtgccttcagaagtcagggtgtcagttttcaggctctgccagacactgtggccaaggccaagggtgctccgtcaaatctatccat

SEQ ID NO: 6847707 - DNA, 60 bp, Homo sapiens
gaggaggtgaatagttttgagggatatttcataaaaacccacagaattattcttgtcctc

SEQ ID NO: 6847708 - DNA, 56 bp, Homo sapiens
gcagatcttggtggccattggctggactccaggtgggcactccgctcgaggtctgc

SEQ ID NO: 6847709 - DNA, 93 bp, Homo sapiens
ttagttggcctctaaaatttagtctgaaagggtgaacattgaaggaaatagactaaagaatgtgtactttttcatgctcagatggtgtattaa

SEQ ID NO: 6847710 - DNA, 127 bp, Homo sapiens
tcctgtctcttagttcctttttcctgaactcttcctccagagttgtgggtgtttctcttccaataagaaaagaaacctatcagccacatggaattctaagggggagagtatttaatgagagacagga

SEQ ID NO: 6847711 - DNA, 69 bp, Homo sapiens
tgttagataaactgaagggaacactgaggacaaggagcttttgttctaccttctgtttcagatctagca

SEQ ID NO: 6847712 - DNA, 66 bp, Homo sapiens
ccctggcacctactccctgtcagtgtgtgggtaagtaattgcatgtggcttagttaggtgccccgg

SEQ ID NO: 6847713 - DNA, 76 bp, Homo sapiens
gttcccactcaggccccatcgcccatctgcagatggtggcccctccacaggtgggcaatgaggcctgagtgtagac

SEQ ID NO: 6847714 - DNA, 79 bp, Homo sapiens
agctctgcttccttgtacaggtctgttgtgggcatcccgacctgcgagtccgtggtgcagctgcagccggggcggagct

SEQ ID NO: 6847715 - DNA, 59 bp, Homo sapiens
gttaccagcagcctttcccgcacagcacagcgctcagcctttgaagggctgcagggcac

SEQ ID NO: 6847716 - DNA, 80 bp, Homo sapiens
tccgtgggagtgcacggccatgcactttagagataatgagagccagggctctggagtgggtggccgggagcccccttgga

SEQ ID NO: 6847717 - DNA, 74 bp, Homo sapiens
ggaagggcttgagacccgggagccagactgaagccagggttgggttcaagggggtctcactgagagccgcttcc

SEQ ID NO: 6847718 - DNA, 96 bp, Homo sapiens
attgtgatcagctctactttataagtatataagtcaatttgatggttatatggagggcggattttacttatcaaggtagaagggaaggagaacaat

SEQ ID NO: 6847719 - DNA, 73 bp, Homo sapiens
caatgtaatgtatgcagtgtagatgcatgagaatttttaagacgctcttggtgtcattactgtaattattgtg

SEQ ID NO: 6847720 - DNA, 62 bp, Homo sapiens
taaggtttataggaaatttgttcctgacccaagggtcagagaatagcttactatgaatttta

SEQ ID NO: 6847721 - DNA, 112 bp, Homo sapiens
cttgttttttgtactagcctttggaagtatgtctttgggtattattttcctccttcaactaatgtagaaatgagatcagagataactcaactaaggccacacagttgataag

SEQ ID NO: 6847722 - DNA, 117 bp, Homo sapiens
ggcacacaggatttcaatagaaattgcatgcctttttagatgtgcgaatgtttcattaagcgtatgaatatttgaagagatgtatgacactttaaaaactgtttcctctactgtgtt

SEQ ID NO: 6847723 - DNA, 58 bp, Homo sapiens
gatgttgcacagggatgcccagaagtggcgaggactgaaggggcatggatgcagcatc

SEQ ID NO: 6847724 - DNA, 68 bp, Homo sapiens
gtcacacaatagtaagtggtccaagattctaacctcagatctgctaaccactgtactatttgagtggc

SEQ ID NO: 6847725 - DNA, 57 bp, Homo sapiens
gagcagccagaatgggactctgaagtgagttgtaaacagaggcccatgagggtgctc

SEQ ID NO: 6847726 - DNA, 77 bp, Homo sapiens
tagctaccctggaaatgtgagactgagttttcctgtttgtacatggatttgtctttcattttctggggaaatagtta

SEQ ID NO: 6847727 - DNA, 76 bp, Homo sapiens
gagtcagatttggcttccagccccagctctgctgaatctgagcagccagaccctggggaaagtcacttcctttctc

SEQ ID NO: 6847728 - DNA, 95 bp, Homo sapiens
ggtgagagctggtgggtagactcttggagaagagctatatattctcatacccggaaatatagccggcccttccaagagcaccccatcactcaacc

SEQ ID NO: 6847729 - DNA, 68 bp, Homo sapiens
tgttccaactcccagaacatgctcttcttactacaccacggaagaatggggtggtgggaggcggaaca

SEQ ID NO: 6847730 - DNA, 83 bp, Homo sapiens
gcctgtcaattttgtgtacaatttttttggcaaatttaacattcaaccacttttgttagcttagtaccagagttgtcacgggc

SEQ ID NO: 6847731 - DNA, 81 bp, Homo sapiens
atttctctgttgtattctttatgacttccctccaggttgagctgtgaaagggtgaggggaaaggagccatgtcggagaagt

SEQ ID NO: 6847732 - DNA, 87 bp, Homo sapiens
ggagaatcgcttgaacctggaggcagaggttgcagtaagctgagatcatgccattgcactccagcctgggtgacagagtgagactcc

SEQ ID NO: 6847733 - DNA, 86 bp, Homo sapiens
tcccagagccaggtcctcgcctgctgtttaacctaggagaagcccagctcctggctcggatgcttggtgaaatcaggggtctgggg

SEQ ID NO: 6847734 - DNA, 66 bp, Homo sapiens
ggcaagggcatggctctgatcaatgtttgggtgggtctgatttgtttggagccagtgacctttccc

SEQ ID NO: 6847735 - DNA, 129 bp, Homo sapiens
ttccctctctgataaggtcccctcaggagtcctggctgcctagtccctcagcctcaccaagggcactttgctaaggcacgtgggtggagtggacggccaggttcctatgaagccatatcagagtttgag

SEQ ID NO: 6847736 - DNA, 73 bp, Homo sapiens
gtggaggggctgccctgggagttggagctgctggaaccagctagtaactggcttccagaggggcccttgtcac

SEQ ID NO: 6847737 - DNA, 57 bp, Homo sapiens
ggacagtattcattggagagaacttaagggtgaacacctcccttggtgagactgtct

SEQ ID NO: 6847738 - DNA, 74 bp, Homo sapiens
atgagcataacaaataccatgatcagtcccatgatcttccagaagtcttgtggaggagtgtgattgtctgccat

SEQ ID NO: 6847739 - DNA, 64 bp, Homo sapiens
ttgtctgtctgtctttttctttcctttctcctgggtcaggcaggaagttaaggcagacagacag

SEQ ID NO: 6847740 - DNA, 65 bp, Homo sapiens
gcctatagcagaagcagaggctctggaatttttgtctgaagatccttggttctgctttccctggc

SEQ ID NO: 6847741 - DNA, 79 bp, Homo sapiens
ggaaatggtcacagctgcctggagccagagttgaccatcccacgggcttcagctgccccgggcactgcccgaccactcc

SEQ ID NO: 6847742 - DNA, 77 bp, Homo sapiens
cttgggatgcttttcctgccacaggcctgtggagatggaccagggctggccagctcaggcttgggaggaggcccagg

SEQ ID NO: 6847743 - DNA, 97 bp, Homo sapiens
ggctctgctgcagtgacaattccaaatctcactgtcttcacacagctcatactgtaggtccaggagatttggcaattcgggctgcctctgcagttcc

SEQ ID NO: 6847744 - DNA, 74 bp, Homo sapiens
agaatcatgtacttcttaaattaggatcaaaagttttacttctttggacctgaagaataggaagtattcgtttt

SEQ ID NO: 6847745 - DNA, 61 bp, Homo sapiens
acattggtagtcttccatggtcttttcacatattggattggccattattttttatcagtgt

SEQ ID NO: 6847746 - DNA, 71 bp, Homo sapiens
caggaaatggggtgacagtgcagtggtcattgacctgccagtgtgtccaggccctgtgaccttgtctcttg

SEQ ID NO: 6847747 - DNA, 95 bp, Homo sapiens
tctgtctcagctcaaaattgctcctgttttcttccagaaatgccattcatccagaatgccattctgtgagagaagaagggagagtgaggggcaga

SEQ ID NO: 6847748 - DNA, 77 bp, Homo sapiens
tttcttacttgctacgtgtgtgacattgggaacgtgatttaccacccaatatgttgtcatatgtgaaaagtaggaga

SEQ ID NO: 6847749 - DNA, 87 bp, Homo sapiens
gcattgagaagagaaagtgacagttcaggtcagatttattgagcatctatttaatactacttgtaattgttcttgtcactcccctgt

SEQ ID NO: 6847750 - DNA, 82 bp, Homo sapiens
gccagtggtattctgctttaaatatgaattagcattagcacttgcagaggttttcttgtttcaaagatgaattagccctggc

SEQ ID NO: 6847751 - DNA, 57 bp, Homo sapiens
gtttccaccttctcccgaagccggttctgcagctaagctgtagacgggagaggaagc

SEQ ID NO: 6847752 - DNA, 104 bp, Homo sapiens
ccaggcatcgttgtagatgatgggcgctgtttactgggcatttaatatgtgctgagtatgtcccatacagcatccccacatttaataaacaggagtgtgtctgg

SEQ ID NO: 6847753 - DNA, 116 bp, Homo sapiens
ttgctggtgaaagaggatacaaagatacctccagagacagggcagggagtgtggtgtacttaccacatttctggaattgacttgggaagtggtgttcacttcttttatcaaagcaa

SEQ ID NO: 6847754 - DNA, 118 bp, Homo sapiens
atttctgacatccctaattccccgtggcctctcagctctgacaggaggcatctggggtaatggggggcagggacgcagagctgggagaatgcagggagttaattggagagacggagat

SEQ ID NO: 6847755 - DNA, 56 bp, Homo sapiens
gtgactgcccccaccgcacaggcagcgggagttgcccaggtggctgggttagtggc

SEQ ID NO: 6847756 - DNA, 61 bp, Homo sapiens
tgatggctgtgctgatgttagggtgaaatggtgttaatcttgtcattagcacagtgtgtca

SEQ ID NO: 6847757 - DNA, 106 bp, Homo sapiens
attctttccaggcaatgttagttttaaaaagttgctagagtattgttaagtatagatcacttaatctatgtcactctttggaaagaatgcagtgcataaaaagaat

SEQ ID NO: 6847758 - DNA, 110 bp, Homo sapiens
caatatataaattttaatgccaagacaggaaattcaatctaagaaatgatcacttgccaaattaatgatccgtttacatctgaggttagagctgaggcataattatattg

SEQ ID NO: 6847759 - DNA, 74 bp, Homo sapiens
gcctcactaggcatctgtgagggtagattggctcaattcctactggtatccctacccataggtgcttaggtggc

SEQ ID NO: 6847760 - DNA, 56 bp, Homo sapiens
gctccaggagaagcagcaggaagggggctgcccaaccctggtgtatttcctggggt

SEQ ID NO: 6847761 - DNA, 71 bp, Homo sapiens
tgcactcattttttcactgtgttgtcagccatggacaacatttgagtaaagaaatggtcatggtcagtgca

SEQ ID NO: 6847762 - DNA, 70 bp, Homo sapiens
gcctctagaactgtagagaatacatttctgtcttttgtaggatactgagatttacatgttctagtagagc

SEQ ID NO: 6847763 - DNA, 104 bp, Homo sapiens
actatcagtctctaggatgggcccagcattcctgcacctgcccctgctgcccttgaagctgtgtggactggttgaggccctgaaacttcttggggacagatagt

SEQ ID NO: 6847764 - DNA, 107 bp, Homo sapiens
ggaacagtaaaggctgacagcccagagggaagaggtgtcatcccttcatcacacaggaggatgtcggatgcacactctcccctgcctggttgatgctggctttttcc

SEQ ID NO: 6847765 - DNA, 79 bp, Homo sapiens
ggcaagtggcaaggccttattcttaggaaacactactctggctattgggtagacaatggaatgtggcctgccacaggtc

SEQ ID NO: 6847766 - DNA, 84 bp, Homo sapiens
ataggtcattgtgactccaaccttcttccaggtatgtttctagttcagagtatgggacagcatacctgggagtacctgacttgt

SEQ ID NO: 6847767 - DNA, 87 bp, Homo sapiens
caggcaattatatggtcctgtgatgagtaccaggtgggaaaaggttcaacctaggccatcatggggaaaccccatagatgatgtgtg

SEQ ID NO: 6847768 - DNA, 57 bp, Homo sapiens
gggcacagagctccagccttggctccagattctgggtcctggtagggctctgtgtct

SEQ ID NO: 6847769 - DNA, 59 bp, Homo sapiens
tttgggattgataaggaataccagaaggaaccctgagtttttctctaagtagtcccaaa

SEQ ID NO: 6847770 - DNA, 64 bp, Homo sapiens
ctttgctggtttggcgttctgatgagtaaaaatctatttgctctgacagtgccagagagcaagg

SEQ ID NO: 6847771 - DNA, 90 bp, Homo sapiens
ctttggtggtgagggtgtgaaatgagggggtgcacgtggagggaaaaaagggactcccctccctcttggcttctatcccaccaacccggg

SEQ ID NO: 6847772 - DNA, 125 bp, Homo sapiens
ggtacctgcagtgatgtatattttaaggcttagattcattttagcaaaagttagttttctgtaaattgcattctagctcgctgtaaaatgaattctaagttctcttagtgttccactgctgtact

SEQ ID NO: 6847773 - DNA, 67 bp, Homo sapiens
gcaatgagtcagggttcaattcccatggtctaagatggctaggagattgagctctgaagttccaggc

SEQ ID NO: 6847774 - DNA, 74 bp, Homo sapiens
ctagatggctggtgtacttcagtgattcctgtgcctttatgtagacatagaaagtcatgaattacaccatctag

SEQ ID NO: 6847775 - DNA, 77 bp, Homo sapiens
tcatccaataatgggcaccctagagtaactgtggaagaaatgaacacagtgcttcctgcctggtgcctttatggaga

SEQ ID NO: 6847776 - DNA, 64 bp, Homo sapiens
atgctctcctgggattttgatatgtgagtaaagtgacacaaggatggaaaaacaggtagagcat

SEQ ID NO: 6847777 - DNA, 55 bp, Homo sapiens
caggtgcccagctcctgctgtggctaagtcctagcaggggctccgggcgggcctg

SEQ ID NO: 6847778 - DNA, 76 bp, Homo sapiens
gcccagccagggacgctgcaggctaccctggggcctgctgggagatgtagttctgcagtgtcacctgagactgggc

SEQ ID NO: 6847779 - DNA, 89 bp, Homo sapiens
ttttatctcctttttgctttcccttgtagaaagttgacaaatagtccctaaagctgtcaataggttggaaataagaaggaaaagtaaag

SEQ ID NO: 6847780 - DNA, 59 bp, Homo sapiens
actgtggcaggggttttctgacttgagtctccaactctggtcctgcctcctgcaatggt

SEQ ID NO: 6847781 - DNA, 60 bp, Homo sapiens
gcagaaacttggagaagccaggcttacagccctgtcatcattcttcagcgtttcccaggc

SEQ ID NO: 6847782 - DNA, 112 bp, Homo sapiens
tagctgagcatggtggtgcatgcctgtagtcccagctacttgggaggttgaggcatgagaatcgcttgaacccaggaagcggagattgcagagagctgagatcatgccacta

SEQ ID NO: 6847783 - DNA, 61 bp, Homo sapiens
cacctcacagagttcaggactaaatgtgatcacatgtaaagtgtctagaacattgtaggtg

SEQ ID NO: 6847784 - DNA, 62 bp, Homo sapiens
ccccaacactgcacgtgcagcctcagagtacagcctgcagggtgcacagtggggtgccgggg

SEQ ID NO: 6847785 - DNA, 59 bp, Homo sapiens
ggatgctatgatgtgccatttctttgggcttttccgaggactgctcacttgaggcttcc

SEQ ID NO: 6847786 - DNA, 66 bp, Homo sapiens
gcactttagtgaccaagtactcgggggtgggagaagagcaccccgagggtagatggcattgaatgt

SEQ ID NO: 6847787 - DNA, 56 bp, Homo sapiens
actgaccttctcagctaactcagcaaaacccagcatgtcagtgtgacttggtcagt

SEQ ID NO: 6847788 - DNA, 65 bp, Homo sapiens
ccaaagtgtgttcctcaaaactggtcctgggagatgctatgtgggaatcgtggaacacattttgg

SEQ ID NO: 6847789 - DNA, 67 bp, Homo sapiens
gggtcaggctgcccgttcagggctcggcgtgtgaggcggagactctcctggggagcctgcggtgccc

SEQ ID NO: 6847790 - DNA, 74 bp, Homo sapiens
ggggcttaaagagtagagacaggaagattactccaggtggcagctggagtggtaactaagtcctgcttagtccc

SEQ ID NO: 6847791 - DNA, 87 bp, Homo sapiens
tcagcagggttgttggtttagcaacttcctgtgtctccagacaagagtatgtggagagtgtgcctagcccagccaagctttgctcga

SEQ ID NO: 6847792 - DNA, 87 bp, Homo sapiens
tattttcttagtctataaatatttaccaaaagcaatctatttactgaagcggtaccagacattttggaaagtattactttgaggatg

SEQ ID NO: 6847793 - DNA, 67 bp, Homo sapiens
taagttggtatacaatacacaatgctctggaagactctgatggaacacagtgattgatagcgactta

SEQ ID NO: 6847794 - DNA, 59 bp, Homo sapiens
gaactctgagaggagcacaggctctactgcagtgcctggacggcttcctcatgcagttc

SEQ ID NO: 6847795 - DNA, 124 bp, Homo sapiens
tttgctgcgtgactttaaataactgatgctacctctctgagcttaaggtgtttcaccttagaaatgagaattgtgatatccagttcagaggatatggtgagggttaataagttaacatggtaaa

SEQ ID NO: 6847796 - DNA, 56 bp, Homo sapiens
aggaagagaaaggcaaggagttttgtgaatgccaaaataatggcctttctctgctt

SEQ ID NO: 6847797 - DNA, 55 bp, Homo sapiens
tttaaccagtttacaaagaattggtcttccacaatccaaatgggagctggttaag

SEQ ID NO: 6847798 - DNA, 55 bp, Homo sapiens
tgtcaagagtgcacacatctgctttccttctgagttgtgctttctgcccttgaca

SEQ ID NO: 6847799 - DNA, 79 bp, Homo sapiens
tctccagtgaatgtgttgttgaatttaacaggaagttagtgtcagctatgcctgtgtatcagggactaggtactgggga

SEQ ID NO: 6847800 - DNA, 63 bp, Homo sapiens
gctaaatagtttttggaacctcttggaaatcaaacaaagtaggtttcaccagactatcttggc

SEQ ID NO: 6847801 - DNA, 78 bp, Homo sapiens
gccagctgctggaacagcgcgagcaactgcaccgcgagcacgaggacacgcgggacctggcgcgtgtgcacggctggc

SEQ ID NO: 6847802 - DNA, 62 bp, Homo sapiens
gggggtacaagtatagatttcttacatgcatatattgaggtctgggctcttagtgtaccctc

SEQ ID NO: 6847803 - DNA, 62 bp, Homo sapiens
gtctctatgcaggacattctcctggagcacacagtctgttggggtgagaccctgcatagggc

SEQ ID NO: 6847804 - DNA, 55 bp, Homo sapiens
atttctcatctttgtgaatggtcccatcatccacctacttatttaggtgagaaat

SEQ ID NO: 6847805 - DNA, 112 bp, Homo sapiens
gtgctgcctgtggcttccgtggggcctgtggcttccgtggggcctgtggcttccgtgctgcctgtggcttccgtggggcctgtggcttccgtggggcctgtggcttctgtgc

SEQ ID NO: 6847806 - DNA, 56 bp, Homo sapiens
cttccccaggacctctgctaaatagctcagagctaaggcagagggcctgggagaag

SEQ ID NO: 6847807 - DNA, 76 bp, Homo sapiens
ggattcttgaggaaagagtgcaaagaggaacgtccccacccactttccctctacctggcatcattcccagtaatcc

SEQ ID NO: 6847808 - DNA, 68 bp, Homo sapiens
agaggcaacaacaatctaccctagcttctttttacaaagaaaagactgggatagatttttttgtctct

SEQ ID NO: 6847809 - DNA, 61 bp, Homo sapiens
tcatagttttacttagtggtgtgctagacccagctcttacccactgatggaaacaaaatga

SEQ ID NO: 6847810 - DNA, 111 bp, Homo sapiens
agtcagaggattcaaagtcccattatttctggctttgagggtgatgggaattagcctagatttatcgcctctcagagccagtagtgaaatgaaggccttaatcctatgact

SEQ ID NO: 6847811 - DNA, 84 bp, Homo sapiens
tgagttaggtgccctaggtcagtgatgtcatataatatatacaggaacaatagaaatgctacaacattatctggggttgactca

SEQ ID NO: 6847812 - DNA, 56 bp, Homo sapiens
tagcttataaaggttttcaaagtaatattttactgtaggtgaaaatttgtgagctg

SEQ ID NO: 6847813 - DNA, 126 bp, Homo sapiens
ctgcagccaaattctactgtatagccacaagcttcatgtgagtagagaagcaattgtagcagcatgttggtagtttctgtatctcacagctccaggttgtgttctggaagtcaaccattcctgtgg

SEQ ID NO: 6847814 - DNA, 64 bp, Homo sapiens
gagggaaaggatcacagaggcgctgagccgggatggctacgtgtacaagtacgacctctccctc

SEQ ID NO: 6847815 - DNA, 68 bp, Homo sapiens
tcggatacccacaacagctctaggaagtggtttctattttcacttcctattgcagttgaggatgctga

SEQ ID NO: 6847816 - DNA, 74 bp, Homo sapiens
ggtgaggaaagtggtgggaaatcaggtgggatttaaatatttcccctgcccatactgacctctaattcactacc

SEQ ID NO: 6847817 - DNA, 55 bp, Homo sapiens
agagctggaaacagaattgaggtctcctaactcagaccagagttcttgccattct

SEQ ID NO: 6847818 - DNA, 55 bp, Homo sapiens
ttgctaaaaatggaattataggtgtctttagggataaatatataatttttggcag

SEQ ID NO: 6847819 - DNA, 84 bp, Homo sapiens
acatcttggcatccacatgctgttgaatatgacattgtaccttctgcatggcacagtgctctcctcacagatgggcccaggtgt

SEQ ID NO: 6847820 - DNA, 93 bp, Homo sapiens
gaggcaggagaatggcgtgaacccggcggagcctgcagtgagccgagattgcgccactgcactccagcctgggcaacagcgaaactccgtctc

SEQ ID NO: 6847821 - DNA, 124 bp, Homo sapiens
gactgcttttgcctaggacctgtgagaggttcctgttagaactgcaggacgattcagcatctttaagtttcagagttttgagaggaatcatctagtgtgtacaggcttaaaggcatggacagtc

SEQ ID NO: 6847822 - DNA, 57 bp, Homo sapiens
ctcaggtgcagcatttgtaagcagctccctggctggttctgattttgctgcattgag

SEQ ID NO: 6847823 - DNA, 55 bp, Homo sapiens
gaagccagactcagctttggagactcggggaagaatttccaaagctgctggtttt

SEQ ID NO: 6847824 - DNA, 77 bp, Homo sapiens
ctggacacctactttgtgcagattttagatgcttgggactcagcagtgaaagtctctgttatagagaaggaaaacag

SEQ ID NO: 6847825 - DNA, 57 bp, Homo sapiens
gagcctggaagtcatgcatgattgggcgcttgttgctgaatctctgacatctggctc

SEQ ID NO: 6847826 - DNA, 79 bp, Homo sapiens
ggtttatttaagctttggagaggcgggcaggaatcaagaagcagaaaaatatcctgtgccagtcttcgaagtaagtacc

SEQ ID NO: 6847827 - DNA, 130 bp, Homo sapiens
ttctttatcttgcctttaaaagcagttgttacccttttccctttcttgtatttctagctgtgttagtggctctattaggaacaactgcaggtacaagaaagcctgctgctgacttaaaccaagagaagaa

SEQ ID NO: 6847828 - DNA, 61 bp, Homo sapiens
gaagtttctgaatttgaaaggatctataaatctacagattctaaaaagctcagcgaacttc

SEQ ID NO: 6847829 - DNA, 95 bp, Homo sapiens
gactgtctatcgagccccagcaaccttgatatttgcggatctcagactcaagtaagggctgctgggcagatgttgttgctgggagttgggtggtc

SEQ ID NO: 6847830 - DNA, 61 bp, Homo sapiens
cttgctgagggtcagaggaatggaatctcaccagtcatatttcatgaggtctttcagcaag

SEQ ID NO: 6847831 - DNA, 56 bp, Homo sapiens
gagggcgtgtgtgatcattttccacttcatgcgtcggaatgcacacaactgctttc

SEQ ID NO: 6847832 - DNA, 70 bp, Homo sapiens
gtggaagggaaaccgcactggccttggcctgtcttgggacctgaacttggcctgctgttcaccctgccac

SEQ ID NO: 6847833 - DNA, 71 bp, Homo sapiens
tgacccagattgagagccggccacgcagctttgggacaccctgagtgctcccaggcaggctctctgggtca

SEQ ID NO: 6847834 - DNA, 77 bp, Homo sapiens
ttccctttggctttaaggtttatttagaattcatgaagttgtgtctgtgctgaaaagctttgaaccgttaaagggaa

SEQ ID NO: 6847835 - DNA, 87 bp, Homo sapiens
attcttggactcagtcagcccagctacatgaacaacaaggtcccaaacagccatttcagtataattgctggcactgactcccagaat

SEQ ID NO: 6847836 - DNA, 91 bp, Homo sapiens
gccaggatggtctcgagctcctgacctcgtgatccgccctccttggcctcccaaagtgctgggattacaggcatgagccaccgtgccgggc

SEQ ID NO: 6847837 - DNA, 70 bp, Homo sapiens
gagggacatacagccctctccctggtgccctcaggcggcagggggaacgggctgtctctgctgtcccctc

SEQ ID NO: 6847838 - DNA, 89 bp, Homo sapiens
ttgttgaaaatcagatagctgtaaataaatggatttatttctgggttctctattctgttccgtttgtgtatgtgtctgtttttatgcaa

SEQ ID NO: 6847839 - DNA, 61 bp, Homo sapiens
acactacacactctgctttgcttgttctataatactggtgagttttgagagtgggtagtgt

SEQ ID NO: 6847840 - DNA, 72 bp, Homo sapiens
gcgctgacatttttacattttattcgtttatttcttggctcaggaatgagaatgtaagtgaagagagggcgc

SEQ ID NO: 6847841 - DNA, 62 bp, Homo sapiens
gtcaacaagaagggtgattaggggcagaggcctgcaagaggcttcatggcccacccgttgat

SEQ ID NO: 6847842 - DNA, 86 bp, Homo sapiens
tgagagggtggacaggggtggtctggggctgagggtggtgttctcttgggagctgtgcacttccagatggccccatctaatctcca

SEQ ID NO: 6847843 - DNA, 72 bp, Homo sapiens
gagaagaaaaattatttagaagctaatttttcagaaatctctggttgacagagcttcaagtcatgactactc

SEQ ID NO: 6847844 - DNA, 93 bp, Homo sapiens
gtagaaagagcaatgcacttgagcttgaaaggtatgctctcctcacctacccaggagcatgtctaactcttcagggtgtgctcctttcttcac

SEQ ID NO: 6847845 - DNA, 75 bp, Homo sapiens
cttctgggtagaagattcctcaggagaggacctgaaatctgtggttgtcatttctgtatcttcagtgcccagcag

SEQ ID NO: 6847846 - DNA, 89 bp, Homo sapiens
aggcatccttcaacttagaagtcagctccagagggaacaccaggacatttgctctagttttagcttgagttgcagaagagaaggatcct

SEQ ID NO: 6847847 - DNA, 65 bp, Homo sapiens
ctgtaggactgagggcttcagctccttgtggtatctctgctggaagctgctttcagctcctagag

SEQ ID NO: 6847848 - DNA, 88 bp, Homo sapiens
gggcttctgggatatgggtgctctaggggtcagtggttagaggccatatgactggtgcctgtggggtagcttttgttccatgtggtct

SEQ ID NO: 6847849 - DNA, 99 bp, Homo sapiens
tggtttaaaagagatccagtatattcttcagactactgatgattgctaacatttagtacatcagaaacagagtcatgaaattgtattgatattaaacta

SEQ ID NO: 6847850 - DNA, 93 bp, Homo sapiens
caaacttgcagggaaggaggatgctctggccttgaggttcgaactcccgccccggggaggcaagagccaggcacccctttctcctaatgtttg

SEQ ID NO: 6847851 - DNA, 84 bp, Homo sapiens
aaacccttctctgttcagctgcctcagggtatacagttgtccttgctcagatatcccatgagccagctgcagcagctcaagttt

SEQ ID NO: 6847852 - DNA, 64 bp, Homo sapiens
tctcccctggccttttgtactcactctcccttttgaaggaagtgagggactagtgctggggaga

SEQ ID NO: 6847853 - DNA, 57 bp, Homo sapiens
ctgaggggatggccagtcctgttccatggaagtgagaaacagtaccatttatctcag

SEQ ID NO: 6847854 - DNA, 74 bp, Homo sapiens
ccagggctgggtctggatgctcaggtggaaggtggggatgggatccagaaccccagggcagctcccagacctgg

SEQ ID NO: 6847855 - DNA, 58 bp, Homo sapiens
ggccatttgggttaggaggttttggcctctgggtcaggacatcatattgcccagggcc

SEQ ID NO: 6847856 - DNA, 83 bp, Homo sapiens
cacttcaacacctggtgcattcatgtgccggcacaatcagtgattggtgggttaatgagtgactgcgtgagactgacttagtg

SEQ ID NO: 6847857 - DNA, 57 bp, Homo sapiens
tctatattctgggtggccaagaagccaggtagagctcaaaggctccctgactatgga

SEQ ID NO: 6847858 - DNA, 93 bp, Homo sapiens
aatttctctcagtatgtagagcaagttcagttttgagttgggaatgaattccagtcacctagacagaacttacttctgatcatataggaaatt

SEQ ID NO: 6847859 - DNA, 78 bp, Homo sapiens
ggttatagcagtctcttttgtctcaccagtatcaaaaacagagctggcacagaccaggagatcagaaaatgttgagcc

SEQ ID NO: 6847860 - DNA, 128 bp, Homo sapiens
gaaaccagttatcattcatttagtcatttgcttcattcatttattcactatttaataagcaccaaatgatgcattggtctggggaaatgaagaggccactccggactctagaatgactcctgggaatc

SEQ ID NO: 6847861 - DNA, 57 bp, Homo sapiens
ggtatctacaggctgggtgtggtggcccacacctgtaatcccagcactttgggagcc

SEQ ID NO: 6847862 - DNA, 65 bp, Homo sapiens
cctcttactaggcactgggctaggacaggtagaatgacaataagacatgtcccctatgcttaagg

SEQ ID NO: 6847863 - DNA, 67 bp, Homo sapiens
ctggcagaccaggaagggtttctgggatatgtctgtctcctaaaccatcctggtaccaacctgttag

SEQ ID NO: 6847864 - DNA, 61 bp, Homo sapiens
ttttggggagaacggttgctattacttagcctgtgtgcatggtagctgagttcccacagaa

SEQ ID NO: 6847865 - DNA, 55 bp, Homo sapiens
gtcttattctgagttggccacccagaaagctggacctggcaggcccaggatggac

SEQ ID NO: 6847866 - DNA, 81 bp, Homo sapiens
aaggagctgtgaagaggctagagccaagtaaggggctaccggaggtggctcaggggtctggctctgtcatcaggtctcctt

SEQ ID NO: 6847867 - DNA, 86 bp, Homo sapiens
gactaaacagagacaaacactgcaacttctgaggccacagcagttactaggctagataagaggaagtttgtagatgtttcttagtc

SEQ ID NO: 6847868 - DNA, 73 bp, Homo sapiens
tagcttgctgagagcgtgtcaacaagaagagtgacaaataatcttgcttttgttcactgtctctgagcacctg

SEQ ID NO: 6847869 - DNA, 94 bp, Homo sapiens
tggagacacttgcgtttgaactgtccaggctgccgacaagatgctgttttctcctatatctcacgaaggctgtggcattaaacgtttgtctcca

SEQ ID NO: 6847870 - DNA, 63 bp, Homo sapiens
ggtgtcagaggaggctgagtaggaaggagggactttacccctgccccctaatcctgtgatatc

SEQ ID NO: 6847871 - DNA, 86 bp, Homo sapiens
accacccatcacactggacattggatactcctatttattcaagaggcttgtgaagtatctgtgtgccagtgggggatggtgtgtgt

SEQ ID NO: 6847872 - DNA, 88 bp, Homo sapiens
aaaatggtaggttaaaggtatcagtaaagctctgcccaattcctagattctgtggtaggtcccagcttactgaaccaactttagtttt

SEQ ID NO: 6847873 - DNA, 55 bp, Homo sapiens
gggttacaatttttatctgtgtactaaaaagtatacaggaaagaaatttgaactc

SEQ ID NO: 6847874 - DNA, 80 bp, Homo sapiens
atgaggctcagagaggctcagggacttgctgagggacacactgcttcctgagtaccagtcccatgggtctcctggcccat

SEQ ID NO: 6847875 - DNA, 60 bp, Homo sapiens
tgaattgtagggattgctggtatactgaatattagttctttgcttgtaatacctgcttca

SEQ ID NO: 6847876 - DNA, 86 bp, Homo sapiens
ctgggggactggaaggagccgagctcttccccactcaggtctcctttccgctgtcctctgtgggggctctgctgctcctcctccgg

SEQ ID NO: 6847877 - DNA, 64 bp, Homo sapiens
ggaccaggacaatgttttgtggcaaaggaaggctttcttctacaaggttgtcctctatgggtct

SEQ ID NO: 6847878 - DNA, 55 bp, Homo sapiens
ctctgtgtctgaagccctatttctggcctacaagtggggcgtgtggacacacgag

SEQ ID NO: 6847879 - DNA, 68 bp, Homo sapiens
gcttttgaatatctagattggtgagatgctagattggtgagatccattcattcaggtatttagtgagt

SEQ ID NO: 6847880 - DNA, 75 bp, Homo sapiens
gagtattttacagctactgtcctatttccagtccccttcctctggacggctatgggatgtgctgtggatgccctc

SEQ ID NO: 6847881 - DNA, 78 bp, Homo sapiens
tttcagttttcccacatttggggcgctaggtagactcaacctgaactacattcaccccaaagtgttggataattgaaa

SEQ ID NO: 6847882 - DNA, 78 bp, Homo sapiens
atagtttatttatccatcatctgctgaaggacatctttgtcacttccaagttctggcaattatgaatagagctgctgt

SEQ ID NO: 6847883 - DNA, 72 bp, Homo sapiens
cagggaatgctaaatccagaagcagtcaataaatttattttatttctgattttgtttgtgaattggtacctg

SEQ ID NO: 6847884 - DNA, 56 bp, Homo sapiens
agttgatggtgttttggtttcccatgggaaatattgtcactggagcattagcagct

SEQ ID NO: 6847885 - DNA, 98 bp, Homo sapiens
ggctttttgaaatgttggtaactattaactattaccactctaggtttaagatagaccgtttaagcccctctgtagctaatagtataagagcaaaagcc

SEQ ID NO: 6847886 - DNA, 69 bp, Homo sapiens
gctgagcagtggggccagctcccgcccacccccaggagactggtgaggagagctgtccggctgagcagc

SEQ ID NO: 6847887 - DNA, 59 bp, Homo sapiens
tggtgaggtcatagagaactgtcaggagatggtcatctggtgtcactgtgtcttcatca

SEQ ID NO: 6847888 - DNA, 62 bp, Homo sapiens
ggttaacagttattctggggattcagatggaggttgaactccagagctcacatgtctaaacc

SEQ ID NO: 6847889 - DNA, 75 bp, Homo sapiens
atgtgagggtcatttggaagtggaatcttgaaagttgactggatagtccactcttgatgatctgtgaatttacat

SEQ ID NO: 6847890 - DNA, 57 bp, Homo sapiens
ctctctggtcccagattccagaagccctctcatctggctttggctctggtcagagag

SEQ ID NO: 6847891 - DNA, 56 bp, Homo sapiens
gaacctggaatgtggcgcccaacaatgtaatgaatggcgcttaattttccaggttc

SEQ ID NO: 6847892 - DNA, 98 bp, Homo sapiens
aaaaattagtaatttacaaatgtgtgggaattttaagagaaagttaaagaatagttctaggaaattgttactatatttgtttaaattattatattttt

SEQ ID NO: 6847893 - DNA, 61 bp, Homo sapiens
acacatcacctgtccacgcagtctgcctaaatcctggccaggaaaaacgtggtgggagtgt

SEQ ID NO: 6847894 - DNA, 64 bp, Homo sapiens
cagtcacctcccggtgtactgtgtcttccgtcaagacatgtttgctatagggatttgggtactg

SEQ ID NO: 6847895 - DNA, 104 bp, Homo sapiens
acttttcaggtactccatattaaatgatcaaaaagagagaaatatattgcagcagttctcaacagcaagatggttttgtctttatgattctgtagcctgattgt

SEQ ID NO: 6847896 - DNA, 86 bp, Homo sapiens
ggctccttgatgaattgaattcatttactcaaatgtgcaggcttaaactttgcagaaatgaaattgaatgaccatcaagagaagct

SEQ ID NO: 6847897 - DNA, 72 bp, Homo sapiens
gggataagtttctggaccttacctgcttaggcagcctgttgtctttagctcttagtccaagagacttaatcc

SEQ ID NO: 6847898 - DNA, 94 bp, Homo sapiens
gccactaaagcactggaggggaagtttctcagggttgattggggttggtcacggcttccatcaatctgagaagctgaccagtggttgaggtggc

SEQ ID NO: 6847899 - DNA, 60 bp, Homo sapiens
gggagcatctggctagaggagtgaagtcctagggttttatttcaataactacatgttttc

SEQ ID NO: 6847900 - DNA, 61 bp, Homo sapiens
cctggagtgggagcgtgctgggctttcgggggctggttaggttcagctttcttactctggg

SEQ ID NO: 6847901 - DNA, 75 bp, Homo sapiens
agccttgaagattccacagctacatcaatctagagtggttatcttggttcttactgtgttgtggtctgtagggct

SEQ ID NO: 6847902 - DNA, 60 bp, Homo sapiens
gctggatttgtctgatgttgacggtgtttctgtggcaccctgcttctggattaatccagt

SEQ ID NO: 6847903 - DNA, 60 bp, Homo sapiens
ctgggtggaaagtgctgagaatgttgagagaaaggagacattccagcatgcgccttccag

SEQ ID NO: 6847904 - DNA, 74 bp, Homo sapiens
tcacaatgtttccatctgctaggtaaatgaatcaagaatagttttacattcataattacagagggaaagtgtga

SEQ ID NO: 6847905 - DNA, 58 bp, Homo sapiens
aataaatgttaagattgtctcagctgtaagccatgcaccaccagtcttgacacttgtt

SEQ ID NO: 6847906 - DNA, 58 bp, Homo sapiens
ccatgacccccaagggcagcgtgacccccgagggtggcgtgacccctgggggtggtgg

SEQ ID NO: 6847907 - DNA, 55 bp, Homo sapiens
gatgttcgctttggtttgtccctgtatgaggcacaaaacttgctggtgaaacatc

SEQ ID NO: 6847908 - DNA, 59 bp, Homo sapiens
gctggagtggcagaactgggggtcctggggcccagggctcaccactgtgcactcccagc

SEQ ID NO: 6847909 - DNA, 81 bp, Homo sapiens
tgggaggctttctccgacttgataaactcctcctcctctattccagttcagatgtcatctcttgcaggaagccttctccca

SEQ ID NO: 6847910 - DNA, 95 bp, Homo sapiens
ctgtgagtgtgcctggcgctggttgctgatctgggggcccccacctctggtgggtccctcatgagaggcatttcctgccagccaggtattcgcag

SEQ ID NO: 6847911 - DNA, 66 bp, Homo sapiens
gtctttgttacactctccaggcacttgggagtcagaactttttccagggcctagaggtgacctgac

SEQ ID NO: 6847912 - DNA, 75 bp, Homo sapiens
cacagaagcattttagtaatgaacttgagaaaaactaaaaattttcaggaacgtgctggaatgtcaggcactgtg

SEQ ID NO: 6847913 - DNA, 74 bp, Homo sapiens
atgtgaacattcttcacacctgttcctgttcatagggcaatgggcttcgacatacgtgaggaatacagtcatat

SEQ ID NO: 6847914 - DNA, 76 bp, Homo sapiens
aggtagtataatgtagccattaagcatttgggtttgagatacagtgccagatacattagtagttacttgttgacct

SEQ ID NO: 6847915 - DNA, 98 bp, Homo sapiens
aaagatagaaaatattactactgaaactcagaaattcaaactcacattaatttagtgcaaaggcttgatctgggttcagtggtatattttatttcttt

SEQ ID NO: 6847916 - DNA, 117 bp, Homo sapiens
ggcaaagtgaaggtcccttgacagatggtctgatagtctgaaaatgatgggaggataggaaccattcattgctgtggcttcagtaccaaattgtgaattggactcttacaatgtgcc

SEQ ID NO: 6847917 - DNA, 76 bp, Homo sapiens
ctggcattcccattaaggaagcctattctctcctcatgaaatacatgggatgagatgctgccttggccaatgccag

SEQ ID NO: 6847918 - DNA, 101 bp, Homo sapiens
gtgtatgtatgcatgttattgatgcctgaggcttgtggaactcatctgcctggtctattccttgagagcaacacgcagtagtatacgagcgtaacaagaac

SEQ ID NO: 6847919 - DNA, 68 bp, Homo sapiens
agcatgtgaagatagctgttacatcttgcatatcgtctcagtgagattcaggcatgtcttcatttgtt

SEQ ID NO: 6847920 - DNA, 86 bp, Homo sapiens
caagccctagacaaaatgataatgtcagcatagtttatttttgactcttgttaataaatagatttctgacgtgcatgtctttcttg

SEQ ID NO: 6847921 - DNA, 79 bp, Homo sapiens
aaagttggaagcacattgatttattttggagcagtccgaacagtttctttgataataaattcaatctgcgctcaacttt

SEQ ID NO: 6847922 - DNA, 65 bp, Homo sapiens
gagagtgtgttattaaagatggaacccaggagcaccaagattccatgttctaaataacagctctc

SEQ ID NO: 6847923 - DNA, 69 bp, Homo sapiens
tttgtgactgctttaaccaagaaagcatatttgaaatgatgtcgtttaactttggaggtaggtcataaa

SEQ ID NO: 6847924 - DNA, 61 bp, Homo sapiens
ggttctattaattttgggtagtaaatcctttccttttagactccaaaagtttggtggaacc

SEQ ID NO: 6847925 - DNA, 82 bp, Homo sapiens
atcagctgaggaccttgttggaagtgcagattctgattccacaagtctgcgattctgtatttctaataagatctcaggtgat

SEQ ID NO: 6847926 - DNA, 61 bp, Homo sapiens
gctggtgaaacccacagagaccctcacgctgacctgcactctctctgggttctcactcagc

SEQ ID NO: 6847927 - DNA, 61 bp, Homo sapiens
gagctgcggggcccccaggtgggctccacatggagcagagcttgctggtgcctgcaggctc

SEQ ID NO: 6847928 - DNA, 123 bp, Homo sapiens
tattaggaacaagcagtgttgggcagtgggtggatctcagggatggatgcaaacttgcctctgcagtggtgagcccatgttctcttccaatccactaagctcagccaacagatgttcttagta

SEQ ID NO: 6847929 - DNA, 72 bp, Homo sapiens
cctgctgtgcacccaggaaggctgacttatatgatttgtttcatttaagcattcttgggcgtttagtcaagg

SEQ ID NO: 6847930 - DNA, 109 bp, Homo sapiens
tgcttatttgagtagtaggaagtaaacagataagaaatctgaataatccataatgcaaactattccctgatgccatctgtgtgtttactatttatcatttgaagctgca

SEQ ID NO: 6847931 - DNA, 60 bp, Homo sapiens
ggcatcttgttgctcaaatctatgaaggtcatcttgatggattcgagagaataaagtgcc

SEQ ID NO: 6847932 - DNA, 66 bp, Homo sapiens
ggtcagcagtgtagcatcttcaaaagtctgtctctctgcttctgtcacaatttgcttactctgact

SEQ ID NO: 6847933 - DNA, 94 bp, Homo sapiens
ctgtgatttattttactggaagctggaacaggtgtggtctatctttgccaaagtcttccagaaattcatacctgccccaggtttcaggtttcag

SEQ ID NO: 6847934 - DNA, 86 bp, Homo sapiens
cccatgttggctgttggagctttcttttccctcatttgttatgagtcaataaagaagcagaaggtttggacgtgctagccagtggg

SEQ ID NO: 6847935 - DNA, 79 bp, Homo sapiens
ggatgcttagaaaaaagaactgtatcaagatgtagtataaagactgatcaaaatacaattctttgttcaaacaagatcc

SEQ ID NO: 6847936 - DNA, 63 bp, Homo sapiens
cccataggattacagatactgacaaagtgaaagactttcaggcctgagaaaaatccttttggg

SEQ ID NO: 6847937 - DNA, 76 bp, Homo sapiens
tgatttcaatagtatgtttttctgtgacatccttatggatcacaaagtcacaatggcatagtataaaatggaatca

SEQ ID NO: 6847938 - DNA, 62 bp, Homo sapiens
cctcaggctcgatgtccagctccttgtattttctcagtacgagctccaattcagccttcagg

SEQ ID NO: 6847939 - DNA, 82 bp, Homo sapiens
caaaaactctatgaaagttcctaatgtggctatctagtgtattcctaacataggcacattaggaacttttgtagagtttttg

SEQ ID NO: 6847940 - DNA, 67 bp, Homo sapiens
cccaccttctgttgctattttgagagtcatagttgctttgaactgtgcaatgagtaataaacttggg

SEQ ID NO: 6847941 - DNA, 70 bp, Homo sapiens
ttttgattcagacatatcaataggcacttcagatttatagattgtcatttggtattagtttggcttaaga

SEQ ID NO: 6847942 - DNA, 101 bp, Homo sapiens
tgaggcaggagaattgcttgaacccgggaggcggaggttgcagtgagcggagatcacgccactgtactccagcctgggggacagagcaagactctgtctca

SEQ ID NO: 6847943 - DNA, 74 bp, Homo sapiens
ctggggtcctgagaagctggacctggcaggcggacttgaggcccttcctgtggtccagctccgggactccccag

SEQ ID NO: 6847944 - DNA, 120 bp, Homo sapiens
cttggcggacacactcagttctcatgatgtaccaggatcaccgactgcctgtaagtgaaaatgcaggccttggcaatgagcctgagcacagtccctggagcttacagtggtcacgtaaag

SEQ ID NO: 6847945 - DNA, 64 bp, Homo sapiens
tggatatgcaagtcacgtctccctaggtcttctgcagcccccaggagagagacttgaatctcca

SEQ ID NO: 6847946 - DNA, 66 bp, Homo sapiens
ttaaagggattgatcttgacacagttgagacatgattctaacttttttccccatcggtctctttaa

SEQ ID NO: 6847947 - DNA, 58 bp, Homo sapiens
atcccttgtgctcagcctcttgggccacagagctggagggagaggctggacaggggat

SEQ ID NO: 6847948 - DNA, 58 bp, Homo sapiens
ctgggtcctgcactgcaagcacctctcgagcacaaggcctaacagaggcagggctgag

SEQ ID NO: 6847949 - DNA, 69 bp, Homo sapiens
gagggagcgcctttgcctaccaggccggagaaccctgttcttcagtcgccttggcaggggcagcccctc

SEQ ID NO: 6847950 - DNA, 84 bp, Homo sapiens
tccctgagacagggactgggttcgagttggtcctggctctatccatggtgcctggcacgggctcggcccacaaggtctcaggga

SEQ ID NO: 6847951 - DNA, 76 bp, Homo sapiens
gaagcaaagccaggctgtggggaacttgaacgcacaaaaaggtgtttagactttaccctatgtttgatgtagcttc

SEQ ID NO: 6847952 - DNA, 77 bp, Homo sapiens
gaaggaataaagaatctggttcccccactagaacacgagctcctatgctaatagggggaactacattctattccttt

SEQ ID NO: 6847953 - DNA, 75 bp, Homo sapiens
tagctcaaaaaaagtatgaagattataatttttccaaaaactttctgggaattactatcttgatactcagggcta

SEQ ID NO: 6847954 - DNA, 70 bp, Homo sapiens
agaggcgggcagatcacctgaggtcaggagttggagaccagcctggccaacgtggtgaaaccctgtctct

SEQ ID NO: 6847955 - DNA, 115 bp, Homo sapiens
atttgagcatagactattagacgatactgaattaatgttaattgtcttaggtgtgatgatgggattatagtaatctaagagaattttcttatttttggtagatacatgctgaaat

SEQ ID NO: 6847956 - DNA, 81 bp, Homo sapiens
aatgcttctgattttcctactgataaacagttattagaaaataattggataaaaataattagtaggacagttgaaggtgtt

SEQ ID NO: 6847957 - DNA, 66 bp, Homo sapiens
ggcagcaacttaggcagaacatctagaacctagatgttctagacacttgagaaatgcatttttgcc

SEQ ID NO: 6847958 - DNA, 82 bp, Homo sapiens
ccctgctgctaaaattaactaattgttaaagtaataaccatggaccctcatggcctattttaatagtcagtggcaatctggg

SEQ ID NO: 6847959 - DNA, 72 bp, Homo sapiens
ccagaattggttagtgagcattccttcaaaccacccttgtgtccttttgacatgtgcttataacttttttgg

SEQ ID NO: 6847960 - DNA, 86 bp, Homo sapiens
gcaaaagcagctgctttcagcaggagggaactgtggtggagaaggccaggatctctctcctgtggagggcattgctttgagaatgc

SEQ ID NO: 6847961 - DNA, 56 bp, Homo sapiens
gtctttgttctgtcactaaaaatgtctttactgcatatatgtgacagacaataggc

SEQ ID NO: 6847962 - DNA, 82 bp, Homo sapiens
cttcccagcctctcagctcaaactcaggtgtgaaggtttatgatgcagtcacagctttgagcagagaccacaggcaggggag

SEQ ID NO: 6847963 - DNA, 84 bp, Homo sapiens
cctaagaagtgctttttaatatttatacatctaaagagggtttgcccttccagacatagaaaatcattaggaagcattctcagg

SEQ ID NO: 6847964 - DNA, 57 bp, Homo sapiens
ctgcagctccttctggcatgtgaaattgcctgataagccagctaactgagtctgcag

SEQ ID NO: 6847965 - DNA, 95 bp, Homo sapiens
gattgttattcccttgggcagaagactcttgcctaatacatctttgtcagcccataaagactagtgagatgtcttgccaggaggagctggaaatc

SEQ ID NO: 6847966 - DNA, 116 bp, Homo sapiens
gtctaagggcagtggcagaggcaggagttgcattgatcccagcttgggccatggagagctcaccagcccaggtagtgctattaaggagcacctgctttgagccaacagtgctagac

SEQ ID NO: 6847967 - DNA, 66 bp, Homo sapiens
ctggggaaaagcacttcaggagcagtttgctacagcaagcaatgctgctgactgttccctccttgg

SEQ ID NO: 6847968 - DNA, 69 bp, Homo sapiens
gtggccaccctcggcacacacagatttccagagggcacccaggccctgtgtctgctgaaggctggtcac

SEQ ID NO: 6847969 - DNA, 68 bp, Homo sapiens
gttccctcgtccaaggatgcaggatgctgtttctttcacagcgcattattcatttcttggcagggaac

SEQ ID NO: 6847970 - DNA, 76 bp, Homo sapiens
ccagtcagtccccatccctgcagtggtgcctcctaggaaagatataaaaggaatcaaagggattgggggctgctgg

SEQ ID NO: 6847971 - DNA, 72 bp, Homo sapiens
gccctggagatgcacgagcaggtggagcagctgaagcagagcatccaccgcgtgcacctctactcccggggc

SEQ ID NO: 6847972 - DNA, 55 bp, Homo sapiens
caggctgggactgacccctgctgagaagtaccaggcggtcttgtccctctgcctg

SEQ ID NO: 6847973 - DNA, 67 bp, Homo sapiens
tagtgggttcttggaccagcagcattgacattacctgggatgttagaaatgcacccaagacctactg

SEQ ID NO: 6847974 - DNA, 58 bp, Homo sapiens
gtctcaaggtcagcgtgaagttctgtcagatgaaactaggatgttgctggcctaagat

SEQ ID NO: 6847975 - DNA, 57 bp, Homo sapiens
cttgccctggcacacacacagctggaacctgagcccagaggtggtttgaagggtcag

SEQ ID NO: 6847976 - DNA, 73 bp, Homo sapiens
tttcttccataagcagatctttaacagggtcacttaggtaattgggctgcttaaacagatgtgctggaagaaa

SEQ ID NO: 6847977 - DNA, 62 bp, Homo sapiens
tctcctttcctctgatgctgacttggaccagaaggctgttcctatggacaggaggaaggaga

SEQ ID NO: 6847978 - DNA, 64 bp, Homo sapiens
gaacctgtcctgagtgaggagttcctggaggatcttacacaggcctcatcaaagggagaggttt

SEQ ID NO: 6847979 - DNA, 85 bp, Homo sapiens
tctgaatgaagtgtggactttgtttaataataatgtatcagtattggttcaataattgtgacaaatgtgccatactaaagtcaga

SEQ ID NO: 6847980 - DNA, 61 bp, Homo sapiens
ccctggctggctctgcccggacagtccttagggacatcttggtcctgcccaccagccaggg

SEQ ID NO: 6847981 - DNA, 80 bp, Homo sapiens
cagttgatctccagatgcctggaaatgagaatgtgtcaaggtaactctcaccttcgttgccaggctgagggatccagctg

SEQ ID NO: 6847982 - DNA, 67 bp, Homo sapiens
gtcacttatctggccaccaagagcttgctcaggggacaccctgcgactctttaaggtggccaagggc

SEQ ID NO: 6847983 - DNA, 72 bp, Homo sapiens
atgtctaaaagaaggcatctatgtgacctggatttattcagtaatccaagggaaactgcacttctaagatat

SEQ ID NO: 6847984 - DNA, 113 bp, Homo sapiens
aacagttcctagattctggcagttggcattggcatctggcattaactctctccaccccgtgcccattttatagatgcgaacaggccaactgatgcaggactgtggtttctgtt

SEQ ID NO: 6847985 - DNA, 91 bp, Homo sapiens
gtgcctcgtgattggcttctgcattggaaacctaagaataagcaagcacacttgggccagaattcaaagcagagggtcaatacagaggtat

SEQ ID NO: 6847986 - DNA, 87 bp, Homo sapiens
ttgcccttgctgtgttctccctctagcctgagtgtttccagagcctgagccctccaaaggttgggggaggcagcacagccggggggg

SEQ ID NO: 6847987 - DNA, 84 bp, Homo sapiens
tttttaattaacatattaattaacacatatttggagagctactaatgtaggcctggtactgtgttaataagagttaattgaaaa

SEQ ID NO: 6847988 - DNA, 123 bp, Homo sapiens
gggaggctgaggtagggggatcacttgagcctgggaggcagaggttgtagtgagccaggttgtgccactgcactccagccttggtgacagagtgagaccctgtctcagaaaaaaaaaaatccc

SEQ ID NO: 6847989 - DNA, 66 bp, Homo sapiens
tcctctgatgccctgtccactctatgttaaatataaacaagtacaaagagccagggcattaggtga

SEQ ID NO: 6847990 - DNA, 88 bp, Homo sapiens
tggtagtaagattgattaaatttggtgtttctcactttttgccctagagaaatgaaatgaagatatgatcagttcttaagttttacta

SEQ ID NO: 6847991 - DNA, 75 bp, Homo sapiens
aatcctcgtaccagtgctaaattacctttggtatcccaaggaccagaggctaagggtagcttggggtgagtggtt

SEQ ID NO: 6847992 - DNA, 100 bp, Homo sapiens
tgttggaacactgccaggcacattcatttatgaaatatctatatctgcttttacgcaatggtagagttgagtagcatgaacagtgaccatgtggccagca

SEQ ID NO: 6847993 - DNA, 65 bp, Homo sapiens
gccctgtatctatagtggtttataagagcaattttaatttcttgcatacactatatgtacagtgt

SEQ ID NO: 6847994 - DNA, 64 bp, Homo sapiens
aggctaatgtgcaggctcaaaccttgtaatttaaaaaggacacgggtatggctgcacattgttt

SEQ ID NO: 6847995 - DNA, 61 bp, Homo sapiens
gtctcacagttggctcattaatgaacattgtgtgcaatcaataagttaccgactgagagac

SEQ ID NO: 6847996 - DNA, 88 bp, Homo sapiens
ggtttgtatgtatgactgaaggactagattgattaatacttaatagttggtaagcatttatttcctgcagttatttaaatgtgcttcc

SEQ ID NO: 6847997 - DNA, 56 bp, Homo sapiens
ctgaggtccactgaggcaacagggctacacaactcctgcctgggaagggcttgtag

SEQ ID NO: 6847998 - DNA, 55 bp, Homo sapiens
gtcttggcatgcatatatcccaaagcctgggatgccaagaatcatatgccaggat

SEQ ID NO: 6847999 - DNA, 59 bp, Homo sapiens
ttcctttgatttcttgctggagctcccccttagccaaacacaagcagaagtcagaggga

SEQ ID NO: 6848000 - DNA, 56 bp, Homo sapiens
tcttgggcctcaccccagacatcctggatcagaaactctggggatgaggtctagga

SEQ ID NO: 6848001 - DNA, 56 bp, Homo sapiens
catagcaaggtgctttccacatctctcatctgagaagtggaaaaaccttgcatatg

SEQ ID NO: 6848002 - DNA, 81 bp, Homo sapiens
ctttggagttccctaatttcccaattgggggttttagttaatctgtccccagaagttaagcagggaaaaaattcttcaaag

SEQ ID NO: 6848003 - DNA, 66 bp, Homo sapiens
tggactaagatacattgtttttggtagtgcatgtaaaataactgagaaatagcaagtgtctctcca

SEQ ID NO: 6848004 - DNA, 83 bp, Homo sapiens
atcatggaaaggttcagcaagcttaatactccactcaacattagacacatatggtaggacgaatttctgaacagccccatgat

SEQ ID NO: 6848005 - DNA, 80 bp, Homo sapiens
aagttatgacttaaaaagagatgcaaataatctgaataaatttaataatttataggctgtgcttgtgtctttcatgattt

SEQ ID NO: 6848006 - DNA, 75 bp, Homo sapiens
cattcatttattctataggcattaagcacctgccatgctctgagaacagtgctgtgtgctgggaataaaagagtg

SEQ ID NO: 6848007 - DNA, 92 bp, Homo sapiens
agcacaggggagaatggtaggagatgaggtcagaggggtgtgtgtgggaggagacaacatgtctccacccatcttaaagatttctgtgtgct

SEQ ID NO: 6848008 - DNA, 104 bp, Homo sapiens
gtcttaatggatagaggcagacatcaccaataatgggaccaggtcactaggggaaatccactgggcttcactcataattaggttctgttttgattcccagagat

SEQ ID NO: 6848009 - DNA, 59 bp, Homo sapiens
tgcggcaggagaaggtgttatggggagggtgagcctcccgtaactcacttgtgcctgca

SEQ ID NO: 6848010 - DNA, 89 bp, Homo sapiens
gatgacaaagcattgatgaacagtcaaaaagtgaccattactctactaagagatggcctataatttgctttcatttctgctttgcaatc

SEQ ID NO: 6848011 - DNA, 66 bp, Homo sapiens
tatttgctattgttctctcagtgcccagtatagtgccctctactgagcagggaccaaaagcatttg

SEQ ID NO: 6848012 - DNA, 56 bp, Homo sapiens
tgattctattacaggaaagggtcccaatccagaccccaaaagagtaatagaattca

SEQ ID NO: 6848013 - DNA, 63 bp, Homo sapiens
ggatgtctttactttgggattttgttatctaagatctaaatctgtcccacatgtaaggatgcc

SEQ ID NO: 6848014 - DNA, 106 bp, Homo sapiens
ctcagtgtcaaggctttcttgtttgagtagcccaggcttagtaagtggccttcagtctcattggttacacacagagctgggcctgggagagggggatctacatgag

SEQ ID NO: 6848015 - DNA, 82 bp, Homo sapiens
aggtcctgcagttttgtggagagcaaataattggaatccatctgacctacaggaggatcatttgcccaagctttagagactt

SEQ ID NO: 6848016 - DNA, 56 bp, Homo sapiens
ggtatgctgtgcggacgcagacactgcgggaaggaaacaggtgtcccgcggcggcc

SEQ ID NO: 6848017 - DNA, 83 bp, Homo sapiens
tgcgagcttcaggaaaccgcatcccagtgggcactgcagtattgactgacctgctgggacgtgtggttgccaggagcaatgca

SEQ ID NO: 6848018 - DNA, 57 bp, Homo sapiens
aaagaggggactgttaattccatttatctcttgaacaggaattgctttcctgtcttt

SEQ ID NO: 6848019 - DNA, 57 bp, Homo sapiens
cccaggctagaaaggccaacaacccatgtatgtggtctggggtctagttggcctggg

SEQ ID NO: 6848020 - DNA, 72 bp, Homo sapiens
gttgttttgagatggagtctcactctgtcacccaggctggagtgcaatggtgcgatctctgctcactacaac

SEQ ID NO: 6848021 - DNA, 62 bp, Homo sapiens
atatgcaacccgcacttaaggaatggaaagttatgctgtacctccttgaaagtggggtatat

SEQ ID NO: 6848022 - DNA, 89 bp, Homo sapiens
tggtcatctaagcggccctgctgagcttgtctgggttgctcacatatctgggggtcagcaggctgtcagcaggggccactgggtgatgg

SEQ ID NO: 6848023 - DNA, 120 bp, Homo sapiens
acagatatcacccatctcaggttggctggctcagggtgcagtgtccatgacaccagaaccctttcctggtcctgtgacggagcgccagaggtatgcagagcttggctttcgggtgactgt

SEQ ID NO: 6848024 - DNA, 89 bp, Homo sapiens
ggggaagttcagtgtgctaaggcagtctatcacaggggatataatctagtctagcagtccctgaggcagtgatgtttaagcacctccct

SEQ ID NO: 6848025 - DNA, 99 bp, Homo sapiens
atatatatttcactatatcacacttcaaacttttgtttactgtttcccttctcctactctattataaacctttgagggtggggactgtgagttatttat

SEQ ID NO: 6848026 - DNA, 58 bp, Homo sapiens
ctgcttctcggtgcccttcttagactggttgtaggtgataacagggccctagaaagag

SEQ ID NO: 6848027 - DNA, 83 bp, Homo sapiens
cagtcaggcctagggttaaggccacatttagagtcaaagtccgctctggagttactgctggctttggcttgttggtcagattg

SEQ ID NO: 6848028 - DNA, 98 bp, Homo sapiens
tgtaatttactctgcatccccaggaagaaattctgatttgcctgaatcacagtgtaagtaggcatgtttctattttggtacttgtaagtagtattata

SEQ ID NO: 6848029 - DNA, 64 bp, Homo sapiens
tgcctggcaggagctgtggccgtagctaggggattacagctacggccacaactctggccctgta

SEQ ID NO: 6848030 - DNA, 60 bp, Homo sapiens
gtgtcttttgcaactactcaactccactgttgtggtataaaagcagctgtagatagacac

SEQ ID NO: 6848031 - DNA, 77 bp, Homo sapiens
ccgagcacattcccaggagctgctggtacagcttgcctcaatatcttatcagcaggtgaattcctggatgtgcttgg

SEQ ID NO: 6848032 - DNA, 86 bp, Homo sapiens
gcagaggcagtacttactaaaatccaggcattctgacttcaagtccagaggattccagtctagtacctggatgcactggtttttgc

SEQ ID NO: 6848033 - DNA, 79 bp, Homo sapiens
ttgctgattttatatggcatactgtggaattgggactttatcctaagaactatggggagccatttaaaggattaagcaa

SEQ ID NO: 6848034 - DNA, 68 bp, Homo sapiens
ctattgaaagtgtacaattcaatagtttttaggatatttagagttcagagttgtgcaactctcagtag

SEQ ID NO: 6848035 - DNA, 129 bp, Homo sapiens
gaagaaaaatgttgggcaagaaaaatatcaagttctgggttttgtcctgagcattaagcaattgtgggcctctgtgccattcacaaagtgcacaagatgagaaccaggacttgactgaatatggaattc

SEQ ID NO: 6848036 - DNA, 130 bp, Homo sapiens
gacttgcactcattgactgttttctgaaaggaaattcttttaagatactgttatggataaagtgaatgagttgtcaaagcatggttttgaaagacgttgtttgagtctgttttgtgagtaagacactgtc

SEQ ID NO: 6848037 - DNA, 89 bp, Homo sapiens
gggaggcagaggtgggaggatcatttaaggccaggagctcactcaaggtcagcctggccaacatagtgggacccccacctctctctctc

SEQ ID NO: 6848038 - DNA, 104 bp, Homo sapiens
atgattgagtttgtactgtgtgccaggcacttgcccaggcttgaaggaaagagtgatgtttgagacagggtacgggctaggcacaaaacaagctggttggttat

SEQ ID NO: 6848039 - DNA, 64 bp, Homo sapiens
gtgagtttatgccctgccctatttttgctgggaaggtatctgtggggttgagccataaatttac

SEQ ID NO: 6848040 - DNA, 69 bp, Homo sapiens
ggctgatgctgctttggggtttggaagtacagccccaacaactgggctgttcccacaccagcctcagcc

SEQ ID NO: 6848041 - DNA, 74 bp, Homo sapiens
aggatgacagggaaacattgaagtgtccttagtagaggagtgacattatcaggtttgttttctagcttaattct

SEQ ID NO: 6848042 - DNA, 65 bp, Homo sapiens
accagcctggccaacatggcaaaaccccatctctactaaaactacaaaacttggccgggcgtggt

SEQ ID NO: 6848043 - DNA, 80 bp, Homo sapiens
tgaaatgctgaggctgctgagagcaaggacaaagcattagacctcatgcttgtggggttgcttcagggtttagtatttca

SEQ ID NO: 6848044 - DNA, 79 bp, Homo sapiens
gaaagttttcatatataccaaagaccgcacgaattttcccaagtgcttatgttggtactttgtgctcagaagacatttc

SEQ ID NO: 6848045 - DNA, 69 bp, Homo sapiens
tctttcacatttctcagcactgatgaagtcacagaagcttgtctcgacagtgcagtagaaggtagaaga

SEQ ID NO: 6848046 - DNA, 61 bp, Homo sapiens
ctctgaactggaacttagttttttaaatcctgtctaggtaaattacctttccagtgcaggg

SEQ ID NO: 6848047 - DNA, 74 bp, Homo sapiens
gtccctgcgtcttatgcatattcataacacactgaaccctggtggttgtgagcgatggatggagcttcagggat

SEQ ID NO: 6848048 - DNA, 129 bp, Homo sapiens
tcatccatctttgtctaccatggacttatagtttttaaagctgaactccagaaagctacaatcctactttcatggagtcctagtattggaaacataagaggaggcctcgcatggctaggagatggaaga

SEQ ID NO: 6848049 - DNA, 75 bp, Homo sapiens
gctgcgatcctctctgtgacagggaacggctcgggaaacgcttggcgcgttccctcctgccacgggaggagcagc

SEQ ID NO: 6848050 - DNA, 66 bp, Homo sapiens
tttcagacatgtttctgacttttagataattaacaaatcctctgaagaaaaggagcaggcctgaga

SEQ ID NO: 6848051 - DNA, 67 bp, Homo sapiens
ggcagcttccttggttttatcttaagattctttgcaagagcaaactgtgaggccgggaagcacagcc

SEQ ID NO: 6848052 - DNA, 65 bp, Homo sapiens
ttgtgcccaaggaggaggctgcagtgagccaagatcatgccactgcactccatcctgggcaacag

SEQ ID NO: 6848053 - DNA, 77 bp, Homo sapiens
gttcagagtcagctagtctccttctttgcttgggggtgagggctgggtaaagagggggtgactggtcagccttgggc

SEQ ID NO: 6848054 - DNA, 72 bp, Homo sapiens
taaaggggctttattacagaatttagtcaattttcctgctattcccacttcattccagtataagcctctttg

SEQ ID NO: 6848055 - DNA, 61 bp, Homo sapiens
ctttgccagcctcctgatatcatccccagctacaaactcagggatgaagaggcaggcatag

SEQ ID NO: 6848056 - DNA, 89 bp, Homo sapiens
gcgcttgtctctgaggcatctgcagagcttggtgatctgcccaggaatgagctcatacattctgcagattccagggaacagacaagagc

SEQ ID NO: 6848057 - DNA, 55 bp, Homo sapiens
gcagaactgtgctagaattcatttagtcttctgagttctattgggtaggttctgt

SEQ ID NO: 6848058 - DNA, 63 bp, Homo sapiens
tggccagccataaaagaacccaagtttctcagctcataggccaggttcttcagtggttgtcta

SEQ ID NO: 6848059 - DNA, 84 bp, Homo sapiens
tccagtgagagtacagttgaaacaagtcaacttgtttagagtacagttagtacagttgacttgtttcaactgtactctcctgga

SEQ ID NO: 6848060 - DNA, 60 bp, Homo sapiens
gctcttgcccaccagtcagtggcttgttctgaggacaaggtggagaaagtggccaggagc

SEQ ID NO: 6848061 - DNA, 83 bp, Homo sapiens
tatgcgagttaatggtaacctcagaaacataatctttgaaagtcttcaaaaggtgagtctttctgggatgtctgaactgcatg

SEQ ID NO: 6848062 - DNA, 67 bp, Homo sapiens
actgtgtacaagtcacttaaaataactcttttttcctctgggtaatgttactgatttgatatacagt

SEQ ID NO: 6848063 - DNA, 129 bp, Homo sapiens
tccatctttccctcagtgtcctgtgggcaagtgtcccagccccacaggcctgtgaaaaggcaccagcccctctcccaccggcctgtggggctgggacacttgcccacaggaccccgagggaaaggcaag

SEQ ID NO: 6848064 - DNA, 130 bp, Homo sapiens
gaggacagggcttctctggtggcttggagtccttgctgcttcactttttggagacaggacagatggagcccaggcgtaggataaataaaccaatgaaatctgagaaaacaatgtcctgctacttctcttc

SEQ ID NO: 6848065 - DNA, 75 bp, Homo sapiens
tcacctgacaggcttgctaagacatagatatctgggtcccacaaccagagtgctgatccaggaggtctgtcgtga

SEQ ID NO: 6848066 - DNA, 64 bp, Homo sapiens
ctctgggtcctggggctacaagctgttttcaccctcagccaccagcagcaacaggatcccaggg

SEQ ID NO: 6848067 - DNA, 90 bp, Homo sapiens
ttttggttagaattcttgttcacaatgccttgttgatggtattgcggaagcagccatcaaatcagagcattaatcttttctatgccagaa

SEQ ID NO: 6848068 - DNA, 88 bp, Homo sapiens
ggtggctgggatggcccaggtgcacccagaggccccagccctttggctgcctttgggttgtgacttgggttgtctctgaggccctgcc

SEQ ID NO: 6848069 - DNA, 58 bp, Homo sapiens
tccttgcttaaaaagaaatgaagtactggccaggacctcagagtctcaggagcaaggg

SEQ ID NO: 6848070 - DNA, 64 bp, Homo sapiens
cagtgtctccggcttttccatgctgatctgatgcctattttagatccatgtgggctggaaactg

SEQ ID NO: 6848071 - DNA, 76 bp, Homo sapiens
tcgcttgaaccctggaggcggaggttgcagtgagccgagatggcaccactgcactccagcctgggcaacaaagtga

SEQ ID NO: 6848072 - DNA, 104 bp, Homo sapiens
tccacacaggactgctgcctgggcctgaggaatgctcctgacttagcttggggaaggacaggaagtattcctgggacagcctgggtgggaccagttagggtgga

SEQ ID NO: 6848073 - DNA, 56 bp, Homo sapiens
ctgctgaccttcagggctgcttccatccctggtgggggccgtcctggggattatag

SEQ ID NO: 6848074 - DNA, 75 bp, Homo sapiens
ctgtgtgtcgcaaagtttgttttagtctaatgatttttatgaaagaagttgctgaaattaatattggagccatag

SEQ ID NO: 6848075 - DNA, 82 bp, Homo sapiens
cttccagaagacctaagatacatggggcctgggtcagcctggcaacatgaggtctccaggccaatgtagcaggccctggagg

SEQ ID NO: 6848076 - DNA, 79 bp, Homo sapiens
ccatgatcagatggtggcaagagccaagtcttctcacataaagagaaatcacattgaatctgctacctacgaccactgg

SEQ ID NO: 6848077 - DNA, 68 bp, Homo sapiens
gaaaaagtgatttgctgttcccaactgaaatcacagctgggatgtttacacagaaattagttattttc

SEQ ID NO: 6848078 - DNA, 86 bp, Homo sapiens
ggattttctactaactgaaaatgtctagaatctagaatatttcacaatgaatgtttcagagcactgggcttatcttttgggaatct

SEQ ID NO: 6848079 - DNA, 70 bp, Homo sapiens
tgctgttattcatcctttggtatttgttttgtctcaccccagctataccaaaggctcctgaagaactgta

SEQ ID NO: 6848080 - DNA, 82 bp, Homo sapiens
gtctaatagcataaaatttgctactgttaaataaatgcttatcccctgcataatttacaggtagaattttaagtaattggat

SEQ ID NO: 6848081 - DNA, 79 bp, Homo sapiens
ctggtgcacatcagaattacttggggagcttgttaaaacacaggatactaagccaccccaatagttcctgatccactag

SEQ ID NO: 6848082 - DNA, 73 bp, Homo sapiens
ttgttctgtgccatctgcactctcgtctatgtggcagagccaagccttgatgagagagcagaggacaggccaa

SEQ ID NO: 6848083 - DNA, 90 bp, Homo sapiens
tggccacttccctcctctgcacggggcctctgctgggccgtggtggtgcccacagctggccccacagtagaggcaggcagagggtggcca

SEQ ID NO: 6848084 - DNA, 67 bp, Homo sapiens
gtgctaatgaattggagtgcctctcatatacaaatttaatttgaaggctttcaattacttttagcat

SEQ ID NO: 6848085 - DNA, 82 bp, Homo sapiens
agcacacacagggcacttctaagcatggggctctgtgcacctgcctgggttgcatgccagaagccagccctgtctcagtgct

SEQ ID NO: 6848086 - DNA, 76 bp, Homo sapiens
tgggagttagaaggcggcccccaggtttcagagtttctccttaagctgagataaatccagctccttctaacttcca

SEQ ID NO: 6848087 - DNA, 129 bp, Homo sapiens
aaggaggatgaaaaatcaggagctgtcaacaaccgcctggtaaccctgggtcggcaccattttctagttgcttgcaatcaaggattgtgtgattccagaggttattcctggccagctcccatcttcctt

SEQ ID NO: 6848088 - DNA, 79 bp, Homo sapiens
tacacacgctttacatttttttcctaagtgataattcaaaatcccagtgggaatgtagaatgtaaaccatgtgtgtgta

SEQ ID NO: 6848089 - DNA, 129 bp, Homo sapiens
atagggtttcaccatgttggccaggctggtctcgaactcctgaccttgtgatccacccgccttggcctcccaaagtgctaggattacaagcgtgagccaccatgcctggccaagatgtttcatttttgt

SEQ ID NO: 6848090 - DNA, 72 bp, Homo sapiens
cagtttggaagacaggtacttaatggactatagcctcctcggcaatgtctgggagacctgtgatataaagtg

SEQ ID NO: 6848091 - DNA, 75 bp, Homo sapiens
aaagatacacacaggggctctgagattgtctaaggttgtaaagaatcagaattagaactcaagcaccctatcttt

SEQ ID NO: 6848092 - DNA, 56 bp, Homo sapiens
ccaccctggacaggcctctgagggccatgtctcctcccggggctattccagggtgg

SEQ ID NO: 6848093 - DNA, 77 bp, Homo sapiens
gccattcaaaattacatgtacaaacaattcttaatgccatgagaagctgcttgtgctgtattgttaggtgaagtggc

SEQ ID NO: 6848094 - DNA, 59 bp, Homo sapiens
catgttcatcagatcaattgtaatgaaatacaaatttatgaaattgtctgttgaatatg

SEQ ID NO: 6848095 - DNA, 64 bp, Homo sapiens
agctcattaaggctggacaaggcttggggactgtattaagctgcaggtttgtctagtctgggct

SEQ ID NO: 6848096 - DNA, 88 bp, Homo sapiens
cacaccctgcattcacgttgcttcctttctgttacactattgattctttctcttggcagctgaggggaggctttgatgtggggatgtg

SEQ ID NO: 6848097 - DNA, 95 bp, Homo sapiens
cccaagtgagcaggagatagaggctgtagccagtactggtgtttttggtagtagaggctccttcactctggcaccgcctccttgcatagttgagg

SEQ ID NO: 6848098 - DNA, 59 bp, Homo sapiens
agcacggggcgccggtcatccctgagctgatgtcagggcagcctaaggcacctcaggct

SEQ ID NO: 6848099 - DNA, 64 bp, Homo sapiens
gtggaaagagactggaaactagggtcacatacttctctgtgacagtgagtgccagtttacctac

SEQ ID NO: 6848100 - DNA, 81 bp, Homo sapiens
gttagaatggtgagagtcttgtggtcccaggttgcccaggactaaagggttggctgctacacagggctttcagtattaaac

SEQ ID NO: 6848101 - DNA, 58 bp, Homo sapiens
gtgtgcctgagaggatggggcccctctgcagagggcctgggatgtcctcctaggccac

SEQ ID NO: 6848102 - DNA, 71 bp, Homo sapiens
gctctgggccacatcagatgaagacacgcagcctcctgtttagtcttctggattgatcgtggtaaagcagc

SEQ ID NO: 6848103 - DNA, 123 bp, Homo sapiens
tttggtaagtaattcagggagaataaattatcaccagacttgggttttggtaacttaagtgttaaagttagcaaataccacaatctgcatttgatttctgtgcttttcctgttatttaccaag

SEQ ID NO: 6848104 - DNA, 127 bp, Homo sapiens
gaacagctcagttctggcacagatcttagggggcgcaaggcagagccgcccctggggcctgccccgcctaggcctgcagacgtgttttcctcagccccaccggagctcactgcgagggtagcttttc

SEQ ID NO: 6848105 - DNA, 86 bp, Homo sapiens
acagctgggaagtgatggagccaggatttaattccagacaatgaggctttgggatcctggagctccatcactatttcatctgctgt

SEQ ID NO: 6848106 - DNA, 130 bp, Homo sapiens
gattaataatgaatgttttattaatagttcatcttataattgtaagtgctgagttaagggaaatttgatagcttttcctgcacttgatcttacagtcaagagccacattttaaaatccattgctctaatt

SEQ ID NO: 6848107 - DNA, 64 bp, Homo sapiens
ttacacttccagtgcataggtagatcatttctatatgctatctagaaatactgggttttggtaa

SEQ ID NO: 6848108 - DNA, 55 bp, Homo sapiens
cagcctggctgtaacctcatggtcacaaagatggctgccgtaacagctaaggctg

SEQ ID NO: 6848109 - DNA, 66 bp, Homo sapiens
ttagcctagcaggtcaaaccagctgatgactagccagctccaattactgacctgacctgcttctaa

SEQ ID NO: 6848110 - DNA, 62 bp, Homo sapiens
ttgtgtaccatgaaagctgccttgcccccactctggggctgttgtagactttggttatgcag

SEQ ID NO: 6848111 - DNA, 64 bp, Homo sapiens
gagcaatgcccttcaccagcccctgtatggataggaagcaggggctggagaggaggttttggtc

SEQ ID NO: 6848112 - DNA, 81 bp, Homo sapiens
gagggggagaggggaacttgttgcttgcaacccattggccatcaatggctgagtgaccagaagtccccctcctgtaccctc

SEQ ID NO: 6848113 - DNA, 80 bp, Homo sapiens
gtcacagaagaagaccaaaggacctgggcagcacagggagcagagtgcctgtcctgggggtggtccttgcttttgtgcac

SEQ ID NO: 6848114 - DNA, 81 bp, Homo sapiens
ttatctaacagtcattcatagaatcagtttgggaaggggaattttcactgaactctcatagagaaactgtgttttagataa

SEQ ID NO: 6848115 - DNA, 67 bp, Homo sapiens
tggaatgcattgcctggataagcaggtcagagttcacagttgaaactgctcatgcaatgcatgtcca

SEQ ID NO: 6848116 - DNA, 55 bp, Homo sapiens
cctgttgagagagctcactgaggtcccagcacagaactcagcacttttacacagg

SEQ ID NO: 6848117 - DNA, 58 bp, Homo sapiens
tatagccatgtaagaactccattttcagtttcacgtagacagtccttacgaggctata

SEQ ID NO: 6848118 - DNA, 58 bp, Homo sapiens
ggataccattgcatgggtagctctgccaccctacacctgcctcagtgcagctggatct

SEQ ID NO: 6848119 - DNA, 72 bp, Homo sapiens
ccattcaaaatgctgtccattaactaggatggggccatctgttggagagagagggcagttcacgttgagtgg

SEQ ID NO: 6848120 - DNA, 83 bp, Homo sapiens
tgctctcttttctcctctttctggagctgagaccagccagtttctcagtcaccaatgggaggaggaaggataagggagagacg

SEQ ID NO: 6848121 - DNA, 67 bp, Homo sapiens
atggcattgggcaggatgacaccacttgtctaagtggcagtgtggtgtggttatgttgttgtgcgat

SEQ ID NO: 6848122 - DNA, 113 bp, Homo sapiens
attacaagcctgctgcctgcagtcatttgtctggcacagggaatatcaggatggattagatatggtcttgggcttaggcagagtgttgactggtggtgctgcgggttgctgat

SEQ ID NO: 6848123 - DNA, 87 bp, Homo sapiens
ctgcatctctcttctccctctgccataagaccaacacatcccagaaggggtggcttcttctgccagaaggaagaaaacagggagcag

SEQ ID NO: 6848124 - DNA, 91 bp, Homo sapiens
aaggagcatagagtccagcagttgtatgacaaaatttgccatatttagcaatgggctgagaatcaacaacctgctcctggattttgccttt

SEQ ID NO: 6848125 - DNA, 56 bp, Homo sapiens
aggcggtccactgtcccagtgggacctgacgtggcccagagtggacggtggcccct

SEQ ID NO: 6848126 - DNA, 76 bp, Homo sapiens
tcgctctgtcacccaggctggagtgcagtggggcgatcttggctcaccgcaacctccgcctcctgagtttaagcga

SEQ ID NO: 6848127 - DNA, 81 bp, Homo sapiens
tagactattgtattccaaaggtagggattactgaaaggccaacagacacctaaaagtgatcttttgcctttgatgcttcta

SEQ ID NO: 6848128 - DNA, 59 bp, Homo sapiens
tactgtgttgtgctgaaagggagaatggttgttttccctcacttgtgttcaatactgta

SEQ ID NO: 6848129 - DNA, 96 bp, Homo sapiens
tcttcagttttctgatttatttgtatacctgccagaagttttagaaaccacaatgcctggcatgttaaataagatcatagtgaagtttgctggaga

SEQ ID NO: 6848130 - DNA, 63 bp, Homo sapiens
tggtatgcagaataatggtcccctaaagatgtctacatcttgatctttggaatctgtgtatca

SEQ ID NO: 6848131 - DNA, 57 bp, Homo sapiens
tggatggcatgttgggctctgttcttggctgcatgcttaactgcccaatatccttca

SEQ ID NO: 6848132 - DNA, 57 bp, Homo sapiens
cgtccattccttaatgaatcaggccattccattcctggaggctgttagggagggacg

SEQ ID NO: 6848133 - DNA, 67 bp, Homo sapiens
cttttcactgtgatgtttaagagaatgtatgaacagtttacattttccttagaaatacattgatggg

SEQ ID NO: 6848134 - DNA, 81 bp, Homo sapiens
gggtggccctggcagggctggctaggtgcgttccctgcagaccacgggaagccctgtgcttgcctgggtcagggctaagct

SEQ ID NO: 6848135 - DNA, 113 bp, Homo sapiens
cccagcctgtcttggggtgaggatcgctgcccggaagcggggcactggggccccaacacagggggtttgcagtgtcagcttctgtgttcacctctccccttatcttaactggg

SEQ ID NO: 6848136 - DNA, 67 bp, Homo sapiens
ccagaggtttggggagatgagagctgagaacctgggggttggctgtcgctcacctccctttcctggg

SEQ ID NO: 6848137 - DNA, 99 bp, Homo sapiens
agttgtggagccccctgggcagtgagaaaggtcaggtttttgattggcaaagtaagcctcaagacatttttaattgctctttcctcctactagacaact

SEQ ID NO: 6848138 - DNA, 58 bp, Homo sapiens
gtccacttctgcctttctggatcgtgtgagtgtgtgagacagacagagagagatggat

SEQ ID NO: 6848139 - DNA, 80 bp, Homo sapiens
gacaataattgtggaaataatgtttgaaatattagggatataaaccagtcctgagagacagtgtttgtataattcctgtc

SEQ ID NO: 6848140 - DNA, 63 bp, Homo sapiens
ggcatgtacattgtgtactagcactgctcaacagaaacataatgtaagacacaaatgcaagcc

SEQ ID NO: 6848141 - DNA, 61 bp, Homo sapiens
caaggactgtgggaggaaatgctgtagagaagcaggcagggccctgaccacacaggccttg

SEQ ID NO: 6848142 - DNA, 88 bp, Homo sapiens
cttgaatggaatttggaagctaagataatttaagtaggtcccagtctcaacctcctcaaatatgttttacttgtgggtaacattttgg

SEQ ID NO: 6848143 - DNA, 70 bp, Homo sapiens
cttgagcccaggaggtggagctttcagtgagccatgattaagtcactgcactccatcctgggcaacagag

SEQ ID NO: 6848144 - DNA, 63 bp, Homo sapiens
ggctggagtcagcaaggacgaggcctaggacagggagcccagcctccgccttcctgtctcccc

SEQ ID NO: 6848145 - DNA, 79 bp, Homo sapiens
acattttagcaccaaacatatactcagtcagcaccagagactgctcactagagaagagtgttatgtgtgctgtgaatgt

SEQ ID NO: 6848146 - DNA, 57 bp, Homo sapiens
gtgaggcccagagagggccacagcaccaaagccagagaaggccttctctgccctcac

SEQ ID NO: 6848147 - DNA, 83 bp, Homo sapiens
ctgagcttagcaatggagaagcagcttcttgatgaagccccatcctgtgggttccatcaaagaaatttccaaagttgaggcag

SEQ ID NO: 6848148 - DNA, 73 bp, Homo sapiens
aactgatgtttttactattgtccttcgataatttatcagagtcagtgtcagtgctatagtgggaatatctgtt

SEQ ID NO: 6848149 - DNA, 64 bp, Homo sapiens
tctcagaagaacccagggtcccatggctggcctgtcaggttgtagagcctttgttcttctgagg

SEQ ID NO: 6848150 - DNA, 71 bp, Homo sapiens
gcagaggtctggggaagtcagggcatcaggctgagagagccctctgcagtcttgtttccccaggctggggc

SEQ ID NO: 6848151 - DNA, 71 bp, Homo sapiens
ctatgagggagtgtgaggcttcaaggaacaggaaacttactgctcctcagagactgcatcttccctcatgg

SEQ ID NO: 6848152 - DNA, 59 bp, Homo sapiens
gggaaagcaggcacataacttgccatggactacaggctagattttggcattgctctcct

SEQ ID NO: 6848153 - DNA, 63 bp, Homo sapiens
ggtgactctctgtaattttgtcttcaaagggaccagtctcagagatactttacagtgattgcc

SEQ ID NO: 6848154 - DNA, 62 bp, Homo sapiens
cccttggaatccataaatgtcagatttggaagggatgtccaaaatcaactggattctactgg

SEQ ID NO: 6848155 - DNA, 99 bp, Homo sapiens
ctctgagcctcagtttcctaggctgtaaaatgaacctagtcatcccttggttgtaggaatgatgagtagggatattttgtggcgaggctgggcccagag

SEQ ID NO: 6848156 - DNA, 55 bp, Homo sapiens
caacggctctggcttccaggcggccgggacgcggtcccaggactggagaccgttg

SEQ ID NO: 6848157 - DNA, 83 bp, Homo sapiens
atggttgttcagctgttagtcaaatcagttgagacattcaaacattgtctatttgatttcttctgacaacggagcatcaccat

SEQ ID NO: 6848158 - DNA, 55 bp, Homo sapiens
aggatcttgctatgttggccaggctagtctcagattcctggcctcaagcagtcct

SEQ ID NO: 6848159 - DNA, 90 bp, Homo sapiens
cgccgagacaactgggagaggcgcgggactcgcccgttccgcggaacgccgggaaggggtcacctcctgatgaagtttccggttccggtg

SEQ ID NO: 6848160 - DNA, 127 bp, Homo sapiens
cctttgtttaaacctacttaatattaatatttcatatggaaattagaaaactatataggttctggaaatcttagaatcattatatttattaagcacagtgaaatgttgatagatgggaaacgagtgg

SEQ ID NO: 6848161 - DNA, 129 bp, Homo sapiens
catggaatgtcatcttggcatccactactgttaatataggaggatgagtggttttacggaaggaactgtctttgtttaggaaattctcttgctaagttactagtggggaagcgagggctcaggccaatg

SEQ ID NO: 6848162 - DNA, 62 bp, Homo sapiens
tagatttttaaaaggtggctctggatgcataagagtagaagcagaggccagttaggagtcta

SEQ ID NO: 6848163 - DNA, 71 bp, Homo sapiens
cagacagtctttcaaagaaaagatcacttcatttttgaagtgataagctactttctgtgaggactgtactg

SEQ ID NO: 6848164 - DNA, 85 bp, Homo sapiens
ggttaaatttgaattgagatctgcatcataagctcagaaacactgagtgtatgcaggttttcaatgtttttctattatttatgcc

SEQ ID NO: 6848165 - DNA, 72 bp, Homo sapiens
attttctccttagagaattcacagtaatttagtttattttgtgaagttctgtgagtactttaacgagagagt

SEQ ID NO: 6848166 - DNA, 64 bp, Homo sapiens
tggcagctcatgcctgtaatcccagcacttagggaggaagagctgggaagatagcttgagccca

SEQ ID NO: 6848167 - DNA, 61 bp, Homo sapiens
cagtgagtccaagatggctgaatgagagcaggtgttctgacttcaggtgtgggctgcaatg

SEQ ID NO: 6848168 - DNA, 57 bp, Homo sapiens
cctggtgccggtagacgcgcagaaattccacctgtgcgcgctgcccggcgcccctgg

SEQ ID NO: 6848169 - DNA, 56 bp, Homo sapiens
tgtggtcattctctgtcttcacaccctcctgcagaagacaccagagactggcctca

SEQ ID NO: 6848170 - DNA, 55 bp, Homo sapiens
gcctgagattggacattatttaaaagcaatttggagagttttctccatttcaggc

SEQ ID NO: 6848171 - DNA, 105 bp, Homo sapiens
cagtgagggcctcagttttgctgacttagtaactctttctgctggagtgatctgaggagcagtcttgagggatgctagagttgataatctctgaagtcctttctg

SEQ ID NO: 6848172 - DNA, 58 bp, Homo sapiens
cagcatggggctgcaagctgcaatccctgggtccaggctgctgctttgccactagttg

SEQ ID NO: 6848173 - DNA, 86 bp, Homo sapiens
gagcactctcatagttccttaagatcagaactttatacaggaaaaagttccctttacataaagtttgatttggctggagaaagctt

SEQ ID NO: 6848174 - DNA, 65 bp, Homo sapiens
agcttggaggagacaggactcagaaagcatggcagagcgtctttcgatcaagggtcccttcagct

SEQ ID NO: 6848175 - DNA, 89 bp, Homo sapiens
ttactccagaattataatcatacctcaggcctgtcattgtatcatgccctctacagatgatgaccatgggaatggattctggtcagtgg

SEQ ID NO: 6848176 - DNA, 113 bp, Homo sapiens
gatctatagcaagcaaatcatcggtttttattctgcatgtaggtttgctcacttaaccaaagtactgccatgtcagaataaacaagaactaaatggtaatgattgttaggatt

SEQ ID NO: 6848177 - DNA, 66 bp, Homo sapiens
gaccactcagtactaattgaacacctggtacatgcccatgcttgatgtgagaagagtactgaggtc

SEQ ID NO: 6848178 - DNA, 65 bp, Homo sapiens
ttcagctgaaaaagctacataatattgggctggtgcaaaagtaattgtggtttttgccagttgaa

SEQ ID NO: 6848179 - DNA, 70 bp, Homo sapiens
aggttcaagtgtaagaggggttaaatttagccttttagagctgaaaccccagattaccacaaatgggcct

SEQ ID NO: 6848180 - DNA, 85 bp, Homo sapiens
attttgtggtttggatttacagcttgttttttatgcctttaaatttactgaataaaatgacaataaaagtccatgcctacaaagt

SEQ ID NO: 6848181 - DNA, 95 bp, Homo sapiens
ttgttgattattgatgtagtagtgttttttaattgctgcatgacagattactaccatcatagtggcttaagcaacacacattaattatttcacag

SEQ ID NO: 6848182 - DNA, 55 bp, Homo sapiens
tctgaacactgagtgtcatcacttgattttcagcatcaagcacactgtgtttaga

SEQ ID NO: 6848183 - DNA, 78 bp, Homo sapiens
ccataaataaactcccagtgtgatgaggttgctaaaaataacataataacattttaggctcttctaacactggtgtgg

SEQ ID NO: 6848184 - DNA, 107 bp, Homo sapiens
cagaacaggaagtcttctggtgtgttaatggaaataattttgccctctaataggaggtaaaagaaggtaagattactttcttagccaaccactgcttcctctatttg

SEQ ID NO: 6848185 - DNA, 55 bp, Homo sapiens
gaaaggcatcttcagtctctgagcttcccacgcacatttgctggaattgtctttc

SEQ ID NO: 6848186 - DNA, 57 bp, Homo sapiens
gcctgagctgcagcctcatgattcggttacgctggctgaattccaggcctgcagggc

SEQ ID NO: 6848187 - DNA, 77 bp, Homo sapiens
cccatggtcttctgaaggattttaaagtacattaaggaaacttgcagaaaatttctttggaatcttaggagtgtggg

SEQ ID NO: 6848188 - DNA, 75 bp, Homo sapiens
acatgctattctagccaaagaaggtatatttgtatagatataaaatctctacagatttttggctgggatatttgt

SEQ ID NO: 6848189 - DNA, 84 bp, Homo sapiens
gttttcagcatgaatgttactaggtgtaataattaaccctagcggggtgagttactgcctagtaacttgacaatcattgaggat

SEQ ID NO: 6848190 - DNA, 81 bp, Homo sapiens
agaaggggaaaagaaacgtaagtcaatttaacaagaaaaagataaatttttgtggggaaacactgtttcttttctcctttt

SEQ ID NO: 6848191 - DNA, 55 bp, Homo sapiens
ggtgttcctggacagcaagtgagtgacttgctcacaggcggtaattcagggaccc

SEQ ID NO: 6848192 - DNA, 129 bp, Homo sapiens
caaataacatcctttctcatcctttttttgaatgcagaactcttcattttggaactgtaaatttggcacttgtatgtcatttatcttcagaatttctgttaatggaagcaaatgaggaggagattatgg

SEQ ID NO: 6848193 - DNA, 56 bp, Homo sapiens
agcgattcacacactgggctgtgatttcatgcccactgctcagtctcctgattgct

SEQ ID NO: 6848194 - DNA, 57 bp, Homo sapiens
ctccagggagctgcgggagccacatgcaggcccctcaccttcagttcccaatggcag

SEQ ID NO: 6848195 - DNA, 67 bp, Homo sapiens
gcatcacatatttaagaaacatgttttcttgcaggttatcctgactgtttctcaaattatgtggtgc

SEQ ID NO: 6848196 - DNA, 68 bp, Homo sapiens
agtgtaattactttttagtcaaaggttggctctacaatgtaggattttgattttaaaatagtgacact

SEQ ID NO: 6848197 - DNA, 119 bp, Homo sapiens
ccctccatagagttgaacttcctctctttttagaagaatggatttctcggagtctgaaaaatttatggttcttctctggaagaattttattttaaaggtaagttgaactacctataggg

SEQ ID NO: 6848198 - DNA, 67 bp, Homo sapiens
tcccagtgatgaacctaggactgtaggctctaacttggaagtcagctacaagttcattcactaggga

SEQ ID NO: 6848199 - DNA, 66 bp, Homo sapiens
gggggggccttgatggagttcccagtgccaaaggatagagagctgaatggacccagggcctcaccc

SEQ ID NO: 6848200 - DNA, 96 bp, Homo sapiens
cacacagccccagattaaatgtgggaaccagcagagtggggtttagagtcaggcagcccagattcaatcccagctctgctacttcctggctgtgtg

SEQ ID NO: 6848201 - DNA, 59 bp, Homo sapiens
cactgactaagtttgtgaaggtgcagatagtataactacatcataaactgggcacagtg

SEQ ID NO: 6848202 - DNA, 68 bp, Homo sapiens
gagccggagccggcgaaggagcggaaggagcagctccagctccagctccagctccggctccgaagctt

SEQ ID NO: 6848203 - DNA, 79 bp, Homo sapiens
agaaaaacataatttctgtatcagcaccatgcgctaaccaattgcgccactggagctccactggaaaaatgtaatttct

SEQ ID NO: 6848204 - DNA, 81 bp, Homo sapiens
ttgaatcatctgcaaatattagcttagacatatatcctcttgtatgtcactgcctttattctgtccagtatgacgtgtcaa

SEQ ID NO: 6848205 - DNA, 91 bp, Homo sapiens
gtcaatactgctggactgaaactggtaagaatgtgatgattatacatcattgtgtcctaacatctagttaaagttctgaggcactattgac

SEQ ID NO: 6848206 - DNA, 96 bp, Homo sapiens
agtcagaggatcacttgagctcgggaggtcgaggctgcagtgaaccatggtggcaccactgcactccagcccgagcaacagagtgagaccctgtct

SEQ ID NO: 6848207 - DNA, 71 bp, Homo sapiens
tagacgctataaaggaatgaaaaggatgtctggaatttgtcaggttcttaacttgttcttcctagcttcta

SEQ ID NO: 6848208 - DNA, 56 bp, Homo sapiens
agagctccctaaagcgaggtggtcatactatagatgccaggactgctggggactct

SEQ ID NO: 6848209 - DNA, 78 bp, Homo sapiens
ccctctggtcagaggccggccgagcccatgggcggtgaggttggtgcctggggtcgtggctggtctggtacaggtggg

SEQ ID NO: 6848210 - DNA, 109 bp, Homo sapiens
gtctacaaggtattagattggtgcaaaagtaattgcggttttggccatcacttttatggtaaaaaccacaattccttttacgtcaacctaatacttaatttttgtggac

SEQ ID NO: 6848211 - DNA, 76 bp, Homo sapiens
agtgggggttttccagcttagagcatcatgtttacctgctcgcggggacatggaatgagatggaatgtcctctcct

SEQ ID NO: 6848212 - DNA, 80 bp, Homo sapiens
gtgttaaggggatgcctagtggagtctccacgctggacaaaaaggcttctgagattcttatgggcattgtcccatagcac

SEQ ID NO: 6848213 - DNA, 57 bp, Homo sapiens
cacactctaattcctgtggggaacataaaacagcacttttacacagttatgggtgtg

SEQ ID NO: 6848214 - DNA, 76 bp, Homo sapiens
tctttccatattgtactctttggaggaaagtcacacatatgtgcagcccactcttaaggaatgcagaatgggaaga

SEQ ID NO: 6848215 - DNA, 59 bp, Homo sapiens
acccaggctggagtgcagtggcgccatctccggctcactgcaagctccacctcccgggt

SEQ ID NO: 6848216 - DNA, 66 bp, Homo sapiens
aacatttcataacttgacttttctctggactatattccaatgagattttcatgtggtgcagatgtt

SEQ ID NO: 6848217 - DNA, 57 bp, Homo sapiens
ggaggtggcagggaacataatttctgtttgaaagttcttttgttttctgctaccttt

SEQ ID NO: 6848218 - DNA, 79 bp, Homo sapiens
cctggatttccacagaagttttgctctcttgggtccctcttgggtctcctgtgctctgagtgcatgcttttgggccagg

SEQ ID NO: 6848219 - DNA, 56 bp, Homo sapiens
cagaagcagctgatctcgcgagcccgccccctgctcggcgagaacagagcttactg

SEQ ID NO: 6848220 - DNA, 129 bp, Homo sapiens
acttattcacggtgcgtacaggtagtaaatgtaggagtcagaacatatattttgtgatgtctgatcccagcgtcatgttattagatgtggttctgctttctaactcacaatctactagtgtgaacagat

SEQ ID NO: 6848221 - DNA, 62 bp, Homo sapiens
gtgagaataccagcagtgagaaaatcatagccatgctgaattcattactgcggtagtcacac

SEQ ID NO: 6848222 - DNA, 59 bp, Homo sapiens
tcctcaggatgtggagtagaatctggttgtggttttgctttgtactttcctgataagga

SEQ ID NO: 6848223 - DNA, 83 bp, Homo sapiens
taaagagagaagattttaagcttgaaacactaaagctgttctaaaagaaaatagtgctttaagtttacagagaaaacttttta

SEQ ID NO: 6848224 - DNA, 61 bp, Homo sapiens
attggcttatcatctaaggccctttcatgattaatgagagagggaaagaaaatgagctaat

SEQ ID NO: 6848225 - DNA, 72 bp, Homo sapiens
agtgtaatagtgtgggcagcttccacttagttaggtacttctggacaaatggaagcttgtctgcatgcagct

SEQ ID NO: 6848226 - DNA, 79 bp, Homo sapiens
ttgctaagggcaaaatattcagaagcaggtttcactgtcgaaacatgctatgttttggataatttcctttgtcctgtga

SEQ ID NO: 6848227 - DNA, 75 bp, Homo sapiens
gctggagggtagggacagaggagaagatgctgtgggtcgaggcccagggctctgcttctgccatgactctgcagc

SEQ ID NO: 6848228 - DNA, 55 bp, Homo sapiens
gcagtagcagtatccagaagcagtcttcatgttctctctggttcatttctgctgt

SEQ ID NO: 6848229 - DNA, 78 bp, Homo sapiens
ttgaaacaagatccacagacttggctgaaatcatgggaaagattttggaacatcacaagtcatggattggagtttcag

SEQ ID NO: 6848230 - DNA, 78 bp, Homo sapiens
cctcataccccatccgtccaacctccggcgggcgccactgcttgtcctctggtcttcggtgtggacagataggagagg

SEQ ID NO: 6848231 - DNA, 59 bp, Homo sapiens
tctgactttggacagtggcgaagatgactacatgattcattgcaactgtaagaagcagg

SEQ ID NO: 6848232 - DNA, 83 bp, Homo sapiens
caagggattttacagttaccctggaaagaaatgatgtgtccctagcaatggcatttaatctgggtaatttgtaggtcttcatg

SEQ ID NO: 6848233 - DNA, 94 bp, Homo sapiens
gagacagagtttcactcttgttgcctaggctggaatgcagtggcgcaatctcggctcactgcagcctcccaggttcaagtgattctcctgcctc

SEQ ID NO: 6848234 - DNA, 94 bp, Homo sapiens
gcttggtgtcatagccgcagaagttagtgtctgccagtatctgatgaatatggtgacttgcagcctaatttttgtgaaattatgaggccaaagt

SEQ ID NO: 6848235 - DNA, 80 bp, Homo sapiens
gccaaagatagcttcagaattgagatatcttaaggaatgatctatgaaagttgtactcaatatctgactaataatttggc

SEQ ID NO: 6848236 - DNA, 62 bp, Homo sapiens
gggctgggatggcttgaagattagagctgccaatctgagtatcttcatgtggttctgtgtgt

SEQ ID NO: 6848237 - DNA, 64 bp, Homo sapiens
gagcaacagggcgaggagaactggaccctggttctggctctgggatgactttgccctgtggctt

SEQ ID NO: 6848238 - DNA, 65 bp, Homo sapiens
tgtcatcagctcttcattcttgatttttggttatatgttaatgaggacactagagcaggtgcaca

SEQ ID NO: 6848239 - DNA, 55 bp, Homo sapiens
cctgcttgatatttgtagtagggaaaggtgatctttactaaacaaaacatgcagg

SEQ ID NO: 6848240 - DNA, 71 bp, Homo sapiens
aaacatgttgtctattatgtgactccgtgctgctggtaccattgttatttaaagtagacattttcatgttt

SEQ ID NO: 6848241 - DNA, 71 bp, Homo sapiens
cgctcatggaagagtagtgctttcagagatgagcaaaagctacatttacagagccttctctgcagggagtg

SEQ ID NO: 6848242 - DNA, 56 bp, Homo sapiens
aagcatgcaatctgtgataaggatgatttccttcctgcatcaacggagtggtgttt

SEQ ID NO: 6848243 - DNA, 112 bp, Homo sapiens
gttttaatattatctcattgcctgcaaggtccagtataacttaagagagaggaaattaatctttgaggttaagtttacttaccatttgatgtcagtgttgtgctataagaac

SEQ ID NO: 6848244 - DNA, 56 bp, Homo sapiens
tttttgcttttttgtcatctaaagattaatgaacttcagatggcaaaatgcaaaga

SEQ ID NO: 6848245 - DNA, 58 bp, Homo sapiens
gaggcctgggttggaggtgcatttctttggatttgcattaatttttgccaggttcctc

SEQ ID NO: 6848246 - DNA, 123 bp, Homo sapiens
ggaaggtggtaccatctttccccagtggcagggtggaagatggcactatctttctgtggtggcggggtggaaggttttaccatctttccccagtggcagggtggaaggtggcaccatctctcc

SEQ ID NO: 6848247 - DNA, 84 bp, Homo sapiens
gtgtgcaccatctcaacctttgttcaagctactgatagcttctgtacactatacagtatcttttgaaggcagaatgtgacatat

SEQ ID NO: 6848248 - DNA, 84 bp, Homo sapiens
tggtatctgtgacaagaaacatgggtacagtctatgcatttgagaatctcagtgtttatggaaccctggtggtcacacgtgcca

SEQ ID NO: 6848249 - DNA, 65 bp, Homo sapiens
gaagaatacagcagatggagacaaatagatttgatttctatctccacaatatgcatgtatttttt

SEQ ID NO: 6848250 - DNA, 70 bp, Homo sapiens
ctccctgcttctagccttgtctctggctgttctccacaaggcagctacagggaactaaaagctaaaagag

SEQ ID NO: 6848251 - DNA, 61 bp, Homo sapiens
taacatgatattgtttgaggctaatggccaccatgtttgcctcctagcagtaaacatgtta

SEQ ID NO: 6848252 - DNA, 93 bp, Homo sapiens
ttactgctgctgcttggtttactaggattcaaattagaacagtatccttttgctgtaatttgtgtctggtggtgctcaattcagtttaggtag

SEQ ID NO: 6848253 - DNA, 71 bp, Homo sapiens
tttagatgtgcttggaaaagcagtggtggaaagaaaaccattcaaatattctccaagcaccatactctgag

SEQ ID NO: 6848254 - DNA, 61 bp, Homo sapiens
gtcagctaatagggtgtgtgtccatggcgtgctcagcccctcacaggccttgtgagcagac

SEQ ID NO: 6848255 - DNA, 60 bp, Homo sapiens
ttcctaagagattggcagtgttggccgctgatagctcaagactgcattcctttctgggaa

SEQ ID NO: 6848256 - DNA, 77 bp, Homo sapiens
cttccattgtcttcccaaatgtacctcttttagaagggcattctaggtgagggagcattgtgagaaaatacagggag

SEQ ID NO: 6848257 - DNA, 87 bp, Homo sapiens
tctgagattttgcctaggaacaagctttattcatgatttcagggatacaaattatcatgagtcatagtgaagcaggagaaatctgga

SEQ ID NO: 6848258 - DNA, 108 bp, Homo sapiens
gcctactctgtctttgtggtgctggttgtgcatttatgaagaagttcttattttggaagaacttcttgctcatgagtataaagcacattcttcgttttaaaagtaggc

SEQ ID NO: 6848259 - DNA, 58 bp, Homo sapiens
cctactttggtctcacttgaatgttgcaccaagcagctcaggctaattccaaggtagg

SEQ ID NO: 6848260 - DNA, 80 bp, Homo sapiens
tgcatcatatacccgtaactggaccaatcacagtggccagagggattggacacactgattggccaggcctgtgtcatgca

SEQ ID NO: 6848261 - DNA, 61 bp, Homo sapiens
ctcggctgcttgttggagagtgattggctgaagacttctttagcttccagctcaagctgag

SEQ ID NO: 6848262 - DNA, 78 bp, Homo sapiens
tgtttgaggtaattgcttagagaatccaggtaggagagacacttctgcctggattcccttagtaatgtagccaaaaca

SEQ ID NO: 6848263 - DNA, 87 bp, Homo sapiens
ggataacgcacatctgtgacccagaggctgactaacacatgcctgctgatggtctcatttctagggtctcaggtgctatgtaaatcc

SEQ ID NO: 6848264 - DNA, 89 bp, Homo sapiens
tatgtacactaaaacatatagatatatacaactatatttatttctgtagctatccatctatgtgtgtctgtgtgtgagagagtgacata

SEQ ID NO: 6848265 - DNA, 56 bp, Homo sapiens
tatttttcccccttccactgtctatttcaaaggggtggtggcagggaggaaatata

SEQ ID NO: 6848266 - DNA, 78 bp, Homo sapiens
agagcagtagcaggtggcggtggaggctccattatttcagaaagtgatggtctagtcaaattgccaaggctctgcact

SEQ ID NO: 6848267 - DNA, 75 bp, Homo sapiens
ctcaaacataaatatgcaaggcatcgaagcaattaccgttgccccatcctattcatgtttctgtgcatgtttgag

SEQ ID NO: 6848268 - DNA, 68 bp, Homo sapiens
atgtgcatgcacttacatgtgtggatatttgcatgtgtagtgacttgtacatatgagtgtgtgtgcat

SEQ ID NO: 6848269 - DNA, 66 bp, Homo sapiens
ccagatgcagggaacttgagagaggtgagccacacaggcctcttcagctaggatccctgcagctgg

SEQ ID NO: 6848270 - DNA, 78 bp, Homo sapiens
tgaccctgcagtcatctctgagatagaagcttatagtaaacttgccagcttactgacagagaacctggaactgcatca

SEQ ID NO: 6848271 - DNA, 58 bp, Homo sapiens
ggccttagtgaggtcctgatgcagccctggtgaggccctggggaggcctagtgaggcc

SEQ ID NO: 6848272 - DNA, 59 bp, Homo sapiens
tgctagtagaaggcaaagaaggctcgacctagatccaagcctgtgttttttctattgca

SEQ ID NO: 6848273 - DNA, 55 bp, Homo sapiens
gggatgaaggtctgcatgttaaggaagtctgaaagataaaatgggccttggtcct

SEQ ID NO: 6848274 - DNA, 64 bp, Homo sapiens
cagggcagtgaagaacacacgtgaccatggccatcagctggataacgactgtcatcgtgccctg

SEQ ID NO: 6848275 - DNA, 103 bp, Homo sapiens
tgtcttttaagagcttttgatacaatactgagtttacattcatctgttatttattgaacacttgctggtgaaaggcatcagtgttatctgctcttagggaaca

SEQ ID NO: 6848276 - DNA, 75 bp, Homo sapiens
gcactcatttactgtccccttggtaaccttcagctctactgggctggagggcagggggacgtctttgtgcagtgc

SEQ ID NO: 6848277 - DNA, 67 bp, Homo sapiens
gcagctggtctggcctagagtacctgccttcaattcactagctccttcttggccatcaagactctgc

SEQ ID NO: 6848278 - DNA, 61 bp, Homo sapiens
aatatttcatcatgcagtgctatttttaaaaagtgaggatggcattttccaatgatatgtt

SEQ ID NO: 6848279 - DNA, 67 bp, Homo sapiens
gggatgcatccatctttcctgctgaactgtgagcccatggtcaacaggcagggatgaaatgcatctt

SEQ ID NO: 6848280 - DNA, 75 bp, Homo sapiens
gagaaacttgagcttgctttcacaaaaatagatttttatgtttgattttatgattgagctggctacaggcaactc

SEQ ID NO: 6848281 - DNA, 66 bp, Homo sapiens
cttcatagtcctcagagttatttgaagtgaacattagttcagctccttatttctgagcatgtgaag

SEQ ID NO: 6848282 - DNA, 66 bp, Homo sapiens
cgaggagaccaggctggagttctgtagagtgtaaaatcctggatgtcctctcagcctgtctccttg

SEQ ID NO: 6848283 - DNA, 74 bp, Homo sapiens
ctggctcagctgtcacagcctggctctgacaaagcctcagaactcaattgccatgtgaagctggacttggccag

SEQ ID NO: 6848284 - DNA, 55 bp, Homo sapiens
tataaaattctcagtttggggtagatgacgctatggttaaaactggaattttgta

SEQ ID NO: 6848285 - DNA, 79 bp, Homo sapiens
gagcagtgaagacagaagtacaaacaaacaatcccctccccaaaatacagatagtggccagtactttgtttttattctc

SEQ ID NO: 6848286 - DNA, 89 bp, Homo sapiens
tagaagatcatggtgtcagcaggataggtttctttggaggcctctccttggcttgcagacggctgccttcttgctgtatctttcttcta

SEQ ID NO: 6848287 - DNA, 55 bp, Homo sapiens
acagagctcccagccatctcctccctgttctggaagactgatgggaagactctgt

SEQ ID NO: 6848288 - DNA, 67 bp, Homo sapiens
gaatttaattatagcattggagtggcctttgacaaatggctgctataaattttatggtaccaaattc

SEQ ID NO: 6848289 - DNA, 60 bp, Homo sapiens
ccccaagcctcatgtttgccagagttgcttagcttacattgtgtgcatgaggggatgggg

SEQ ID NO: 6848290 - DNA, 56 bp, Homo sapiens
gcccacaggtggaagcctcggaaggggttcctgagaggctgctccgcctgtgaggt

SEQ ID NO: 6848291 - DNA, 84 bp, Homo sapiens
tttggtaaccccaggaaaaggagactttagcactgagcacctcctccttcagctgccacgaggtttccttatccgtcctccaga

SEQ ID NO: 6848292 - DNA, 92 bp, Homo sapiens
tgcttctcctaaattctggggctggttattttgattaatattgagaagctgtgggaatgacttccctagaaatcttgactaggttagaagca

SEQ ID NO: 6848293 - DNA, 87 bp, Homo sapiens
cttgagatggagctggagagctagcctaggccaggatcatgaagaacctaattgtccaggctaaggatttttagttttgtcctaaag

SEQ ID NO: 6848294 - DNA, 66 bp, Homo sapiens
cattttccaaaataattgttactgagatagccagtattcctgcggtgactgtatctttggaaaatg

SEQ ID NO: 6848295 - DNA, 63 bp, Homo sapiens
tcagctgattgaataaagcagattaccctccataatgtgggtggaccttatccaatcagttga

SEQ ID NO: 6848296 - DNA, 60 bp, Homo sapiens
ctgcagttgaaaatgtaagcagaggatttatgaatttttctgctacttttcttactgtag

SEQ ID NO: 6848297 - DNA, 58 bp, Homo sapiens
tttaacacctgtagcaggataaagtaaaataatttttgtactgttatcatgtgttgag

SEQ ID NO: 6848298 - DNA, 66 bp, Homo sapiens
agcttctgctttcttgatggctgcctagaagggctggttagcacaaccaagaaatgcgggaaagct

SEQ ID NO: 6848299 - DNA, 64 bp, Homo sapiens
gtcgccaatggaggctggtctgcggcaagcaagtggaaagcaaacagtcctgccccttggggac

SEQ ID NO: 6848300 - DNA, 115 bp, Homo sapiens
cgggaaaggaattctgatctgttgaaatttgtctcctctgtgtgtcctgcactaaatgcccaaaccccagcatgggacttaatgcagagagggacacaggcagagtccaggcctg

SEQ ID NO: 6848301 - DNA, 85 bp, Homo sapiens
cttgacctgtgactattcaggctccatctggtactggtggttctcacaggataccggagcaagcctagaggggaatcaggaagag

SEQ ID NO: 6848302 - DNA, 60 bp, Homo sapiens
aagctttgataattggattactcacacactctgtgagtagctcttagaagtcagcagttt

SEQ ID NO: 6848303 - DNA, 60 bp, Homo sapiens
taagtgatttgtaaagctctgtactttttgagttctagtgcaaagttttattctcatttg

SEQ ID NO: 6848304 - DNA, 85 bp, Homo sapiens
ttatttttagtagtgggcttgtattgctgttttgcatctgcatttgtaagtagctttaaaaatccaatatccatgccaagaatga

SEQ ID NO: 6848305 - DNA, 56 bp, Homo sapiens
gggtggggcaggatattttggctgctttgggcggctcagctagcttggccccaccc

SEQ ID NO: 6848306 - DNA, 93 bp, Homo sapiens
aagccctgaataaatagtccctgcttattctcatttggttggacttcatttatttccacatgtagtaagcaggcaatgatagttttcatgctt

SEQ ID NO: 6848307 - DNA, 66 bp, Homo sapiens
ccttttccttcattcttcttgtcttatccttactgatagcataacaggtaagagtgagggttctgg

SEQ ID NO: 6848308 - DNA, 57 bp, Homo sapiens
tgacccaagggcttagcagtttcagcaccgactccagctcaactctctcctgggtta

SEQ ID NO: 6848309 - DNA, 88 bp, Homo sapiens
tctttctttagtatctcattggctgtgtgtctcctttccactcaaagggttggctgggaagctgcttagctaatgtagacagggaaga

SEQ ID NO: 6848310 - DNA, 99 bp, Homo sapiens
tgagacaggagaattgcttgaaccagggaggcggaggttgcagtgagccgagatcgtgccattgcactccagcctggggaacagagcaagactgtctca

SEQ ID NO: 6848311 - DNA, 94 bp, Homo sapiens
agattgtaactgagtttcagagacattcagtaaattatcccaaagtcatataggataaaacttaggtatgtcttggctccaaagttcacaattt

SEQ ID NO: 6848312 - DNA, 62 bp, Homo sapiens
cagccactgacaggaatggtccggtgaagagggacgggatgacttgctgatcagagggactg

SEQ ID NO: 6848313 - DNA, 84 bp, Homo sapiens
cctgctgctgtgaactgtatcctcagtcttctcctccaatggagccagctccctgaggatgaggctgatcatatatgcggtagg

SEQ ID NO: 6848314 - DNA, 130 bp, Homo sapiens
ggtctaaatgttctggtgctagatgaactccataattactcctagaatgcatttagttttatgtgagccttatctaagaatgttagatgcattttcaggatgaaaaagagtcaacagagcacatatatcc

SEQ ID NO: 6848315 - DNA, 83 bp, Homo sapiens
acatttcttttgttaggtacagctaaaaattatctgtctttatagaaaggattcttgactgctttgttgattaaaggaaatgt

SEQ ID NO: 6848316 - DNA, 61 bp, Homo sapiens
gtgtgtacgtatatatactgtgcatgcatatttgtgtgtgtgtacatacatatgtacacac

SEQ ID NO: 6848317 - DNA, 126 bp, Homo sapiens
gtgctggctggtagggtggtgtgggcagaggagctctgtgtagcctgagggttcctgagggagacaggcaggcttcggccagagcagttctgagaatggattccagtagtataatggcagcagcat

SEQ ID NO: 6848318 - DNA, 64 bp, Homo sapiens
gcaaccatttggaatgtaaaaacattcaacaaatgtaacattttctccgcattccagtgggagc

SEQ ID NO: 6848319 - DNA, 102 bp, Homo sapiens
tatcgtaatcagttttgactataagctgctgtcagtctgaatctgaaggttctcctcagtcatctctgacagctagcaagtgagcagagcacctcaatgatg

SEQ ID NO: 6848320 - DNA, 106 bp, Homo sapiens
gagacaatgaggaattcaggagctgctttaggttgagctcagctcctgtctcactttaggtgttgagccgaaggcactgaacacctcctgcaccttcccagatctt

SEQ ID NO: 6848321 - DNA, 62 bp, Homo sapiens
tcttcttaaagtatgttctctttttctcttaataccctaaggagcacaatattggaagaaga

SEQ ID NO: 6848322 - DNA, 58 bp, Homo sapiens
agctcctggtgcctcagccgaactcccttgcagaagagctgctgtggcacccggagct

SEQ ID NO: 6848323 - DNA, 79 bp, Homo sapiens
tccactttgtccacataggcatagtcaacccgtgagcccctctgggagacagaatgacagtgcatgtgacaaaggagga

SEQ ID NO: 6848324 - DNA, 68 bp, Homo sapiens
acccttcggactttggaaagtgggaagctcattgcagttttgggctggccttctgcagagttctgggt

SEQ ID NO: 6848325 - DNA, 59 bp, Homo sapiens
tcttaagaaagtgacaaataggggctttacatcagtttttaattgtctgccttttaaga

SEQ ID NO: 6848326 - DNA, 59 bp, Homo sapiens
aacactgtgcccaccctagtccttttcttaaatttgggcagagatccagggtataggtt

SEQ ID NO: 6848327 - DNA, 67 bp, Homo sapiens
aaattggaagctgtcattttttaaaacagtaagtcaatgagttacatgtgtgacagtatcactgttt

SEQ ID NO: 6848328 - DNA, 63 bp, Homo sapiens
ggcaggggtgaggccactctgaaaaacaaggccccccttgttgcaggcacactcattcctgct

SEQ ID NO: 6848329 - DNA, 76 bp, Homo sapiens
tcacttgagtctgggaggttgaggctgcagtgagtcgtgatcacgccactgcactgcagcctggccaaccgagtga

SEQ ID NO: 6848330 - DNA, 83 bp, Homo sapiens
tcttccccacagtgcttttagctgactgtgtgatttggccgttctttactgctcaatcatgtcactagggactttaggaaaga

SEQ ID NO: 6848331 - DNA, 96 bp, Homo sapiens
ttttgaaagctggttagttcatgagttttcatatagctgttgtcttcatttctgatgctggagcatgaagacttcagagctagctgtctagcagga

SEQ ID NO: 6848332 - DNA, 57 bp, Homo sapiens
acagttactgtatgtcaaagactctaatgacacatagtaggattccacagtgactgt

SEQ ID NO: 6848333 - DNA, 61 bp, Homo sapiens
ccggagaggttatgggtctcaaatgccagcctctgaggcatttggtcccctcacctcctgg

SEQ ID NO: 6848334 - DNA, 129 bp, Homo sapiens
ctccgttccgagcgcgctgcggttccgttccggaccgcgcatccgcccgccccgcgcaccgaggctccgcgcggcgcgcccccgggtgtgtcgttcgccggtaccaccgcagagcgcgggggaatgggg

SEQ ID NO: 6848335 - DNA, 101 bp, Homo sapiens
ggtgctgtctgggaaccgtcagtgctaggttgtgtccaggagccatcagtatcctgttgtatttggaaaccaccagtgccaggctgtttcctggctgcttc

SEQ ID NO: 6848336 - DNA, 64 bp, Homo sapiens
caggcggggcccccctgctgaccctctctctgggggtcttcctatggcggggccctattgcttg

SEQ ID NO: 6848337 - DNA, 62 bp, Homo sapiens
gaaacggtgatgaaaagtgcctttatccaggaagtcttccctgatggatttcaacacctttc

SEQ ID NO: 6848338 - DNA, 61 bp, Homo sapiens
cactcttccccaaacacacagtaattaaaattgccttatgtgtctgtttagggaggatgtg

SEQ ID NO: 6848339 - DNA, 66 bp, Homo sapiens
tctacttgtttctggagtccacctgactacagtatgtagattctcagaattttagaaacttatgga

SEQ ID NO: 6848340 - DNA, 87 bp, Homo sapiens
gtaggaaggcctttgagcccaggtggccttgccatctcctgctaaagtggtaggagtaggagtggccatccctcagaagtaacctgc

SEQ ID NO: 6848341 - DNA, 68 bp, Homo sapiens
cttccatgccaggcccgtgcacagcccccaaagcagctccatctgggctgtgcagcctgcggcaaaag

SEQ ID NO: 6848342 - DNA, 57 bp, Homo sapiens
tctccctatttgggtgttatctcccctgccagatcaccaatgcctcaaattgggaga

SEQ ID NO: 6848343 - DNA, 65 bp, Homo sapiens
ctgggaaagatgcaagcttctgttagccttcacctagctggaggcaactgaagatgtagtcccag

SEQ ID NO: 6848344 - DNA, 119 bp, Homo sapiens
tctggtttgcagatggctgtcttctagtgtgccctcacaaagtggaaagagagaggaagtaagccctctgtgtctttccctgtaagggcactaatgagggctccaccttcatgacctga

SEQ ID NO: 6848345 - DNA, 55 bp, Homo sapiens
tgaaagcagatagctctgttgttgcatatttgacttaatagagctactgctttta

SEQ ID NO: 6848346 - DNA, 59 bp, Homo sapiens
cctgggttaattctccggctttattggaggcagagaaagagaagaggaggaaacccagg

SEQ ID NO: 6848347 - DNA, 66 bp, Homo sapiens
agttctggctttgaccaagttcaagttcctgttccttaagcccctagaactgtccaagtctgagct

SEQ ID NO: 6848348 - DNA, 62 bp, Homo sapiens
gaggagtcgcgcgccggcagccggcccactcctgagggcgcgggctcagcgctcggctcctc

SEQ ID NO: 6848349 - DNA, 62 bp, Homo sapiens
gccaagacttgaacccaggcctgtcttcctctaaggcacaggctgaaagttaagttctgtgc

SEQ ID NO: 6848350 - DNA, 56 bp, Homo sapiens
ctgtaaaactgcttaagtatgctttttggggagacattgagcaaggcggtgaacag

SEQ ID NO: 6848351 - DNA, 65 bp, Homo sapiens
gcatcctaattctgaaacagtgtcaatccctggtttagactgatcttgttttagagttttaatgt

SEQ ID NO: 6848352 - DNA, 64 bp, Homo sapiens
tggcatttctggccatttgtgtctgtgacagtctctcagcccaggagtggtgcaggacctgcca

SEQ ID NO: 6848353 - DNA, 77 bp, Homo sapiens
ctggggcttttctttggggtctccagcataggtcgtgcccattcatatttgtttatggatctcccagagtcctccag

SEQ ID NO: 6848354 - DNA, 75 bp, Homo sapiens
tttggaagtgaattactcctcccagcaccattaagagatagccttgtgccctgaaagagttaattcacttccaga

SEQ ID NO: 6848355 - DNA, 89 bp, Homo sapiens
ccaggatggtcttgatctcttgacctcatgatccacctgccttggcctcccaaagtgctgggattatgggcatgagccaccgtgcctgg

SEQ ID NO: 6848356 - DNA, 87 bp, Homo sapiens
cccttcaccactgtagtgagctccatctgcccttggggcccccttcctgaacaagagagatgcagctcactcacacagtgggatggg

SEQ ID NO: 6848357 - DNA, 79 bp, Homo sapiens
tgcctattatttcacataatcctccagtggcagatgtctttatccctatttaccagggaaattaagtgatttgggggca

SEQ ID NO: 6848358 - DNA, 63 bp, Homo sapiens
agcaattttctaagcaaaatacctggtattaatgaccttgtgcaaattgctggaaaagctgct

SEQ ID NO: 6848359 - DNA, 55 bp, Homo sapiens
agaggggaatctggatcagtgaatttgaaaaccttgaatttctagattatcctct

SEQ ID NO: 6848360 - DNA, 73 bp, Homo sapiens
tttcttcacaaatttcagctccctgaaagttaggtaaatatctggagtttgagctgcagtttgcttgaggggg

SEQ ID NO: 6848361 - DNA, 78 bp, Homo sapiens
tgcctatttccagatgaggaaactgaggcacagagagcttaagtaacatgcccaaagtcactcagctaggaagtagca

SEQ ID NO: 6848362 - DNA, 100 bp, Homo sapiens
gataaatatccggagggcacactaaaatagtttagctctcatttcagccaacaggttttgaagtcagagcttgagctcttcctgcccccttgtgtttgtt

SEQ ID NO: 6848363 - DNA, 111 bp, Homo sapiens
agctggcgcatggtagatgctcataaatatttgttgagtgctttgaaaactgtgaacagttcccactagactgctacttaacagttatcaggatttatttgtgttcctgct

SEQ ID NO: 6848364 - DNA, 89 bp, Homo sapiens
atcagcttttgaccactcaggagttggtaatattgtggatttcgtagtttctattctataaccataccctgaaattcttgagagctggt

SEQ ID NO: 6848365 - DNA, 69 bp, Homo sapiens
ggggcagagaggaaggggttaggggtccctgagtcagctcaggcagccccgcccctccccacctcctcc

SEQ ID NO: 6848366 - DNA, 72 bp, Homo sapiens
tccattggagtcggctttccaggaaaccccctgcaccactgtagtacaggcaggagttcctggactccagga

SEQ ID NO: 6848367 - DNA, 57 bp, Homo sapiens
agaagactgagttcaaatcacagcctcttcctagctgtgtgacctgggcaagtctct

SEQ ID NO: 6848368 - DNA, 129 bp, Homo sapiens
ctcctaaagttgctaggttcttgtttacattcctgttagcatctaagcataaaagatataggatgtttcttgatgctgtatccttagatactaacagggatgaaaacaagaacctagcaactttaggag

SEQ ID NO: 6848369 - DNA, 87 bp, Homo sapiens
gaaaagcagaagtggctaacagtccttgcctctctctgcaggagaggaagaaggtgggcaagggagtggctgtgctatctgactttc

SEQ ID NO: 6848370 - DNA, 71 bp, Homo sapiens
agaaaaatgtggggatgagtcagtggggctccagacctctggccttccacaaatacactccacattgtttt

SEQ ID NO: 6848371 - DNA, 76 bp, Homo sapiens
ctgctgagtgggctcagcctcctcacttcgagccatgttgactgcctcgtggaggcaccgtgagctttctcagcgg

SEQ ID NO: 6848372 - DNA, 79 bp, Homo sapiens
gccttagtgcaaacattcaggagtacaggagccacgacccagattcaattgcctccttgtacttgaatgtttgcaaggt

SEQ ID NO: 6848373 - DNA, 82 bp, Homo sapiens
tctttaagcatgtcacagctcccattcctcctctcacacaagaaacttctgaggaaaaattaagtttgacatgaacaaaagg

SEQ ID NO: 6848374 - DNA, 86 bp, Homo sapiens
ctccagagcattgctggacatcctttggaaataaatgatgtgcaagatgtaatttctaccgtccagggatgccagccatgttggag

SEQ ID NO: 6848375 - DNA, 96 bp, Homo sapiens
ggaaggtgccagggagcagtgagggatcatgggcgtgggactctaactgcatcgccatctcagctgctggccccacatgctccaagcccacctttc

SEQ ID NO: 6848376 - DNA, 77 bp, Homo sapiens
ggcacctgtttgtttgtaactgacatgatctgatccacacactcgggtacaattaagtgcacaaatagtcatttgcc

SEQ ID NO: 6848377 - DNA, 68 bp, Homo sapiens
gaggtgggtggatcacctaaggtcaggagtttgagacaagcctggccaacgtggtgaaaccccatctc

SEQ ID NO: 6848378 - DNA, 116 bp, Homo sapiens
caggtgcctgtgagtgcagctgggaccctgccctgtggcctttggatcctgaagaatgtgctggatcatgaaccaggtgcaggggagggtgaagtcctgcagcagaaaggcatgtg

SEQ ID NO: 6848379 - DNA, 81 bp, Homo sapiens
tcttcccttggccttcagttatgtgccaaggacaatgagagggttctcagctgttgatggaagtgctgaagggagggagga

SEQ ID NO: 6848380 - DNA, 77 bp, Homo sapiens
cacatacttgctcatttgcctttaggttttctgttttcttaaacatacaaacatacaaaggaaagtaggaagttgtg

SEQ ID NO: 6848381 - DNA, 70 bp, Homo sapiens
cttttgtatgcagctcttttacccttgaatctgtggattatttttagattctaaaggctgaatatagaag

SEQ ID NO: 6848382 - DNA, 56 bp, Homo sapiens
ctgggcagtggtggcatctttggacactctgggttaagcagccatttacagcccag

SEQ ID NO: 6848383 - DNA, 118 bp, Homo sapiens
aacttctctccatctcactagtgaggatgaatgctgtcttcctctagggtagtggaggacaatcaggtcactgccagaagacagcttttcacactctcgctttcctcgagagaatgtt

SEQ ID NO: 6848384 - DNA, 82 bp, Homo sapiens
tttcccctgaattttttattggaaagttacttacaagttgctgaaacttacaagttccctttctcaggtagattgggtgaga

SEQ ID NO: 6848385 - DNA, 55 bp, Homo sapiens
gggctcgtctgtgaacaggttacatggaccctctctagacccagcagatgggctt

SEQ ID NO: 6848386 - DNA, 57 bp, Homo sapiens
gctgcagctgtaggacacaattaattatgctaatagtttgtgaggagcggatgtagc

SEQ ID NO: 6848387 - DNA, 95 bp, Homo sapiens
gctttgtctacctaaaaccttttagctctgtttgacagaagacctcaaataagagagctttaaacagagtctgaaatgtaaaggtctgagagagc

SEQ ID NO: 6848388 - DNA, 77 bp, Homo sapiens
ggggtccagttatgaataaatcaggttttcgttaatcaagattatgaaccttgatttgttcatctgctcttgatccc

SEQ ID NO: 6848389 - DNA, 99 bp, Homo sapiens
cctcttcaactgaaatatttaaaaagaatgattgcacgggaatgaaaacctcagaagttattactctttaacatatttgcaggaagttaaaggaagagg

SEQ ID NO: 6848390 - DNA, 100 bp, Homo sapiens
ttgagacagggtctctctctgtctcccaggcaggagtgcagtggcgcaatcacagctcactgcagcctctacctcctgggctcgagttatcctgtctcag

SEQ ID NO: 6848391 - DNA, 63 bp, Homo sapiens
gtcatctgagactatctagattttaaggaataccatcagtagatcacatagttatcagatgac

SEQ ID NO: 6848392 - DNA, 56 bp, Homo sapiens
aaagctgctgtgaatggtttggggtcttccacttctgtcgttcaactggctgcttt

SEQ ID NO: 6848393 - DNA, 58 bp, Homo sapiens
ggcagcaggagccatctggtaggtacgctgccactactcagactcacctctgcctgcc

SEQ ID NO: 6848394 - DNA, 130 bp, Homo sapiens
tccctagagcttttaagttattaatttttaaataacaatttaagttattgctaatgtgtctaaaggtaaaagctacagcgaaaatttagcttgattgcagttgaataaatggcttgattacttttaggga

SEQ ID NO: 6848395 - DNA, 58 bp, Homo sapiens
gcctgagagttgaagttcagtgtcacaaagccaagacttggaggattagcaatcaggc

SEQ ID NO: 6848396 - DNA, 97 bp, Homo sapiens
ttatgttcagaactcatctttgtccctgactttctatatgtagcacccgttttgtgtccaacccagggacaagtatgacactgtctctggaacatga

SEQ ID NO: 6848397 - DNA, 72 bp, Homo sapiens
gatagtgttaccattcctgggacctgcaccccatctgagggcaaacaggacctggaatgcttgtgaaatatt

SEQ ID NO: 6848398 - DNA, 55 bp, Homo sapiens
tagaatgaggcctgcatgcctgctctgcagagtccgggcagctcccctcattctg

SEQ ID NO: 6848399 - DNA, 60 bp, Homo sapiens
ggaggtggcagagggacattcttgcttgagttcatgctttagtttcctctcttactctcc

SEQ ID NO: 6848400 - DNA, 76 bp, Homo sapiens
attgtatcttgtcattatgcataaaaggccatatttttccctagttcttgatgcagatctgtgaaaggaatacaat

SEQ ID NO: 6848401 - DNA, 74 bp, Homo sapiens
tatctcatgctgtttgtgcctcaaatcctcttctgagtcaaacatgaagacaaactgggtagaaattgtagata

SEQ ID NO: 6848402 - DNA, 78 bp, Homo sapiens
ttagaagataatgacatcagaatggcatagaaaagttctcattcactttgcagtatttggatgtaatgtatcaactga

SEQ ID NO: 6848403 - DNA, 60 bp, Homo sapiens
gtggccagaggtcccatgtgtccacatgctgcatgtcccacactgaggaacctctgccac

SEQ ID NO: 6848404 - DNA, 69 bp, Homo sapiens
ccacaacaaaaccatttcaagtagttccttgtagagacatgacaattgccaggatgtggtttgtagtgg

SEQ ID NO: 6848405 - DNA, 57 bp, Homo sapiens
gggtgggcggtggttgaagatgtcatgtcactattttgagctctagatggccctccc

SEQ ID NO: 6848406 - DNA, 119 bp, Homo sapiens
ttccaagaaagatccatttttaaaagatgatttgctgacacttcagatcttgaatccaaggtgctgattcatgcagtttgaagttcagggaattgcttaaagttatagcttcctaggaa

SEQ ID NO: 6848407 - DNA, 66 bp, Homo sapiens
tcctgttctgatgtgttttagtttggtaatagcagctgttaaagagtctactgcacatcccaagga

SEQ ID NO: 6848408 - DNA, 56 bp, Homo sapiens
gtactttcaggctttcccttaactccatcgagaaggaagagggagtatgtgagtac

SEQ ID NO: 6848409 - DNA, 85 bp, Homo sapiens
ttctccttcctgctcctggaagcagctggtactgaggtcatccctggagccacaaagccctccctgcgccagagaggaaggggaa

SEQ ID NO: 6848410 - DNA, 56 bp, Homo sapiens
ctctcatagtgagtgtggtccaacattaaacgaagcatggggcatgattatgagag

SEQ ID NO: 6848411 - DNA, 91 bp, Homo sapiens
catatactcatatcacattggaccttcctgacaatcctatgagctaagcacattagttgcagctagaagattcactgtgctgtggtatatg

SEQ ID NO: 6848412 - DNA, 65 bp, Homo sapiens
tttccaggtggtttgataggataactcttcagagagtttaactttggaaaactatattctggaga

SEQ ID NO: 6848413 - DNA, 82 bp, Homo sapiens
gatgtctaaatgtaggtaagttcgtagatttgcttgcctttatgagaaggcctgagtctttagaattctaactttttacatc

SEQ ID NO: 6848414 - DNA, 102 bp, Homo sapiens
taacaaaccatccaaactgtagtgactcaaaacaaaagccatctattttacacattattatttaaggtggcaagctgggttgggtagccagtggttctgtta

SEQ ID NO: 6848415 - DNA, 59 bp, Homo sapiens
tctagcatctaattatggaatctttgttttagttagcaacaatttatgaagatgctgga

SEQ ID NO: 6848416 - DNA, 129 bp, Homo sapiens
gccggctgggcgctgggggcgggctggggactgcggagccctttgcagcttccaggagctcctgcttccaggagccacacaggggcgggcagccggttcccgcccttctcaggtgcgcacagccttggc

SEQ ID NO: 6848417 - DNA, 59 bp, Homo sapiens
aggaagcaatgttgaagaatttgtttgaaaaccagcacaggctcttaatcagtgctcct

SEQ ID NO: 6848418 - DNA, 97 bp, Homo sapiens
ggagcatggttgtatctgaagctctgtgtgtgtgcataaggaatataatataggctctccaaatgtttttcataccagtgttgggatttagccttcc

SEQ ID NO: 6848419 - DNA, 103 bp, Homo sapiens
gggagagagtgctttgatctctttttaaagtattttctgaaagcaaaagtctatcagaaggaagtgcctttaaaaaaaatctaagagaagcaaccgatcttcc

SEQ ID NO: 6848420 - DNA, 78 bp, Homo sapiens
ctactgggcaggagggctctatggagatgatgccacttcacatttaaaaatctttccatttcgcatcattgccctgag

SEQ ID NO: 6848421 - DNA, 59 bp, Homo sapiens
tgtttatttaacaggaagtctggagataggcatcctaggcctggcctggtggatcaaca

SEQ ID NO: 6848422 - DNA, 130 bp, Homo sapiens
ccctcctcactggtagggcccgcacaaagtccacagggctgaggctggcttcttgaactgagctctttgtgaggagccttcctttctggggctctgctgccatctagtggaagacatgcacaaggttggg

SEQ ID NO: 6848423 - DNA, 79 bp, Homo sapiens
gtggcagttgattggaagaggaaggagactcttggggatcacagtttaactcccttctttcccttccagcagctcccac

SEQ ID NO: 6848424 - DNA, 78 bp, Homo sapiens
atagatatcactgttatctagaagcacattaatatgattttaaaaaatggtttggtttctagatatatagtgaactat

SEQ ID NO: 6848425 - DNA, 94 bp, Homo sapiens
gaggcaaaactgtggcctgggtcctggacttggggaggctagattcttgtaacacaagaacctccctgtgtcctccctcccacagcccaacctt

SEQ ID NO: 6848426 - DNA, 127 bp, Homo sapiens
gtgtgcctggccaatataatgtgtggcaggttcctcacatccttcttgggccaggcggggtgccttcgctagggcactgcagcctcagatggtggtagcacctgcccccatgtatggatcaggccac

SEQ ID NO: 6848427 - DNA, 68 bp, Homo sapiens
agagatgtttcctctgagagcaggatatatgtttcttcctatcataaactctgcctcagaagagctct

SEQ ID NO: 6848428 - DNA, 70 bp, Homo sapiens
taaatgcctgtagaacacttagatcagtacctaacatgattagccttggtaagtctttcataggcaattg

SEQ ID NO: 6848429 - DNA, 78 bp, Homo sapiens
taggatggtgcaaaagtaatcatggttttagccatggaaagtaagggcaaaaactgcagttacttttgcaccaaccta

SEQ ID NO: 6848430 - DNA, 68 bp, Homo sapiens
tattattggaatgtttttaggaatgttatgaataaggtaatgtatgagatcctggagacacaatgatg

SEQ ID NO: 6848431 - DNA, 62 bp, Homo sapiens
atgagtggctgcatcggggtgaccagggacttcaagtccctggggctcattgcagtagccat

SEQ ID NO: 6848432 - DNA, 99 bp, Homo sapiens
tcagcttgcccgccttcaccccagataggttcatgccctactggtggactaatccagtatatctagatcactgtttggtgttgaaagtgcgggctctgg

SEQ ID NO: 6848433 - DNA, 121 bp, Homo sapiens
tgcaatgacttaaaattgtattacctgaatagtctccatggtgaagtgtcagaaaaggtgaaataataaatattttccacagcaccataagattttataaaatactatttcagttaatgta

SEQ ID NO: 6848434 - DNA, 102 bp, Homo sapiens
tcttagtttctccaactacaaaatgtgcaaagtaaagtaattttccaaatacattaaaaagttgcacaactttgtatacgggtggaaagaggcttgttgaga

SEQ ID NO: 6848435 - DNA, 129 bp, Homo sapiens
aataatttcctttcttgttgcaatttttaaaattaagcatgtgtaaattttaatatgctgtcagagagcgtaggctcagtatttggaatatagctaagtcttaagaaatgtgttggatggatagatgtt

SEQ ID NO: 6848436 - DNA, 68 bp, Homo sapiens
tctgggctggtggtcactctgttcttctggatcaggcatcagatgcttagtgactacacaggaccagg

SEQ ID NO: 6848437 - DNA, 87 bp, Homo sapiens
atatagaaggctctggcaagaaggaagtgtaagccaagttagaatataaacctggtaaccacaaccctccttgtgacgcccctgtgt

SEQ ID NO: 6848438 - DNA, 68 bp, Homo sapiens
gtgactcaccaccctggcctctcagtgggctgaaaggagacccctaggaggcgatggtggaaaagcac

SEQ ID NO: 6848439 - DNA, 76 bp, Homo sapiens
gcctgtctgggattttatagacatgctctctctctctgtttattgtgatggcagtttgcacaattcctcttcaggc

SEQ ID NO: 6848440 - DNA, 57 bp, Homo sapiens
aggctctttgagactacctggagtccttgtcaccacaggtacaggtcttgtgagtct

SEQ ID NO: 6848441 - DNA, 72 bp, Homo sapiens
gaggagtattcattttgcatgaaaggaccagaagtattccccggcttttcatgtgttgaatgtgtacagctc

SEQ ID NO: 6848442 - DNA, 69 bp, Homo sapiens
acagctgctttgtctggtgattttgtgtgtttctataaaatgcgcacaaagttggacaacgcaccctgt

SEQ ID NO: 6848443 - DNA, 80 bp, Homo sapiens
atagggtggcatgaaacttccaaagctgacctccataaaaatttaactagtaaaaatggagtagttttacatccccctat

SEQ ID NO: 6848444 - DNA, 62 bp, Homo sapiens
gagcttggaaggggcgtgtggtagcatttgtaccatgcatttgcatactgacctctaagctt

SEQ ID NO: 6848445 - DNA, 86 bp, Homo sapiens
gagggagagagagattctggctgcagtccctgtaataacctctaattagtgcaatgaataacagccaccatctcttctgtttcctc

SEQ ID NO: 6848446 - DNA, 62 bp, Homo sapiens
gagtagaaggaagttatctacccaacctagagggcataaagatgatttccttggagctactc

SEQ ID NO: 6848447 - DNA, 77 bp, Homo sapiens
tgtatctaggctttgttttatctcatttatattcacaaatctgtaaaagagagttgggcaaggttaccaggataaca

SEQ ID NO: 6848448 - DNA, 55 bp, Homo sapiens
ctggtcaatgggaactgccctgaaccctcacctgggctcagccccattgaaccag

SEQ ID NO: 6848449 - DNA, 80 bp, Homo sapiens
caaggcagcatatttggtttatgggtagtttgtgtccttagacagaactttctgatcctgagcctaaatttgccttcttg

SEQ ID NO: 6848450 - DNA, 85 bp, Homo sapiens
tcctgagacaccaaatgcaatttttccagtgctactgtggtgctgtaacatgggcagtgtattggaaggaatatgtgtattagga

SEQ ID NO: 6848451 - DNA, 72 bp, Homo sapiens
agaaatgtttgtcggatgactggagagacaggtacacaaaatcaacctgtgctccatcatccataatcttct

SEQ ID NO: 6848452 - DNA, 55 bp, Homo sapiens
caacttcactgtgcctctagttcctatgatttgaacaggagaaacagggaaattg

SEQ ID NO: 6848453 - DNA, 61 bp, Homo sapiens
ctccgtgaaggcagggagctggagtgttggatgaatttcctttgtttcctgtcttacgggg

SEQ ID NO: 6848454 - DNA, 61 bp, Homo sapiens
ttctttttatattgacaaaaggtatgcagacattacctttaagatagcattgtagagagaa

SEQ ID NO: 6848455 - DNA, 76 bp, Homo sapiens
ccatcttcccccaaatcaagagacctctatgcaccagttaaataaaatttggattctctcattggggtgaaggagg

SEQ ID NO: 6848456 - DNA, 73 bp, Homo sapiens
tcacatttaggaagtggataaaatagctttattttcatcagagtgaaacttcagcatcatttttaagatgtga

SEQ ID NO: 6848457 - DNA, 77 bp, Homo sapiens
tgtctctcttcagccagggcagagcaggtgaggccctgcgtcacccgcgcaaggcttgtggttcagccagggagaca

SEQ ID NO: 6848458 - DNA, 70 bp, Homo sapiens
agaaagaggagcaggagtctcttgaatttggtcttataaaattcaattaactttcatgcttactctctct

SEQ ID NO: 6848459 - DNA, 95 bp, Homo sapiens
gctgtgaggtgagccatctggaaaacacagtgtagactgaaaaataattataagccagtttattacttttttccagttaagcctaccatgacagc

SEQ ID NO: 6848460 - DNA, 58 bp, Homo sapiens
gcctgagcatttgcctttttaacaaagggactaccctttgagaaacagagtcttaggt

SEQ ID NO: 6848461 - DNA, 59 bp, Homo sapiens
gtaggaagctctgaggctagttgatttttcatcatctttagatagcctttcctttctac

SEQ ID NO: 6848462 - DNA, 57 bp, Homo sapiens
ctcaggcaggccctggccgcccagagtgtctcaggaggccacattcccctgcttgag

SEQ ID NO: 6848463 - DNA, 56 bp, Homo sapiens
tttccctgtttcccatttcacctcaataaggtgaaatggactattcggcatggaga

SEQ ID NO: 6848464 - DNA, 99 bp, Homo sapiens
gaaaaatacagttgtctggtctttgtcaagaaaaaccgttaaagtaaaagaaagcgatttgtttggaaactttggcaaagatggctagctgtgagtttc

SEQ ID NO: 6848465 - DNA, 70 bp, Homo sapiens
cagcattagaagggacctctggggggcaactaggccatgccccatccccatcactcccattttacagctg

SEQ ID NO: 6848466 - DNA, 84 bp, Homo sapiens
gtggctcagagagcccggccacagccactggggtggggctcactgctcagccctaggctgaggccagggtgctttgtgtcccac

SEQ ID NO: 6848467 - DNA, 97 bp, Homo sapiens
ttctgtgaggactatagaagggtgtgagactgttattgcaatagttcacattggtgatgacagcattttcttctaaggagatagtcagggagcaggg

SEQ ID NO: 6848468 - DNA, 84 bp, Homo sapiens
tttgtaatatctactccagatgataagggacagtaaccctatggaaggctactgccccttatcatctggagtagacatcacaaa

SEQ ID NO: 6848469 - DNA, 84 bp, Homo sapiens
ttctcatttcatgattctggggcaaaagctgggctttaagatggggccgacttcaatagccccagagcactgagcacctgagaa

SEQ ID NO: 6848470 - DNA, 56 bp, Homo sapiens
caaagtgctgggattacaggcttaagccaccacgcctggccaatctatgcattttg

SEQ ID NO: 6848471 - DNA, 78 bp, Homo sapiens
tgagggaggctttcattttctcatctcccactagtgaggccatgccttattgggatgagaggatgcagtttcatttca

SEQ ID NO: 6848472 - DNA, 70 bp, Homo sapiens
ccctactgtacctttcactgatgtcaagtggctatcaattcatatagctgaaaattagtgatagtttggg

SEQ ID NO: 6848473 - DNA, 72 bp, Homo sapiens
cctgagtggccacagccgaacccttgggcctcaaaataggggctgggggctcaggcttgtgggcatgacagg

SEQ ID NO: 6848474 - DNA, 67 bp, Homo sapiens
tgcacatctggcatgtatgggcagccacaaacattgtcatattatgcacatgcatgcacaggttgta

SEQ ID NO: 6848475 - DNA, 84 bp, Homo sapiens
catcaagcctacaggtgagtggcagtgggatgctatcaggccattgtgtgtctttcgcacctactgcccttgtgggagttgatg

SEQ ID NO: 6848476 - DNA, 60 bp, Homo sapiens
cgtggagatgcaatgtagaatctggccgctggccggatcttctctacttccatcctcccg

SEQ ID NO: 6848477 - DNA, 65 bp, Homo sapiens
gttgtgcaccactgttgattgactgggccctttgcttgtgtacagcactctacagtgtgtacaac

SEQ ID NO: 6848478 - DNA, 62 bp, Homo sapiens
ccagggctctatgagggtggagaccatggagcagcactggccacctggagctggagccttgg

SEQ ID NO: 6848479 - DNA, 80 bp, Homo sapiens
aaatagattgagccaaagcaggaagaatattgaaaagtaagatccttatctagtttgtctagctttgcaaaatcttattt

SEQ ID NO: 6848480 - DNA, 83 bp, Homo sapiens
gtggcgagatctttgggaggtcataaatctgttcttgacatgaatacaaagggcttgattgatgactcctcagattaacatac

SEQ ID NO: 6848481 - DNA, 59 bp, Homo sapiens
gtatctgttatgtgggagatgggaatgacatgatcattagctctccacctaacaggtat

SEQ ID NO: 6848482 - DNA, 61 bp, Homo sapiens
ctgtgaaataatgaatatgtgctgttttacacctctaagtttgcagcaattcgttatacag

SEQ ID NO: 6848483 - DNA, 56 bp, Homo sapiens
ttacccagagctagatgaatttgactctccacctccgtcatttactttctgggtga

SEQ ID NO: 6848484 - DNA, 129 bp, Homo sapiens
ttgggaaaaggatattcttgttttaggaatcctgactccactaatcagcaaatgtttatcaaatacttatgtatgaaacattcagctgggtggagcagaagataccgacctataaggaaagcatcctaa

SEQ ID NO: 6848485 - DNA, 71 bp, Homo sapiens
gaatagcttctccaggtgtaagaatccttcagcttccaaagctaaggaactctgtaacaccagtgttattc

SEQ ID NO: 6848486 - DNA, 55 bp, Homo sapiens
cagggaggtctgagtgcggaaagcctggaccacaggaatgtgcctagcctccctg

SEQ ID NO: 6848487 - DNA, 55 bp, Homo sapiens
gctgagtgaggctgtcaaaatgttttacttctccattagcatagcctgtcttagc

SEQ ID NO: 6848488 - DNA, 68 bp, Homo sapiens
ggatagttctgagagttgaaaacaccactgtgatgataatgacagtgttcctgctctcaggaagctcc

SEQ ID NO: 6848489 - DNA, 64 bp, Homo sapiens
tctcttgctatgatccttaagaacccatgccctaaatgaatgggaaagggtcacaagcagcaga

SEQ ID NO: 6848490 - DNA, 64 bp, Homo sapiens
cctctgcatccccaattagcgcccagcttgaaggcaagcaggtttctctttggagggtgggagg

SEQ ID NO: 6848491 - DNA, 69 bp, Homo sapiens
ctgaggtttttctgaacttaaactgatctgttaaaccagttagttgagcaaggccggaagagccctcag

SEQ ID NO: 6848492 - DNA, 58 bp, Homo sapiens
ccatagtacttgcatagtactatgtggagtccacatagtactccaccagtacatgtgg

SEQ ID NO: 6848493 - DNA, 129 bp, Homo sapiens
ccaattcttcagtggatatgttcagaatgtttctaggtcaataatttttaaatggcaagaaatttttatgtaaagatacaaaaatggttgttctagcaacttctgatttcaggcacattgaaggcaagg

SEQ ID NO: 6848494 - DNA, 78 bp, Homo sapiens
cctggtatgtgctcttgaatcctgccaaaattgtgtagaattatataaacaggagttgaagcagtaatcaggaccagg

SEQ ID NO: 6848495 - DNA, 63 bp, Homo sapiens
cctcctaggtcccaagtcatgtttcctaagacatcttgagagatgagtgagggtcctacaagg

SEQ ID NO: 6848496 - DNA, 56 bp, Homo sapiens
aggcttggaaaatttacagtgtttcctccagggactagctagtgaatgccagggct

SEQ ID NO: 6848497 - DNA, 61 bp, Homo sapiens
gacttgggggccattaaggggcctcctccatcagactgggggccctttaagagctcccatc

SEQ ID NO: 6848498 - DNA, 102 bp, Homo sapiens
ggtctgtttttgcatgttatgttctttatcatggtaaacctgtccatagacagtaagtacttggcaaacaacgtggatatagtgaaaactttgaatcaggcc

SEQ ID NO: 6848499 - DNA, 60 bp, Homo sapiens
tgttcaccaggggctccaggtgagcctggcctcccaggctccccaggaggcccttggaca

SEQ ID NO: 6848500 - DNA, 76 bp, Homo sapiens
ggtatacagatttctgggcaatctaccaaactttctgagtcagaacctggccaggaatctgtactttccaaatgcc

SEQ ID NO: 6848501 - DNA, 65 bp, Homo sapiens
agagaggatcacttgagctcaggggttcaagaccagcctgagtaacatggtgagaacccatcttt

SEQ ID NO: 6848502 - DNA, 96 bp, Homo sapiens
tagcacgtttggacctcttcctgcacttaaagtcatgcctaccttcatgcgctccaggtgtcccaggtaaaaagagccattccccaagcgatgctg

SEQ ID NO: 6848503 - DNA, 68 bp, Homo sapiens
aggtgagcttctcagaacattattcaagtttctgcccttgaacacagttctgatgagcttaattacct

SEQ ID NO: 6848504 - DNA, 86 bp, Homo sapiens
ggcacttcagagccatgcagaatgtggacagtgggtttggaattgtcattgagatgccactttcttattcttcttgtgttggtgcc

SEQ ID NO: 6848505 - DNA, 90 bp, Homo sapiens
gttgaagagaagcacagttcatattttgagttgaatgatgatgtcacttcaattccaactctgaaatgtgaaatgattattgtcttcagc

SEQ ID NO: 6848506 - DNA, 92 bp, Homo sapiens
aggccctttctgagcctcagtatctccacatgtaaagtgcaaatgataaccatctctactttgtgatgatgtgctgaggcttccctgggctt

SEQ ID NO: 6848507 - DNA, 65 bp, Homo sapiens
ggagctagtgacattaattcattgtgtacatgagccacagtgactcaactagtcttactaccttc

SEQ ID NO: 6848508 - DNA, 72 bp, Homo sapiens
accagaaccctaggcctgtgttgccgtacttttatcaactcaaatacaggtgtgagggtctctttactcggt

SEQ ID NO: 6848509 - DNA, 55 bp, Homo sapiens
cagatgtggaatgcagcaggctgagcccagcactctgcctgtgctccagcatctg

SEQ ID NO: 6848510 - DNA, 69 bp, Homo sapiens
taaaatatgataagtgcttcagtgggtcaatggacagaatatctactgatcacagatatgtatatttta

SEQ ID NO: 6848511 - DNA, 84 bp, Homo sapiens
agaaaaccgcagatggcatatcgtgctatcagagtgcctaaaagcaccatgagtaccgctacgttgtccattcctgccctttct

SEQ ID NO: 6848512 - DNA, 71 bp, Homo sapiens
ggagaagaccagggaaagggcctgaaatgagtgacctttaggggcatttctgttctcttcctgtactctcc

SEQ ID NO: 6848513 - DNA, 60 bp, Homo sapiens
tggaggcactaaatggccacaaggaaatgacttccaagatgccaacatttgggcctatca

SEQ ID NO: 6848514 - DNA, 56 bp, Homo sapiens
gaaatgtcatagtcttcaagccattttaggagaagggctgaaggcaatgacatttc

SEQ ID NO: 6848515 - DNA, 58 bp, Homo sapiens
ttgcctctgcggtgcttggcatgtggatgatttccaggtgaatatgcagcagaggcag

SEQ ID NO: 6848516 - DNA, 57 bp, Homo sapiens
gcagagccagaatggccaggacccagagccagctctctccctcagtcctggctttgt

SEQ ID NO: 6848517 - DNA, 73 bp, Homo sapiens
gctgagctctctggctgatctcaatcatggctttaaacattcctgaatgcctgtctgcagcccagagctctgt

SEQ ID NO: 6848518 - DNA, 87 bp, Homo sapiens
ggagtctcgctctgtcaccaggctggagtgcagtggcacaattttggctcactgcaacctctgcctcccgggttcaagcgattctct

SEQ ID NO: 6848519 - DNA, 57 bp, Homo sapiens
ggaatagtgttgttcactcaggaggttgcattctaaaccatgtgtcaatactgtacc

SEQ ID NO: 6848520 - DNA, 74 bp, Homo sapiens
gtggcaggaaggggctcactctggccccaccaaggtgaggtggggaccaagtgatagagccctgatccacccac

SEQ ID NO: 6848521 - DNA, 71 bp, Homo sapiens
gtctgtgatcagggaacatgtgttgtgtcctattatccccagaacattgtacaaatgcctgacacacagat

SEQ ID NO: 6848522 - DNA, 69 bp, Homo sapiens
tcactttggtagctgttttgggaataaattggggggagattataaggtcacattgacggttaccagtgg

SEQ ID NO: 6848523 - DNA, 103 bp, Homo sapiens
tagttcagggatgccttataatttatatgctattttaatgaagatgtctaatgtttttggagaattagcataacatgaattaagtcagtcaaccctggaacta

SEQ ID NO: 6848524 - DNA, 77 bp, Homo sapiens
cattgatgatcacaatgtttcaggaaatcagctagagttaaagtatactctgaatgaccatgaaataatcatgaatg

SEQ ID NO: 6848525 - DNA, 59 bp, Homo sapiens
tagtggtgagagcagaccttcttttctcttttttgaaaacgttcaggctttcaccatta

SEQ ID NO: 6848526 - DNA, 55 bp, Homo sapiens
ccctgttgggaagagagatggccagagtgtccctggccactgggcaccagcaggg

SEQ ID NO: 6848527 - DNA, 87 bp, Homo sapiens
gcagcagggccctttgtgatcatcccactgggctggccctgttgcaggcagggcgcatctctggggtgaatgaagctgccctcctgc

SEQ ID NO: 6848528 - DNA, 100 bp, Homo sapiens
tgcttaaagattcattgccacagtttgcataggaaaaacactcttttagaagacaagttagttttcctaagtaagcagtatgaatatgaatttagaagca

SEQ ID NO: 6848529 - DNA, 101 bp, Homo sapiens
gcacactctaaggtatggatccctgtaaacacttaaggagagatcaaatgtcaaagtatgcaaggtctcccctggtgtagtttcactacttttttgtgtgc

SEQ ID NO: 6848530 - DNA, 71 bp, Homo sapiens
aacacacattaaaaaatgttgcatgaacgttacttcctgctctcatgttctgtagattttttaatggagtt

SEQ ID NO: 6848531 - DNA, 62 bp, Homo sapiens
agcatttatagataccctatggggaacattccctaccttttaatgggcatctactgagtgct

SEQ ID NO: 6848532 - DNA, 95 bp, Homo sapiens
aattacaatttcactaaagcattctcagattttgctaccctttcaaatggttagaaaagtctagaagaggaatgttgctttttaaaaaatgaatt

SEQ ID NO: 6848533 - DNA, 55 bp, Homo sapiens
cctgggcccccttaggccaatgcatggccaccctccaggcctctgggggccctgg

SEQ ID NO: 6848534 - DNA, 68 bp, Homo sapiens
tgctaggggtggaggggggtccagagccagctgccctggcacccaggaaccttcttagcccctgagca

SEQ ID NO: 6848535 - DNA, 65 bp, Homo sapiens
gggcagctcggaagtgggaaagagggccaggaatccatagggcatcattctcccgccagctgcct

SEQ ID NO: 6848536 - DNA, 65 bp, Homo sapiens
cttatttttctctccagagcttataacattgggaaccagttccaaagagctggatcaaggataag

SEQ ID NO: 6848537 - DNA, 59 bp, Homo sapiens
gtgcagagaggaccttggggaggacccacgaagctgtccttccccaggctggtctgtat

SEQ ID NO: 6848538 - DNA, 59 bp, Homo sapiens
tgggtggtttatgagtgggtttatgggtggccctccccagcctcagactgagccaccca

SEQ ID NO: 6848539 - DNA, 78 bp, Homo sapiens
ggaaagagttatgtctttgtggctatctaggcagttttggggactgttctgaaaagaaactaagtcataactctttcc

SEQ ID NO: 6848540 - DNA, 91 bp, Homo sapiens
tattgggtaactatataatctgaaagtgaaaaattctctgtttgacagtgcagatggtggttctatttcatattaatagttgaatctaatg

SEQ ID NO: 6848541 - DNA, 94 bp, Homo sapiens
aagcaatggaggtttgcctacaaacgaatctatctgaaaatgtccccgtctactatttagagattcctttggggaaagcactacccagtggctt

SEQ ID NO: 6848542 - DNA, 57 bp, Homo sapiens
ggccactttcatagcaagtgtgatcggcacccgagggcttgcggctgaaggtgagtt

SEQ ID NO: 6848543 - DNA, 62 bp, Homo sapiens
gttcttagggtattatgtgtgtgggtataatcataccttttcatctgaaacttttagagaac

SEQ ID NO: 6848544 - DNA, 86 bp, Homo sapiens
ggagggaagacagtgctgagcacagcctgtgtcctcactgtgtgtttagtgtgtggacaagtgtgcctcttcccgcctctccctcc

SEQ ID NO: 6848545 - DNA, 66 bp, Homo sapiens
tgcttcaagacaattggcccatctttactccaagtggctgttaatggtttatgttgttgtgaagca

SEQ ID NO: 6848546 - DNA, 114 bp, Homo sapiens
tgctgtttactctgaaatgttgttgtgagagacccttgaaacagtatatatgaaacttctttgttaactttaatatacaattttacgggcttacaaggttttaagtagatggca

SEQ ID NO: 6848547 - DNA, 113 bp, Homo sapiens
ccaccgacctctgagtgatggcactgtgccacaattcaccagggcacaaggaagggagacagccacccacctctgagtgatggcactgtgccgctcttcaccagggcatgggg

SEQ ID NO: 6848548 - DNA, 63 bp, Homo sapiens
gtgacgccaggagtggagccagggtgtgcaggacactgcagcacctatggacacttgtgtcgc

SEQ ID NO: 6848549 - DNA, 87 bp, Homo sapiens
ttccaaagactttcgaacttaatggttcctaaaatgtgtaattgtctttcccaaccacctttttaaagatcattgaacttgatggaa

SEQ ID NO: 6848550 - DNA, 89 bp, Homo sapiens
gagtcctgttagcaaaagtctttccttagaataattcttttatagaatagtgaaagagaaggaagtggaagaaaatgctgatggctctc

SEQ ID NO: 6848551 - DNA, 72 bp, Homo sapiens
tctgaaaggagcagcatagaagctgggaggatgaggcctgtcttcctggcattgatgctgcaggactacagg

SEQ ID NO: 6848552 - DNA, 68 bp, Homo sapiens
ggtggtggaagagatagtgagaagctgtaacttatgcaatggtcgcctggctgactcttcctatcatt

SEQ ID NO: 6848553 - DNA, 108 bp, Homo sapiens
tcacctgggagcttttatggctctggaggttcaggctgcacacctgagcaatgaagtcagggtcctgagggtggggcctggatgcaggtattaaagttctgcaggtga

SEQ ID NO: 6848554 - DNA, 79 bp, Homo sapiens
ttaaaataggggaccaggaaaggagcctatttccaagaggggtatggagacctcctttctttatggagttctgtggtag

SEQ ID NO: 6848555 - DNA, 57 bp, Homo sapiens
gaagtgaaagagaacaagtccccgaggccttaggatttgtgtttccccagtcacttt

SEQ ID NO: 6848556 - DNA, 58 bp, Homo sapiens
actttgaactggggaagtgttcaaagactagcaatggtttgggcatcattcacaaagt

SEQ ID NO: 6848557 - DNA, 58 bp, Homo sapiens
ggggaaaggccatggcaagaaccacgagcctctgtggggctatctgctcaccttcctc

SEQ ID NO: 6848558 - DNA, 67 bp, Homo sapiens
attatgcagaggaattggttcctgaaaggatcctgaatccaatcaaccctgttttctttgcaatgat

SEQ ID NO: 6848559 - DNA, 72 bp, Homo sapiens
gttcttcaaagtgcataataactcccaagttgcagtttaagcagtgggaaattagaatgaattacggagaat

SEQ ID NO: 6848560 - DNA, 57 bp, Homo sapiens
gtaagcagaggttaatgttaacatgttaaatgttttatatgaagactatctgtttac

SEQ ID NO: 6848561 - DNA, 77 bp, Homo sapiens
taatctcccctctgacacatccattcaactagactaaatccaatattgacatttgtatcttaggggaaaggaggtta

SEQ ID NO: 6848562 - DNA, 84 bp, Homo sapiens
tgaagttatcaggcagagcagtatttgttccctatcaatgtgtatctaacaaaacattacacagaatactttctgcctgcttta

SEQ ID NO: 6848563 - DNA, 67 bp, Homo sapiens
cctacatgtggtccctgtaggctgggtggggctcttttcacaccatcctatctgacctacttgtagg

SEQ ID NO: 6848564 - DNA, 56 bp, Homo sapiens
ttttactgcatatagcttagagctgaatgagccatcctgtaagttatagcagaaga

SEQ ID NO: 6848565 - DNA, 68 bp, Homo sapiens
gctcaggggcagtttcctatgatctttaggcctcaaaatgtctcttggactcaaaattgccttagggc

SEQ ID NO: 6848566 - DNA, 68 bp, Homo sapiens
gtctagttgccacagtagcaaaaggttctcattgtaagaacattttactcctgaggcagaccactgac

SEQ ID NO: 6848567 - DNA, 86 bp, Homo sapiens
gagggtcttgcagagatatgtgtgcatcaagcaggaataagaagcacttacctgagcccagtgcagcatattctgaacagatgttc

SEQ ID NO: 6848568 - DNA, 87 bp, Homo sapiens
tttgaaatgtttcaaatgaaagcaacttatttgagatggccatttcatgggttgattctcatttgggtttctttctcacattttgaa

SEQ ID NO: 6848569 - DNA, 113 bp, Homo sapiens
caaaacagatgactaataggtgcttgaagctctgatagaaatgcttgcaaactagaacatttacaagtaggtgccaacagtatttctgccaaagcaagcgctgtactgttttg

SEQ ID NO: 6848570 - DNA, 61 bp, Homo sapiens
gcctcaagagacgggcaaggcaagagccctagagcctgtctaacccatgtctctgcagggc

SEQ ID NO: 6848571 - DNA, 72 bp, Homo sapiens
aaagtgcactagtcaagtgaacaattttctatatccattttgtggcaaattatcatgattattgtgtatttt

SEQ ID NO: 6848572 - DNA, 68 bp, Homo sapiens
atgcctccatgtttcagcatctacgtcaggggcttggtcctggagtcgattaaaaacaatggaggtgt

SEQ ID NO: 6848573 - DNA, 93 bp, Homo sapiens
aggcggttaagccatgggacagggccgcagatggagactgctcaaggtcaaaggggtctccagctgggaccctgcacctggttcgtagcccct

SEQ ID NO: 6848574 - DNA, 86 bp, Homo sapiens
aatactacagaaaaactggcattgaagacagtaggtgtgcaagccacttacctccttgccttcagcgtcgatttctgtcctgtgtt

SEQ ID NO: 6848575 - DNA, 71 bp, Homo sapiens
ccagcaggaagcctccacttgtgatatgaaaatgccctttcaatagctcagtgtggaagctcagatgttgg

SEQ ID NO: 6848576 - DNA, 60 bp, Homo sapiens
cctcacctgccaaatggggatgctgagggcacctcgctctctggagtgggaggtgtcagg

SEQ ID NO: 6848577 - DNA, 71 bp, Homo sapiens
ctgaactatataaaactgccaatatttgtgtcttttttgaactgtaatgaaggcagttttataagattcag

SEQ ID NO: 6848578 - DNA, 65 bp, Homo sapiens
agagagttgctagttttcaggatacctccaactaaaaaggcatcctggagaaaagaaacatttct

SEQ ID NO: 6848579 - DNA, 57 bp, Homo sapiens
gaggagctgtcaccgtgactcactggagcagagctttctaaacggtgtcagctcttc

SEQ ID NO: 6848580 - DNA, 91 bp, Homo sapiens
gccaggatggtctcgatctcctgacctcgtgatccacccgccttggcctcccaaagtgttgggattacaggcatgagccaccgtacctggc

SEQ ID NO: 6848581 - DNA, 86 bp, Homo sapiens
ggccttcggcagcagcagaggctgtcggggcactgaagagtcctcttgtgccttctcagtcctgctcacaccctgagaccgaggcc

SEQ ID NO: 6848582 - DNA, 63 bp, Homo sapiens
tagctattcagtaagccaaaaccatggttttcataagcaaggtaaaaatttactgaatgccta

SEQ ID NO: 6848583 - DNA, 63 bp, Homo sapiens
ccctaccatcaggctgctacaaggaattcaaagattcctgggtagagacctgatgaaaatggg

SEQ ID NO: 6848584 - DNA, 63 bp, Homo sapiens
ctgcaggccaggcaacattctgaagttttgttttaggctaagaataggtgcttggctacgcag

SEQ ID NO: 6848585 - DNA, 73 bp, Homo sapiens
agggccaagtaagatcttgaaatttaagatagagacatctggtctgagttttctgagaagcttattgaatcct

SEQ ID NO: 6848586 - DNA, 59 bp, Homo sapiens
gattttatctgcagcatgacttctggataatctctgcaagaagccatgccagtaaaatt

SEQ ID NO: 6848587 - DNA, 61 bp, Homo sapiens
gagacttgtacaaagatttcacagctccccttttgggatggattcttctttgtactatctc

SEQ ID NO: 6848588 - DNA, 61 bp, Homo sapiens
ggccagcgccgcgccttgggagttccctccgcgaagggggtgatcaaggtgcggcggcgcc

SEQ ID NO: 6848589 - DNA, 73 bp, Homo sapiens
agcctgccttggattgcagggaaccttctaaccctcagttagcaggtccctacttatctgaaggcatcatgct

SEQ ID NO: 6848590 - DNA, 73 bp, Homo sapiens
ggacttttgagctgcctgttgaagggtctgtgggagaacattccaggcatggggagagccagatcgaaggtcc

SEQ ID NO: 6848591 - DNA, 123 bp, Homo sapiens
ccccagcccgcgcaggtgagccttgctgtctacctcttcctcctccatctcgaaggctgagtggtcttggctgtcgaaacaggaggcgctgaggaagacagggggagccggcggggactgggg

SEQ ID NO: 6848592 - DNA, 79 bp, Homo sapiens
aagcttctgcccgattctcatgtcttgcttcacctgctattgcaaactcagaggtctcaagttgagaaggcagagcctt

SEQ ID NO: 6848593 - DNA, 87 bp, Homo sapiens
ctggggtccctcggtccagcctggttgcgggcatcctcctcacggactggggcaggcgtccagcgcggaatgtgcgaggtaccctgg

SEQ ID NO: 6848594 - DNA, 65 bp, Homo sapiens
agaaccctaagttcatgagaagttaactgagttactcagtttctttactcatagaatgggggtct

SEQ ID NO: 6848595 - DNA, 81 bp, Homo sapiens
aggactttcattaagaaatgaggagtccccaaagtgaactgctgcagagtggtggatctttatatttcttatggggtgcct

SEQ ID NO: 6848596 - DNA, 129 bp, Homo sapiens
tggtggggcaaggcaggggctgaggggtaggcaggagggagctggattggcagtctacttactaggtgtttattcactgttatccagtgtgaactcctctaccctagctccttatacctagctccttaa

SEQ ID NO: 6848597 - DNA, 76 bp, Homo sapiens
ggggtatttctgctgaggctgagcaatgagccaccagaagcaatggctcattgctcaggcccagcaggaattcccc

SEQ ID NO: 6848598 - DNA, 74 bp, Homo sapiens
ctgaagttaaacttgcctttattcctgtttgtggattagctaggataaaatgaggaagtttgcaatgctcttag

SEQ ID NO: 6848599 - DNA, 61 bp, Homo sapiens
ggagccatacaaaaacagttattgggttagattgggcttgtaggctgtagtttgtaggtcc

SEQ ID NO: 6848600 - DNA, 75 bp, Homo sapiens
gcagtcccatatgcaaagctgtgggttaggtttaactaagaatcaatgtgacctacagatctttgaatgtgttgc

SEQ ID NO: 6848601 - DNA, 87 bp, Homo sapiens
tcttctccattagtttagtgaatggttaaagaaataaatgaaaattagctcggttttctaaactacgtcaaaactagttagagaaga

SEQ ID NO: 6848602 - DNA, 57 bp, Homo sapiens
gcttccaatgatgcaaggagctgcctgcgcaacagtgagctcctcatcactggaggt

SEQ ID NO: 6848603 - DNA, 55 bp, Homo sapiens
tgggaatgcaaggaaagctgtttcagaaatgatctacagatttgatgcaatccca

SEQ ID NO: 6848604 - DNA, 90 bp, Homo sapiens
ctgtgggaaaagcagactgggatgcggggttgacagctgagacccacacctgcccagcgcccacattctgtcccagcccacctcccacag

SEQ ID NO: 6848605 - DNA, 127 bp, Homo sapiens
tgacacagtcagatattaagttgatatgcctatcattgaatgtctggagcaaggtaacctcacctcagacttgattcctaacaaacttcagtgaatattcaatttttgttttatcacaaatgtatta

SEQ ID NO: 6848606 - DNA, 58 bp, Homo sapiens
tgcaccatattgttttaaataaattgtgccacaggccatatgaaacaagaatggtgca

SEQ ID NO: 6848607 - DNA, 74 bp, Homo sapiens
ctgtaatcttgtttagctgttacccactagggaaagaatggttttctctcagtcagatgctaaagagattaaag

SEQ ID NO: 6848608 - DNA, 95 bp, Homo sapiens
ggctcctggttccagcctctcccgcttcctgctggctgccccattcatgtgtgcacccagggcaggaagtgaggacctggcaggtccctaggatc

SEQ ID NO: 6848609 - DNA, 61 bp, Homo sapiens
tctgcaagctcagttctgacttactcctgcattgcaccttcagtcacattgagcttttgga

SEQ ID NO: 6848610 - DNA, 76 bp, Homo sapiens
gttatggatgagcagttaggaggatgatgaataaaactagatgccatgttgtcagtttgaaagctacatctatagc

SEQ ID NO: 6848611 - DNA, 66 bp, Homo sapiens
aggtgggtggatcgtttgagctcaggagttcaagacaagactgggccacatggtgaaaccctatct

SEQ ID NO: 6848612 - DNA, 57 bp, Homo sapiens
gggcaatggtcacatagagtgagtggaacgagagaaccctgactccaagccgtgccc

SEQ ID NO: 6848613 - DNA, 60 bp, Homo sapiens
ggccttgcgctgaatttcctccactgtagcctctggatggggagatgcagcccaggtgcc

SEQ ID NO: 6848614 - DNA, 70 bp, Homo sapiens
ctccttctagatagagagctactgcgagaactttgctttcaagcaactgctttttgatctcaggagagag

SEQ ID NO: 6848615 - DNA, 55 bp, Homo sapiens
gtgtcctaatttatagctgggtctcatagcagaagccagctctgtggttagatac

SEQ ID NO: 6848616 - DNA, 96 bp, Homo sapiens
tttaagttgggaaacgtggttgtttaggtcgtggatccagtgggagaaagtccacattagagcatgtcagaatagccattaatccttattcttaaa

SEQ ID NO: 6848617 - DNA, 57 bp, Homo sapiens
gcctctggaagtgggaaggggtaggaaggaaggctcttttcctggagcttccggggc

SEQ ID NO: 6848618 - DNA, 79 bp, Homo sapiens
ggtcactctgtgtactcaacatgcctactcagtctggaagtatcctgggcagtgggcaagttgtattcagagaagggcc

SEQ ID NO: 6848619 - DNA, 90 bp, Homo sapiens
gtccatgttattgttggccattcttttcagggataatgcttaatgttatttgtgcgttgtataaggaatgttgtttatcagtatatagac

SEQ ID NO: 6848620 - DNA, 63 bp, Homo sapiens
tcccagaggaaatggcagctgatttgagtttgaaaagacagctggcagtcatcctagtgagga

SEQ ID NO: 6848621 - DNA, 89 bp, Homo sapiens
cctttcatggcaaccagttccctaatgtgtagaagatgtgtaaacctcatgttctgttttatggtagggaaaaaaccatgtcagagagg

SEQ ID NO: 6848622 - DNA, 59 bp, Homo sapiens
ctgatggccaccaaagtcctgtggcttaccaaagctttcttatttggtggctgtattag

SEQ ID NO: 6848623 - DNA, 63 bp, Homo sapiens
tgttgtcatgcagtcagtggtatgtgaattttagggttttattagggaactgcaagactaaca

SEQ ID NO: 6848624 - DNA, 57 bp, Homo sapiens
tgtgcagttcaaacccgtgttgttcaagggtcaaccttatacttaatgaactgtaca

SEQ ID NO: 6848625 - DNA, 129 bp, Homo sapiens
ctgtaataaacagcaacttgactccatgtgtcatgaggttaatagttgagatcagattcaactgctaaaatagttgacatcagattcaagtgcctcctcagcccatcaaagtcactgtcaaacaatcag

SEQ ID NO: 6848626 - DNA, 62 bp, Homo sapiens
gctgggggcaagatcagaaaactgggccatcaatacagctgtcctttattcctgcccccagc

SEQ ID NO: 6848627 - DNA, 55 bp, Homo sapiens
acaggcattgggatggaggttgtggtgcccaagtgccatgcgtcacaatgcttgt

SEQ ID NO: 6848628 - DNA, 60 bp, Homo sapiens
gcaggagccaggccgagctggtccccaggctcccacatctggcctgtgttccccacctgc

SEQ ID NO: 6848629 - DNA, 130 bp, Homo sapiens
tactggtaggaactctcatattaaaagggaacccaaaccagggcggcttgaggaggcagcttcccagaaaggatggctttttgagctgccttgtggggagaccctgctgtgtgtccccagttcaccagca

SEQ ID NO: 6848630 - DNA, 65 bp, Homo sapiens
tcttcccagattggagggcaggggtgtaccatgtcacccctatgcgtctttcccatctgggcaga

SEQ ID NO: 6848631 - DNA, 77 bp, Homo sapiens
tgtcctcagggtttctccaggttgtagcctcggggttttgggcttgaacaacttggaggtggcatttgctgaggaca

SEQ ID NO: 6848632 - DNA, 76 bp, Homo sapiens
gaggatggacgtgactccctggccctgcccttctcagttgcatataggcagggcttctgggcaccactccctcctt

SEQ ID NO: 6848633 - DNA, 55 bp, Homo sapiens
tcttagccctgggggaaggaggaagcctccaaaccacccctccctcagctaaaga

SEQ ID NO: 6848634 - DNA, 82 bp, Homo sapiens
ggtagtaagtgactgaactaggattggaatgagagcagtctggctccattgtctttggtcctagcctcttttcaacactgcc

SEQ ID NO: 6848635 - DNA, 83 bp, Homo sapiens
aacttagaatcccctatcttattctttttggttttatgaactcgtctgatatgaagaatctaggataggcaattgactgagtt

SEQ ID NO: 6848636 - DNA, 104 bp, Homo sapiens
caatcatcattaaggctaaactgaagctcaactcaaattggtagtgataagagaatgccaaatgattgataaatgagttttaagtccttggtcttaagattttg

SEQ ID NO: 6848637 - DNA, 78 bp, Homo sapiens
ccagtacccaggactctcttccagtagcctacagtagatagagggctctgacttatcggagaagtcctgcttggctgg

SEQ ID NO: 6848638 - DNA, 127 bp, Homo sapiens
attgcacatacttgatatacatgtatatacatataagtagacatgtgtatgtttgggcatatgcatgtataatatatgcatgtgtacttatgtgtctgttaatatgcacgtatatatttgttataat

SEQ ID NO: 6848639 - DNA, 80 bp, Homo sapiens
gggagtgggcccacgggctttggtgctggatagctggagttcagatcccagccctgtcaccaactggaggtaagactccc

SEQ ID NO: 6848640 - DNA, 117 bp, Homo sapiens
cagatgttcacctagtgagaaactagactttggtagaactgtcattgattcaaactacatgactgcaatgaggaaatggacagtgctgcttcagaggctcaaggatgtcttcatctg

SEQ ID NO: 6848641 - DNA, 64 bp, Homo sapiens
cccttgtttgcagaatggcacccccacccacaactctggctgtccagctttctgtagaaaaggg

SEQ ID NO: 6848642 - DNA, 77 bp, Homo sapiens
tacagtttagtttctgttacattttctgaatcactacttgactgaaatatcagagaaaatggaaacttttatctgtg

SEQ ID NO: 6848643 - DNA, 65 bp, Homo sapiens
ggattcagataagtggaggtgaagataaatcaagatgctgttactcattttactttctagaatcc

SEQ ID NO: 6848644 - DNA, 71 bp, Homo sapiens
ccaggctagtgcttgcgaaccttggccaacctttcccaagtccttggcccagcatgcgggtctgtgcctgg

SEQ ID NO: 6848645 - DNA, 81 bp, Homo sapiens
ctgagtcactatttaacagggtcccagctggctaaagtatgacctccatctggccagcatgagacctggtgtggtggccag

SEQ ID NO: 6848646 - DNA, 66 bp, Homo sapiens
ggtgccagagaaaggtttgattcatttggaaaacagttcttagtctcagtgaccttttctgccgcc

SEQ ID NO: 6848647 - DNA, 58 bp, Homo sapiens
ctccatccagaatcaatagcagttatcattcattttgatgtgtttgtttctggaggag

SEQ ID NO: 6848648 - DNA, 129 bp, Homo sapiens
tttttatgtggttctttggttcatgtgggtaccaagctgcttgggggcagaaaccccaattcttattcaaagttggatcccagggcccacagtgtagcaggtactcagtgaagacaggccagatatgaa

SEQ ID NO: 6848649 - DNA, 79 bp, Homo sapiens
cctgtatactctttgatttaattatttcacctttaggaatttatccttaggaaatcattagcaaagatatgtctgcagg

SEQ ID NO: 6848650 - DNA, 71 bp, Homo sapiens
gatttggacttctggagtgtggttaatttaagtgttctcatcaggccttgatatttcagatttccgtaatc

SEQ ID NO: 6848651 - DNA, 64 bp, Homo sapiens
ggctctgaagattaccagctaaatgatcttaccaaattatttagtctctctggcttcagtttcc

SEQ ID NO: 6848652 - DNA, 71 bp, Homo sapiens
taatgtctaagtgtctctctttggtgtttagcagccattagtgaacactgtccagagccattaattcatta

SEQ ID NO: 6848653 - DNA, 71 bp, Homo sapiens
tgggtaactgcagaatgtgcctcagaattgtccacttgagatggagctggggagagtactgtatttatcca

SEQ ID NO: 6848654 - DNA, 80 bp, Homo sapiens
tgtgcatattgcaaaaccatcctaagtaaacagtctgtgtcatctgtattaaagggaagttatgcatggattagtgtata

SEQ ID NO: 6848655 - DNA, 82 bp, Homo sapiens
gtggtacctgtatacttcaggggactgcctaacccattgtttatttcaaaaggagaggcaggcccctgagaatagacatcgc

SEQ ID NO: 6848656 - DNA, 61 bp, Homo sapiens
gagcccgagcgcgtacccggcggagcgcgcgcccgcccccgagtgcgcctgcgcggagctc

SEQ ID NO: 6848657 - DNA, 81 bp, Homo sapiens
ctacagaacctctctgagcaccagtgtattcgcctgtaaagtaagggtgagtaacacagtatgcttacagggcagttgtgg

SEQ ID NO: 6848658 - DNA, 78 bp, Homo sapiens
cagagtttccagtattcaggcttcgagaaacagtgagaatgtgatgttcctgaagcctgagtgatgactatgattctg

SEQ ID NO: 6848659 - DNA, 59 bp, Homo sapiens
acaccagcctcgcccgtgtgttctgtaacccagactcatttggttgtgagggctgttgt

SEQ ID NO: 6848660 - DNA, 73 bp, Homo sapiens
gaatgaacacagccctgctggcaatgatgagtaatcatattcatctcagctgtgcagggatggctcagtattc

SEQ ID NO: 6848661 - DNA, 72 bp, Homo sapiens
gtatatgattgtgcttcggggggaaagcagagaagccactttctgtacttacaacggagttcacttcagtgc

SEQ ID NO: 6848662 - DNA, 62 bp, Homo sapiens
agaaatcacaggaggcagaaggcttccatctcagtttcagcctcagcctcagcaggatttct

SEQ ID NO: 6848663 - DNA, 130 bp, Homo sapiens
tgaaggtgtatattcagttattattcccttaatgcacaagcaagagataatggattttaggaaacctagtagactctgccattatctaattgtcatgtatctaagtactgtaataaagtctaattagctg

SEQ ID NO: 6848664 - DNA, 86 bp, Homo sapiens
tgtgtaaaggagtgattgaagatatagcaataatcatttccaaagaaatgttagtaacttgagtatttgcagtcattttagaaaca

SEQ ID NO: 6848665 - DNA, 68 bp, Homo sapiens
tcttcatcctttcagatgggcatggaccgaacattatatttctgtctcagctctttggaaaaagaaga

SEQ ID NO: 6848666 - DNA, 56 bp, Homo sapiens
cccaggctggagtgcagtggcgctatctcggctcactgcaagctcagcctcccggg

SEQ ID NO: 6848667 - DNA, 72 bp, Homo sapiens
atgcctttgccaccaggagaaccagtgcaactgaagtttccactgcctgctgctctcctgtggcatccacat

SEQ ID NO: 6848668 - DNA, 68 bp, Homo sapiens
ggaaagaggagggacaccaatatatgttctctaggccttttagaaaacatggagttgttcctttggcc

SEQ ID NO: 6848669 - DNA, 65 bp, Homo sapiens
gactattccaagcacagcaacccagaagagccaaagccctggagttgggatgtgcctggaatgtt

SEQ ID NO: 6848670 - DNA, 107 bp, Homo sapiens
acattccaacttcccatcatggtgaacaaggattcccaaagaagaaatgtccaagtaatttttacctcgttgtgtccttgttccttaggaaaaatatggcccagtgt

SEQ ID NO: 6848671 - DNA, 59 bp, Homo sapiens
atttccagaatagaaggttctctagacttgcaaaggaaaccctctctagggttggaaat

SEQ ID NO: 6848672 - DNA, 62 bp, Homo sapiens
tcttcatgttagttgggttttctgtgacttgcgtcacctaaaaaagacataacaaatgaaga

SEQ ID NO: 6848673 - DNA, 68 bp, Homo sapiens
gcttacaagggtaggaagtctaacgggttttatttgtacctctgagtacattccactcctctgtgagc

SEQ ID NO: 6848674 - DNA, 61 bp, Homo sapiens
accctcctggtgacaaggcaaagccacacccttgagctttgtttgatcatacaggcagtgt

SEQ ID NO: 6848675 - DNA, 69 bp, Homo sapiens
tgcctgcctgggctgctttctggggcttcttgctcaaggtaatcctccaggaacagcaccctgctggca

SEQ ID NO: 6848676 - DNA, 104 bp, Homo sapiens
ggaagtgagtaactgcctctccagacctgcagacgacagccccgctgccaaggatagaattaggaagagtggccaggccgactgccaggctgagggctacttcc

SEQ ID NO: 6848677 - DNA, 71 bp, Homo sapiens
gagaaggacttttgcaatggctttcccaaatgacaagcacaaaatgggtcagaatccattcagaccttctc

SEQ ID NO: 6848678 - DNA, 81 bp, Homo sapiens
cttcggcctcatttttacttaaggatgcttgaaataactttctcaacatcattctgctagtaacagatgaaggaaacgaag

SEQ ID NO: 6848679 - DNA, 73 bp, Homo sapiens
gagagaatacaggtggggtggtctatgaggggtagaagtgtctctaaagtctgaaacacctgtgccttctttc

SEQ ID NO: 6848680 - DNA, 77 bp, Homo sapiens
gtatttcacatatggatatgctatccattgatattataatagataaataaattgtagcatatctttgtgtggaatac

SEQ ID NO: 6848681 - DNA, 68 bp, Homo sapiens
tccgcggactggcacagatgctgtttctcacctcctcccactaacagctctgttgccagatctgctga

SEQ ID NO: 6848682 - DNA, 58 bp, Homo sapiens
ttcctctcgctctccggggcccctgtgcaaagagggtcttccccccgagcagcaggaa

SEQ ID NO: 6848683 - DNA, 68 bp, Homo sapiens
gcataggatgctagatttatgagtttggaaagatctgagatggaggtataagtctggcatatgtatgc

SEQ ID NO: 6848684 - DNA, 66 bp, Homo sapiens
gaggaatgtgaaacaggtggctgggacccagaaaccctcttaccctgcacctctgtcatacttctc

SEQ ID NO: 6848685 - DNA, 62 bp, Homo sapiens
ttctacctatttcttctattggtgaaattagaagcaaagttatcagtgaagagtgggaagga

SEQ ID NO: 6848686 - DNA, 102 bp, Homo sapiens
ggatgggcactgatcctgagtttggccactgccagggtggtcaatcctcctcccgataaccctcagacagctgtggccagatgtggacttcttcctgcctcc

SEQ ID NO: 6848687 - DNA, 76 bp, Homo sapiens
ctgtggcacctaatatttacctttgtagtgtccctttctcattagcaacatggtgaatatgtgtaggagtaaacag

SEQ ID NO: 6848688 - DNA, 55 bp, Homo sapiens
tctctcactggtgcctctgttggccgacgctacccagaaggcagccagtgagaga

SEQ ID NO: 6848689 - DNA, 119 bp, Homo sapiens
gctcagaaaagtcacctaggtggcggcagggcagggcagtgccagacggggccatgtggaaccagccttatgctggtagatgccctgctctgtatgagccttagaatggaaagttgagc

SEQ ID NO: 6848690 - DNA, 77 bp, Homo sapiens
tcttggagatgacaatgaggttgttattctttataacatttacatatacaaataaaaaccccattttatcggcaagg

SEQ ID NO: 6848691 - DNA, 79 bp, Homo sapiens
ctcaagaatgtcaggactgatatcttcatgattcttttgccttttccctacggttccaagatgtcggtcctgtccagag

SEQ ID NO: 6848692 - DNA, 61 bp, Homo sapiens
gagatgtttagggtggggagaggtgggctctttttccagctctggtctgctgagtcatctc

SEQ ID NO: 6848693 - DNA, 88 bp, Homo sapiens
cccagtgtgtcctggttccttgtggctgtccctggcagttggagacacccacatgccccagccttcagtcagcagacacaaacttggg

SEQ ID NO: 6848694 - DNA, 63 bp, Homo sapiens
agacacaggctgccacttgcatccaaaacgtttgggtgccttaagtgagtgcctcacttgtct

SEQ ID NO: 6848695 - DNA, 64 bp, Homo sapiens
cttagaggcagaagaaattgacaaaagacataacacttttttgttatctgtaatctgtgctaag

SEQ ID NO: 6848696 - DNA, 66 bp, Homo sapiens
ctctggacttgtacatactcagttttgccctatccgggtccaccctgagcatgtagagtactggag

SEQ ID NO: 6848697 - DNA, 81 bp, Homo sapiens
gctgttatacttcaagtaggtctgattcaaccaacaataaaaatgagaaggttaagtttaaatgtacatgaagcttgcagc

SEQ ID NO: 6848698 - DNA, 76 bp, Homo sapiens
gcctcaagctactttaacaattcgcaagaaaaatttgatttaattgtttttggtgaaatgttcagttggcacaggc

SEQ ID NO: 6848699 - DNA, 79 bp, Homo sapiens
ccctggcgccttcagagagagtctgtccctgaagatgtcttgacatttgacttctgggttgcaggtcttggcggcgggg

SEQ ID NO: 6848700 - DNA, 105 bp, Homo sapiens
aaaatctgaaaatttacaactggaattttacaagaaggcctcgtattataaagtttgttgcttggtttgtgagacttgggttgtggacagtttgaataaggtttt

SEQ ID NO: 6848701 - DNA, 77 bp, Homo sapiens
cccaggcgacctcaaggcagttcactcacgcagccagccctcagagacgtgggctgcgtgtctgctgcccgcctggg

SEQ ID NO: 6848702 - DNA, 71 bp, Homo sapiens
attaacaagggctctgggatgctcttagagcatgaattgcagagcagaagaggtcctagatgccagctagt

SEQ ID NO: 6848703 - DNA, 55 bp, Homo sapiens
aatccagattccagaaaatcgcaccaaaaaagtgtgattttgtgttttgtggatt

SEQ ID NO: 6848704 - DNA, 81 bp, Homo sapiens
ccgcatagtgcaggcacaggtggacttcacagtcagctggatttgattatgagtcgactgtgccacttaccggctgtgtgg

SEQ ID NO: 6848705 - DNA, 70 bp, Homo sapiens
gtggcttagaagcaggctgtgtccccagggtccagcttcctctgggggagattagagcttcttaggccac

SEQ ID NO: 6848706 - DNA, 86 bp, Homo sapiens
agtgaaaattcagagacagttctggggcaggagccagatttgacccattcctatccctaccattgtctcttgagactctgttcact

SEQ ID NO: 6848707 - DNA, 116 bp, Homo sapiens
ggcaccttctctgtgttaggttttagaagttagtggataaacagcaaaatgcttttaagagaatgttttgtatatttattgattttgttaatactcattacacagtttagggagct

SEQ ID NO: 6848708 - DNA, 83 bp, Homo sapiens
gaatggttgaggtagtttttcaagtatttggggcagaaaaacacacatttacctcagatatttggataattgcctccactttc

SEQ ID NO: 6848709 - DNA, 68 bp, Homo sapiens
ttaaagaaagacccaaggccctacatgggtactttcttccccatgcagggccttgggtctttctttaa

SEQ ID NO: 6848710 - DNA, 77 bp, Homo sapiens
ccatctccagggaaggctctgcctgcttggggccatcccaaagcacgcagtttgtttttaaccctcaggacgatcgg

SEQ ID NO: 6848711 - DNA, 74 bp, Homo sapiens
gcgagatgggcgggggcgggtgtaagtaggacagcgctttgtgcgcgttgctatggcgccgccgccgcccgtgc

SEQ ID NO: 6848712 - DNA, 77 bp, Homo sapiens
ggggattctgacacagcttgaggtggcctagggcacaagctagagtcatgagaccctttgggtctgtgcaggacccc

SEQ ID NO: 6848713 - DNA, 55 bp, Homo sapiens
accacagcaggccctggaagctggaacccccacctgctgccttgtcctgcttggt

SEQ ID NO: 6848714 - DNA, 60 bp, Homo sapiens
ttaatatgttgaaatttattagactagcacctggatcttagtaagtgctcagcaagttga

SEQ ID NO: 6848715 - DNA, 77 bp, Homo sapiens
tattctacacaaatggttgtagacattaactagggaacacccgcttacctgcagccatctgtataatctctaggata

SEQ ID NO: 6848716 - DNA, 59 bp, Homo sapiens
acatgggagtgtggttagagacctgggcactttgcccagctctgtaacccattccctgt

SEQ ID NO: 6848717 - DNA, 92 bp, Homo sapiens
cagtctgagtccactttaaaatgtcagcctgaactctcagacttaattgttacagacattttataagcagggcatttaaaatcctcaggctg

SEQ ID NO: 6848718 - DNA, 63 bp, Homo sapiens
tgtcaccatgcaggttatatgtgcttctgttttcattgctggaagagaacctgcaaggtggtg

SEQ ID NO: 6848719 - DNA, 81 bp, Homo sapiens
tttaaaatcttttaacacattttcctcatacggatgttactgttacagtcccttgtgagaacatgtgttggttatgttaga

SEQ ID NO: 6848720 - DNA, 61 bp, Homo sapiens
gggctcttctctcaggcttgatggatgggggaccggggcccggaggtctgaggaagagcct

SEQ ID NO: 6848721 - DNA, 84 bp, Homo sapiens
caagaaacagttaattgctttcagtttctccatcttcaagaaagggacaaaaaggtaactgatgaagctgtttctgttttcttg

SEQ ID NO: 6848722 - DNA, 87 bp, Homo sapiens
cctcaaaacatttccagatatttttatgtggaatatatgattagatgttatttttccttgttaatagtgtctggatttgatttgggg

SEQ ID NO: 6848723 - DNA, 57 bp, Homo sapiens
tctgcccaaggctgtcactagatgttacacgtcccagtgcacccctggcctggcaga

SEQ ID NO: 6848724 - DNA, 128 bp, Homo sapiens
agccctgtgaggacagactgacatggcctggagagtgcggcaatccattgctgcagagagtggagcaggcggcgctcactctcagtgcccaggttagttctgtttttctccattacaccacaagggct

SEQ ID NO: 6848725 - DNA, 60 bp, Homo sapiens
tcatatcctcttctggttctcaccccactactgagaacctgagataataggagagtatga

SEQ ID NO: 6848726 - DNA, 58 bp, Homo sapiens
tgctggggtttgaacctactcattctggctccagagtcccagctcagaaccactagca

SEQ ID NO: 6848727 - DNA, 55 bp, Homo sapiens
gcggtgtctataaatttctgctgtcactgatgttagcagaacagtcgagcactgc

SEQ ID NO: 6848728 - DNA, 63 bp, Homo sapiens
ggcatgttaatgacttacgatagtgtcctactctgggcagctgtgtaggatcataacacggtt

SEQ ID NO: 6848729 - DNA, 57 bp, Homo sapiens
gctcccttccctccttggccacacaaaaccttcgtcaagttaggcagggtggggagt

SEQ ID NO: 6848730 - DNA, 61 bp, Homo sapiens
atagtctgagagttgtagggggaaaagattatttatctcacctataagtctcacagtctat

SEQ ID NO: 6848731 - DNA, 72 bp, Homo sapiens
ggtgcgggccgcctgcccttggctcgaggtcgatgggggagaaagcgaggaaggggcgaggctggcccgacc

SEQ ID NO: 6848732 - DNA, 73 bp, Homo sapiens
cctcctggtgctgtgggtcagaattacagtacaacctgtctcagctgtgtcttctgcttacagtctcataagg

SEQ ID NO: 6848733 - DNA, 95 bp, Homo sapiens
gagggggctcatggtattttagacaggggcaaaataagggagattgagaaaaacatctgtcttggcctcctgctgctgctataacgaattctctc

SEQ ID NO: 6848734 - DNA, 80 bp, Homo sapiens
tgacacattcccagcacagagatgctggtggtcagtgacagcatcatcagggacatttctgtgctgtcctttttctgtta

SEQ ID NO: 6848735 - DNA, 66 bp, Homo sapiens
agtagccaaagatagagccgtttccttggtccatcatactgagagcgttcctttctttgagtagct

SEQ ID NO: 6848736 - DNA, 125 bp, Homo sapiens
cctcaaatgtaattggcattggaaaactgctggttggttgaatgaataagtggatgagtgattaatttactctgtactcatttcaaacagcacaaaagttacaacattgcacgataaatttgagg

SEQ ID NO: 6848737 - DNA, 55 bp, Homo sapiens
tatttgcatcagttgctaaatcctgttggttagcaaagcccttgctgtgtaagtg

SEQ ID NO: 6848738 - DNA, 63 bp, Homo sapiens
ctgacttcacatgaatggcctggaggggatcatatttttaaacaggaaatcagtgtgaattag

SEQ ID NO: 6848739 - DNA, 69 bp, Homo sapiens
tctgcaacctgaattctgctttggcatgtgtcataccatattcttaggttccagagattagggtgtgga

SEQ ID NO: 6848740 - DNA, 77 bp, Homo sapiens
agagaaatggtaaaaagcaaacagaaccccaagctttgctcacaagcttggggcctgctatgctctaccttgtctct

SEQ ID NO: 6848741 - DNA, 57 bp, Homo sapiens
tccctgggcctatcttagctcccaggtcaaacttagagttgcagcaggccacaggga

SEQ ID NO: 6848742 - DNA, 98 bp, Homo sapiens
catgcttggcatgtgtgacagtaatgggcaagacaatatgtctcctgctttcatggaatatatgttctccttcccagtattgcatcttccacagcatg

SEQ ID NO: 6848743 - DNA, 55 bp, Homo sapiens
ggagcagtggtcattcagctggccttttcttcagctgattgattgtcctgactct

SEQ ID NO: 6848744 - DNA, 91 bp, Homo sapiens
ttctatgggcgctgtatatttcatcgcagttcatctttcatatcctgggaagtatgtcaaaatctgcatgatatgtgtcgtgttataagga

SEQ ID NO: 6848745 - DNA, 97 bp, Homo sapiens
tgggggtgggggtggaggggtaacctgggggcgtctgggctgaagggattgacagctcctggctcgctgacctcaggggcctccttcccactctcca

SEQ ID NO: 6848746 - DNA, 73 bp, Homo sapiens
ggcaaaggactacaaagtcagaataacaggtgtaattaacacttctgtgtgctggctttttgctccacacgcc

SEQ ID NO: 6848747 - DNA, 56 bp, Homo sapiens
ggatgaggaaaccacagtgtccttattgaaggagtgacttactgacttctacatcc

SEQ ID NO: 6848748 - DNA, 62 bp, Homo sapiens
aatgtctttatttcaggtttacttatggctgtctatacggtagaacctaaaaaaaggatgtt

SEQ ID NO: 6848749 - DNA, 58 bp, Homo sapiens
cccagggctgcctgactccagagcccagtgtttcacccccaggccaggcagccctggg

SEQ ID NO: 6848750 - DNA, 70 bp, Homo sapiens
gtcagtcattgaatgctggcctcttggaggaaaggtgacaacaggtgaggccagcaccataggggctgac

SEQ ID NO: 6848751 - DNA, 85 bp, Homo sapiens
tacatttattttattcatgaagtgtgattttgttttgaccattataaaatggtaggaatgattacgactttataatattgatgta

SEQ ID NO: 6848752 - DNA, 73 bp, Homo sapiens
ttaaagctattacaatctgctactatgaataaatgagtattttagctctcaaagggtaatgtaatagtcttga

SEQ ID NO: 6848753 - DNA, 61 bp, Homo sapiens
gccatcacgtcagcttgccaggtggtaaagcatgcccgcttcacctggcttctgacctggc

SEQ ID NO: 6848754 - DNA, 86 bp, Homo sapiens
gcacgggaggataatgctaacctgtggacattgctgttgcttcagaggcatgctgcagtgaaatcaggaagcaatcccaacctggc

SEQ ID NO: 6848755 - DNA, 55 bp, Homo sapiens
gcagctgtgtgtaaattttttgtcaggaataaataagtggtttacatccagctgt

SEQ ID NO: 6848756 - DNA, 90 bp, Homo sapiens
ctctctggttttagtggaaaaacagagctttttacattaatgataacttatatacaattgtgttaaagggctttaactgaatccagggag

SEQ ID NO: 6848757 - DNA, 75 bp, Homo sapiens
cacagaggcatgtgattgtggggatggagtggggctcctccctcccttccccagtagtcaagaccgtcctccctg

SEQ ID NO: 6848758 - DNA, 62 bp, Homo sapiens
tgactgggaagtcagagagaggctacctgtgatgtcaggagcctgccctcccttctcagtca

SEQ ID NO: 6848759 - DNA, 64 bp, Homo sapiens
cttaacattagggttccccgtggcagcttcatcctgagcactgcctgtgagccctggttctggg

SEQ ID NO: 6848760 - DNA, 63 bp, Homo sapiens
tcctacaaaattgctgtgaggtggtagtacaaggactgttattcccatttcataggcaaagga

SEQ ID NO: 6848761 - DNA, 59 bp, Homo sapiens
gcagagctggggtaggcaggagggagctggctcacttcctaagtccaccccggctctgt

SEQ ID NO: 6848762 - DNA, 67 bp, Homo sapiens
gggagtgtctggagggaagagatgtcaggctgacctagactagatgtcctttattccagtgactgct

SEQ ID NO: 6848763 - DNA, 67 bp, Homo sapiens
gtcttctgcccaggaggtcccatggggcatgaaatattgatttaggaatttgctgggcatgaatgac

SEQ ID NO: 6848764 - DNA, 55 bp, Homo sapiens
ggagcagggctccaatgtctgggctccgtcctctgaagccagatgccctgtctcc

SEQ ID NO: 6848765 - DNA, 66 bp, Homo sapiens
tgagacaaggacagtattctcttgaaataagctcctgagtttgttttattacggtctttggcctca

SEQ ID NO: 6848766 - DNA, 76 bp, Homo sapiens
cttactttaatagcttagtcctgattctgttgagagtggctgttaatggaacacatgattaatggctattaatgag

SEQ ID NO: 6848767 - DNA, 74 bp, Homo sapiens
gcttgtactgtggtatgacgcatatttctggagtttggcaaaccccagaaatatgtgccatgccttagtgaagt

SEQ ID NO: 6848768 - DNA, 62 bp, Homo sapiens
aatgttttaggcagtatttaggatggcttgactccaccatgctaaaacatgctgctaatatt

SEQ ID NO: 6848769 - DNA, 62 bp, Homo sapiens
gaagccctcctatagtcatctgctaatggcagatggcatccatatgggacctatggtgtttt

SEQ ID NO: 6848770 - DNA, 75 bp, Homo sapiens
gataatctaaacaatgaacaaagcactgattgatcattgaacagagcttgaatgtccatggttttagtggttgtc

SEQ ID NO: 6848771 - DNA, 57 bp, Homo sapiens
cccactactggatgagcttggtgcccgtagccactgcgtggcctgtcctgttgtggg

SEQ ID NO: 6848772 - DNA, 72 bp, Homo sapiens
gcaggaagctggcatgtgtttggctcctgttgtgtaacaggcactttgacatgccatctctatactttctgc

SEQ ID NO: 6848773 - DNA, 62 bp, Homo sapiens
tgagaagatggtcatctgaaagccaggaaaagagactgctccagaacctgaccatgctggca

SEQ ID NO: 6848774 - DNA, 73 bp, Homo sapiens
ccggaagaggcggcccaaggccaaggccagagagcgtcaggcctgccagctgtgggccagcctccctccccgg

SEQ ID NO: 6848775 - DNA, 59 bp, Homo sapiens
tcagttttgtatgaagttatattgcatagaatatgcacttatgctttttataagattga

SEQ ID NO: 6848776 - DNA, 65 bp, Homo sapiens
tttcagagatgcagaattcaggtcccgctccagacccatgagtcagaatctgcattctcctgaga

SEQ ID NO: 6848777 - DNA, 67 bp, Homo sapiens
aggcactttttgcattttagaaatgactgtaaccccctaagtcggttttgaaatttgtaaaaagcct

SEQ ID NO: 6848778 - DNA, 65 bp, Homo sapiens
ccctctgactgggccagttctgggctttgcaaagatggcctggacctggtcaggcggacgcaggg

SEQ ID NO: 6848779 - DNA, 57 bp, Homo sapiens
tgcctaaggaagcaaaggagtttataagaaagaataagatacttgctaacttaggca

SEQ ID NO: 6848780 - DNA, 55 bp, Homo sapiens
ttacgattatggctaagcattgtgctgaaaggaacatagctcagcataatcgtgg

SEQ ID NO: 6848781 - DNA, 59 bp, Homo sapiens
aaattaagactccatgctgggctaattcattagattagcagctgtggagttttgcattt

SEQ ID NO: 6848782 - DNA, 62 bp, Homo sapiens
ccagcagcatatcagagaaagtcatcctctagggatggctgtgaagagagtgtaggtgttgg

SEQ ID NO: 6848783 - DNA, 65 bp, Homo sapiens
caggtggcaggagtgggccttgaagttagcactagtcccatgggctaaatcctgttcaccacctg

SEQ ID NO: 6848784 - DNA, 75 bp, Homo sapiens
gtaggtaagaccttgagtcacctggaccagcctcatcatttctgaggcttcagatgaccttagcatccaatctgc

SEQ ID NO: 6848785 - DNA, 60 bp, Homo sapiens
gaggctggttttcagttactgagttggaggggtccctgagacagaactgagaacagtctc

SEQ ID NO: 6848786 - DNA, 67 bp, Homo sapiens
tgttgctggtgacgaagctggtgctaaaacacttatccctctgagtcagcattttcactgagctaca

SEQ ID NO: 6848787 - DNA, 87 bp, Homo sapiens
gtgttgtcagaccttgtcctggctgctcaggggcttaattctgccttttgatgcagtattcctgagcaccagacactgcacaggcgc

SEQ ID NO: 6848788 - DNA, 56 bp, Homo sapiens
gagaggggagcatctggcaaggggcccatttctcagcacagtacatttcctgtctc

SEQ ID NO: 6848789 - DNA, 61 bp, Homo sapiens
tgttgggagcttggacttagtgtggacacctgatctcccgcctcctccatagctccctgca

SEQ ID NO: 6848790 - DNA, 71 bp, Homo sapiens
gaatgtaacatcctgacaagaaagccagaaagaacatacagtttctgtatttctatgcaggattatacctc

SEQ ID NO: 6848791 - DNA, 81 bp, Homo sapiens
ggggtttcccctccttgacctttttcttcacctcctgctcccatactcccgttggatggtcaggcaaggagggctggcctc

SEQ ID NO: 6848792 - DNA, 55 bp, Homo sapiens
ctctgtttctcagcctatttccacttgtatggagcaagtgggctagaaatcaggg

SEQ ID NO: 6848793 - DNA, 128 bp, Homo sapiens
tccccattgaacgggactgggaggcagtatagtggttaaatgctccgatcttggtgccagactaatttggattcaagcctggcatttagctctctgagaatctgttttctcttctgcaaaatggagga

SEQ ID NO: 6848794 - DNA, 69 bp, Homo sapiens
ttcacatgcaagtcctcagttctattattttaatgtaaaactctagagcttggactgcattttcgtgag

SEQ ID NO: 6848795 - DNA, 93 bp, Homo sapiens
gttaagacttcgctctttttttatgccatccgtttgtgttagtgcctaaaatgaaccagatttatgcaaaaaggaagaaagtaaggtcaaaac

SEQ ID NO: 6848796 - DNA, 55 bp, Homo sapiens
caagccagcttgatgacctgtcggacatcacagaagaagttgtccagctggtttg

SEQ ID NO: 6848797 - DNA, 64 bp, Homo sapiens
cagaaagtgcagctttttctttacatgattttcaaaaatcttgtgcgattgaactgcatgactg

SEQ ID NO: 6848798 - DNA, 85 bp, Homo sapiens
gtgttttgttttaaactgtagaagggacacaaaagtccacaatttgggcttcaaacttatttttacagctgtaagatgaaaacac

SEQ ID NO: 6848799 - DNA, 77 bp, Homo sapiens
ccagcagcttctttccttcccaggtgtcgccgcctgctttctgcagccgctgcctgggaggggttccgaggttctgg

SEQ ID NO: 6848800 - DNA, 80 bp, Homo sapiens
gatggcccaagaggcttggtggtgggagagctttctggaactgcactggctctaggttctcaccctcctctctggccatc

SEQ ID NO: 6848801 - DNA, 130 bp, Homo sapiens
ggaagaggcatcctccgagactacggcagtggctcctctctactcccagctgacccccagaacactgtcaccgcgccgcggaggagagggggctttgcctcaagtcaggaagatcctcgcctctccatcc

SEQ ID NO: 6848802 - DNA, 55 bp, Homo sapiens
aggcttaactacaatttttgccatgaatttaagctggcattttttagttgagctt

SEQ ID NO: 6848803 - DNA, 99 bp, Homo sapiens
ctgggaataagtcgtgttagaagtaaaacacacagtccaccggcaggtaagaaccacctgatgggggacttgtttttctgcgctgagacttcttttcag

SEQ ID NO: 6848804 - DNA, 79 bp, Homo sapiens
ggattagtcaccagtctattccctctgaagagaaacacatctctgttcatagggagagtggtggaaagctaatgaaacc

SEQ ID NO: 6848805 - DNA, 60 bp, Homo sapiens
ctgagagctggctgggatctctgggaaggaacatggccccaggccccaggaaactctcag

SEQ ID NO: 6848806 - DNA, 65 bp, Homo sapiens
ccatctaaggacaggccatgagggttcgattttgtgtaagagacatggccagatctattaggtgg

SEQ ID NO: 6848807 - DNA, 97 bp, Homo sapiens
tagtggcaggttgcatgaactaattcttttcattaacacctgagggttttgcctttcagctgtatgtttatttgggaattgattttgcctgctgttg

SEQ ID NO: 6848808 - DNA, 70 bp, Homo sapiens
ttagggaaggagcagggggaggaggactcggcgagctcctgtgtgcccacctgctctcacttctccttaa

SEQ ID NO: 6848809 - DNA, 62 bp, Homo sapiens
gtccatccacctctcgtctacccactgggaagcacagtaatgaagacagggaggaggaggac

SEQ ID NO: 6848810 - DNA, 56 bp, Homo sapiens
aggccaaagcaagaccctgtaaagcacaaagcccagagcaggtaatgctgtggtct

SEQ ID NO: 6848811 - DNA, 69 bp, Homo sapiens
tcagaagtagggaaatgttttacttagagatttaaaatacttaatttcattacatttctatgcttctgg

SEQ ID NO: 6848812 - DNA, 62 bp, Homo sapiens
ccttctctgcaggtagttggctacaggggtctaccaaaaccaatctatttctgcagtaaagg

SEQ ID NO: 6848813 - DNA, 70 bp, Homo sapiens
cggcgctctcttctcctggcccgcagccgggagccaaggcccgggggtgggcggggaaaggggagaaacg

SEQ ID NO: 6848814 - DNA, 82 bp, Homo sapiens
ggtttgtaagatgagtcgtatgctagggagacaggcagctgaatgtatactgtctgtgtgagcaaatgacttcttttgaacc

SEQ ID NO: 6848815 - DNA, 59 bp, Homo sapiens
ttctctgatgacctatgatgttgaacactttttcttgtctttttttggtcattcgagaa

SEQ ID NO: 6848816 - DNA, 70 bp, Homo sapiens
gacattaacccattagacgtggaagattgtgctccaagactttttccagcttcagggtgggaaagatgtc

SEQ ID NO: 6848817 - DNA, 61 bp, Homo sapiens
gctgacccacagactcctgagtcacgatcaccgattgtttcaggatggtttgttacacagc

SEQ ID NO: 6848818 - DNA, 65 bp, Homo sapiens
agccttgagaagcctccttgcagtgataagggttatcctggaggacagaggcatctcagcaggct

SEQ ID NO: 6848819 - DNA, 59 bp, Homo sapiens
gactgtgggaagactgtaggttactcattggtgcaggcgctttcagaagtctcatagtt

SEQ ID NO: 6848820 - DNA, 113 bp, Homo sapiens
gctggccccactggaggttgtgctggactcagagttggtggcagtgctggccctactggacactgtgctggactcagagttggtggctgtgctggccccactggaggttgtgc

SEQ ID NO: 6848821 - DNA, 70 bp, Homo sapiens
aatcaatcaagtagataaaaatgatgttgtagatgatgtctgctagcagctctgatatttacaattgatt

SEQ ID NO: 6848822 - DNA, 64 bp, Homo sapiens
ttgttcagagctgggtttggtcttaagagtcattaaaagactctctgagctaccaggtgagcaa

SEQ ID NO: 6848823 - DNA, 109 bp, Homo sapiens
agagaatacaatatcgagtcgctgactggatctaattggttatagtgcctagatactgtatttgtcctaggtccaggatcatgtggctagttttatatttgtatattct

SEQ ID NO: 6848824 - DNA, 101 bp, Homo sapiens
agacttgaggtccctttagatacagtaaccacattctatagttggatgtctgtgaacttacatatggagaaaggttaatgatcaagtggtctaaatagtct

SEQ ID NO: 6848825 - DNA, 72 bp, Homo sapiens
gccgcccgcctcaggctctctctgccagccgtgcggccaggcccgcggggtggtcggggggagccgggcggc

SEQ ID NO: 6848826 - DNA, 67 bp, Homo sapiens
atgaaggactatctagggcttcccaaaagaaggggaatttcaaactcttgccctcagaatttttcat

SEQ ID NO: 6848827 - DNA, 103 bp, Homo sapiens
tgagaggaggacctggctttaaaatgctcctggactttacttctgtttacctgaggcgagcatgattttccacagcttttaaatgtctagttcctccgcatca

SEQ ID NO: 6848828 - DNA, 59 bp, Homo sapiens
cccaaacctaggcagagttccgtgcgtgattcacaactttggaggcctgcaggtttggg

SEQ ID NO: 6848829 - DNA, 61 bp, Homo sapiens
caggtctgaagagtcacatgcccaggggcagaatttaggggccagattttcttagaacctg

SEQ ID NO: 6848830 - DNA, 73 bp, Homo sapiens
ggggacgagagccaggtggatgggaacaggataaacagcctctctggatccagtctgtctaccttctcaccct

SEQ ID NO: 6848831 - DNA, 89 bp, Homo sapiens
tctgcttctgtgtcttctctctccaggcgaggtcctactgaggttgttgccagcgatagtcctctcctggagcttgaattggaagcaga

SEQ ID NO: 6848832 - DNA, 79 bp, Homo sapiens
tggtgacatggcactttgtgtgggatcaggggtcagaagagtccatggctcttgtcccatttgcagagatttgttacta

SEQ ID NO: 6848833 - DNA, 56 bp, Homo sapiens
gagaggtgacaggacaggagctggtgaacctcacctggacacctgctgtcatctcc

SEQ ID NO: 6848834 - DNA, 126 bp, Homo sapiens
gtcccagtttcttgatgtcattttggtgaaattcaacttgattaatcccatgtgagtagttcacaattatctacttcattacgttgatcacttggtcactaattaatcaaagtctagtactgggat

SEQ ID NO: 6848835 - DNA, 89 bp, Homo sapiens
gccctttagaaggttgtcaggatttgtttagtataggcctaatataggcctaatatgcaaaattgatacttgatatactctgaggtggc

SEQ ID NO: 6848836 - DNA, 65 bp, Homo sapiens
tcagactctgcccgtgcctttcccagtccgggacaaaggaccattgagagtcgggcggggcttga

SEQ ID NO: 6848837 - DNA, 59 bp, Homo sapiens
aacaagttctaagtgtctactttgacagacaggattaaaagtaggtgctcatatttgtt

SEQ ID NO: 6848838 - DNA, 66 bp, Homo sapiens
ctgtaggttttagggaaacatttattatacagtactaccaaaataaaagtggatccctaagaacag

SEQ ID NO: 6848839 - DNA, 91 bp, Homo sapiens
caaatgtcctttggccttttgtcaaatccacactgacctcttttcaaatgcgtgtggtcagtgttatttttcaaaggccctttgaagtttg

SEQ ID NO: 6848840 - DNA, 61 bp, Homo sapiens
agtgacagccaaatccatccatgtcagagcaatggcctatggtatgtggtttcgtgtggct

SEQ ID NO: 6848841 - DNA, 62 bp, Homo sapiens
gccaggcacagttctaggtgctggggatattgctctgagtacaacagaatctttgctttggt

SEQ ID NO: 6848842 - DNA, 58 bp, Homo sapiens
gcgagatatgatagcacaagggccttaattccctccctatcatgctgtcatgtttggc

SEQ ID NO: 6848843 - DNA, 69 bp, Homo sapiens
ggagagtgggggcagctaccggaagtagggggatgagaagctccctccggaatgtatgcccccctctcc

SEQ ID NO: 6848844 - DNA, 63 bp, Homo sapiens
tgtggcctttagtggttctggagtcggttcttctgctggttctgacacacccactgggccaca

SEQ ID NO: 6848845 - DNA, 97 bp, Homo sapiens
tattaaccacagttagaatttaagatagcacgtctagatatatttgggcttataaagtatattgtaggtgctatttgaacttcatatatgtttaata

SEQ ID NO: 6848846 - DNA, 56 bp, Homo sapiens
tcagccaggcacaatggcagctgaacactgatttggtatcaacgtgtttgtgctga

SEQ ID NO: 6848847 - DNA, 57 bp, Homo sapiens
cctcaagaaggcatccccagtccctagatgctgagctcagggaatgcttcctttagg

SEQ ID NO: 6848848 - DNA, 77 bp, Homo sapiens
ttttttcaaaggttaatgttgtcatgttattttactcatgtaattattgccatggaagattaactctactgggaaga

SEQ ID NO: 6848849 - DNA, 62 bp, Homo sapiens
gatatttaactctcacaggtcctcaatgcagtgtaatctacacacctttgagaagaaatgtc

SEQ ID NO: 6848850 - DNA, 79 bp, Homo sapiens
ttagtgcagtcttctagagtaaggaacaaatgaagtccaatcactcccattggcattccttctcaggaatatttcctaa

SEQ ID NO: 6848851 - DNA, 69 bp, Homo sapiens
ttatccatcttctttgagaatggaagagcttttgtgaagcagtacatcattgctcaagataatggttga

SEQ ID NO: 6848852 - DNA, 81 bp, Homo sapiens
gtcacattatgttgcacaaagtccatccattctacctagggagaaagatggaagagacttcatggggcgagtatttttggc

SEQ ID NO: 6848853 - DNA, 61 bp, Homo sapiens
acagcctgtttgatctggtgcttgttggctttaacatccacaatgaatacaagcatgttgt

SEQ ID NO: 6848854 - DNA, 59 bp, Homo sapiens
atcggcaagccccacaccgtcccttgcaaggtgacaggccactgcggctctgtgctggt

SEQ ID NO: 6848855 - DNA, 74 bp, Homo sapiens
atcccctggcttacaccctctttttgatagagctcatccttcagtagcttcttgagaaagggtgcctcggagat

SEQ ID NO: 6848856 - DNA, 79 bp, Homo sapiens
taattatatggtgaagttctacctcccagtatctcagaatgtgaagtatttggagataagggctttaaagaggtaatta

SEQ ID NO: 6848857 - DNA, 56 bp, Homo sapiens
gcctttggagcaggcttcaatcttctctccctctggagagaagcctgcctcaatgc

SEQ ID NO: 6848858 - DNA, 110 bp, Homo sapiens
ggatggtatgttgagttctaatttaaaggagatgctacagagataggttgggttaagataacttcctgctatgagcttctgtgatttttatttgaattttcttcccatcc

SEQ ID NO: 6848859 - DNA, 91 bp, Homo sapiens
agttggattggcaaacggaagtattattgtatacttttcaatagagttagggaaaatatactatactactttctggaagctcaaccctact

SEQ ID NO: 6848860 - DNA, 61 bp, Homo sapiens
gcacctggggccagcttaaccaaggggcatacaaatattcccagcatggcctacagtgtgc

SEQ ID NO: 6848861 - DNA, 112 bp, Homo sapiens
ggttacaggagtatcttaaaaaggtgattgcagattcggctgctcaggatatagtgttgcggttattagcttttgacaatgctaatctcaattgccaggctgctctgtgacc

SEQ ID NO: 6848862 - DNA, 56 bp, Homo sapiens
gtttcaggttggacaacatgcccacgttgggtgagactgatgggataatctgagac

SEQ ID NO: 6848863 - DNA, 63 bp, Homo sapiens
ctaatcatacctgcaaagttccttttgccatgtaaggtgacatgtgaaggtttcaggggttag

SEQ ID NO: 6848864 - DNA, 83 bp, Homo sapiens
atgattggtaaagttgctgttgaagacactgcctgttatgttcttcaataacaaaggcagagaattcaacattttcttttcat

SEQ ID NO: 6848865 - DNA, 79 bp, Homo sapiens
gttggttttatgattgcagttgctttctatattgaattatcaaattcaaacagaggaacaattgttttgtataattgac

SEQ ID NO: 6848866 - DNA, 114 bp, Homo sapiens
cctggggctggaatgctgggggttctggaagctgggcagcaccctttgactccaatatagagtgggcaagtgccctaggctttcccctccagcctaactgttgtctaccccagg

SEQ ID NO: 6848867 - DNA, 55 bp, Homo sapiens
atatccagttcaatgaaagaaatgatcctattgtgtttttcattgagtgtgatat

SEQ ID NO: 6848868 - DNA, 98 bp, Homo sapiens
agatagatagatagacagatgatagatacttgtagatacagactatgcttgatgctctaaatccaaataagtgtccaattaattagctattttcttct

SEQ ID NO: 6848869 - DNA, 75 bp, Homo sapiens
agtgtcagaaagccaactccaactgtctacagcaataacagtgtgacagtgtatcaggagtggggtttttaagct

SEQ ID NO: 6848870 - DNA, 88 bp, Homo sapiens
tgatatagaatcctggtgagtgaatatgttccctgatatccctagatacaaagacaaatctcaatctttaaaactttgattctgttca

SEQ ID NO: 6848871 - DNA, 67 bp, Homo sapiens
tggacaggtgcaaagggcacatgacaccttcatcaatgcagcctcgtgtaagtccattgcctgtcta

SEQ ID NO: 6848872 - DNA, 77 bp, Homo sapiens
catgtttattatgcacctaagcgatgtcaggcattgtgctagatattgcgaatgtggtgataaatgacatagacatg

SEQ ID NO: 6848873 - DNA, 57 bp, Homo sapiens
cccagtcagggcatttggaaggcactgctgagcctagcctcagtgtcctggactggg

SEQ ID NO: 6848874 - DNA, 78 bp, Homo sapiens
tcttcttccaccctatctctgtccacctcaaagccgtccattccctttggctgtaggaagacagaatgcagaagaaga

SEQ ID NO: 6848875 - DNA, 58 bp, Homo sapiens
tggaaacctactgatacaggagttaagtacagctggctctctgtatccatgggttcca

SEQ ID NO: 6848876 - DNA, 107 bp, Homo sapiens
tggtttaagcctctaagttttgcgtgtggtttgttgttatatagcttgcagataagcagcaggctgcctaacccttaagtgtcacatgcggaagaggcaaggaacca

SEQ ID NO: 6848877 - DNA, 69 bp, Homo sapiens
ctgggctgcatcaaagaggcatttccaagttctttgcaaaacttttcttgactttatttgacagcccag

SEQ ID NO: 6848878 - DNA, 93 bp, Homo sapiens
taaggtgatgctgaattagttctccctgcatacacatatcactcctaagcatgggacagacagtgtgagtgaggctgaggaagtatgatgttg

SEQ ID NO: 6848879 - DNA, 59 bp, Homo sapiens
ctgaaggctggggtgcagacggcctcctcagtgatgaaggcaaatggcccaggcctcgg

SEQ ID NO: 6848880 - DNA, 79 bp, Homo sapiens
tagtgtactcttaaaacttctcaactagcttagagtcttcactgaagaaatgttgtatgaagaagtatgggttacactg

SEQ ID NO: 6848881 - DNA, 80 bp, Homo sapiens
tgtgtgtgtgtgtgtgtgtgtgtggttttacattgtgatgctgtcttagtccattagggccaccataacaaaatgccaca

SEQ ID NO: 6848882 - DNA, 63 bp, Homo sapiens
ctcccaaagtgctgggattacaagtgtgagccaccgcgccccatctacagtacttttttagag

SEQ ID NO: 6848883 - DNA, 56 bp, Homo sapiens
gataataggtctgaaacttctggaagcccctaggccagcaggtggagcctcttgtc

SEQ ID NO: 6848884 - DNA, 116 bp, Homo sapiens
tgctgacaagtttccttaattgatattaaagttcgtcattcaataaagaaaccattctaaggcaattcagtgtggaatgtgaactgcagtgaacacagacaagaaattaaaaagca

SEQ ID NO: 6848885 - DNA, 73 bp, Homo sapiens
ttttgttaaatcctgtgagatttatgctttaaagaggttctgttttgatgtgtttccaggatttgtttcaaga

SEQ ID NO: 6848886 - DNA, 63 bp, Homo sapiens
gtagttattttacatggaagtttgctgtaggaatgttgctaacttctttgtgggcataagtac

SEQ ID NO: 6848887 - DNA, 87 bp, Homo sapiens
tatataagaggaataacatgtcagaatcaacttgagtttatcccaggaatacaacactggttcgacatgtgaaaatcactcagtata

SEQ ID NO: 6848888 - DNA, 56 bp, Homo sapiens
tggggaggtatgaggaactttgaggaacccagaccttctgctggcatactgcccca

SEQ ID NO: 6848889 - DNA, 79 bp, Homo sapiens
ctggctcattttctttcactgctcaataggggaaattaaaagcacctactttatagggatgtggtgagaactgagtgag

SEQ ID NO: 6848890 - DNA, 88 bp, Homo sapiens
ccctttttaatcaattgaaggaagtcccatttcaccagctgtcccagcctggaggtggaagggactgcctagaggaggtgaaagaggg

SEQ ID NO: 6848891 - DNA, 71 bp, Homo sapiens
ttcatcaaagagaagtttttcttattacatgtaatacatagttcatgatggacaaagacttctcttgtgag

SEQ ID NO: 6848892 - DNA, 72 bp, Homo sapiens
aagctctgacactaaagtatagggtatctcgccattcagctaattgctaggcggctgtacttttgagagttt

SEQ ID NO: 6848893 - DNA, 78 bp, Homo sapiens
gccatcaatgtcaatgactccctcaccaagagtgagttcaacaagctctatggctgctgggagtccctcatagatggc

SEQ ID NO: 6848894 - DNA, 67 bp, Homo sapiens
agacagtgttcactaaggttagctttacttttgcctagtaaataatgggttcctagtgaacctgttt

SEQ ID NO: 6848895 - DNA, 63 bp, Homo sapiens
gctaattcaaccccatggctttaaatactatcagtgtgctaatgtctccagggttgacctagt

SEQ ID NO: 6848896 - DNA, 68 bp, Homo sapiens
ggctgcagggtgacgttgcccacctctggctccacgcagatgctggtgaagtaacgcgccctgttcac

SEQ ID NO: 6848897 - DNA, 83 bp, Homo sapiens
ggtctggggacagacagagtcttcccatcagtcttccagaacagggaggagatggctgggagctctgtttggtaccaacaacc

SEQ ID NO: 6848898 - DNA, 80 bp, Homo sapiens
cgctgtccgttctctgctcctttgccacgctgagcgagctagctgtggccagatgtgagcggtgtgcaggacggacagtg

SEQ ID NO: 6848899 - DNA, 129 bp, Homo sapiens
cattagctgacgataatgaatcttctgttctgaaaagcatggtttagttgatttttttaattttacttcaatggagcagtaccttgtcttttatagaacaagttagacaaaccattaatgacaagagtg

SEQ ID NO: 6848900 - DNA, 113 bp, Homo sapiens
ggttgctatagcaaaggacaagtgagaagaaatttccatcaggtccagtctccaattggctgaagattggctccatggaagataattttcccttgtgtctgagttgggcaatc

SEQ ID NO: 6848901 - DNA, 76 bp, Homo sapiens
ctctgattttcattgacagttctttaagttgctttggaagtgttgtagcattttgctccttaaggcagagtcagag

SEQ ID NO: 6848902 - DNA, 130 bp, Homo sapiens
gggttaaataaggagctcaagtttcctcagaattggaaatcagatctgattccattgtgttaatactatagacagatgagattcattgaccactgacaggatgctctgtctcctacctatttgttaacct

SEQ ID NO: 6848903 - DNA, 64 bp, Homo sapiens
gtcctctcttcaaatatagtcacattaggggttagagtttcaatgcattaatttgggagagtac

SEQ ID NO: 6848904 - DNA, 88 bp, Homo sapiens
tacatttggcttatattcacccaataatactgaataacaatttaacacaaagttacttggatgatgggttgatgtgaagggggatgta

SEQ ID NO: 6848905 - DNA, 58 bp, Homo sapiens
tctaagctgaccacatggccaagccatgtgtcatgatgtggagttgtggcagtttgga

SEQ ID NO: 6848906 - DNA, 116 bp, Homo sapiens
gagaaagtgcagtttctagaaagagtcaagtcatctaaggtctaacttttaagagctgcccagtgtgggcttcttccagaggatctcaggtatttccttaaacatgtactcttctt

SEQ ID NO: 6848907 - DNA, 55 bp, Homo sapiens
gcatttcccacaggaaagtagacattgttgccaatgtattgtctgtgggacatgt

SEQ ID NO: 6848908 - DNA, 83 bp, Homo sapiens
gtggtctgtaagcctgtttcaagcaggtggcgcaagaatctttgttgtgactgtggtgagatttaagagtaggacacgattac

SEQ ID NO: 6848909 - DNA, 91 bp, Homo sapiens
gcttttgaagcaggatcgtttgcttcattctcaaaacagccacttcagtccctccttgttcccacctgaagcaaacgcttctgttccttgc

SEQ ID NO: 6848910 - DNA, 68 bp, Homo sapiens
gggagcagaaggagttgtaaaatggggaaatgtaccacatttcaactagcccctaagtcctctgccct

SEQ ID NO: 6848911 - DNA, 55 bp, Homo sapiens
ggcgtgaagcccagggaacgaggctgaaaaaggctctcttccctggctgtcagtc

SEQ ID NO: 6848912 - DNA, 102 bp, Homo sapiens
tttaaaggatgtggacataaggaagagcaaagaattatgttcaaacgcaacacacaattagttttatgctttaggatgattcctttgttacaaaccattaaa

SEQ ID NO: 6848913 - DNA, 63 bp, Homo sapiens
caagtgaatgatgtgaagtgtaaaccaaccattgttgtgtttcatgttactgtcatacacttg

SEQ ID NO: 6848914 - DNA, 66 bp, Homo sapiens
gtgggctgggtttgactcctggcttctccactgactgggatgctgggagtgaagcccctggcacac

SEQ ID NO: 6848915 - DNA, 83 bp, Homo sapiens
ttatcaatgtccagcccagtttggtgaattgctctatctgggaattcgattttccaacagggcttctcaaaggaggttgttaa

SEQ ID NO: 6848916 - DNA, 64 bp, Homo sapiens
gggaaggcttcctggaggaggtggcctcccagagctcagcttgtccttccttgaggtcctttcc

SEQ ID NO: 6848917 - DNA, 68 bp, Homo sapiens
tcagaaaggagttagaggtctcattttagagaaggttaatatactaaagacatttaattgctttctgg

SEQ ID NO: 6848918 - DNA, 110 bp, Homo sapiens
tcacgagaaagctgatcaagaaggcggaccagaagggagtgaccatcatcggacctgccactgtgagcttcccctccggaaagccttttacgttcgatgctatcttatga

SEQ ID NO: 6848919 - DNA, 78 bp, Homo sapiens
gtaataggttattcagtgtgttattctactttcataatctttgtgatcctgagatgtcatgttaatgcactttattgc

SEQ ID NO: 6848920 - DNA, 118 bp, Homo sapiens
acactgaaaataacaactcaggtctcataaagaaggaaatcataattttgtgaatgtagtcattctgatttgatatgcaaaattatggaccctaagacctttagttgttgtttcatgt

SEQ ID NO: 6848921 - DNA, 81 bp, Homo sapiens
ccacttgattattcagattacttgtgcctgctggccgtgcttgggccaaatgccgggtataatactctgactgaacaatgg

SEQ ID NO: 6848922 - DNA, 68 bp, Homo sapiens
cctgctctgatagcaaaggacaatagtcagtgattttcacactgactctgatggttgatagagctagg

SEQ ID NO: 6848923 - DNA, 69 bp, Homo sapiens
gacaagaacatttgtttcgttatgtgaactttgatcatgagtttaataacatgaacaagtaatcatgtt

SEQ ID NO: 6848924 - DNA, 90 bp, Homo sapiens
gaatttaatgtcatatatggtagggaaatttgctcagttagaatggctacagaatgggtttttcattgtctacatatgacattttagttc

SEQ ID NO: 6848925 - DNA, 76 bp, Homo sapiens
ggccctccaggcgggaggcggttccaggaagtgaagtgagcaggtgctgggactcccctcccctcctggaggcgcc

SEQ ID NO: 6848926 - DNA, 72 bp, Homo sapiens
gttgcgcccattctgctcatgagctcccgggtttccaagcgggacctgtctgagccagggtgggcagccaac

SEQ ID NO: 6848927 - DNA, 115 bp, Homo sapiens
aaatttgaatttcagataaatagtgaataattttttagtataagacagtcccaaatattgcatgggacgaacttatactgaaaaattatttgtcgtttatctgaaagtcagattt

SEQ ID NO: 6848928 - DNA, 84 bp, Homo sapiens
ctgcagaaagcaagctagggatggatgatgcctggcaatgaaagtcgttttcaaagaccattaactatcagctgctttactcag

SEQ ID NO: 6848929 - DNA, 56 bp, Homo sapiens
ccaggaaagaggaagaacgcatatgtaaaccatgcctaccgttttccttttcctgg

SEQ ID NO: 6848930 - DNA, 55 bp, Homo sapiens
gggcctgaggcccagacactggccaccctggctcagagtctggactgcaggctcc

SEQ ID NO: 6848931 - DNA, 56 bp, Homo sapiens
cagttagagggctcctgggccacccccaaatatctggcttgcccacatctgcactg

SEQ ID NO: 6848932 - DNA, 62 bp, Homo sapiens
ctgaggaggggctcttgggcatgaagggctttgagcatcttggtccctgagctctttcacag

SEQ ID NO: 6848933 - DNA, 60 bp, Homo sapiens
gtttgaattaggaaattatatgtcctccacttaatatcagttggagtttttagttcaaac

SEQ ID NO: 6848934 - DNA, 64 bp, Homo sapiens
ctggtgggagggtgtgctgggttgtgtttgctggtgagcccagcaactgcacccttctttccag

SEQ ID NO: 6848935 - DNA, 69 bp, Homo sapiens
tgccaagcccaaacatgtggaactaaatcttaaaacccctaagaatcttgacagtttgggaaatgagca

SEQ ID NO: 6848936 - DNA, 55 bp, Homo sapiens
agaatcagtgctggctattagctacaaaggtaccagctaatacctcactgaatct

SEQ ID NO: 6848937 - DNA, 75 bp, Homo sapiens
gactggcatggttccctaagcattgcaatggcgttcacacagtgtgccaggaggcggcttgggaaagtgctgctc

SEQ ID NO: 6848938 - DNA, 65 bp, Homo sapiens
agcctgtgctctcctggctgccctgaccaccatgggttagggtccacagaaaagggctgaggact

SEQ ID NO: 6848939 - DNA, 58 bp, Homo sapiens
gacattcattgatgtcttcctctgtaccaggccagtactaggaggaaaaaaatgagtc

SEQ ID NO: 6848940 - DNA, 90 bp, Homo sapiens
tgtgactgctaagaagtattgtgggcaaagattttaacaaacaaaaatatgaaaatcacaacaagctatacacatttcttggtagtcaca

SEQ ID NO: 6848941 - DNA, 73 bp, Homo sapiens
gttggattcctgggaaccatgcagtttaaacttaaattatagtaatatgttgcctgttcctattaatgtcagc

SEQ ID NO: 6848942 - DNA, 71 bp, Homo sapiens
tattttttggaccatttattagttcttaagatggtaatgccaggcttaatttttgtagtagatggaaaata

SEQ ID NO: 6848943 - DNA, 85 bp, Homo sapiens
ctaattccactcatgcaaaggtcccaactcccaacaccatcacactggaggttaggatttcaatgtacagactttgtggagagag

SEQ ID NO: 6848944 - DNA, 70 bp, Homo sapiens
gtacaggccagtcacttacaaaaatataatatgactcacaaattgatgcccgttgtgactggcctatagc

SEQ ID NO: 6848945 - DNA, 71 bp, Homo sapiens
tcacatagcaaaatattttgttttcttgctgtaaagtgtatgcagtaaagcctgagatatatgctatctga

SEQ ID NO: 6848946 - DNA, 69 bp, Homo sapiens
gtttgcaacatagtcctatgtagtgattttaatgatatcgcatactttacacatggattttgtgcaaac

SEQ ID NO: 6848947 - DNA, 118 bp, Homo sapiens
ttcattaggtttgtttagtttccattgcttcaggggtgttagttttgtgttcccaactagattataaactcctcttgcattcctgatggcagtgacttgaaggcatttatttgaagaa

SEQ ID NO: 6848948 - DNA, 65 bp, Homo sapiens
tagggtgatctgataaatagggatttctgcatagagctctgaatcaatcagataaggtacctcta

SEQ ID NO: 6848949 - DNA, 100 bp, Homo sapiens
ttggtgacatcaatcttcgttacttggtcaaggtagacaagagttttaattttgaaatattctctctacacagccttgccaagagaggattttgtcccaa

SEQ ID NO: 6848950 - DNA, 74 bp, Homo sapiens
tgtgcaacctttggttgagtgaaagtaagtccacatcatttgcctgcttcactttcgttatccagatttgcaca

SEQ ID NO: 6848951 - DNA, 71 bp, Homo sapiens
gggattgagttaggtgaaagctagtgtttgggaagatggctcgggaaactgcttacactagagggaatctt

SEQ ID NO: 6848952 - DNA, 85 bp, Homo sapiens
gtgcaggttcacttgaatcacactcgtaagtgagttggaagggactccagctaactcttagctgtaattcaggccaatctcccac

SEQ ID NO: 6848953 - DNA, 71 bp, Homo sapiens
ctctggctcccgcagcccccatggtttgggctttgggctcttcacatgtgcagggcagcggagagcaagag

SEQ ID NO: 6848954 - DNA, 96 bp, Homo sapiens
gcagtacctctggcttcttcaggagtccatctggcctggtggagttttgcctaagtttccacggcctgtaaggacccaggagcagaaactggctgc

SEQ ID NO: 6848955 - DNA, 67 bp, Homo sapiens
gaccatagcagtggcattttaatggatgtcagcctcttgagagtttgaatagtgtcagtgttaggtt

SEQ ID NO: 6848956 - DNA, 56 bp, Homo sapiens
aggctggctggggatgcgtcttcatgtcgtctcagggcacatcctagggttagctt

SEQ ID NO: 6848957 - DNA, 55 bp, Homo sapiens
gcggaggcgcggggcgtggcacacgggcagccccgcccaggcctggcgtctccgc

SEQ ID NO: 6848958 - DNA, 88 bp, Homo sapiens
acctatctttggaacacaatgtttctttcagcacatgtcacaatgtgtataaagtatttctgaggggatgtgtttctaagttaaaggt

SEQ ID NO: 6848959 - DNA, 58 bp, Homo sapiens
gctcccagcattgctgctgaataagccagccctttggttacttcagtgcagagtgagc

SEQ ID NO: 6848960 - DNA, 62 bp, Homo sapiens
tctatgtaaagccatattgataaagtgggtttttttacattcaatattctggctttaatgga

SEQ ID NO: 6848961 - DNA, 70 bp, Homo sapiens
ctacttctttctcttttcttttggatgcagttactttctttcagtctctaataatggagagaagcagtgg

SEQ ID NO: 6848962 - DNA, 63 bp, Homo sapiens
cctgagcctgagtggtgcagggcagcaggcgtcttattatgctcccaaaccatgtgggccagg

SEQ ID NO: 6848963 - DNA, 64 bp, Homo sapiens
ggcagcctccagggcactggtgttttctttgcagaaggtgataatccatgagtgtctgaggccc

SEQ ID NO: 6848964 - DNA, 84 bp, Homo sapiens
gggcaggtcatcctgcaggagggggcggacgccggtcatccctgccgcgtccagggcgggctcccctcagctgcaggtctgtcc

SEQ ID NO: 6848965 - DNA, 74 bp, Homo sapiens
ccaaacagtagtatgaagttacctgtgatgacgctttcttgtgatggctatttaattttaactgtgctgtttgg

SEQ ID NO: 6848966 - DNA, 87 bp, Homo sapiens
aaataaatctacacaattagttgcaaagtgaatggtatagataatctgatcacttcttggaaatgaacatgtgagatagatttgttt

SEQ ID NO: 6848967 - DNA, 56 bp, Homo sapiens
tactggtgtctactacatggttgaaatcgaatagtcaataaggaagacacacagta

SEQ ID NO: 6848968 - DNA, 79 bp, Homo sapiens
gggcagggcagaggctgcctctgggtctcctgattccaggcagtctggggcaggaggcccacaggcccctgcactggcc

SEQ ID NO: 6848969 - DNA, 101 bp, Homo sapiens
ctaagtaggtgctcaataaatatgttctgactctacatgggagccctttgaacatgaggctgggtccctggagtctgatcacattaggtttaccttcttag

SEQ ID NO: 6848970 - DNA, 60 bp, Homo sapiens
cccagtgccaggcacaggcagcccacttccacctagggctgctctgttattggcggtggg

SEQ ID NO: 6848971 - DNA, 82 bp, Homo sapiens
agttttagggttcatgtgcacaacatgcaggtttgttacatatgtatacgtgtgccatgttggtgtgctgcacccattaact

SEQ ID NO: 6848972 - DNA, 81 bp, Homo sapiens
tttgacagatgaaattagaaatatgtatgggcatttaaaaatgtttgtataagaacattctagcatttatggcatgtcaaa

SEQ ID NO: 6848973 - DNA, 64 bp, Homo sapiens
tcctggcaatactcaacacttttgcttgcttcctgcaggaatgtattgacctgttgcattagga

SEQ ID NO: 6848974 - DNA, 67 bp, Homo sapiens
cttgctgagatgaaatttgaaaatagtgttggttcttccactcactgaaattcattcatcccacaag

SEQ ID NO: 6848975 - DNA, 114 bp, Homo sapiens
ttgggggttgggttttatttgctggagtggggggtccgtctcagtgcatcctcctggattccccattaggacgccccgcccatacatccagcctcctctcccggatacccccag

SEQ ID NO: 6848976 - DNA, 107 bp, Homo sapiens
ttggcatatcacaggtaaaagaaaaccactaggtgtcattatagaccagatactatctaggtatcattttactgtgacattttggtttcctgaaagatagatgctaa

SEQ ID NO: 6848977 - DNA, 60 bp, Homo sapiens
gcagcagggcaggatttgaacccagttctgacactgaaatctctgcttcttgccctctgc

SEQ ID NO: 6848978 - DNA, 86 bp, Homo sapiens
gactaatgatgttgaacatcttttcatgtgcatgttgagtacccgtgtgttttctttggagagatgtctgttcaaggttatttatc

SEQ ID NO: 6848979 - DNA, 78 bp, Homo sapiens
gttctttaagcatttatttccttgtcagtgttactatgtcagcaaatatgtgtgggtggtaaggaaggccctgggaat

SEQ ID NO: 6848980 - DNA, 69 bp, Homo sapiens
attttctctttcatggagaaaagctatagctttcactattcatggcttcttaatcatgagagtgaaaat

SEQ ID NO: 6848981 - DNA, 55 bp, Homo sapiens
aggtggcagagtgacaggctgatatgaattacattaaggtttctggctgccatct

SEQ ID NO: 6848982 - DNA, 85 bp, Homo sapiens
gtatgcctgtaaaacagcacccagaggacatactgctccatgccatgcacagaagcctaactgggttctcgttttgcagagcagc

SEQ ID NO: 6848983 - DNA, 57 bp, Homo sapiens
tctcctccaatggttctctgtcccctctcctccagtggaacaggctattgcaggaga

SEQ ID NO: 6848984 - DNA, 59 bp, Homo sapiens
tgtatgtgtgtatgcatgcacatgtatgtatgtacatgtgtatagcctgtatagataca

SEQ ID NO: 6848985 - DNA, 57 bp, Homo sapiens
gtgaggtcctccctgctgggagagttccatggatgttcttggggaggagggctgcac

SEQ ID NO: 6848986 - DNA, 60 bp, Homo sapiens
tgaaagaagcctccctttggagttgctaatgcggcgatggaagggtttggctctgaatca

SEQ ID NO: 6848987 - DNA, 79 bp, Homo sapiens
gtcttcaacaaatggtagggtctgtagcagcaacaacgtaatcagcaggcacttattaagcccactgtatgtgtaagac

SEQ ID NO: 6848988 - DNA, 91 bp, Homo sapiens
tcccacttcttaagtcacatggcttctgtcttggaaattttacctttaaaagattatttaagacaggaaccaggaggcttgggaacaggga

SEQ ID NO: 6848989 - DNA, 57 bp, Homo sapiens
gcagaaaatgatgttaattgccacttcctctagaggcaggaagtgacatcaggctgc

SEQ ID NO: 6848990 - DNA, 61 bp, Homo sapiens
gtggagccttaaatgtttgatttgagcatttaataagatgttcctcactattttggcccat

SEQ ID NO: 6848991 - DNA, 78 bp, Homo sapiens
gtcttacaactgtcatggcactagagtggggtcttgggaacctctggcatctttcctttagttgctgagttgagaggc

SEQ ID NO: 6848992 - DNA, 85 bp, Homo sapiens
gagacactggactagaggacatttagaaaaaacggtctaatagatcaatggtttccaaatgcccatctacacagaccagtgtctt

SEQ ID NO: 6848993 - DNA, 80 bp, Homo sapiens
gccttctcattgcatggcttcttggaatggaggttgaacaaacatcccgagtgccaggaagcataatgtagtgggggggt

SEQ ID NO: 6848994 - DNA, 78 bp, Homo sapiens
ggcagagcacaatattttgcattctgttaaaatgtattttcccccctctggagaaagaatgaaaatgtgtttcatgcc

SEQ ID NO: 6848995 - DNA, 72 bp, Homo sapiens
agagttgcagatggctgccttcttgctgtgtcctcacatggcagagaaagcgagccacactttctgttatct

SEQ ID NO: 6848996 - DNA, 59 bp, Homo sapiens
ctagtttcatactgtgtagcccagctagctgagggtctgggctgctgagaatgagagag

SEQ ID NO: 6848997 - DNA, 128 bp, Homo sapiens
gactttgtgttgatcttttggcctttatgtaatttatgtttatgtttctggcaatgccctgatggttaatgtccttatggtaattaaaacatgtatattaattaagtgtgctactagtaataaaagtt

SEQ ID NO: 6848998 - DNA, 90 bp, Homo sapiens
aggattgaaaattaatgtgtcaaggaattcatgaaaagcttaaatgagtggttcttgggaatttttccaacacacaaagtattctaccct

SEQ ID NO: 6848999 - DNA, 79 bp, Homo sapiens
cattctctcttcttccctgagctttctcaggctgggccaacccaggggcctggggaggtgagggcatgtggagagaatg

SEQ ID NO: 6849000 - DNA, 66 bp, Homo sapiens
atggaatcagagaaaacaagatatgaggattctttaaaaatctgccctgtctttttctgatgacgt

SEQ ID NO: 6849001 - DNA, 68 bp, Homo sapiens
agttcccaagtgcacagcaggagtagtgatgtcctcactggcttctcatttgcattaaactgtgagct

SEQ ID NO: 6849002 - DNA, 86 bp, Homo sapiens
ctgcaggtcaggggggcagctgtcctggccatgggcatctggaccctggtggagaggagcagctacctcagcatcctggcctccag

SEQ ID NO: 6849003 - DNA, 58 bp, Homo sapiens
gcaggatgggagcttcactctgtctcagttgctctggcaaagagaagcctcaccttgt

SEQ ID NO: 6849004 - DNA, 57 bp, Homo sapiens
gaaggagctaccaagactgaatgtggctaataaagcctctttagttcctggcccttt

SEQ ID NO: 6849005 - DNA, 64 bp, Homo sapiens
taggcactgccacacccaatgtttttgtgtgacagcaaagatcacactgtggggcagtgactta

SEQ ID NO: 6849006 - DNA, 80 bp, Homo sapiens
taaacatggctgtttcagttatctttggctgcttaacaaaccaccccaaaatgcagtgcctgaaagcaacagccatttta

SEQ ID NO: 6849007 - DNA, 67 bp, Homo sapiens
cagggctgtttagtctgggcctttgggagttcggtgcagctaatgccttccagaggcccagcccctg

SEQ ID NO: 6849008 - DNA, 71 bp, Homo sapiens
gggtggaatcttacctttcagagtgttttggttctaaagcagtctcagacttaagcacagttaattcccct

SEQ ID NO: 6849009 - DNA, 115 bp, Homo sapiens
tctgtggttggtggtggctggggcagggcttggatctgtggtcaggactcaagggatcctgagaagttactacaaccagcaccttgggtccaaattagttgacagcacccatgga

SEQ ID NO: 6849010 - DNA, 79 bp, Homo sapiens
aggaagagggttggagtaggctaggaataggagcacaaattaaagctcctgttcactttgacttctccatccctctcct

SEQ ID NO: 6849011 - DNA, 55 bp, Homo sapiens
ggagggggaattcagccccagcctgtgtgactcaaagttcctgtttcccacctct

SEQ ID NO: 6849012 - DNA, 89 bp, Homo sapiens
ggtttttcctacacatgaatgcgagaaatggctgataagcacagtaatttaagattgcgtattcatgtagtgagatttagtcattaacc

SEQ ID NO: 6849013 - DNA, 79 bp, Homo sapiens
ggaggtttaaatttagaaattcatctatggcctttccctttataaagaaagccaaaacatgtgagttttgagtttctcc

SEQ ID NO: 6849014 - DNA, 117 bp, Homo sapiens
gacagactactggagacctgtaatcacctcgaaggctggacctggatgaatcttctgtaagatcctagcaacttcagctttgttcagggtagttttaggattctatgtaactttgtt

SEQ ID NO: 6849015 - DNA, 93 bp, Homo sapiens
tggtcttgacaccctggcctcaatctgtcctccagcctcgtcctcccaaagtgctgggatgacagacttgagccactgagactgttgagacca

SEQ ID NO: 6849016 - DNA, 68 bp, Homo sapiens
tttattcatcatctgttcatattaagccacacataagcatttgtgtggtggcagcagaggtgagtgaa

SEQ ID NO: 6849017 - DNA, 88 bp, Homo sapiens
gtgaagaggaacagaaagcagtagaggggtagatgttcttaggatgatccacatctgttcttctcttgtccctgtgcttcctggtcac

SEQ ID NO: 6849018 - DNA, 59 bp, Homo sapiens
tatggagaagatagtgggagaacagatgtcctttcattctctgagctgcttcttgcata

SEQ ID NO: 6849019 - DNA, 100 bp, Homo sapiens
cagacagcagggagatgctctccatgaggatccaggtgacaggcccagtggggatctgggagcctcatggagacgagacatcccagccctgccccctctg

SEQ ID NO: 6849020 - DNA, 110 bp, Homo sapiens
gtgttttacttacatattactttagttaacgtttccacatcaccatgaggtgaggactgttaatattctcactttacagatgggaaaactgtggcatagagagtttacac

SEQ ID NO: 6849021 - DNA, 70 bp, Homo sapiens
cacgggaagggtacatggggtgaagtccaggggaaaccagatgccagtttcccattgttcccctccagtg

SEQ ID NO: 6849022 - DNA, 69 bp, Homo sapiens
ccttaattctatttatctttcttacttgaaatatgtgtttctggggtatgagatataggtgaataaagg

SEQ ID NO: 6849023 - DNA, 121 bp, Homo sapiens
gtcctagccaagagggtatgcttgagtgagggctagagttgagatggggagcttgcaaggaaaagctgctttattcagggtttacccccagcacactcaataccagtttcagggcagagat

SEQ ID NO: 6849024 - DNA, 102 bp, Homo sapiens
tccttggctccttttcctcctgggaaatgaaggggcagtggcccagcctctcgtagcatttctccctccttctatttactcggttggaatggctgccaaaga

SEQ ID NO: 6849025 - DNA, 60 bp, Homo sapiens
attcttggcctggatatccacttaagtcaatagcgatagttctgtctaggtacgatggat

SEQ ID NO: 6849026 - DNA, 58 bp, Homo sapiens
gttattgcacagtgggtgaggtgtccgagtgcttgagacctggtttagggtgcatggc

SEQ ID NO: 6849027 - DNA, 61 bp, Homo sapiens
tgaagtaaatgtttctgttgagtcaattaagatgaagattacaaagggaatattggcttta

SEQ ID NO: 6849028 - DNA, 84 bp, Homo sapiens
atctaatttctccacttcatccagggtcaccagggcccccatgttagccctgggacacagtgtgtgaagtgccagagcatagat

SEQ ID NO: 6849029 - DNA, 61 bp, Homo sapiens
tgtaactatctcagagaaggacatttgaatgtacatttgctgcctttactgggatttaaca

SEQ ID NO: 6849030 - DNA, 67 bp, Homo sapiens
gcgcttcccatcaggagaccaggtcctgctcctccccgaggggcaacctgagcttgtggagaaacgc

SEQ ID NO: 6849031 - DNA, 58 bp, Homo sapiens
tgtgtgttcatcccctcaacattaataaattaataaatgttgagtggatgaacaaaca

SEQ ID NO: 6849032 - DNA, 58 bp, Homo sapiens
tcctcccacaagggccagctcacctggtcgccccaaagacctccctctgtgggtggga

SEQ ID NO: 6849033 - DNA, 62 bp, Homo sapiens
aagtcctagacttggatagttttttcacataaatgtggtggtcagtattcagtctaggactt

SEQ ID NO: 6849034 - DNA, 101 bp, Homo sapiens
aacatcatttcttctcaagctcctcagagacatcataatgaagtttcctggttggagtagtgtaggaaatctcttttgtggtgtttagaaaagataatgtt

SEQ ID NO: 6849035 - DNA, 63 bp, Homo sapiens
acagttttggaagtattactatccctctttacaaatgaggagagactgaaacaccaagactgt

SEQ ID NO: 6849036 - DNA, 79 bp, Homo sapiens
ttaaaactcgaactatatttttctgagcagtgtttggagaaaagccttgctgaagaaaaaatatgttagattgttttga

SEQ ID NO: 6849037 - DNA, 69 bp, Homo sapiens
gggaggtggagctggaagttccaagcttctaatcctggcttggtccttctgttgaccagcccccatccc

SEQ ID NO: 6849038 - DNA, 60 bp, Homo sapiens
ctcatcactggatcattagatatttacattataaaatcatctgatgtgtttaatggtggg

SEQ ID NO: 6849039 - DNA, 79 bp, Homo sapiens
gcatggaactgagtctggcacgctttaaatctccggggattttggctgatgaggaatgctcagctcaatgtttccatgt

SEQ ID NO: 6849040 - DNA, 107 bp, Homo sapiens
ttgataggaaaggagtgggactctgagacttaggatgggaaaatctgggtagattcacttcagaatcctgagttctcagagtctcctgaaatcttaggtcctatgga

SEQ ID NO: 6849041 - DNA, 77 bp, Homo sapiens
gacttactttatatattcctaaaaatcatgtgtgtgttgagctgtgtactcatggcaataggaatgatgtgaatgtt

SEQ ID NO: 6849042 - DNA, 98 bp, Homo sapiens
ggagccggggctcgcaacaccttcagtcccggcagtcgcgggcgtgggcttgagcgcgtgccttctgcgctcgtgtctccgccggtgcccctggctcc

SEQ ID NO: 6849043 - DNA, 78 bp, Homo sapiens
actggcgacttccagtgtttattccattagtattcaattatatttcccagataaacagctggaggccatctcttcagt

SEQ ID NO: 6849044 - DNA, 68 bp, Homo sapiens
ctattcactttgtcaaatggaaagtaaaagttttctggtactttgcagcttgataaaatgtctcttag

SEQ ID NO: 6849045 - DNA, 58 bp, Homo sapiens
accctggcaggctctctggtcggtttccagcaaagtaaacggactcggtttgctgggt

SEQ ID NO: 6849046 - DNA, 118 bp, Homo sapiens
atgattaggctttttggtatttattcagaaaaaacttcaataagtgggaaaaagtgagaaggccccaatgattacttgttagttttatctgcatgatacccacactgccaaagattat

SEQ ID NO: 6849047 - DNA, 74 bp, Homo sapiens
ggggctgatgctgctgggagtggtgctcattgtcagatcaagtgacggcctcactccaagtcagctttagcttc

SEQ ID NO: 6849048 - DNA, 119 bp, Homo sapiens
gtcatggtaagttcaatgtgtgtatatatatgtatgtatgtgtgtataagtatgtatatatgtatgtatgtgtgtgcttaaacacatacatacatacactgacattgtacatactatac

SEQ ID NO: 6849049 - DNA, 75 bp, Homo sapiens
tctggcccctgacttctgatttctcccaaatctttcttagggaggcagtgggagcttaggcagtgctggggctga

SEQ ID NO: 6849050 - DNA, 80 bp, Homo sapiens
gcctttccttcattttctgccagggaattctgcttatcctccaaggcttgactgcagaactctgtagagagaataaaggc

SEQ ID NO: 6849051 - DNA, 57 bp, Homo sapiens
tccaattgacaaatgaatcatgtcgtgttccagacgttagtatgtaagtcagttgga

SEQ ID NO: 6849052 - DNA, 55 bp, Homo sapiens
caaaggcagttactgaatgaaggcaacatcccaccaatcattttgtctgcctttg

SEQ ID NO: 6849053 - DNA, 60 bp, Homo sapiens
ggtgtcttggggtctgcttaagtgagaaaacacggtagcagcagacagcccaagaaaatc

SEQ ID NO: 6849054 - DNA, 74 bp, Homo sapiens
tgcaaaaagttacctctgtaatataagattttgtataaattttataaatttgtgtcatagggtaattttgtcca

SEQ ID NO: 6849055 - DNA, 98 bp, Homo sapiens
ctgatttatggtgcctaccatgttctaggcattagagaaatgcattaatttactcttcatagcaaacatatgggaaaactgaggtacgcacaggtcag

SEQ ID NO: 6849056 - DNA, 90 bp, Homo sapiens
aggttcttgctgtaaacactgggcagagtagctcagaagaagactgtggttcttggatgccctcatgcctttgttccagtgcaggtgcct

SEQ ID NO: 6849057 - DNA, 85 bp, Homo sapiens
cctagtgtcccctgctgtgcttgcatggctcactgttgtaccttcagcatctagcacagtgctgggcacacagtaggtgctcagg

SEQ ID NO: 6849058 - DNA, 130 bp, Homo sapiens
catgcagccagagggtgacagagccacccagggctcctgactccaggtcctgtgtgttacctagaaatagcactggacttggagtcagaaggcctgagtggagtcaccttccccactctctggctgggtg

SEQ ID NO: 6849059 - DNA, 63 bp, Homo sapiens
tgctggaagctcctgcatgtctgagacctgagcacagggatataacacaaggggttttcggca

SEQ ID NO: 6849060 - DNA, 73 bp, Homo sapiens
tagtgttgttacaaggaagaatgtaggtaattcccaacttgctgaaaacctactcatttccttttaaaaactg

SEQ ID NO: 6849061 - DNA, 67 bp, Homo sapiens
gtcatttctcagtgtacattatgttagttccttggaatggagataggtgttatatagggaaatagat

SEQ ID NO: 6849062 - DNA, 60 bp, Homo sapiens
gggaaagagtgcttgtccagagagcagatggcagctctacttagcagccacctctgtccc

SEQ ID NO: 6849063 - DNA, 57 bp, Homo sapiens
gagccaggcagtttgaaggcttccttcgggtagaaaaaattacactagccttggttc

SEQ ID NO: 6849064 - DNA, 68 bp, Homo sapiens
gtagtgtgtttgtgggttgacatttgaagcttcttattacaagaggaattggctcatgcaacacctac

SEQ ID NO: 6849065 - DNA, 62 bp, Homo sapiens
gtgccgtgggccttagtgatctgcctaccatcagccaaggcgccttattgtggtcacagcac

SEQ ID NO: 6849066 - DNA, 82 bp, Homo sapiens
aggcctagatgatctctgatatttctcttaacactagaagttattttaataaagggaatgacagattttcagatcaaggtct

SEQ ID NO: 6849067 - DNA, 85 bp, Homo sapiens
gtagccagtcaagtgagagagaactttctatgaggcttgagatctggactctagcccagttcttctcattagtctgggaagctac

SEQ ID NO: 6849068 - DNA, 58 bp, Homo sapiens
ctcattaatttgcttagacttatctcattgtctgagacaagtgaggtgaatagaagag

SEQ ID NO: 6849069 - DNA, 67 bp, Homo sapiens
ggtattcttggcggctctcagggaaggtttgggatttcggaaaggctgttctgagggtgcgggagct

SEQ ID NO: 6849070 - DNA, 73 bp, Homo sapiens
gcacctgaacttgactccagtttctactgaggatttaatcacaaaatcctgagtggggagctaagtgaggtgt

SEQ ID NO: 6849071 - DNA, 61 bp, Homo sapiens
acagatgaggctggcgagggcaggggtgacatcctacctccgctctcagcctctcatctgt

SEQ ID NO: 6849072 - DNA, 76 bp, Homo sapiens
gagtagtagagaggtgtgtcctaggtatgcattaataaatagtcttgcacacagttcgtgcttttctattctgctc

SEQ ID NO: 6849073 - DNA, 66 bp, Homo sapiens
actgattgaaaggtgacattgttagagattataaataattcaacaaatggcatctatctgattagt

SEQ ID NO: 6849074 - DNA, 73 bp, Homo sapiens
tcacctttttaccagaattgccaccagaaaactattaattcttttctgggaggcagtggtatgagggaactga

SEQ ID NO: 6849075 - DNA, 58 bp, Homo sapiens
gcctgaccattttgcccacagcctggcatgaaccatggtgtacagcaatgtgtcaggc

SEQ ID NO: 6849076 - DNA, 69 bp, Homo sapiens
cgattacactcgtagggcttctcaccagtatgagtcctctggtgccagatgaggcccgcgatgttcctg

SEQ ID NO: 6849077 - DNA, 76 bp, Homo sapiens
agccagccttcagtctcatggatgtgaaataaaatctttgttgatgtaaaccactgagactgtgggcttattggtt

SEQ ID NO: 6849078 - DNA, 77 bp, Homo sapiens
ctacctagaggcaaagacaggagagagggagtccgtaaaatctggaattcttgggtcctgtcgttgccctgaggtgg

SEQ ID NO: 6849079 - DNA, 86 bp, Homo sapiens
aatttgacatattgacacatttccttagcgctgagctcgtcagatgagtttagatggcattaaggtaggtatgttattgtttgatt

SEQ ID NO: 6849080 - DNA, 78 bp, Homo sapiens
gaagtgagaatgacaaaggttttagaatctgttggacctgggcaagtcccacgacttttctgagactcatttgaactc

SEQ ID NO: 6849081 - DNA, 82 bp, Homo sapiens
ccgtgatggggggggaatggaggaaaagtctgtttatgattatgaattgaactttgaaccattcctattgttcctgccaagg

SEQ ID NO: 6849082 - DNA, 73 bp, Homo sapiens
gtacttgtaaagtgtctgtgtctgtcattttctgttattagatagtcaaaatgaagcaaaggcattcaggtat

SEQ ID NO: 6849083 - DNA, 63 bp, Homo sapiens
gagacagggaggaaagagactgctttcctcccacaaaagcagtttccacaacctcccctggtc

SEQ ID NO: 6849084 - DNA, 87 bp, Homo sapiens
ttatttgtcttcccattgtttatttagacttaatccccaggagtgaaatgactgaatcagataatgtggtcatttaaagacatttga

SEQ ID NO: 6849085 - DNA, 65 bp, Homo sapiens
tctcagtaacaggctctgtggtatacctctgtaggtattcaaacacttgagcttgaatgctagga

SEQ ID NO: 6849086 - DNA, 97 bp, Homo sapiens
gcagactagtcttccgtggcaagcagagcgctccagtcttcagtagggagctgctgaataggcacagagggcatctgccacctttagaccagtctgc

SEQ ID NO: 6849087 - DNA, 78 bp, Homo sapiens
atatttgtatgttcactgacatgtctgagagtgagcaccactgtgtgtgtctgggcatgtctgtgaacacgtcagtgt

SEQ ID NO: 6849088 - DNA, 68 bp, Homo sapiens
gtgtcacaggtttgattaagaagcccttacaattttgtaatagcaccttagcctgaatttgtgtacac

SEQ ID NO: 6849089 - DNA, 62 bp, Homo sapiens
tgtgacaaagtatttttaggtttgtagcagaattttacttttgcttctgatactttgataca

SEQ ID NO: 6849090 - DNA, 76 bp, Homo sapiens
gggaggagagtggagatttgataaaagtagcagtttccctcaagtggagctgctctgataaacctactttcctccc

SEQ ID NO: 6849091 - DNA, 89 bp, Homo sapiens
ggatagaacatttgaagttgagatatcttgagataactgttatatttaattgacctgaattgtcatatcttattctgaaatgtctgtcc

SEQ ID NO: 6849092 - DNA, 70 bp, Homo sapiens
tgctttcttcctctgaaatgtgtgcaaatttaagtgcaaaatttggaattctatttcagtaggacatgca

SEQ ID NO: 6849093 - DNA, 56 bp, Homo sapiens
gggtggacaggtcttgaagtctgagaaggcacagatttccagaccaggtctcaccc

SEQ ID NO: 6849094 - DNA, 58 bp, Homo sapiens
tagcagtcattgtggagcctgctgtgtgtccttgccaggctctaaggagggctgtcta

SEQ ID NO: 6849095 - DNA, 60 bp, Homo sapiens
ggtgggaaggccactgaaggttagtgcattctcatacaaaactcccagtgccttcccagc

SEQ ID NO: 6849096 - DNA, 69 bp, Homo sapiens
attagaaaatctggaggtggggcctaggaaatctgcatctttaaactatccactccaggtgattctgat

SEQ ID NO: 6849097 - DNA, 58 bp, Homo sapiens
cagagaggaggctatatgcaaacccctgtatgacttgcaatgtccctttgcctctctg

SEQ ID NO: 6849098 - DNA, 71 bp, Homo sapiens
atatcaggcaaaccgaggagcagaattatagtattatatgataaaaatacttcacttctgggtgccgatat

SEQ ID NO: 6849099 - DNA, 59 bp, Homo sapiens
cacggtgtggctacctgggcctgactccacagggacggggggcaccttggctatgcctg

SEQ ID NO: 6849100 - DNA, 64 bp, Homo sapiens
gctgtgcccttacacatggaaagggataactctggtctcttcagcccattataagggcactagt

SEQ ID NO: 6849101 - DNA, 64 bp, Homo sapiens
tcaagtgcagagtttctcagtggaattttcaagaagatttacaaaggatttgcttttcacttga

SEQ ID NO: 6849102 - DNA, 77 bp, Homo sapiens
ctcctctgagcacagcaagtgggttattaaagatatctaccttcgattgatgcctgaggctctgttaggaatgggag

SEQ ID NO: 6849103 - DNA, 78 bp, Homo sapiens
agtctacaaattgatggatgggaggaatatatactttttaatttttctccagctcaatatttattaatttgtaaggct

SEQ ID NO: 6849104 - DNA, 85 bp, Homo sapiens
ctgccaggtcatccaagatcagtggcccctggacaagcccttcacttaagggttatgggcagagggtaactgataatccttgcag

SEQ ID NO: 6849105 - DNA, 129 bp, Homo sapiens
tgagagaagaaggctctgatttcctaacctctagctgcatattttatccattagacctctgctttctggtgaaaactgcatatgcactgatagtttgggaacactgcaattagatcactttgcctttta

SEQ ID NO: 6849106 - DNA, 125 bp, Homo sapiens
tcctcacaccttcaaggctgtaaaaggattttgaggtgacctgtgcatttttttgagatcagcctcagttattgcttaagaagccacacacctctttcaatgcctcagttatagacttaaaggga

SEQ ID NO: 6849107 - DNA, 65 bp, Homo sapiens
tgcatactgattgggagttttgttctatgcattgcagggagctgagttacctccagatcatagta

SEQ ID NO: 6849108 - DNA, 62 bp, Homo sapiens
ctgttttacaaatgacggcattcaaagcaagaaacttttatgccagttatattgtaaatgag

SEQ ID NO: 6849109 - DNA, 81 bp, Homo sapiens
tccattagcatagttacaaacttgagatcctttgtctttggtagaacttaaagataatgtcaaattctgtctgctactgga

SEQ ID NO: 6849110 - DNA, 78 bp, Homo sapiens
gctaatattttcatgagggtgttttacttcagtgtatgagatacattggtctgtagttttcttatgtctttgtctagt

SEQ ID NO: 6849111 - DNA, 77 bp, Homo sapiens
tctggccagcatggttttgattgtatgttgggttgtcagccagctacacaccagaactattattttaggcggctgga

SEQ ID NO: 6849112 - DNA, 127 bp, Homo sapiens
taatacctgggggagagtcactaacctctgttctctggtgatcaatcacctcggctacgttgtgctgacaatgtctggaggtcatctggttaatgagacagcactagaaaattccttcccaggatta

SEQ ID NO: 6849113 - DNA, 66 bp, Homo sapiens
gtttattgaacacctggtgtgtgcctgggcctttataagagctgaggatacatcagtgaacaagac

SEQ ID NO: 6849114 - DNA, 66 bp, Homo sapiens
gtgtacctaccgaaaattatgattaggcaaacctgtttagtttatgattttttggaaggaaaatac

SEQ ID NO: 6849115 - DNA, 58 bp, Homo sapiens
gcccagtagttcaaggttgcaggacaccatgatcatgccactgtacttcagcctgggt

SEQ ID NO: 6849116 - DNA, 59 bp, Homo sapiens
cccaaggaagggagtgagacctccactcccagtgggggacctggccacccatccttggg

SEQ ID NO: 6849117 - DNA, 65 bp, Homo sapiens
tgtgtgtgtgtataaaagggatgaataaaattatttacctgatcatctgttattgcatgtacata

SEQ ID NO: 6849118 - DNA, 87 bp, Homo sapiens
atgaatgaaacctacaatgtatttaagtctacataattctaagtgggatctgaagatatgaaatatttgattgtggttgccatacat

SEQ ID NO: 6849119 - DNA, 63 bp, Homo sapiens
caggttttttctgtgtttggttgtttgcacacgtatgagcaatagccaatacagcaaaatttg

SEQ ID NO: 6849120 - DNA, 99 bp, Homo sapiens
tctttagagactcaccttatcccattaattgagatagtctgacaaatgtgaataatacattgaactacttgtaatgagactggtagttaatctagaaga

SEQ ID NO: 6849121 - DNA, 77 bp, Homo sapiens
agccaagtaccacactagacattaggtaggttcatgggcctgtggtctgttatcaatgtcttgtgttaatccaggct

SEQ ID NO: 6849122 - DNA, 65 bp, Homo sapiens
ggaatggacgtcagcactgagggtcataaggcccctgctctatggcttccaggctggccagggcc

SEQ ID NO: 6849123 - DNA, 90 bp, Homo sapiens
gacaggattagtattactgagttttccttttgtcccaggctctaatatggcttggcatggggcagaacattacaacataccagtcgtgtc

SEQ ID NO: 6849124 - DNA, 77 bp, Homo sapiens
gaaacacaaatagaattctttgaaatttatgctttgttagctgtaaagacatgtatttgctagattctgtgggtttc

SEQ ID NO: 6849125 - DNA, 76 bp, Homo sapiens
gagcttggagatctctgtaaaccataaattgaagggtatggtctctttgtagggtatagcaggagaacccaggctc

SEQ ID NO: 6849126 - DNA, 83 bp, Homo sapiens
ttagagatcccttggtggtcaggatagtcaaatgctaagttattaacatgctcttcctggctagtcatttgttttgtctctaa

SEQ ID NO: 6849127 - DNA, 65 bp, Homo sapiens
ctgtggctcaggcctgtaagcccagcactttgggaggctgaggcaggcggattgcttgagcccag

SEQ ID NO: 6849128 - DNA, 92 bp, Homo sapiens
gaggtaatttagaaactattccaggggaaggtatcctgacagctgtatgttcaattgatgttgtaggtatttttccatggggagattgattc

SEQ ID NO: 6849129 - DNA, 57 bp, Homo sapiens
cctgggctggagtacagcagtgtgatctcagctcactgcaacctccgtccccccagg

SEQ ID NO: 6849130 - DNA, 56 bp, Homo sapiens
ctgtgtgacccccagtgaagccttgcggtatcggggagccatgggtggtcatggag

SEQ ID NO: 6849131 - DNA, 56 bp, Homo sapiens
ggtgccagaaaacttgaagagtggctctggccagctctctgggcccagttggcacc

SEQ ID NO: 6849132 - DNA, 102 bp, Homo sapiens
gaaatgtgaggacatgagatttgggtggggccacgggtggaatgatatggtttggctgtgtccccacccaaatctcatcctgaattataactcccacaattc

SEQ ID NO: 6849133 - DNA, 75 bp, Homo sapiens
tccagtcggggctgcctgctcaggtgcggcgcctccagggttgcttgtataagaaggtgcagcagaccggctgga

SEQ ID NO: 6849134 - DNA, 60 bp, Homo sapiens
gctcaggcctccagaggggcaaagccacaagctctcctgcttcaaccctctttgcctagc

SEQ ID NO: 6849135 - DNA, 63 bp, Homo sapiens
aatgtaaattttagatgagccattttctgccacgattgtggatttgaatctaagatgtgcatt

SEQ ID NO: 6849136 - DNA, 55 bp, Homo sapiens
ccttttgagaggcagggaccacctcattgccagagcccagagcctctcctaaagg

SEQ ID NO: 6849137 - DNA, 59 bp, Homo sapiens
catttccttgggagaaaaaatatatatgtgtataatatatataacttctagggacaatg

SEQ ID NO: 6849138 - DNA, 82 bp, Homo sapiens
ccctgctgccaaggaagttttaggagaggaatccagtcttatcaggttcctagcttaaaacattttgataatcccagcatgg

SEQ ID NO: 6849139 - DNA, 70 bp, Homo sapiens
gtaggataaactgggtatcaagaggcctatatgtatagacttcctgaataagacctagtttttaatctac

SEQ ID NO: 6849140 - DNA, 66 bp, Homo sapiens
gcagatttggaagttgatttaaaaaggaattatcacagtttccttgtaaaggagctctaacactgt

SEQ ID NO: 6849141 - DNA, 107 bp, Homo sapiens
agctgagaggtgggtttgtgcttgtggcatttagcttggcaggatagaatgtaaattacacctcttgtcctaagagctggattctagcacagtctccatcattagct

SEQ ID NO: 6849142 - DNA, 58 bp, Homo sapiens
aagagtaataaagtctcaggacagtcctctccttgggctctgggactcctgatacctt

SEQ ID NO: 6849143 - DNA, 62 bp, Homo sapiens
ggattcctggaaagaattaaagagaatttgctggagatttgaatagggctttgcagggaacc

SEQ ID NO: 6849144 - DNA, 63 bp, Homo sapiens
agggttggggaagccctaagcacccctgagcctgaagggggcaaagggagagtccctactcct

SEQ ID NO: 6849145 - DNA, 59 bp, Homo sapiens
caaattccaaaaataacaaaagcgttagatgataacaacgctctttgtaagggaatttg

SEQ ID NO: 6849146 - DNA, 58 bp, Homo sapiens
ggttgattctcattatcttggggtgccttctgcacttctgtctgtaatgggatttttc

SEQ ID NO: 6849147 - DNA, 69 bp, Homo sapiens
tcttctatttaggttagtctaaaagtatttgtgttttgcagtcattttttgcaccaacctaatagaagg

SEQ ID NO: 6849148 - DNA, 124 bp, Homo sapiens
ctgatgtgattctaaagtttatgtttttaagaactgttctgtgctttatctccatggtgctgaatgtttttgataggtgaagaggagtgtcttaagagcaggggcttaggacttgtaaggtcag

SEQ ID NO: 6849149 - DNA, 100 bp, Homo sapiens
gggtatgaaaaagactgggtaaagtagatactgtgaaattcttttctggagtgattttatcaatttactcaccagctttgtaggagaattcaaactgccc

SEQ ID NO: 6849150 - DNA, 88 bp, Homo sapiens
catgcatacagcgctcgcctgcttggtgccccagccattcctctccaggaagctggaggggccagcaggtgtaggggttgggggcttg

SEQ ID NO: 6849151 - DNA, 77 bp, Homo sapiens
gtggaattatgcatttcttcactttggttcctctttgacataatctcgccaaatacttagggttgtataacttccat

SEQ ID NO: 6849152 - DNA, 130 bp, Homo sapiens
cagattctaacagggtcaagtatgtggacagatcaaggcttagagtggggtgagaagcagcaaggccagctggccctgagatgcctcaccctagtcaaagcttcattaacggtgtcctggccttgatctg

SEQ ID NO: 6849153 - DNA, 65 bp, Homo sapiens
attatgctttcttcttttttgatgcttaggcatttgaaaggcaattcttggagaagaagcataat

SEQ ID NO: 6849154 - DNA, 92 bp, Homo sapiens
agggaattaataatgtgaaggctctggagtaagagtctgtgatcttggctctaccacttattagctctgtggccttggcaagttaattgctt

SEQ ID NO: 6849155 - DNA, 59 bp, Homo sapiens
gcagaacatggaaagagaactagagtgatgaatcaagttgaactcaatctttgttttgc

SEQ ID NO: 6849156 - DNA, 68 bp, Homo sapiens
ggcagtgagatgaacatattcctctccagattgcatatttgcaggatactatgttcctctattttgcc

SEQ ID NO: 6849157 - DNA, 66 bp, Homo sapiens
aaagttgagcactgcagaaagttcagtctgcttagagctgtgtaagtcatgtaggtgttcatcttt

SEQ ID NO: 6849158 - DNA, 79 bp, Homo sapiens
ggcaccaatgtttattttcctgctgcaaaactgtcaatgttcccaaatattggtacaggaattgtaaatgatttatgcc

SEQ ID NO: 6849159 - DNA, 73 bp, Homo sapiens
gctgacacaaggcttcacacagtatgaactcaaaaaaggaattgtctttcatgctcatgtcaggcaactcagc

SEQ ID NO: 6849160 - DNA, 56 bp, Homo sapiens
agaatttgagtgctttctgtgtgctgagtacacagaagttaaagaatttaaaatct

SEQ ID NO: 6849161 - DNA, 85 bp, Homo sapiens
agaaatcaggagttaatgcaatgtggctactgcaaggaaaccatggtccctggtaaagcacattgcatttaaagacctgctttct

SEQ ID NO: 6849162 - DNA, 111 bp, Homo sapiens
caggagccgtgaagggattcccagagaagattgtcatctaacggagtcattcgtccgcccaggacttctctgtcacagggttacgtttgggagaattttcacaggccactg

SEQ ID NO: 6849163 - DNA, 66 bp, Homo sapiens
gtgcaccacccaggcacagcagccactcacagtctccagagctggcacctggtgcagggtggccac

SEQ ID NO: 6849164 - DNA, 95 bp, Homo sapiens
agccaccagttaatgtatatttggatgatttccagtgtgagattgttatgaatagcgctactataaacattcacgtacatgtctttgtgtggact

SEQ ID NO: 6849165 - DNA, 55 bp, Homo sapiens
tacaattttaagccagagtgggttgacctgtcacccaagcatggttaaaattgta

SEQ ID NO: 6849166 - DNA, 65 bp, Homo sapiens
gttccttgtaatttgttaaggaagccctaggaaactaacacatctaacaacaagatgcgaggaac

SEQ ID NO: 6849167 - DNA, 57 bp, Homo sapiens
tcaagtttctctcagattatggggtcattttagagacccaatttaccaaagacttga

SEQ ID NO: 6849168 - DNA, 77 bp, Homo sapiens
gttgaaggaactgggctcataatgtcatagaaggcaattattttcacattttgttcaaggctagttcccaaatcaat

SEQ ID NO: 6849169 - DNA, 84 bp, Homo sapiens
gcagcatcatcgtttaccctgagtgattgccttgtgataggaatgcatgaagccagcacttcacgggagcgataaggtatctgt

SEQ ID NO: 6849170 - DNA, 58 bp, Homo sapiens
tgtatcacactagcctatagtggatgtttgtgtttcatccaatgagagtgtgaatgca

SEQ ID NO: 6849171 - DNA, 66 bp, Homo sapiens
catataaacttgagtctcagagtatcttgggccagaacatgatgttactgggagtgagtttgtgtg

SEQ ID NO: 6849172 - DNA, 57 bp, Homo sapiens
agcaggccaaggaactttgtgggtgatggacatattccatatgttaattggtgtgct

SEQ ID NO: 6849173 - DNA, 59 bp, Homo sapiens
tctacagtagaaagatcccagtaaccaaatttgtaatatgggatctcatctgtcttaga

SEQ ID NO: 6849174 - DNA, 60 bp, Homo sapiens
gtgataaaattcaaatagctctgactccctggagaacaagaggatattggattttttcat

SEQ ID NO: 6849175 - DNA, 115 bp, Homo sapiens
tcagtggactcaattctgttattttagaaagttcaaattatagaaggtttgaggtggcgaggcacttacgcatcatctagtttaactttctttctgcatggatgagtaaaactga

SEQ ID NO: 6849176 - DNA, 59 bp, Homo sapiens
gaggcagctgaccacagtatgatgcaggtcctttgaatattttctgtgatagctgtctc

SEQ ID NO: 6849177 - DNA, 85 bp, Homo sapiens
catctttttgtgtgtgtgcatgcttccgtttctggctggggttttcccagtgttgcatgaggcagtaccacagtgcacagaggtg

SEQ ID NO: 6849178 - DNA, 58 bp, Homo sapiens
gggcagtgtagcattttgggctgttctgagtaacagaataaccagtgtttcacagttc

SEQ ID NO: 6849179 - DNA, 55 bp, Homo sapiens
tcttccgcaacctgctaatttaacactggagcgcgttattgcagtgttaggagga

SEQ ID NO: 6849180 - DNA, 123 bp, Homo sapiens
tcctcactttgtttgcttttattctctgtcctcgggtaccctgaactgacctaactatacaccttggggagaccagtgaggagtccagggcagagaacatggtggcttgaaccagggagagga

SEQ ID NO: 6849181 - DNA, 68 bp, Homo sapiens
ccatgcctttcactgaaccagtcagtatcatgggcttgcctatgcctgggtcatgtgaataggcctgg

SEQ ID NO: 6849182 - DNA, 68 bp, Homo sapiens
gtgcaatattttatatccaacaaacactcaacaaacacttggtaattgttgattattgagtatggcac

SEQ ID NO: 6849183 - DNA, 56 bp, Homo sapiens
tctcatctgcgagctctgccagtgtatccagcgctcagaggatatggagaatgaga

SEQ ID NO: 6849184 - DNA, 97 bp, Homo sapiens
gcccactatgctaatgtacatcagtaactgtaaaacaggggttctttgtaagttcctcttgtgtatatatagtaacttataacaatggcatgtgggc

SEQ ID NO: 6849185 - DNA, 63 bp, Homo sapiens
aaagcttagaggccagtggagggagaacttaggagttctacagggcatttgtctctcagcttt

SEQ ID NO: 6849186 - DNA, 66 bp, Homo sapiens
gccagctcagaccctcagcttttataatgcagagctggatagaaaggctggggactgaggaagggc

SEQ ID NO: 6849187 - DNA, 115 bp, Homo sapiens
ccatttttaaaataaagactttaaaaatcactagcacaagattggcacataataggtaaccagtaaatgatgtctatctttgtagtatttgctattgttatttgagtatagatgg

SEQ ID NO: 6849188 - DNA, 56 bp, Homo sapiens
agcttgtatgtgtgtgtgtgtggtgtgtgtatgttgcatacatgcatttacatgct

SEQ ID NO: 6849189 - DNA, 82 bp, Homo sapiens
tccatgaaagcaatatttcagctagcaggtggtgaagtaaatttttagagcaagtacctgtcagctccagtattcctttgga

SEQ ID NO: 6849190 - DNA, 96 bp, Homo sapiens
cctctttaccttcttctacccgcaaccctccacaccagtcttattttagcaaaacctagagaaggaggaggtggagggatttggagggtggagagg

SEQ ID NO: 6849191 - DNA, 76 bp, Homo sapiens
ttcttttaatttctatgttctaagtctcaaggccctggcagggtgtgggtagccagagaaagtggggagggaggaa

SEQ ID NO: 6849192 - DNA, 62 bp, Homo sapiens
gcttttcatttcatagaattgtgttggggatttaccaacaaccaaaaagatgaatgtaaagc

SEQ ID NO: 6849193 - DNA, 64 bp, Homo sapiens
ccacatgcacttcaccactaggctatactgctatgcagatagcaaagaaagtgtgagggggtgg

SEQ ID NO: 6849194 - DNA, 108 bp, Homo sapiens
ggtgggttttgggaatccattcaatacctggtgttttctttagactttattctgccttctgctgggtaaatgtcatggaaatgcacttagtgactcttaatccttttc

SEQ ID NO: 6849195 - DNA, 69 bp, Homo sapiens
catgtgtctgttatacagaggagactccaaaatggcctgggatatgtcacttaactgtaataacacatg

SEQ ID NO: 6849196 - DNA, 64 bp, Homo sapiens
ccactgatccagagccaaccaaggcacctcaggaaatggaaggccacattgcctctggatttgg

SEQ ID NO: 6849197 - DNA, 77 bp, Homo sapiens
gtaaacattaagacagtttctgaatgcgtacttgaattaataagtgtgtatattcagaggctgaaattggtttttat

SEQ ID NO: 6849198 - DNA, 55 bp, Homo sapiens
atggccctcaaagctttggcaaagggagtgccttgcaggccagcttgagggccat

SEQ ID NO: 6849199 - DNA, 96 bp, Homo sapiens
gagaagagatatgaataaacaatgtcctgtgagatgataaattctgtattttttcaagcacctggaatattgattcatgtctccctaaaatatctc

SEQ ID NO: 6849200 - DNA, 110 bp, Homo sapiens
gctttaatttggtatgtttgttttggaatcactccagcagtaggtccaattataaaaatagaatcaattagattcactgtggtgtctgatataagcattccaagcttagc

SEQ ID NO: 6849201 - DNA, 80 bp, Homo sapiens
tggtttgcaagcccagctattactttttttggactttaccacagtcagttagggccacagtaatgctgagtaacaaacca

SEQ ID NO: 6849202 - DNA, 99 bp, Homo sapiens
gaagcaaacaacattgacataaagcttctgtccacagcactgatggcagtaacacagcattggcaacagtaaagacagaatttatctcgtggcagcttc

SEQ ID NO: 6849203 - DNA, 55 bp, Homo sapiens
ccgcgccacccattcccactgactccagctccatggacctgggtgggaggagcgg

SEQ ID NO: 6849204 - DNA, 75 bp, Homo sapiens
tttcattgcttcatcttttcaaactgtagctgccattcttttgtgtttggttttggaagggaagagcatttgaga

SEQ ID NO: 6849205 - DNA, 83 bp, Homo sapiens
ccagcagtttgtctcagtctgtcttgtctgtgttctttgggtaatctctgaatgtgacaagcacagactgtgggtgcttttgg

SEQ ID NO: 6849206 - DNA, 63 bp, Homo sapiens
tggctgcctggtgataagcagtgacctcaaattaatataggatgtcactgtttaccagctcca

SEQ ID NO: 6849207 - DNA, 63 bp, Homo sapiens
cacattccttacattcatagagtttttcaccagaatgaagtctctgatgtcgagtaaggtgtg

SEQ ID NO: 6849208 - DNA, 85 bp, Homo sapiens
ctgttagcaatagaaggaaacacaaatcagtactttcaatctcccaaatgtacttctatgccttcctctgtttgccttctagcag

SEQ ID NO: 6849209 - DNA, 61 bp, Homo sapiens
tttggacagaattgatttgtaagtctaaagacagcaattttatgtcagttttgaagccaga

SEQ ID NO: 6849210 - DNA, 79 bp, Homo sapiens
gggcggatagctaattctgagagtcagggatagtggtaaggaggacataacaatttggctaagatttaaatgtttgccc

SEQ ID NO: 6849211 - DNA, 70 bp, Homo sapiens
gcatggcatttattcagctcagtcggttagacttgaactctagttggcctaatgaaggaattagttatgc

SEQ ID NO: 6849212 - DNA, 75 bp, Homo sapiens
agaaaaatttttgaggtattgataaaacatttatgtttatgcatgggtgcatgtgtgtatactcaaaaactttct

SEQ ID NO: 6849213 - DNA, 78 bp, Homo sapiens
ggttggacaggagccagaggcggatggagcgcggcagaggcgcccccactgtctcccgtgccactggctcctgcagct

SEQ ID NO: 6849214 - DNA, 71 bp, Homo sapiens
cagagaacaaagctgagggtttaagccaatctattgttatcagctcacaataaactccagtctgttttgtg

SEQ ID NO: 6849215 - DNA, 55 bp, Homo sapiens
tagccttgacttcttaagccctcgggttatggaccagtgcttattttcatggctg

SEQ ID NO: 6849216 - DNA, 56 bp, Homo sapiens
ttcctgaaccccacccaaattacctgaaattaaaatagttggggtgaggccaggaa

SEQ ID NO: 6849217 - DNA, 127 bp, Homo sapiens
gtcccgtggtggggctcagggtgcaggaggagccctggatctggttccttgaggatgccacacaaaaggccttcagagtaccatgtcctcctggcctctttctccaccctgggttggacataggggc

SEQ ID NO: 6849218 - DNA, 62 bp, Homo sapiens
tgtggtttccttcatggggtgataactatacctacattacacatggattaaatgagaccaca

SEQ ID NO: 6849219 - DNA, 78 bp, Homo sapiens
tgtaaggctagtatcatctacttttgaaaacataatttttatgattagcaggtaaaggtagcatgaaactgcaataca

SEQ ID NO: 6849220 - DNA, 68 bp, Homo sapiens
ctgcagaaagccaccttacacaggagccaggatgctaaaggctgtccatcagaaaggggcttatgtag

SEQ ID NO: 6849221 - DNA, 77 bp, Homo sapiens
ggggtctcaaagaacatcatctgaaatgtgacaggaagtctctggaggcttttagatgtgtgtcttctggaggtttc

SEQ ID NO: 6849222 - DNA, 76 bp, Homo sapiens
cgtgtctgctgtgttgctggggtggtgggctgagccctgagcgggatggccaagctctcattccagcacagtcacg

SEQ ID NO: 6849223 - DNA, 60 bp, Homo sapiens
gcggggtgtgagtgtgtgtgtgtgcgcgcgcgtgcacacacatgtgagtacatgcctagc

SEQ ID NO: 6849224 - DNA, 58 bp, Homo sapiens
gtttcagaaatgttctcctgctcagtgatgtgctgggtgaatgagtattttttgaaat

SEQ ID NO: 6849225 - DNA, 74 bp, Homo sapiens
gtcttaagtgagccagtggaagatggcagtttattcatgaattgttggttatctgctgcttaactacttaacac

SEQ ID NO: 6849226 - DNA, 92 bp, Homo sapiens
gtggggaagaaggccgcttatgctctattatctttttttactgaaaaaaaggaagggcggatagtataagttaacagaagcctctttctcac

SEQ ID NO: 6849227 - DNA, 87 bp, Homo sapiens
gatagaattataaattttaaagcaagtagaagcctgagttattactagtcatatctccttcaattctgctttataggtgaggttatc

SEQ ID NO: 6849228 - DNA, 93 bp, Homo sapiens
gacagtggggtgctcatcttctgtaactgttgggaaggctcggtggtccattttcaccagttaaagaatatgaggccagcccagaaatctgtt

SEQ ID NO: 6849229 - DNA, 58 bp, Homo sapiens
gccacctcctcctctgtccctgctgggatcaactctccacaaggaaccaggaggtggc

SEQ ID NO: 6849230 - DNA, 60 bp, Homo sapiens
tgttcagaagccagaatattcatggatttgatataagcatgaagatttttggcttccaca

SEQ ID NO: 6849231 - DNA, 71 bp, Homo sapiens
ggcactccagggcttctatgatggttccagcattaccagggacccaagtccatccaggcctctgctctgtc

SEQ ID NO: 6849232 - DNA, 65 bp, Homo sapiens
ccaccagaagtggctttctcagggatactgccatttgttttcctgttcctgttcgctcctgctgg

SEQ ID NO: 6849233 - DNA, 68 bp, Homo sapiens
catgcacaacatactcaagaggcctaccatcccaacacttttagtcatcttgtgtgtgtgtgtgtgtg

SEQ ID NO: 6849234 - DNA, 68 bp, Homo sapiens
ttaaaagtgttgattgaccgaatatcagtaactggaagaactgaatgttcattagtcaacatttctgg

SEQ ID NO: 6849235 - DNA, 56 bp, Homo sapiens
tatgacagtcggctcttgcaagctggtacaagccagctctagcaacccactgcatg

SEQ ID NO: 6849236 - DNA, 81 bp, Homo sapiens
ctttttgaaaagtctgcattacatgccatagacactgtgtgtctctgtgtgtgtgtgtgtgtgtgtgtgtgtgtcagaaag

SEQ ID NO: 6849237 - DNA, 59 bp, Homo sapiens
tacagtggaaaactcagtgtgtgcgtgtttctgactacaaactctgaggacccactgtg

SEQ ID NO: 6849238 - DNA, 71 bp, Homo sapiens
cattcttagttcaaggcatctgtagctaactgaaattaaacatagctccagagtctgaactattcagaatg

SEQ ID NO: 6849239 - DNA, 95 bp, Homo sapiens
ggcactgaacacaggccctgtgaacaaggatgagggctcctatggttcccaaccagagtgggtgatctctgttgtccatagggagaatcagtgcc

SEQ ID NO: 6849240 - DNA, 87 bp, Homo sapiens
gaagctatctgattgcaccggtcactttcattaggttaacatgtgcacatttagccaaacaggtgaaattgatttatgccaggcttt

SEQ ID NO: 6849241 - DNA, 77 bp, Homo sapiens
tctattattgtctttatgattatgattttgtcttgtcttatagatgaggggagagttaatgtgaatgtgatgatgga

SEQ ID NO: 6849242 - DNA, 65 bp, Homo sapiens
aatgattcagtattcactgtgttgttacaatcctagtgacagtatttgcgatactgatgatggtt

SEQ ID NO: 6849243 - DNA, 130 bp, Homo sapiens
agaggtaagtctcggttgcagaggggactggggcagaagtgaggattgtccagcctatccgactggttgggcagctgtttgtcctcctgttactctccccaactcctgccctgcaccctgccacatttct

SEQ ID NO: 6849244 - DNA, 60 bp, Homo sapiens
tgtgtgtgtttccgaatgcaagcgtgtgtataagagtgtgtgtgttaggaagggcacaca

SEQ ID NO: 6849245 - DNA, 55 bp, Homo sapiens
ggagggaaggacccattttaagttccagggaccactggactattccattcccttt

SEQ ID NO: 6849246 - DNA, 61 bp, Homo sapiens
gaatgacatgctttttaattatagtacccaaattaggttttatctttaagaggctgcattt

SEQ ID NO: 6849247 - DNA, 64 bp, Homo sapiens
ggaagagaggttcagccctaagatagatatggtaaattggcttggcttgttcaatctctattct

SEQ ID NO: 6849248 - DNA, 63 bp, Homo sapiens
agatcccaggatactggcctataatgctgagaaaggaaatagtgtcagagaatcttggttttt

SEQ ID NO: 6849249 - DNA, 63 bp, Homo sapiens
ttacacatgctttgtgtgtatgtacaggtgtctgttttgaggcgtgtccatgtgcatgtgtaa

SEQ ID NO: 6849250 - DNA, 58 bp, Homo sapiens
tcttcatttccgcttctctactctcagcagctagggctaagaagctgtgaaatgaagg

SEQ ID NO: 6849251 - DNA, 74 bp, Homo sapiens
gcggaacccgaggtggctgcggctcccccgggacacaaccgggagaggaagtcctggccatctgccggccccgc

SEQ ID NO: 6849252 - DNA, 59 bp, Homo sapiens
tcttctctcagctcgtcaaagtcattctccatccagctttgatccgttgctggtgagga

SEQ ID NO: 6849253 - DNA, 91 bp, Homo sapiens
tcaagccaaatgtgctgggattttgtcaaattccaaatgttggaacacatttcaggatgtttgactgagtttggcagaatcagtaccttga

SEQ ID NO: 6849254 - DNA, 85 bp, Homo sapiens
tctcatcctggcctctgagtcaagaacccagtgaactgactttctagttctagaagttccgctgcaaggccaggaaagcttgaga

SEQ ID NO: 6849255 - DNA, 59 bp, Homo sapiens
cccctggactctataaatgttaggggtttgcctgacagtgagcttggggtactttgggg

SEQ ID NO: 6849256 - DNA, 70 bp, Homo sapiens
gctcgtttacctgaactggtctgctgcccggtttagatgaattcatgcagagccagtcaggataaggagc

SEQ ID NO: 6849257 - DNA, 62 bp, Homo sapiens
caaggtttctatgctcaaaggaccacatggcccaatgttcctgctgaggcatgaggccattg

SEQ ID NO: 6849258 - DNA, 56 bp, Homo sapiens
tttaatagtcctatatgtgtatcaatgcaccatgcattgattcaagggctgatgga

SEQ ID NO: 6849259 - DNA, 61 bp, Homo sapiens
catgtgtgagtgagcagtcttccctcagtctgagaggagagaaagttttgtgctatatatg

SEQ ID NO: 6849260 - DNA, 91 bp, Homo sapiens
gttcccagatttgtcttaatccagtggtttctgaacagtgtgccaaggcaccctggcatgctgcagcaaactcacaggagggctgtgggac

SEQ ID NO: 6849261 - DNA, 57 bp, Homo sapiens
tgtaaattggcacactggcatcctaggactgcattgatgccagtgtgtcaatttata

SEQ ID NO: 6849262 - DNA, 61 bp, Homo sapiens
tgtggcagctgctgcaggagctctgtgggataattgagtagaactgttcagctgaactaca

SEQ ID NO: 6849263 - DNA, 116 bp, Homo sapiens
tcattagcacagacacttagactccagttaatccctggataaaaaatcttgaatagcaagattgtcctagattggcctggagttggctaagttgtcttgagcttcataataaatga

SEQ ID NO: 6849264 - DNA, 73 bp, Homo sapiens
gctatggacacatgagttacgattgctgtgaaaaccatagctttgcatttattgacttcgttgtgtttaaagt

SEQ ID NO: 6849265 - DNA, 57 bp, Homo sapiens
gaactgctagattgttattcaaggtgtctgcaccttgttcattatcatcagcagttt

SEQ ID NO: 6849266 - DNA, 99 bp, Homo sapiens
taacttagcagactgtaccaagacagtggcattcatgatgaatctttatttctaggatatcaacattaatattttctggtcaaaagatctgttgtatta

SEQ ID NO: 6849267 - DNA, 74 bp, Homo sapiens
gacacacctctccctacatccgagtgatggacagaacagggaaccttactgggaatgttatggagaaaagtgtt

SEQ ID NO: 6849268 - DNA, 56 bp, Homo sapiens
ttgtatgtctcaatatcctgtccttggtctagagtggcagtttggatgatatataa

SEQ ID NO: 6849269 - DNA, 61 bp, Homo sapiens
aagcataaattgtaagatgatggtagttttaagactgcctgaacatgaatagtttatgctt

SEQ ID NO: 6849270 - DNA, 71 bp, Homo sapiens
gttatgtatatgtgtgttgacaacttgccatgaagtcctggcaaagatgttttcaacacaataaatgtaac

SEQ ID NO: 6849271 - DNA, 57 bp, Homo sapiens
aattaccttttccacttaggccctggtcagcaggacttgaatggtatgagagtaatt

SEQ ID NO: 6849272 - DNA, 76 bp, Homo sapiens
gctcccattgcttcaaagatcctccactagagtatcagggaccctctttaaatgggatctttgtagaagtaagagt

SEQ ID NO: 6849273 - DNA, 56 bp, Homo sapiens
ggcaggtggggctgctaccagaataatgggttcaacattcaggctgcctccctgct

SEQ ID NO: 6849274 - DNA, 57 bp, Homo sapiens
tatgcatagatattatcagccaaattgtcatggatgattttgatggtgttctgcatg

SEQ ID NO: 6849275 - DNA, 90 bp, Homo sapiens
tcctggggagctttaaaaactgccctgctctggtttagtcagtctgggctgggtcccaggtgtctagagttttagttttgtttcccagga

SEQ ID NO: 6849276 - DNA, 80 bp, Homo sapiens
cacttatccgaagtggccactagaagctcagctggtcaggggggtgctgaaggcagagggcagtggtcaggagtgaagtg

SEQ ID NO: 6849277 - DNA, 80 bp, Homo sapiens
aaagaccatcacaagaacaactgctttaaaagcaccgcctttggtgctgttgactttgttgttcttatcaagatgttttt

SEQ ID NO: 6849278 - DNA, 66 bp, Homo sapiens
gccatagctgtgatgtagaggtcaggaagctctactgctgctggcttagatatcactgccacaggc

SEQ ID NO: 6849279 - DNA, 98 bp, Homo sapiens
tcaccctaatcttgattaataccttagccctcttctgactgaccaataagcgaggatgagtttcgggagggtaaagagaggtcaagatcctagcttga

SEQ ID NO: 6849280 - DNA, 78 bp, Homo sapiens
ggacccagcgaagaacctagcggccgaaaagagtcccaggaaatgtgccccccgggattactggtatttgctggctcc

SEQ ID NO: 6849281 - DNA, 61 bp, Homo sapiens
agccttcagcagttcaggtgcctggtggtagatggggctgactggatgattgagaaaggct

SEQ ID NO: 6849282 - DNA, 71 bp, Homo sapiens
ttctcagacttccagcaccagcctggtcctcctttttcaaccatttcaggttgaacatgtgagtctcagga

SEQ ID NO: 6849283 - DNA, 89 bp, Homo sapiens
aatggtagtttatctggaaatcaatttcttggttgatagtgtttcattcagcacttctatcatttagttgtcttcttgtttctattgtt

SEQ ID NO: 6849284 - DNA, 65 bp, Homo sapiens
aattcagaaagaagtaaggctgaccagcaagacttgggagggcacaaattacatccttctgaatt

SEQ ID NO: 6849285 - DNA, 118 bp, Homo sapiens
gaggctggacctccaaaaggaatggctgtgtggggcagccaggaaagctggaccctggggaccatggccctgtaccctggcttggcacagacacaatggcgcgttctgtctagcactc

SEQ ID NO: 6849286 - DNA, 59 bp, Homo sapiens
tgtggagcagcgtcacagccttccaaaggaagatggatggtggctggcttgctcacaca

SEQ ID NO: 6849287 - DNA, 103 bp, Homo sapiens
cttttctgccattgtttgtcttactctaccccgggctcacacagcctgcttctgaatggtgcccttgtgggtgagatgcttctgaagcctgtggcaggaacag

SEQ ID NO: 6849288 - DNA, 64 bp, Homo sapiens
acactaagatctaggcactagcttgaccttccagagtgtttcacaagcttccaggatctggtgt

SEQ ID NO: 6849289 - DNA, 58 bp, Homo sapiens
aaacgcccgtggttgccaaggtagcactttcttgttcttttcatttcctcgggtgttt

SEQ ID NO: 6849290 - DNA, 57 bp, Homo sapiens
gcccagtgccctagaatgcacttgtcatagagacatttgcattaagtggcattgagc

SEQ ID NO: 6849291 - DNA, 78 bp, Homo sapiens
gttttttcctttcattcctttgctctgaacacttggccgtatgctgtgtgcagcagagacaggactcagggaagagac

SEQ ID NO: 6849292 - DNA, 60 bp, Homo sapiens
tttctatagtatgtgagctgaccttcctaatattctgtcagttcatgtctcaaatagaaa

SEQ ID NO: 6849293 - DNA, 94 bp, Homo sapiens
gagagtaaaattctactgtagagattaactcatggttttaccgtcaggaaaactggtagttttgagttaatctctacgatagaatttctttctc

SEQ ID NO: 6849294 - DNA, 78 bp, Homo sapiens
gtcttgattgaattcaaatgcaatcttcgttcagctaaaaaataatgagccaggtttatttagaatttcagttatgac

SEQ ID NO: 6849295 - DNA, 82 bp, Homo sapiens
tttttagtataattgtgtcccaaatattgcatggggcataagtgtgttccaaatataggatgtgatatatttatactgaaaa

SEQ ID NO: 6849296 - DNA, 83 bp, Homo sapiens
cttactgtggttctcactgtgccttttcccaaacattgtagctaatgttgggaagtgtgtgtacagtgtgaagacagagtcag

SEQ ID NO: 6849297 - DNA, 74 bp, Homo sapiens
caggaagatgagcagagctggcctgagatcatctgtcttcattacaccgtccccaccagccctgtcacttcttg

SEQ ID NO: 6849298 - DNA, 130 bp, Homo sapiens
tttccacccaaattattgtagtttttgtcatttttggtgtggctgaaggtatgagttttatcttggaagtccaaagctggaaaaaattccatctcagttccagttaaagtgagaaatgctatggaggaga

SEQ ID NO: 6849299 - DNA, 69 bp, Homo sapiens
atcagagagattgtcttgtacgtttgcctgttgcaaacaggctggtttgtaaaagatgtatgttttggt

SEQ ID NO: 6849300 - DNA, 75 bp, Homo sapiens
ggacagctggtagagtgtttagggtcctgagataataaggaatccaggcagcctttagacagtctgctgttgtcc

SEQ ID NO: 6849301 - DNA, 72 bp, Homo sapiens
tctgctatgtgctaagctccagatcagtttctgagaatgcaaaggttggtagggaacttagaacatactggg

SEQ ID NO: 6849302 - DNA, 67 bp, Homo sapiens
gctcaaatcctcttatttgtatgctcctcttttcccacaggagagtaggtatgatggtgacttgagt

SEQ ID NO: 6849303 - DNA, 60 bp, Homo sapiens
ttggatgtttgaaatcacgtacatggaaatgatctctatgtgcatgagggaggatagcaa

SEQ ID NO: 6849304 - DNA, 77 bp, Homo sapiens
tagtctcagtgtgttcgtatcaacagaggatggtttccagtttttttcgggtaatatgaaacattccactgagactg

SEQ ID NO: 6849305 - DNA, 63 bp, Homo sapiens
gactggagtgcctccaggaaagcaggaagcaagacatgtttttaacctggtaagtatttagtc

SEQ ID NO: 6849306 - DNA, 84 bp, Homo sapiens
tctgcttgttaatttaatttcatgccagcctgttggtccctgaaagtaactgctgtaaaaggctggggaattgaatttgctaga

SEQ ID NO: 6849307 - DNA, 55 bp, Homo sapiens
gccatagtagcatttggaaaaattggagctacccaagcttctaatgctgctgagc

SEQ ID NO: 6849308 - DNA, 72 bp, Homo sapiens
aggatgggtcagctagagtccatttaggaatgaaatgtggacttgacccaaaatagctgtcatgctcagcct

SEQ ID NO: 6849309 - DNA, 68 bp, Homo sapiens
ttctgaagctagtatgtatgaaccatacttaggtttatcaatacatattgctaaattgtttttcagga

SEQ ID NO: 6849310 - DNA, 73 bp, Homo sapiens
agtacagacagcagcaatagcagtgacattttccaaggactctacggatgtgtcaggccctgcattatgtgct

SEQ ID NO: 6849311 - DNA, 81 bp, Homo sapiens
atacagtagaagtcctttgtgacatgtatttaggcttgagactaatacttgtcataaaggcattataagtgtttattgtat

SEQ ID NO: 6849312 - DNA, 98 bp, Homo sapiens
acaatgataaagctgtgagaatgattttcttagatgatgttttgaacctaaaaagttcaaggtaagtatgagaaagcagtacattttgcttgtgttgt

SEQ ID NO: 6849313 - DNA, 121 bp, Homo sapiens
gacagggaaataacgagtaccccaggaagactgaatttgcatagttggcaaatgctgccagacaagttcgcattcaactgttgcatcagattcatttggaaagcttttaaaaaatattgtt

SEQ ID NO: 6849314 - DNA, 83 bp, Homo sapiens
aagaggctttctaaatgtgtaattgcaggcaagtaacaacacttgagtctccttcattgcatctttaagagagagaacctctt

SEQ ID NO: 6849315 - DNA, 55 bp, Homo sapiens
tgccatcacctttctgaacgttggtctccttaccactcacctggggttgatggca

SEQ ID NO: 6849316 - DNA, 65 bp, Homo sapiens
ggagacattaacagtgcttcagaggagctcttggctaagggaggttattgcactgggatgtcttc

SEQ ID NO: 6849317 - DNA, 55 bp, Homo sapiens
gtgactatggccctgtctgtgagctcttccagagctacaagtacattatagttat

SEQ ID NO: 6849318 - DNA, 59 bp, Homo sapiens
cagtgtttttacaagcactctgggtgattctgataaatccagaaatttgagaaccactg

SEQ ID NO: 6849319 - DNA, 85 bp, Homo sapiens
gaggctcggcagtagggatgtcctgagacttggctcggcactgccccacctccagccacctctttgtctctgccgcctctgcctt

SEQ ID NO: 6849320 - DNA, 58 bp, Homo sapiens
gccaggagagcgccctcccggccccttccatgaggggtgtgaagcgccctctgctggc

SEQ ID NO: 6849321 - DNA, 70 bp, Homo sapiens
gggtcatcggttcgctcattccacaggcatctgctgagtcttcgccaggcctggttgagccctgagaccc

SEQ ID NO: 6849322 - DNA, 103 bp, Homo sapiens
gcagtgtcatgctctgtcctgtcttcaggacctggaattttggggtctgagtgacaccagcattcactggacctgcagagaaggagaacaaagctgatgctgc

SEQ ID NO: 6849323 - DNA, 62 bp, Homo sapiens
gagttcagtagttatagtctaggagattcccaggccatcctccctgctgtaactctgtgctc

SEQ ID NO: 6849324 - DNA, 69 bp, Homo sapiens
agactacactgctgggcagtgaatgaacctggaatacaaagactcattcactgtccagcagtagagttt

SEQ ID NO: 6849325 - DNA, 57 bp, Homo sapiens
ctcaccaaggcctgaactgcccaagactctgcatgagtgggcagtggcactagggag

SEQ ID NO: 6849326 - DNA, 68 bp, Homo sapiens
ggtggaggcacacctcagactgggagcaccagtttcaatattgtttccatgaggcatgccgctcagcc

SEQ ID NO: 6849327 - DNA, 59 bp, Homo sapiens
ttctctcctcctagaggcttttgtgatttctgtcacctttgtgtcctgggaggagagag

SEQ ID NO: 6849328 - DNA, 59 bp, Homo sapiens
ccacttcttgatgaaaatggtacttgtatacaaagactagatgagtatcaagatagtgg

SEQ ID NO: 6849329 - DNA, 85 bp, Homo sapiens
tgaagcttttctagtaatttgtgccttccatttcctaggaacaagagtgagtgaggactaaggacacaaaacagcagcagtttca

SEQ ID NO: 6849330 - DNA, 74 bp, Homo sapiens
ctagggacttcaagactcaaggaacaacacagtgctgagttcactaggttttctttcagtctcatatattctag

SEQ ID NO: 6849331 - DNA, 66 bp, Homo sapiens
cccctgccatagtcaaatctaaacatgttccagaagtgtatatgtttgggtatggtcatggagggg

SEQ ID NO: 6849332 - DNA, 66 bp, Homo sapiens
tgcagatcaaagttcgtaactgataaccagttaatggatgagaagagacgaggctttgttttagca

SEQ ID NO: 6849333 - DNA, 125 bp, Homo sapiens
ctgggatggggctggaatccaggctggcacctggaggccttggcatgctgccctgcccagcagggtactcgggccacagcagggcagcgtgcagcctgtctgcctgtccaggagggcccgcccag

SEQ ID NO: 6849334 - DNA, 114 bp, Homo sapiens
tggcctggtcagctcactgaagagctgaaggagaaagcaggggtcatagaggccatcaagatccaccctgcttttgtctttgaatatcagctcctgtgtgtcctgaaagagcca

SEQ ID NO: 6849335 - DNA, 84 bp, Homo sapiens
ttgaatggtgtaggtctggagaaagttgagtttgtgatcatttgggaatgcaatgccagtttctccacagcttctgactttcaa

SEQ ID NO: 6849336 - DNA, 85 bp, Homo sapiens
gttggccaggcctgatgtcgtgatccacccgccttggcctcccaaagtgctgggattaccggcatgagccacgcgcctggccaat

SEQ ID NO: 6849337 - DNA, 62 bp, Homo sapiens
aacgcagtgtttgtgttattctactcttagaaaagtgattgaataattcagacattgttgtt

SEQ ID NO: 6849338 - DNA, 77 bp, Homo sapiens
ttgaccagatgaggctcttggggctgaaccctgcctgggagcagctccagagccacatccatcatacagctggtcaa

SEQ ID NO: 6849339 - DNA, 74 bp, Homo sapiens
acatatctactctgaatcgatgttatacatgccaagtatgtaaagtaatctgtcgatcagtactactagaatgt

SEQ ID NO: 6849340 - DNA, 76 bp, Homo sapiens
tcattaatccaacaattctgtgcaggcagagctatacttacaggaatagaaatgtcttgcatataatattaaatga

SEQ ID NO: 6849341 - DNA, 71 bp, Homo sapiens
gggagctgggcccaggcagcatgctggcgtttccccgagggaatcctggcatgtgccttgggaaaggtccc

SEQ ID NO: 6849342 - DNA, 59 bp, Homo sapiens
ctctttttcagccttaccaaagaccttgactcaggaagaagtgagtgtgggaagaagag

SEQ ID NO: 6849343 - DNA, 61 bp, Homo sapiens
attcttttgtcctagcttgatagtttagcaaactggagcagcaggaaatgggccaaagagt

SEQ ID NO: 6849344 - DNA, 63 bp, Homo sapiens
gtatgcttattctgtgtgctgtgtcctcataagggtatacaggtaatttgaataatagcatac

SEQ ID NO: 6849345 - DNA, 81 bp, Homo sapiens
gtatcattaagctgacttttagttccatgttcatgttagctctaccaataaaggcaggtgctaagagaggtaaaaagatac

SEQ ID NO: 6849346 - DNA, 59 bp, Homo sapiens
gcctaccacagtgatattttgcatatgacttccttcagttagcaaaatgtttttgaggc

SEQ ID NO: 6849347 - DNA, 77 bp, Homo sapiens
ttagtggtattattgggtagtatagtaaatatatgtttagctttacaaagtgctgcaccattttaatctcccactag

SEQ ID NO: 6849348 - DNA, 76 bp, Homo sapiens
cctacaggcacaccagtttaataactgctcaaggctccttgccagcaccataatgtgagcttgggtgccacgtggg

SEQ ID NO: 6849349 - DNA, 55 bp, Homo sapiens
cctccccacaggccaaataggcaagactgcagccatccgttgccctgaggggagg

SEQ ID NO: 6849350 - DNA, 73 bp, Homo sapiens
ggatcatggaatcagtgagtggcagaggcaggactcaacttgagaaagcctggctctgcagccactccagacc

SEQ ID NO: 6849351 - DNA, 72 bp, Homo sapiens
tgaacatgcaggatgagcaggtgtgagtgtgtcagtggtgtgcacatacctgtgtatccacaagcgtgtcca

SEQ ID NO: 6849352 - DNA, 75 bp, Homo sapiens
ggcttaagatatttctgattccttataaggcagaaatagaaaatgaaaaggagagcaatcagaaatatcgaggcc

SEQ ID NO: 6849353 - DNA, 69 bp, Homo sapiens
atattacaataatgttatgaggctgactcatcaaaccttggtatcaggcttattacgttattgtcatat

SEQ ID NO: 6849354 - DNA, 80 bp, Homo sapiens
ggaagaaatatattaaaaagttgaaaggacttatctctgtgagatgggatttttctccttttcatgtttctgtattttcc

SEQ ID NO: 6849355 - DNA, 96 bp, Homo sapiens
gagtgacggcaggcaggaccgtgggtccaaggttgatgtctgagtggagccagccaggcatgtgaccctggactcaggccctcaggctgatctctc

SEQ ID NO: 6849356 - DNA, 67 bp, Homo sapiens
ggaaaagagtagctgtctcctagaaactgaaggaaccctttacaactgtagcagtgtgctctttttc

SEQ ID NO: 6849357 - DNA, 87 bp, Homo sapiens
tcagtgatccttttgcttttggaaattgtaatgaacttcaccatcgtagagctttaatatttctttcctgaagcagaaagcatgtga

SEQ ID NO: 6849358 - DNA, 58 bp, Homo sapiens
tgagtcggagtcttgcactgttgcccaggctggagtgaagtggcaaggtctctgctca

SEQ ID NO: 6849359 - DNA, 56 bp, Homo sapiens
gttcatcactcagagacctccctcagggctgggggacatggactgtgaatggggac

SEQ ID NO: 6849360 - DNA, 109 bp, Homo sapiens
tctcctgtggctgcacccctgacagccaggtctgatgacccagatggcaaccactgcaactggagtggtgtgggctctgctgtcgggcacacactgagtcacagtgaga

SEQ ID NO: 6849361 - DNA, 80 bp, Homo sapiens
aagggaggttattactacaacagttcatgaaatgaaagctacctgcttttacccagggagctcttgaaaataaccctctt

SEQ ID NO: 6849362 - DNA, 79 bp, Homo sapiens
gcaaggcggaaggggtgggtgagcctcaggggtgcttctggctctcacgctgaggcctctcccactccagctgcccagc

SEQ ID NO: 6849363 - DNA, 68 bp, Homo sapiens
gaccaatcttacctttctcagaggtctattttatgtttagtgggcttctaagtgaaagtgtaaatgtc

SEQ ID NO: 6849364 - DNA, 88 bp, Homo sapiens
ctggcagttctagtggtcactggtaaatgctattcctatatttttattagaggagaggaatcattattacaaccaaagaaactcccag

SEQ ID NO: 6849365 - DNA, 94 bp, Homo sapiens
cttgagggctttgatgatcaggtcagaggcagaaggcaccacctcaatctgggcctgtctgttctgactggtcagtttcactgtaatcctcagg

SEQ ID NO: 6849366 - DNA, 94 bp, Homo sapiens
tgtcatgggtccctctgtgccccctgctctccgcaggcaaagtctaccctctcccccggtgtgcctgcaagagttggggctacagggccagaca

SEQ ID NO: 6849367 - DNA, 56 bp, Homo sapiens
agggtggggaggacgggtgaccaagcgcagacgtgggtgacacgtggccccgctct

SEQ ID NO: 6849368 - DNA, 69 bp, Homo sapiens
catcagtgcggcatctgtcatcctgctaggcccaaattgttttctatgatggatgtcacagtctgtatg

SEQ ID NO: 6849369 - DNA, 68 bp, Homo sapiens
gggaaaggtgatagagacaagaatggggttgatgcctgatattccatgtgcttgctctggcacctcct

SEQ ID NO: 6849370 - DNA, 68 bp, Homo sapiens
agagcagctggggcagagaccagggcagagagctgatgcccagagagggtgctcctccatgctgctct

SEQ ID NO: 6849371 - DNA, 61 bp, Homo sapiens
gtttccatgggagaagacagtgtaagtttacattagagctgtgtttctacccaggggaggc

SEQ ID NO: 6849372 - DNA, 101 bp, Homo sapiens
tgaggcagagtcttgctctgtcacccaggctggagtgcagtgtcgctatcttggttcactgcaacctccgcctcccggattcaagcgattttcctgcctca

SEQ ID NO: 6849373 - DNA, 60 bp, Homo sapiens
gtactagttgagctctgaataaactgggtgaaattttctagtatcatgcccaactattac

SEQ ID NO: 6849374 - DNA, 109 bp, Homo sapiens
gcttttatattgtaggtttttgctcatgcaccatggttgtctgagcatgcagcatgcttgtctgctcataccccatggtttctgagcaggaaccttcattgtctactgc

SEQ ID NO: 6849375 - DNA, 57 bp, Homo sapiens
tgtgcattaactccacaagcagcctggctgcagagtgaaggtggctgtttgtgcata

SEQ ID NO: 6849376 - DNA, 62 bp, Homo sapiens
tggctttggcttctcctggcaggaagtcatcaggcatcctctccaggtgagccgaaattcca

SEQ ID NO: 6849377 - DNA, 70 bp, Homo sapiens
ctgtatccattcattcattgatgaacatttaggttgagtccgtatcatgttatcgtgaataatgctgcag

SEQ ID NO: 6849378 - DNA, 66 bp, Homo sapiens
ctggtaagtatccttccacactgtcataattcccaggaaacagcttgagactggatatgcacacag

SEQ ID NO: 6849379 - DNA, 66 bp, Homo sapiens
gagctctccaggcagggcagccatcaagtgcagaggccttgagacggagttgtgcctggcaagttc

SEQ ID NO: 6849380 - DNA, 73 bp, Homo sapiens
ggttgggggtgccctatgaggaagccctgggtaagtcttgtcaacctgagcttcttgggatacccccatggcc

SEQ ID NO: 6849381 - DNA, 127 bp, Homo sapiens
agttggttttttgagatggagtctcactctgtcacccaggctggagtgcagtggcacaatttcggctcactgcaacctccgcctcctgggttcaagcaattctcctgcctcagcctaccaagtagct

SEQ ID NO: 6849382 - DNA, 74 bp, Homo sapiens
ctgccaactttcctgagtcttcagcttttctcttacattcaacaagataaagaagcattggaccaggggcccag

SEQ ID NO: 6849383 - DNA, 68 bp, Homo sapiens
ggaatcaagaaggttctattgagccctggagtatttccacaggctttgcctggaatttccttggtttt

SEQ ID NO: 6849384 - DNA, 127 bp, Homo sapiens
ctgatacctactgtgttccaagttctttctggagtttgcggggacagagacatgaactaaacaaggtcattgcctttgcagagcttagtatttagtggggtcaggattggggtagagatggggagag

SEQ ID NO: 6849385 - DNA, 62 bp, Homo sapiens
ctctgttgtcagtggaagcagcacagatcttccctgcaccgtgtggccatttgaaaacaggg

SEQ ID NO: 6849386 - DNA, 72 bp, Homo sapiens
aggttggctatgagagctttagtgggtgcataaagaatatcactaatccgccaggcttggtagctcatgcct

SEQ ID NO: 6849387 - DNA, 66 bp, Homo sapiens
ctggagtgttatagtgacttccacatcatctttaccatctctcttgactggagtcagtgacaccag

SEQ ID NO: 6849388 - DNA, 73 bp, Homo sapiens
actatggcagatggttcctgggagcctttggtggagaaagccagtggctgtgaccagggacctttgctggagt

SEQ ID NO: 6849389 - DNA, 76 bp, Homo sapiens
ggacagaagatggagcagagtagagatgcctttaaataactcagagggaagggctcttttctgagcttcactgtgc

SEQ ID NO: 6849390 - DNA, 56 bp, Homo sapiens
gcactgggagctgcctgccggtcctttaacaaccggcagcgcgagcgtccagtcgc

SEQ ID NO: 6849391 - DNA, 55 bp, Homo sapiens
gtgtcataaatccacgtgcatgaaggcaccaagccagcaccagattgagtgacac

SEQ ID NO: 6849392 - DNA, 59 bp, Homo sapiens
caaggcattgtgtaagcacttgatatccatgatcatgtttaatccttaccattgccttg

SEQ ID NO: 6849393 - DNA, 78 bp, Homo sapiens
taacccagaataattgcatgacctttagcgccctgcatttatgtaggtgggggcaaggggcagcaagttttggtgtta

SEQ ID NO: 6849394 - DNA, 74 bp, Homo sapiens
cctcaacgtttccatctaaaatggttctttggtagatggtactataggaccatcctaaggtaggcaacctgggg

SEQ ID NO: 6849395 - DNA, 61 bp, Homo sapiens
gactgtgacttctgaagcaatagctgcctaaaatgaaggtgcaggctccagaattctagtc

SEQ ID NO: 6849396 - DNA, 82 bp, Homo sapiens
ggtactgttagagcgatttgtcctgcatttctgggcaacctgtgggcagaagaggagaaggatagatccttctgatatctcc

SEQ ID NO: 6849397 - DNA, 100 bp, Homo sapiens
agcgattctcctgcctcagcctcctgagtagctggaattaaaggcactcaccaccatgccttgctaatttttgtatttttagtagagacagggtttcgct

SEQ ID NO: 6849398 - DNA, 56 bp, Homo sapiens
tctgagccacagatgtcctgtttcctctatgagggactataggccaggtggccagg

SEQ ID NO: 6849399 - DNA, 61 bp, Homo sapiens
actgaactctctcaagtgacagaattactctttggatatttgtcactagaaagggtaaagt

SEQ ID NO: 6849400 - DNA, 58 bp, Homo sapiens
tacgtctgcttctatccttagtgatttgatgtaattcagatgcattagatgcagggta

SEQ ID NO: 6849401 - DNA, 75 bp, Homo sapiens
ttggcactgaccaaagaagtccagtgagcatccctgtacctgctcacagggagggaggattctttgaagtgctag

SEQ ID NO: 6849402 - DNA, 63 bp, Homo sapiens
aatggttttgtttccattttcataacacggccttattaggggtgtctggaaacaaaacttatt

SEQ ID NO: 6849403 - DNA, 59 bp, Homo sapiens
tgtctgcaaagtccagcacaggcttggattgcctgtgctgccagaaactatggaagata

SEQ ID NO: 6849404 - DNA, 70 bp, Homo sapiens
tcccggagtgtgtcggtcagcgtggcgctgaacagcagtgtctgcctgcgggccggcacagccgccagga

SEQ ID NO: 6849405 - DNA, 69 bp, Homo sapiens
tggtaacatagttggagcaggcattctccacggacacggagaagctccgcctgccctctgtgatggcca

SEQ ID NO: 6849406 - DNA, 106 bp, Homo sapiens
tgagacagagtgtcgctctgtcacccaggctggagtgtagcagtgcagtgcgatctcggctcactgcaacttctgccttccgggttcaagcgattctcctgcctca

SEQ ID NO: 6849407 - DNA, 92 bp, Homo sapiens
aggcaaggcaggatagccagaggtcatgagcacaggtcttagagtcaaattgcctgtatttgcatctggcctctcagcctcctgtctttact

SEQ ID NO: 6849408 - DNA, 58 bp, Homo sapiens
ctgagaacatcatattttgcctggtatacagaaccagctgcccactatgtgttcttgg

SEQ ID NO: 6849409 - DNA, 55 bp, Homo sapiens
atagtagcggtactgataataataagtagctgtatgacttatctactgctactgt

SEQ ID NO: 6849410 - DNA, 69 bp, Homo sapiens
gacgattatctcccactcagtcctggtgggcattatgtatgccaggtgggagcggagactgattttgtc

SEQ ID NO: 6849411 - DNA, 93 bp, Homo sapiens
gcacttccttcctagtgtacacgtgtaggggtgtatgactgagcagatactgctgcaggcagcccctctactggggcctctgggaggcagtgc

SEQ ID NO: 6849412 - DNA, 78 bp, Homo sapiens
ctctcagcagcagccactgtgtccagagaaactcacagctcgggactgagcctcgggatggtggcctgtgcttgagag

SEQ ID NO: 6849413 - DNA, 66 bp, Homo sapiens
gggattctgaggctttcccgtcccctcctcactcaacaggccaggggaatctaacttcggaacccc

SEQ ID NO: 6849414 - DNA, 67 bp, Homo sapiens
ttaaacaattaagactattgatatttacaaatattttttagtgggcatcagtgtcttatgtgtttga

SEQ ID NO: 6849415 - DNA, 67 bp, Homo sapiens
gacgcggactggttaatccataaacagagagcatcaggctcttggatccctgggaaccagctgcctc

SEQ ID NO: 6849416 - DNA, 77 bp, Homo sapiens
gtcacacagtcaagtgtagtggtgtcaggtctatctgacctaaagtccatgatcttccttcattatgctctgttgac

SEQ ID NO: 6849417 - DNA, 113 bp, Homo sapiens
tgacactgcctctttaatctgtagcatccgcatgcaagtgctgtcccagtgcagtacacctgggctaggactcacagatggtatgttatgcacagagcagagagtgcctgtca

SEQ ID NO: 6849418 - DNA, 62 bp, Homo sapiens
cgatggcctttccttggcacagggtccactgcagcatgccaaacgaggaggcaggggcgtcg

SEQ ID NO: 6849419 - DNA, 126 bp, Homo sapiens
cctgctcacgtggaagtaaattatttgatgagctggggaaatataagcagtttgtgtggattaaaaggaaatcctcacccaaactatatctttaaaaattatctagataattcaggtgaaagcagg

SEQ ID NO: 6849420 - DNA, 63 bp, Homo sapiens
cccagtttccttccactggctcattcctgagattgcagtagagctgagtgtagggagactagg

SEQ ID NO: 6849421 - DNA, 55 bp, Homo sapiens
gtgtcctgggcactgactagacttgctgggtgtgtaagaaggcctgcccagacac

SEQ ID NO: 6849422 - DNA, 81 bp, Homo sapiens
gcaagggtttctcaaatactgttccaggagatgctgtgctgaaagagaattctgtactcaaataggtttgggaaggcctgc

SEQ ID NO: 6849423 - DNA, 73 bp, Homo sapiens
aatttttcatcaaggtcaccttcataacaactgtgacagattcagtgtttgttaggttcctttgtggagaatt

SEQ ID NO: 6849424 - DNA, 98 bp, Homo sapiens
tgacacatttgctagtttacacagtagcagggattattttaggtaaggtactcatatattttaaaaaatcctgtattagattgcaagagtaagtgtca

SEQ ID NO: 6849425 - DNA, 74 bp, Homo sapiens
cctgggatagtggctggtaggaatgtgtggattacaaatgaagctacacaagtccctccatactctcttgcagg

SEQ ID NO: 6849426 - DNA, 70 bp, Homo sapiens
gattaaaaataacccatgctgaaagcaggagagtgacctttgcaaaagcagtaatgggatattttggttc

SEQ ID NO: 6849427 - DNA, 81 bp, Homo sapiens
tgcagtctctcagagtgctctagaaattgtcagtggtttacataaagtggccgtgggtgtccagagcaccctgaaactgta

SEQ ID NO: 6849428 - DNA, 58 bp, Homo sapiens
tcagagaagtaggctaatggtggggaagcatttccctgctgatgttcgtgcttcctgg

SEQ ID NO: 6849429 - DNA, 57 bp, Homo sapiens
gggccccagtcctcccacgtggacagcagctctgggcctgggggtgggctggggccc

SEQ ID NO: 6849430 - DNA, 58 bp, Homo sapiens
ctttcactctatccaacttcttgatttggaaagcaaatcaggcaggcgcagagggaag

SEQ ID NO: 6849431 - DNA, 65 bp, Homo sapiens
gcaatttaccaggagtcagaaggactagtaagctgaacccagccaggtctctgacagctggttgc

SEQ ID NO: 6849432 - DNA, 61 bp, Homo sapiens
ctggaggcactgcagggcttctgaaagcggcccatcccaggagcctggcaaacacccccag

SEQ ID NO: 6849433 - DNA, 106 bp, Homo sapiens
gctcaggaagaaagtgccaaaagctgggagtgggggcagggagctgacggacactccctcgagaacgcccctctcacagatatgctgggatttttgttcccaaagt

SEQ ID NO: 6849434 - DNA, 76 bp, Homo sapiens
gttctggaggctggagagtccaagatcaaggcaccagcagatttggttccttgtgagggctctcttcctgaagcac

SEQ ID NO: 6849435 - DNA, 88 bp, Homo sapiens
gtacagtcttaggtaatttcatgggcatattctctacctcatgacttctcaattttaagaaagtgtgcttaagtttatcaggatttac

SEQ ID NO: 6849436 - DNA, 118 bp, Homo sapiens
tagccacactcaactacaagggaggctgggaaatgtattccagctcttgatgaccaggagaaaattgaaagagtctggtagacacctagccaatccctactccagtgaatgtggtcta

SEQ ID NO: 6849437 - DNA, 58 bp, Homo sapiens
tctgagaataaaaattgcatttcttggaagtctctgagattgctgttatgttcccagg

SEQ ID NO: 6849438 - DNA, 91 bp, Homo sapiens
gtctgtggaaaaccttgttgctgaattcaggattctttcttccagagaagatttgggcttgtgtttgcaacagccttggacagctacagac

SEQ ID NO: 6849439 - DNA, 88 bp, Homo sapiens
gctccaccacctgctgtctggataatcctaggaggttcacctcactctctgaacctgcttccttttatattaaacaggaggctggagc

SEQ ID NO: 6849440 - DNA, 68 bp, Homo sapiens
ccatgggaacgtatgttgggaatattgttccagccactgcaaaagggctcccagcattgcttcccagg

SEQ ID NO: 6849441 - DNA, 99 bp, Homo sapiens
gagacaggagaattgcttgaaacctggaggcagaggttgcagtgagccgagatagggccactgcactccagcctgggtaacagagcaagactctgtctc

SEQ ID NO: 6849442 - DNA, 79 bp, Homo sapiens
cattgtgactgtggacactacgataggggaaaagtttctttttaaaaaaattttaattgttgtgggtacatagtatatg

SEQ ID NO: 6849443 - DNA, 66 bp, Homo sapiens
atggtgtgtatgtgtgcaaatgtaaatatatacctgtgtattcatttatttactcatccacgctat

SEQ ID NO: 6849444 - DNA, 88 bp, Homo sapiens
gtaggatccagtgatgtttctgcatcagagtgaaggaatttctaaatgagagcaaactctctgccatgcattgacatcggggttctat

SEQ ID NO: 6849445 - DNA, 62 bp, Homo sapiens
ggggaaactgaggctcagcgtgaggaaaggcctctgcttggatcactctgaagccttacccc

SEQ ID NO: 6849446 - DNA, 70 bp, Homo sapiens
agctggctttatggttggctaagggattcttcccgagtctcactgcagcctgccgaccaggaggccacct

SEQ ID NO: 6849447 - DNA, 81 bp, Homo sapiens
cagtctgactcttctaggggctcattgtcaacacttaataagtgaaacagaagctcctggaatatttgaaagagtcaggtg

SEQ ID NO: 6849448 - DNA, 93 bp, Homo sapiens
catcctagtgttattgtttacacataactcctatcaagagtttggtcaggacaatggattttcttgaggggtgtgataggcatgctatggatg

SEQ ID NO: 6849449 - DNA, 86 bp, Homo sapiens
accgcactcatgtaggccacggaaagcaggttgcactcctcataggacagctcggtgccctgcttggtcatggccttcatgcaggt

SEQ ID NO: 6849450 - DNA, 73 bp, Homo sapiens
ctcctgggatggcctccttcctgtctggggcccacaggcagcttgtcctggaggatgggccaagccaccggag

SEQ ID NO: 6849451 - DNA, 73 bp, Homo sapiens
cattgacactggaaatattgaattggatgttggtgataggagccatcagttctttatttcacagtgatcagtg

SEQ ID NO: 6849452 - DNA, 102 bp, Homo sapiens
ctgcattttttgatgtgggggcactttactgcctcatctctagtggttgatgttcctcctctctaaagaaggcacagtgctgctaagattgagaaatcacag

SEQ ID NO: 6849453 - DNA, 69 bp, Homo sapiens
atcgtgggaattttgtttagatactctgattgactgtatcagaggaagacgacggaatgcacccttgat

SEQ ID NO: 6849454 - DNA, 61 bp, Homo sapiens
gcctggagaagatggaactagcacagcactctagtgaggactcaggaccttcttcccgggc

SEQ ID NO: 6849455 - DNA, 57 bp, Homo sapiens
ggcaccccaacggtcggcccccacccgggctcctggagccaacgcgctggggctgcc

SEQ ID NO: 6849456 - DNA, 67 bp, Homo sapiens
ttgcttgaaatcggaaggcggagttgcagtgagccgagatcgtgccactgcactctagcctgagcaa

SEQ ID NO: 6849457 - DNA, 84 bp, Homo sapiens
tgaagctaatccgttcctagaggagctgcttctgggtccgagttttctctgcagcagagcagctccctggatgggatctgttca

SEQ ID NO: 6849458 - DNA, 81 bp, Homo sapiens
cggttttaggcagaacatggactttgagaagttttaaaaattctattattcccacccatgtttccctctgtctttaagctg

SEQ ID NO: 6849459 - DNA, 55 bp, Homo sapiens
aggtggcagactaacagaaggatgtgtgtatcccactgctttgctctgctcacct

SEQ ID NO: 6849460 - DNA, 129 bp, Homo sapiens
ctcagccttcctgcctccaagcgtgtgctctgaactggcaggctggaggctgttctggggaggacgcactgtgtcccatgactctccagtctcctcggagctgctgagcttcctggcaggaagcccatg

SEQ ID NO: 6849461 - DNA, 63 bp, Homo sapiens
gttgcagacggggtgcactgaaactccttacaaaagagtcacttacgaaacccagtttgcaac

SEQ ID NO: 6849462 - DNA, 84 bp, Homo sapiens
agggagtggccaaagatgtatagatagaaaggcaccaaaatcaaaccttgttacatttctaaacataactttgtgtgatttcct

SEQ ID NO: 6849463 - DNA, 68 bp, Homo sapiens
gggacagagcctccaagggtcttccaccaggagcagggctgctggtttagattcttggaaaatcgccc

SEQ ID NO: 6849464 - DNA, 94 bp, Homo sapiens
ctggtgtgtgaccggcacagccgggcaaggctggaggctttgtaggttgctgcccttaggaccccacttgctgggcctgtgctgacacgtccag

SEQ ID NO: 6849465 - DNA, 81 bp, Homo sapiens
gtaaggtacttgagtattccaaaaataaggacaattgtgattgcacaataattcctttaactggaaaacatattggcttat

SEQ ID NO: 6849466 - DNA, 104 bp, Homo sapiens
gaggcagaggcagagatttgcttgaacccaggaggtggaggctgcagtgatccgagatcacaccactgcactccagcctgggggacagatcaagactccgtctc

SEQ ID NO: 6849467 - DNA, 84 bp, Homo sapiens
gcatcacctttcccagacctcaacaaagttttcttgacgtctctaatgtgaccaaagagctgttcagtgtcgctgaggagatgt

SEQ ID NO: 6849468 - DNA, 82 bp, Homo sapiens
gtttctatttttgctttcatctgtgttctatttcgatatagtcattagagataacttgaacatggagagtaagtagcctagc

SEQ ID NO: 6849469 - DNA, 78 bp, Homo sapiens
gctgggttacaagctgaccctgaagatgatcagacaaggcaaaacgaaattgatcatcctcgctaacaactacccagc

SEQ ID NO: 6849470 - DNA, 65 bp, Homo sapiens
gtgacagactgcgtagtccccaaagcctaaaatgtttagttatgggttaaattgcagcctctcac

SEQ ID NO: 6849471 - DNA, 63 bp, Homo sapiens
ttaggaatatagactaagtagaatccctgaagttaagccttcaacttagtgtagggttcctag

SEQ ID NO: 6849472 - DNA, 55 bp, Homo sapiens
gggccagacggggtctccaggctgcaagtccttgccagtcctgtccctgctgccc

SEQ ID NO: 6849473 - DNA, 83 bp, Homo sapiens
cctttattgcatcattaattgccaaccttgttggaccagtactctgatgactactctctcacagcttggctgataaataaagg

SEQ ID NO: 6849474 - DNA, 130 bp, Homo sapiens
gcatattgaaatcacctgagaagcattaaaaagtcttgatgctgcctagtcagagattctgacttaattggtccagggagttggctggatagtgggctgttttaaagcttctcaggtgactccagggtgc

SEQ ID NO: 6849475 - DNA, 59 bp, Homo sapiens
tttgaacagacactttctacagtacttatgagtcaaggctgttcactgtgctgtgcaaa

SEQ ID NO: 6849476 - DNA, 91 bp, Homo sapiens
agttattcccttctggaggagaggggctcagtttccttaattctttattcattgaggaaactgagctcctttcctccagaagggaataatt

SEQ ID NO: 6849477 - DNA, 83 bp, Homo sapiens
ttacataaagtggggcttcttttaaagggcggcattctggtttcatccatttccctcttgaagagaagagttactttatctaa

SEQ ID NO: 6849478 - DNA, 84 bp, Homo sapiens
cattgccctgaaattaaatatgagtttgagattttgatttgaagtcttctctttgaaatgaaatatttaagctcttagggaatg

SEQ ID NO: 6849479 - DNA, 85 bp, Homo sapiens
gtgcctcctcctctttgtcctagagatggccagagaaaaccctggcccctacatttctcagggctgaggaggagagagaggaaac

SEQ ID NO: 6849480 - DNA, 78 bp, Homo sapiens
cagatactaatccaactggtggctcttgagccctgtcgcctatgcatagggctctgctcatcagttgtgctggtgctg

SEQ ID NO: 6849481 - DNA, 79 bp, Homo sapiens
aagcactggcacagagacagaaggattaaagagtggttcatctcggaaatcttgctctgattttgtttgttggtttctt

SEQ ID NO: 6849482 - DNA, 83 bp, Homo sapiens
ctgcggaatcagactgggtgcaccaaggcggagggccatgccgggcttcgcccttcctgggtgtcccggagtccgttccggag

SEQ ID NO: 6849483 - DNA, 72 bp, Homo sapiens
ggtcggcgaggggatgtgattatatttctatgtgaatcgtgagaatcttgaaccatggttgtcctgctggcc

SEQ ID NO: 6849484 - DNA, 120 bp, Homo sapiens
gtatttactcagcattacattccattatggtggcaaaaggttaaatactatcaagtggtttgatattttagtatttaatcacttttgtcttgaacgagtgaatgtttagtccgtagatat

SEQ ID NO: 6849485 - DNA, 79 bp, Homo sapiens
tttttaacctggtatgcacattggtttcctcattagcaaaatcgggatagtaatggtgcctacctaatagagttatgaa

SEQ ID NO: 6849486 - DNA, 71 bp, Homo sapiens
tattagcatagtgtctggtaacatagtaaagattcagttattttattattgttatgaggcttatgattatg

SEQ ID NO: 6849487 - DNA, 92 bp, Homo sapiens
tgctggagatctttcatgcttttcctaaaatgatgcctctgaggtgaggtgacctacatgtggaaaataccgcactgaaagttttcttttca

SEQ ID NO: 6849488 - DNA, 65 bp, Homo sapiens
gaagtctcatttggtgtcagttgtggaataacacagtcagctaccactcgcatcccttgaggttc

SEQ ID NO: 6849489 - DNA, 104 bp, Homo sapiens
catgtaaccaattccttgcattcaagtccctttgccttgaacaatctggtggtttctctttcctggttggattctgattaatgcaagactgagttgtgaatgtg

SEQ ID NO: 6849490 - DNA, 55 bp, Homo sapiens
atgtttacttgttctgctgaattctgacccccattaggatggcaagcaagtgcat

SEQ ID NO: 6849491 - DNA, 56 bp, Homo sapiens
tctcagcaagagacttttatgtctgccttgtggctgcagtttgtcttttgcttagg

SEQ ID NO: 6849492 - DNA, 55 bp, Homo sapiens
gtgcactgtctggtcaagagcagtgtccatgtgcgtttctgtggcagcagtgcac

SEQ ID NO: 6849493 - DNA, 65 bp, Homo sapiens
tgtgaggctggttctgaagtactgtacaccccagcagaggtgacagccacagtaccagccctcca

SEQ ID NO: 6849494 - DNA, 69 bp, Homo sapiens
tatgtaaatggccagcaacaggagtgaaggtgttggggttgcattcactctcctaggctaaagctcatg

SEQ ID NO: 6849495 - DNA, 84 bp, Homo sapiens
gtgggtgtgtttgtgggggtctgtatgtgtatgcatgtctacataaacagacatatatgcataccctcaccaactacacactac

SEQ ID NO: 6849496 - DNA, 69 bp, Homo sapiens
ttcagaataacatggccaaatctaaactgttggaaacttcttctatagaaggtttgtcatggttcagaa

SEQ ID NO: 6849497 - DNA, 79 bp, Homo sapiens
cagttcttactctctctgtggtgcccttggggtgtctctctggcatcctaagcctctaaggagtgcattttgagaactg

SEQ ID NO: 6849498 - DNA, 77 bp, Homo sapiens
gtggtgatactagcaatggtggtggtagtctcctgatggagcagccaggcccagatcatgctgtgctggttcaccac

SEQ ID NO: 6849499 - DNA, 63 bp, Homo sapiens
gggaatcagcatggggcttggagtcagcccaatctgggttgaaacctgtctctgctgcttttc

SEQ ID NO: 6849500 - DNA, 72 bp, Homo sapiens
cagaattcgaatgagcagaatcaggaagtctggatatttctggatgttttctgctcattcaaataaattttg

SEQ ID NO: 6849501 - DNA, 58 bp, Homo sapiens
agctggggctgtggttgtgattgtggctggggctgtggttgtggttggggctgcagct

SEQ ID NO: 6849502 - DNA, 91 bp, Homo sapiens
gccgggatggtctcgatctcctgacctcgtgatccgcctgctttggcctcccaaagtgctgggattacaggcgtgagtcaccgcacccggt

SEQ ID NO: 6849503 - DNA, 69 bp, Homo sapiens
tacagtgacctagaataaatacaatggcagtatcttttttgttctaaggttatttttagtttcactgtg

SEQ ID NO: 6849504 - DNA, 58 bp, Homo sapiens
tcctaaaagtaatcaaacatttgtgggttcacatcacgctatgttcatatttttaggg

SEQ ID NO: 6849505 - DNA, 57 bp, Homo sapiens
gagcactaggcatggttgtaaaaatctagactcttttcatccatggcttttgtgctt

SEQ ID NO: 6849506 - DNA, 117 bp, Homo sapiens
ctgagcccagcactggcggggctggggtggaaggagcgtggaatcgggtgcgagaggacagtctccttcagattcctgcttctggcagcctggggaccagttggggcacgggctggg

SEQ ID NO: 6849507 - DNA, 58 bp, Homo sapiens
tacagccatggttaatttacctatgttgcctaagcgtaggctgcatttatatggtgtg

SEQ ID NO: 6849508 - DNA, 83 bp, Homo sapiens
cctccctactcccagatagtcactcttcacacagctaatatggctgtagctggcaggtgaagatgatttcagtaggtcaaagg

SEQ ID NO: 6849509 - DNA, 72 bp, Homo sapiens
taaaactgaatctattgttttttaaagtagtttggacaactgtgtccatcttataggcagagttcagtttta

SEQ ID NO: 6849510 - DNA, 78 bp, Homo sapiens
tggtcttacatgatatgtgaatgaatcataagttattcctcaaactcttaacaagtatttatgtatctgtgtagatca

SEQ ID NO: 6849511 - DNA, 74 bp, Homo sapiens
gctgttcctgttgctggtgattacagccatatttcacagagaacatatggctgtgtttatagccatcaggcagc

SEQ ID NO: 6849512 - DNA, 69 bp, Homo sapiens
ctccgggacccaggtagggaggaagattttgctcaggtcattatctggctcttcctggagttccgagag

SEQ ID NO: 6849513 - DNA, 76 bp, Homo sapiens
actggatttatgaacatatttctcaagaatgtcaagaaagaattgtacaatctgatgatgtatggtgagtttcagt

SEQ ID NO: 6849514 - DNA, 78 bp, Homo sapiens
aattggttgatatctaattggcttgtaagtaatactgctggttacattatgttatgctatttcagatatatatcagtt

SEQ ID NO: 6849515 - DNA, 63 bp, Homo sapiens
tgtctgggagttcatgagttcttaatcctctgtcactggaacagacttagagcatcccaatca

SEQ ID NO: 6849516 - DNA, 78 bp, Homo sapiens
atgtgatcaaaaacctgaaggatgatacaacagtgataatttgtttcattcttgcatcatccttctaggtgattccat

SEQ ID NO: 6849517 - DNA, 55 bp, Homo sapiens
gagggagattttagaaattactttacataattgtaatagtaatgaagtcttgttc

SEQ ID NO: 6849518 - DNA, 66 bp, Homo sapiens
tgaaggacacattttctaacagggatcactgtgtaaaaaaactggtggtagaaaatgtgtgcttta

SEQ ID NO: 6849519 - DNA, 59 bp, Homo sapiens
agatacagaagtttttccctattaggcagtaggcttcctgggggcagggttctgtctct

SEQ ID NO: 6849520 - DNA, 82 bp, Homo sapiens
gacaaagaaaaggatactttgaagaaagggccctcgtctactggggcctctggtcaagcaaagaggtttgtttttctatgtc

SEQ ID NO: 6849521 - DNA, 57 bp, Homo sapiens
ttccagtctttccaacatttcattggctattcagtcaaaaagtatgaaagacaggaa

SEQ ID NO: 6849522 - DNA, 76 bp, Homo sapiens
ggggagaggcaggcagcagaggagtgtgggaagctttttgccactgctattctgttgactgacttttaattaaccc

SEQ ID NO: 6849523 - DNA, 79 bp, Homo sapiens
gattctttaaaagtcttgggaaataaacagattgactttcactttacatggtttatttacctaaggaccaaagagaatt

SEQ ID NO: 6849524 - DNA, 60 bp, Homo sapiens
ccataggccagttccgggagcactgtgacctagcactcagtttctcatgtggccttatgg

SEQ ID NO: 6849525 - DNA, 87 bp, Homo sapiens
gaatccaaagatgaagtagactagaggatcagcaagggctccaaagaaagagtatttggtgaatctatggtcaggctttagtggttc

SEQ ID NO: 6849526 - DNA, 62 bp, Homo sapiens
tgaggctcattctgcatgccaaataatccttgattttttcttggtgttgtaggagagtcaca

SEQ ID NO: 6849527 - DNA, 79 bp, Homo sapiens
gttattgtaatccagccacttgcacagttaaattttgtatttgattttcagcaatagtggctctgtggttacaagaaac

SEQ ID NO: 6849528 - DNA, 56 bp, Homo sapiens
tggtgatgtttttgctgcacttggcattgtgtgtgtgtgtgtgtagagcatcgcca

SEQ ID NO: 6849529 - DNA, 75 bp, Homo sapiens
ttttgccttttcaacttctgtgcccttagctccagtttaattcctcgccaagtgtcagaaacaggaaggggaaaa

SEQ ID NO: 6849530 - DNA, 86 bp, Homo sapiens
agatttaccctttctgggaggcagtttctcaggagtacatctgtaaaaggaggctgcctcttttgagagggtactgacaagaatct

SEQ ID NO: 6849531 - DNA, 55 bp, Homo sapiens
acagacatgctgtttgggtggtcagaatattttgcatccaagcataaatgttagt

SEQ ID NO: 6849532 - DNA, 75 bp, Homo sapiens
ctggctggctctgtggtagttggcagccattcaagactggtcttgtgccaggagtattactagatagccagacag

SEQ ID NO: 6849533 - DNA, 66 bp, Homo sapiens
caggaagctaatgatctaatgtctcaggagcaagtaatcattttggacagttatctcattgtcctg

SEQ ID NO: 6849534 - DNA, 93 bp, Homo sapiens
ggccctaggagctacccgccatgtttttaaaagccttagggaaatcatattttgcttaggctaacaaaaatagcagtggctttgcttggggtt

SEQ ID NO: 6849535 - DNA, 107 bp, Homo sapiens
ccatgtggttacagagtagaactggatatttcagtatgagcacttagctcaatattgatgcaaatagttacatacagaaatatttacagataaatgaagatacatgg

SEQ ID NO: 6849536 - DNA, 80 bp, Homo sapiens
caaatactgttgcctacattatatgattgtgctttaaaagtctcatcgttacagtatacattgattaggaccagtatttg

SEQ ID NO: 6849537 - DNA, 85 bp, Homo sapiens
gcagctttccttccacagcaggaccattgaggcatcatcctgaaaaacatgaaggatgtgaagcagtcattgctgaaggacatgc

SEQ ID NO: 6849538 - DNA, 56 bp, Homo sapiens
actccatctgctcctgaagccatgtagaatgtcggtcttgcaggagtgggtagagt

SEQ ID NO: 6849539 - DNA, 97 bp, Homo sapiens
tactgacaaggtacttaaaagtggatactaattattgtgcatgtctatacatttttgcaataagttgtgttatcactcaaaagtgaccttgttagtg

SEQ ID NO: 6849540 - DNA, 80 bp, Homo sapiens
gttttctatggtgctattgtttctatgctctgaggcctctccaggtgtcagtgtctatgaagaatttatttatggaaaac

SEQ ID NO: 6849541 - DNA, 65 bp, Homo sapiens
tctgtgcactgtgtcattaggttaaaggcatgggaaaacaaatgcacttggacacaggccacaga

SEQ ID NO: 6849542 - DNA, 62 bp, Homo sapiens
cctttagttgctttagttgagctgctcctctagcagcagctccagcccaggcagctccttgg

SEQ ID NO: 6849543 - DNA, 56 bp, Homo sapiens
agggtggagggccatgagaagtatctgaggaaactcagcaggtcaggccccttcct

SEQ ID NO: 6849544 - DNA, 82 bp, Homo sapiens
gggcagcaggtggagactgtgagtgatttccttctggggcccactgcccaggaaggtgggagctgatgacttccctctggct

SEQ ID NO: 6849545 - DNA, 67 bp, Homo sapiens
tctatttgcaggtagcattttttgacaaataataaatatttgatgaatatgttttgcctgacgtaga

SEQ ID NO: 6849546 - DNA, 86 bp, Homo sapiens
tatgtgctggaaaattatctattccaaatatcagcgtgttttacagccaaaagcagctaaggaatcagaagaggtttcaacatatg

SEQ ID NO: 6849547 - DNA, 68 bp, Homo sapiens
ccgcccgcgccagcctctccatctcgcaagttttaattaacgctgagggggaggcggctgacgggcgg

SEQ ID NO: 6849548 - DNA, 101 bp, Homo sapiens
gagtcagtgtcataacagcaatgactgccattagtacaggtagtttatagctcaaatttttacctttgtatttacctagtctcactgttttgcgctgtctc

SEQ ID NO: 6849549 - DNA, 70 bp, Homo sapiens
ttttgacatcgtaatgtgatttgcattgatttgaggctgccatcaggatgagctcataactatgtcaaaa

SEQ ID NO: 6849550 - DNA, 72 bp, Homo sapiens
gattagcagaggcagagtcacaaagagtcttttataaaccttggtagagagtttgtactttaccctgagatc

SEQ ID NO: 6849551 - DNA, 77 bp, Homo sapiens
gtgatttggatgttggggtgcatgggccacgcttggagaaaaactggccctgcaccccaatggcatgacccgttcac

SEQ ID NO: 6849552 - DNA, 76 bp, Homo sapiens
cagtctgaaatgttctggagtttctgtggctctaaagcggggttttcaacagcagcactattgacattttgggctg

SEQ ID NO: 6849553 - DNA, 62 bp, Homo sapiens
ttctaagagtctttcagaaatgtacaatttggagtaccaattgactctaagagattcttgaa

SEQ ID NO: 6849554 - DNA, 119 bp, Homo sapiens
ttacagcaatttgacattgctatgatattcaagcaccaaattagtaggctcatctcgttgaatagggtagagaccagtttgagtgttgttgaacttgtgtgatgaattacgtggtgtga

SEQ ID NO: 6849555 - DNA, 58 bp, Homo sapiens
cacagcttagaaaagaagccattcctgcagttcatgcccatggctctgatttaatgtg

SEQ ID NO: 6849556 - DNA, 72 bp, Homo sapiens
gcgcccagctcagggctatgattaatgatggtgtcggcagacattagtgtgcccaggccctaggctaagtgc

SEQ ID NO: 6849557 - DNA, 73 bp, Homo sapiens
ttccccagatgacatcaaaaggccatgttggtgtcaccaccacctccagtgctaaattgaagtctcaggggaa

SEQ ID NO: 6849558 - DNA, 60 bp, Homo sapiens
ttctgacgttctgaataagtagtgcaccaactggccctgcaactgtgtcagaagttagaa

SEQ ID NO: 6849559 - DNA, 128 bp, Homo sapiens
aactagaagatatgagtattctattcacaccaagttagataaattaagactttacatattcttgtgtcaggtcagtatttgatgccaagtgagtgtaggattggccatgttttgccaccaattaagtt

SEQ ID NO: 6849560 - DNA, 75 bp, Homo sapiens
aggcttattctccagggatgccaagctttaccatgcacatataatagtaacagcagcttccctgtgaatgtgctt

SEQ ID NO: 6849561 - DNA, 91 bp, Homo sapiens
gctaggctggtctcgaactcctgaccttgtaatctgtccaccttggcctcccaaagtgctgggattacaggcttgagccaccatgcctggc

SEQ ID NO: 6849562 - DNA, 103 bp, Homo sapiens
agccatgtgttttcctttgatatccttattcattagggtagtgggaagatccagcccagaaatgaaaggatgattttttaaagttaccagactcaacctggct

SEQ ID NO: 6849563 - DNA, 87 bp, Homo sapiens
cccgctgctgaggtcttgaatctcacatgcaaacagtccacagttggaattgtgactgtcatatgtgagcatccagccacagttggg

SEQ ID NO: 6849564 - DNA, 129 bp, Homo sapiens
aaaactaaagggtggagtatccagaactttgggtagaactttcagaaattccaaagaaagactgacattctttgggtactcgaaaagttgaactgagatgcttctggaaacttaatttcattattattt

SEQ ID NO: 6849565 - DNA, 112 bp, Homo sapiens
gaaagccgactccaccgccatatgtgttagagctggccgggacagctggaagaaatatcgcccagcccgaatccctggccaggattgtgatccatgtctgcatacggctatc

SEQ ID NO: 6849566 - DNA, 58 bp, Homo sapiens
cagtctggcacagcacactgaacactattcttagtccacgtgtgtagatgctgaactg

SEQ ID NO: 6849567 - DNA, 88 bp, Homo sapiens
ccctgaatagtttgaaaaattatgtagccatatgaaacaagagcataagccatgtgtgatagggctacgtaggatcagctttcagagg

SEQ ID NO: 6849568 - DNA, 62 bp, Homo sapiens
gaagtttacagtgactggactttgtcatcatatctgagatgagtacagagctgtactctatc

SEQ ID NO: 6849569 - DNA, 74 bp, Homo sapiens
gggttttttgatctctgttcatttatttactggggaaaaatgttaacacattccagaaagaatgaactgaaccc

SEQ ID NO: 6849570 - DNA, 67 bp, Homo sapiens
ccacagtgtatcattagtgtgatgagtttatctctttaaagcctcacaacctgctgatatgctgtgg

SEQ ID NO: 6849571 - DNA, 56 bp, Homo sapiens
tgtgcatgttctcatttctaacttatttttaatgatagagatgagctgatagcata

SEQ ID NO: 6849572 - DNA, 89 bp, Homo sapiens
aagatatgtttccaactgtgatcttacttggaaatagggtgattgcagatctcatctgctacagtgaggtcatactggagagggatctt

SEQ ID NO: 6849573 - DNA, 65 bp, Homo sapiens
tcttaaaggcatgttagggtcctttgggttaattatacaaggtttgctgacagcgcctgataaga

SEQ ID NO: 6849574 - DNA, 67 bp, Homo sapiens
tggcacctgctcatctggactcagcgcctgcctccatccaagttgagtgtcccaaagcaggtagtta

SEQ ID NO: 6849575 - DNA, 65 bp, Homo sapiens
tcaagggctgtgtctctggagcgtcccagaagtttgaccctttccatctgtgagcatgccctgga

SEQ ID NO: 6849576 - DNA, 74 bp, Homo sapiens
acctggagtgatggaaagtgcttggccaaagtttacaaagccctgtagccaataactggttccaaatttcaggt

SEQ ID NO: 6849577 - DNA, 74 bp, Homo sapiens
tcacataggcaagatgaggtttttattcagctctaaaaatcaaatgataaaagtttccaatcatgcctgtgtga

SEQ ID NO: 6849578 - DNA, 83 bp, Homo sapiens
ggtgctgtgagtcatgtggcgatcagctgtgctttctctatgatagaatgcaaatgatcccacacactcaaattcccagcatc

SEQ ID NO: 6849579 - DNA, 75 bp, Homo sapiens
caacctggctgcaagacaaggttggtttccaagccttcctggacctccagatttgatttgcactatttatggttg

SEQ ID NO: 6849580 - DNA, 127 bp, Homo sapiens
tcaacaggtccctcggagagaaccttccagagctctgcctgtggatacatgctctgatcacacagctcatcaagcactggggccacagacacggactgggaggtgggtccccatggcacttgtgtga

SEQ ID NO: 6849581 - DNA, 64 bp, Homo sapiens
tgtaggcatcactttctcttgggcagttatcacattggcagactgaagggaagtgatttctaca

SEQ ID NO: 6849582 - DNA, 65 bp, Homo sapiens
gtgacagggttgagtaaactgggatcagggcacaggcttctctcaccatactcagcttcttgcac

SEQ ID NO: 6849583 - DNA, 60 bp, Homo sapiens
tagtccacagactctacagcatcatggccccaagtctattgcatggaattctggggacta

SEQ ID NO: 6849584 - DNA, 58 bp, Homo sapiens
cagtcaacagagagcccgtcaggtgctctaagagagtagggcagacctttggtgattg

SEQ ID NO: 6849585 - DNA, 57 bp, Homo sapiens
tctgggaacgaaggctaatatggctcaaatcccaaacagtcctacattgttcctagg

SEQ ID NO: 6849586 - DNA, 80 bp, Homo sapiens
tgttatagcagcacaaagtggaccaagtgccttttcatgtactatgtccttaaccacttgtgtttattcctgctgtagca

SEQ ID NO: 6849587 - DNA, 58 bp, Homo sapiens
ggagggctttttatgaatggaggctcagttcaagatggcctcccccttgaagccctcc

SEQ ID NO: 6849588 - DNA, 62 bp, Homo sapiens
gaaaccacaaagtctgcagttgtggcataaattgtgcctctgaattttggctatgtagtttt

SEQ ID NO: 6849589 - DNA, 68 bp, Homo sapiens
gggaaagagctttgctttctaggcgtgtgtctccagatgggcccaggaaagatagggcctcagttctc

SEQ ID NO: 6849590 - DNA, 77 bp, Homo sapiens
gttgaagctataattcctcagcttgttaccaagggtggctaatggaataatcagtgcctttgtagcaagccttcaat

SEQ ID NO: 6849591 - DNA, 83 bp, Homo sapiens
gtcccgtcggctgcggccgcgcgcggcccggggtcgccgtgagtactcgccaggctggcctgtgtggccgccaccacgggcac

SEQ ID NO: 6849592 - DNA, 68 bp, Homo sapiens
ggtcagaggggattccttgggagagagaattgcagtaccagattgcaggccgagggccctgtctgacc

SEQ ID NO: 6849593 - DNA, 75 bp, Homo sapiens
cattgtgattgtctaagagtgcaatgcatgatccaggttgggtcaatcatagtccttctctagacttttccaatg

SEQ ID NO: 6849594 - DNA, 71 bp, Homo sapiens
gttgaattcagttaagcaactggctgttttgcgactaatgatttgtaagtagcagtttggctgaatttaac

SEQ ID NO: 6849595 - DNA, 75 bp, Homo sapiens
ggagacatcttagcattctgcctcctatatcaactatcttattagaggtgaggacaaagaagcccagaagtcttc

SEQ ID NO: 6849596 - DNA, 58 bp, Homo sapiens
agaaggttgttaaaggggattcaaatcaattactttgaaactatgaagacaaccatct

SEQ ID NO: 6849597 - DNA, 59 bp, Homo sapiens
tctcatccagagcattttcaagatatgaagtcagtattacatgttttatgctgatggga

SEQ ID NO: 6849598 - DNA, 55 bp, Homo sapiens
ggcctcattttttgtaaatgacctctgagttgaaagaaagtttcaaaatgaggcc

SEQ ID NO: 6849599 - DNA, 104 bp, Homo sapiens
ggaacaaaggtgacattagtatttcatgtgatggtctgtttactctgtattaaaatgtcatatgctgtatacatatgaaattactgatttcacttctggaatcc

SEQ ID NO: 6849600 - DNA, 81 bp, Homo sapiens
gaggccacacttacaccaggctgctcctagccagtgactgggcatggcaggggtcctggtgttgactcagtgcaattcctc

SEQ ID NO: 6849601 - DNA, 83 bp, Homo sapiens
gactttgtgaattttatgtggaaagcaaagatactgggagggtcatcagtgactaggagaaatattaaaattgacacaaagtc

SEQ ID NO: 6849602 - DNA, 78 bp, Homo sapiens
ccctggcctgggcggctgcctccacgatgccactgctcatcgaggggcagcgagtgcggctgccacagtccgccgggg

SEQ ID NO: 6849603 - DNA, 105 bp, Homo sapiens
tggaaaaggagacagataccctctagtctttctccctggctttggagatgaggaccccaaggcccagagagccagttagtggcagatcccctgcctcccagtcca

SEQ ID NO: 6849604 - DNA, 76 bp, Homo sapiens
gccagaggctggcctcgcctccaaagagttcctgagaaccctcttcaggagggtggagggcgggcattgcttctgc

SEQ ID NO: 6849605 - DNA, 112 bp, Homo sapiens
agcataaataaaacgcttgacagaaggttttatcctaagttttcagtcattaaatatctgaaataataggaaattaagtctcttttgtcaaacaaggacatcacaatatgct

SEQ ID NO: 6849606 - DNA, 71 bp, Homo sapiens
aagagcaggaatggggtgcagagggcagacccgtcaggccaggcttccctgctttcccactccatgctctt

SEQ ID NO: 6849607 - DNA, 63 bp, Homo sapiens
ggggaagacattttggactgcctcgagaggtctcaaggaccttccagggctctccagaacccc

SEQ ID NO: 6849608 - DNA, 76 bp, Homo sapiens
gcagggaatgagatagaggaagaatgggatttctaactgaaattccacagctcagcctctcttttcaaaacccagc

SEQ ID NO: 6849609 - DNA, 63 bp, Homo sapiens
catctgctctttcaggagccagagttcaacctctaaagctctgagtgattaaggagcttcatg

SEQ ID NO: 6849610 - DNA, 74 bp, Homo sapiens
tcatatttctacttgccaaatgacacattgtattttccctgtcaatgcaatcagtaagcaagtggagaaaatgg

SEQ ID NO: 6849611 - DNA, 71 bp, Homo sapiens
agagtctgagcagaaatccactgttctgcatgtggggaaaggtttaaggcacagaggcattttcagactct

SEQ ID NO: 6849612 - DNA, 80 bp, Homo sapiens
tcatctaggtttttctgtattattgtgcttcagctcagagagtgaatatttaacaaaatgcagagtatgaatttcagtga

SEQ ID NO: 6849613 - DNA, 85 bp, Homo sapiens
gacaaaatagtgtctgtccagaacgtacatcttgggtgctcaaacccgacagtgtgccgtctgagacgccgacgcaagtgaagtc

SEQ ID NO: 6849614 - DNA, 74 bp, Homo sapiens
agttgggatatgggtcagttcagtggccaacagtctctgttcccaccatgctgcacccatctcttaccccagct

SEQ ID NO: 6849615 - DNA, 59 bp, Homo sapiens
taggttggtgcaaaagttattgcgttttttgccatttactttcaatttgcactaaccta

SEQ ID NO: 6849616 - DNA, 58 bp, Homo sapiens
atggggttatgcagagaagtctgtgacttcacagtatacgactaacgcatgaccttgt

SEQ ID NO: 6849617 - DNA, 64 bp, Homo sapiens
ggatggacagctggcctcaagggaacactgcaaagtggctctaggaagaagccactgtccctcc

SEQ ID NO: 6849618 - DNA, 56 bp, Homo sapiens
gaatgtacactgaaagcctatcaggagccaagccctgggctaagtactttacattc

SEQ ID NO: 6849619 - DNA, 64 bp, Homo sapiens
gtgctttaccttattggtctcggttctgagttttctaaacctggagacattgaggagagagcat

SEQ ID NO: 6849620 - DNA, 61 bp, Homo sapiens
gtctacctctccctaccaagcaccagagcccctctgccatcttcttggggagcagctagac

SEQ ID NO: 6849621 - DNA, 79 bp, Homo sapiens
ctcaggaagccagccaggctggctgtggaggtcccaagaccctgggtcatcctccatctccagcttctgccttgctgag

SEQ ID NO: 6849622 - DNA, 75 bp, Homo sapiens
tgtagcggttccctctgccagctatttttagcattgttgctgccagctgacagcagagacaaaggcaccgaggca

SEQ ID NO: 6849623 - DNA, 66 bp, Homo sapiens
gtttggtcctgctcccctgcctcctctgctacccagagctgcagagcctggagccctgggccgtac

SEQ ID NO: 6849624 - DNA, 60 bp, Homo sapiens
ttctgtcctccaccccttccccatcatagttgccctgtggaaatctgggtgaggacagaa

SEQ ID NO: 6849625 - DNA, 84 bp, Homo sapiens
ccacaagcttcttggctctgaggcattgtcctggggagggccgagcacctccctggaggcccagacctgggagtgcataagtgg

SEQ ID NO: 6849626 - DNA, 72 bp, Homo sapiens
aggagaacaatttcacatctatctcagatttgttttgcggataaaatgagatacagtttgaaagtagctcct

SEQ ID NO: 6849627 - DNA, 81 bp, Homo sapiens
tgtgtttattcttgtggtttgattcagtatgacctttggagcctcactttggactagacatcgagctacagagtggaaata

SEQ ID NO: 6849628 - DNA, 62 bp, Homo sapiens
ttttaaagtgcacagaaactggaccaaccccgggtggtggtcctgctgggcctgctttagga

SEQ ID NO: 6849629 - DNA, 76 bp, Homo sapiens
cctttatgccacccatcatggctataattccttgtttgaaggtcattgttgtctctgatgctggaggctccaaagg

SEQ ID NO: 6849630 - DNA, 116 bp, Homo sapiens
taaattcatagtctaaatgagcatttttggtctaatacaggcactagtcttgggcattagacatgcctttaatagttctgtgtagctcaagagttgttctttagcttaggacttta

SEQ ID NO: 6849631 - DNA, 58 bp, Homo sapiens
taatgaggccaagtccacctctgcctgtgttgggaggcactgtctggggacctcatta

SEQ ID NO: 6849632 - DNA, 82 bp, Homo sapiens
caggctccatttgctgatgggctgtgcgactcaatgttcacaaatgtttagtcattcagctccttttcaaggaataagcctg

SEQ ID NO: 6849633 - DNA, 83 bp, Homo sapiens
tttaagaacaaactgccatatgtcaactgtactaaaatctgggaattgtggagtacagttataagtggtcttgaatttttaaa

SEQ ID NO: 6849634 - DNA, 58 bp, Homo sapiens
gcacttcttggttctcctgggctgttgcagaattgtgctctaaagaacccagaggagt

SEQ ID NO: 6849635 - DNA, 72 bp, Homo sapiens
gaatttattcctttatggctggaggactcatggtagtttgctttttcaaagctagtaaagagagtaagattc

SEQ ID NO: 6849636 - DNA, 68 bp, Homo sapiens
gtcctgcttctgctccccaccctcctactctgtgagcagaatcaggagctagggggcaatgctggggc

SEQ ID NO: 6849637 - DNA, 90 bp, Homo sapiens
gcctgctcaaaatagtattatcattggtaatatggtctgtatcttgtctgacccggatgatgtgtcccaagaagtagggtttgagaaggt

SEQ ID NO: 6849638 - DNA, 58 bp, Homo sapiens
taaaatagcatgtgcagtgaaagaaaagcatacacgttctcattgcatatgctttttg

SEQ ID NO: 6849639 - DNA, 130 bp, Homo sapiens
tgtgaatatccacttaaaatgccatgtgatgctaatcatctctgtgggagcagctcatgtctctagtaaattgcatttcacagtaaagtgatttcacagttctcatgtattttttgtgtttagtgcaata

SEQ ID NO: 6849640 - DNA, 57 bp, Homo sapiens
cctgaatagacatctggccatagacaaatcctccttgtctccagagacttctacagg

SEQ ID NO: 6849641 - DNA, 90 bp, Homo sapiens
tagaagaagtttctgaaatggggttgtgatcagggatgggagagtcctcctctaggcattgttattacaactcttttataaactctttta

SEQ ID NO: 6849642 - DNA, 56 bp, Homo sapiens
gttgtctaaattggcctgccccaatcttctgggctttgtagtacaattaggacaat

SEQ ID NO: 6849643 - DNA, 70 bp, Homo sapiens
tttttctttacaccaacttctccatcagataagagtttcctcttcttgagggaaggagttaagagaaaga

SEQ ID NO: 6849644 - DNA, 55 bp, Homo sapiens
cacatttacatataaaactttccccagtgggccacagaggatttatgtggatgtg

SEQ ID NO: 6849645 - DNA, 76 bp, Homo sapiens
aaggcaaattgttgggccctaccccagagctactaaatcagaaactctcggggtggggcccaacaatccttgtttt

SEQ ID NO: 6849646 - DNA, 55 bp, Homo sapiens
gtgtggctaggatggctttgctgtcacagaagggacagtccacactacccaacac

SEQ ID NO: 6849647 - DNA, 82 bp, Homo sapiens
tgcaaagtgttttgtgtgcatctgtgtttaatatgtagggtggcattaagtaagtacaaatgtatacataagcacacatgca

SEQ ID NO: 6849648 - DNA, 59 bp, Homo sapiens
tcactgcatctccccatctgtttccctccatgtatctgaaccagaggaaagagcagtga

SEQ ID NO: 6849649 - DNA, 95 bp, Homo sapiens
tgtctgatgtcctgatgtatgtggaattaattcagttaatgcttatttagcactgactctgtaaaagttctcttcaaggctctgggcaaaggaca

SEQ ID NO: 6849650 - DNA, 92 bp, Homo sapiens
actattgtgctaaccatggattgatttcattatgaatttaaaagttataaatttagaaccataatgaatcaatgaataattggccgatgtgt

SEQ ID NO: 6849651 - DNA, 55 bp, Homo sapiens
gggctggctgtagccaaacaactggatcccagccagttgcataggccagccatcc

SEQ ID NO: 6849652 - DNA, 77 bp, Homo sapiens
ggcaagggctgggggaggctctgctcagcccccgggtggccctgggggacaccagtctctctctgggcctcaatgtc

SEQ ID NO: 6849653 - DNA, 66 bp, Homo sapiens
ggaacctcctcctggagaatgagcagcagcatttgtcctggctgccttctggaggaagtgaaatcc

SEQ ID NO: 6849654 - DNA, 64 bp, Homo sapiens
ctggggccacctgggttcgactgggccccacgggtggtggcccagcgggatgggttggagccgg

SEQ ID NO: 6849655 - DNA, 62 bp, Homo sapiens
gctgaacagtatcttttatcagaaatactgaacagtatttctgatacagtgtactgaatagt

SEQ ID NO: 6849656 - DNA, 57 bp, Homo sapiens
agggcagagagatgaatgggatgaccccggagggtgcttccaacacctttctcccct

SEQ ID NO: 6849657 - DNA, 72 bp, Homo sapiens
aggctgtgagtagttcttgttgaatcattttactggcagtaaaccagatgaagatacaagaactccacactt

SEQ ID NO: 6849658 - DNA, 80 bp, Homo sapiens
tttagtgtgggcccttgatgattttttctgagtgcctgcctcactcagtcactcagagtcaatgttaatggcagactaaa

SEQ ID NO: 6849659 - DNA, 58 bp, Homo sapiens
ggggagatttagagagacttaaacagcagatttctctgtgtggatgctaactctcccc

SEQ ID NO: 6849660 - DNA, 67 bp, Homo sapiens
tagggactagtttcaaggctaaaaggtgattataatcacccacacagctgttgaaaatggtgtccta

SEQ ID NO: 6849661 - DNA, 72 bp, Homo sapiens
cctttattaagttcttgctgtgtgtcagatgccatggtaggtattggaaatacagtagaaaaataatatagg

SEQ ID NO: 6849662 - DNA, 93 bp, Homo sapiens
ctatcagctccaagtggcacagagctttgtcccagttggcacggtgccctgggagctgggtacagcctgtgcctatggccagggagagggtgg

SEQ ID NO: 6849663 - DNA, 69 bp, Homo sapiens
ctgcgatttgaaccctggccagtaattctaagccaagcgggatgctgctatcaggcttcgagtcagcag

SEQ ID NO: 6849664 - DNA, 101 bp, Homo sapiens
tctggatcctttctacaggtgatctgtgtggtagtttcagtgaacagcaccagcactgttcaatgaagctaccacacaaattacctgtagaatcctctaga

SEQ ID NO: 6849665 - DNA, 70 bp, Homo sapiens
tcacatgtgacatgtgtgagcatgtatgtgtgtgtgattgtgtatgcatgtattcatgtgtgacatgtga

SEQ ID NO: 6849666 - DNA, 64 bp, Homo sapiens
gggatgtgctttctttccaaggggctgctgaagcgtgcctctgtaggagtgagagcatcttttc

SEQ ID NO: 6849667 - DNA, 82 bp, Homo sapiens
ctaagaggagatagtgcatagggggatgcacagctctgtaaaagataatgcctccttgcataccctatgttctgttctgtag

SEQ ID NO: 6849668 - DNA, 68 bp, Homo sapiens
caccacattgcagcttcttttggcttgtccacagtgcgaggcgaagctaatggagagctgagtgtgtg

SEQ ID NO: 6849669 - DNA, 92 bp, Homo sapiens
acgaaacacgtcatggtgtttaaggccccagcacacactatttctaatttgcattctgatgtgactgtacctctaacacctgacggtttggt

SEQ ID NO: 6849670 - DNA, 64 bp, Homo sapiens
gtgcccgtgctaagctccatcacttgtttcctcccacgatgggtgtcgtgcttgccatgggtac

SEQ ID NO: 6849671 - DNA, 58 bp, Homo sapiens
tgagatggagtctcactctgtcacccaggctggagtgcaatggtgaggtctccgctca

SEQ ID NO: 6849672 - DNA, 77 bp, Homo sapiens
ctttgacacatctggaatcttgctgaccctggagggactgctcctcctagggtagccaattcctagaaagagtaaag

SEQ ID NO: 6849673 - DNA, 56 bp, Homo sapiens
tatctagcagtgttataattggatacatgagagtgattcatatgatcctgcttata

SEQ ID NO: 6849674 - DNA, 62 bp, Homo sapiens
gcccctatggagctcttctggaattaatattcatgattctatggaaggcataaggaatgggc

SEQ ID NO: 6849675 - DNA, 63 bp, Homo sapiens
gaagcaaactttctgtgttattactgtctctgacgagcagcattaacacagaaagcttccttc

SEQ ID NO: 6849676 - DNA, 73 bp, Homo sapiens
ttaattttccactctgtttatctgacagtgtggatgtgcaatccaaacagataatgagagagtgggatattga

SEQ ID NO: 6849677 - DNA, 60 bp, Homo sapiens
gaaacaaagtgatcaaagtgctgtgggagcagtttggcaacagtttgagctttgaatttc

SEQ ID NO: 6849678 - DNA, 73 bp, Homo sapiens
aggaattcttgtaaattttgtgtgaagtatatcaaacattaaaaagtacttttatgaagccaacaagtttcct

SEQ ID NO: 6849679 - DNA, 61 bp, Homo sapiens
aatttcctgggataaaaagccaataattgcgctagaaagcaaagaggttttcccagaaatt

SEQ ID NO: 6849680 - DNA, 56 bp, Homo sapiens
aggatgaggctggcaggtcttgcagcaaccttgcaagccaggaccaaactcatcct

SEQ ID NO: 6849681 - DNA, 63 bp, Homo sapiens
tttaaatagtaggtctattttggccaatgattgagttccaccattgtagctctgctgtttgaa

SEQ ID NO: 6849682 - DNA, 56 bp, Homo sapiens
tcagccctggcactgtctcccattctcagaggagacagggcagagccagaggctga

SEQ ID NO: 6849683 - DNA, 67 bp, Homo sapiens
tgtcatttacaatgtacaggttgtgccctgcacaatcaccaaagggtaccatttgcatcgtaggaca

SEQ ID NO: 6849684 - DNA, 85 bp, Homo sapiens
cagatggtttctgcggctctaagccgaaatctccagtgcgtcccagggtcacgtgggtggtgtattagagctgcaggaatgtctg

SEQ ID NO: 6849685 - DNA, 76 bp, Homo sapiens
caatggagacaggacacaagctgcataagggataaaaactgcttccctcctttgttcgggtgtgctgtcaccattg

SEQ ID NO: 6849686 - DNA, 79 bp, Homo sapiens
ttatctgacttctggtgaccttaattattcagtggatgatgaaatcctaacgtataatttcaggttcaagataagatag

SEQ ID NO: 6849687 - DNA, 74 bp, Homo sapiens
tccttcattcagtttttattggaccagctattctatgccagatagtatgctgagcttgtaagaagaataaagga

SEQ ID NO: 6849688 - DNA, 129 bp, Homo sapiens
tatttagaggtctaggtagatacacaggatttgtgtgtgtgtgtgtgtgtgtgtgtgtgcatgtgtgcatgcatatatacatacacagtcctgtcatatttcccctttctattttattcctgagagata

SEQ ID NO: 6849689 - DNA, 60 bp, Homo sapiens
acctgatagaatctacagtgaggtctgttctgattttttgctaccctgtgtctatcaggt

SEQ ID NO: 6849690 - DNA, 59 bp, Homo sapiens
ggtcaggtcatttccttgatttgaagagaccagaatggtatcaggaagagagactgacc

SEQ ID NO: 6849691 - DNA, 67 bp, Homo sapiens
tattggaatagttattagagaagctggtataaagggataccacgtttttctagaatttaacttaata

SEQ ID NO: 6849692 - DNA, 87 bp, Homo sapiens
gctggcagctttgcccagctggccaggtggctttgaggggagcccacctcctgccaagcctctaccctgagccagcagctgctcagc

SEQ ID NO: 6849693 - DNA, 63 bp, Homo sapiens
ccagttaaggaaacagcacgaaggatggagaagaaactgtgtgttttgtttgacttccactgg

SEQ ID NO: 6849694 - DNA, 75 bp, Homo sapiens
gtcatttagaaatgtggcagaatcattgtgtggtaatttgcacataaatggtgccatgttttatttagccatgac

SEQ ID NO: 6849695 - DNA, 85 bp, Homo sapiens
tctcaagctgtgactgcaaagggaagccctttctgttgtctaaaagaaaagaaagtgcttccctttggtgaattacggtttgaga

SEQ ID NO: 6849696 - DNA, 90 bp, Homo sapiens
gacctgctgaagtgtgtatgctttgtttaaagattttcaaataaaaatttgtgtgggtcaaagaaagcatgtctgcaggctgaggcggtc

SEQ ID NO: 6849697 - DNA, 60 bp, Homo sapiens
tgtactcactctctcaaggcctctgaggttattagctcaaaggctcagagcagtagtaca

SEQ ID NO: 6849698 - DNA, 58 bp, Homo sapiens
cagggattttgtgctgtaatgcccatccactgcatgtacaggcagcacccagtccttg

SEQ ID NO: 6849699 - DNA, 56 bp, Homo sapiens
agaaaagaggctgtgatcctttctatagtgatgaggaagagagagtgcctctttct

SEQ ID NO: 6849700 - DNA, 97 bp, Homo sapiens
ccatgtcaccctcatggagctttcgttagccttgtttgggatacaaaggggtaagtgtcccctcattttagagaaagatcaagagccagtgaacagg

SEQ ID NO: 6849701 - DNA, 56 bp, Homo sapiens
gccagcaaggaggggaaaaatgcataactgcactttcttcagaagccttgcgaggc

SEQ ID NO: 6849702 - DNA, 78 bp, Homo sapiens
tggaggcagagctcattgcagcccagagcgcaggaccccagagaagtctgggctttgctacctggcagttctcctcca

SEQ ID NO: 6849703 - DNA, 78 bp, Homo sapiens
gctgaataaatgcttatatatgtgtgtgtgtgtgtgtgtgtgtgtgtgtgtgtgtgtgtgtaaaagcatttatatagc

SEQ ID NO: 6849704 - DNA, 96 bp, Homo sapiens
tggccgggcatggtggctcacgcctgtaatcccagcactttgggaggcttgaggtgggcggatcacaaggtcaggagatcaagaccatcctggcta

SEQ ID NO: 6849705 - DNA, 58 bp, Homo sapiens
gccttcaggaaatcagtccttgaatatgaagcccaagtcaccaactgagttctgaggc

SEQ ID NO: 6849706 - DNA, 107 bp, Homo sapiens
tgatggtgagtcattttcacagaggccattgcaaagtttgcctcctgtagctgattctgcagcacaggagtgctgctattgttgtttcatttggtgtcttatcatca

SEQ ID NO: 6849707 - DNA, 100 bp, Homo sapiens
gttggccaggctggtcttgaactcctgacctcgtgatctgcctgcctcggcctccccaaagtgctaggattacaggcgggagccaccatgcctggccaac

SEQ ID NO: 6849708 - DNA, 90 bp, Homo sapiens
gtactcaggtaattgtaatgcaatgtttgatatgctatataatagtgatatagcactgagtctagctttggatgtgcagaactgagctac

SEQ ID NO: 6849709 - DNA, 57 bp, Homo sapiens
ctgcaaatcaagttcttataatcccattctcctaggggaaactaatttgatttgtag

SEQ ID NO: 6849710 - DNA, 72 bp, Homo sapiens
tctggattcttgctagaactgggctatggaggtccagggagaatgggggccaaagtcgaagtctagtccaga

SEQ ID NO: 6849711 - DNA, 66 bp, Homo sapiens
ctggaagagtgcaggtttgtttcataaacatcgcttatggaaactataaaagcaccttcttcacag

SEQ ID NO: 6849712 - DNA, 65 bp, Homo sapiens
ggagaggaactcccagtgcctgggcatgactgtgtgctaggcattgtactgggtgtttttcatcc

SEQ ID NO: 6849713 - DNA, 96 bp, Homo sapiens
cagtgctcaacactggtcttgacagtttaagcacctaatatttgctaaataaataaccaaaagtagtaaacttgaactgatgagtgttagagcttg

SEQ ID NO: 6849714 - DNA, 57 bp, Homo sapiens
gcagcctcagaggggagatatattcaataggattatttccttgctttgaggaaaggc

SEQ ID NO: 6849715 - DNA, 65 bp, Homo sapiens
ggtggagtgattagaaagtacacttgggtgttgattcaagctacagtcttcagtttagctccacc

SEQ ID NO: 6849716 - DNA, 74 bp, Homo sapiens
agctcccaggaccaaggtgcacagaactctgtctcctagagcacagactgagtcatcttcttaaaccttaggct

SEQ ID NO: 6849717 - DNA, 60 bp, Homo sapiens
tgtctctttgcagcaaggagaaggccagtattaactttcatgaggctgcataaggagacg

SEQ ID NO: 6849718 - DNA, 61 bp, Homo sapiens
gaagagacctttaaagtagctgcagtgtaattgagaagaccgctcagtcacaggtcttttc

SEQ ID NO: 6849719 - DNA, 76 bp, Homo sapiens
gttcatgtcctattttccgcagcaggaagtatgtctgttaacaagattgcatcctgaatgtggcaagtaatcaagc

SEQ ID NO: 6849720 - DNA, 67 bp, Homo sapiens
cctttagctgtgacgtatctctatggaagaatgtggcctttctctaaagatatttatggcaaaacgg

SEQ ID NO: 6849721 - DNA, 57 bp, Homo sapiens
tggtttgtttgttcatgtaaaacgggatttcctgtttatacaaggagaacaatgcta

SEQ ID NO: 6849722 - DNA, 60 bp, Homo sapiens
taggataaccctcactcagaggtggttccctaagacctctattgcttgtaggtcatcctg

SEQ ID NO: 6849723 - DNA, 81 bp, Homo sapiens
tagctgctatttatttttcatctacagatggcttcataaaagccattctccttattctgaaaaaagtccaagtggtagtta

SEQ ID NO: 6849724 - DNA, 64 bp, Homo sapiens
cttcagaagtcacactgttatctgctacttggtgctgtagtaagaaactgaattatttctgagg

SEQ ID NO: 6849725 - DNA, 85 bp, Homo sapiens
ccagaagcagttccacagtactgtagggccctctcaccttaaaagttgtggtgccatagagcttggtagtgtgaactgtctctgg

SEQ ID NO: 6849726 - DNA, 77 bp, Homo sapiens
gcaaccctccctcagttttccagtgtgggctttgctttatgtacagccctcactcaacaattgccaagggattttgc

SEQ ID NO: 6849727 - DNA, 66 bp, Homo sapiens
tattccttttcccaagtctccaatgtgggaagaatataattccgggactactgaggagggggtttg

SEQ ID NO: 6849728 - DNA, 79 bp, Homo sapiens
gaaaatgtgttcactggagaaaagtaatgtataattgcatatatgctatacttccttttttcttcagtgttttgttttc

SEQ ID NO: 6849729 - DNA, 69 bp, Homo sapiens
gccctcagtgaccactgattcagtgccccaccaatactgcacattattttactggtcatctgagtaggc

SEQ ID NO: 6849730 - DNA, 82 bp, Homo sapiens
gtgtcggagttctgtctgggcctattcgggtccgagttcggaatttcggttcaaggcccagttcctcggattgttcctgcgc

SEQ ID NO: 6849731 - DNA, 61 bp, Homo sapiens
gcactatgttaatcactgtagttaagataattcctattataagacatggttgatctagtgt

SEQ ID NO: 6849732 - DNA, 70 bp, Homo sapiens
tccgcaaaggcccaggggctctagggcaagctagaaaacaaccctctgtcttaatcccctgacgcctgga

SEQ ID NO: 6849733 - DNA, 82 bp, Homo sapiens
aaaagggttgtccttagatgtggcctccagggatagttaagctgtaaatggaaggcttcatatgtaaagacattttcctttt

SEQ ID NO: 6849734 - DNA, 66 bp, Homo sapiens
ggcactcttctgtgagaattcaagcaaggaaaacaaatcttttctcagggttgcagaaggcaggct

SEQ ID NO: 6849735 - DNA, 56 bp, Homo sapiens
tgaagctggttgtatgactggaagtttactgcttaggtctgctgtgtctagcctca

SEQ ID NO: 6849736 - DNA, 130 bp, Homo sapiens
tcagaattacccaaagggcttgttaaaacacacattgttaggggtcccactctcagagtttctcatccagcagcttagagataggacccaagaatgtgcatttctaacacattctcggtgatgttaatga

SEQ ID NO: 6849737 - DNA, 77 bp, Homo sapiens
ttgagataatggtagatgtccacgcagttgtaagaaataatacagattctgtgtttcatttacccagtttccctcaa

SEQ ID NO: 6849738 - DNA, 57 bp, Homo sapiens
aggttgttttgcctcattatccaaggaattctgtggacagaggggcagtgacaacct

SEQ ID NO: 6849739 - DNA, 77 bp, Homo sapiens
gaacactcattggacaatttttgtttggtgggcaatggtccagaaaattcagaaattgttttatttaattcatgttc

SEQ ID NO: 6849740 - DNA, 80 bp, Homo sapiens
ggaataaggaaagactggggccccagaagacaaacccagcacccaggcccctgctggcagccccagctttaacttagtcc

SEQ ID NO: 6849741 - DNA, 84 bp, Homo sapiens
gtacccctggttcttgggcctttagacatgactgggacttaccccattagccacccagttctcaggcctaagggcttggactac

SEQ ID NO: 6849742 - DNA, 57 bp, Homo sapiens
aatgctttgccaacagctattgtctttgacaagtgactgtgctggcaacatagcatt

SEQ ID NO: 6849743 - DNA, 58 bp, Homo sapiens
aggagaggcatcaagaaaatcgctaaaggaaatgtgatgagcttgagggctttttcct

SEQ ID NO: 6849744 - DNA, 64 bp, Homo sapiens
ggacagacagcgttgtgtttgcaggattggacacccggttctccctatataaggctggcagtcc

SEQ ID NO: 6849745 - DNA, 61 bp, Homo sapiens
ccatgcaaagaatgtgggcataggtggataacggtgactaaatcccacagaatttgtgtgg

SEQ ID NO: 6849746 - DNA, 72 bp, Homo sapiens
ggtagtagaaagatgactatttatctgtaagtgaagtcacatacatacagaaaatatattttgattcctgcc

SEQ ID NO: 6849747 - DNA, 111 bp, Homo sapiens
cattgaggggaggatgcagagctctatgccatatgattggcatccctgtggcatcatatgcaatcatatggcatacagctcttcaaacctgtatgtgttttcctatcaatg

SEQ ID NO: 6849748 - DNA, 98 bp, Homo sapiens
tgctgtaagaatggcagttccagagtgtcacctggatcacgaaagaagcacttgtgtgttaaggcactgatatctgagagttgttttttattgcagca

SEQ ID NO: 6849749 - DNA, 72 bp, Homo sapiens
ggtaccaagtgcattccaccgtgcaggttgcagtcactagagagtctcctgtccattgtggattgtggcacc

SEQ ID NO: 6849750 - DNA, 62 bp, Homo sapiens
cctgctgtgtcctatccaaccaaagtcatttttcatgactggttgaactcaggacagacagg

SEQ ID NO: 6849751 - DNA, 106 bp, Homo sapiens
cacggtgctgagtgtctctgcgtgctgggctggcgcatccgacacgtgggcgatcatggtggtgcggcagccagcggtggccagggattcacgcagcagcatggtg

SEQ ID NO: 6849752 - DNA, 56 bp, Homo sapiens
tcactctgacttggcctccaacacacttcccctcatgttggaaggagccagagtgg

SEQ ID NO: 6849753 - DNA, 58 bp, Homo sapiens
aggtggggattggctctggtggaaagtaaggtttctaaatcaggtgtattccttatct

SEQ ID NO: 6849754 - DNA, 62 bp, Homo sapiens
gaaatcttccttcagtgaagaagaggtttttatgttatgttcctccttcttcagaaggtttc

SEQ ID NO: 6849755 - DNA, 85 bp, Homo sapiens
gaacacaaggggtcttgagtatttcacactgtaaagcatatgtgtccacatatacatagattttgaaactggactgcttgtgttc

SEQ ID NO: 6849756 - DNA, 74 bp, Homo sapiens
catcctattccttgtacagatcttgcaaggacgctgtgtgaaacagcgttgttgcaactctgaacaagaggatg

SEQ ID NO: 6849757 - DNA, 73 bp, Homo sapiens
ggtggctgaggggcccagaggaacagggatctggctagaaagcacctgttcttaacaagggtccccagcagcc

SEQ ID NO: 6849758 - DNA, 60 bp, Homo sapiens
actctgcgaggccagagagacgtgttgcaatttacaatgtgctttgctcgttcccagagt

SEQ ID NO: 6849759 - DNA, 71 bp, Homo sapiens
gatgttactggaacaccttgctccagaaagcaaagatgctttcaagaataggagaggtgtacctaaatgtt

SEQ ID NO: 6849760 - DNA, 89 bp, Homo sapiens
gtgttctgtgaagcgtctatttctttgaatcttttcgtacagtcaaaatgagaatgtccagaggtgagtcagagcttctcaaaggacat

SEQ ID NO: 6849761 - DNA, 104 bp, Homo sapiens
ttgatcatccaaattgtcaggcaaggactctggtaatttaatcactcttggatgaatgagaatacagaagttatcagcttcttttctggggggtgggaggacag

SEQ ID NO: 6849762 - DNA, 79 bp, Homo sapiens
ttgtttcacgcttttctgtggatggtgagcaaatggctgattctttatggccctcagagccccaggagggtgtggacaa

SEQ ID NO: 6849763 - DNA, 57 bp, Homo sapiens
cctgccttcagccctgaagtctcctgggagcaggaggatcaggttactggggacagg

SEQ ID NO: 6849764 - DNA, 57 bp, Homo sapiens
ctgagagactgtttgtaatatttaggtgttaatcaacaacaaacagtgttctttcag

SEQ ID NO: 6849765 - DNA, 123 bp, Homo sapiens
caggggacagattaggagaatacagacatcattcggagtattgacatgtgaagctaagagtaatggaatcactttcttcatacaattttttgacatatgtacaaagctactataggttccctg

SEQ ID NO: 6849766 - DNA, 60 bp, Homo sapiens
ttgtgcaaggtctggactatagttttttagcatctactgtttatcaggcacttgacataa

SEQ ID NO: 6849767 - DNA, 55 bp, Homo sapiens
tgggaggtaaagaatgagatctcatcatttaacggtgaggtacacatacttctca

SEQ ID NO: 6849768 - DNA, 114 bp, Homo sapiens
gcgtttcaagctggagcaaaggtttcttttcagcattgtggcagagaatggtagattttaacctatttcctcattcttgccgcatatgttcctcctttgtcctgccactcttgc

SEQ ID NO: 6849769 - DNA, 62 bp, Homo sapiens
gcagcatgggggcaattcaggtgagagagaagcgcttttacctcttgcctttccctgcatgt

SEQ ID NO: 6849770 - DNA, 74 bp, Homo sapiens
gcagcaagacttcagggcttggtttaaattgcttttttatatcttagttgtaatcagcctggagtctactttgt

SEQ ID NO: 6849771 - DNA, 66 bp, Homo sapiens
cagtgcctagcatggtataggagcttaataaatacagggtagctcctcagtatataaaggcagatg

SEQ ID NO: 6849772 - DNA, 68 bp, Homo sapiens
gaggcgggcagatcacctgaggccgggagttcgagaccggcctgaccaacatggtgaaaccctgtctc

SEQ ID NO: 6849773 - DNA, 75 bp, Homo sapiens
cctcagtcctgggctcagaaccttgttaaggctctgacagcctgcttagaatcttgactatctgagtccctgggg

SEQ ID NO: 6849774 - DNA, 104 bp, Homo sapiens
ggagcttctctccgaggaggacctgggcctggtgtggcacctgctgtgtgagcggggccatgtccaacggccttcttggggactttgggtcggggagaagttct

SEQ ID NO: 6849775 - DNA, 71 bp, Homo sapiens
tatttatagagtggcatctaagttttagaaagtgacagtattttttaaagtgagatttcatttcttagata

SEQ ID NO: 6849776 - DNA, 57 bp, Homo sapiens
tgcctgtgctgggattgcatgtggctccaggcagacgattggtcttagctgcaggta

SEQ ID NO: 6849777 - DNA, 56 bp, Homo sapiens
ggagctgggggggcgaggctgggtgccgcgggcctgggccttgcttctccggcttc

SEQ ID NO: 6849778 - DNA, 66 bp, Homo sapiens
ggcggaagaatgcagcaggctcccagggcctgtgttcatctctctgggagcgctgtttttcccacc

SEQ ID NO: 6849779 - DNA, 84 bp, Homo sapiens
tttactcgaatgtgttggatattagtggggagcacataatagagatggccgtccagccacgtattatctcactgagagagtaaa

SEQ ID NO: 6849780 - DNA, 81 bp, Homo sapiens
caagtattatggctctatttccttgtctagatactgatataactgtaattgtggatgggttgaaatgtgagccaatgcttg

SEQ ID NO: 6849781 - DNA, 56 bp, Homo sapiens
gggaataggggaaaggaggagttatttacatgtgtagcaccttcaattctattgtc

SEQ ID NO: 6849782 - DNA, 60 bp, Homo sapiens
tcagggaagatgtctcatcttaggcttctttatcatccaagtgcctggcattgttcctga

SEQ ID NO: 6849783 - DNA, 109 bp, Homo sapiens
gaaggtatatggagtaaagtgcatgcaattaaggtttaaattttctgttggtgtcgccaaagattttagaatttgcaattttatagtgtacttttctagtgtgtccttc

SEQ ID NO: 6849784 - DNA, 84 bp, Homo sapiens
ctttgtctttccaggctgcagttttctagtatattaccattgatttatataatcagataaaagcagctccttgggaagatcaag

SEQ ID NO: 6849785 - DNA, 61 bp, Homo sapiens
gtggagtcaggcttgctgagcctggtacacggtgtcagagagctcagagcctgaacttcat

SEQ ID NO: 6849786 - DNA, 78 bp, Homo sapiens
ttctgatccaaatgcttttatggttgttggctccttgaacctgccgttagataataacaagcatataatggattggaa

SEQ ID NO: 6849787 - DNA, 101 bp, Homo sapiens
gtaacctctgtggggtagaaactgtatctgtttgctcacaggtgttattccagaggaaatgcttgggcaagcagaactttgtctaaaataccacagtgtac

SEQ ID NO: 6849788 - DNA, 100 bp, Homo sapiens
ggaaacccacattcatccttctgctgttcagaggacctcacttatacttattctcagagggaggtgagattctggaagtgaagtcatgagcagagttttc

SEQ ID NO: 6849789 - DNA, 79 bp, Homo sapiens
gctgttttcatggcaggagtcagaagctaaaggggaacaacaagggcttctgcaagtttctgcttggcattaggacagt

SEQ ID NO: 6849790 - DNA, 127 bp, Homo sapiens
tcatatgttgatgtcctaaccccaggtaccgcagaatgtgaccttatttggaaatagggttattgaaaatataattaatttcagatgaggtcataatgaggttgggtgggcccctaatctaatatga

SEQ ID NO: 6849791 - DNA, 59 bp, Homo sapiens
ggtacagctgaccccttctcaccatgttgtaaatatttactgagactgggtgcagtact

SEQ ID NO: 6849792 - DNA, 56 bp, Homo sapiens
gctagagagtcatacagtttcagagttgtcgcagttttgatgattgattctctggc

SEQ ID NO: 6849793 - DNA, 55 bp, Homo sapiens
ttgttcgtttcattaccttcatatgtgtgcattgtactggttttgaaatgagcag

SEQ ID NO: 6849794 - DNA, 89 bp, Homo sapiens
aagctcctggagggcaagtcttgcatccactgctttgctggcaacccgactggtaagcttctggaaggcaaggcttgcatccagtgctt

SEQ ID NO: 6849795 - DNA, 58 bp, Homo sapiens
gcggtggcggtggtgcatgtgggcatgagggtggtggtgccgcatgtacacgtcatgc

SEQ ID NO: 6849796 - DNA, 68 bp, Homo sapiens
tgttggaataagtgcttgaaggagtttttctaatgcctcttcctctcttttgtcaactgcatccagca

SEQ ID NO: 6849797 - DNA, 68 bp, Homo sapiens
ggtgacctctgaccctggtggtggccactgctggctctgcccaatgcccacacctgggggaggctgct

SEQ ID NO: 6849798 - DNA, 91 bp, Homo sapiens
gaggttggaatgttttcccttttttacgagaggaaattgagtcacagtaagaataaatgcctctctgggagccaggatgacactcgacctc

SEQ ID NO: 6849799 - DNA, 81 bp, Homo sapiens
ccacgtgaggagcctgtgcctggcactccagacagactgcatacgttaggtgggccacaggcaggcacatcccacacgtgg

SEQ ID NO: 6849800 - DNA, 62 bp, Homo sapiens
cctgagctcccctagtgcttatgggataccgaaaaacctttcagcaaggctggagcttatgg

SEQ ID NO: 6849801 - DNA, 94 bp, Homo sapiens
gggagtgaggactgggaagtgtgggcggcgtcccagtcccatccgtcccatctaggatgggcccgggacggcgctgctctcctgtcctcctctc

SEQ ID NO: 6849802 - DNA, 103 bp, Homo sapiens
gctacacatggtgcctagggaagatgtgggcccactccagagctcaggccacctgcagtgttatttgagatgtgctcccattcttttcttccactatctgtgc

SEQ ID NO: 6849803 - DNA, 71 bp, Homo sapiens
gtggcttttctccagaagaggaagcggaggctgtggtccaagccttctcgctcttcttgagaaactgctgc

SEQ ID NO: 6849804 - DNA, 62 bp, Homo sapiens
ataggaaattacagatcaccaatgcataaggttttatgctaggtgctctgtgatctgcttat

SEQ ID NO: 6849805 - DNA, 97 bp, Homo sapiens
ctgggaagaagacaactctgtcctcagtattgtggagcagatcacatatgtgtgaacactctgtattaactgagaagatatgaggtctttttcgcag

SEQ ID NO: 6849806 - DNA, 57 bp, Homo sapiens
ttctgccttggcagggtggtcctgagagtggtgggtgccaccctgtccggggcggag

SEQ ID NO: 6849807 - DNA, 99 bp, Homo sapiens
tgcctcctcagaatgacctgggccaggcttgggaatgccagcgcttttagcagttgattgatctgcatttggtttggctcaggccaactgagaggggca

SEQ ID NO: 6849808 - DNA, 74 bp, Homo sapiens
gctgtgtattttatgtcccttcaaatgtttacttttgcacaaagatgagtgtttggaggacatggaagactggc

SEQ ID NO: 6849809 - DNA, 109 bp, Homo sapiens
catgtgaaagactctgtacttgggtctgaccttgagcctcaggtgggtctggctcagctgaggatgcctgcctgttggctgaggtgcaaactcagggagcagacacatg

SEQ ID NO: 6849810 - DNA, 81 bp, Homo sapiens
tcccaacagtttagaatgccacatagttcatactcatggaagtagagtactatatttggcattttatattgtcttatggga

SEQ ID NO: 6849811 - DNA, 85 bp, Homo sapiens
caggtgatttgaatgtgcagccaggtttgaggaccactgttctacatgcatctttggccacttgtgctgcatcttgtctactctg

SEQ ID NO: 6849812 - DNA, 92 bp, Homo sapiens
cctgagcaaggagatgggttaggaggatatttgagtatcttgtgaaagtcgatgggattctggattgtctgcttgaatattgaattggcagg

SEQ ID NO: 6849813 - DNA, 80 bp, Homo sapiens
cttgcctggtaccttctctagatctttattctaaacaatcggttagtaatgataaattctgtaggagggtctattccgag

SEQ ID NO: 6849814 - DNA, 62 bp, Homo sapiens
gacgtctctcttcttgtctaaatgaggaattgaacccatggccaggccaagagagtacagtc

SEQ ID NO: 6849815 - DNA, 98 bp, Homo sapiens
tacagaagcttggaagtgccagttagtagacttttccatttagtaaagtgctgaataaataaacttttactacaactggtttctttaaagtgtttgta

SEQ ID NO: 6849816 - DNA, 128 bp, Homo sapiens
cactaatcttcacaatttagaggtacacagagaaactagagtcagaagccaggaactgcctgttggctacagggcagcaatttggttcctggaagtttgttgtttttctcaaaattggaagtacattg

SEQ ID NO: 6849817 - DNA, 78 bp, Homo sapiens
agcacttggccagctggagctcgcagataggccttccctaatacccactttgcctgtccgttttccacctggattgct

SEQ ID NO: 6849818 - DNA, 84 bp, Homo sapiens
tcctgttccagcagcgttccaaggtggcttcgtagatgaagggcatttgagctgtaaggtgggatgtgaaaggtggagctaggg

SEQ ID NO: 6849819 - DNA, 72 bp, Homo sapiens
ggctgattgtcatcatgttttccaaaggtctaagaaactctctttcctttgggggacctgatacttaaagtt

SEQ ID NO: 6849820 - DNA, 62 bp, Homo sapiens
ggacagggctcttggcactccttgcctctcagactccatccaggaagccagagaccactgcc

SEQ ID NO: 6849821 - DNA, 71 bp, Homo sapiens
caatgttgttcaggctttgctctgttgatttctatttattggaaaaacaactagaacctgaagcaatattg

SEQ ID NO: 6849822 - DNA, 90 bp, Homo sapiens
ttaagtcctagttcaaactattgcctgtctcagtggtatgaagtggaaagcgaatctatttcacattagataggtctgtgcttgacttga

SEQ ID NO: 6849823 - DNA, 71 bp, Homo sapiens
gccctcaccactgccctgggggttgccatctggaggagcctggggataagggtaacccagggaggctgggc

SEQ ID NO: 6849824 - DNA, 95 bp, Homo sapiens
caggagtgttggctgggcatagaggcctgtgtgctccagtggtgatatctgtcccacagacaaggcttttgacccacgtggtggccatactcttg

SEQ ID NO: 6849825 - DNA, 123 bp, Homo sapiens
acaggatccttatggtctttattctcttttctgggggctatgattttctacaaattattggggaagattctcactgctcaactttcagaggagctagaatgcccacttactagcatctcctgt

SEQ ID NO: 6849826 - DNA, 86 bp, Homo sapiens
ggtctgagatcttattccaacttcactattgtctagtaatgtcctttgtagcaaaagacagttctgagttgggatagtttcatgcc

SEQ ID NO: 6849827 - DNA, 73 bp, Homo sapiens
ccaggatcatcgtcccttctcttgtcaactggtatcttataagtttgataggatataaagatgaacctcctgg

SEQ ID NO: 6849828 - DNA, 129 bp, Homo sapiens
ctccacccttccctgccccgcgctccacccaatgggaagctgacctgcatggacagcatcaatggtctcccttgccctctggcttctggttgggtttggcaaataacgagcactgcagggcgactggag

SEQ ID NO: 6849829 - DNA, 65 bp, Homo sapiens
atatctctattatctcccccataagacatatttacagccgtattaaaagggagatgaagggatat

SEQ ID NO: 6849830 - DNA, 86 bp, Homo sapiens
ggtggttgtctccgtgagccacagctgctgtcatcgtctgtgcccccaaccgagtgcagggactgtgatctcacagaaaagccact

SEQ ID NO: 6849831 - DNA, 65 bp, Homo sapiens
gttagagggctgccttttgtttaaataagaataaaaataataattggctacctcagcccactgac

SEQ ID NO: 6849832 - DNA, 68 bp, Homo sapiens
tagtggctgccaagagcaatgctgtgaataactgaggtttcactgggccttcttagggcagagtacta

SEQ ID NO: 6849833 - DNA, 63 bp, Homo sapiens
tatttctaaaggaagctatgtctggtataaaaggcaaaagagaaaactggcttcccagagata

SEQ ID NO: 6849834 - DNA, 61 bp, Homo sapiens
gacctacatatagggctttgctgtcaggtatgaacaggcagttctgcctatgtagtgggtc

SEQ ID NO: 6849835 - DNA, 75 bp, Homo sapiens
gcaacttgtactcattcttcaaatgccagtgtctataatgtaatacttcaaagcaatagaaagagtgacgggtgc

SEQ ID NO: 6849836 - DNA, 55 bp, Homo sapiens
tccaggcccgagatgggctggaggtcctcattttgccttcagaaaggggcctggg

SEQ ID NO: 6849837 - DNA, 55 bp, Homo sapiens
cttaacactcctaactacagtctcagaaacccatgagaagtttgggggtgtggag

SEQ ID NO: 6849838 - DNA, 57 bp, Homo sapiens
ctttccccaagcaccacagtgccttgtctattggtcacagggtgatgcttgggagag

SEQ ID NO: 6849839 - DNA, 70 bp, Homo sapiens
ttctctctaccccgctaggattaggattaatcctagaaactaggattaggcctgtgctggcaagagagga

SEQ ID NO: 6849840 - DNA, 88 bp, Homo sapiens
gcattcttccactctgacctgctaagcccctgtccgaatgaaccacccatggagggagaggtgaggccggggccggactgaaggatgc

SEQ ID NO: 6849841 - DNA, 57 bp, Homo sapiens
aagtcggagtggtacagagcgatgcatcctcttacacaattactcactcctggactt

SEQ ID NO: 6849842 - DNA, 60 bp, Homo sapiens
actcaaagttagagcaagagtctgttacaactgtgacagttctgagctataattgctggt

SEQ ID NO: 6849843 - DNA, 64 bp, Homo sapiens
acttccagagatctctcttccctgtgacaggataactggcagtactgaagatgggtctctaagt

SEQ ID NO: 6849844 - DNA, 58 bp, Homo sapiens
gtctgtcatacggcttatgtaaccgtgcctttaggcgattctcatagcctgtgaagat

SEQ ID NO: 6849845 - DNA, 91 bp, Homo sapiens
acagaagcacactctcttcctctcccacgctggcagcggaaagggccgattgaagtgagtggctcagtttctgcccagctgggacttctgt

SEQ ID NO: 6849846 - DNA, 65 bp, Homo sapiens
gtggccacccagagtagcttttccttggcgaatttgccacagagctgaacctgggtcatagtcat

SEQ ID NO: 6849847 - DNA, 75 bp, Homo sapiens
taaatttttactcttagttattttcactacatgggtaaacatgttttcagtgacagctgggaaggtgaaaattta

SEQ ID NO: 6849848 - DNA, 76 bp, Homo sapiens
ggcctaaccaagcaaactttcattgttatgtggtttctaggtctcctacagggcaaaaagtagtgctggttaggcc

SEQ ID NO: 6849849 - DNA, 119 bp, Homo sapiens
tccaagtgatgttaagaggattacagtaatgaggccatgcttggtatgctgtgagctcctaaaagtcttgagtcatataaagacagaggccttataattacatctttatattcactgga

SEQ ID NO: 6849850 - DNA, 59 bp, Homo sapiens
catccaggctggttctctcagttcactcaagcctatgtcatgctgtggccacctggatg

SEQ ID NO: 6849851 - DNA, 76 bp, Homo sapiens
tctgtttccagcatccaatcatctctctctctctgaagtttcccgaaacttaaggagtagtggtgatggcaacaga

SEQ ID NO: 6849852 - DNA, 69 bp, Homo sapiens
tttacgtgaaaggcagtttaaaatgtgctaaagtgtaaaacaaatgcatacagctttctttcacatgag

SEQ ID NO: 6849853 - DNA, 57 bp, Homo sapiens
acagagctaatgttgcataggctcaaaagaaggtaaggcctgagataaaagctttgt

SEQ ID NO: 6849854 - DNA, 58 bp, Homo sapiens
cctgggagggaagtagactaggaaagctgttgaaagggctccttcacttcttaccagg

SEQ ID NO: 6849855 - DNA, 81 bp, Homo sapiens
tggtgcaggaaaaacataatttagcaacagatttaaaaggtagtctggagtgtttctaattactgtttgtttagttcacca

SEQ ID NO: 6849856 - DNA, 64 bp, Homo sapiens
gccctgtggcaccaatacatttttctaaagtgtagagaggtgaatgtggatgccacggtctggt

SEQ ID NO: 6849857 - DNA, 75 bp, Homo sapiens
gcatccatgcatgcagggtgtgtgctctttgtatctggcgtctttgggcaattcatccgcattgtgtgtggttgc

SEQ ID NO: 6849858 - DNA, 86 bp, Homo sapiens
ttgtcccctgccatctggatgccattgatatgtctcagctcagtcatgagcctggtgatatcagtggtttccatgtcaatggatga

SEQ ID NO: 6849859 - DNA, 77 bp, Homo sapiens
actgagatgctggatgaccctgaattagtaacactccatacttcatttgttagtggcattcagtattgatccttagt

SEQ ID NO: 6849860 - DNA, 82 bp, Homo sapiens
cattttgtgtgtatttattttgctgctatgccttgcaactgattttgcttgcagacttagcaaattgaagttatttaaaatg

SEQ ID NO: 6849861 - DNA, 84 bp, Homo sapiens
gctggcggtaagttggagagaatctgaacctgctcctattttcaatagtagacaaatttcttctctcaatattattgctcatgc

SEQ ID NO: 6849862 - DNA, 83 bp, Homo sapiens
ccttattcccaggcctggcatggggactaagggaggaccccattttagctttcccttacagtctgggccagctctgggaaggg

SEQ ID NO: 6849863 - DNA, 86 bp, Homo sapiens
agcctaattgggtttacttgtgccttggcttaaggtctagaatataataaacttaaaggtctgaacacagtgaggttaattatgct

SEQ ID NO: 6849864 - DNA, 85 bp, Homo sapiens
ccagggtctcctgcctgtttgactggtctctgctgtgtgcaaacttccccatcacagcaggtgacccaagcaggctggagcctgg

SEQ ID NO: 6849865 - DNA, 87 bp, Homo sapiens
ggctggaactgttctggtgggtccagaggttatcagcccaggacttgaccctctctggctgagtctgtgacccatgcgtttccagct

SEQ ID NO: 6849866 - DNA, 83 bp, Homo sapiens
gtttgtctctggcacaatggtgtttgcctgactcacactccctttgggagctcctcatgcaaatactgttccagaagatctgc

SEQ ID NO: 6849867 - DNA, 60 bp, Homo sapiens
gtgccaaagaacataaggctgaatttgcaaattttggcagctaacagttctttttggtac

SEQ ID NO: 6849868 - DNA, 61 bp, Homo sapiens
cccccatgactgcttcatcttgcatctgtggtgcctagcatggcagccagtacatggtggg

SEQ ID NO: 6849869 - DNA, 109 bp, Homo sapiens
acagactaagacacatgctgattcctattttttcataagaaacccggaacacggagctattaagggtgtaaatggcagaattaggatttcaagtcatggttgggtctgt

SEQ ID NO: 6849870 - DNA, 78 bp, Homo sapiens
tattcttctatatctattatctctttactgctactacaaagatcttttgatggtggagagacagtgtattggggaatg

SEQ ID NO: 6849871 - DNA, 62 bp, Homo sapiens
cctgcgcttcctggcctctgagcacgccctgctgctgctgttcagcaatgggatggtgcagg

SEQ ID NO: 6849872 - DNA, 62 bp, Homo sapiens
gctttgaagtcatttagcttcatcactggataatttattgatgtggttagatactttgtggc

SEQ ID NO: 6849873 - DNA, 119 bp, Homo sapiens
gtcacctacaagagcttctacaactacggatgccaagactctatctttagagatcaagtttcaattggtctggggatggtgtctttgtatctgtatattttgaaagcttttctggtgat

SEQ ID NO: 6849874 - DNA, 92 bp, Homo sapiens
agccagcaggccaggggagagcaaggtgatttcctggctgggtcacgctgaggaacaatacaggctttattcctcccggccttgtcctggtt

SEQ ID NO: 6849875 - DNA, 55 bp, Homo sapiens
gactatcattaaatattttaatttgctttcgctaggaaatcagttaatgatggtt

SEQ ID NO: 6849876 - DNA, 77 bp, Homo sapiens
ctgctcccacggcacaggatgttgctcccatgtccctgcagggatgtgacaagcagttcttcaatgcctcggtgcag

SEQ ID NO: 6849877 - DNA, 68 bp, Homo sapiens
acatagagatagtgcttttcattctatccattttctcctccaagagagtgagaggacatttttcatgt

SEQ ID NO: 6849878 - DNA, 60 bp, Homo sapiens
tgggggctttatgtaatgcacactccaccatgtcatgtagaaggtgccgactgaacccca

SEQ ID NO: 6849879 - DNA, 76 bp, Homo sapiens
gataagaaaattgccaaaagctaaagggttgtgtgactttgcttgtgtcaatgctttagtttctggtaagaatatc

SEQ ID NO: 6849880 - DNA, 96 bp, Homo sapiens
ggattccacttttctgttgtcaaagagcaatttactttcagagctaccccaagagttaggcctgaagtgtgttctctgataaactctgttgactct

SEQ ID NO: 6849881 - DNA, 74 bp, Homo sapiens
ttctgggaatttctaaggtgaggtagaaaatcttcagcaaggaggaaacctatatagtcttagaagccaatgaa

SEQ ID NO: 6849882 - DNA, 120 bp, Homo sapiens
tgcatagtcagctgtgaaattatttttctttcttgaaatctagcttaggtccacagctatattctgttacctaaattctggctgattaggcaggaaggaaatgatttcattctgaaggca

SEQ ID NO: 6849883 - DNA, 80 bp, Homo sapiens
actgatagctgactccagacatagctctctttaaacataacagccaaagggcatgtttgtttgagccagtctcttcatgt

SEQ ID NO: 6849884 - DNA, 65 bp, Homo sapiens
gttgctatgggaggagatatcacaggggctggctcagctccaggtatctggcttccacatctgac

SEQ ID NO: 6849885 - DNA, 130 bp, Homo sapiens
tgttaaggaaatgtcagcaccctgccattcatggtgactgcctcagtttccctgcagcccaggaagagggtcgcagctaatatagatggaggcaggattcagatggctttctttgctacactctggaaca

SEQ ID NO: 6849886 - DNA, 57 bp, Homo sapiens
tcagaagcatgtggggagcctgttaaaaatacacagattcctagaatcttcttctgg

SEQ ID NO: 6849887 - DNA, 62 bp, Homo sapiens
agaggaagattttattaaccaggtggatgggatgacctgttttggggatggcagtctcctct

SEQ ID NO: 6849888 - DNA, 63 bp, Homo sapiens
ttccttgttatttgaaggattaattagctacaaaatgctacattgatatttcaaatacaggaa

SEQ ID NO: 6849889 - DNA, 78 bp, Homo sapiens
gtttttcatttgtaaaagaacctctttaaagaacagaatggaaacaagcagttcttcaaagggtttcaaatgagaaat

SEQ ID NO: 6849890 - DNA, 84 bp, Homo sapiens
ggctgagtagcccataacaggaacatttactgagtgcaaaggcagctttcaagtaaatcactttttgtccagtggggcccagcc

SEQ ID NO: 6849891 - DNA, 69 bp, Homo sapiens
cctgggtcctggcagcctcctggagctagagaattgctaagctagtcacagtgaggtccccagcctagg

SEQ ID NO: 6849892 - DNA, 87 bp, Homo sapiens
cacacatgaatgcaaaagacacacagtgcttcagttggcatgtctagtaactgatgtaatgtctgtgtgtatgcatgtgcgtgtgtg

SEQ ID NO: 6849893 - DNA, 58 bp, Homo sapiens
atgaacagttgaagctatttcaccctttggtctggtcaaatggtctcaagtgtttcat

SEQ ID NO: 6849894 - DNA, 97 bp, Homo sapiens
tcttgaaagaactgtgacaaagagcatatggttctcaaagccttaactatttactaagctttacagagaaagtttgcctgatctagtattttcgagg

SEQ ID NO: 6849895 - DNA, 67 bp, Homo sapiens
caactttgacccttgttcttaaaatgctttaaccttgaagttgcttgagacttaagaggtcatgttg

SEQ ID NO: 6849896 - DNA, 66 bp, Homo sapiens
acagtaattaaggtctgaaacgcttcccaatcaaagaacaggaagagttcactccgagttaactgt

SEQ ID NO: 6849897 - DNA, 61 bp, Homo sapiens
gttagacttggagcggaaactcaagttgaatgaaaatgccatctccaggctccaggctaac

SEQ ID NO: 6849898 - DNA, 68 bp, Homo sapiens
tgtggaccagagggatgacatttggcaccaagaaagtaacccaggtgtctgtctctttttcagtccca

SEQ ID NO: 6849899 - DNA, 96 bp, Homo sapiens
tgacttgtcaggtattgatcaaagcgcttaagtgaaactattggtaacaataagccggctcatgtaagagcttttgtgtcatcttgaagatagtca

SEQ ID NO: 6849900 - DNA, 60 bp, Homo sapiens
cttgccttccccttgataatgcagtaagggaccccctttttacaacatggggcaggcagg

SEQ ID NO: 6849901 - DNA, 67 bp, Homo sapiens
gccagctttctggaagccccagagtcagatgtactcctgtcctgacttccagccttccagtactggc

SEQ ID NO: 6849902 - DNA, 100 bp, Homo sapiens
tttgattatgcaacattcttggtgaaaagctggttgtcattcagaattgatttctgtatagttttgaatttataaccatgaagaatagcagctgattaaa

SEQ ID NO: 6849903 - DNA, 82 bp, Homo sapiens
cagacaggctccagactgaccctgacctcgcggcggccttctccactgggccggcgcttcccagggcggcttacgccttctg

SEQ ID NO: 6849904 - DNA, 59 bp, Homo sapiens
tgtgtgtcagggctagagctgggaccacaacctgctcccagcgctgagccctgcaggca

SEQ ID NO: 6849905 - DNA, 118 bp, Homo sapiens
cctgatagccacaggttggaggcagccagtgcattgccgtgtctaggtcttcagtgggaagctctgcccttgttctcctaagcctggtaagtctggcttttctaaacaggcagtcagg

SEQ ID NO: 6849906 - DNA, 86 bp, Homo sapiens
tcaaccaaagccctgaatgaagctccactgtactatcaaacaaacaaacaaactatggttacaagtgagatttaggagatggttga

SEQ ID NO: 6849907 - DNA, 61 bp, Homo sapiens
ccatgtcttattaaattgaaccctcacttactggagtgataaaaggtgataagatctatgg

SEQ ID NO: 6849908 - DNA, 61 bp, Homo sapiens
ctctgggaccatggcaagtgcggcaagttcttagagcaacactggctgccatgatccaggg

SEQ ID NO: 6849909 - DNA, 76 bp, Homo sapiens
gaggccccaggtcggggtggggacaggcagagcccactgctcccaccacctctgtctcttcccactcagacccctc

SEQ ID NO: 6849910 - DNA, 84 bp, Homo sapiens
taaacagtggttaatatgctgcttcttgaaaagacatattacaacttacagtctttcttcataagtgtatgttgttactgttta

SEQ ID NO: 6849911 - DNA, 74 bp, Homo sapiens
cccttgggctgcggtttaagacaggcttcacagtatttactgtttatagttttgagctgacagctatttaaggg

SEQ ID NO: 6849912 - DNA, 69 bp, Homo sapiens
tatatgagatgcctcagcgatggcaggattccatgggaggaaacttatcagactgatgtatggtgtata

SEQ ID NO: 6849913 - DNA, 91 bp, Homo sapiens
taaagaatgaagtaattcctcctggtactggctgattgtttacggtttgcctgatcttcaaggaaaaaatacagttactttatgatctttg

SEQ ID NO: 6849914 - DNA, 65 bp, Homo sapiens
gatcctagagttctagtgacaacgggagggaaaaattgtagtagtcccactggaagattagggtc

SEQ ID NO: 6849915 - DNA, 58 bp, Homo sapiens
tccttaagacacaaagcttcccttttcgcttcctggagtgtggacgtgtgctggagga

SEQ ID NO: 6849916 - DNA, 78 bp, Homo sapiens
gataaataatgggatgagtgataggaaggaaaatgatttttgttctttttctctttttgcatctcaacctctttaatc

SEQ ID NO: 6849917 - DNA, 85 bp, Homo sapiens
aagatagaaaacaagaggattaggctgagagtgggagattaaataattcatttgactgcaccactcagccctccaaattctactt

SEQ ID NO: 6849918 - DNA, 79 bp, Homo sapiens
tcattattgtattctgttacagcaacataaagacaatgctctatgtttctgagattaatagagatagcagttagaatga

SEQ ID NO: 6849919 - DNA, 57 bp, Homo sapiens
actgtgtctatctaggctgtaagtccccagggctcagcacagggctggcatcccagt

SEQ ID NO: 6849920 - DNA, 61 bp, Homo sapiens
gtggatgttgtgtctactcatgagccaattgtggagctatgagaacaagaacaatctccat

SEQ ID NO: 6849921 - DNA, 65 bp, Homo sapiens
gtggctggaggaaggaactgaggaggaccttcagggctttctgagtctatattcccactagccac

SEQ ID NO: 6849922 - DNA, 76 bp, Homo sapiens
cagcttaattaacactgcagcccagttactgtttagttcattgcatagtacagtactgggctctagttctgggttg

SEQ ID NO: 6849923 - DNA, 70 bp, Homo sapiens
gtcttatccttcaggaaaccatcctcagtaattcacgttggtgagcggggctcctggtaggagtacagat

SEQ ID NO: 6849924 - DNA, 65 bp, Homo sapiens
acaatgaacacacaaggaattctcgtccagacaaagatgaatggattcatctgtttgttcgctgt

SEQ ID NO: 6849925 - DNA, 88 bp, Homo sapiens
gatctaggaagtacctgtctcatttgccatttttataccaaacagggctgagactagagtgaggcatgtaaggtgctcatcttgggtt

SEQ ID NO: 6849926 - DNA, 75 bp, Homo sapiens
cggctgcgagaacctggcgccgcactcggtgcagccgtagggccggtctcccgtgtgtgtgcgctcgtgcagccg

SEQ ID NO: 6849927 - DNA, 67 bp, Homo sapiens
gttttactcaatgtatttccagctcctggccagtacctggcacagagcttgtttacatttgtaaagc

SEQ ID NO: 6849928 - DNA, 64 bp, Homo sapiens
ctcagagggttgaaggtgctctggaagcaatctggaacaactctgtgcacctaaattttctgag

SEQ ID NO: 6849929 - DNA, 82 bp, Homo sapiens
tcacacccgtttccagcaacgagaagcacaaaataaattcactaagaaatttagctgtgtttcttgttgtttttgtatgtgg

SEQ ID NO: 6849930 - DNA, 71 bp, Homo sapiens
gcccagcaagaagtggagcaggagcttcagccaaatggaatgaggcaggatgcttgcacaggtcttgaggc

SEQ ID NO: 6849931 - DNA, 55 bp, Homo sapiens
ctctggctgcctctcaggcctgctgtagctggtgtgcctgcagagaaggtcagag

SEQ ID NO: 6849932 - DNA, 62 bp, Homo sapiens
cttggagcctggctatggcctcccccatgctatgcggggagggaggctgccaggaggacaag

SEQ ID NO: 6849933 - DNA, 62 bp, Homo sapiens
cagtgtgcaggtctcccctgctggggcctagacagcagccaggaggtgacagcctgcatctg

SEQ ID NO: 6849934 - DNA, 62 bp, Homo sapiens
ctcatccctgtggtgaagtctttggtggcccagagattcctgaaactgccattgggcatgag

SEQ ID NO: 6849935 - DNA, 110 bp, Homo sapiens
ttccacttttgttttgctaaattcggtatatgtctccaggataaaataatgtctgtattcaacaaatatctggaaataaatacgagttctagaataagggaaagaaggaa

SEQ ID NO: 6849936 - DNA, 58 bp, Homo sapiens
acctggttcctcctcactgctgtgtccccagctttttgcacagtgcatgggacctggt

SEQ ID NO: 6849937 - DNA, 59 bp, Homo sapiens
gacaggtaccggtcagattacggtggcacaggcggcgtggggttagacaggtaccggtc

SEQ ID NO: 6849938 - DNA, 56 bp, Homo sapiens
tgtgtacagcatggtccagcaggttcgcaggtgaaggctgggctttgactgacaca

SEQ ID NO: 6849939 - DNA, 67 bp, Homo sapiens
gaggcaactgcttttcctcctttgggcctctcagttttccatctagtaagtgaggaagttgaacctt

SEQ ID NO: 6849940 - DNA, 71 bp, Homo sapiens
ggtgggaactgtgtcagcaccggggtagacagaagtcaaggaacttctgtggggagctgatcagatcagcc

SEQ ID NO: 6849941 - DNA, 59 bp, Homo sapiens
gttatctcaggaagcacaggccctacaagttggaatgtaggccaatgctttctgaaagc

SEQ ID NO: 6849942 - DNA, 56 bp, Homo sapiens
agtacagtagatgtaggaatagattcttcctctcagtttcatccttctactgtgct

SEQ ID NO: 6849943 - DNA, 95 bp, Homo sapiens
aagttctcccacttgcaatatataatgaggagacatatttttgaagcaattaactgttccttcaaaattgttctttattgttggtgtaaggactt

SEQ ID NO: 6849944 - DNA, 104 bp, Homo sapiens
cagtttgttcttgtttctctaatgccttgaggtgtgacattaggttgtcaatctgtgcgtgatctttcagactttctgatgtaaacatttagtggtataaactg

SEQ ID NO: 6849945 - DNA, 55 bp, Homo sapiens
gatggagataggctcctgggtattttgaataacaatacaaagagcccctctcttc

SEQ ID NO: 6849946 - DNA, 65 bp, Homo sapiens
gtagaggctcttgcccttcccacacatgcagctggattgcctgtgggagcagcagagagctctgc

SEQ ID NO: 6849947 - DNA, 63 bp, Homo sapiens
ttcttacttgggaaaggaagaattgcaagcaaatgtaatttattgcttaaccaagaacgagaa

SEQ ID NO: 6849948 - DNA, 118 bp, Homo sapiens
ccaccttttaatctgcttattataatgtatttcataactttctatgctgtggtattgatcattcattcatcagttacacaattattgcatggaaggatacaaagagaaaaagatatgg

SEQ ID NO: 6849949 - DNA, 87 bp, Homo sapiens
tcatttaattttcacgacaatcctacaaagcagggctatggctgtggcatccatagcctaaatgtgaggaactgaggatttgaatga

SEQ ID NO: 6849950 - DNA, 58 bp, Homo sapiens
atccttggtaagagagttggatttgagtgacatctggaggctttctatacctagagat

SEQ ID NO: 6849951 - DNA, 67 bp, Homo sapiens
tcatcatccacttgttaattacagtgtgaaatatctcaatcactttgtttttagaggtggcatgaga

SEQ ID NO: 6849952 - DNA, 64 bp, Homo sapiens
ggtgtattagggactgggaacttggtttcactagcataagccagcagtccagtccttagtgacc

SEQ ID NO: 6849953 - DNA, 84 bp, Homo sapiens
cttaaggaggcaaaaaatgtccttccattttgatctgtaaagaacccttagccaagcttggaaggatcatggtgctttctggag

SEQ ID NO: 6849954 - DNA, 57 bp, Homo sapiens
ttggtccaggatggcgtgggtgtcaaggatgacttccaggcatgagctctggatgga

SEQ ID NO: 6849955 - DNA, 72 bp, Homo sapiens
tagccacacaggcgatgatatctgataacagtagagtgttatagtgtctatttgaattatcctaatgggcta

SEQ ID NO: 6849956 - DNA, 112 bp, Homo sapiens
ggtatcagctaagcataaaggtagacgcaactataacacttcaaaactgtgatgttaatgaagatgtaccctggttgccagctattatttgctttaaatgcaatttgatatt

SEQ ID NO: 6849957 - DNA, 107 bp, Homo sapiens
gctccagggtgtccctgttccccacagcattcagactgactcaggctcagtatggaaatgcttcatgcttgcccatgtttctgaagtaatagtacttccacttgagc

SEQ ID NO: 6849958 - DNA, 55 bp, Homo sapiens
aaagcttctaggcctattgcttgtcacccattatggcactggcctggactgtttt

SEQ ID NO: 6849959 - DNA, 62 bp, Homo sapiens
ggaaacagggagcctccaaagctttcagatgttttcccaactagcaggaggcccctgcttgc

SEQ ID NO: 6849960 - DNA, 122 bp, Homo sapiens
gtgtcccccatcgatggggctggtcactcagtttttggcctctgctgcatccctaacactatatcaagtgtggcggggaaattgagaggcccctcctcaagccctggtcatgatggaggtac

SEQ ID NO: 6849961 - DNA, 64 bp, Homo sapiens
gccattcttaacagtcatcactttcaaatgcattcaaaatgtgatagtcaatgttgagactggt

SEQ ID NO: 6849962 - DNA, 64 bp, Homo sapiens
gagctccatcatgtgtgagctatgatttacttgccttctcatgtctggcacataagaggagctc

SEQ ID NO: 6849963 - DNA, 123 bp, Homo sapiens
gtgttccctttgttcagatgagtggtctttatttgagattgtcatttaatatgctgtcatggaagaaatgactaaatctgaagatagggccaaatccaattgtattagatgaagaggctgcac

SEQ ID NO: 6849964 - DNA, 72 bp, Homo sapiens
ccttccaggccgggcaggaaacaccataaagccaccatgcttccttggggtgttgtcgctgggttttgaggg

SEQ ID NO: 6849965 - DNA, 125 bp, Homo sapiens
cctgggattctgggctcactgagttcacctgcgagtcagccctacctgcactgctctggtctagtacaaacaggctgctggcattgaggtaggtggcagagagagtaatggtcccatggcccagg

SEQ ID NO: 6849966 - DNA, 89 bp, Homo sapiens
ttagttaattacatatgggtccagtttcatctgaggttctagagatcgtgaatcagataattgggctggagttataatggttgaattaa

SEQ ID NO: 6849967 - DNA, 60 bp, Homo sapiens
tggtggcagagcaagagctggagtgatatcacctgtctccagcttttgacaaaaccacta

SEQ ID NO: 6849968 - DNA, 121 bp, Homo sapiens
tagaactgaagtgttttgagatgtaagcttctagataaggcagtgagacctgtgatgggtgtcaagaaaacccttgcctccactgttttaggtgattgcacttagtcacttacacgttctg

SEQ ID NO: 6849969 - DNA, 72 bp, Homo sapiens
gtccaaggtttatggagcaccacatctactgatgtacaaattggagcaatgttggcctatatacctctggat

SEQ ID NO: 6849970 - DNA, 55 bp, Homo sapiens
accctcagctggagattgaattaatattataataacatcgttctccaactggggt

SEQ ID NO: 6849971 - DNA, 59 bp, Homo sapiens
ggagacctgtctcttatgcaaatcccaggccactacctgggggtgtgccagggacctcc

SEQ ID NO: 6849972 - DNA, 79 bp, Homo sapiens
atagtaggtcattagtagtagcagtgtgtgtatttatggcccttcattactatatgtctgctactgtataaatctttgt

SEQ ID NO: 6849973 - DNA, 61 bp, Homo sapiens
ctctgtgctgaaagattaaaatgacttccatcatacaggtgttacttgtctcagcatggag

SEQ ID NO: 6849974 - DNA, 75 bp, Homo sapiens
gacaggcttattttaggtctctctttaccccaccagcccaacctggcattttggaaggagggcaagtagcctgtt

SEQ ID NO: 6849975 - DNA, 68 bp, Homo sapiens
gctccttaacagcaagatctgtgtcagcccttctttgtggctcccacagtgccttgttcttattaagt

SEQ ID NO: 6849976 - DNA, 98 bp, Homo sapiens
ccagcctcactcccgcagccactgctgcccatctggccacacacaggatgcccctggtagtgtctgctctggtgccagggctgttgggggcaggctgg

SEQ ID NO: 6849977 - DNA, 55 bp, Homo sapiens
actgtctgagtcaggagtcacataaaatctttcctggaactctgatttagacagt

SEQ ID NO: 6849978 - DNA, 77 bp, Homo sapiens
gcctcccatggtgcctgaatcccctctgaggctgcacctcgctgaaggagtctctaggatcagacacccaggcaggc

SEQ ID NO: 6849979 - DNA, 130 bp, Homo sapiens
gcatttcttaatgaagtcctgcatgaagctgctgcatttcaaggaccaccctgggaacaggaaggcactatgccagccatcctcagtgtggtccctggatcagcagcatctgcatcacctgggaacttgc

SEQ ID NO: 6849980 - DNA, 67 bp, Homo sapiens
gtaggcttggtttatagaagtaatcactaaaagcaattgtgataatctgacaaagacttaagcttac

SEQ ID NO: 6849981 - DNA, 64 bp, Homo sapiens
tgatagtcttcatctctgccttggccacattttggcccagatgaggcagcgtgagggccactca

SEQ ID NO: 6849982 - DNA, 80 bp, Homo sapiens
tctggggatttcacctcagtctttttatatggcttctgtaccatgctgtacaaatacattctgaaggtagggtctccaga

SEQ ID NO: 6849983 - DNA, 61 bp, Homo sapiens
tcttatgataatatcactaccagtttccctatgtgtactgttgtggtgagaaaatataaga

SEQ ID NO: 6849984 - DNA, 62 bp, Homo sapiens
ctgtggcagaggtgacacctcttggttctggatttggctggtgggtgtgcttctagtgacag

SEQ ID NO: 6849985 - DNA, 71 bp, Homo sapiens
ccctaacttccttgtactgactccattaaggcaactcaacagtatagtctgagtacatagtcaagctgggg

SEQ ID NO: 6849986 - DNA, 123 bp, Homo sapiens
cctgtgattcttggcatgctgctcaccactgtctgaccctggcccattgctgtgcctctgagccaggcggcgcctgcccatgggctagagagagcagagtggaggggcatgaccctgcacagg

SEQ ID NO: 6849987 - DNA, 56 bp, Homo sapiens
tggggggatacttgctactggcattcaatgggcaggtggcagagttgtcccaccca

SEQ ID NO: 6849988 - DNA, 64 bp, Homo sapiens
gtctgcttttgttttactggtactaggtcgggaaagaaatgctcagtgaaacagaagtccaggc

SEQ ID NO: 6849989 - DNA, 81 bp, Homo sapiens
cctcttgtttctacatttgtaaccagattcaagtctcaccaggccccagagtgtgagttacaaagtgtgaaccatgagagg

SEQ ID NO: 6849990 - DNA, 63 bp, Homo sapiens
ttttgaggtttgtgaagtttaaaattgctgtgtctcagcatcgggggagcacaagcgttaaga

SEQ ID NO: 6849991 - DNA, 83 bp, Homo sapiens
agaacaagctgctgctgaacgagctggccaagttccgctcggagcacgagctggacgtggcgctgtcggaggacagttgttct

SEQ ID NO: 6849992 - DNA, 62 bp, Homo sapiens
gtagggggtggaatctttagatggctccaagttcctggccctctgatgttcacaccctgtat

SEQ ID NO: 6849993 - DNA, 56 bp, Homo sapiens
gagacagggctgctgagagacagagagacctctgatcccattggcagtccagtctc

SEQ ID NO: 6849994 - DNA, 57 bp, Homo sapiens
ggccctgagccctggctcatcagcccctttctggggcaggtggctcagggcccagcc

SEQ ID NO: 6849995 - DNA, 68 bp, Homo sapiens
gtgagaggatgtcttaagcccagaagttcaagaacagcctggacaatgaagtgagaccccatctctac

SEQ ID NO: 6849996 - DNA, 115 bp, Homo sapiens
gttatttgcatatatgttacaggcattatgaacaatttctaggaatgacttatgaacattatacatattgtctaggaattgtttaaaattcctgatttaacattctgcctataac

SEQ ID NO: 6849997 - DNA, 56 bp, Homo sapiens
tgggagatggggcaggcaggaatttccggaccagttctgcctgctcctggcttcca

SEQ ID NO: 6849998 - DNA, 62 bp, Homo sapiens
gggaaagtgccggcctgctacagagaaaaaggcaacatctgtaacaattcccagcctttgcc

SEQ ID NO: 6849999 - DNA, 62 bp, Homo sapiens
ggcgctcagagtcatgaggcaacaccaagacatacagtcctgtctgccttatgaccttcgcc

SEQ ID NO: 6850000 - DNA, 70 bp, Homo sapiens
atttacatttatttgagaaggttttgattgccaaaataaagaaaaggaaaaactctcagaaaatgtgaat

SEQ ID NO: 6850001 - DNA, 128 bp, Homo sapiens
gtattttctgtagctttgttgggataaagggtcttaacctgcctaagaagattgcatgcttctggaaggcagggctcatttcttaggctcctttattgcctccacagaggttaacacagagatgatac

SEQ ID NO: 6850002 - DNA, 96 bp, Homo sapiens
ttcatttccaaatgttgccattcattattctctttaatgttctggaagacgcatactttaggactaatttcaggggatatatgaggtcagaatgaa

SEQ ID NO: 6850003 - DNA, 83 bp, Homo sapiens
ggggcaaatggatgtggggatgactgtcaatcaggcaatggagcagatgtctgaggaagtcagccctttatttatcttctccc

SEQ ID NO: 6850004 - DNA, 92 bp, Homo sapiens
ggggtctttgtgaggaggtgtagagtagccttgggaaggagacttgaggcaaactgggccctgcgtctccagggctgctggcgcctggccct

SEQ ID NO: 6850005 - DNA, 80 bp, Homo sapiens
cgtcagtcagcagctgtttacggaacaccagctgcaggccaggcaccgtgctgcaaggcgtagatatgttgctgaacacg

SEQ ID NO: 6850006 - DNA, 73 bp, Homo sapiens
ttagatagtgcaggtgtagataatttgatctgtttcggaaggcaaaagagatcactacatttgtaaaatttaa

SEQ ID NO: 6850007 - DNA, 101 bp, Homo sapiens
tgaggcagcaggattgcttgagccaggaaggttgaaactgaagtgagccatgatcgtgccactgcactccagccttggcaatggagcaagaccctgtctca

SEQ ID NO: 6850008 - DNA, 72 bp, Homo sapiens
cagaccctcatgtataggtccatagtgaatgttatctaacatgattttggtttattacatccatgggtgctg

SEQ ID NO: 6850009 - DNA, 79 bp, Homo sapiens
gcccagcgctcagtttctccaaacgcaggctgaggctcgaccagcccagacctgaggagcactgagccagtccctgggt

SEQ ID NO: 6850010 - DNA, 75 bp, Homo sapiens
agtcttcggagcagccaaactcggcgttcacaacatagatgtgtttgactcttgcccagtttggccatggagact

SEQ ID NO: 6850011 - DNA, 66 bp, Homo sapiens
gttaatattgagcacaaacgttactagagagtgactatctctctcagtgtggtgcttaggataaac

SEQ ID NO: 6850012 - DNA, 80 bp, Homo sapiens
acatagtacctagcttctggataattgtgtgattacatgagataatacgtatgaagcactttacccagagcctgggatgt

SEQ ID NO: 6850013 - DNA, 67 bp, Homo sapiens
tttgtttgttttctaagtttgtaggtttgcttcagtagattgacaaaacagaagatttaaaaataaa

SEQ ID NO: 6850014 - DNA, 58 bp, Homo sapiens
ttttcacccactttcatgagtttcatcaaatactgagcctactcaagggtggagagaa

SEQ ID NO: 6850015 - DNA, 78 bp, Homo sapiens
gcttgtcttttgcttttcatccaagatctccaatcataaccagactgctgagacagtggataggggctggagagaagt

SEQ ID NO: 6850016 - DNA, 70 bp, Homo sapiens
gggtgagtggtcaaagcatcagagacctcacctgggtctgggtctccatgtagccttgaccctttcacct

SEQ ID NO: 6850017 - DNA, 79 bp, Homo sapiens
ggagataggtctctcttcttgatgggaagaatgttaaagaatttacagacttgctttgaaacagagacttaatttctcc

SEQ ID NO: 6850018 - DNA, 130 bp, Homo sapiens
ttgtttatggggatattttgcccattcctgattggagaaatggggctttaggaagttatttaactgatctctgccctagtttcttcatgtgttaaatatggatagtaatagtatctaccttatgaagtga

SEQ ID NO: 6850019 - DNA, 67 bp, Homo sapiens
ccatatgcgtgtgagtatttttaggtaagtaaattgccttccaaaggagccacatctgcagctttgg

SEQ ID NO: 6850020 - DNA, 93 bp, Homo sapiens
tataagttaataaattcatgtatgtaaatttcagtccttcatctacccagaatctattttgttgaagaggaatgagatatacacatgcttgta

SEQ ID NO: 6850021 - DNA, 55 bp, Homo sapiens
gcactctgggctcttgtttcagaattctcaaggatgtttgggaagcccagagtgt

SEQ ID NO: 6850022 - DNA, 108 bp, Homo sapiens
tcttcagcatttttacttttctaacgaagacatcatggagaggataaatagattggcaagccttttctatgtcttttccaatgctgtctggaatcaatttgttgacga

SEQ ID NO: 6850023 - DNA, 62 bp, Homo sapiens
ctgccttctcatacaggatctcttattattgtcataatagtcttgtgagtgaggaagggcag

SEQ ID NO: 6850024 - DNA, 73 bp, Homo sapiens
gaaggtgtaaagggtatggcctctggggtccttgctagactggcaggtccatcgccctttactcagtgccttt

SEQ ID NO: 6850025 - DNA, 82 bp, Homo sapiens
ggcctcactggactctattgccaagatcccttgcactttggtttgcagttggatttggctagtggaggaaggtcacatggcc

SEQ ID NO: 6850026 - DNA, 70 bp, Homo sapiens
atttttaatattcctgtcaagatcttacaagaagaaattactttgtgaggtatgtagggatgctaacagt

SEQ ID NO: 6850027 - DNA, 84 bp, Homo sapiens
ggccagtgtgtaaattgtcttggcattcaaattaggctccttaagataggacctagaatgaaagttaaggctttatcgttggtc

SEQ ID NO: 6850028 - DNA, 65 bp, Homo sapiens
ggcaaggctgcttggttttctcatgggtatttcacttagtctatgtaaacttcagagtcattgcc

SEQ ID NO: 6850029 - DNA, 66 bp, Homo sapiens
cccggggcgtgggtggcggcctggttctgagtcgctgcgcggggcttcagccgcccagtccctggg

SEQ ID NO: 6850030 - DNA, 58 bp, Homo sapiens
ggttttaactacagaattgcaagtccacaaaacctggagttgcagcaaagttaggacc

SEQ ID NO: 6850031 - DNA, 61 bp, Homo sapiens
tcaacatgaaggtgggttgcatgttagccacaggcctggcacaactccacctcagcgttgg

SEQ ID NO: 6850032 - DNA, 126 bp, Homo sapiens
ggccaaccccaacatttacttcttcgtgggctcctttaggcagtgtcaaaataggcagaacctgaagctggttctccagagggctctgcaggacacgactgaggtgaatgaaggtggacgatggct

SEQ ID NO: 6850033 - DNA, 130 bp, Homo sapiens
actttccttctacttagatttttaaataatcaattcagggaaatagcagggctgaaatttcagcagatggttcagctctaaaatttcatttgagtctcagatttttagattccttggcagaataaaaagt

SEQ ID NO: 6850034 - DNA, 61 bp, Homo sapiens
caggcgggcaggtgcggcccctccccgccgccgcagagggccgggtcccactgcccgtctg

SEQ ID NO: 6850035 - DNA, 67 bp, Homo sapiens
cacttgaactgtttgaatgagaaaggtgttcattaaaagacattgtttattcaaatactttgggatg

SEQ ID NO: 6850036 - DNA, 72 bp, Homo sapiens
ctgaaaccaaacatctttctattgcaagttaacagcacctgagcttggcatctaaggtagtttggacactag

SEQ ID NO: 6850037 - DNA, 60 bp, Homo sapiens
gtatttactgttttatattgtccaggtaagaaacctggagcttattgggagcagaattac

SEQ ID NO: 6850038 - DNA, 97 bp, Homo sapiens
gaggcaggagaatcgcctgaattcaggatgcagaggttgtagtgagccaagattatgccactgcactccagcctggacgacagagcgagactgtctc

SEQ ID NO: 6850039 - DNA, 68 bp, Homo sapiens
gaaagccacactggaggctatgtgctaagccaagttctcatactcggccaggacctcccagagctttc

SEQ ID NO: 6850040 - DNA, 67 bp, Homo sapiens
tcataatgattccttttaatttaagctaaaactatagtagttttgtaaaaggaggaagcatggatga

SEQ ID NO: 6850041 - DNA, 67 bp, Homo sapiens
ttgttcatagctatcattgtgtcagcaaaatctctcaccatgaatgacaccaagcagttatgaacaa

SEQ ID NO: 6850042 - DNA, 130 bp, Homo sapiens
atttgtattgttatggaaatgaataatatgattctgggaccaatagtctttcaacaatgtgacacaatgtactggcacattcctcacatttggagaaagcctgcctgggacagaatctgacagggcagat

SEQ ID NO: 6850043 - DNA, 85 bp, Homo sapiens
ggatggagggaggctggaggtggcacaagggaggtctgacttaacagtgagcccttgtttatgtcatttcccttgcctgatgtct

SEQ ID NO: 6850044 - DNA, 67 bp, Homo sapiens
ttcttagaagaacatcagaaattggatttaggggccactgtaaatgcagaatgatttcatctaggga

SEQ ID NO: 6850045 - DNA, 81 bp, Homo sapiens
gaagtatcagcagtaggatgtttggtgcagggaagatgtgagcacctgcatatcttccctgcaccaaacatctgatacttt

SEQ ID NO: 6850046 - DNA, 60 bp, Homo sapiens
ggaggccaattttctaactgcattccatttcaaaggatgtaagaaaaatcatttgcctcc

SEQ ID NO: 6850047 - DNA, 58 bp, Homo sapiens
gcggcagcctctgatgatggccgtaggtatctcctactccattctggaggctccctgc

SEQ ID NO: 6850048 - DNA, 76 bp, Homo sapiens
tcttcttaagtgactttctgaaggtctcgcagtgtcagatctgaggcattgtgctgcctcatggaagcagagaagg

SEQ ID NO: 6850049 - DNA, 99 bp, Homo sapiens
gtgtgcatgtgtgtttgtctaaatgtagcttgaagtgtagatgtttccccaagtggctagacactacaatctcagaactataagaacacagatttatac

SEQ ID NO: 6850050 - DNA, 57 bp, Homo sapiens
ggggcagcatgcaggaaccacatggcaaggattgccatgttgtgctgctgtggctct

SEQ ID NO: 6850051 - DNA, 83 bp, Homo sapiens
gctcagtaatccagcagaacagttaaagaaaccgtgagcactttcttgaggttcttggtgtgttttgatttgggttattttgc

SEQ ID NO: 6850052 - DNA, 59 bp, Homo sapiens
aggaggaaggtagcagacgtggtaaagtgtttgttccacatggaagctgctcttctcct

SEQ ID NO: 6850053 - DNA, 70 bp, Homo sapiens
gacgaggttcaggcacttgcccaacatcaccaagcaagtcagtgatgaagctaggatttgagcctcagtc

SEQ ID NO: 6850054 - DNA, 60 bp, Homo sapiens
ctggctggtcatcagcagtacgtggagagctctgaaaaactgcagatgcccaggacccag

SEQ ID NO: 6850055 - DNA, 80 bp, Homo sapiens
aagtatccttatagcaatgctccatttcttggcaccaattttctgtgttagtctctttgcattgccataaaggaatactt

SEQ ID NO: 6850056 - DNA, 78 bp, Homo sapiens
tctgacagcagccccaccttgagagcagaaacagaagagttctgttctgtgtgctgggagggagtcacactgtgcaga

SEQ ID NO: 6850057 - DNA, 71 bp, Homo sapiens
ggctgaattctcatctcctgacactatgtatttcaattacaaaagtgtgtgtgggagctgtggatttggct

SEQ ID NO: 6850058 - DNA, 91 bp, Homo sapiens
atttacttagattgttgcatatctggttgatttaaataaacatggtctttcttcatttaaatgaacgagatatgcaacaatctaagtaaat

SEQ ID NO: 6850059 - DNA, 85 bp, Homo sapiens
ggtcctaacacactgtggctcattcttggtggcatagcaacctaggtcttgggtgagactgcccaccaggcagtggccagggact

SEQ ID NO: 6850060 - DNA, 122 bp, Homo sapiens
tttcagtgagccaacgtcaaatatcaggggattttacacataaatgtgtagacacaatctggattttgtgtctacgtgtttatgtgtaaaatcccttgatatttggtgttcgctcattgaaa

SEQ ID NO: 6850061 - DNA, 55 bp, Homo sapiens
gctattgtacatttcttgtttgccctgagacgcaaacaagagcaaatgacatggc

SEQ ID NO: 6850062 - DNA, 77 bp, Homo sapiens
ggctggggcatctccagagctttttccttgacttgggtccaagaccagctcccagaaaggctctgggacccccaact

SEQ ID NO: 6850063 - DNA, 130 bp, Homo sapiens
gatttgacttatagagatccatgaactctgcttgacaacttttatttgctttgtcatgaacaggaatcatttcctggctacaggtaaaattatcagaaacagaggctctgtggtctcttgatggaaattc

SEQ ID NO: 6850064 - DNA, 90 bp, Homo sapiens
ctgccccagtggcagattttccagttggcagtgccccttgaccagtgctggagcgtcagtggggccactccagtctgtgcctggtggtgg

SEQ ID NO: 6850065 - DNA, 61 bp, Homo sapiens
ctcagcctggaggccaggagacagtttggaagctgttataatattctgtttgtagggtgag

SEQ ID NO: 6850066 - DNA, 67 bp, Homo sapiens
tggtctttcatggatattcagtttaatcaacttattaaagaaagcagagacactacatgaaagacca

SEQ ID NO: 6850067 - DNA, 59 bp, Homo sapiens
gctgagggagaattgcagccagcgttctgttaatacaatggtggtgttctatcctgagc

SEQ ID NO: 6850068 - DNA, 89 bp, Homo sapiens
gctgacatctctccctgaaaggtttccagtgatattgtggcacaatttgttggccagaatcctagagacccagggatggagatgccagt

SEQ ID NO: 6850069 - DNA, 84 bp, Homo sapiens
ttcctgtccccgctcccttctctgtcactcactctttcatcataggaagcacagatgcaagggggacctgactgggcacaggaa

SEQ ID NO: 6850070 - DNA, 77 bp, Homo sapiens
ggaaggacctgtccgtggtgctgcttgtgagtcccagctctgaacaaattatccagcttcagggacagcttcttttc

SEQ ID NO: 6850071 - DNA, 77 bp, Homo sapiens
gattactctacccaggctggagtgcagtagtgtgatcccggctcactgcagcctccgacttctgggttcaagtgatt

SEQ ID NO: 6850072 - DNA, 57 bp, Homo sapiens
gagaagaacttagctttctatctcatggaacgccaagataggttgcaagtccttctc

SEQ ID NO: 6850073 - DNA, 72 bp, Homo sapiens
tcttccagctactcttctggctggcttccagtatgttctgccaatggaaggcactgggagaagactggaaga

SEQ ID NO: 6850074 - DNA, 73 bp, Homo sapiens
tgttctgtagcaagtgagaggcattttaggtcatgaaaagacaatacccaattcctttacttgctatactaca

SEQ ID NO: 6850075 - DNA, 77 bp, Homo sapiens
ctgtattctgtatatgattgagggctgcaaggaaatcactgttcgacttgtgtttttaaataatgatagaaaaacag

SEQ ID NO: 6850076 - DNA, 58 bp, Homo sapiens
gacactgctcacttcttcccttggattttccaagattaacttggagtgggacagagtt

SEQ ID NO: 6850077 - DNA, 55 bp, Homo sapiens
gagtcagccttctgaggacctgggagcagtgatgtttcccaggcaaaggcttctc

SEQ ID NO: 6850078 - DNA, 88 bp, Homo sapiens
tatacttgtgtgtcatttggactttggtattaccataagggaatatatacttatgataacatgaaactccaaatggtacagaagtata

SEQ ID NO: 6850079 - DNA, 102 bp, Homo sapiens
ccttgtgatagagaagatcactatcttatgttctgatgactctccaaagagggtaggattctgtttaagtagtctcagggcctggttatctttatttcaagg

SEQ ID NO: 6850080 - DNA, 64 bp, Homo sapiens
caggtactgtcgttacccttttttaacagaaaaatgagccaggaggaattgacacagaagcctg

SEQ ID NO: 6850081 - DNA, 106 bp, Homo sapiens
ttaccactgttaatgtgtttaaataattaggggcctgtgtcaaagactcacatacctgtccacagaagccttccctggttgtttgaaagtcttaaaatcttggtaa

SEQ ID NO: 6850082 - DNA, 91 bp, Homo sapiens
cagcctgggtatgcgtgaccccaaaacagctggttaattccctgaaaagaattgagtgccagatgtgggggatcgtgtaacctgagggctg

SEQ ID NO: 6850083 - DNA, 57 bp, Homo sapiens
cctggcagttttgcccaggattagcaggtcataactaggcttgggaagctgaccagg

SEQ ID NO: 6850084 - DNA, 68 bp, Homo sapiens
tttctattttgtccttgtcatgaagagttaaccaaaaagtgccactgttggtcagggatattgtgaaa

SEQ ID NO: 6850085 - DNA, 72 bp, Homo sapiens
ttatgaatccgtttttatgaaatgtccaaaataggcaaatctatggacagaaagtagaaagcagattcgtgg

SEQ ID NO: 6850086 - DNA, 94 bp, Homo sapiens
ccctgaccggctagagagcctgctacctcattccagagttatcactgccacacctcggggtcgggggtggaggctcgatagggctggttagagg

SEQ ID NO: 6850087 - DNA, 68 bp, Homo sapiens
gattacttggtggataacagctgggatttgggacttcccccaaagattcctttattctccaagtgctc

SEQ ID NO: 6850088 - DNA, 58 bp, Homo sapiens
tgcttgtgagagttttttcagatttctctgaaaaaaatctgaaagacgtaacagtgca

SEQ ID NO: 6850089 - DNA, 102 bp, Homo sapiens
atagaatgtgtatagatgtagattatgtgtagtatgtattctatacctacttatgaatggtatgttgtctacatctatactgatctacattcatatctctat

SEQ ID NO: 6850090 - DNA, 57 bp, Homo sapiens
tcccaacttgaacctgggagtcaaaaagatagctcagtcaccaggtgggaggtgggg

SEQ ID NO: 6850091 - DNA, 55 bp, Homo sapiens
ctgcagaaaagatagaggattgcactacgtgagtgtagtgtatttttttctgtag

SEQ ID NO: 6850092 - DNA, 55 bp, Homo sapiens
catagcatttatcttttgtttgagttcttgtaaactgaataaggtgaatgctctg

SEQ ID NO: 6850093 - DNA, 72 bp, Homo sapiens
tgtatagacacagctatgatttgagcagtgccattagtgtcttagtaccactcggaggacctgttttatgca

SEQ ID NO: 6850094 - DNA, 55 bp, Homo sapiens
ctcctaagcagcggaggcctgacactccatggactgcatggctgctgcttgggag

SEQ ID NO: 6850095 - DNA, 71 bp, Homo sapiens
tcccagtagcagacagatgtgggaagatccaagttctcccggaagatcccacgacttgtctgcatttggga

SEQ ID NO: 6850096 - DNA, 66 bp, Homo sapiens
tatatacacatgtgtatacatttacataatgtataaattataaaggtgtgtgtgcatgtgtgtgtg

SEQ ID NO: 6850097 - DNA, 58 bp, Homo sapiens
gagggcagagttagggtcatagtggtcatcactaacactttccactgactctgacttc

SEQ ID NO: 6850098 - DNA, 101 bp, Homo sapiens
gctggtctgttaatcatgtctacctcgatggagccatcccagtacatggggttactgggttcgaatggtttcagagcagagggggctagaggcagggcagc

SEQ ID NO: 6850099 - DNA, 88 bp, Homo sapiens
taggcagaagggccacctccttcatcagaaggaaggacgattatgcagatgcaggtatatttgctgagaaggagggagatcctgccta

SEQ ID NO: 6850100 - DNA, 56 bp, Homo sapiens
ggaggccttacgaagcaagccttgttttgctgagagctctgtacgttggtgccttc

SEQ ID NO: 6850101 - DNA, 66 bp, Homo sapiens
tggttgatgctggctgttggctggggccttaatttggcctgtcagcagaaacgccacatgcaacca

SEQ ID NO: 6850102 - DNA, 57 bp, Homo sapiens
gtgcattaacaacccagaactctagccatatatttgagtttggcttgtttattgtac

SEQ ID NO: 6850103 - DNA, 58 bp, Homo sapiens
gactctgggccccaggtggagctgtgctgcccctacagcctgcagaaggcccagggtc

SEQ ID NO: 6850104 - DNA, 86 bp, Homo sapiens
tacaggccagggcaggatcgtgcatttttattaaccctgaaagagtttgaggaaaggagatgacatgatcagattgtatgtttgta

SEQ ID NO: 6850105 - DNA, 79 bp, Homo sapiens
agtacctcagtttctgcttaatactgcagaacttgattctctcaagttctggtggccagaagtctgaactgaaggtatt

SEQ ID NO: 6850106 - DNA, 76 bp, Homo sapiens
gaaatatgactatgcagaacgtttgtgaaacttttaagttttgtgaagttgaataaaatgatctgtattcacattc

SEQ ID NO: 6850107 - DNA, 82 bp, Homo sapiens
ggaaagagagtatggaggatggaatttgcttcctaaaaactttcaccaggaaaacagcacacatcacttctgctcatattcc

SEQ ID NO: 6850108 - DNA, 90 bp, Homo sapiens
attatttcatcctgctggtgatggttaaggttagtagaaatagtactaccagttgctttactttcaccaagtaattatttttgaagtaat

SEQ ID NO: 6850109 - DNA, 96 bp, Homo sapiens
aggttccttgatgtgcctttcaggaacaaggcctatgggactctgtgactcaggaacacagtacttttcctgatggcaaggcagcatcaagatcct

SEQ ID NO: 6850110 - DNA, 65 bp, Homo sapiens
gtactcaggcttcaggcacagctgtgtccaggtgctgaatgtagctagtgtttggagatggatgc

SEQ ID NO: 6850111 - DNA, 117 bp, Homo sapiens
ggattatgaaggtggaacatttaccccagacaaagcggaaactgtttagaaaaggcttctatcactgtgttgtctcatgagcatttcttctttgtttttgtgtccattttacactcc

SEQ ID NO: 6850112 - DNA, 89 bp, Homo sapiens
aatcatttttaggaacctactgtggttttaatgtgtcccctctaaaatcaggtgttgaaactaagaggtgaggtctttaagagatgatt

SEQ ID NO: 6850113 - DNA, 66 bp, Homo sapiens
cggctctgaaacctttgccgatggggtccctcgggagggactgagtcgccagcaggtgttgacccg

SEQ ID NO: 6850114 - DNA, 78 bp, Homo sapiens
tctgcagaccttgcttctagtttagggctcttcaacttggaaggtgggaagtagaaactaggaagagagtctcaacga

SEQ ID NO: 6850115 - DNA, 101 bp, Homo sapiens
tcttctggtgctttcctcctgactttaaaataacaagtttagaaggccatttcttgattttccagtttaaatgtcacgggatgaacttccaccatggaaga

SEQ ID NO: 6850116 - DNA, 69 bp, Homo sapiens
tctgtatccagtggaaattgtgttcattttaaattaaaataaaatgaacggtgtccatctgtttgtgga

SEQ ID NO: 6850117 - DNA, 58 bp, Homo sapiens
tgcataggttctctcagaaaagttttttttcccacttagtttgatgagaatttaagca

SEQ ID NO: 6850118 - DNA, 91 bp, Homo sapiens
gctagttctgcgggatctgttaggtcaggtatggaaagacatacattcttgaattcctgtgcctacttagcactgttatccctgaattggc

SEQ ID NO: 6850119 - DNA, 65 bp, Homo sapiens
agggaaggaaaagctgtcgctttgctccattaattcccacaattaacgacagcaaatctgtccct

SEQ ID NO: 6850120 - DNA, 130 bp, Homo sapiens
tgggtgcagccctgggtggctggaagtgggagtcagggttttcccggcagctcacagcccccaggggcagagcagggcactggaaggcactgatcatatttccctgatgctcccctgaggttgtagtcaa

SEQ ID NO: 6850121 - DNA, 66 bp, Homo sapiens
ggatggaagcagaggccacagagtgggcatgaaaactaaatgatcactcctcattctgccccatcc

SEQ ID NO: 6850122 - DNA, 61 bp, Homo sapiens
aggctcagaggcctgaaagaatttggcattttaggggaatggccagaggtttgctgggcct

SEQ ID NO: 6850123 - DNA, 97 bp, Homo sapiens
tacgtaatgtaactattaggctgggctgaacttcatctgatgataaatgataggtcacagaaagttcatgcccaataacagaagtagcatatcagta

SEQ ID NO: 6850124 - DNA, 71 bp, Homo sapiens
ccaccctatgtttcagttctaaagttagaaggtcctctcatccttttaagaagaacagagacagaaaatgg

SEQ ID NO: 6850125 - DNA, 60 bp, Homo sapiens
ggaaagggcatggccttttcactgctcccaacagcaccctagaaatggcttggcctttcc

SEQ ID NO: 6850126 - DNA, 108 bp, Homo sapiens
ggtctatttgatttgcgagcccatatctgtaatcactatgccttcctctggcccactgtgtaggctggcatgaggcctggtttgcatgagaatgggtatcagaaggcc

SEQ ID NO: 6850127 - DNA, 62 bp, Homo sapiens
tagtaaatctcagaaaaagatcacccataagcatagcacaggggtattctgaggtttgacta

SEQ ID NO: 6850128 - DNA, 63 bp, Homo sapiens
agcaggtgtttgtatcataaggcaagatcaagttacatcaccctcatctatacaaactctgct

SEQ ID NO: 6850129 - DNA, 67 bp, Homo sapiens
gggaaatatcatattactgatgttcaagctgactcacagctggtaacattagtcagtatataggccc

SEQ ID NO: 6850130 - DNA, 74 bp, Homo sapiens
agagaagaatgtacaatttctgagagaactaccttggagactaaaccactcagaacattgacattcttatttct

SEQ ID NO: 6850131 - DNA, 65 bp, Homo sapiens
ggttttccagattaagataccacttcaaaagtgactgttcaaggtgggcttaactttggaaggct

SEQ ID NO: 6850132 - DNA, 73 bp, Homo sapiens
cagggaaagttcttgtccactctgttcttgtgcttgcttattttttcagatgaggacaaaaacttttgccctg

SEQ ID NO: 6850133 - DNA, 66 bp, Homo sapiens
tctttactgttcttctgtgggaaagggctctgaaaggattgcgttttgacaggaggaaggtgttga

SEQ ID NO: 6850134 - DNA, 86 bp, Homo sapiens
caccccgggtcctgtcctctgggtgccccatcccagggcctcacatcttccaagatggacactcagagggaggccaacctggagtg

SEQ ID NO: 6850135 - DNA, 62 bp, Homo sapiens
gtggagatgtctggaggtcaggtcctggggtcctgccccaggtcccgccccagctctaccac

SEQ ID NO: 6850136 - DNA, 71 bp, Homo sapiens
tttttgtttgtttggttggttggttgttttttaaggaataataataactggcacatatcacatatcaagaa

SEQ ID NO: 6850137 - DNA, 59 bp, Homo sapiens
cacttgagttcttaatagtcagtcaccccaaaaggaggaatggctataggaacaaagtg

SEQ ID NO: 6850138 - DNA, 67 bp, Homo sapiens
gcaacaccctggtcctgggcccaagcctcattctgctgcggggctggccagagttggagggtgtggc

SEQ ID NO: 6850139 - DNA, 56 bp, Homo sapiens
ctgcctccaggctcaccttgacaagctactgatggagcggggtcggctggaggggg

SEQ ID NO: 6850140 - DNA, 77 bp, Homo sapiens
actggaacagctatactgacagagttgtaaatatttccctttgaaatcacaacagtccagtatagactgtctctagt

SEQ ID NO: 6850141 - DNA, 84 bp, Homo sapiens
gagggacattgagttaaaggcacttaacgtgggaggatgcattcataggtaaccttttgcaagtgccttgacctatttttcctt

SEQ ID NO: 6850142 - DNA, 87 bp, Homo sapiens
gcgtggcccgtagattgtttcttaatatcccttcaagccagaaatttcctttggtagtaagagttaagcaacagataccagccatgt

SEQ ID NO: 6850143 - DNA, 77 bp, Homo sapiens
atgagtgactggttttgacaggaatttaatccttcaattggatttccctttgttcttgtgagtaatcagtatctcat

SEQ ID NO: 6850144 - DNA, 79 bp, Homo sapiens
acttttaaaaatgcagattcctaggttctactgtctgctgtgtcaggttagggccagggaagctgtatttttaacatgt

SEQ ID NO: 6850145 - DNA, 93 bp, Homo sapiens
gaataacttctggatgtttcaaatgtgcttccaaaggataaaaattttccatcccttaaagaatgaacatttgaggatgttaagaatgcattc

SEQ ID NO: 6850146 - DNA, 70 bp, Homo sapiens
cacttggttccaagagtcagctgatcccaggcggacttcaatgtctagaggaagcttcatctttcaagtg

SEQ ID NO: 6850147 - DNA, 55 bp, Homo sapiens
gggtgagggcagagtgggggcagatagaactcaaaaaccagctctgcatcttcct

SEQ ID NO: 6850148 - DNA, 55 bp, Homo sapiens
gcttattatagagagtgggtttagtagtccctaatattcatgtctttataaaagc

SEQ ID NO: 6850149 - DNA, 59 bp, Homo sapiens
ctttccaactctagtgaaattttatcgtaaaatatatgagtcattagccagttggaaag

SEQ ID NO: 6850150 - DNA, 60 bp, Homo sapiens
cctgtggctccagtgaaccaatgtagaagccctccttccccatggctgtgagcccacagg

SEQ ID NO: 6850151 - DNA, 55 bp, Homo sapiens
ttttctcatctggaaacagtgctagggatacctaactgtgacccaggtgaggagg

SEQ ID NO: 6850152 - DNA, 115 bp, Homo sapiens
ctgctataccagagttccactctccatccttccttgtaatgcctgtgtttccgcattggctcctgatgcaggtgtgtgcaagggagggcggcaagtgtacattctaggtatgcag

SEQ ID NO: 6850153 - DNA, 62 bp, Homo sapiens
aacactatggctctgctgagattgatctggaatttcctgtatatctcagtagactgtatgtt

SEQ ID NO: 6850154 - DNA, 67 bp, Homo sapiens
gctttggctgttaactaaaggctgctatttccagtcctggtctggaacagacattagtgagccaggc

SEQ ID NO: 6850155 - DNA, 61 bp, Homo sapiens
aggccatatctactcactgtccatttcatctgtgggacacttgacgtgagggacatagctt

SEQ ID NO: 6850156 - DNA, 70 bp, Homo sapiens
aggctctttggggtcactgaagtgtcatttggaaaatgacttcccaatgcataatgatcccctaaagcct

SEQ ID NO: 6850157 - DNA, 61 bp, Homo sapiens
cagtggtgccatttcctaattgaggcacctggcccaattaggaataaatgagtacttgctg

SEQ ID NO: 6850158 - DNA, 69 bp, Homo sapiens
ctccaactaaagtcctgttgtagcatagacagtgaaatgctatgacatcagaagactttaaaattgcag

SEQ ID NO: 6850159 - DNA, 72 bp, Homo sapiens
gccatgctgtttcctacatggtgttatttgccaacctgtctggaaccatagcccactaagggtagcgatggc

SEQ ID NO: 6850160 - DNA, 55 bp, Homo sapiens
gaggtgtgttacagattgtcataactgataaatcaatgacaaatgtagccacttc

SEQ ID NO: 6850161 - DNA, 65 bp, Homo sapiens
gtcttggccagtcagagtcacagtaatttgttcaagggaatatactatgcttctgatccaatgac

SEQ ID NO: 6850162 - DNA, 76 bp, Homo sapiens
gtgccacaaagcgcaatcttttctgtctttgttactaggaataaatggacttggaaagattgccgttcaagggcac

SEQ ID NO: 6850163 - DNA, 63 bp, Homo sapiens
gtgctgtgtcctggctgatgttcgctgagagtccagcactctaaatcatcctgggtcatgcac

SEQ ID NO: 6850164 - DNA, 76 bp, Homo sapiens
ggcttttatatgaacatagattttgtgtctctggaatatatgtcaaagagtacaactgatgggtcatgtgggagtt

SEQ ID NO: 6850165 - DNA, 75 bp, Homo sapiens
ttagatctacaggactatactggtaaatctgaccctgttaggaagctcagagaagtcttttgaatggagatctga

SEQ ID NO: 6850166 - DNA, 74 bp, Homo sapiens
ctgctggggtcatggggcgcccgaggctgaagtcgggggatgggttggtgggggccgcgtgcacccttagtcgg

SEQ ID NO: 6850167 - DNA, 65 bp, Homo sapiens
tctctttctattgcaccatgctatggcctgatcaaagactcaagcatctaggacagagaaagagg

SEQ ID NO: 6850168 - DNA, 57 bp, Homo sapiens
ccaggagtcaataaaggaagctgtcttcaagttgagcaatccagagatgactcttgg

SEQ ID NO: 6850169 - DNA, 93 bp, Homo sapiens
ggagatgggatgtcttctatgggctgtcctagtccagccctgtgctccccatggggaccgctgccacagcctcctgactgatacccagcctcc

SEQ ID NO: 6850170 - DNA, 74 bp, Homo sapiens
gggaatagctacctttatggagaacttgggatgtattatacaagatgctaagtgcttcacaaatgttatctccc

SEQ ID NO: 6850171 - DNA, 81 bp, Homo sapiens
tgactaaaacctaggtttcctcattcagaggttgagtttcttttagtcacactcctgagttatgagacagggtatgagtca

SEQ ID NO: 6850172 - DNA, 72 bp, Homo sapiens
tgcaacacatatatgcgttgttgttggttcccaggaggggcattcctgggtcataaacaatgcgtgtgttca

SEQ ID NO: 6850173 - DNA, 106 bp, Homo sapiens
ggagcagtggatgtgggccatgggccatggtgaagccaggtcccgagacaggcagagtgagccagtcccctgagctttcctggccctcccgagtatgcactgctcc

SEQ ID NO: 6850174 - DNA, 77 bp, Homo sapiens
cagcagtctttaatgtgagtccctttcaaggccaacaggatgagccttgtgaaggtctttagcattcagagcccttg

SEQ ID NO: 6850175 - DNA, 72 bp, Homo sapiens
gtgtgctattaatgaggctgcattttaaagcaggtgttgttaagtgcaatcagagcagctttattaagccac

SEQ ID NO: 6850176 - DNA, 65 bp, Homo sapiens
agagatcagtgtattcatagggaatattcaaaatctacagattgtttctagaatcattgatgtct

SEQ ID NO: 6850177 - DNA, 78 bp, Homo sapiens
ggggcgggctccggctggggctccgcggccccctgcggaagctggtgctgcagagtctcgtgccgctgctgctgcgcc

SEQ ID NO: 6850178 - DNA, 72 bp, Homo sapiens
aaacccagggtccttctaaacactggtccctgtgtaactgcatagccagtactgtgcaaggataaagggttt

SEQ ID NO: 6850179 - DNA, 73 bp, Homo sapiens
gaggtatatttatgatagttttttaaatgtccttgtatattaaggatattaatctgtgtcatttctttatttc

SEQ ID NO: 6850180 - DNA, 59 bp, Homo sapiens
ggagaagagcctgtgccaaacggagatagaactcggaggatatcacagagctttttccc

SEQ ID NO: 6850181 - DNA, 69 bp, Homo sapiens
taatgcttagagcacattcctcctgtgaattataagaaccttgaaagtttatgactgtgttctgcatta

SEQ ID NO: 6850182 - DNA, 59 bp, Homo sapiens
tcattaactggttaataactatttatgaccccaggatgtagtttctacccagttaatgg

SEQ ID NO: 6850183 - DNA, 56 bp, Homo sapiens
atagacagctacatagaatatataataagcattagtttctgtgtatgtgtgtctat

SEQ ID NO: 6850184 - DNA, 111 bp, Homo sapiens
agcttcttattaaaaatgagacttaatactttcagaattgtacagagtcttgaccttaggacttaagagtgtactctggaactgataagtcttatgacggtatagagggct

SEQ ID NO: 6850185 - DNA, 70 bp, Homo sapiens
tttgggaggcagtttgtgaaggagcccaaaactgtgaggcttcctgctgggctctgtcatgccttccaag

SEQ ID NO: 6850186 - DNA, 84 bp, Homo sapiens
ctgctcctccattggtccactgtgaaattgggacaaaagatatcttattttttaggattcacatggattcatgatggagagcag

SEQ ID NO: 6850187 - DNA, 55 bp, Homo sapiens
tactcattcatgttgttgtatgaatcaaaaacccataccttggtatggctgagta

SEQ ID NO: 6850188 - DNA, 59 bp, Homo sapiens
ccagctgtttctgatgctaggcaagacacgttctgccagtgagcaacagaaacatatgg

SEQ ID NO: 6850189 - DNA, 83 bp, Homo sapiens
ggggagccccaggactggggtacagggacgggggcagggaatgtcaagccatcacccccagacctcagtgccctggcctcccc

SEQ ID NO: 6850190 - DNA, 59 bp, Homo sapiens
gtctgacagccagctgttgggtcttccatcgtttttaaccttcaggtgagcacacagat

SEQ ID NO: 6850191 - DNA, 80 bp, Homo sapiens
ggtgcatgaggccagaatgagtctctggggctcacagcagacagaccccagctgaactcttctggactgacaatgcttcc

SEQ ID NO: 6850192 - DNA, 72 bp, Homo sapiens
cattggttcagttatgtgacctcaaaaggaatattcaataataaagttttgaattccattactgagtcactg

SEQ ID NO: 6850193 - DNA, 102 bp, Homo sapiens
tgaaaaaatatgtgcatatatcagtgtatgcttctatttttggtatgtgtgtttataaattagatcatagtgtatatactgctttgcaacttgcttttttca

SEQ ID NO: 6850194 - DNA, 110 bp, Homo sapiens
cctgtgattctctcctgagggctgcctctgacaatgctctgcccaccccaggcagggcaggctgggtgtcatggagtgatgatgccctcaggacaaaagagaatcacagg

SEQ ID NO: 6850195 - DNA, 69 bp, Homo sapiens
tccctcctgcatgaggctcggcccgaggcagggctccctcctgcatgagtctgtggcctccaggaggga

SEQ ID NO: 6850196 - DNA, 69 bp, Homo sapiens
ttggtctttgactttgtttgcaagaataagtgactttaagccttttgccagcacaagttaagagatcaa

SEQ ID NO: 6850197 - DNA, 77 bp, Homo sapiens
tttagaaaataagtctgagagaaactctctcaggtcaagtcaaacgtggagaaaaactttcagacatgttctctttg

SEQ ID NO: 6850198 - DNA, 59 bp, Homo sapiens
tttcaggttcagtggtatggctaaaaactttagccaataaatttacaactagactgaag

SEQ ID NO: 6850199 - DNA, 71 bp, Homo sapiens
ttaaaaattaaatgctagagattttgtttgttgtgaaagtcatacaggatccgctggctttatatttttga

SEQ ID NO: 6850200 - DNA, 60 bp, Homo sapiens
ctgacagttacatttgaattgccctaatcaggaatgtgcaccccagatgtgattagttag

SEQ ID NO: 6850201 - DNA, 99 bp, Homo sapiens
gagatggagtctcaccctgtcatccaggctggagtacagtggcatgatctcggctcacggcaacctcctactcctgggttcaagcgattctcctgtctc

SEQ ID NO: 6850202 - DNA, 119 bp, Homo sapiens
aagtgaataaaacagataggagaggtgagacagatgagactccaggacctttgcttcaaagtagtcacagtctcatctgttttatattttgaacttttatagtttggtgtgtatcactt

SEQ ID NO: 6850203 - DNA, 73 bp, Homo sapiens
gcttatcatttttgttggatacctgctttgcaaatggcttgctataagtagacattcaacactgtgagatagc

SEQ ID NO: 6850204 - DNA, 63 bp, Homo sapiens
cagcctttagcattaattccaaattaataataataaagatggaaaattagtagtgaaaggctg

SEQ ID NO: 6850205 - DNA, 86 bp, Homo sapiens
gagtcttgctctgtcgcccaggatggagtgcagtagcgctacctcagctcactgcaagctcctcctcctgggttcatgccattctc

SEQ ID NO: 6850206 - DNA, 81 bp, Homo sapiens
catttactgcaaaggaagagccaagcagtcatcaatagtgcagctgtggataactattggctttaagctttgctttaaatg

SEQ ID NO: 6850207 - DNA, 82 bp, Homo sapiens
ctacatgttatcatgcatgtcttgccctgattagtagtcatttccagtgtttacttgttgggttaagatgtgatacatgcag

SEQ ID NO: 6850208 - DNA, 80 bp, Homo sapiens
ccagtttattcaatctctatcagtatctatttcatcctctatataatggagatattaatacattatagggattgtgctgg

SEQ ID NO: 6850209 - DNA, 76 bp, Homo sapiens
ttgtcattggaatctctttgtccctgagtttcagaagcaaatagtgaagctttgggcagaagaggattcatgggaa

SEQ ID NO: 6850210 - DNA, 130 bp, Homo sapiens
tcaagatattggtaatactgtcatatttttggaatggtgctgtacagattattcagtgaaaataattattctctgttcaggaatttacagtttagcatttcaagttgacagtttagcatataatcctgta

SEQ ID NO: 6850211 - DNA, 59 bp, Homo sapiens
ttacctttatgcagtatgcaaccataaaattggtttctatacactgatataaggagtaa

SEQ ID NO: 6850212 - DNA, 55 bp, Homo sapiens
ctggagatatcttattgtcaatgttgttataacttggcagtgctttaatttccag

SEQ ID NO: 6850213 - DNA, 75 bp, Homo sapiens
gcatggatttcttgaatatttccatttactatgtagcaaaccccttcagcaccatcgtaatgtggaagtacatgc

SEQ ID NO: 6850214 - DNA, 60 bp, Homo sapiens
cctgggtgccttgagtctgcagggtcctaagtgagacccatgtagacagtgtgatccagg

SEQ ID NO: 6850215 - DNA, 65 bp, Homo sapiens
ggagtgtcatcgtgaaaacatagcaaaccagtgaaagtttgcatactgttgagatgttgagacct

SEQ ID NO: 6850216 - DNA, 65 bp, Homo sapiens
ggagtttgaagcaaaattgaggaatggctgtccctcagaggtttattaatgatgctgagagcttt

SEQ ID NO: 6850217 - DNA, 82 bp, Homo sapiens
tgagatattcaatccagaaagttctgtgagttgttcagcttttttgagcagaagattggaacttactgaatatagtctctca

SEQ ID NO: 6850218 - DNA, 95 bp, Homo sapiens
ttgggagcatcattgactttagagctttaggtgccttgacaatggctcaatccatggggcacagagaaggttttagtgtaaaaaatgagccttaa

SEQ ID NO: 6850219 - DNA, 61 bp, Homo sapiens
tccatgagaggtaactttacaatgaaatatgttttctttgtgcatggctactttttatgga

SEQ ID NO: 6850220 - DNA, 96 bp, Homo sapiens
ttctgtgaatatttttgtccgtatgtatatgaagctagtatttttgtgtggagagtattaaatttacattgacagagagatttgaagtaagcagaa

SEQ ID NO: 6850221 - DNA, 60 bp, Homo sapiens
tggtttgggcacgtttaagtaagttgtccgtggacaaaacttgaataggtgtcaaggcca

SEQ ID NO: 6850222 - DNA, 66 bp, Homo sapiens
ccctgctgtgtcagagtccaggggtgggtgttctctgccctgttctgaggacgtgacattgccggg

SEQ ID NO: 6850223 - DNA, 59 bp, Homo sapiens
attctttcttctcaggctgggtaaatccacgatttcctgcttttcctgggggaaagaat

SEQ ID NO: 6850224 - DNA, 69 bp, Homo sapiens
cgcagaagaggttgtctagtcccttccaggactcatgggagcccacgactctatagccattcttctccg

SEQ ID NO: 6850225 - DNA, 85 bp, Homo sapiens
atgagtatttgatgaaatttgggcaggttaaaaattagaataagaatatttagtttaagccagatttcagcaaaatatctaccat

SEQ ID NO: 6850226 - DNA, 112 bp, Homo sapiens
acagttggtagcatggtagaaggagtatagaaatgaggaatgttaggctcagagactgaagggctcacgagcttagacttttcacttccagaccttctgtgcctacctctgt

SEQ ID NO: 6850227 - DNA, 70 bp, Homo sapiens
tttttcagaaagttctggaattgtctgaaatccctttaagaggggcagagttccacaactggcaaaaaaa

SEQ ID NO: 6850228 - DNA, 67 bp, Homo sapiens
aggattgatgtccaaggcttggctgaaagagggaagagaagataagtatagctacgacatcaatgtt

SEQ ID NO: 6850229 - DNA, 73 bp, Homo sapiens
gtcctggcctctgggggtatggtgatgaacaacaacaaaacataaaacagattcatgcccttttagagctgac

SEQ ID NO: 6850230 - DNA, 103 bp, Homo sapiens
ccagatggttctttcttatataatggaattctccattagatgtcaacaaaacaagagtgtagatatcttttcagagtcaagtgtgagaagatacacaatctgg

SEQ ID NO: 6850231 - DNA, 76 bp, Homo sapiens
agaaaggttttgttcatcgattttcttaaatggaaaagttttaaaggatgagggtaagtgaacggcgagcttttct

SEQ ID NO: 6850232 - DNA, 58 bp, Homo sapiens
tgcatagaggatccagtgtggttctgccactgtggcaatcattctgattctttgtaca

SEQ ID NO: 6850233 - DNA, 59 bp, Homo sapiens
gctgggagtgggcaagatgagactggcgcctctgcatctgagtgtcccccaaacccagc

SEQ ID NO: 6850234 - DNA, 60 bp, Homo sapiens
tctagcatttctttcctgaggaaaatattgctccccaggggaactttggaaatgtttaga

SEQ ID NO: 6850235 - DNA, 129 bp, Homo sapiens
atactgttaacataatctgaaagctttttcatttaacaaatgtctactgagtacctattgtgaatcagatgctgtgctaagtgcaggatattgaatggggaatgaaactttcactttgaaacacaaagt

SEQ ID NO: 6850236 - DNA, 80 bp, Homo sapiens
cctggggatcttgttaaaatgcagattctgatttcatatgtctgggatggggcattctgcatttttaacaagttcccagg

SEQ ID NO: 6850237 - DNA, 106 bp, Homo sapiens
actctatttttactaaaacaagccatacatgtgtccctgatttatttgcacacatccttttgcaatatatatctacgtgtgtgtgtttgtgtgtgtgtatgtaggt

SEQ ID NO: 6850238 - DNA, 90 bp, Homo sapiens
catctgaaaaggtctgtcgggagccagaaccagcacatgttgtcaaggatgcttttggtctttggtccggagaggaagtgattcatgatg

SEQ ID NO: 6850239 - DNA, 72 bp, Homo sapiens
caggagaataaaaccagctctgcaaaatgtcatcttataggagcatactgtttgagctggtctgttcacttg

SEQ ID NO: 6850240 - DNA, 76 bp, Homo sapiens
ggtcatattaagatagccataagggtgccaccatttcctatgtaagatacaggcacttatggcatcttcctgtgtc

SEQ ID NO: 6850241 - DNA, 64 bp, Homo sapiens
gcctccttccacagctcacactggtctgaccccttctcatgccagtgattgcctggaaggaggt

SEQ ID NO: 6850242 - DNA, 100 bp, Homo sapiens
gcaagcgtagccttagggctggccaggagtgtgtggctatgttggctcctctctggacttaattgggtatgtgcacatcctcagccaagtatacacttgc

SEQ ID NO: 6850243 - DNA, 127 bp, Homo sapiens
tgactatattgtgtactggaacattgctaacagagtagattttgagtattctcaccacaaaagtaggtgaggtaatgtgtacgttaattagtttaatttagccattccacaatgtatacatatgtca

SEQ ID NO: 6850244 - DNA, 72 bp, Homo sapiens
gctcctgaatgcccacctaacagtgtttggattgtttcctaagtgcaaatcctgtttggagtaagttggagc

SEQ ID NO: 6850245 - DNA, 70 bp, Homo sapiens
cctcaactctttcaagggccctagtttggctttgggaaagtcagaatcagggcctcttcaaaggaagagg

SEQ ID NO: 6850246 - DNA, 79 bp, Homo sapiens
cgtatctagttgtcaacacatatttatatatgcacattagtaggtggcacctccaagtctgtgtgtgatgggagatatg

SEQ ID NO: 6850247 - DNA, 70 bp, Homo sapiens
ctttgaatgaggccctgacctgggagatctaggcctctcttggcctacccgtgagggtctacatctgaag

SEQ ID NO: 6850248 - DNA, 59 bp, Homo sapiens
gacaacagggtaaggcaggccatgtgaagagagacgcagtggatggcagatcctgtgtc

SEQ ID NO: 6850249 - DNA, 61 bp, Homo sapiens
gagctgctgtgtgctcaggcaggtctccttttcccagatcacttcagtacacagtaggctt

SEQ ID NO: 6850250 - DNA, 68 bp, Homo sapiens
cagcagtaattagtgctgcatgatgcctcattcagcaagaaaggcaggttgctacccattaactgctg

SEQ ID NO: 6850251 - DNA, 71 bp, Homo sapiens
attaaaagagataatgtgtgttgctgaggctaaagtgtgattacggtcccacatattatttgcattttaat

SEQ ID NO: 6850252 - DNA, 69 bp, Homo sapiens
atgaaagtacctgtaatatgttgtagttctccaatacccttgagatgaacatgtgagcaggttttttat

SEQ ID NO: 6850253 - DNA, 65 bp, Homo sapiens
gtgagttgttttcacaaacccatgatggataatggctaatgggtagtactgtggtaacaaagcac

SEQ ID NO: 6850254 - DNA, 66 bp, Homo sapiens
tgagagcgggaaggcaagctttgaaaggtgtcctggaatggttgagttcagatgcttctcgtctca

SEQ ID NO: 6850255 - DNA, 103 bp, Homo sapiens
tgggcgggggcacagctgccaccatgccatgccttgggcattggaagagcaggacccaggagtgcagggatggtatcactgttgcccctttgaaaatgaccca

SEQ ID NO: 6850256 - DNA, 79 bp, Homo sapiens
tcataatttgactgcaagtcaaatctgcaaaaatgtaatatgctatattttgggtgaatttgccagttagtctctgtga

SEQ ID NO: 6850257 - DNA, 75 bp, Homo sapiens
tgttatttacagatgaggaaactgaggcacagaggtaaaacaactttgctgaggtcaccttgctgctaagtgaca

SEQ ID NO: 6850258 - DNA, 84 bp, Homo sapiens
ttgctcaaggttgcacagttgatttatgctggtgccagctttggaaggcttgtatcttcagcacagatcctgtgctctttgcaa

SEQ ID NO: 6850259 - DNA, 55 bp, Homo sapiens
ggtttgataaaaagggaaagggttatcaggtggccacatcctttccttgtcattc

SEQ ID NO: 6850260 - DNA, 129 bp, Homo sapiens
gagcttgcggatgcgtgacgactcttgctctggtgttggcgccgtcagggacagtgagccggagctttctgcccccgagggcggtgcggggagccgctggcgcaggagttccagcatgctgctctgctc

SEQ ID NO: 6850261 - DNA, 88 bp, Homo sapiens
gttttttttttaaatgtgttttagagcaatgtacaagggcaatttttcgtcctgttttgtcatgtgttcttaaatacatttcctaaac

SEQ ID NO: 6850262 - DNA, 71 bp, Homo sapiens
aggtgctgagttcagctgccaggacaccctggggacaagtgtccctgatccactggaccccttcagcattt

SEQ ID NO: 6850263 - DNA, 68 bp, Homo sapiens
cttgaacccggaggcgggggatgcagtgagccgagattgtgccattgcactccagcctgggtgacaag

SEQ ID NO: 6850264 - DNA, 93 bp, Homo sapiens
ttatttcactatggcacagtgggaaatgacctttgtaacaaatgccacatcaggtaaatgggtcattttacttaaattgcctatatgagataa

SEQ ID NO: 6850265 - DNA, 66 bp, Homo sapiens
ctccacctgccagggaggccccctttgcatgtgctccaagcagctgctcctttcctgcaggcggag

SEQ ID NO: 6850266 - DNA, 80 bp, Homo sapiens
gatttgtagttttatgtgtcagctaacataataggtacgttcttagattggaaggtgaatagatttttaacatataagtc

SEQ ID NO: 6850267 - DNA, 68 bp, Homo sapiens
tctcctgcacagcctaagtagaaaggcggctgatgcctcgtatttctcttattgtgcttttaggaaga

SEQ ID NO: 6850268 - DNA, 86 bp, Homo sapiens
tcttagttattatttctctccttgctaaatggaggcaatattttaaaaacctcaatagcaccactggtgggaaaaactaactggga

SEQ ID NO: 6850269 - DNA, 83 bp, Homo sapiens
gtaacattaagatggcggaacagtgaaggatttttcagctttgtcaatcacttgttttatctgtcaatagatttccatgttac

SEQ ID NO: 6850270 - DNA, 82 bp, Homo sapiens
ctgtgccttcagactgtcaagtatctttctagcaactaaatcccatttgatgggatcctgaaaggtagacaaaggatcacag

SEQ ID NO: 6850271 - DNA, 82 bp, Homo sapiens
aaataaagcaggcagctacttgcactgtttcaggtttttctttaaatcctgtaaactgagggtagctgattggattttattt

SEQ ID NO: 6850272 - DNA, 55 bp, Homo sapiens
ccttctcaaacctgaaaggacaaatatttttgtcctttgccatattgagagtagg

SEQ ID NO: 6850273 - DNA, 62 bp, Homo sapiens
gccaagccaagaatcatgagctaataaacatggatgtttaagactctaaattttggggtggt

SEQ ID NO: 6850274 - DNA, 58 bp, Homo sapiens
acacagtaggccaccatgtcatggccagcatgggcgatgtgatggtgggttgctctgt

SEQ ID NO: 6850275 - DNA, 60 bp, Homo sapiens
aggccctgttgtagcattttggtttcgcagttgctttggaatgctgccaggacagggcct

SEQ ID NO: 6850276 - DNA, 68 bp, Homo sapiens
accagtaactttctaattttggctgagctttccatggagttctgccaacaaggagagcatgtactggt

SEQ ID NO: 6850277 - DNA, 98 bp, Homo sapiens
aatttgtgtccttttacaaaatgcctgtcaaatactgattcccttccacaatggggcttgaatgcagctgacagtcgttttgtttcacgacattgatt

SEQ ID NO: 6850278 - DNA, 55 bp, Homo sapiens
ggactgaagccatgtgctcactggtacaaaaaccaggaagctatagtgttagctc

SEQ ID NO: 6850279 - DNA, 60 bp, Homo sapiens
tagtttaattgtacataatcaagacttgataaatatgtcttgaattgtatgattaaactg

SEQ ID NO: 6850280 - DNA, 124 bp, Homo sapiens
aaaaggtaagtgaatttggtggcataactagaagacattttagacataaaagatttgaaggaaaaatgtcttacatcttccttgacttggaatgtttggttatgtaagaaatgtcttatctttt

SEQ ID NO: 6850281 - DNA, 87 bp, Homo sapiens
acagttctagaagctggatcaagtcactggcagggatgctttcttctgaggcctctctccttggcttgcagatggcttctcctatgt

SEQ ID NO: 6850282 - DNA, 71 bp, Homo sapiens
tatgtgtatatgtgtgtgtgtgtattatatagataatgttgatgaaataaatacccacacatacacacatg

SEQ ID NO: 6850283 - DNA, 68 bp, Homo sapiens
cctattgcagatagagggcatccccttcgccctttgctggtaagggaatccatctatcttcatttagg

SEQ ID NO: 6850284 - DNA, 83 bp, Homo sapiens
gttgggggtgtccccagtcccggcggtgggtgtgtgagagactagacctcctgctgtggccgggccctggggtcagcctcggc

SEQ ID NO: 6850285 - DNA, 60 bp, Homo sapiens
cagtaatgtgctctgcatccagtctgtgtctgtctgccggtgcagagctgacattacctg

SEQ ID NO: 6850286 - DNA, 76 bp, Homo sapiens
ggtgtaattacaggcagttggaatagatcaatgaaacaaaattgatagtctagaaattttgccttgtatttatgct

SEQ ID NO: 6850287 - DNA, 102 bp, Homo sapiens
tagcactgaaatgaattcattgacgtttgtagagctttgtagaaacacttgcttgacctaccacaagtgtattaagcaacgttattggtccaccctgtgcta

SEQ ID NO: 6850288 - DNA, 55 bp, Homo sapiens
atgagccttctcttgtcaggaagacagctaagtttgccctggcacactggctcat

SEQ ID NO: 6850289 - DNA, 58 bp, Homo sapiens
gatggtgtcttctgatggtcctgggctggttcaggtgccactctcatgggctaccatc

SEQ ID NO: 6850290 - DNA, 84 bp, Homo sapiens
aactctgcagtccaggacctggttaattgcacctttttgctgcatgtaatttacaggtacatgtgaccacttgggggcacagtt

SEQ ID NO: 6850291 - DNA, 77 bp, Homo sapiens
gggttctggggcttggggtggtggaggagaggcgccttgcggaaagccctcttcaggcactcgaaggcctcttgctc

SEQ ID NO: 6850292 - DNA, 73 bp, Homo sapiens
gaggtcatgaccatgggaataaagttatttcaatagttgactcttttgaaaagtttgttactcacatgacttc

SEQ ID NO: 6850293 - DNA, 89 bp, Homo sapiens
ggtttggttatgttcttccatcttaaaatgtgtcataactctcagaaagggtgaggagctcaactaggacagaagagggtgatcagatt

SEQ ID NO: 6850294 - DNA, 122 bp, Homo sapiens
tcctggctccctggcagatcaacagctcccctctcttcgcagctcctattcacactctggctttatggggaatgaaagggaacctgctggactggaagctggttctgctgaggggagtagga

SEQ ID NO: 6850295 - DNA, 75 bp, Homo sapiens
ctggaatctagggcctagatcacagggttactgaagacagagtagagacttggactctgggattctggatttcgg

SEQ ID NO: 6850296 - DNA, 75 bp, Homo sapiens
ccttccttaagtcatcccataacagtgctggactaccaaagtccaagccaccacacagggatgacataagtgagg

SEQ ID NO: 6850297 - DNA, 93 bp, Homo sapiens
ggctcctgcttattctaaaattctcttgatcttgacagctctctattatagctaagttaagttagagtgaattaaatggaagagttaacagcc

SEQ ID NO: 6850298 - DNA, 91 bp, Homo sapiens
aggttatttattgattgtttttgtaggttatttttgatatttttgctctgtgggcaaaatagaaaccaacaaggtcagtgattcacatcct

SEQ ID NO: 6850299 - DNA, 61 bp, Homo sapiens
aagagatggctctttctagacttaattataagcttagtagtccattggagagtcaattctt

SEQ ID NO: 6850300 - DNA, 60 bp, Homo sapiens
ggacttcagtacttgatgcgagctataaaggctgtgaagacatcagtgcctgacaggtcc

SEQ ID NO: 6850301 - DNA, 130 bp, Homo sapiens
tcactccagaaatactataatagtcaaaagtacgaataaagctattcctctctttttatggcagtaaaatagaaagagatgaatgctttaagtgtaattctgcctgtggtttcagtagttttggacagga

SEQ ID NO: 6850302 - DNA, 66 bp, Homo sapiens
gctgtccaggttgtggagcaacaggaactcgcattcattgcttgtgcaaatacaaaatggtacagc

SEQ ID NO: 6850303 - DNA, 76 bp, Homo sapiens
cagtggcaggagtcagccctaccttgaggctcagccggggcttgccctggaggaagcggctgacgatctgccgctg

SEQ ID NO: 6850304 - DNA, 71 bp, Homo sapiens
cttgccagggactcagtcaggggactttgggagaaagacttgatagccaggctgactgggttctaggcagg

SEQ ID NO: 6850305 - DNA, 80 bp, Homo sapiens
gccaagcaaagtaaggggcatcagttgcacattttgccatcaagcaaagcaacaaaatgatgccttgcagcttttatggc

SEQ ID NO: 6850306 - DNA, 75 bp, Homo sapiens
ctgatcatctagtctggccacttcttttcatacaaggggaaactaaaccccagggaagtgaatgacagatatcag

SEQ ID NO: 6850307 - DNA, 67 bp, Homo sapiens
ggattacaattttttggaagagtaaaaagttcacacttttgaaatttcacagaaggattgtagggcc

SEQ ID NO: 6850308 - DNA, 71 bp, Homo sapiens
ttcagaggttggtctggtaaatgtataccttgtggtttaggtctcagcattgatgccaaccagattctgaa

SEQ ID NO: 6850309 - DNA, 76 bp, Homo sapiens
ccagagttgttgatgatgagtttgtgccaaggtcttagcagggccatgcccaaaactatcaggctcaaagctctgg

SEQ ID NO: 6850310 - DNA, 57 bp, Homo sapiens
gctggcttttgaagtctagctatgtcattaaattagttatgtgattgaaagccatgc

SEQ ID NO: 6850311 - DNA, 74 bp, Homo sapiens
cctgggcagccacactccagaacgagagtaattatcctaattgctttattgcatcagtgtgggggcagctcggg

SEQ ID NO: 6850312 - DNA, 58 bp, Homo sapiens
gattgatagctgctgggatatttttagagaattttgaaaagattccacagttttcttc

SEQ ID NO: 6850313 - DNA, 92 bp, Homo sapiens
tttttttccctctttgatcctagtttcatagatgtcctctgtctactaggcagcatttttgatcccactaggattgagctcaaggaaagaag

SEQ ID NO: 6850314 - DNA, 77 bp, Homo sapiens
cccagcctacctcatcttctgggataatcaggtgggggtacacatgaatgacctttgaggatggaaattggtttggg

SEQ ID NO: 6850315 - DNA, 56 bp, Homo sapiens
gaggcgagaagctggagatggtatgaggttggctctcctctttactcccttgcctt

SEQ ID NO: 6850316 - DNA, 74 bp, Homo sapiens
cttttcagctttaggactcataataaactgggcactgtccagtttatgagcagcgagttcctatagtttgaaag

SEQ ID NO: 6850317 - DNA, 109 bp, Homo sapiens
agtgtatagcaaggccactcctctgagctcaaagacatcagaaccagctgagcaagacccctcctcagaggtctgagtttcagctcctcaaggtgtgtcttctagaact

SEQ ID NO: 6850318 - DNA, 66 bp, Homo sapiens
ataaaacttctctccctactttgtgcctttctaatgaaaggatactggaagttagagatcttttat

SEQ ID NO: 6850319 - DNA, 60 bp, Homo sapiens
ggtgttgatgataatagcagttccaaagttcactctcaaactgttattcccattttcacc

SEQ ID NO: 6850320 - DNA, 55 bp, Homo sapiens
tattgccatggcttggtatccactgactggaatagcaccaggcttatggtcagtg

SEQ ID NO: 6850321 - DNA, 57 bp, Homo sapiens
tgtgggactttgctttccttaggcctggactaccatcgagctgggcaagcttccata

SEQ ID NO: 6850322 - DNA, 67 bp, Homo sapiens
cttcctgggcaatgcggctggatagacctgagcatgtcagttctttccacactgtatgcccatgagg

SEQ ID NO: 6850323 - DNA, 67 bp, Homo sapiens
atacttctggaacctgctcccccaccaaaaaaagtcttaattctggtgggagattatccagaattat

SEQ ID NO: 6850324 - DNA, 85 bp, Homo sapiens
aatatatactatgattaattttatgtgtcaacttgactgggccacacgatgcccagacatttggccaaacattgttctggttgtt

SEQ ID NO: 6850325 - DNA, 62 bp, Homo sapiens
tgctgccagccaggccatggaggctattcattctgcctctcctagcgctgagttggtcagca

SEQ ID NO: 6850326 - DNA, 79 bp, Homo sapiens
actgacttttagaagcagcagggaaaggattaagttgccaggttaggtaacatattcctaaagtccctgtgctttcagt

SEQ ID NO: 6850327 - DNA, 84 bp, Homo sapiens
tttttctgagttagtcaaaaggaaggatatgctggataggcctaacatatgcagtaaagacatcgtcctttggccttggagaaa

SEQ ID NO: 6850328 - DNA, 71 bp, Homo sapiens
gatatatgcattttatagtgcaaagcattatttcacagttatatagcgctttgtatctgttaaatgttttc

SEQ ID NO: 6850329 - DNA, 62 bp, Homo sapiens
gcacctggttcttaggtactcatatttaatttctagttggaatttgagaccaagaaaagggc

SEQ ID NO: 6850330 - DNA, 64 bp, Homo sapiens
gggctagaagttagctagagaaatgctggcctcaaaatctgctcttcttactaatttccagcct

SEQ ID NO: 6850331 - DNA, 78 bp, Homo sapiens
ccagtaaccagatggcatgcatttcataccaagcttgttgaaataagaactgaaatcatctgccaataagttgcatgg

SEQ ID NO: 6850332 - DNA, 61 bp, Homo sapiens
cagatggttatcttttctttgtattctcacatgggagagagtacagagagctagctctctg

SEQ ID NO: 6850333 - DNA, 64 bp, Homo sapiens
cttcagatgtttgtgtctgattatgggaaatagaaatatttatagtcatgtaaaatatttgaag

SEQ ID NO: 6850334 - DNA, 56 bp, Homo sapiens
agttacaaacactatcagttctgatggacttcagtaatgggaatagtgtctgtgct

SEQ ID NO: 6850335 - DNA, 93 bp, Homo sapiens
ttatggtctcatcactggattaaaaaatgtaataatattctcagtttaaagaaaatgcacaggttttaaatcctctgtgataagggcccatga

SEQ ID NO: 6850336 - DNA, 111 bp, Homo sapiens
gctgcagctttgaatctggtgtttgcgggctggaaactcaggtagggttgcagttctgaagcagctttgaatctggtgtttgcaggctggaaactcagacagggttgcagt

SEQ ID NO: 6850337 - DNA, 72 bp, Homo sapiens
gagcgcctaacctggggcggtttcccaataagtctgtctaacgttgggacctctggcccagagtagtgtatc

SEQ ID NO: 6850338 - DNA, 65 bp, Homo sapiens
tgtgcagcttgggaaggaaaagagctaatcacatggagggttctatattcgcttcccaaggcaca

SEQ ID NO: 6850339 - DNA, 82 bp, Homo sapiens
catgtgtgagtcaaggagtgaacacataaaagcaaagggtgatttatcatatcattgttgttgctgtgttgacatctgcatg

SEQ ID NO: 6850340 - DNA, 60 bp, Homo sapiens
gtgacagtcaaagacatgacttgatgcggagatgtgaagtgtgacttttttgactgtcac

SEQ ID NO: 6850341 - DNA, 58 bp, Homo sapiens
gggagaagtggaaatctcattatccaggctgccagcatgctgatttccactgtctccc

SEQ ID NO: 6850342 - DNA, 83 bp, Homo sapiens
cttattccagcctgtatgtttgttctgcatcacagaaaaaagtagagatgcttactggatggcaggatagaggttagagtaag

SEQ ID NO: 6850343 - DNA, 74 bp, Homo sapiens
ttctattagattattctcaaggactgataaatactttggattctaggtatccttggtgcaaatgatttaatgaa

SEQ ID NO: 6850344 - DNA, 77 bp, Homo sapiens
cattaagttctggtataaatggctcttggtccctttggaaatttcagactaagtgggacatttactaggactctttg

SEQ ID NO: 6850345 - DNA, 116 bp, Homo sapiens
gacaaagcccagtgttcaggctaaagctttgagcatgtttcctttctcttgtagggcacacacatggtattgttcagaacaggttgtagtatgattgaagcactgggttctttgtc

SEQ ID NO: 6850346 - DNA, 65 bp, Homo sapiens
gtgggtaacggtgatgctctctaaggacctgccagagggtgaagagcagagccaccattacctgc

SEQ ID NO: 6850347 - DNA, 100 bp, Homo sapiens
ggaggataaatgatggtctagttctagtcaggctcaaacttttatcctttctgcttttgagagctgccgagctggggccatgggaccaacagctgatgcc

SEQ ID NO: 6850348 - DNA, 57 bp, Homo sapiens
ggctcctggcccgatccctgtgaagagtgctcaagcctttctggagggctgggagcc

SEQ ID NO: 6850349 - DNA, 90 bp, Homo sapiens
tcaaggggaggagagtacccagaggcatgatcccagaaggtgggtgtctttgggggtcactttgggtctttccactacattctccattga

SEQ ID NO: 6850350 - DNA, 66 bp, Homo sapiens
tggaagttgacttttctgcgggaactggcactttaaagtccagtcaaaaggaagtcaatgttttca

SEQ ID NO: 6850351 - DNA, 84 bp, Homo sapiens
atatcttaaagggaagcaaattcaaattagaatgttttgcctgtgacaagcctcgctttggatttcgctttccaactcagctgt

SEQ ID NO: 6850352 - DNA, 93 bp, Homo sapiens
tgcataaaataacttggatattcaagtgaggatggctaatccaaacaatgcttagcattctcatttgcataaagagctttgagttcatatgca

SEQ ID NO: 6850353 - DNA, 74 bp, Homo sapiens
ctaatattttactcagcatttgaaaaatactttgactacaatcaaaagttttctaagtctgagggagtatatag

SEQ ID NO: 6850354 - DNA, 69 bp, Homo sapiens
ttcccacactcagtacatatggaagatttctctctactttgaatcttctcatgtgtaatgaggttggaa

SEQ ID NO: 6850355 - DNA, 78 bp, Homo sapiens
cctgtcactttttataggtgttgagatgtccgatagatatgaaataagcatctccacctcaataaataaaaagacagg

SEQ ID NO: 6850356 - DNA, 130 bp, Homo sapiens
gggctcaagagatcctcctgagtagctgggactacaggtgtgtgccaccatacctggctaatttttttgtattttttgtagaaatggggtttcaccatgtttcccaggctggtctcgaactcttggactc

SEQ ID NO: 6850357 - DNA, 57 bp, Homo sapiens
ctgtggctggccttattgctgcttccagccacgaggcatgataaggtgtgcccacgg

SEQ ID NO: 6850358 - DNA, 80 bp, Homo sapiens
gaaaccttgttccaaattttcacagttgttgagtatgagcaaatgccacacagtctggtagaatagaggaacatttgttc

SEQ ID NO: 6850359 - DNA, 68 bp, Homo sapiens
ggaggcggactccaggcccacgggcatcgacgggtttgttcccggcttgagggtctgagatccactcc

SEQ ID NO: 6850360 - DNA, 84 bp, Homo sapiens
gccagagatgtgagctctctcctcctgcattaaccatggcaggatagtggctggagcaggacggggagtggtatcaagagaggc

SEQ ID NO: 6850361 - DNA, 65 bp, Homo sapiens
gttaggttgtttgctgaactgactgtaaagtgtcatagtcaatattcaagtgtaaatagcagggc

SEQ ID NO: 6850362 - DNA, 65 bp, Homo sapiens
agactgcagcaaccccttcagccgctccacttcagccagagttgaagcatttgctatagcattct

SEQ ID NO: 6850363 - DNA, 80 bp, Homo sapiens
tggggtcacttaagcaagccagtgacagccagggaaggatctgactactccccaacttcaggctgctatgagaatcccca

SEQ ID NO: 6850364 - DNA, 84 bp, Homo sapiens
ctcctcggcccgggttccagcgggtgccagtggctgttttgcaaagtctcagggccacccggggaaaagaggaagctcggggag

SEQ ID NO: 6850365 - DNA, 103 bp, Homo sapiens
ccaggatagaagaagggagaattagtaagagaatgcttgtttctactcagaagttgccagaaacaattctctgtatgccctgcttccttgttatcagccatgg

SEQ ID NO: 6850366 - DNA, 80 bp, Homo sapiens
agcctttattttagcagttgtgagaccctagagaactcctttggtgttttggggtctccccagcatgcacaatgggggtt

SEQ ID NO: 6850367 - DNA, 129 bp, Homo sapiens
cgcccagctgcacacccgctctgtggtttccaggcattaaagtttctcctgaggcacatccctttccctcaggaacctcttactgacttggagtccctcagctcactaagtggcctaaggcaggtgggg

SEQ ID NO: 6850368 - DNA, 98 bp, Homo sapiens
gaggcaggaggatcacctgagcccaggaagttgaggcttgcagtgagctgtgattgcaaatgctctccagcctgggtgacagtgtgagactccgtttc

SEQ ID NO: 6850369 - DNA, 130 bp, Homo sapiens
tcgtgtctcatttccgcttgctatggtccttatggccgtgatatctaaatcctttcatttctttcagtaaggagctggtgctgctgccagcaggatcctggtcacaaagctggagtggagagaagcagga

SEQ ID NO: 6850370 - DNA, 67 bp, Homo sapiens
gttggtcttttcaaggttaaataaactagaggtcttgcttcttgctatgaagctttgaaaagcttac

SEQ ID NO: 6850371 - DNA, 73 bp, Homo sapiens
ggattgaaacccaaggctgctggcttctgagctcatgctgtaccctgggcaggcaaggcagcctggtgattcc

SEQ ID NO: 6850372 - DNA, 63 bp, Homo sapiens
tctgcgctccaggccccagcaccttgggagcttatgctgtcaattacttgcgcttagttcaga

SEQ ID NO: 6850373 - DNA, 83 bp, Homo sapiens
gccgaggaggaggaggctccgggtgctgctcaggaactggggacccacgagtgcctgcaccctgagtgttcagctccagaggc

SEQ ID NO: 6850374 - DNA, 118 bp, Homo sapiens
gcactagatatcttccagcttttagcattgtaaaacctgcatgtttctaaaagcatcttaatgggaatgctgcttttgggacctgggggcatttgctgagtgcggctggagctggtgc

SEQ ID NO: 6850375 - DNA, 58 bp, Homo sapiens
ccctcatctttggccctgacaccctcggattgccaggcttgtctcagaagatgctggg

SEQ ID NO: 6850376 - DNA, 60 bp, Homo sapiens
agtaatgtgtaaatgaggagtcttggctgtgtttccagtaagactttatttatagatact

SEQ ID NO: 6850377 - DNA, 65 bp, Homo sapiens
agctgctgagagtctgccgggcaatgcacaattgctttgcttcaccaaagcagatattcatggct

SEQ ID NO: 6850378 - DNA, 78 bp, Homo sapiens
cagaggaagagcaacttggaaacactcagtctgcatcagaactaatagtggagtccaagttctcccatccatgatctg

SEQ ID NO: 6850379 - DNA, 116 bp, Homo sapiens
gagaaaaagcagttgtttctgggtatatggacaggagttaaggctgagttgacaagtcaaaacttcttgtcctcagcacccctgactttcctctatgtgtccttttgtttcttctc

SEQ ID NO: 6850380 - DNA, 76 bp, Homo sapiens
gaatacaaaacacacacacagatattttgaatacatatgtgtatatatgtgtgtgtgtctgtgtgtgtgtgtgttt

SEQ ID NO: 6850381 - DNA, 92 bp, Homo sapiens
ctttggtttaatattcatggcttatccaaaagatcttgtcaccatagctagatgaaaaaaatgacaaggctctggagaagcagaaccacaag

SEQ ID NO: 6850382 - DNA, 84 bp, Homo sapiens
tgtattgtttttgagttgcttatttaataggcctttattagcacaagcatctggtctagaagagtaagtgttaaaaaggaagca

SEQ ID NO: 6850383 - DNA, 78 bp, Homo sapiens
aagccaagtcttcacacttttagcccagcatcttatctcttagattaactgtggcattgtgaggactgcaagtggttt

SEQ ID NO: 6850384 - DNA, 97 bp, Homo sapiens
acttatcactaaaacatcctctatagttcattgacctgttagacatttgatacaaatttgctgaatcaatgaattttaggatgtttggaatgtaagt

SEQ ID NO: 6850385 - DNA, 57 bp, Homo sapiens
ggaattgcttatcttgttgaatagggcatatttctcaagacattaataagtagttct

SEQ ID NO: 6850386 - DNA, 73 bp, Homo sapiens
ggcctggctttgaaatgcatttcagtctctcaacacagactgctttcattgcatttagagtcccactaaggcc

SEQ ID NO: 6850387 - DNA, 58 bp, Homo sapiens
ctcttgctgggtcaagctggattgacttcattgaacagccagctgggtcttgcaggag

SEQ ID NO: 6850388 - DNA, 129 bp, Homo sapiens
gtgaggagaaacagtggggtgagggtgtcagcgagggtgattacaggctgaggatgattgcatcatggaaaaactccagagatctggcacgttctccagctacccttttagtttgtatccctccctcac

SEQ ID NO: 6850389 - DNA, 80 bp, Homo sapiens
ggaatttcaggggtaatatgtcagccagataaaggcaaaaaagcatgccagtgtctactgtggcatatcagctcctgtcc

SEQ ID NO: 6850390 - DNA, 82 bp, Homo sapiens
aatgtatcatgattttgcactataggaaaatgtgtcttgctgagatgtacaatatttctaagtgtattctgtccattgcatt

SEQ ID NO: 6850391 - DNA, 67 bp, Homo sapiens
agtggctgtcttccaaaatctgcaacgtattttataaacgttattactgacttggtaagcggccatt

SEQ ID NO: 6850392 - DNA, 71 bp, Homo sapiens
ctggaggctgggaagtccaagatcaaggcaccagcagattcagtgtctggtgtgggctctctgcttcacag

SEQ ID NO: 6850393 - DNA, 77 bp, Homo sapiens
ttattgagcatggatcatgtgctgggtgctgggctatatattggtgggggccagagagactgatacatgcttgataa

SEQ ID NO: 6850394 - DNA, 73 bp, Homo sapiens
tagaaagcatgcaagtttgatggtttatatgtaacaaaatggttttgttgttaaacttgtttattgtattctg

SEQ ID NO: 6850395 - DNA, 85 bp, Homo sapiens
aaagttacatgtgaatagaaagtattatttgggggcatctctaccacttgttatacaaaatcttactttcttctatgtatatttt

SEQ ID NO: 6850396 - DNA, 67 bp, Homo sapiens
ctacaagccaagaaaagaggtctcaaaagaaatcaatcctgctgacaccttcatcttggacttctag

SEQ ID NO: 6850397 - DNA, 84 bp, Homo sapiens
tcgcctgtcttaagtacagggttagtgacggtcaggggggttcttggatcctgtagtgaaccactgtacactgggactctgtga

SEQ ID NO: 6850398 - DNA, 87 bp, Homo sapiens
gtatggggccactgtcagaggggctgtgcctgctgagttcaagaggaaatgcactggcacgttcttacactggcgtgtgcttcatgc

SEQ ID NO: 6850399 - DNA, 83 bp, Homo sapiens
gcttatgagacttattctattaatatttctaggaaattttagcaattttcaagggccatttaatagtgtttggtctcatttgc

SEQ ID NO: 6850400 - DNA, 55 bp, Homo sapiens
gaaaagtctaatagagtgctagtccacagttcaccagcattctactagacttttc

SEQ ID NO: 6850401 - DNA, 62 bp, Homo sapiens
aaggccctagaatctatattgcaaaaagaacagaggcaaaaaatggaaaaaattagggcttt

SEQ ID NO: 6850402 - DNA, 70 bp, Homo sapiens
aggactgacaagggctgtgggtttaagaagtttacataggtagtggccttcctggcacccttgttagcct

SEQ ID NO: 6850403 - DNA, 69 bp, Homo sapiens
gtttccaaaggagtaccacgcattcccctttgcgattgtaataaaatgcttggatgctgccatgggaat

SEQ ID NO: 6850404 - DNA, 87 bp, Homo sapiens
tctggggtgcacagcacatgaattgatgccaagtgctctcagatgtactaggaggaggtgcttggctccatttttggtgccctcaga

SEQ ID NO: 6850405 - DNA, 71 bp, Homo sapiens
agagtgaatgttcgttgctttaagccactacgtgtgggtgacttgttaaggcagcaacggatgaacacact

SEQ ID NO: 6850406 - DNA, 65 bp, Homo sapiens
ccggactggccctgctccgcgccgcgggctctttggccggtgagtggggcgcagggcgcggcagg

SEQ ID NO: 6850407 - DNA, 82 bp, Homo sapiens
ggggcagattactaagttttatgcaacttagaagcaaattttcaaatattctatgggtttgtatacttagtatattagtttc

SEQ ID NO: 6850408 - DNA, 64 bp, Homo sapiens
tcaaaatgcttctgctcatatttcattcctctgtgactattggagtgagcagcagatgccttgg

SEQ ID NO: 6850409 - DNA, 83 bp, Homo sapiens
gtatccaaggatctccattgcaatatttaatgtcttgcttatgaaagtaagaaagataaggtttgcttggacatcttcagtat

SEQ ID NO: 6850410 - DNA, 56 bp, Homo sapiens
tgcatcctagggaaggcactgatttcagagtaaccagtattctctgctaggatgca

SEQ ID NO: 6850411 - DNA, 75 bp, Homo sapiens
gtttctaacatgctaatttgcagatagcagagtaattataattctcctctttgtcatagcatagtaaattggagc

SEQ ID NO: 6850412 - DNA, 57 bp, Homo sapiens
agtccttcttttagttgcttgggccatagttcatgttggctagcacaaagcaggatt

SEQ ID NO: 6850413 - DNA, 55 bp, Homo sapiens
caggtcggagccgtccctcctggcattccaggaaaggaggagacagcctcacctg

SEQ ID NO: 6850414 - DNA, 74 bp, Homo sapiens
ggtagctggataaaatgacattacctgattgtgtttaattttgtagttgtcgatgtcattttattctttgtacc

SEQ ID NO: 6850415 - DNA, 84 bp, Homo sapiens
gttttgccctgaaaggggttttatttgttacatgcaagctaaattgttgtaacaaagacactccaaaatatagggtcttaagac

SEQ ID NO: 6850416 - DNA, 113 bp, Homo sapiens
cttctccaaagtgccgggtttctcaaggttttgatttgcacgtggctttccatttttaaactcccatggggaggcgtggagacaactctggggtgagggcgagggtgggggag

SEQ ID NO: 6850417 - DNA, 60 bp, Homo sapiens
gctcatccacgtgcttttctagttgggactttttcttggcttaaattgtttgtggatagt

SEQ ID NO: 6850418 - DNA, 59 bp, Homo sapiens
ttctctttccacagcatgtccatgctaccctttagtgtgcaattttgtgggaggcagaa

SEQ ID NO: 6850419 - DNA, 73 bp, Homo sapiens
ttttgaaaacaaatttggagaagtttgattcaccctattggaaggagaagctggactttccaaactttcagaa

SEQ ID NO: 6850420 - DNA, 95 bp, Homo sapiens
ctcacatttcctctctgagccttaacttccttgtctgtaaaatgggaatgaaacaacctcactctggtagacaaggagaggtggagtgatgagag

SEQ ID NO: 6850421 - DNA, 73 bp, Homo sapiens
aagtcaactggaaagatcagtaggaagagactgagccagaccttctcatgctgatcttctccaccaaacactt

SEQ ID NO: 6850422 - DNA, 78 bp, Homo sapiens
ggaatgagtcaatgaatgaatgagagtaggtcaggggagctaccctgaacatctctgctttatttaggctttgtctcc

SEQ ID NO: 6850423 - DNA, 114 bp, Homo sapiens
gcaaactggtccaagaacttgaggtaggcctgacgctggggtgcagctgctggaatgaagtggccaccagagtgggtgagggtgatggctccgggaaattggctggccagttgc

SEQ ID NO: 6850424 - DNA, 110 bp, Homo sapiens
aactttctagccagagcagcagcacagtgaatggtttactcacagctcctttgtctgctgatgggagatttggcactgtgcttgcctcttgggcttacctgagcaaagtt

SEQ ID NO: 6850425 - DNA, 60 bp, Homo sapiens
gagcttcttggctcagcacttgggagggaaagcctccagggctggtggctgcagaggctc

SEQ ID NO: 6850426 - DNA, 119 bp, Homo sapiens
tgtttgaaagttgaactggagacttgcatgttccaaagaattttgctcctcgagagctcaatcttccaggcaatttctaacattccatggatgttctttagttttgttcttttcaaaca

SEQ ID NO: 6850427 - DNA, 84 bp, Homo sapiens
gagtgatggatgtagggcctgggcatcacaggcctggggaggacccatgggctgtgggaccctggaccagccgcgtaatctctc

SEQ ID NO: 6850428 - DNA, 82 bp, Homo sapiens
caatcatgaagttgaagtttatatgagtgctttctgctgttgcatgttgctcaaggtacagtaaaaccttaacatcgggttg

SEQ ID NO: 6850429 - DNA, 58 bp, Homo sapiens
ctgagaaacaatgaattgtgatcttgcagtgggagatgcaaagattatttgtgctcag

SEQ ID NO: 6850430 - DNA, 64 bp, Homo sapiens
tagttacctggggtacatggttaatttgatttagcagattctttggctaaaccctagtaaatta

SEQ ID NO: 6850431 - DNA, 97 bp, Homo sapiens
ggaatacagcaatgagcaaaacagatgagatctctgcctatatggatgttactatccaatggggagtgagttcttgaacaagtcattgctaaagtcc

SEQ ID NO: 6850432 - DNA, 80 bp, Homo sapiens
gtcacaaatgattgaagctagaacaaccattaagggaaaaccaagaaaatcccaaatgatttagccttagtctttgagac

SEQ ID NO: 6850433 - DNA, 89 bp, Homo sapiens
gcttgcccagtgggccactggtcgtgtgtgtctgcgggtcagagagctccaggcctgagcagacagcatgatggtcagcagagggaagc

SEQ ID NO: 6850434 - DNA, 61 bp, Homo sapiens
gtggtagagccaggattttggacccaaccattctggctgccaagtcctgtctctcaatcat

SEQ ID NO: 6850435 - DNA, 73 bp, Homo sapiens
tgtgcttttctccaggaaggtatgctgaccacgcttatgaacagcaacctggatcatggtgaaaaatagcata

SEQ ID NO: 6850436 - DNA, 89 bp, Homo sapiens
gtgtgccctaaactgtgacaccttatttggaaatataattatagcagatgtaattagttaagatggggtcttactgcagtagggtgggc

SEQ ID NO: 6850437 - DNA, 69 bp, Homo sapiens
ccagctggactgggctttggtactgtgattagcatagctgggatttaccaagcgcttcctctagccagg

SEQ ID NO: 6850438 - DNA, 72 bp, Homo sapiens
caggtaacttattgtccactctgccattcctatcattccacactgatgggctggtgagggatcatttatttg

SEQ ID NO: 6850439 - DNA, 82 bp, Homo sapiens
tataaagaacagactgtcgtagaaaactgtctttgcttccaaatcagcagaggaccattgtatgtattgtcaggtctttata

SEQ ID NO: 6850440 - DNA, 61 bp, Homo sapiens
tctctgaagccagctttggaagacaccgtggggtcttctctatgagctggtctggcaggga

SEQ ID NO: 6850441 - DNA, 59 bp, Homo sapiens
ggtgcatggaaagagtaagtaagtaataaatgctacttattattaatattccatgaact

SEQ ID NO: 6850442 - DNA, 58 bp, Homo sapiens
gtagcttcaagtactctccctggaaagtctagataccttcagagctgctgaaagctat

SEQ ID NO: 6850443 - DNA, 72 bp, Homo sapiens
gttcaaatatcaggatggttatgtagtgatatagattcacacagattcacaaacacatccagagtatttgac

SEQ ID NO: 6850444 - DNA, 77 bp, Homo sapiens
ggtagcatgtcattattttccatgttggtttcaaacagatgattccacttgtgaaataatcaaatataattgctgcc

SEQ ID NO: 6850445 - DNA, 67 bp, Homo sapiens
ggactctcagggctgcgggcttggcccggcccgggcggcgcaggcagaccgcgggctcgaggagtcc

SEQ ID NO: 6850446 - DNA, 74 bp, Homo sapiens
gagcagtagtgccctggttataggtgtggttcaggtgccaggctccccacggccgtggccagggcagagcgctc

SEQ ID NO: 6850447 - DNA, 68 bp, Homo sapiens
ttactaccacgccaccctcagccccacatgcctcctcctgtccctggggctgggggtgtgctgagtga

SEQ ID NO: 6850448 - DNA, 56 bp, Homo sapiens
ctttgtttgcaaagccttagattgctagatcatttccaaggcctggcagcacaaag

SEQ ID NO: 6850449 - DNA, 55 bp, Homo sapiens
ctgtgagggccagagtcagggccagtcatggtaatgggcctgaaggcacttccag

SEQ ID NO: 6850450 - DNA, 63 bp, Homo sapiens
aaagttctttgcatctttgctctacactagaatgctcctaggccagggatggtaaatgacttt

SEQ ID NO: 6850451 - DNA, 74 bp, Homo sapiens
gtagcttgttaaggatgcatattataatatctaaagaaaacactaagttgtaaaatattgcataacaagctaac

SEQ ID NO: 6850452 - DNA, 61 bp, Homo sapiens
ttaccttgccataagacatgaactggctgatagccagtgggtgcaaccatggctagggtag

SEQ ID NO: 6850453 - DNA, 111 bp, Homo sapiens
gcttatgtactatcattagtaataaaacacatatgtcattgaaaaatctctatttgtccaatgaacctgatgttagtgactgtgtgctagtagtagtcacatataaaaagc

SEQ ID NO: 6850454 - DNA, 86 bp, Homo sapiens
ggtgtgctttaatgactaagacctaaaattgtgaatatttatacataaacattccagttgtaaggtttttcataagaaagttgact

SEQ ID NO: 6850455 - DNA, 80 bp, Homo sapiens
tctaagtgacccacagttgactcttgaactatacctaataaacgaccctattaggtggcaagtcctgtggctctctcaga

SEQ ID NO: 6850456 - DNA, 129 bp, Homo sapiens
ggggtaggtttgatgagtaagggtgatgaattcatttctagacatgctgaatttgagatgactgcaaggcactcaagaggatatgtccagaaagaaaattcagccagcctcctatatttgttctgactc

SEQ ID NO: 6850457 - DNA, 66 bp, Homo sapiens
ggggtgaacagggccaggcgagctctaccacccctccacccctccaccctgggcctccatcacccc

SEQ ID NO: 6850458 - DNA, 93 bp, Homo sapiens
gtggctcagccagagctggatggtcaagatggcctcactcccatttctgtcaactctgaggctctcttccgtgtggtctctccaacaggctac

SEQ ID NO: 6850459 - DNA, 126 bp, Homo sapiens
gatgctgccagactgaagcagacctatggggaggaacggagtggggactggggtaatcaatgccttgaattaactcctcttcctccctcctatctcatgccaagacttcctttggcccaaagcatc

SEQ ID NO: 6850460 - DNA, 63 bp, Homo sapiens
gctcagaatgtatcccattcatgtattgttttgaaatacatgtattgaagtgtgcatctgagt

SEQ ID NO: 6850461 - DNA, 129 bp, Homo sapiens
acatgcctggcactctagcacttgaggatagctgaatgaagtaagttgttgatgttgcagtcctgtgaggatcacttcagaactgttataacagctgttttttgggagctggtgttggatggggtgtgt

SEQ ID NO: 6850462 - DNA, 90 bp, Homo sapiens
gtagtattccatgatatggaagtaacacagtttgtttaatcattttcccactgaaagatatctgtattgtttccaatttttggctactat

SEQ ID NO: 6850463 - DNA, 99 bp, Homo sapiens
ccttggacaaattcttacctcagtttgcatatctgtgaaatggagatactattggtactcattttatagagttgtgtagattaagtgattaatccatgg

SEQ ID NO: 6850464 - DNA, 71 bp, Homo sapiens
gctatctacttacactgaagcaaagatacataaagaaatatgtctctactgcttctgtgagtgagtcttgc

SEQ ID NO: 6850465 - DNA, 56 bp, Homo sapiens
tccagccatcttgctgtgagaggacagggcatggactctggagtttgaaggctggg

SEQ ID NO: 6850466 - DNA, 57 bp, Homo sapiens
gacaccaggaaggaagagcttccaccttatctggtggctctgtccctgctgtgtgtc

SEQ ID NO: 6850467 - DNA, 89 bp, Homo sapiens
tctcatgctctccagtcctttctgtccccattatgttatctctgctctgtctgagtagaacatggtagggcaggtgagagcagctgaga

SEQ ID NO: 6850468 - DNA, 57 bp, Homo sapiens
gggaagtgctgccagacagtgagagggatctccttagttagtctatagtgtctaccc

SEQ ID NO: 6850469 - DNA, 68 bp, Homo sapiens
tgagatcacttacgtggctgcagttatttagtggctcaactgcagttcaacgatgtaatgtgacctca

SEQ ID NO: 6850470 - DNA, 107 bp, Homo sapiens
tcttctcttccatcatagttttactaaggactctaagttctattgttgacttgtattggagcaggaagtctatggctgtgactttggatggaatataacaaagagga

SEQ ID NO: 6850471 - DNA, 55 bp, Homo sapiens
aagagcctgcagtaccttgctatgtggaccaggtttgcagggtggcagagctctt

SEQ ID NO: 6850472 - DNA, 88 bp, Homo sapiens
gcttgtagtgttttatttcagcactttgaatatgtcatcccactcctttctgacttgcagggtttctgttgagaagtccactgttagc

SEQ ID NO: 6850473 - DNA, 122 bp, Homo sapiens
cggggcggcgggggcggggcggttccacgtgggtggggctgggcgccccggagggcggcggccgcggggcgcggggcgctgggatcccgcccgctcctccgccctgcacccctcccgccccg

SEQ ID NO: 6850474 - DNA, 55 bp, Homo sapiens
cctggcctcagcctagggctgagcagtgagccccaccccagtggctgtggccggg

SEQ ID NO: 6850475 - DNA, 78 bp, Homo sapiens
gcacgtggggcggcagcggctgcagggaagagaggcttgttaccttgggggtgccagctgcttgtcccccacaactgc

SEQ ID NO: 6850476 - DNA, 113 bp, Homo sapiens
tgtttatagttgttccatcagtgcccagccaatttgttatgttgaaggtgctcaatatatattttctgggcaaatgaatggatgaataaaaataaagaaatataacagaaaca

SEQ ID NO: 6850477 - DNA, 77 bp, Homo sapiens
ggagaactcaatttggaattgtcagtaaatgatggctcactgttatatacttgcttccagtccaagtctgtttcttc

SEQ ID NO: 6850478 - DNA, 82 bp, Homo sapiens
ggggcctgtaggatggcacacaggtctgcaagggagactgagctttctacctttgcctggagacttctgatgcctttgcccc

SEQ ID NO: 6850479 - DNA, 75 bp, Homo sapiens
ggcaagaacgaacactctcccagcgaggctctacttcatgaaaaatgaatgtagctggggaggttgagtcctgct

SEQ ID NO: 6850480 - DNA, 58 bp, Homo sapiens
aacagttctgtgcctgcaaccgtgcagctgaacatggctggaagaaaacagaattgtt

SEQ ID NO: 6850481 - DNA, 62 bp, Homo sapiens
agcgtctggtggatgcagatggcatcattaatcccagcgctttctacatctacctgacggct

SEQ ID NO: 6850482 - DNA, 73 bp, Homo sapiens
cctcccaagtacagattcctccactgccagccttaggcggttagggtgtgatcttacgaaaagaattggcagg

SEQ ID NO: 6850483 - DNA, 78 bp, Homo sapiens
tgtagggcagctgcatcaggcactattcccacatgtttcacattgtatgtagctcagtgtctgagtgcaggctgtgca

SEQ ID NO: 6850484 - DNA, 64 bp, Homo sapiens
gggacagaagaggaggattagaagtgagaaggagaactactttcactggattctcttttgttcc

SEQ ID NO: 6850485 - DNA, 65 bp, Homo sapiens
ctcagaggaggcagggtgtgccctgcccacgggcagtgactcagcataccctgcttcttctcggg

SEQ ID NO: 6850486 - DNA, 56 bp, Homo sapiens
aatgttaatggatcaacctagacatctttgtggtgttaaacatgatccattacgtt

SEQ ID NO: 6850487 - DNA, 112 bp, Homo sapiens
gttaagttgcttgaaaaaaaatactataaaactctgtgacaaaaacactgattatttctaaaaggtcaattgaaatggactgattatgctttgtcattaagtggcccttaac

SEQ ID NO: 6850488 - DNA, 88 bp, Homo sapiens
caatgagaacatatacttgaaagcacttagtaaattagaaatgtgggtcacaaataatactgctgtgcttgagttgttgttgttgttg

SEQ ID NO: 6850489 - DNA, 56 bp, Homo sapiens
tccctgtgacaagtctgagttcaattttacctaattttaagacttgtaacaaggga

SEQ ID NO: 6850490 - DNA, 68 bp, Homo sapiens
tcgcttgaacctgggaggcagaggttgcagttagccaaaattgcaccactgcaccccagtctgggtga

SEQ ID NO: 6850491 - DNA, 77 bp, Homo sapiens
taaatctcttgagcgattttcattttttgcaaggccgcactgctggtgtcctggaaaaatggagagttagagcttta

SEQ ID NO: 6850492 - DNA, 92 bp, Homo sapiens
ataataagctatatgtcagtgaatacttcaggaaaataaaataacctccaaagaaaaggatctgaggtatatgactggctatagtttgatat

SEQ ID NO: 6850493 - DNA, 69 bp, Homo sapiens
caggtgatggaggggggaatggtcctagaccctccttctagggttcccatcacctccttccttctcctg

SEQ ID NO: 6850494 - DNA, 58 bp, Homo sapiens
gagagtgattttggtctgagttccaggcactgctggtgagctcctgagggttactttc

SEQ ID NO: 6850495 - DNA, 88 bp, Homo sapiens
tgcagactctcctctgcctgcccacctgggctctagactgaccaagaccccaccaggctgtgggcagtgcctgacggatgagctgaca

SEQ ID NO: 6850496 - DNA, 99 bp, Homo sapiens
tggtgagagagaggggcagggagacctacccaggacagatttgtgcaaacccacatgctggtctcattgggttagggagagctggccttctcttagcca

SEQ ID NO: 6850497 - DNA, 72 bp, Homo sapiens
tactcataaggagcaaatggcctttccaaaatgctgcagttcattgaatgattcccctttgccctatgagta

SEQ ID NO: 6850498 - DNA, 65 bp, Homo sapiens
gtctgctgtgccttggggaaaagagacaatgaaaaataaccattgttcctcaggggctcacagac

SEQ ID NO: 6850499 - DNA, 91 bp, Homo sapiens
gttgattctgggttgagatggggggtggttgtgtgaggattaatggagccattttgaaaaccgttgctaatcaggctaaaatgaatcacac

SEQ ID NO: 6850500 - DNA, 89 bp, Homo sapiens
taggcagatggcagggggctcagtccttcttggcagctgctttcctcatggcagccaggacgttgctcagctcctcctgccttctcttg

SEQ ID NO: 6850501 - DNA, 59 bp, Homo sapiens
catgctgggcaccattcttgcaggcctcacctcgaatttctgctctctggtgcttcatg

SEQ ID NO: 6850502 - DNA, 113 bp, Homo sapiens
tcctcatgtcagcacttgtctcagatcaagcctggcagtcctctcattggcctcctggagccagggtgtcaggagggggattggggtggggttcaaagtatgacagcaatgga

SEQ ID NO: 6850503 - DNA, 65 bp, Homo sapiens
tgatatttttaatgtggcagcattttagtatattttcctattaaatggccaaggttaaaaataca

SEQ ID NO: 6850504 - DNA, 57 bp, Homo sapiens
tcactgctctctgcaagtagatgggcttactctccatggcttacagatggagcatgg

SEQ ID NO: 6850505 - DNA, 75 bp, Homo sapiens
tcctggtgaggctggaactgctccagacttcagaaggggctggaaaggatattttaggtagacctacatcaagga

SEQ ID NO: 6850506 - DNA, 56 bp, Homo sapiens
acaggcagctgcgacaagagagcccttttgccgaaaatagctttccagcagcctgt

SEQ ID NO: 6850507 - DNA, 58 bp, Homo sapiens
gcccagggtgaagtgcagttgtgcgatctcgactcactgcagcctccaccttttgggt

SEQ ID NO: 6850508 - DNA, 77 bp, Homo sapiens
ctcacctgggccactcagattgtccccttccttaagttttctgtctctgaggggcagactgaggtgcacaggctgag

SEQ ID NO: 6850509 - DNA, 69 bp, Homo sapiens
caaagccaggtgtgatttcatctgaggtccatgaatggcccaggagatctggatctcgtcctggttttg

SEQ ID NO: 6850510 - DNA, 102 bp, Homo sapiens
cagaccctatctcccgtgctcttttacagtggctatttcatttagtactagggggctttttgcctgtattttataaatgagcaaagaggactggagggtctg

SEQ ID NO: 6850511 - DNA, 91 bp, Homo sapiens
gtaatgcgcatgaattataatgagatcttgttgatgttatatattatgatacaacagaaaatgattattctttgtgattaccttatattac

SEQ ID NO: 6850512 - DNA, 124 bp, Homo sapiens
agtggggatgcccgttggtcaggatcaagtggacacgatttattgctaagggaaagttgtggattacctgtaacatttgaagttgtgtccaacttgaacattctacaaatttgcatcaataact

SEQ ID NO: 6850513 - DNA, 56 bp, Homo sapiens
tatttcacagttttcagacgctggaaagtcagtgtctagggcgagaatgtgtagta

SEQ ID NO: 6850514 - DNA, 78 bp, Homo sapiens
cctgctctatgggagagtctaaaaccgaggtaccatgtaagaaaaataatgctttgaagacttttccagggtaaaagg

SEQ ID NO: 6850515 - DNA, 95 bp, Homo sapiens
gtgattcttttcttccctaaggaagctgatgcaaagggttcctcagaagtagttaattgaaccctctgcatcagcttctttagggaaggaatcac

SEQ ID NO: 6850516 - DNA, 81 bp, Homo sapiens
gcgcggggcacgctggtcattgtagtccagtccatatgagctcccggggcactggactacaactcccggcaggctctgcgc

SEQ ID NO: 6850517 - DNA, 80 bp, Homo sapiens
tcagttgtacttctactttcatgaccctgacactttcaaagactgcaggcagttatttagtagaatctctctcaatttga

SEQ ID NO: 6850518 - DNA, 59 bp, Homo sapiens
tggttggagccaaaattcaaagccaggcagtctggctccagagctcatgctctcaacca

SEQ ID NO: 6850519 - DNA, 77 bp, Homo sapiens
agttaggtaaaaatatgttttccagttgtcatcttaaaatagagacacagaacacaaaagcataggtaagcctaatt

SEQ ID NO: 6850520 - DNA, 109 bp, Homo sapiens
tcaatctgggaagctcatactggtgtacaatgcagcagtttacaaagcaatcccaatggggttgtgtactagctgcttgtttgtttgcaagtgcaattccagatgttga

SEQ ID NO: 6850521 - DNA, 83 bp, Homo sapiens
cataacagcttctattgtgaagggaaaaatagtgcattcaaaatataatggaatatactccattcacgatagtaagaaaaatg

SEQ ID NO: 6850522 - DNA, 61 bp, Homo sapiens
accaaagctctggttaaaaggcctgggttgcgtgcccacttctgaagctaagggctaaggt

SEQ ID NO: 6850523 - DNA, 81 bp, Homo sapiens
gtgggcagtgccttactcagaaaggtgccagtcacttacactacatgtcactgtgtcctttctgcgtagagtaaggctcac

SEQ ID NO: 6850524 - DNA, 64 bp, Homo sapiens
ggtagggctcaagaaagtgtacctcagtaagacctgtggacttttgtttcttggatactcttcc

SEQ ID NO: 6850525 - DNA, 56 bp, Homo sapiens
ccacatgccacctggagagactactgtctgcaagggtgtcacaggaggccgtgtgg

SEQ ID NO: 6850526 - DNA, 67 bp, Homo sapiens
ggtttgaaaaaggtgaactcaaaatgcttagcaaatgtcagtattgctagagttcactggcagcact

SEQ ID NO: 6850527 - DNA, 71 bp, Homo sapiens
tctgagaaaataggaaacttgagtctgttggccaatttgtctcacattgagtttcttgatttttaattaga

SEQ ID NO: 6850528 - DNA, 76 bp, Homo sapiens
agttctgtcttgctggggtaagtctgtgctagcacgcagcaagggcagcaaagaaggaaccccaagctgacgagct

SEQ ID NO: 6850529 - DNA, 85 bp, Homo sapiens
atgtacaaacttctggattttagcatgtaactgtgtgtaactgcattcatgtcaatggctacaaatcactgggaagcttctacat

SEQ ID NO: 6850530 - DNA, 75 bp, Homo sapiens
gtgggggtagggagtgggagagtcggagaggtagaagaaagccgctagatccaggcctctagcccctatctctac

SEQ ID NO: 6850531 - DNA, 68 bp, Homo sapiens
cattcttagctgacacatggatatctggaataaagatccttttccaggttcccttgcagctaagtgtg

SEQ ID NO: 6850532 - DNA, 61 bp, Homo sapiens
gcagagcagtactctcttgactctactcaacgatcagaaaattaaggagtattgattttgt

SEQ ID NO: 6850533 - DNA, 55 bp, Homo sapiens
gccaggcagctagcaacccctgtgagggggcaggcacagctggactctgcctggc

SEQ ID NO: 6850534 - DNA, 66 bp, Homo sapiens
gcagtctgaccccagaatctatgctttacaccactgtcaggtagagataatggggggaaaaagagc

SEQ ID NO: 6850535 - DNA, 59 bp, Homo sapiens
cgggcacaggtggagctgctgaacctgaggctcaggcctcagttctctgcctgtgcttg

SEQ ID NO: 6850536 - DNA, 73 bp, Homo sapiens
agatggtggaggagcggggcaagctggtgggcactcctggccttgcctcactgtccagctcgagacactatct

SEQ ID NO: 6850537 - DNA, 57 bp, Homo sapiens
aagagactaggttagcagagtctcaatattaaaaggctatggttgactctttctctt

SEQ ID NO: 6850538 - DNA, 59 bp, Homo sapiens
catgaaaaggcttttctagtgaagttccggtgatgtttcagctggagatccttgttgtg

SEQ ID NO: 6850539 - DNA, 97 bp, Homo sapiens
cagcactttgtgaatttttctgtttcacagtattcagaattcattagaacatgtttgattagaatgcacatgaggcaagcaaaattagcacagtctg

SEQ ID NO: 6850540 - DNA, 74 bp, Homo sapiens
gccagattcagcatttggacagcggctctggggcgcagtcggcccagcgagtttgccggtgaacagcctcgggc

SEQ ID NO: 6850541 - DNA, 104 bp, Homo sapiens
caggaagggagaagggttggaactggctaattgtcagttgttacccacactgggttaatttcaagtctaatggtacctgaagtcagttcctcctctccctcctg

SEQ ID NO: 6850542 - DNA, 92 bp, Homo sapiens
tggggaacactcaggaaattgagataatggcaaacagtagtatattttttgtaatctattattaaatttctagagtgtctactgttacccca

SEQ ID NO: 6850543 - DNA, 69 bp, Homo sapiens
gcccttttgggtggaagctgttatggctggaccttaaatgatcttcgtagagttgtcgcccaccctggc

SEQ ID NO: 6850544 - DNA, 58 bp, Homo sapiens
ctttgtaaggattctctgcagggctagagttctgagtccacaggtcctctttgcaaag

SEQ ID NO: 6850545 - DNA, 73 bp, Homo sapiens
ccttaagaggcaggtgttacctctggtttctgtttaaactgatggccagcaaggtagggcaatttgcctaagg

SEQ ID NO: 6850546 - DNA, 56 bp, Homo sapiens
agtccctcctccctacttctccttcttagagtgagggacatgaggcaggagaggct

SEQ ID NO: 6850547 - DNA, 76 bp, Homo sapiens
aggagccaatcaaaagcttaccttttcagtctttgttattgttcaaggatgattggtaatgacactatcttctcct

SEQ ID NO: 6850548 - DNA, 76 bp, Homo sapiens
gtaaattatccaaaaataattgcttgcagggagactttgctccaataaataggtagttattttctctgtaatttgc

SEQ ID NO: 6850549 - DNA, 57 bp, Homo sapiens
gggtgggtgggcagaaggaaggggctggagacagatcatcagccttcccacccaccc

SEQ ID NO: 6850550 - DNA, 84 bp, Homo sapiens
agtcactcgaggccgggagggagcgcgtgcagaggatggtccctggtgactgtctgcaatgttttcccatcctggccaggtgct

SEQ ID NO: 6850551 - DNA, 89 bp, Homo sapiens
ggccttgggcaagtcagcttgcctctgagtctctacaaaaatgaagagcttcagcttgcagctgtgatctgtgatttgcccccgtagct

SEQ ID NO: 6850552 - DNA, 99 bp, Homo sapiens
gaggcaggagaatggcgtgaacccaggaggcagagcttgcagtgagccgagattgtgccactgcactccagcctgggtgacagagcaagactctgcctc

SEQ ID NO: 6850553 - DNA, 66 bp, Homo sapiens
tacaaggttgattctggcatctggataaccaagaaagctgcttttaggtgtctggacaactttgta

SEQ ID NO: 6850554 - DNA, 81 bp, Homo sapiens
agattataccaacagctacaggacgggcatctgcagtcaagcatgcagaaaaggcagtgcccagtgttgtagaaataatct

SEQ ID NO: 6850555 - DNA, 56 bp, Homo sapiens
ctagctcagtggggttgagtcagggaaggttttcaggaggagccaccttgagctgg

SEQ ID NO: 6850556 - DNA, 129 bp, Homo sapiens
gttttcatgaaacagagcatagcaggctacttggagagcaggaagctgcccaagactgaagcatctactttctggatctctcaggagcctcctgctctctgattctccctgcacacctgcctcattttc

SEQ ID NO: 6850557 - DNA, 58 bp, Homo sapiens
gggctgcgaggagccttgtctgcttttacaagggcactgaacaccctcttcgctgctc

SEQ ID NO: 6850558 - DNA, 57 bp, Homo sapiens
tccagcccgactgggcctgccggggctgccccgcgcacggtaaggcccggggctggg

SEQ ID NO: 6850559 - DNA, 99 bp, Homo sapiens
atttgattctcgtattcacagttattttcccagcatttagagctgcatcaggcattgtttaggtgctggaaaatatttgttgaatgactataaataaat

SEQ ID NO: 6850560 - DNA, 81 bp, Homo sapiens
agagtgccgggaagggcatttagagactctgccgtagcgctaccattgcctgggcaggctccagagccctctcccctttct

SEQ ID NO: 6850561 - DNA, 61 bp, Homo sapiens
gctgtaggaaggaagagaggagctttctctggctcctgcttgaaactctgccttcctgagt

SEQ ID NO: 6850562 - DNA, 72 bp, Homo sapiens
ctcccagtttgttgctcctctgactgtggctgtggctgtggctgcgggtggcatgggcaagaggactggggg

SEQ ID NO: 6850563 - DNA, 82 bp, Homo sapiens
gatcagggtgctagcagggtcgacgtctggcgagggctctctttttgttgcagatggcaccttgctatgccctcaaatggtc

SEQ ID NO: 6850564 - DNA, 63 bp, Homo sapiens
attggaaactctgggaatgggatttagaacctgtgttttaacagaacctccagggattccaat

SEQ ID NO: 6850565 - DNA, 59 bp, Homo sapiens
ccatgggccaggcttgggatgacacagccctcagttacaaaccgcacttggacccttgg

SEQ ID NO: 6850566 - DNA, 70 bp, Homo sapiens
acaatatgttttggcccttatatggaataaaatatattctttttctaaaagagagtcaaaatgatattgt

SEQ ID NO: 6850567 - DNA, 67 bp, Homo sapiens
gggaaaagtctctctgtgtgggataagaaaaataatttgtgattccacgtcagcagaggaaaccccc

SEQ ID NO: 6850568 - DNA, 62 bp, Homo sapiens
tgcagaagcacaggtgacgggcctagggttgctcaccatggcctgagccagtgtcttctgca

SEQ ID NO: 6850569 - DNA, 130 bp, Homo sapiens
gggagtagagagtcagtctgagataaggcatagaagttgatcaagtagcgagttcatgtttcctggccaggtaaaggaatagaaagctgttgaaatttttgggcaatgttttaatttttctctctctctt

SEQ ID NO: 6850570 - DNA, 57 bp, Homo sapiens
agttatctcagtcctatgtgtattagtctgaataagctaggttgtgctgtggtagct

SEQ ID NO: 6850571 - DNA, 55 bp, Homo sapiens
aatggctgggtttcattttgtaaaggcatttgtttagaaactggtcttagccatt

SEQ ID NO: 6850572 - DNA, 57 bp, Homo sapiens
gccaagggggcagtgcatgggtgacctcatgggaacatccagtcctatctgtttggc

SEQ ID NO: 6850573 - DNA, 83 bp, Homo sapiens
tattagcttgctgcaaatgtgagtgcagttcttgccattaaaagtaatgcaaaaactgcacttacgcttacaccaacctgata

SEQ ID NO: 6850574 - DNA, 62 bp, Homo sapiens
gaatagtgtggtgtgtacttcctagagtaattctctgggatataatggtattacatctgttt

SEQ ID NO: 6850575 - DNA, 83 bp, Homo sapiens
ggcactgactgacctcagggcccctgttcgcctgcctgaggcacttcagggtggagggagtccctgagcacagccttcaggcc

SEQ ID NO: 6850576 - DNA, 71 bp, Homo sapiens
aggcactgctattattagacaatgtgtccttccttctaaggaaacccacgctggtggataagcagtgacct

SEQ ID NO: 6850577 - DNA, 101 bp, Homo sapiens
ttctattgtaaggatcaaatgagataatgtatgagcgtgaaagcactgtgtgatctctgaagcacagtgaattacttttattattatttttctcaatagga

SEQ ID NO: 6850578 - DNA, 89 bp, Homo sapiens
tttcttcccaagtgtttacagctttttactaatagattgaatcctatccctagctgccagttttctgtgaagagctgaaaaggaggagg

SEQ ID NO: 6850579 - DNA, 82 bp, Homo sapiens
gaaagaacaagagtagtttggttgacagctgtggcagaggagccgatagccgagttcttaggcaaacaactctttgactttc

SEQ ID NO: 6850580 - DNA, 58 bp, Homo sapiens
gtggaaggcttgaataatctgccaatgccatttagccaggttattacaatttttctac

SEQ ID NO: 6850581 - DNA, 62 bp, Homo sapiens
atctttctatggtactttctccatatcataaaaactttggagacctgtattattgggaagat

SEQ ID NO: 6850582 - DNA, 85 bp, Homo sapiens
tcagatgtagattagataggaatcgagtgggactgactcaaaggcactatttattagctcacatgccctacctaatcttagctga

SEQ ID NO: 6850583 - DNA, 79 bp, Homo sapiens
acactatgtcctttacatctgacttctttcacttagtgtggtgattttgagttcatgatgtagaatgtgtcagtagtgt

SEQ ID NO: 6850584 - DNA, 67 bp, Homo sapiens
ggagctgtgctgggtgtgcttatgatgcactctgaggcatcatcaagggaacaccaagcccatttcc

SEQ ID NO: 6850585 - DNA, 80 bp, Homo sapiens
tacaatttggtgtgagaattatcatggcatctgtaacacacatgcctgtgctatattctcacaattttgttcaggttgtg

SEQ ID NO: 6850586 - DNA, 78 bp, Homo sapiens
tttggtcaaacattttgagtggtttctgtgagaatgtttttgtatgagattagcatttaaatccatggactgactaaa

SEQ ID NO: 6850587 - DNA, 56 bp, Homo sapiens
ctctcccatggctttccctcaagagcaagaaattctttgacaagagtcaggaagag

SEQ ID NO: 6850588 - DNA, 72 bp, Homo sapiens
gtctgtatataggcaaaatgagttttgaaggccactttatgagcatctgacatttaaaactgtatgctgggc

SEQ ID NO: 6850589 - DNA, 57 bp, Homo sapiens
cagcaataaggtaagcttctccttataacctttttaggaagaagtccctttgtgctg

SEQ ID NO: 6850590 - DNA, 94 bp, Homo sapiens
catctatctgcagagttaaatagctacatgatctctaggaatttatccacacttcctgagtgtttctgtgttattcagtaaaatgcagataatg

SEQ ID NO: 6850591 - DNA, 57 bp, Homo sapiens
ccaggcctagcccctgagggtaaaggatcttgccgaccgaagggggctgagggttgg

SEQ ID NO: 6850592 - DNA, 57 bp, Homo sapiens
aggtccagctctattgaaaagatataatagactatctttagaatatagtaggactct

SEQ ID NO: 6850593 - DNA, 99 bp, Homo sapiens
tcatcgttgggtagcagcggggaggcgtgggaggatctgaggcctgcggtgggccttggtcccttctctccccgccccgaagccgcctgctcaacctga

SEQ ID NO: 6850594 - DNA, 66 bp, Homo sapiens
ctgacaagaggctaaactgggctattccatgaccagggacaaaataggcttttagcctctaagaag

SEQ ID NO: 6850595 - DNA, 62 bp, Homo sapiens
ttcctttcatttttataaggctaatgtaacaaggatgttgcagaggcaaaaatgaactcgaa

SEQ ID NO: 6850596 - DNA, 63 bp, Homo sapiens
taccagcaccatgaccttgccattgaagaatgtgtttcagttggtttgggaatggtactagtg

SEQ ID NO: 6850597 - DNA, 78 bp, Homo sapiens
tctggcattgggacaaagggtggagcctctgactttccaatcagttttttagttcctttagtcttaatcatgaccaga

SEQ ID NO: 6850598 - DNA, 89 bp, Homo sapiens
taagcaaacgacatagcctggctgggcctgatttctcatctataaaatgggaatggcaccaccgggtttgagaattgtgttgatgttta

SEQ ID NO: 6850599 - DNA, 76 bp, Homo sapiens
ttttgagatgactgaattcaatgactctgtgtggggaaaactaatctctgaatagtatattgaaagcatctaagag

SEQ ID NO: 6850600 - DNA, 76 bp, Homo sapiens
ccaaagatattagttgctgtttctacctagttatttaaataaaatggcttttaaaaatagcatttaattgagaggg

SEQ ID NO: 6850601 - DNA, 55 bp, Homo sapiens
agtgctaaaggatcacagggtcaagtagaacacaggaccatgttgcctttggcct

SEQ ID NO: 6850602 - DNA, 113 bp, Homo sapiens
gagtcactctgccaccttttggctgtacgtaggaattgcaccttttctggcattcccctcatccggagaggacctgcaactcgctctacagacctagggcagcagcatcattc

SEQ ID NO: 6850603 - DNA, 61 bp, Homo sapiens
ctattgaggacataaggactctgaagccaagttaaggtaacaattcctcatgtttcagtag

SEQ ID NO: 6850604 - DNA, 56 bp, Homo sapiens
ctgctggtgatgtctgggcatgtgtctgcttcacagtccagtgttatgatcagtag

SEQ ID NO: 6850605 - DNA, 78 bp, Homo sapiens
ttttctgtttcctcatttatctgctgggacgctaaggtcacagttagcttcccaacagataaatgaggaaacagaaaa

SEQ ID NO: 6850606 - DNA, 60 bp, Homo sapiens
atgaacaaatggaaataaccagtgggaatgaatgatccatctgattagatcctttgtcat

SEQ ID NO: 6850607 - DNA, 81 bp, Homo sapiens
ccatagctagcaggttgcatctgtcttatatatgtcccttaaaatagaagacctggatcacaacactgctgatctctgtgg

SEQ ID NO: 6850608 - DNA, 85 bp, Homo sapiens
ggtagtggcagtctgaaacactggtaaagactgccgatcctggtgtgagtcagactaggtttgattccaggctgtaccacttacc

SEQ ID NO: 6850609 - DNA, 56 bp, Homo sapiens
tcattgtaggtgatgctgtgaaccctccccaagggaggtaccaaaagcctgcatga

SEQ ID NO: 6850610 - DNA, 63 bp, Homo sapiens
ggtgttgtaaatacagcagataattgaaatttagatttcagatataggcactgttagcagccc

SEQ ID NO: 6850611 - DNA, 58 bp, Homo sapiens
ttgagcctcctctcagttttctcactagtactctagggtggcacactggggagctcgg

SEQ ID NO: 6850612 - DNA, 61 bp, Homo sapiens
atgatttaaagtcattgtgaacatccatttagacaggtatgttcagagattattgagtcat

SEQ ID NO: 6850613 - DNA, 80 bp, Homo sapiens
ctccacttaaacatgcccagtgacagggatcttactgctcctaaggttctctgttcccttgggcagtttcagagctgggg

SEQ ID NO: 6850614 - DNA, 92 bp, Homo sapiens
gtgggggttcagggactttctcaccagcatgggacttcttgaaatctgggtcaggaagtcagaatgctggggaggttttctctctgaaacac

SEQ ID NO: 6850615 - DNA, 78 bp, Homo sapiens
aagcatttgttacacacctgcctgccgtgtgctggactcaggttcaggggcagggagaggaaggtggagaagatgctt

SEQ ID NO: 6850616 - DNA, 81 bp, Homo sapiens
gattcaggcctcattacagagatataatctacattcatacatttatgttagtgattcaaatctattgggagagattgaatt

SEQ ID NO: 6850617 - DNA, 75 bp, Homo sapiens
ttggagcagaagctgaagccggatcaaaaagtccttaagaaagctgggcttgcctactcgcttcagcagctccag

SEQ ID NO: 6850618 - DNA, 84 bp, Homo sapiens
tggaggtggcaaatcattcatagtaagaagagccgcaaatgtctcatagcacttcccctcctgagctggtattgtccatctcca

SEQ ID NO: 6850619 - DNA, 66 bp, Homo sapiens
gcgcatgtgccactaagatgcacagatttccggcaacacaatgcctgtctcctgttggcacatggc

SEQ ID NO: 6850620 - DNA, 63 bp, Homo sapiens
tagtccttacttactagaataatactatagagggaaagaatattctagaaaagtatgggactg

SEQ ID NO: 6850621 - DNA, 90 bp, Homo sapiens
gccccaggctttggtgcattgtttctctacccatccctacctctcttatccccgatgtttggctcaaacgagtgtctccttggctttggc

SEQ ID NO: 6850622 - DNA, 97 bp, Homo sapiens
cccaggatgaggacccagctatatcttcctgcaacacctgtgttgccagtttattggcagcctctgcagttcaggaggacctagcttgtcccttggg

SEQ ID NO: 6850623 - DNA, 56 bp, Homo sapiens
ttctgagcaagctggacagtctgagaggcagttcctccagctcttatgttcatgaa

SEQ ID NO: 6850624 - DNA, 56 bp, Homo sapiens
caagttatcagaaggcacttttaatttctggtttgaatctgcttccctgtgacttg

SEQ ID NO: 6850625 - DNA, 84 bp, Homo sapiens
gccgctatatcagtgacctgaaatgtttttcacttgcttacaagcagtaaagaaactgattttggaggctgaaaaaatagtggc

SEQ ID NO: 6850626 - DNA, 118 bp, Homo sapiens
gaacaaataaggctggagctgtcacaggtaagggaacagcagtcactcatgttattcagagaaggagaacgtttagttatttttgtgattactgggtggctttatctttatcttgttc

SEQ ID NO: 6850627 - DNA, 56 bp, Homo sapiens
ccttcagaaagcctcccccggtgtagtctttttaaagattcatgaaggcttgaagg

SEQ ID NO: 6850628 - DNA, 116 bp, Homo sapiens
ccacagagcgctggcactgaattcagaggggtggtgctctcctggagcccgtgtggctaatccatttacaccatctcctccgagaacttcatccagcccaggagggtgtgctgtgg

SEQ ID NO: 6850629 - DNA, 89 bp, Homo sapiens
ctttgggacttgcgttgggtcagcgacaccacagcaggtgttcagccttgcgccttcagtagtgtcagctgtacacatacatcctagag

SEQ ID NO: 6850630 - DNA, 64 bp, Homo sapiens
gagattagtgtgtgtgggtttgtatgtgagagagaaacacacacatgcacccagttacactctc

SEQ ID NO: 6850631 - DNA, 73 bp, Homo sapiens
tttatccagtctaccattgatgggcattagattgattccatgtctttgctattgtgagtagtgctgcaatgaa

SEQ ID NO: 6850632 - DNA, 90 bp, Homo sapiens
cagagaagaaatgcattatgctgcggttttatatttcagtcggaagatggctggagaactagttaaacacgtgcctaggaatgttctctg

SEQ ID NO: 6850633 - DNA, 88 bp, Homo sapiens
gtgaaatacctagcttagttttgagcatctgcctgagtactactgcctgagtacttccagttgtcataaagctaggctgtttatccac

SEQ ID NO: 6850634 - DNA, 63 bp, Homo sapiens
gaggagaatttggtgaaagctttgcctggctagatctcaggctggaaatcactagattccttt

SEQ ID NO: 6850635 - DNA, 74 bp, Homo sapiens
tcagatgaggtcaggacatttttgctttgtgacagatttgggacgcagagaaaagagttcaggctttgtactga

SEQ ID NO: 6850636 - DNA, 72 bp, Homo sapiens
agaacacttctgttgataataagcttaaaagatatttactttattttgcttacatgttcatagaggatgtct

SEQ ID NO: 6850637 - DNA, 63 bp, Homo sapiens
aaccacatgaaattgcttatatttgaccatttttgactgaacaagtggtaattttatgtggtt

SEQ ID NO: 6850638 - DNA, 82 bp, Homo sapiens
ggcaaaagtgagttttgaacctaaggccctgggtatgccgcctacacaggcccccacacctggtttaatgctcactgttgct

SEQ ID NO: 6850639 - DNA, 56 bp, Homo sapiens
atgcagaatgagttcacgatctcctagaggtggaatattgttctttcgttttgcat

SEQ ID NO: 6850640 - DNA, 58 bp, Homo sapiens
tagcaactgctctattctaggactggagagctctcccgggccctggtcagagttgcta

SEQ ID NO: 6850641 - DNA, 56 bp, Homo sapiens
ctggaaagtgctgagacaattgctattggcatttgactctaaatttacttttccag

SEQ ID NO: 6850642 - DNA, 67 bp, Homo sapiens
ggtgaggggtggggtgatggtgattgggggctgaggtttaccacttcatcagtgctccattttcact

SEQ ID NO: 6850643 - DNA, 83 bp, Homo sapiens
cattagatttcaaatcatggaaacaatgcggaaaaatattgtgtgtgtgtttttgccatctccgtgagttctgacatctaatg

SEQ ID NO: 6850644 - DNA, 69 bp, Homo sapiens
ctactgctttgacagggatgacatgagccatcacatcggatcctcactgccactattgcaaagctgtgg

SEQ ID NO: 6850645 - DNA, 68 bp, Homo sapiens
ccaagagggctgttggtgccctcgagggcagtggtgggctgtgtgggcgaagacagcctttgccttgg

SEQ ID NO: 6850646 - DNA, 84 bp, Homo sapiens
atgagatgagtaaattagtggatttaacatgggggtattgaatctaatatacttagttttaatccattagactcttcagctcat

SEQ ID NO: 6850647 - DNA, 73 bp, Homo sapiens
tgagatgccattttatactcattcaatttacaaaaatcaaaaagttggagaggatgtgaatggcagagtctca

SEQ ID NO: 6850648 - DNA, 56 bp, Homo sapiens
gctaggagtaaggagaccttcatttgcctcatgcaattgactttggcacttttggc

SEQ ID NO: 6850649 - DNA, 55 bp, Homo sapiens
atgttcatatccccattctgatcagtcactgatgcaggaaacagggaatgggcgt

SEQ ID NO: 6850650 - DNA, 83 bp, Homo sapiens
ggaggtgcccacttggtaaagcacaatttcaccttcttgtaaaccacagggcagagtgaaatgctatgaatgtgggcacatcc

SEQ ID NO: 6850651 - DNA, 78 bp, Homo sapiens
gatgtttggtgtttttgaacttgtaattactgtagtaaaggttattacaatgcagaaaatagacccccaaaccatatc

SEQ ID NO: 6850652 - DNA, 78 bp, Homo sapiens
ctttcccttaacagtgtgacaggaaggcggcaacatctgtttccatgtgagtacactgtgatacattgaaagggacag

SEQ ID NO: 6850653 - DNA, 67 bp, Homo sapiens
aggtcatcagacctgccagactaggtcatttcatgaaatacatataacttacatggctctgaggcct

SEQ ID NO: 6850654 - DNA, 56 bp, Homo sapiens
ccctgatcgaggttggcaaaggtggccctgagctgcagtcagcaccatggacaggg

SEQ ID NO: 6850655 - DNA, 59 bp, Homo sapiens
ctagcatctccttagggtaaggaaggcaaaatgcccattcctgatcccagattgcttgg

SEQ ID NO: 6850656 - DNA, 69 bp, Homo sapiens
ctgagtggaggcattgtgactgctgaacttgcattggaggtgattcagcacatcgtgtcttgaaatcag

SEQ ID NO: 6850657 - DNA, 86 bp, Homo sapiens
ttagcgcttggctgccagcttttagtgggcttattacttccttaaagagaaatagagagctgtttgaaagcaggcacaggaactag

SEQ ID NO: 6850658 - DNA, 60 bp, Homo sapiens
ggcctgtttccaagcactctgtgtgattcttatgatgtctgaggctggagacaccaggcc

SEQ ID NO: 6850659 - DNA, 96 bp, Homo sapiens
catctgtccttcttctctgtgattttcgttatggcttggggagcatttatgtcagaaccaccatgctaggaactctcagggaaataaagatcagtg

SEQ ID NO: 6850660 - DNA, 59 bp, Homo sapiens
cttcatgagggttattcttgttggcatggagtgccctgcaaggcagcatccttttgagg

SEQ ID NO: 6850661 - DNA, 56 bp, Homo sapiens
ggtttccaccttgctatgagaagagtgtgaagcagttctctctaggggtggaagct

SEQ ID NO: 6850662 - DNA, 63 bp, Homo sapiens
ggaggtcctgtcctgggatggtccttcctggtggggaggggtctatcctgagatggtccttcc

SEQ ID NO: 6850663 - DNA, 63 bp, Homo sapiens
tgagacattgcctgacattttaatttatatttttctgattactaagagttgggcactgtttca

SEQ ID NO: 6850664 - DNA, 88 bp, Homo sapiens
ggaggatcacttgaacctggaaggtggaggttgcagtgagctgagatcatgccactgcactccagcctgggcaacagagtgagattcc

SEQ ID NO: 6850665 - DNA, 84 bp, Homo sapiens
cagtgataaggaaccagtagccaactccaggaactagtggtcaattctagtgcttaggagctggttcacatttttcaattgctg

SEQ ID NO: 6850666 - DNA, 57 bp, Homo sapiens
agcctggcggtcgtcggtcaggcaacagtactgcagcgtgactgggtccgtctggct

SEQ ID NO: 6850667 - DNA, 91 bp, Homo sapiens
ggcggtattagattttcattgataaattgcaatggggctgtctcgtctccacagtacccttttcactgtcacaagaaaacaaagtgccacc

SEQ ID NO: 6850668 - DNA, 61 bp, Homo sapiens
gcagacagaggaagggctccatgagctgcccagaggcttcaggaagcctttcttggtctgc

SEQ ID NO: 6850669 - DNA, 118 bp, Homo sapiens
tcaggtgatttgcccgccttggcctcccaaagtgctgagattacaggtgtagctgggcatggtggcgcaagcctgtaatcccagctactcaggaggctgaggcaggagaatcgcttga

SEQ ID NO: 6850670 - DNA, 63 bp, Homo sapiens
gttgaggctcttagattataaattttcaaagatccctgatattttatcatcacgagcttgagc

SEQ ID NO: 6850671 - DNA, 108 bp, Homo sapiens
actgcacaggaacagtgtcaacaattgttagccttgggagggatttccattatcttcaaaaataatgagacactctcgggcacatttgaggacattttcattgttagt

SEQ ID NO: 6850672 - DNA, 70 bp, Homo sapiens
gctgtcgcccaggctggagtgcaggggtgtgataatggctcactgctgccttgacctcctgggctcaagc

SEQ ID NO: 6850673 - DNA, 78 bp, Homo sapiens
tcctgatgtatatcatgtttcctaaactagactggaaacttcccctggacggggaatatgacttattttttacagtgg

SEQ ID NO: 6850674 - DNA, 89 bp, Homo sapiens
gagaaagattcccaaagagacttctgatcattgtttatgtataaattacatagataatgtgtagcagtgatcttgaaacttcttgactc

SEQ ID NO: 6850675 - DNA, 70 bp, Homo sapiens
aaattgaagtttcaaatataaaattacaggaaattaccaactttctgttttgtgaatggaattttgattt

SEQ ID NO: 6850676 - DNA, 66 bp, Homo sapiens
ccacatagcctggtgtctcagcatggagcttggtgccaagtcctgtgctagagacacctgatctgg

SEQ ID NO: 6850677 - DNA, 60 bp, Homo sapiens
gtgttatctctctgcctggattaactgcaagttttctccgcagttaatagcagagcacac

SEQ ID NO: 6850678 - DNA, 58 bp, Homo sapiens
tttatgaaccactctacaccttagtttccttctctataaaatggggatggttcatgag

SEQ ID NO: 6850679 - DNA, 58 bp, Homo sapiens
ctcttgactctggaggtcactgaaggaatcagtttctcggcttcctctgagtcaaagg

SEQ ID NO: 6850680 - DNA, 70 bp, Homo sapiens
gagtccagttagtgggcaaaatttatggttgctgctgacaccctgatgaatgtgtgttcctagctggctc

SEQ ID NO: 6850681 - DNA, 65 bp, Homo sapiens
tttagtggctgatttgctgctgacttgcgcaggaaactgaatcagcttgtgggtcagcctctgag

SEQ ID NO: 6850682 - DNA, 67 bp, Homo sapiens
tgctgctcaagctgcagcaaaagaggaagcagacactgctctcaagagtgttgcagcttgatcggta

SEQ ID NO: 6850683 - DNA, 93 bp, Homo sapiens
tttaaggatattgtgaattttacaagtgatcattttggttttaatttcaacacccagagagattgcttctaaagaacagagctcatccctaga

SEQ ID NO: 6850684 - DNA, 64 bp, Homo sapiens
ccactgcctgacttagatgacatcgatgtggcccagaagttcagcctgggtcagagtagagtgg

SEQ ID NO: 6850685 - DNA, 72 bp, Homo sapiens
acagaaggagctcaaatttactcttggttgcaccctgacactgtgatttctgggttccagcctttattctgt

SEQ ID NO: 6850686 - DNA, 60 bp, Homo sapiens
ggcaatgtagcttgtcccacatcatatgctaatagatgtgagcccaggctgctttctgcc

SEQ ID NO: 6850687 - DNA, 61 bp, Homo sapiens
cttcacaatcaccttttcggaaacagcaatgacttcatcctacaagaggtggttggggaag

SEQ ID NO: 6850688 - DNA, 62 bp, Homo sapiens
ctctttggggtgccccactggtctcaagggaatccaacacagtcaggatgcatccccaagag

SEQ ID NO: 6850689 - DNA, 57 bp, Homo sapiens
ggcgtgggaagtggggcttctggccaggctgacgcgtgaagaaccgcactcccagcc

SEQ ID NO: 6850690 - DNA, 70 bp, Homo sapiens
atacttatggccctcaagctgcataaggaccttctgttgaagttcattgtaacttgatggaatgagctat

SEQ ID NO: 6850691 - DNA, 58 bp, Homo sapiens
gagctgcttctgtgtgccgggtgcatgccaatgaaccttggcccactgaagtagcgtc

SEQ ID NO: 6850692 - DNA, 91 bp, Homo sapiens
tggggtcagattcctctgtgatgggctctgcagctgagtgcccctccctcacagcatcatctcagggcgacatcatgtgggatctgcccta

SEQ ID NO: 6850693 - DNA, 123 bp, Homo sapiens
gttcatgtggtgcttttatgtgtctatgcgttggggttatgtgtgtggaccacgtatgtgtgtcagagtttgtatgtggacacacatgtatgtcagaggagatgcatggtggcttgtgtgtgc

SEQ ID NO: 6850694 - DNA, 67 bp, Homo sapiens
tgcttgctatgtgtgccagggactgtgttaggcattgagtacacatcccatgcgcatctggcaaaca

SEQ ID NO: 6850695 - DNA, 86 bp, Homo sapiens
cttgagttattgttaattagaggtatgtgaagtgataccatactatggttttaaaatgcatttctctgattatttataaggtcaag

SEQ ID NO: 6850696 - DNA, 86 bp, Homo sapiens
gggcatctattgggtactcctgtatgttgggcttcacactaagtgcagcagttggagccatgaagacaggctgtcccatggagctt

SEQ ID NO: 6850697 - DNA, 130 bp, Homo sapiens
tggaaaagaagggctttcttttatctgtttgaaagtggtcaccttctcatttcaaggattggcctcataaattccaaggaaggacaaagaagatggctaccagcaggagggagacagcagaagaaaggaa

SEQ ID NO: 6850698 - DNA, 76 bp, Homo sapiens
cttgtccaaatgacccgatgaatcacttccttcctttttggccagtctggtctgttcatgggtcaccgaagacaag

SEQ ID NO: 6850699 - DNA, 67 bp, Homo sapiens
ggatgctacctttgtaaaatctaaaagcatagtgtatatggtttctggattcatacagatgtagtcc

SEQ ID NO: 6850700 - DNA, 77 bp, Homo sapiens
gccatgaactgaagccttgtgtggcctctctagcaacctaggtttgatggggagtgtgatgagggtttcagcagggc

SEQ ID NO: 6850701 - DNA, 68 bp, Homo sapiens
ggctcacagagagtgacttgttgctgtgtccttacatggtgaaaggcataaaagggctctctggggtc

SEQ ID NO: 6850702 - DNA, 59 bp, Homo sapiens
caaggtgcagcgttgtcaagctgaatcctaataatgtgcgcaacggaccctgccccttg

SEQ ID NO: 6850703 - DNA, 58 bp, Homo sapiens
tagatacaggcaagattatgaaccaaaattaatgttattaatattttgcttgtattta

SEQ ID NO: 6850704 - DNA, 71 bp, Homo sapiens
gggagtcatggaggtgtggcatggtgctcagatgtgatctgcacctacagccacatttaccacaggcttcc

SEQ ID NO: 6850705 - DNA, 62 bp, Homo sapiens
aggagcgagtggcgggggctcaccgggcgccaggtgcttgctcctaggacgccgctgctcct

SEQ ID NO: 6850706 - DNA, 57 bp, Homo sapiens
ggaaggagggcggcaatgatgatcatagttgataaatactgacactgtcttcattcc

SEQ ID NO: 6850707 - DNA, 57 bp, Homo sapiens
gaccatgttcactttctcagaaggcctccctgcccctctgggagtgggaaaatggtc

SEQ ID NO: 6850708 - DNA, 75 bp, Homo sapiens
atgcagtagctttaaagactggctgatatctggaaaacagaaaagatccttccaggcttctgaagatagctgtgt

SEQ ID NO: 6850709 - DNA, 77 bp, Homo sapiens
ggaagtagagattcattaggagacattcagtcagctactgttggctgacctcatagatgtagtctcctacaacttcc

SEQ ID NO: 6850710 - DNA, 63 bp, Homo sapiens
taggaaaagtgatgtgaaaatgccttccaaatggaaagcactgtacaaatgtcactttccctg

SEQ ID NO: 6850711 - DNA, 78 bp, Homo sapiens
aggagacagggctagagtggtcaggagaggctcgatggatggcctagagcttcagcagatccctaagtcctgtttcct

SEQ ID NO: 6850712 - DNA, 85 bp, Homo sapiens
tcctgtctcagcctcttgagtaccttggattacaggtgtgcaccaccatacctggctaatttttgtgttttgggtggagacaggg

SEQ ID NO: 6850713 - DNA, 82 bp, Homo sapiens
cagagagatgttaatggctttgctcaagtttagccagctggtaagtggcaaagctggggtgtgagccattcatattattgtg

SEQ ID NO: 6850714 - DNA, 57 bp, Homo sapiens
tctgcatccctcattgaacggctaagaaaacaaggctcacaatactaagggggcaga

SEQ ID NO: 6850715 - DNA, 102 bp, Homo sapiens
cgtcagaattgcactgcggtaatttatttcctgccagtacacaagggctgagggtggaggtggggctggaagatgggtactgccgcaagagcagtgatgatg

SEQ ID NO: 6850716 - DNA, 59 bp, Homo sapiens
gcatgctcagtagcctagttgtttactacctgtaataattggctaaccctgggaagggc

SEQ ID NO: 6850717 - DNA, 72 bp, Homo sapiens
gcctgtttgtttgcaaaggagccaagtagatgttcctaaagctattcgaactgctttgcagaccgagcaggt

SEQ ID NO: 6850718 - DNA, 55 bp, Homo sapiens
tcgaatgtgactgcagggggagtgagaccacaagccagacctgcacccacttcga

SEQ ID NO: 6850719 - DNA, 59 bp, Homo sapiens
caatcagtaaccggatcatggttccagaggcttaactgacaagtgatttttgctgattg

SEQ ID NO: 6850720 - DNA, 88 bp, Homo sapiens
ctggagttcctctcttgtaaaacaaacacccaaaggcaaggaaaaacaccgtaaagttctttgtatgtatgtttcaaaggaatgccag

SEQ ID NO: 6850721 - DNA, 56 bp, Homo sapiens
gggtcaggggcctgcaaggtagaatttgtgtggtatcagtaagcatccctgaaccc

SEQ ID NO: 6850722 - DNA, 63 bp, Homo sapiens
actatttccagcagtaagaagacagactgggtccttagcttgcttctttcctctgccaatggt

SEQ ID NO: 6850723 - DNA, 71 bp, Homo sapiens
gttgatatttgcagagtgtaccatgttgcaggaggcacattagccctctgtggtacaacttgaatgataac

SEQ ID NO: 6850724 - DNA, 82 bp, Homo sapiens
ggcatggatgctgggtagcattttagccaattttcttcaaaccctggttggaaatttattcatcattcattcaaaaagtgcc

SEQ ID NO: 6850725 - DNA, 128 bp, Homo sapiens
gtgttccagcctctcctgcgcctccagatacggctgcttcctgggtctgggtgtctgaggggacgtccctcaaggttcccacccagctcagcctgtcaggagccgcaccctgcgaggcctgagaccac

SEQ ID NO: 6850726 - DNA, 73 bp, Homo sapiens
aggtaatgtttcacaagcaacgggtaagggagtccctaatttctgggtttggaaactggtagaatgattacct

SEQ ID NO: 6850727 - DNA, 79 bp, Homo sapiens
tacaaatgaagagggcaacttctgagctgaactttgtctctctctagttcagaaagcacaggatcctcaatcatttgta

SEQ ID NO: 6850728 - DNA, 57 bp, Homo sapiens
ggccacctctcagggccttggtttccacctgtgtagcataggtcctgggaggctgtc

SEQ ID NO: 6850729 - DNA, 103 bp, Homo sapiens
gcaagtagtggtgtttaagaagtatataaggttcagggactggctttccttaattgatactatcttttctgttaaagtccctgccttaattcccattactagc

SEQ ID NO: 6850730 - DNA, 94 bp, Homo sapiens
gaggcaggattgcgtgagcccaggagtttgatgctgcagtgagctaggatggtgccactgcactccagcctgggtaacagccagaccctgtctc

SEQ ID NO: 6850731 - DNA, 76 bp, Homo sapiens
tgtattgtattgggatgagctctaagtctaatgattggtgtgcttatgagaagagagacatttggatacagaaaca

SEQ ID NO: 6850732 - DNA, 82 bp, Homo sapiens
gggctgcctggaaagaggaaggaagcctggcatctctggacacatgacccccaggctcttttttggtgctttccgtgctcct

SEQ ID NO: 6850733 - DNA, 71 bp, Homo sapiens
gtgaaataaagctttgcattcaaactgatgtcagccaatcggaacacagtagagagtgctgcccatttcat

SEQ ID NO: 6850734 - DNA, 72 bp, Homo sapiens
taggcatctcagagatatagtccctgcttccgtgaatggggaaactgaggcagagagtcctgcaggagtctg

SEQ ID NO: 6850735 - DNA, 70 bp, Homo sapiens
tcttgccttcaaattctcttagctgaatatgtattcatagtattaattgaagggtgtttggagaaaaaga

SEQ ID NO: 6850736 - DNA, 57 bp, Homo sapiens
cacaattagcagctctttatttgcagttttcatacatatatggaggtgctgtttgtg

SEQ ID NO: 6850737 - DNA, 100 bp, Homo sapiens
agaagttaattagtggaagagtaaggttagaagcagaaggaaggtggcttccctgagccagcctgatctcttcttgccctactttcatttgggtacttct

SEQ ID NO: 6850738 - DNA, 93 bp, Homo sapiens
gactggaaattttacagaatcaatgagggagggagaactttatttaggatataaattttacttccctcagtgtagctgatactcactctagtt

SEQ ID NO: 6850739 - DNA, 73 bp, Homo sapiens
gaggcggaggttgcagtgagccgaggttgggccactgcactccagcctgggcaacagagcaaaactctttctc

SEQ ID NO: 6850740 - DNA, 98 bp, Homo sapiens
ccaccttggctccaggacccagcttgacttctcatgtgacttttccctctggtgctcagaaattggagtctgaggagtaaggcctggggaggaggtgg

SEQ ID NO: 6850741 - DNA, 60 bp, Homo sapiens
gggctcttaagcagagacagaccaatcaataggttggcactactccttgcttaattgcct

SEQ ID NO: 6850742 - DNA, 68 bp, Homo sapiens
tcttcttctggtttatgtggcaaggactatcataattaatttttcctctgaacattgatgggagaaga

SEQ ID NO: 6850743 - DNA, 86 bp, Homo sapiens
cagaccccagcccatttctcaggactccatgggcgcgcacaggacgtgctctcgtccctgccagggaagtggctcctggcggtctg

SEQ ID NO: 6850744 - DNA, 100 bp, Homo sapiens
ccctatcccctccccaggtggcttcttggagacatacgaggctctgtgtgactacaatggcttccctttccgagaggagattcagtgggtgagggtaggg

SEQ ID NO: 6850745 - DNA, 86 bp, Homo sapiens
agcttgttcctgtaatgtagagtgtgttttattgggagtttgccatataaatttttaaagagatgctgtgcataaagaaacaagtt

SEQ ID NO: 6850746 - DNA, 77 bp, Homo sapiens
tggattagtctatgctaagtgtcagcagcggtgagggaagttcagggctgtctgagaacatggtggaagagtatcta

SEQ ID NO: 6850747 - DNA, 72 bp, Homo sapiens
ttatatttcatcagccctgtgagattagaacagcagatattgttatttccattttatgggtgtgaaatatag

SEQ ID NO: 6850748 - DNA, 57 bp, Homo sapiens
catggagtgtttgtttggaggggttaatgtcaatttcttcaattcaacactgccatg

SEQ ID NO: 6850749 - DNA, 85 bp, Homo sapiens
tgcatgtttaacactctgtaagctaccagctgacatgaacacatttttagctcatcaggtgtatatagtggtgttgcttcatgca

SEQ ID NO: 6850750 - DNA, 101 bp, Homo sapiens
cttcacccgctgactctggtctcggcgatgacagtgagttccttcttggcgccttcaatgggagggattgtcgtgcacttggggaggagttggctgtggag

SEQ ID NO: 6850751 - DNA, 86 bp, Homo sapiens
ctttaaacaaggtaacctcattgtttctgcttttcatgatggtctcatcaaggaaggggtaggaataatcatagcctgttgcaaag

SEQ ID NO: 6850752 - DNA, 58 bp, Homo sapiens
ttggttctggaggcaactaacctagttcatgagtagcatgagcttgcctaagctctaa

SEQ ID NO: 6850753 - DNA, 57 bp, Homo sapiens
ctggggcattgggagaggcctgggactctggacctggtctgtctttcttgtccccag

SEQ ID NO: 6850754 - DNA, 75 bp, Homo sapiens
gttaacatgggtgcactttgttgtcattgatgccttaggttagtatcactgagacaactgtgtttctaactggac

SEQ ID NO: 6850755 - DNA, 80 bp, Homo sapiens
cagcttccgtgttgctgagcacagacttgggggaaacgaagatcccagagccaatgatggtgcccacgatgatggagatg

SEQ ID NO: 6850756 - DNA, 58 bp, Homo sapiens
tttcatttttctgcgagtagcatgtgtgtattacactgcttcagtcagagaaattaaa

SEQ ID NO: 6850757 - DNA, 62 bp, Homo sapiens
ttggggttacggtgcatgccctccatcatcttgttaggaggagggagcatgttagctttcga

SEQ ID NO: 6850758 - DNA, 64 bp, Homo sapiens
ttggttcagaccaggtccaaagctactgtcagggcagctgacagccctgtgcctggttccccaa

SEQ ID NO: 6850759 - DNA, 69 bp, Homo sapiens
gacggaagccatctttgttccccaccaggctaagcgattttccggagggggagtaagatcccttgcgtc

SEQ ID NO: 6850760 - DNA, 59 bp, Homo sapiens
gttcactgctttcttagtactctctaatgctacagtctgtgatacaggagagcaggaac

SEQ ID NO: 6850761 - DNA, 64 bp, Homo sapiens
tgatatctgcctgtactataacgtagcatttgaggagtgctgtgttaaatacaagcatgaatca

SEQ ID NO: 6850762 - DNA, 80 bp, Homo sapiens
gaaaaggacaccaggatctgaatggttagcattctccattgacaagcatgttttagttctgtcttgcatgtgttttcttc

SEQ ID NO: 6850763 - DNA, 94 bp, Homo sapiens
ggcaaattctatcttcccctgcaagacctgagacacacccacttctactgagagacactgggtggcaggctggcattggcaagatggttctgcc

SEQ ID NO: 6850764 - DNA, 90 bp, Homo sapiens
gtttttactcagaccttccacatagtgaataacattttttcctttacaggtttaccttagattgtagctatgtgggaggtgagattaaac

SEQ ID NO: 6850765 - DNA, 75 bp, Homo sapiens
cattacttaacatcctgcatttttcttcagacttgattttcaaagaaggagaaacgcaagatgctaagttaaatg

SEQ ID NO: 6850766 - DNA, 125 bp, Homo sapiens
ttgccaaaccaagtgttgtgtgtattgatttgcctccctctctgccactggacattgctgctgtgtttctgacatgacggccatccgtgacacagaggcaggaaatccatgaggcatggtggcaa

SEQ ID NO: 6850767 - DNA, 65 bp, Homo sapiens
gaataagaggtctagtgggtaactaacacaagtgtttaaatagcttaaactagaccttaatattt

SEQ ID NO: 6850768 - DNA, 70 bp, Homo sapiens
ggaaatgtcagaggaacatattgaaagaatctgcatccttgatgtcaatcaacccttcctccatatttcc

SEQ ID NO: 6850769 - DNA, 68 bp, Homo sapiens
caaacatagccctttcttgtttaactgcattttgttcaatgttttaagctctagaaggggaatctttg

SEQ ID NO: 6850770 - DNA, 130 bp, Homo sapiens
ctagggagaattacgatatcctacccagggagaattaaagtgtcttacccagggagaattacggagtcctacccagggagagttactgcggtatcctacccagggagaattactatggtgtccttcctag

SEQ ID NO: 6850771 - DNA, 67 bp, Homo sapiens
cttccagtgtggaggtgaccaactgtcatgtcccccagattcagtgggtctacttccatcactgaag

SEQ ID NO: 6850772 - DNA, 92 bp, Homo sapiens
aacaacagttccacatgtgatatggccaatcgggtggacgccagccataaaggatgagtgctgcctaatggcctgtcccagtgctgtgtgtt

SEQ ID NO: 6850773 - DNA, 88 bp, Homo sapiens
ggcaagtatggcagatgggttgagaacacatgctttgcaaactgcagcagtatagtgctaacccatccagaaataacccattccttcc

SEQ ID NO: 6850774 - DNA, 68 bp, Homo sapiens
tgagcaggggagagcgaatgtgtgtccacttacatgtctgtgtttgcatgttcctcctcttcagttca

SEQ ID NO: 6850775 - DNA, 79 bp, Homo sapiens
tgtgatgcttttctagtagaaaccaactggcatgtgagaaatctgaccatcctgaaaccttcatgctagagaggccaca

SEQ ID NO: 6850776 - DNA, 111 bp, Homo sapiens
ccttctaggtgttcatcatcctgaggactggcagtggcagcagaaagagggctcctctttcccagtagctctcccagaattcaaggattgactcaaactagcccagttagg

SEQ ID NO: 6850777 - DNA, 68 bp, Homo sapiens
gtaagcatgcactccaaacagcttcagaatggaaaaggactgaagaagaaattgcaggcgatgctgac

SEQ ID NO: 6850778 - DNA, 73 bp, Homo sapiens
tctgggcccctccctgcctccgcagccccacccttcccacccctgggtggcccggaaaggactagggctcaga

SEQ ID NO: 6850779 - DNA, 60 bp, Homo sapiens
acaaggctcactgtagagtaattgtaacgagagacagttaatgtttacagtgatcttagt

SEQ ID NO: 6850780 - DNA, 82 bp, Homo sapiens
agttctagggtacctatgcacaacatgcaggtttgttacatacatatacatgtgccatgttggtgtgctgcacccattaact

SEQ ID NO: 6850781 - DNA, 90 bp, Homo sapiens
cttcaggagagtaggagagactgaagtagtcattgtcattacctcagcaggttaatataatagcttttcactcgcatttaaatccagagg

SEQ ID NO: 6850782 - DNA, 79 bp, Homo sapiens
gaatcctgactaatacacgagtcttttagagatattaccggattctctttgaactctgtgtattaactttacagggttt

SEQ ID NO: 6850783 - DNA, 59 bp, Homo sapiens
tagaccattctatttcctatgcggtggtgatattcaaggcaggggatagaaatggtctg

SEQ ID NO: 6850784 - DNA, 61 bp, Homo sapiens
tccatggagcattcaggtttcccttttgactgacaagaactaaaaagaatgctccagtggg

SEQ ID NO: 6850785 - DNA, 68 bp, Homo sapiens
gaatattcagaaaagtgtctgacgtggagcaagcactcagtaacatgcagatatttttattgtggttt

SEQ ID NO: 6850786 - DNA, 85 bp, Homo sapiens
gactggatgtttagagaaatattgggactcagagcttcaatactgaaaatctggtaatttgaatgtgtgtatgtatattacagtc

SEQ ID NO: 6850787 - DNA, 97 bp, Homo sapiens
ccaaaatataggaaagttagaacaatattctccctacaaacagtgcatagtccagctgaaatgtggggaattatatagtaatggttcctgtgaatgg

SEQ ID NO: 6850788 - DNA, 68 bp, Homo sapiens
attttgagctcctattatgtgcccagtgtggcattagacactgtggggaaataataggagataaaaat

SEQ ID NO: 6850789 - DNA, 60 bp, Homo sapiens
ctggggtgacagagtgagaccttgtcttcaaaaaagaaggcaagttaacctttcaaccag

SEQ ID NO: 6850790 - DNA, 77 bp, Homo sapiens
cccactccagcattcttgaggtgtggactcagagcccccaggcactcgggtttgcaatcaactgtgagatgtttggg

SEQ ID NO: 6850791 - DNA, 61 bp, Homo sapiens
ctggaaactggtgcttctgtgtgcagctgctggaaacagcacctgggctggaagaccccag

SEQ ID NO: 6850792 - DNA, 83 bp, Homo sapiens
aatacatctggtgagaagccgttgccagtcccagcccctgctttgagtctggtattggtctttaatctctcattctgtgtgtt

SEQ ID NO: 6850793 - DNA, 85 bp, Homo sapiens
ctgttaaaagcactgccatcctgggtgaatatggacttaaacatttcaaacttaaaaaggatcaggacagatgttttacaagcag

SEQ ID NO: 6850794 - DNA, 130 bp, Homo sapiens
gtcttgaagactttctaactagaattagaattgatgagttttgggggatgttagataaggtatgtttggtttatatctctaatactgctgtaatttaaacactaagatgtagcaatgaagttgccaagat

SEQ ID NO: 6850795 - DNA, 66 bp, Homo sapiens
tgaggagaatcatttacagaatgatttattacagaatcatttgctgttcatgattcagcaaactca

SEQ ID NO: 6850796 - DNA, 67 bp, Homo sapiens
ggatgaatgaaggagtgtgggagtcatgcgtgctggaagcacatatctttccctctcctgaacatcc

SEQ ID NO: 6850797 - DNA, 59 bp, Homo sapiens
ggtgtatggatatgtcatggtggccagaactcttgggcatcatcacctgctatacgatc

SEQ ID NO: 6850798 - DNA, 60 bp, Homo sapiens
gctcaaaatggttcagaattgtggttgctcatcagctgttcctttcagaagcattttggc

SEQ ID NO: 6850799 - DNA, 109 bp, Homo sapiens
tgttttatacagattgatgatatgttatgattcataaactttggaagtctcaaacattttgtgttgaatattttaagagttttgtttctatcatcaaatgtaaaaaata

SEQ ID NO: 6850800 - DNA, 80 bp, Homo sapiens
aaaagattaatgatgttgtagattgtgtgctgacaaattggagcctccaatgcacataactgaccacatctaaaactttt

SEQ ID NO: 6850801 - DNA, 56 bp, Homo sapiens
ctagtttaaagcagctgaaagggctctttgtgcctctctccttgactttgagctgg

SEQ ID NO: 6850802 - DNA, 86 bp, Homo sapiens
ggactgatgatgctgttagctataaaacctgtcaggggagaagaatgttccctgctgcagtgtttgctgaagttacatcaatgtct

SEQ ID NO: 6850803 - DNA, 90 bp, Homo sapiens
tgtaagcacagagatagcacaagcaactactgaagttagcaaaattgaggtgcagaactcggtgagggcttagctaactgttagcataca

SEQ ID NO: 6850804 - DNA, 60 bp, Homo sapiens
gatgcacagccatgttaatgtgaaggaaatgatgtgcctatttacgtgtttctgtgtatc

SEQ ID NO: 6850805 - DNA, 94 bp, Homo sapiens
ccaacatcttcttcatgattgacagcttcgaggaggtgagctctgcacagggcctctctccttagcttccccttctcgtgagatgggtgttagg

SEQ ID NO: 6850806 - DNA, 58 bp, Homo sapiens
agtgatggcatatatagatgtgggcctgggaggaatagtctgtaattatgccatcact

SEQ ID NO: 6850807 - DNA, 64 bp, Homo sapiens
ggagtcaactgactggttcatgtaattcaacctccttcctctgctgcaaccttcccttggctcc

SEQ ID NO: 6850808 - DNA, 76 bp, Homo sapiens
attcactggaaaaactgcccagtcagtaagcatttattaagtgcttccgtgtagggcagcttttgacctatcgagt

SEQ ID NO: 6850809 - DNA, 58 bp, Homo sapiens
agatatgagaatatagaggcccatgaacactgaggcgctctaaggaaatctcatgttt

SEQ ID NO: 6850810 - DNA, 77 bp, Homo sapiens
gtctctctcctcttgctccagaaaagccaatgaattgtgttacttggtttagtttggagggaagtggggagtagagc

SEQ ID NO: 6850811 - DNA, 55 bp, Homo sapiens
gtttctaccttcctgataactggtgaattcaccatggtaacagttgagtagaaac

SEQ ID NO: 6850812 - DNA, 99 bp, Homo sapiens
gaactagcggagagtgcatgaatcaaagaggtaaaaacgttccctccccagggaggctgccagctgtctcattgattcagtgctgctcttggctgattc

SEQ ID NO: 6850813 - DNA, 58 bp, Homo sapiens
gctaagtttcaaatgcttgtgactcctccaggtagggttgtacagacatgaaacttgc

SEQ ID NO: 6850814 - DNA, 65 bp, Homo sapiens
tgatggcctactttccaggcaggaatgatattaaaaatatttagcaacctgtgacagaggcatca

SEQ ID NO: 6850815 - DNA, 64 bp, Homo sapiens
ttgggtgctctgcttccctgcactcacagatatttcccagggtcagggaggcagtgtcacctga

SEQ ID NO: 6850816 - DNA, 60 bp, Homo sapiens
aaaggctatgatagtccagtggggaattcatatctaactgggaactgagcatggtccttt

SEQ ID NO: 6850817 - DNA, 57 bp, Homo sapiens
gggcagtgttgctctcaaagtcccatctgacaggacagaggctcttcctcactgccc

SEQ ID NO: 6850818 - DNA, 60 bp, Homo sapiens
ccctcctttcttgcttagtggctcatcacactttgatggagatgaacaatgaggggaggg

SEQ ID NO: 6850819 - DNA, 106 bp, Homo sapiens
aggaataagatcatcggaaattatcatagaatctttgtaaaacacttggaaaatccatggtgttttactgggtgctcagatgatgctcaatattcattaagttcct

SEQ ID NO: 6850820 - DNA, 72 bp, Homo sapiens
ttctcagatgccacattctgttgaggctgggtcactccgagtggctccagggatagggtgagggtctgggaa

SEQ ID NO: 6850821 - DNA, 72 bp, Homo sapiens
caggcgtgaaggaggacacccaggactgggcgccttggccccccgctccttacctgtccaacctcatctctg

SEQ ID NO: 6850822 - DNA, 55 bp, Homo sapiens
tcagataaataaacctgccagagagacaaagcttcttgtggtttagattatctga

SEQ ID NO: 6850823 - DNA, 55 bp, Homo sapiens
tgaggctgtggcaccgtgaccacatgcatgagcaaaatggatgcctcatgcctca

SEQ ID NO: 6850824 - DNA, 81 bp, Homo sapiens
gggccacgccagaggcctcaggcccagccctgccagctcagctgcagggccaccagggagtctcaggcctcctgtgggcct

SEQ ID NO: 6850825 - DNA, 58 bp, Homo sapiens
tgtgtgtgtagataagtatatgatgtctttctgggactatatgcttaatctcactaca

SEQ ID NO: 6850826 - DNA, 61 bp, Homo sapiens
cactgtgtaaatctgaaagtctagcaatgctgctaggttttagtaagatgtataatcagtg

SEQ ID NO: 6850827 - DNA, 56 bp, Homo sapiens
tgaggatggaatgctgtgcaagtctctaataggcaaattgccagcttctaatccca

SEQ ID NO: 6850828 - DNA, 68 bp, Homo sapiens
ttaaaacagctgcaaaaggttgcctggccacagagaatgcgtgctgcagcattatgtagctgttttag

SEQ ID NO: 6850829 - DNA, 71 bp, Homo sapiens
ttggtgggggctcggacccaacagcatattattcttggaaaagacttgctctgggtcctgggcctcctcaa

SEQ ID NO: 6850830 - DNA, 76 bp, Homo sapiens
aggttactcacctgtgtgagatgcaacccaaggaaagagcactcactccttggagctctccaagggatggtgactt

SEQ ID NO: 6850831 - DNA, 81 bp, Homo sapiens
gtgaatgtcaacaggctttctaaggcaaaagtggtatttgaatctggttttctgttttatgatgtcgttgttggtatttat

SEQ ID NO: 6850832 - DNA, 63 bp, Homo sapiens
gggaaacgatgtagaagatgtattgggtctgtattccatgaaatcattttctcattgtgcccc

SEQ ID NO: 6850833 - DNA, 70 bp, Homo sapiens
tccccagagcattttgtgcacacgtggagttccgcgcagggacaggcgccgggcacagagtggcttggga

SEQ ID NO: 6850834 - DNA, 81 bp, Homo sapiens
gcagcaccagcccccacttgttctggggggcagtcaggaaggatctggtcagttcctgatcccccaggacaaaggtgctgc

SEQ ID NO: 6850835 - DNA, 69 bp, Homo sapiens
ggtctgggacccacactctgagaaatgctgaggcatagccatttgcactcaaaagtatggacctagacc

SEQ ID NO: 6850836 - DNA, 64 bp, Homo sapiens
aggctggacccgacacctgcccacgagaagcagcatacctgggactggagggacttcctggcct

SEQ ID NO: 6850837 - DNA, 118 bp, Homo sapiens
ctgaagtatagtgcagggtgtcaggcactgtggcggcttccatgttgctgctggtcagttggttcacctgcttagcatggggcagctcctggaaaagcacctggatctccttcttcag

SEQ ID NO: 6850838 - DNA, 71 bp, Homo sapiens
taccagggggaaattgctcttaaagagaagctgcaaaatgtctataggaaaacgtgattttctcactggta

SEQ ID NO: 6850839 - DNA, 55 bp, Homo sapiens
tgccgtgaccacttcaaattctagatcctgcttggtcctgaagcagtggttggta

SEQ ID NO: 6850840 - DNA, 77 bp, Homo sapiens
ggtctttcccaggctcacatagctggaaaggggaaggggccttctccttccagaggcgtgacaccctggagaaggct

SEQ ID NO: 6850841 - DNA, 64 bp, Homo sapiens
ggactggaggagcggtgcatgtgggggctgaggcacagcctgcactcaaacactctcttcttcc

SEQ ID NO: 6850842 - DNA, 55 bp, Homo sapiens
gcagcctcgcgctcagtcatgttggggctaaacctgtgcctggagaagaggctgt

SEQ ID NO: 6850843 - DNA, 58 bp, Homo sapiens
ggggagagtttcgcaggcagggacaggaaaggtcctggagtgctgcccaactctcccc

SEQ ID NO: 6850844 - DNA, 55 bp, Homo sapiens
ttgacagctacggagcagctgtctactccggcaaatgcgtctaatgtgctgtgaa

SEQ ID NO: 6850845 - DNA, 108 bp, Homo sapiens
gtgtaccctgtattgagataatttatgaatatctatttccacaaccagatacaaactcctggaaggaaggagccatatcatatccatctttgtatccagaggtaacac

SEQ ID NO: 6850846 - DNA, 60 bp, Homo sapiens
gctagcccaggtcctgagcccagatggggaaactgtctgggcacctggcctgggaagagc

SEQ ID NO: 6850847 - DNA, 73 bp, Homo sapiens
gtagtctccactgtagaagttaattgatgagtagtagcctacaatcaggctctagcttctccaggaacactac

SEQ ID NO: 6850848 - DNA, 59 bp, Homo sapiens
cgcccacctccaggcggatgctttccgtggaggccagcagctcctggaggtgagaggcg

SEQ ID NO: 6850849 - DNA, 57 bp, Homo sapiens
gctggctggagtgagctaccctgtgctctcactcccagggttctaccccagaccagc

SEQ ID NO: 6850850 - DNA, 71 bp, Homo sapiens
tcagagatagacggcctcttaattaaaacaattggaaagaccaatttgtaatgagaagctttgtttcctga

SEQ ID NO: 6850851 - DNA, 60 bp, Homo sapiens
tcaccccctcttcccctcattgcttagacacagctaagcagtgactctcagaggcagtgg

SEQ ID NO: 6850852 - DNA, 58 bp, Homo sapiens
atcataaagtgctatctgattggatttcacccatcttttcagaatttgcctctgtgat

SEQ ID NO: 6850853 - DNA, 97 bp, Homo sapiens
ggagcctgggtgggaactgctttagagctgagcctcagatcagatcacagcactggtgccactgagttttctttgggtgttccacaccctgagctcc

SEQ ID NO: 6850854 - DNA, 59 bp, Homo sapiens
cacctgggctaaactatgcagggctttgtaggccatggtaaggtgttaggctaagggtg

SEQ ID NO: 6850855 - DNA, 60 bp, Homo sapiens
gccagatgccgtaaagatgggcatgaacaatatcccttctgtctgaatatggcttctggc

SEQ ID NO: 6850856 - DNA, 65 bp, Homo sapiens
ggatggtcaggctttaacatctgtttgggttgccttgaagtcatgagttcaaaatgcctgcctcc

SEQ ID NO: 6850857 - DNA, 85 bp, Homo sapiens
gtgggattccaaggtcagggttctttcagttaagttgtcattgttgtagtaattgtgcaatctgtaagtccctggcctatcctgc

SEQ ID NO: 6850858 - DNA, 125 bp, Homo sapiens
tggatggatttcactcataaagtttcttttatggaattctaagggatttgctggaagagatttctatgtgaaggtcaaaaggagtaaattatttagcttccagaagaggcagtggttactattca

SEQ ID NO: 6850859 - DNA, 55 bp, Homo sapiens
ttcattccttgttgtctgaaatgtcaaatcattttaccagaatagcaggggagag

SEQ ID NO: 6850860 - DNA, 61 bp, Homo sapiens
gctgagtgtactctcaagatgcatttctctcaggaagtgtgttttcagtgtacttaaaagc

SEQ ID NO: 6850861 - DNA, 81 bp, Homo sapiens
ttttcctgtcttgttctgtgcttcttacattgtatagcataatgtttaaatgtaaagttgggcacaaatggtacctgaaag

SEQ ID NO: 6850862 - DNA, 59 bp, Homo sapiens
tcacagagaggttaagcagttgcaaacatgaaggcaactagttcctgttctcctgctga

SEQ ID NO: 6850863 - DNA, 67 bp, Homo sapiens
gcacttacattcacatgcattggcaaaagtgtaggtgaggccacctactgggtatgctgtgaagtgc

SEQ ID NO: 6850864 - DNA, 70 bp, Homo sapiens
cagccagcagggagccaccagataattacacagtatttgtgcggttccaggaagcttcccgtgcaggttg

SEQ ID NO: 6850865 - DNA, 63 bp, Homo sapiens
gccttgtattcactgtaactcagcaatagaaagctctgtttggtgggagcagggaagcaaggt

SEQ ID NO: 6850866 - DNA, 59 bp, Homo sapiens
actcatttcctgcttgattttgtgatttagccatcaatgtcagctggtaggaaatgtgt

SEQ ID NO: 6850867 - DNA, 57 bp, Homo sapiens
tagtattcagcttctcaggcaaaggatgtataaactaggcaggataggctgagacta

SEQ ID NO: 6850868 - DNA, 63 bp, Homo sapiens
cccacagctggggctctagcgtgatgtataacctttgcttcctatgctgctgtccttgcaggg

SEQ ID NO: 6850869 - DNA, 99 bp, Homo sapiens
ctttgcaaagagagaaaaatagaacccacaaaggatttcagctccaccttgaaatgttgaatgggctggggttctgtgtagggctttatttgagcaaag

SEQ ID NO: 6850870 - DNA, 58 bp, Homo sapiens
ctgtcagggggcctggccatcaggctgggaaggtgaggggagtcaggcctgtgtgcag

SEQ ID NO: 6850871 - DNA, 61 bp, Homo sapiens
ccagagtctgcagctactgtggtgttggggatgagctgccagcaccaaatgcaggctctgg

SEQ ID NO: 6850872 - DNA, 63 bp, Homo sapiens
tctccatctgtcattcttgtccatggcaaatgtggacatgtcattcggaatgtagcatggagg

SEQ ID NO: 6850873 - DNA, 68 bp, Homo sapiens
gttcatgcctgtatttctgatctatacctatttacctggtacgatctgatattatgtcagatatgagc

SEQ ID NO: 6850874 - DNA, 73 bp, Homo sapiens
gtcctggctactcacctgagggtgtagctcgcaaaggtgggaatctggtgctggcttttccttcaggcaggat

SEQ ID NO: 6850875 - DNA, 58 bp, Homo sapiens
tgtacatgtgtctgtatatctttggagaggcttacatgattatggagaaatatgtaca

SEQ ID NO: 6850876 - DNA, 68 bp, Homo sapiens
gttggttccccagcatccattctgctacagccctgttgagtagcagcagtgtggtttggggaattgac

SEQ ID NO: 6850877 - DNA, 72 bp, Homo sapiens
ctcatttttctactgcccacattgtaccttttctatctgtgcaaaggtcactgtttgcagtgaagagaagag

SEQ ID NO: 6850878 - DNA, 78 bp, Homo sapiens
catcaggccctgatcccaatgtattttaatcaccttaaggaaaagaactgcatgggattaatctctgggtcaatggtg

SEQ ID NO: 6850879 - DNA, 90 bp, Homo sapiens
gttctaccttgagggtcctgcagctgcagacctggggaggagctaatgttctagtttgagtgtcatgcagctgcagacccggggaggagc

SEQ ID NO: 6850880 - DNA, 129 bp, Homo sapiens
aggctcagagctagcccttctggccccaccggtctcatctgtccccacatcagtctgaggccctgcttggaacctcaggccagggggcggccagggacgcggggtcccagccaggcgggctcccatgct

SEQ ID NO: 6850881 - DNA, 119 bp, Homo sapiens
ggcaccatcttggaagcagagagaacccttaccagattctgaatcggctgatgccttaatcttaggcttcccagcttttaggactgtgagaaataaatttcttttgtttacaaagtgtc

SEQ ID NO: 6850882 - DNA, 130 bp, Homo sapiens
ctaggggagaggagacccctgcaagcgaagccgctttcctcattcctgaggctcatcggagtcggaaggaccctactctcatgctacaggggccagagagtggcttgccagcggtctcaccgcaccttgg

SEQ ID NO: 6850883 - DNA, 83 bp, Homo sapiens
tgccaggtcagagagctgttcagcagccaggttgtgtgcagaaccggagccccagctgcctgaacttgcagttggcctttgca

SEQ ID NO: 6850884 - DNA, 65 bp, Homo sapiens
ttgcttcatatttgtggcttgccttctatttctattggacagcactggtctaaagtctgaagcag

SEQ ID NO: 6850885 - DNA, 80 bp, Homo sapiens
ctttgatatttgtttggcagagttcaggccaaccccaggcttctgcccttgccagacaagtaagctgatgatattcaaag

SEQ ID NO: 6850886 - DNA, 61 bp, Homo sapiens
cctgctggaggttggagcatgcagatacagatctccagttcatggccctctcaaaggcagg

SEQ ID NO: 6850887 - DNA, 113 bp, Homo sapiens
catttcttcatcccttttttcgaagtcctgtatgttttctcctttggttggaggcttgatgtgaactaaagaactggaaaacatacagtcagactttgaatggatgttaaatg

SEQ ID NO: 6850888 - DNA, 86 bp, Homo sapiens
ggaatggctgatgggaagtgtggcctcaacgggatgcaatgctgaattcagagcatagcagctggggctattcatcagttatgccc

SEQ ID NO: 6850889 - DNA, 57 bp, Homo sapiens
tgctgctcactgcattgttcatccactgtgtcatgatgaattcccatgtgagcagca

SEQ ID NO: 6850890 - DNA, 68 bp, Homo sapiens
ttcttgtgtaggcccagaaaacggatttactcaggactaaattaaaatctggagccctaagctgagaa

SEQ ID NO: 6850891 - DNA, 77 bp, Homo sapiens
gggccttggccttggctgttggagcttgatagactaatgagatgtacatcagctcaggaaacagctgctgagtgcct

SEQ ID NO: 6850892 - DNA, 93 bp, Homo sapiens
tgttcttttgttcaaagctgtatgagttattctaggtcctttgtatttttatataaattttagaatcagcttgtcagttgcaacaaaaatgca

SEQ ID NO: 6850893 - DNA, 91 bp, Homo sapiens
gatttatgttggcatatgctattgaaaagaaataagattcagaaattcattactgactctaatttttctctttgttctgctgacataaatt

SEQ ID NO: 6850894 - DNA, 63 bp, Homo sapiens
attcaggagtgtgccaggaagggtggggcaattcccacaggactcctggggcacactctgagt

SEQ ID NO: 6850895 - DNA, 95 bp, Homo sapiens
tcccagcagcctggacacttgagaaacaattgcagttggagggcattctttccccccgatgccaatagttttacaggcatcttttcctgcttgga

SEQ ID NO: 6850896 - DNA, 85 bp, Homo sapiens
tgctttttaacattatttggggtatttttggcatgagttacaattcatatgccagctccaagtaagagttaagaaactttctgca

SEQ ID NO: 6850897 - DNA, 67 bp, Homo sapiens
agatattacttgtgaaatagtatctgagtgcttgctgtatgccagggactgtttcaccagattgttt

SEQ ID NO: 6850898 - DNA, 103 bp, Homo sapiens
tctaaataaagtttgtaggttagataacagtagaatatcaacatcaatttcctgattttgataatcatattgtggttatgtaggagaatgttctttttttagg

SEQ ID NO: 6850899 - DNA, 96 bp, Homo sapiens
gtcattgtaggtcatagggagaagccctttttcctggtagttttgtgtaccataataaacagtagagaaaggtggttgtctgtgttctgtaatgat

SEQ ID NO: 6850900 - DNA, 58 bp, Homo sapiens
tcttgctttcctaaacataaaaaggctgtgatgtgctttatggagaaggaaagtaagg

SEQ ID NO: 6850901 - DNA, 79 bp, Homo sapiens
tgaagcagcatttacattcccccaattaccaatgggatgagtttccctgggaaggagaggggagtggggagctgctgca

SEQ ID NO: 6850902 - DNA, 69 bp, Homo sapiens
cagggtctgggaggtcacgtcctacaggcaaggctgtttcaagggctgctaccttaatcagttattctg

SEQ ID NO: 6850903 - DNA, 79 bp, Homo sapiens
tttctgcgttaaggctgataagtcagatataaaggttgaccaaattgttaacacatgctctacttacggctttcagaaa

SEQ ID NO: 6850904 - DNA, 73 bp, Homo sapiens
gctgagttgactccagactgctttgaccaatagcacagtgaccctgtgccagttctggggtgtagcccttagc

SEQ ID NO: 6850905 - DNA, 76 bp, Homo sapiens
tctaggtagttatatctgcatatgtacttggatctctaggattctattttgcacagcaaatattgactacccaaga

SEQ ID NO: 6850906 - DNA, 97 bp, Homo sapiens
gctttaatttcttggaccatttttacagagcattcatttttcagctattacgatgaacaaaattgattgttttggaagaatgtctagggcttatagc

SEQ ID NO: 6850907 - DNA, 68 bp, Homo sapiens
accaaatgaattgcttctggtatgttactgagttcatgctcactgggttcagagggagtttctttggt

SEQ ID NO: 6850908 - DNA, 70 bp, Homo sapiens
gtgacccaagttatgctgaagaatatgagagacaccaccttttaaaaatttttacatagcctgcggccac

SEQ ID NO: 6850909 - DNA, 68 bp, Homo sapiens
gacgcatcaggaggcgaggagctgtggactgagatgaaaacacaggactgtttgcaagcctatgtgtc

SEQ ID NO: 6850910 - DNA, 57 bp, Homo sapiens
ttgcttatacagatggtgtgctattcatgaatggctttactttgatctgataagcaa

SEQ ID NO: 6850911 - DNA, 56 bp, Homo sapiens
gttggggggcgtgcaggtaaagtgcaaccactctgacagcctgccatccccacagc

SEQ ID NO: 6850912 - DNA, 55 bp, Homo sapiens
attgtcttggaaccaaggtctttgtcagtatggtgatgaacgatttcaggacaat

SEQ ID NO: 6850913 - DNA, 97 bp, Homo sapiens
tgggcaggaaccgggccggggcgatggggctgggattctcctcgggcgccccggcaggaccccggcctcactagcctctgcccaggatatctctcca

SEQ ID NO: 6850914 - DNA, 64 bp, Homo sapiens
acagagcagctggctctgggaaaaactggaaaaccaagtttgtgttccccagccggctccctgt

SEQ ID NO: 6850915 - DNA, 76 bp, Homo sapiens
gagtcctgtcacttattatccttgtgccttgcttttgcttcactggtaaagtgaaggtcataatgattcaggattt

SEQ ID NO: 6850916 - DNA, 62 bp, Homo sapiens
tttctggtccctacgataagaagagttgtttggctagaaggttttatctgtgggagtggaga

SEQ ID NO: 6850917 - DNA, 79 bp, Homo sapiens
tgctgagggttagcttgattcatggcacaagcagatggcatcctgcttctggcaaaacaggcagaaaattcctttagca

SEQ ID NO: 6850918 - DNA, 77 bp, Homo sapiens
tggaaacttaccgtttggggaaataagtcattgtttgaaacatccctcaattatctcctcaaagcagcaagtttcca

SEQ ID NO: 6850919 - DNA, 74 bp, Homo sapiens
gaggataagaagccaccattgttgtgggcttaaagtgatccactttcactagggctcagagaagtggggccctc

SEQ ID NO: 6850920 - DNA, 82 bp, Homo sapiens
ttgagtgtactggagctggtgtgtgcccgagcacaaactaattaacgtttgtgtgctgcccaactcgcagattcacactcag

SEQ ID NO: 6850921 - DNA, 56 bp, Homo sapiens
actcccttggtggagaatgcaaccttcttgcttcagtttcaagtccctctgggagt

SEQ ID NO: 6850922 - DNA, 72 bp, Homo sapiens
gcagtgcacactttaatagcccgtattccacgtgaaagctatgtgtcttctgtgggtttgaactgtttctgc

SEQ ID NO: 6850923 - DNA, 63 bp, Homo sapiens
atgctatgttatgacaagcatgacagacttgatggggatctgttctgactcatgacattgcat

SEQ ID NO: 6850924 - DNA, 59 bp, Homo sapiens
aagtcatagggaaatgggtatacacagctaaataagagtatccatcatgtccatgactt

SEQ ID NO: 6850925 - DNA, 85 bp, Homo sapiens
tttattaaagggtcgggaaagggaggaacacatgggggctttagggggcactgataatgtcctctctcttatcctatgtgataga

SEQ ID NO: 6850926 - DNA, 82 bp, Homo sapiens
cacatagcaggatttgaagaagatctcatgtagcataaggaggtaggtttatgtaagatctttgcaaataccttgaaatgtg

SEQ ID NO: 6850927 - DNA, 60 bp, Homo sapiens
cttggagggctgtagtggctgagccgggaggggctcctgccagcatcttcagcccctgag

SEQ ID NO: 6850928 - DNA, 129 bp, Homo sapiens
cttttttttttttgagatggagtcttgttgctgtgttgcccagggtggagtgcagtggcatgatctctgctcactgcaagctccacctcttgggttcacgtcgttctcctgcctcaatctcctgagtag

SEQ ID NO: 6850929 - DNA, 76 bp, Homo sapiens
gggttatataagacaaatcagagtctgatgtattgaacacaattggatcttattctgccatatttgtttttaattc

SEQ ID NO: 6850930 - DNA, 84 bp, Homo sapiens
ccgtctgtcagtaggaagtaatcgtgatcgagagatcagcatgtctgttggtctgggaagatcacaattagattctaaaggagg

SEQ ID NO: 6850931 - DNA, 57 bp, Homo sapiens
ggtttcctatgaataaatattgagctataacactagctatagaatttcatagagacc

SEQ ID NO: 6850932 - DNA, 78 bp, Homo sapiens
aactagagatggcagaacctggctgaagtgggaaggctgaattttatttaacctctaatttagttctcctctcaagtt

SEQ ID NO: 6850933 - DNA, 80 bp, Homo sapiens
cccagccacaggacccccaggggcaggaagagtccagggtctccagggtttcctatgtccattgagggagtgtttctggg

SEQ ID NO: 6850934 - DNA, 67 bp, Homo sapiens
agggtcctaagcctcagataagaccccagccccagctgacaccttaattttagccttacaggaccct

SEQ ID NO: 6850935 - DNA, 77 bp, Homo sapiens
gcgtggctctgggcctccaaggtctgttcttacccacggcatcctggggtgtaggcctcaggaccccagggctgtgc

SEQ ID NO: 6850936 - DNA, 68 bp, Homo sapiens
tcttttcaagtttgcatgcccaagcaggtaggctgtgtgtttgctgctttttgcgatatttgaagtga

SEQ ID NO: 6850937 - DNA, 72 bp, Homo sapiens
tgtgtattcctttttcaattgtgatgtcagagttacattagccttgcagaataatttgaagaggttttcata

SEQ ID NO: 6850938 - DNA, 61 bp, Homo sapiens
actgagaaactgaatatttaacggggcctattgctctgaaaaaactcagatttctcttagt

SEQ ID NO: 6850939 - DNA, 85 bp, Homo sapiens
ttcagtaggctactttgtgtatagtttcttagttactgagaataactacttaggcgagtaagagattataaatattatcattgaa

SEQ ID NO: 6850940 - DNA, 86 bp, Homo sapiens
ggggtctagcccatgggaggtgttctgccaacgcgggtccctcccgtccccttcaggagccgcggtgcgctgaccacttcgacccc

SEQ ID NO: 6850941 - DNA, 82 bp, Homo sapiens
tcattttatcttctgtgtagaaagaatatgtttcataaagtccctttagaggtaatgaagtttttacacaaagctgagatga

SEQ ID NO: 6850942 - DNA, 77 bp, Homo sapiens
tgaaaatgtgtagcaggacaatatgggatcaggaaaccaagtgttctgactctgcattgtctgcccctccgtgttca

SEQ ID NO: 6850943 - DNA, 89 bp, Homo sapiens
gttgagaggtggcaagaatatcaccatttatgtacctgagatttttacagatgggtacacagattttacatgttatgcttaatctcaac

SEQ ID NO: 6850944 - DNA, 71 bp, Homo sapiens
taaatgcatctcagtggatagagatttaaaaatgattgaaagatcattctgatcattcaagatgtcaattg

SEQ ID NO: 6850945 - DNA, 78 bp, Homo sapiens
gtccacacatcagccaggtggtctgtcacccatcgtgtgtttaaaatgatggccaagggcctggcgtggagtgtgtgc

SEQ ID NO: 6850946 - DNA, 78 bp, Homo sapiens
gtggggaaaggaaagagtatgcaccttgtttttaattttaggaaacaagggttttggatttgttgctttattcctcat

SEQ ID NO: 6850947 - DNA, 68 bp, Homo sapiens
cctgggcactgtggggagcagaaagaggactaatactgcccttgtgctgaggcacctacagtctcggg

SEQ ID NO: 6850948 - DNA, 99 bp, Homo sapiens
ggatacaaaattcagatctgctgtttctcaaaattaagtacacccttgttagcatgacacttaaatttgatcatgcagtctctctgattaaagccttcc

SEQ ID NO: 6850949 - DNA, 110 bp, Homo sapiens
tgactgtcaaaattccaagaagataaaataaagatcaaattagagttgaaggtgctttccctaatttaatgaatgagtcttaaatttgtttttctggaaattttacagca

SEQ ID NO: 6850950 - DNA, 75 bp, Homo sapiens
gtctgttttcatagcatcatgttggcatgtcatcagtagagaggatagacttgacagggtgactttgtgacagat

SEQ ID NO: 6850951 - DNA, 69 bp, Homo sapiens
attcagaagggctctctgcattgaaattgcaactttttctcacctggctgcaaagagaacccactgagt

SEQ ID NO: 6850952 - DNA, 65 bp, Homo sapiens
gggcagccacgtaaggaagcagcctctcttgtgcctggaggtcaggctggccctactggctgcct

SEQ ID NO: 6850953 - DNA, 86 bp, Homo sapiens
gaataacatttcccattaaggcacaattttcctttacaaaaacattgaaggagtttcttgagcccttaaggtaaactgaaagattt

SEQ ID NO: 6850954 - DNA, 63 bp, Homo sapiens
tggatggctgtggtctttgcccccagctcactgagactgttgagggcaaggaaacagccccca

SEQ ID NO: 6850955 - DNA, 118 bp, Homo sapiens
tgccagtaattgcaaaatatgtcctaactacagagaattcaaattgtgatatgatgtgggtcttggaattgatgattttcataatggttaatatatattgagcatttacaatatggta

SEQ ID NO: 6850956 - DNA, 63 bp, Homo sapiens
gatcagctgcagaaaggtactaggaaactttgtaaagtgggggaactgttctgtatgttgatt

SEQ ID NO: 6850957 - DNA, 67 bp, Homo sapiens
cttagagctaagttgtaatttataagatgctaagcagtgtctggcacttaaaaattattcttctagg

SEQ ID NO: 6850958 - DNA, 57 bp, Homo sapiens
acccaattaagcctttccagaattctgtcctatagaattgtgagctaataaatgggt

SEQ ID NO: 6850959 - DNA, 128 bp, Homo sapiens
tgaatacaacaaagacagcttgcataggacatgccagtaacaggaaagactagcacttgaaggatttgtttctctgtgtgggagatctttttattgctgttgttttgtttgttggttatttgtaatca

SEQ ID NO: 6850960 - DNA, 68 bp, Homo sapiens
caaccagagtctatgagtcctcattgtttttctaccccaagcatagaggactccatgaattttctatg

SEQ ID NO: 6850961 - DNA, 55 bp, Homo sapiens
gacaatcagccatatccagggtgggcacttgcttgggaaatgtttgctgatggtt

SEQ ID NO: 6850962 - DNA, 56 bp, Homo sapiens
ttgaggaggtgggcacacagagtcagcatccactcgattcttgttccatttcccag

SEQ ID NO: 6850963 - DNA, 76 bp, Homo sapiens
agcatgttaaaaaataatgcaggcacttgactgactgggctcaggacagtgatttgcagtatttactaatagagtt

SEQ ID NO: 6850964 - DNA, 89 bp, Homo sapiens
taaaacacatggtaatgtgtaccatgtgttttacacatggtaatgtgtaccatgtgttttacacatggtaatgtgtaccatgtgtttta

SEQ ID NO: 6850965 - DNA, 55 bp, Homo sapiens
ttggatgtgtcagtgtgggcatgctcccttatgcaagcctgagccagccatgcaa

SEQ ID NO: 6850966 - DNA, 90 bp, Homo sapiens
agggcctgagacctgctctgccctctcttaaggagagaaggctttttctgtctggcctggaatcctctggggtcagggcactacagccct

SEQ ID NO: 6850967 - DNA, 68 bp, Homo sapiens
tctctcctctgccatcttcactctttgccaaaataggaaacaaatcagaaaatatggagaggatgggg

SEQ ID NO: 6850968 - DNA, 89 bp, Homo sapiens
ctgattagagactggaggctgtgtgcatgagacctccctaaagcagaggtttcagaaacctgcacattgtttaaactggttaccctcag

SEQ ID NO: 6850969 - DNA, 83 bp, Homo sapiens
cctccacttttcccctctttggttaatcacacagattctgctgagaattgtgcctttacacaaagattgaacagccttggagg

SEQ ID NO: 6850970 - DNA, 64 bp, Homo sapiens
atattgttagtgcaatgtttggtgaacagcaaaatgttcaacagatgttagctctaatttttat

SEQ ID NO: 6850971 - DNA, 66 bp, Homo sapiens
gggagggtggtgagcagtagcactttgtacatttgaaatgttcattagcattgttgacattttccc

SEQ ID NO: 6850972 - DNA, 56 bp, Homo sapiens
taagtagaataaaacagcacagtattcgtttttctgtgactggcttatttcactta

SEQ ID NO: 6850973 - DNA, 94 bp, Homo sapiens
tactggttggcagtcgtttgcagagtacctgaagaggacagtaaaatacacaaaagaatgctgtgctggtagtctgcaaatcagagcaccagta

SEQ ID NO: 6850974 - DNA, 129 bp, Homo sapiens
ctttattcatatttgtgtgtgcagtcctttgtaactgtttgcaaatttcgtctcctcagacattctttcttcctgaggtaatagatgtgcacaccactggggcactcagacacaggtatgctgtcttgg

SEQ ID NO: 6850975 - DNA, 81 bp, Homo sapiens
ggggtggcgctttctctctactggggcactaggagtgcttactctcctgctccctctggtcctcggtggagagccacaccc

SEQ ID NO: 6850976 - DNA, 73 bp, Homo sapiens
acagttctggctgaggcagagcctggggtatcatatctgagtccccgctccgtttgtctccatgtcagcctgt

SEQ ID NO: 6850977 - DNA, 69 bp, Homo sapiens
gcccctacagccccagcccgcagcccacgtggcaccctacagggctgtgagagtggggctgctggaggc

SEQ ID NO: 6850978 - DNA, 80 bp, Homo sapiens
ttgagagaaccttgaacattgctttatttcttctacactcttgaatgtggaggaaataaaaagatggttggttgtcccaa

SEQ ID NO: 6850979 - DNA, 69 bp, Homo sapiens
agtcctttgtctctgatccaggagtcttgtgtcttctgccagtctctgtggaacagtgacaagtggact

SEQ ID NO: 6850980 - DNA, 88 bp, Homo sapiens
tatcacactcatcccactagcttgtcctccacccacactgcatccctgagctgggacacgcagaggacaggtgtgatgaaggtgcatg

SEQ ID NO: 6850981 - DNA, 103 bp, Homo sapiens
tttggcacaaatgtgatttgaaataagtgctgtgctttaagactgactgacaccacactgaaggagctaggtagtggcatttgaaattatctaaaaggctgaa

SEQ ID NO: 6850982 - DNA, 104 bp, Homo sapiens
ttgagacagagtttcactcttgttgcccaggctggagtgcaatggcgtgatcttggttcactgcaacctccacctcctgggttcaagcgattctcctgcctcag

SEQ ID NO: 6850983 - DNA, 61 bp, Homo sapiens
aaagaaatgttatcagggaattgtcctagccatataagggcagtcctgcaaataattcttt

SEQ ID NO: 6850984 - DNA, 82 bp, Homo sapiens
agttctagggtacatatgcacaacatgcaggtttgttacatacgtatacatgtgccgtgttggtgtgctgcacccattaact

SEQ ID NO: 6850985 - DNA, 80 bp, Homo sapiens
gggctggcactggtgttcgggctcgttttgcatgtgctgcctctgtgcctgtaactggtcctgaacagcccaggttaccc

SEQ ID NO: 6850986 - DNA, 66 bp, Homo sapiens
aagtgcattacaggaatttgttactgaaccttgtgagttttagtagaaaacagcctgtgttgactt

SEQ ID NO: 6850987 - DNA, 55 bp, Homo sapiens
tccagtgacctctctttatccagaatgttgtgactgagccataagggaggctggg

SEQ ID NO: 6850988 - DNA, 86 bp, Homo sapiens
gtaatgagtggtagtatcttcaatttattcaaggagagttttgttgaatgattttctttgacattcattgaatatccactccctgc

SEQ ID NO: 6850989 - DNA, 67 bp, Homo sapiens
ctttgaaagtttatggagtctgcagagtatatttgtcctacgatgcaggagccttggacttgaaaag

SEQ ID NO: 6850990 - DNA, 73 bp, Homo sapiens
ttcaagccaaggatacttttagagcctgagcacctaactgccagttctggatagagtccacgaccggagtgag

SEQ ID NO: 6850991 - DNA, 58 bp, Homo sapiens
accatgggggtagtcaacagggtcggcctgtgctggcagtggcactgcccccataggt

SEQ ID NO: 6850992 - DNA, 90 bp, Homo sapiens
gtcttagattgatcttctaaactttgtttatactctgagttatctttgagtagattagggaagagcaaagcttacaaaggtagctaagat

SEQ ID NO: 6850993 - DNA, 78 bp, Homo sapiens
gtggcctaaatgtaagtgcagtcaagagatttcctccaggagtaggagaattagaggccatgtacttgttgggtttac

SEQ ID NO: 6850994 - DNA, 104 bp, Homo sapiens
gcatgtaaatcacctggggatcttgttaaaatgcagattctaattcattatttctggggcttgagaatctgcatttctaacaagttcccaggtaatgctgttgc

SEQ ID NO: 6850995 - DNA, 61 bp, Homo sapiens
ccatgcaaggagaactctcacttctgcgctagagaagagcagttatggattctcctgcagg

SEQ ID NO: 6850996 - DNA, 126 bp, Homo sapiens
aatcttatctattgggaggtagactaaagtggagataaggcttttgtgggttttttgtctgtgcttagacaaaattatgaagaggccttgttttgtttcattttgtcatgttctcagtgtaacatt

SEQ ID NO: 6850997 - DNA, 56 bp, Homo sapiens
aggattttgctttataaaagccagtttttaaaaatggtttcaaaagcttaagtcct

SEQ ID NO: 6850998 - DNA, 64 bp, Homo sapiens
caggctctgtcaggcggagcagcatgaggtcgtggctgtagtcctcgtctgcttggcgggtgtg

SEQ ID NO: 6850999 - DNA, 79 bp, Homo sapiens
gccagggagaggtgcactgggagggtgcaagggttctgggggggccccttggcaaagctccccagtcacttctccaggc

SEQ ID NO: 6851000 - DNA, 65 bp, Homo sapiens
agcatgtaacagagttcttagggtggaatatgttttgtttaataccttgatctctcttgtctgct

SEQ ID NO: 6851001 - DNA, 55 bp, Homo sapiens
tcaaagcatcagtcaatttaggagggttgttttatctggacttgagctgctttga

SEQ ID NO: 6851002 - DNA, 80 bp, Homo sapiens
ttttgaaaaaccaggttgatttcaacaagattgatgaaaaatgtcttcaagatgattgcttcaggcccagtgtttcaaaa

SEQ ID NO: 6851003 - DNA, 61 bp, Homo sapiens
gcagcaatcttcacagtgtcattggtgcaggaaacatgcaacaccacatggagcttgttgc

SEQ ID NO: 6851004 - DNA, 91 bp, Homo sapiens
tctccctgacaagactatacactttttgaaaatagagacactgtattttgtgtcttctgtactccttgagtagtgctagtcccaagggaga

SEQ ID NO: 6851005 - DNA, 79 bp, Homo sapiens
ctctctcgttttctccctgcccaccgtgtgcacgtgcgtgcgcgcgcgggcgtgcgagcgtgtgggtttctcgggagag

SEQ ID NO: 6851006 - DNA, 56 bp, Homo sapiens
ggtgccccatcgcgggtggctggctcaaggaggtggacgccgactttggaggcgct

SEQ ID NO: 6851007 - DNA, 60 bp, Homo sapiens
tttgttttgctttgtttttggcttggtagcacaatagccatgctaccaaggcaagacaaa

SEQ ID NO: 6851008 - DNA, 94 bp, Homo sapiens
ttgagtttattttatttgatttctagtgaggttgaacatgtcttttgtactcaataactgttcagatttcattaaagtgttttggtaatcttaa

SEQ ID NO: 6851009 - DNA, 93 bp, Homo sapiens
tctgaaagtaggtttccttctttccaagaatgcagataccttgttggaaagcaaagttgtatgtcttagaaagtagaaacacggctgatcaga

SEQ ID NO: 6851010 - DNA, 71 bp, Homo sapiens
atgttcaccagtctttcttaccattgtggtatctatagatagagttcaaaggtatgagaaagggtgtttat

SEQ ID NO: 6851011 - DNA, 62 bp, Homo sapiens
gctgccatgtggcggggcaggactgcaaacccgcatgctcagtcactctgctacatgacagc

SEQ ID NO: 6851012 - DNA, 56 bp, Homo sapiens
ttgtgatctgtgttgatggcctattcgaatatgcaggtgattctcactattcacag

SEQ ID NO: 6851013 - DNA, 129 bp, Homo sapiens
cgtggcgggtgggcaggcggcccgggcgaggggctcgcagcctgggcgtcagcgtggtcatggccgtcgtggcttccgccgcgggcctcggcgcagagatcctagggccgcggcgcccttccggtcccg

SEQ ID NO: 6851014 - DNA, 57 bp, Homo sapiens
caagcagatattttagtcaagaattccagagaaggctgctcctaaaatgtctacttg

SEQ ID NO: 6851015 - DNA, 80 bp, Homo sapiens
gggaaggaaggaaggaaatgaggttgatggatggcactttgtccattctaggcttttcttatatctgtgtctgccttccc

SEQ ID NO: 6851016 - DNA, 71 bp, Homo sapiens
tgggaacagggataagtaatttggcaggctttctcttttctattcacctccatttgcttaccttgtttcta

SEQ ID NO: 6851017 - DNA, 101 bp, Homo sapiens
tgaggcaggagaattgcttgaacccaggagatggaggttgtggtgagccaagatcacgctactgcactccagcctgggtgaagaagcaagactccatctca

SEQ ID NO: 6851018 - DNA, 81 bp, Homo sapiens
aagatatttcatatacagataatgaagaccaagctagtggctgcactgtaggtctgctgcttatttgtatttgttgtgctt

SEQ ID NO: 6851019 - DNA, 66 bp, Homo sapiens
tgccagtcagctggccaggctggcagcctgccagagaaagccagccagccagccagttgctcagca

SEQ ID NO: 6851020 - DNA, 90 bp, Homo sapiens
tggaactggaggagctgtcctgtgtcagcctgaaataatcaaaaggatcaaaaatcctgttttaggcaacataggaagactccaactcta

SEQ ID NO: 6851021 - DNA, 99 bp, Homo sapiens
ttcccagaacaaagattctgattgattcagtttatacctgttgattatctacccttggttcaattggctatggagtggcatgcaggatctgaagtggaa

SEQ ID NO: 6851022 - DNA, 92 bp, Homo sapiens
ttggatcaaagttgcaacatattacttcctggtataaaatgtattttatatgctgaattctgtgccacaagaaagctgcaactttgatctga

SEQ ID NO: 6851023 - DNA, 70 bp, Homo sapiens
gtaagtgactttcaaggatcattttgccagttggatttgtaatctcaggggcagtgatcctaagtactgc

SEQ ID NO: 6851024 - DNA, 70 bp, Homo sapiens
ccttgcaaggtttctctctgcctaaatgagtctccattgcaggcgatagagtaggagaggccttgtgggg

SEQ ID NO: 6851025 - DNA, 57 bp, Homo sapiens
gcctcaggactggcatactcatactcactggacaaagaggatgccatcctgaatggt

SEQ ID NO: 6851026 - DNA, 71 bp, Homo sapiens
gtcttcttaaatgttggcattggaggccgggcacagtggctcacgcctgtaatcccagcactttgggaggc

SEQ ID NO: 6851027 - DNA, 76 bp, Homo sapiens
gatatgattctcattttataaacttatccaacgtcacataggaataagtggcagaataagagtgagaactcaaatc

SEQ ID NO: 6851028 - DNA, 66 bp, Homo sapiens
ggaataatgtcagtcttttgctgctgggcacagcacacagagcgatgcagctgaaagtatgacacc

SEQ ID NO: 6851029 - DNA, 121 bp, Homo sapiens
tttggtaccagctcccataaacccaattgagaaatataatctggaaagttgtaaatataattctgtttcttctgtattttttgttgttgttgtagggagcatggtgttcctcctaaccaaa

SEQ ID NO: 6851030 - DNA, 90 bp, Homo sapiens
tccagaataagcaatctatattctatagattcttatagatttataaatctatagagacacaaagtagattagtggttgcctatggctgga

SEQ ID NO: 6851031 - DNA, 68 bp, Homo sapiens
cagctaattcttcctttcattcatgtgttaaagatgaaattataacagaaagagagaagacaaagctg

SEQ ID NO: 6851032 - DNA, 66 bp, Homo sapiens
gcttcataggtacagggaatttctctgctctgttcactgataattttcttgtacctagaacactgc

SEQ ID NO: 6851033 - DNA, 84 bp, Homo sapiens
acttccagctgctgttcagatgcgattcaggaatgtgacttccccaaggttccaaatgacatcggacagtaatgggctgggggt

SEQ ID NO: 6851034 - DNA, 66 bp, Homo sapiens
agcaagaagctttgctgtgatacatttaatttgacatacaagtaattacagcagaaatgttttgct

SEQ ID NO: 6851035 - DNA, 58 bp, Homo sapiens
ttctgcatctatttttctgctgctcccaggcttggagaaggaaccaaagtatgcagga

SEQ ID NO: 6851036 - DNA, 105 bp, Homo sapiens
gaagaaaaagagaaaatggtatgaggaagacaaagggaatttttcgtagcttgtttattctatgttaggatctatgaaaagtctattcattccttctcattcttc

SEQ ID NO: 6851037 - DNA, 55 bp, Homo sapiens
tgtcatatttgggctaaaagtgagcagtattgttctcatttttcccagatggata

SEQ ID NO: 6851038 - DNA, 77 bp, Homo sapiens
tggtatcagagccatctgtatttatgtttgctgtgtgactgtcacttgtatacaatcatgcagagactctgatatta

SEQ ID NO: 6851039 - DNA, 94 bp, Homo sapiens
tcccagagccttgtactttgtgagtacatcttaatttgactaattgaatttatcactcttttggtcagttggtgttttgcaaacacatttggga

SEQ ID NO: 6851040 - DNA, 60 bp, Homo sapiens
catagagctggtttactcaggaatttgggtttcctttcaactcttcgtccagctcttgtg

SEQ ID NO: 6851041 - DNA, 65 bp, Homo sapiens
tgggtaagtaactggctggatttagggggctacagaaggccactgaacattagagctagtgccta

SEQ ID NO: 6851042 - DNA, 90 bp, Homo sapiens
agctttattcagtcaatacagatggcatgtgaagatgtaatatgcttttttacattttcatatgggttatttgtaaataactatattgct

SEQ ID NO: 6851043 - DNA, 75 bp, Homo sapiens
gtgccaagattaagaaaccccttgtctatctgattaataattatcaaatacagtggttttgttggtgttggatac

SEQ ID NO: 6851044 - DNA, 58 bp, Homo sapiens
ggggcaggtgcaagcaggtaggcgttggcaagagacgttcacttgaagatcttgcccc

SEQ ID NO: 6851045 - DNA, 73 bp, Homo sapiens
agtatgacctaaggtccagtggaaactagagtgaacattactctaggtttgacatggactgagcaggttccct

SEQ ID NO: 6851046 - DNA, 57 bp, Homo sapiens
tgtgtgcttaagggctgaacctgacggaagagaatgggttcatggcctggccacaca

SEQ ID NO: 6851047 - DNA, 69 bp, Homo sapiens
gaagctatgatctctgggtctggagctttgccctctgtacccaaggctctgcactcagagtcattcttc

SEQ ID NO: 6851048 - DNA, 106 bp, Homo sapiens
tttgggtgcttattaaaaatgcagtttcctggtctctacttcaagcctattaatccaagctctctaagtggagccagggaaactgaatgttaacaaactatccagg

SEQ ID NO: 6851049 - DNA, 81 bp, Homo sapiens
aagtgcgctcacagggcatctagttccctctcttgagttccttttaagcaagcaaggcaacctatgtccagagaagcagtt

SEQ ID NO: 6851050 - DNA, 78 bp, Homo sapiens
tatacttgtgtgcctgtgtgtgtccgtgtgtacacatgtgtgcgccgacacagccaggtgttggccaatgcaggtgtg

SEQ ID NO: 6851051 - DNA, 118 bp, Homo sapiens
ggtagatggtttagggaaatagcttgcagggaggagggcttagtggagaaggtctgtaggggccctgagttgagccttccaaaacattcctacaagccaaacagagagactatctgcc

SEQ ID NO: 6851052 - DNA, 97 bp, Homo sapiens
ggcagggctgagcagctggatcccgtctgagcctcctagtctgctgctcagcgtgcagctcccaggaggcctaggctgggcccctcttgccagagcc

SEQ ID NO: 6851053 - DNA, 95 bp, Homo sapiens
acctctctgggctgctgtgaggatgagatgagataacacacaggaaggtgttctcgctacatgagtgttcccagtcattcttagggccaagaggt

SEQ ID NO: 6851054 - DNA, 83 bp, Homo sapiens
gcagtttctcattaagctacttagaaggtgctcacctttctttcgggcactgtttatctaagtcttgaaagagacccttttgc

SEQ ID NO: 6851055 - DNA, 72 bp, Homo sapiens
tagtttgtacacaaataataaagttacatactattagtgtgttgtgaaagaaaagtatttgtgtctaaatta

SEQ ID NO: 6851056 - DNA, 59 bp, Homo sapiens
aagtagtggccaacttatatgaaaaacatcatcattgtttttaaattagtggccaactt

SEQ ID NO: 6851057 - DNA, 73 bp, Homo sapiens
tccagtctccaagaaaggttacattctgaggtcctgggggttagaacttcagcatctttttcttgggggcgga

SEQ ID NO: 6851058 - DNA, 78 bp, Homo sapiens
gtgatcagctgcttcaagatgaagctgatcttcccagccacaggctgccaggagctcattgaagtggatgatgaacac

SEQ ID NO: 6851059 - DNA, 65 bp, Homo sapiens
tccctaaatacagtcatgttctgaggtactgggagttaggactttaacatattaactgttagggg

SEQ ID NO: 6851060 - DNA, 92 bp, Homo sapiens
cagcctcatggtcctcaaggctggagtggcgttggagaaaccaggtcatagttgtataaccaaggtactctgcaggatggactatggagctg

SEQ ID NO: 6851061 - DNA, 67 bp, Homo sapiens
ggagacaaaagtttgcactgtgctgaggattccgagtaaattttctaagcctgtcagacttgtctcc

SEQ ID NO: 6851062 - DNA, 95 bp, Homo sapiens
tagttttaagaggtatgttcaaagcttatatcagaacaatgcttttctataatgagtgagagagttcaaaatatatgctttacctcagaaaattg

SEQ ID NO: 6851063 - DNA, 59 bp, Homo sapiens
ttcattgtgaacacattctgccacaacagctgaggtagaacattgtgtttatttgtgag

SEQ ID NO: 6851064 - DNA, 63 bp, Homo sapiens
aggctggatttccaaacctccagcttcccaatctatcagctgcagagggactgaagccagctt

SEQ ID NO: 6851065 - DNA, 60 bp, Homo sapiens
gccggcgcccggggcgcaagggggcggccccgcgccacagcgccttccccgggagcgggc

SEQ ID NO: 6851066 - DNA, 76 bp, Homo sapiens
taactttgttaatgtcactttatgtggcttcttcccatatagggaagtcagtagtgacattacaaaactttagtta

SEQ ID NO: 6851067 - DNA, 103 bp, Homo sapiens
ttatttcatttggttcttaagtaatcttgtgatgtatgcaaattggataattttatttctatgtaaaaatatacacagagcttatggtgattgtatgaagtga

SEQ ID NO: 6851068 - DNA, 57 bp, Homo sapiens
ggcagaagctgaggactcatgatttagcttcagacgtcatgaagcatcacttctgcc

SEQ ID NO: 6851069 - DNA, 67 bp, Homo sapiens
cagtgtctgctcagacagctacagctgcccaaattgcctttctgtatctacctgtctagcaacactg

SEQ ID NO: 6851070 - DNA, 84 bp, Homo sapiens
tcattcctcttaatcttcactaaaatggacaagtattcattgagcacctaatgcgtgttcagtatggtgggagatgagggatga

SEQ ID NO: 6851071 - DNA, 68 bp, Homo sapiens
gcttgacagtgtccctctggggtggaaatgagttccttagctccatcaccacagaggacagagtaagc

SEQ ID NO: 6851072 - DNA, 74 bp, Homo sapiens
cttctcttctctggtggaggtgcggtgagtgtcatctcactcacacatgctaagccagagatgagtcagggaag

SEQ ID NO: 6851073 - DNA, 80 bp, Homo sapiens
tctgaattgttttaagtagagtcgtctggcttctggggactttctccagtgatcagctagatctacttgtccaatccaga

SEQ ID NO: 6851074 - DNA, 56 bp, Homo sapiens
taagtttctacttgtcgggtcttcagagcactgcctggtaggtactgtgaggctta

SEQ ID NO: 6851075 - DNA, 55 bp, Homo sapiens
aagctctgaggtgagcaatcgggtttttttctagccttagcacaaagcagagctt

SEQ ID NO: 6851076 - DNA, 61 bp, Homo sapiens
gagactcttgctttaatagccctcttaggcagaagctttatataataaagcaggatttctc

SEQ ID NO: 6851077 - DNA, 64 bp, Homo sapiens
tagaacacatgtatttaaatgtggcttattttattagcagttactcttagatactagtgtgcta

SEQ ID NO: 6851078 - DNA, 56 bp, Homo sapiens
gttcaagttcatatctcttaactgtattacatagtgttaaggttatgatcttggat

SEQ ID NO: 6851079 - DNA, 83 bp, Homo sapiens
gggggttggggattctgttgggttagtgtctcccttcctgagatcccagccagaggccaaagacctagagatcctcagttccc

SEQ ID NO: 6851080 - DNA, 55 bp, Homo sapiens
cccggaggcggagcttgcagtgagctgagatcgtgccactgcactccagcctggg

SEQ ID NO: 6851081 - DNA, 55 bp, Homo sapiens
agctatcgtcagaactaccacttaaaataaactttttgggactctgatgggagct

SEQ ID NO: 6851082 - DNA, 67 bp, Homo sapiens
tggggtgggactctttggcctgagcactaaatctgatctattgcttgatgtcatctggcccatccca

SEQ ID NO: 6851083 - DNA, 64 bp, Homo sapiens
tccacatgggacacagtccgccctctaaaagtactttccttagagggcacggctcctgtctgga

SEQ ID NO: 6851084 - DNA, 63 bp, Homo sapiens
tctctgtgagtcttaagcaccacctttcttggtccaaagaaaggcaaactgagacacaagaga

SEQ ID NO: 6851085 - DNA, 56 bp, Homo sapiens
gccttcttcttgcaagggaatgtcagagagcatgaacccccctggcaaagaatggc

SEQ ID NO: 6851086 - DNA, 75 bp, Homo sapiens
ctccaaatacatactttcaattcccaagacctagcaaagctgagtgtgtctggaaatttaaggtatgagatggag

SEQ ID NO: 6851087 - DNA, 66 bp, Homo sapiens
ccaggaatttcgaaatactgtttcccctttatgtattttccatttgatggaaataatttctcctgg

SEQ ID NO: 6851088 - DNA, 56 bp, Homo sapiens
acatctctgggtcctccatgcattccatgtgttagaatccaagggaacagagttgt

SEQ ID NO: 6851089 - DNA, 93 bp, Homo sapiens
ttaagaaaaattcagaaacagcataccaatgtacatataagataaataagcttatgtggtacagtaagtgttctgttctgagaaataccttga

SEQ ID NO: 6851090 - DNA, 84 bp, Homo sapiens
gggatgcagacaggaatgtgaccactagactctcagccccgggagggcgaggctttttgctggttttgttcattgctgtatccc

SEQ ID NO: 6851091 - DNA, 75 bp, Homo sapiens
gagaagcactggctcctcagtattccacttttcttcaaggaaggacactgctgaggatcagatgacatgcagctc

SEQ ID NO: 6851092 - DNA, 94 bp, Homo sapiens
gctttgtacagtagattcttttttaaatgtgtaagctgactgaacttttgtgagtcaggttgcattttaagtaaaagaatccagaaaaggaagc

SEQ ID NO: 6851093 - DNA, 56 bp, Homo sapiens
aacagcaggcatttcttagctcacatttagtgtgactgggaagatcttttgttgtt

SEQ ID NO: 6851094 - DNA, 103 bp, Homo sapiens
gggctgcaggctggacacccaggagagtcaagggtgcagaggaagtccgaaggcagactgctggaggattcactcttgctcagggtggccagacttttggttc

SEQ ID NO: 6851095 - DNA, 83 bp, Homo sapiens
ggtgagaaactgaatatcccgctatgcaaagtacaaacaagctctctgtgaaaatgctttgttatatggggattcttctcact

SEQ ID NO: 6851096 - DNA, 128 bp, Homo sapiens
ggggtaaggattcttgcctgcagaacaaggaagcacttttaaagctagaaggtgctgtacagaaaagactcttacctttgcgtctagctcttgaagcaggctctcctctcatgccaggtaccctcccc

SEQ ID NO: 6851097 - DNA, 107 bp, Homo sapiens
tgagagtctcagcctttttcttcctgccaagttacttttttattaggtagataaactcctgaattgttgagaagcagctgtttgaagaaggatttggctgattctca

SEQ ID NO: 6851098 - DNA, 66 bp, Homo sapiens
cacagctaatcagagtcagaggctagagctgagccagcagctagacttcagaatctgtgtcctgtg

SEQ ID NO: 6851099 - DNA, 77 bp, Homo sapiens
ccagggatggatgtggttttagtaaacctgatagggtgtaagcaggatcagaatggagcccacatggtcgaccgtgg

SEQ ID NO: 6851100 - DNA, 70 bp, Homo sapiens
tggggagagattgaggagttttaagccaggagagtaatgtgatggcaaaactcctgaaattgtttcccta

SEQ ID NO: 6851101 - DNA, 56 bp, Homo sapiens
catgttggcactgtctctgcctgagtcttcccaagcagcacgctttgccaacaatg

SEQ ID NO: 6851102 - DNA, 77 bp, Homo sapiens
cttgtcctcctcctcctcttgctccagggcactcgcagaggttcttttcacaaaggagctggaggatggggggcagg

SEQ ID NO: 6851103 - DNA, 111 bp, Homo sapiens
gggaccttcttgccttgctcttgctactctgctctgggtggtcattgtgaaaagcccgcaccaaccatgccagtggcagccagacgaggacacagcctggctctgggtccc

SEQ ID NO: 6851104 - DNA, 98 bp, Homo sapiens
tgcttctaataatgagatgtagcagaggagacgtgtgtactttccagctcacaagaaggactgcaagtcacttggctatgttcaacttgaaaggagta

SEQ ID NO: 6851105 - DNA, 55 bp, Homo sapiens
cttatgtctctggaactgctgctgttgcaaacagcagtaacttcagaaacatcag

SEQ ID NO: 6851106 - DNA, 75 bp, Homo sapiens
ccacagtcccaggctccatggcagccacatccaccttggagtggagcttggttctggccatgggctggggaaggg

SEQ ID NO: 6851107 - DNA, 67 bp, Homo sapiens
tttgtgtccctgtaagacaaagccagggacgtaaagccttggtctttcaatgtcaggagacaataaa

SEQ ID NO: 6851108 - DNA, 78 bp, Homo sapiens
agactaaggctcagaactacatggacatgttaagtgtcaaacgcttggagccaaactggtcctggcctaggaaagtct

SEQ ID NO: 6851109 - DNA, 64 bp, Homo sapiens
gcctgggtaggagacaaaaggtgtgtatccacagcacagaacgacctactgtatccacccagtc

SEQ ID NO: 6851110 - DNA, 63 bp, Homo sapiens
ggtacatttttctgtcactttgatttgtatcgttatgatgcctaagtttttagagtatgtgcc

SEQ ID NO: 6851111 - DNA, 85 bp, Homo sapiens
gccatggacttgtgagctcctcctgacttgtgagcccctcctacagtgtttccattctaggaacagtcagccttacagtcctagc

SEQ ID NO: 6851112 - DNA, 59 bp, Homo sapiens
gtcaccatggataagaatcactggaacagcttgttaaagcagattctgattctggaggc

SEQ ID NO: 6851113 - DNA, 129 bp, Homo sapiens
ttgaataggttatgtgagaggtgactgggttatttgggaggtgactggtttatctggcagtgactgggttatctggggtgaataggttatgtgagaggtgactgggttatttgggaggtgactggttta

SEQ ID NO: 6851114 - DNA, 67 bp, Homo sapiens
gccctgaaaagcatctcaaaggagcttcaagtcccaggggaaaagggatctctttaggtgtcagggt

SEQ ID NO: 6851115 - DNA, 82 bp, Homo sapiens
aggcacagctgccgccccggacgtctgaccaaacacaccaggtttgtgcgggacatgatccgggaggtgtgtagcttcgtct

SEQ ID NO: 6851116 - DNA, 57 bp, Homo sapiens
ccaggtgtcaaaataccatttcaggaaataactcggaaatgaattttgatcaccagg

SEQ ID NO: 6851117 - DNA, 67 bp, Homo sapiens
gtgatatttgggaaagggattatgagtagatattgggtgtttactacaatatttctttctatattat

SEQ ID NO: 6851118 - DNA, 58 bp, Homo sapiens
gctatcatgaaagccaagatttcttttctcctcagaggccttggttatggtatgatgc

SEQ ID NO: 6851119 - DNA, 71 bp, Homo sapiens
ggattgatgaagtatctcttcttttgcaaatatgttattacctttgcaaggcagcaggtgcagtatcaacc

SEQ ID NO: 6851120 - DNA, 83 bp, Homo sapiens
ggcctggcaccagccaagggcctctctgggcctttcctgtcatggatgcaggaagggattcatgaggccagagctgccaggct

SEQ ID NO: 6851121 - DNA, 79 bp, Homo sapiens
ccatgtcttgcacttacctaagaactataggaattctccatgtacctcctacagtttttctagcagtgttggacaatgg

SEQ ID NO: 6851122 - DNA, 57 bp, Homo sapiens
gtcccatttcaagaaattcatgatgttattctaagtcagtgtttctcaacatggggc

SEQ ID NO: 6851123 - DNA, 89 bp, Homo sapiens
ggagaagctcatggttgagttattttgaggtatttttgagctgcttattagcaggttctcattagtagcttcttattatgagctttccc

SEQ ID NO: 6851124 - DNA, 126 bp, Homo sapiens
ttaaggccttgtcttcctgatccacccttggttctgtttttttcatgttggttctatttctagacaggctccattcatgtgaaggcagcatagccattggtttcttcaggtccacatggtccttgg

SEQ ID NO: 6851125 - DNA, 64 bp, Homo sapiens
cctgccctcggcctgcaggctaaggctctgagcctgtggcctggaaggggctgctctgggcagg

SEQ ID NO: 6851126 - DNA, 78 bp, Homo sapiens
tcaagcacctaccgtgtgtatggtggaactgctttgcatacgttagctctgatctttacaacaaagtaggtggtatga

SEQ ID NO: 6851127 - DNA, 79 bp, Homo sapiens
agcatttatgtctttctcatacaagcccaagaagatgaacttaattctgtaaatggacttcggaaagataatagttgct

SEQ ID NO: 6851128 - DNA, 72 bp, Homo sapiens
gatttaaagaactattaacgaggaagctgggactgttccctgctttctgtaggtagttactgttgttaaatc

SEQ ID NO: 6851129 - DNA, 62 bp, Homo sapiens
ctgtacagacctattagcccagaggtcacaaattgcagccaagggctggggtctgcctgcag

SEQ ID NO: 6851130 - DNA, 129 bp, Homo sapiens
agtgacaagtggactaagtgaaatcatatgggtaatgaaacttggatttcatttaacccgttcctataattaagggaaatgtgtcagtttcattctctcagttggcgatcatcttagtctgcttgggct

SEQ ID NO: 6851131 - DNA, 62 bp, Homo sapiens
gcaggaagctgtgagtccaccaggctgccctgtgctgggcacctgctcaactggcttctcgc

SEQ ID NO: 6851132 - DNA, 64 bp, Homo sapiens
ttgcatgttatttaatctgtatacttcagttttcctatctgaaaaatgcagagaatggcagtag

SEQ ID NO: 6851133 - DNA, 88 bp, Homo sapiens
gtggctcaggcttggaatcctggagcttttgtgggggccaaggtgagaggatcacttgagcctgggagttgagaccagcctgggcaac

SEQ ID NO: 6851134 - DNA, 83 bp, Homo sapiens
aggggatagtgctaatgttgttgtacctcaagcagaggatgggtacatttcttgattacaaataacatcataacctgtttcct

SEQ ID NO: 6851135 - DNA, 78 bp, Homo sapiens
gtcatgtactagttattaatagagaggtgggctaaaaagcgtttttattccagtaatctctgtaatacaaagaacagc

SEQ ID NO: 6851136 - DNA, 57 bp, Homo sapiens
gctgaagagcaaggctgggtctccttttccagagactgagcccattaccctctcggc

SEQ ID NO: 6851137 - DNA, 130 bp, Homo sapiens
tgtgaagcaccagttgacccgcaggtgggggtgccaactggtaggctgtagggttagctctggcctctggcagccagccagttgtctcctaagaaaatactgtggcgtgaatgcaaaatgtgattcatca

SEQ ID NO: 6851138 - DNA, 57 bp, Homo sapiens
tctcaggaagattagggctaaggatgctattgtccacagccctgtaaatcccctgga

SEQ ID NO: 6851139 - DNA, 79 bp, Homo sapiens
ttcattcatccatccattcattaattctaaagtctgcaccactggggtctatagaaacttgaggggatataatgatgaa

SEQ ID NO: 6851140 - DNA, 73 bp, Homo sapiens
gaagaaggtggagtagaacaagctattgtacattttaaaaccatcagggagtttgatttgtctatcttcattc

SEQ ID NO: 6851141 - DNA, 76 bp, Homo sapiens
tcctgggtgatgaaatgattgaaatctttactgtatctttgggaagagaaaacaatgatttctaagcaacctagga

SEQ ID NO: 6851142 - DNA, 71 bp, Homo sapiens
actcaggtttactttatcatagatgattaataggtgttacgtgttaaattcgatgatggataaactgttgt

SEQ ID NO: 6851143 - DNA, 65 bp, Homo sapiens
attgtgactgttggtgttgacctagttcactaagtagtgtctgtcaggtttctccaacttatagt

SEQ ID NO: 6851144 - DNA, 55 bp, Homo sapiens
ttcccaaagttccctgcaacttgcttctggaagagtaaatggaaaactttgggaa

SEQ ID NO: 6851145 - DNA, 75 bp, Homo sapiens
ttttgcttagattatattgaccagtacaattggtacaattttgcctttgtttcatggttcatatttgaggcaaaa

SEQ ID NO: 6851146 - DNA, 69 bp, Homo sapiens
ggagagctcattgcattggaattgtattgtaattttccaaataatatttgaacagtcactgagttatcc

SEQ ID NO: 6851147 - DNA, 56 bp, Homo sapiens
tagaaaggcaagcgtgaaatatgatggtattgccctctatttcaaagtgccgtcta

SEQ ID NO: 6851148 - DNA, 68 bp, Homo sapiens
tgcaaggcccagacaagagctccacttcttaaacaatatgtgtgtggaggctgtcaaagggtattgca

SEQ ID NO: 6851149 - DNA, 81 bp, Homo sapiens
gctcctagagagacatttattcacacatttatttttaaagaagaaaagaataagtatgtatagtgagtggcctccagaagc

SEQ ID NO: 6851150 - DNA, 89 bp, Homo sapiens
atagaaggccttgttgtgtgtaacttgaagaaatataggcaagttcagagtctcatttgtcttcacattcacgtaacataggtttctgt

SEQ ID NO: 6851151 - DNA, 93 bp, Homo sapiens
atggcagacaataaggtctgctggggagagtgcaagttattttgagcttatcttattcttagccagcagcctggggcgttggtgtctgcacat

SEQ ID NO: 6851152 - DNA, 57 bp, Homo sapiens
ccccccatgtaattattgtgaacaccttgctttgtggtcactgtaacatttgggggg

SEQ ID NO: 6851153 - DNA, 70 bp, Homo sapiens
tcaatattcttctttagtaggatttcatttttattactaaatgcatctttctgttagagcgggttattga

SEQ ID NO: 6851154 - DNA, 77 bp, Homo sapiens
gagacaggcagaaaagagccctgaaggacaaggtctggggaacctggatgtcctcaggaaggctttctgactgtgtc

SEQ ID NO: 6851155 - DNA, 78 bp, Homo sapiens
gcaaagtgctctgctgcagggaggttccttgttctgaccccaggacgcttcaaggactccctttcagctaagttctgc

SEQ ID NO: 6851156 - DNA, 57 bp, Homo sapiens
tccaagctttccatgccctcaccctgacatgtgcaggggtggcatagagggtgtgga

SEQ ID NO: 6851157 - DNA, 56 bp, Homo sapiens
tgagcaagaaatagaaacagatttaaggaaatctaggtgttggctgttctagctca

SEQ ID NO: 6851158 - DNA, 77 bp, Homo sapiens
gcctttctcagtgtagcttttcaagagtcctagatccaatttcatagacatcctttcagagcatgcacagcagaggt

SEQ ID NO: 6851159 - DNA, 59 bp, Homo sapiens
ccacagcttctgtctgacccatgtttctgccactgagctggttccagaattgcctgtgg

SEQ ID NO: 6851160 - DNA, 60 bp, Homo sapiens
gaagagaatggaggaattgcagtctcttcttaatcaattataatgtcctcctctcttttc

SEQ ID NO: 6851161 - DNA, 99 bp, Homo sapiens
ctcctaatattcacactctttctattcctttcctttttagtgtgggagggacctggtaacttgcatctaatgaggagaatatggcaaaaaggataggag

SEQ ID NO: 6851162 - DNA, 59 bp, Homo sapiens
ggtgatgccagcattacatgactgtatctccagatgcagctctgcatggctggttcatt

SEQ ID NO: 6851163 - DNA, 77 bp, Homo sapiens
cccaagaaccagctcagagcaggctcctgccctgtacgaggaaacccagagaatgattctgagacttgcttcatggg

SEQ ID NO: 6851164 - DNA, 70 bp, Homo sapiens
catagcctcctgtagttctgtccccttggtccgcctctttggtgctccaggaaatgaatccaggaggatg

SEQ ID NO: 6851165 - DNA, 58 bp, Homo sapiens
gcatgtccgcatggtggttccataatgtatcatcatatgataccataatgtggaatgt

SEQ ID NO: 6851166 - DNA, 83 bp, Homo sapiens
agttttctgatatttcattcaaaagtacactggagtttatctctgtgcccaaaaatattcttgaagatgaaatacagggaatt

SEQ ID NO: 6851167 - DNA, 119 bp, Homo sapiens
agaaactagaggtgaaagttttagtcaggaattaatgtagtctctgaggtaaacaactattaaatttatttgtttacttttaattacctgtctcctgagagcagacacctgtcttttct

SEQ ID NO: 6851168 - DNA, 102 bp, Homo sapiens
gtgccttacacatggtactctataataaaaaatgtattgaagttcaataactgaataaatgaataaatcagtcatagtttggagagaatagtgtagtggcat

SEQ ID NO: 6851169 - DNA, 57 bp, Homo sapiens
atgatgtaacataaagatgtctgtggattttgctatagaactcttttgttaggtcat

SEQ ID NO: 6851170 - DNA, 71 bp, Homo sapiens
tgtttcagtgacttctttgctctgcgtaggtctcactgctgctgggtttgacagtcacttcacctgaaaca

SEQ ID NO: 6851171 - DNA, 129 bp, Homo sapiens
aagccctatgtgcttctccttcagccaacctgtttcaactcacactagtctatccattagctggtaaacactgagcaccggctgggtacagggcagtgtgctgggcatgatgggtgggtgatatgcact

SEQ ID NO: 6851172 - DNA, 75 bp, Homo sapiens
gcacctataaatgcatgctgtgtgcctgaaatacactaaaaggtatccgttcttacagcatgtttgtgtgtttgc

SEQ ID NO: 6851173 - DNA, 67 bp, Homo sapiens
gaggtgagggcccatttcttaaagaggatgcttgtccagcggcgtgaatgatggtgctcctcatctt

SEQ ID NO: 6851174 - DNA, 116 bp, Homo sapiens
gtggtcagtgtgggagcttggaggggccatgcacttccggagaagaccaccgactcgtggctttggtggaggggtgcaggcagatttagttaggctctcccccatccctgacacac

SEQ ID NO: 6851175 - DNA, 83 bp, Homo sapiens
tatatacacgtattagagggttattaggacagaagcggagctggaacaagctcctttacctgaagaccttcaaagaatatata

SEQ ID NO: 6851176 - DNA, 105 bp, Homo sapiens
gtagtctaccatattagattcttattccagttgggttctaatacatagttcctgtgtatttgtcttatagggaacagcatgtaattaggaaatttggtaatttat

SEQ ID NO: 6851177 - DNA, 59 bp, Homo sapiens
ttgtttaagtcacttgatctgtggtgttttgttacggcagacagagcagactaagacaa

SEQ ID NO: 6851178 - DNA, 120 bp, Homo sapiens
gtacctttcttcccagctcactgatgcctgcaactccatggagtttttatttggtagaaggaatgaaatgcccagattatcaagtacctccgtgtgccagctctgtgccagaggatttac

SEQ ID NO: 6851179 - DNA, 109 bp, Homo sapiens
tatgtgaaaggaagatagagttatgactaaactttggtattcgacagctcttgcttggcctagtcagtgtgtgatcttcggcgtttctaagtctgttttctcgtctata

SEQ ID NO: 6851180 - DNA, 57 bp, Homo sapiens
ggctggaagagactgaggacactggccaggttgtcaagatctgagtcttgttccacc

SEQ ID NO: 6851181 - DNA, 71 bp, Homo sapiens
ggaaaggctgagccagggcccctatataaacaagcatacttgttccatcgggacccttggttggcttttcc

SEQ ID NO: 6851182 - DNA, 70 bp, Homo sapiens
agttgagcatagccttcagtagcagaattctgaagtggttgactttgtttaactgtgggctggcaaaact

SEQ ID NO: 6851183 - DNA, 66 bp, Homo sapiens
gtcacttacacatctctgtcagtagtgatgcttctgggcatagcaaaatgtggatgtagttgtgac

SEQ ID NO: 6851184 - DNA, 71 bp, Homo sapiens
caaaggttatggcaatataatcatctgctcttgctctgcaagggaaactcaatattgccttaattactttg

SEQ ID NO: 6851185 - DNA, 110 bp, Homo sapiens
agatctaaaattctgaattggaatatttggaatttttgaatgccccaagtatatattttctgttgcaaatactttggctcatggttttatccaatttggaattgaattct

SEQ ID NO: 6851186 - DNA, 58 bp, Homo sapiens
ctatgtcagtatgaggctcctaaaataattttattttaggcagctacatactaactgg

SEQ ID NO: 6851187 - DNA, 60 bp, Homo sapiens
ttttcttctgggtcgcctcttaagtggctcctgaaggagtgagcagtgagccagggaaag

SEQ ID NO: 6851188 - DNA, 66 bp, Homo sapiens
gctagagagctagggatggcagaggcagaatccttgcccgtgcctctggatcctgtagctcctggc

SEQ ID NO: 6851189 - DNA, 62 bp, Homo sapiens
agaagggcagagggaatcccacatggactggtggatcatgtgtgtgcatttctctcccttct

SEQ ID NO: 6851190 - DNA, 69 bp, Homo sapiens
cctcccagctttctgggtggtttctgtccccttgaggcgatttacaacccaagtccagagagcgagagg

SEQ ID NO: 6851191 - DNA, 128 bp, Homo sapiens
cttctcgtacctgggccagggcacaggcgctggagagcagccagaaagggcagtcgaggcaaagtgggcacatctcgaagctgtccttgctgccacacagttcctgcctgcaaggcatggagcggagg

SEQ ID NO: 6851192 - DNA, 60 bp, Homo sapiens
gttgtcttccctccaccacctgtaccagagatgttggatatgttggaggtgaaggtgtgc

SEQ ID NO: 6851193 - DNA, 80 bp, Homo sapiens
ggaagttatttggctctggttctggctccagaaatctacccatgataaagatgggcaagaaccacggccttttgatttcc

SEQ ID NO: 6851194 - DNA, 63 bp, Homo sapiens
cacccagagtcccaggacttccagttggaggacaaataccaaagctgtgtccaagggagggtg

SEQ ID NO: 6851195 - DNA, 65 bp, Homo sapiens
tggtgtaaagtcatatgcacagagctattcaaaacataaaaaagcttcagtatataattacacca

SEQ ID NO: 6851196 - DNA, 81 bp, Homo sapiens
aggtattttaagattcacatcttttggcctattctgaggccaaatggttttagtaccaaccagaagatgcttaaagcacct

SEQ ID NO: 6851197 - DNA, 68 bp, Homo sapiens
agccatcccaagagggctctgccaaagtggccacttgtagggcgattggccccatcaagggatgagtt

SEQ ID NO: 6851198 - DNA, 88 bp, Homo sapiens
ggggtggagagttctgtagatatctattaggtctgcttggtgcagagctgagttcaattcttggatatccttgttaactttctgtctc

SEQ ID NO: 6851199 - DNA, 81 bp, Homo sapiens
tctgggaggggtagctgaattgtgggagacctaggtggacttgacttggctttcctgctactctgcgtctccttctcaaga

SEQ ID NO: 6851200 - DNA, 65 bp, Homo sapiens
cagaggacctgctcgaccgtggccccacacacgctttggaactggccagggaggagaggcccctg

SEQ ID NO: 6851201 - DNA, 78 bp, Homo sapiens
gatcctgtttgatggacttaatgcacactttagcagagggttctgtatgatgtgtacctaagtcaccggaaacaaatc

SEQ ID NO: 6851202 - DNA, 70 bp, Homo sapiens
gccatcatggcaggaggctgctggcagagcttcacctggtttccactgccagtcccttatgcccagtggc

SEQ ID NO: 6851203 - DNA, 115 bp, Homo sapiens
tcatagaatctcaggactctttgtatgatccttccacttccctccagcaggacaatttttctgtttatacgacaggtggaggcatcaagcacaaagattctactgaataaaatga

SEQ ID NO: 6851204 - DNA, 76 bp, Homo sapiens
tactttgtgcatctcatggtgggccacattgtttcagtttgaagtttggccgtggcacctgagatttacactggta

SEQ ID NO: 6851205 - DNA, 88 bp, Homo sapiens
agaatggtgttcaatatagcacatattcagttcatacaaatgccaacatttatatgaaatagtgtgtgcccttttgaagcatgatttt

SEQ ID NO: 6851206 - DNA, 59 bp, Homo sapiens
tagtacttacaaaataggttgctgtaggaatacacagagacaatatttgtaaagtgctg

SEQ ID NO: 6851207 - DNA, 86 bp, Homo sapiens
cattggtcatgaggtcctccagctactaggcaaatactgatttctgtgctttctgtgtgccaggccctggggaccaaggatgggtg

SEQ ID NO: 6851208 - DNA, 83 bp, Homo sapiens
cctcccctgtgctgtcatgctgggcgtggaagagccggcctagctggaggccccgcaccacatggtagagcaggagctggggg

SEQ ID NO: 6851209 - DNA, 84 bp, Homo sapiens
tcatggtttcatcatgattttcttcatttttaggagtaacccttatatgcactcctgagaaataagcaagtaatgaaaatatga

SEQ ID NO: 6851210 - DNA, 71 bp, Homo sapiens
gcagtaaactagttttagctctagcaactgaagcagccattctacagttgagattgggatagtttgcctgc

SEQ ID NO: 6851211 - DNA, 101 bp, Homo sapiens
gccgctttctggagtagtcagtcttacatatttgaacaataccaccctggtgtaattttaaaaagtaagagcttgattctttaaaaaacacttagccaggc

SEQ ID NO: 6851212 - DNA, 58 bp, Homo sapiens
ctcagcaacacggcctattaagaggaaggttaaatctgaattagttggctttgctgag

SEQ ID NO: 6851213 - DNA, 70 bp, Homo sapiens
tcacttgagatgtttgcacctggtaagaatgtttcaaaccttgaattctactttgtgtaattatctgtga

SEQ ID NO: 6851214 - DNA, 91 bp, Homo sapiens
tgagaagaatgtcattgtctaagtatgttcaggctgctataacaaaatatcataaactgagtggcttataaacaacagacattatttctca

SEQ ID NO: 6851215 - DNA, 56 bp, Homo sapiens
cccattttggaacgagtagccaggctgtccctgccaccccggaccccgaagtgtgg

SEQ ID NO: 6851216 - DNA, 79 bp, Homo sapiens
gcttctgtactgttgtatgtggaagagctataaatgcctattttgtttaagctacttttatatgcagtaggactcaagc

SEQ ID NO: 6851217 - DNA, 102 bp, Homo sapiens
ggtgtggtggtgggcgcctgtagtcccagctacttgggagtctaaggcatgaaaatcacttgaatctaggaggcggagattgcagtgagctgagatcacacc

SEQ ID NO: 6851218 - DNA, 71 bp, Homo sapiens
agtcagttgggtgctgcggtcggtggccgagcacccgctcagcagggcagaggctgcaggactcattggct

SEQ ID NO: 6851219 - DNA, 84 bp, Homo sapiens
cttgtattcttccacttaagattgaatattgacaacagcatcttcccaatttttgattaatttttgagtgggcagcaaagcaag

SEQ ID NO: 6851220 - DNA, 65 bp, Homo sapiens
ctttggcagagggtcttcaggggttacagttccctttgtcagccaaggaaagccctttgctgagg

SEQ ID NO: 6851221 - DNA, 120 bp, Homo sapiens
ccccaccctgctactcaagaccattgaggccacggggtttgctgaaactcctcaaaaactgacaagtttccactggagacactgtggagaacatggtctcagggaaataactctctgggg

SEQ ID NO: 6851222 - DNA, 89 bp, Homo sapiens
tctccccttttctgtgttcgtagcagctggcacaagcccagcactgggctctgctcctggtgccagtgctgcctactgatgtgggggga

SEQ ID NO: 6851223 - DNA, 65 bp, Homo sapiens
tcagttttcacactcaccaaaaggggctatcactacctgtctcctacggttaatgtgagaactgg

SEQ ID NO: 6851224 - DNA, 61 bp, Homo sapiens
gagccgcagcaggtccagccaggattccattacctcacccggcggcgcagagctgcggctc

SEQ ID NO: 6851225 - DNA, 57 bp, Homo sapiens
cctttgctatagaccgggtgagagagatgaatcttgaactaaggtggtagcagcagg

SEQ ID NO: 6851226 - DNA, 130 bp, Homo sapiens
tgtgtatgcactgcctggattcttcaagcaagagaaggacatttctatagtgcatctgttatggtgacaggttacaagacagagctctgtgaagctcctgctccctttgggatgaaagcgtgcatgtgca

SEQ ID NO: 6851227 - DNA, 56 bp, Homo sapiens
ggtttcagctcttcctggaaccagcatcatccctgggacacagatgacctggaacc

SEQ ID NO: 6851228 - DNA, 62 bp, Homo sapiens
ctctttgctaatgttgcattttcagtaacacaattgagaatactgcattgttaggaacagag

SEQ ID NO: 6851229 - DNA, 70 bp, Homo sapiens
tgatatctttcaaagccaaaagtaattagaaatagagaaatctagttattgctttatgggaaaaatgtca

SEQ ID NO: 6851230 - DNA, 55 bp, Homo sapiens
ctacaggatctaatgtaactgaaaatggtttgtttcaagttgctagatgctgtag

SEQ ID NO: 6851231 - DNA, 72 bp, Homo sapiens
cttgcatttatagtgctatgctaggtgtcaaaattcaaaatggaaaattagcacagttcactatgatacaag

SEQ ID NO: 6851232 - DNA, 113 bp, Homo sapiens
tggaacagaataatagagggagcatgtcaggaggctgtaggctttgcttagacactcaaagatagacaaaaaacagtttgccctgacattctcctatttatttccaagttcta

SEQ ID NO: 6851233 - DNA, 59 bp, Homo sapiens
taggccacaaataagatcctgtgggtattggttctcccttatcattataatgtggcctg

SEQ ID NO: 6851234 - DNA, 102 bp, Homo sapiens
ggtgggggtggggctgtgtgctgagagtgggtgcagtgcttcaccaagaggcccctgcaggtgctgttctcttttttaacatgtggacctccatcctcagcc

SEQ ID NO: 6851235 - DNA, 66 bp, Homo sapiens
gagaggcctggtgctcctgaatgcagagcacgcatcggctcagtggggggactgaggcctgatctc

SEQ ID NO: 6851236 - DNA, 69 bp, Homo sapiens
ctcagttgcactcaccacatttcaggtgctcagtagtcatatggtcaccatgatgggagtgcaaataag

SEQ ID NO: 6851237 - DNA, 84 bp, Homo sapiens
gatttagggtggagaaagggaatggatttctgttgcttgaaattccttgcgacagtatttgtttgctttaattggcgctagatt

SEQ ID NO: 6851238 - DNA, 63 bp, Homo sapiens
tctttctagtggcctctattctcggaaatgttttcttatttctaacagagaaccacagagaga

SEQ ID NO: 6851239 - DNA, 58 bp, Homo sapiens
gtgatatttttaaagattaaggagtatgacatcaattaacagtctttaaagatgttac

SEQ ID NO: 6851240 - DNA, 109 bp, Homo sapiens
ggggacaagcctcctgggcaagcggctgcctccagctcttgttccaggtgaagtccctcctgggacagtgaccccagaggtcatcgctgctctcaggccacccttcccc

SEQ ID NO: 6851241 - DNA, 78 bp, Homo sapiens
ggggaagtaattatcttagaggtgattgtattctgcctccctcagaataattcctccctttctaggaaaatattcctc

SEQ ID NO: 6851242 - DNA, 62 bp, Homo sapiens
gtcctctgaaagatgaaccatggcctatgcatccttgggaaccaggttcctttagagttggc

SEQ ID NO: 6851243 - DNA, 61 bp, Homo sapiens
caccagcttctcattgcgggtcttgatcttcttcacaaccacgaccctggtggagctggtg

SEQ ID NO: 6851244 - DNA, 103 bp, Homo sapiens
ggatggttctttaaggtaaagattcctgggctctatcctgacccagtgaatgagactctctgaggatggagcccaggcatttgctttccttaataagttgtcc

SEQ ID NO: 6851245 - DNA, 63 bp, Homo sapiens
gctcttgtccccagaaaggtgaggcaggatgagcacctcctgtcagccctttggggtgagagt

SEQ ID NO: 6851246 - DNA, 75 bp, Homo sapiens
gagaaagaaaaagagaatacagggtaacaggaagcgcattttcttgaattcatctggttctttttgttctgtctc

SEQ ID NO: 6851247 - DNA, 92 bp, Homo sapiens
ccttgggagttaggattttaacatgtgaattttggaaggacacaaatgttcagtccttaccagccaccatgtaaagtcctaccaccctgagg

SEQ ID NO: 6851248 - DNA, 73 bp, Homo sapiens
acaatggggcaacatgaagaaaacagaacccttgcacactgttggtgggactgtaaattcatatggccattgt

SEQ ID NO: 6851249 - DNA, 89 bp, Homo sapiens
gtgggtctgagcccccagccagtatccagaaagaaggaattttacatgaatgtccactctgtactgagcatggtgcttatttagcctat

SEQ ID NO: 6851250 - DNA, 70 bp, Homo sapiens
ccaatgggtggtgttggagatggttgcattaaggcatccttaatacgactcataatttaacataaattgg

SEQ ID NO: 6851251 - DNA, 57 bp, Homo sapiens
tggaggtatgtgtggccagtggcttagtcaccagcgtgctggtcacaggtggcccca

SEQ ID NO: 6851252 - DNA, 77 bp, Homo sapiens
gaacaaattccagcaacacctttttacatgtgccaaatagtacttcaagagcattgaaaaggatattgtatttgttc

SEQ ID NO: 6851253 - DNA, 82 bp, Homo sapiens
tccatcatgggtgagcaggtggcctcctgtctgtcctcctggagggctggacactggccatctgcttgtttcccatgaagga

SEQ ID NO: 6851254 - DNA, 69 bp, Homo sapiens
cagtttcagtcagtttcagtcggaaagaaagacaagtgtttggttagtaactggatctggctggagctg

SEQ ID NO: 6851255 - DNA, 85 bp, Homo sapiens
ggcccatcacactgtgtggtctctctcggagcccgtgacctccttattttttccagtgccttccgaagatcaccactgtgacccc

SEQ ID NO: 6851256 - DNA, 86 bp, Homo sapiens
gtatgaggttggtgcaaaagtaatcgcagtttttgccattgaaggtaatggcaaaaaccgcaataacttctgcaccaatctaatac

SEQ ID NO: 6851257 - DNA, 58 bp, Homo sapiens
gtgttctgcagaccagcatcatcagtatcacctgggagcttgttcaaatgcagaatac

SEQ ID NO: 6851258 - DNA, 60 bp, Homo sapiens
attattgcaaaggaagagcttgaatgagtaatttctcgtcggtattctattgacagtagt

SEQ ID NO: 6851259 - DNA, 76 bp, Homo sapiens
aggtgattaagtcattcccactcagaagccacttcatgtgagcattagagttactgggtggaaggcactttcacct

SEQ ID NO: 6851260 - DNA, 75 bp, Homo sapiens
ctggactcattctgggcaattccttcaagctgtgaggtccattatggtagggaacttgtctattttgttctccag

SEQ ID NO: 6851261 - DNA, 83 bp, Homo sapiens
actttttctgggatatacaggtgttcgctcagttagacacatgcgtgagttcatttgagtgaacacttcctgagagcttaagt

SEQ ID NO: 6851262 - DNA, 97 bp, Homo sapiens
ggatcatgtttagctgcaatgactgaatatgtgattatgacttaaaacaactgcagcaaggatcagcaaggcaatcactgcagctggacaagcatcc

SEQ ID NO: 6851263 - DNA, 81 bp, Homo sapiens
gagccatctggagcacctactttgataactaacaatgactgttgggcattgttctatgtgctttccttacatgatgtgttt

SEQ ID NO: 6851264 - DNA, 59 bp, Homo sapiens
tatgtatatctggatatatgtgtagaatatattcacctgcacatatgtggatatacatg

SEQ ID NO: 6851265 - DNA, 74 bp, Homo sapiens
tgacaaaagttaactgtgttcatgcatgctcagccttgctgggttcttgctcgtggagcatagttctctgctca

SEQ ID NO: 6851266 - DNA, 56 bp, Homo sapiens
tgccagcgtgaagctgggccccgctcacagaagccaggggcatcttctagctggca

SEQ ID NO: 6851267 - DNA, 73 bp, Homo sapiens
ttttttctgttcactggattgtatgtatgatgactggagcttctgcagccagaatacaatcatgaggaaaaag

SEQ ID NO: 6851268 - DNA, 83 bp, Homo sapiens
taggcttctcaaaatatgattagaattgttggtatagaattttgcttctcatacaagggagattattcatatttgaaagtcta

SEQ ID NO: 6851269 - DNA, 66 bp, Homo sapiens
cacagcttcttccattccactcacagtttcccctgagagctgaacatcatggaaaggctagcagtg

SEQ ID NO: 6851270 - DNA, 84 bp, Homo sapiens
ccacctgttctacactggcctgtcaagaataacaataataataattattattttagagagaggcctgctgtgttggccaggtgg

SEQ ID NO: 6851271 - DNA, 78 bp, Homo sapiens
tgggaaggaatggtgattaatattctgttgctacctctgtgccgtagcccctctatgtgatgtcaccatcttatccca

SEQ ID NO: 6851272 - DNA, 71 bp, Homo sapiens
gggattggctggaggatgggacctcattttatttagctatctgggcctcaaatgtccatccaggcagtgtc

SEQ ID NO: 6851273 - DNA, 83 bp, Homo sapiens
gggcaaggagcccagcttccttctgtctcttgtgtagtacaagagtcctggaatagaaggcaagaggcttgggctctgttacc

SEQ ID NO: 6851274 - DNA, 89 bp, Homo sapiens
aagcatgaagtcttatattttgaagtcagaaagcattatgctctgaaaggcataaagttttgttgcctgactttaaaatgtgaatgttt

SEQ ID NO: 6851275 - DNA, 61 bp, Homo sapiens
agttgttaggggagtaaacatgtgctgctttgcacacattggttttactcctttgacttct

SEQ ID NO: 6851276 - DNA, 98 bp, Homo sapiens
ctgccagggcacttgggaatggcaaggaaaccgttaccattactgagtttagtaatggtaatggttctcttgctatacccagaaaacgtgccaggaag

SEQ ID NO: 6851277 - DNA, 82 bp, Homo sapiens
cctgctccatccctaaagcttccattaactgctacactcacaatcttgagtcagtggtatttaggggaatgatggaatcagg

SEQ ID NO: 6851278 - DNA, 119 bp, Homo sapiens
tactacatggacatgatgttgagaaatccagtgtttgatgggattttcagatgtgttgagtttgaaattaattaggttcctacagatattgtaattttcattttcagtataaggcagta

SEQ ID NO: 6851279 - DNA, 78 bp, Homo sapiens
ccctcctcagtctctaaggcctcagctggaaagacttgagtggtcaggcgtgatgctgagggctggggctgagcaggg

SEQ ID NO: 6851280 - DNA, 97 bp, Homo sapiens
cagagatctaagtggcttgggcaatgtcactgacatggtcattggcagaaccagccttggtcctctagcctgtctgaccccatggccacttttcctg

SEQ ID NO: 6851281 - DNA, 57 bp, Homo sapiens
ttgtctcctccatttgaccatagatgttgaagttatcagggtcaggggcggagagaa

SEQ ID NO: 6851282 - DNA, 74 bp, Homo sapiens
catatgaataatcatatcgtctcacatatcggcaaggaggttgaaaaatgtgggaggattatggatattcaatg

SEQ ID NO: 6851283 - DNA, 67 bp, Homo sapiens
ccactctctccctctgtaggggcctctctctgagatcgggtcctcctcctgcagggcagcagagtgg

SEQ ID NO: 6851284 - DNA, 71 bp, Homo sapiens
ctggggaggaagtggggacagtagagcaatcatgaacatctctattccagaaatcaccatttcctctgcag

SEQ ID NO: 6851285 - DNA, 58 bp, Homo sapiens
taccaagatgccagtgcatttgaaggatgatgtccccaaagcagaaggttctgtggta

SEQ ID NO: 6851286 - DNA, 55 bp, Homo sapiens
ccagggcaggggctggagttcaacctggtctggacagtctctgcccctgccccgg

SEQ ID NO: 6851287 - DNA, 62 bp, Homo sapiens
atagaagtgggccatggtgagagtttggcatgacccaaagtttatgattaatccaattctgt

SEQ ID NO: 6851288 - DNA, 80 bp, Homo sapiens
aaagaagcatgacttgatgacgctcatacagtacctttctttgctgtgctggcagcaatcaaggaattttatgaaccttt

SEQ ID NO: 6851289 - DNA, 71 bp, Homo sapiens
tagggaacattttgcttgatgagaaaatccgccagcaaggatgttgggctctaagcagaactgaagctctg

SEQ ID NO: 6851290 - DNA, 72 bp, Homo sapiens
cattctagctatctgtgtccagatccaagtgtctgagtctcagatgagctggtcctacacatgtgctatctg

SEQ ID NO: 6851291 - DNA, 91 bp, Homo sapiens
gatagtgacagcagcttggggccagtagcacctgtgtggacccagcctcaggttccggggtgtggtaatggcagcaggcagtagcactatc

SEQ ID NO: 6851292 - DNA, 72 bp, Homo sapiens
gtttgtattgactgtgaatctaagttactaagaaaaattagtgatattagcaaatggttatactatgcaaat

SEQ ID NO: 6851293 - DNA, 75 bp, Homo sapiens
taccatcctcacatcttgggcagcgggttgctaaaaaccatagctgtgtgccatgtaaaaactcgaggcatggtg

SEQ ID NO: 6851294 - DNA, 78 bp, Homo sapiens
agaggctcggttagaaggcctggtgttcattcattcgggaactgcttgttaagctcctggtctttgtccagagctttt

SEQ ID NO: 6851295 - DNA, 93 bp, Homo sapiens
tttctctacattttgctcagctgttggcagcagccctactttctctctccccaagcagagagagggaaactgctaaactgcaaaaagaagaaa

SEQ ID NO: 6851296 - DNA, 70 bp, Homo sapiens
gagtcactagtcagtatgaaattgctcaaggaactctaaccttgatgatttctttttgattcatttattc

SEQ ID NO: 6851297 - DNA, 70 bp, Homo sapiens
caggcttgtggggaatctgtgtgccccgagggggctcccctcccaggtaacaacattcgtcagaagcctg

SEQ ID NO: 6851298 - DNA, 66 bp, Homo sapiens
gatagtaactctacacacgacactagcaggccacaatgaagtactgaagtgtttgggagtactgtt

SEQ ID NO: 6851299 - DNA, 70 bp, Homo sapiens
ggataggatgggggcagacaggcactgtcaatggctagcctgggcctgatctttgaccctcatccttgct

SEQ ID NO: 6851300 - DNA, 76 bp, Homo sapiens
ggtttgaaaaatagccaaacattatttattatttttgcagccttgtaggcatttggaaaatgtttggcttcaaatt

SEQ ID NO: 6851301 - DNA, 72 bp, Homo sapiens
ctcagcagatggtagcaactgtggtagaaaatgaagccatatctacatgatgtaccatctaagacagctgag

SEQ ID NO: 6851302 - DNA, 60 bp, Homo sapiens
catttaccctctgtatgcatcctctagaaaaacatggaaatgtaatcacagagggttttg

SEQ ID NO: 6851303 - DNA, 61 bp, Homo sapiens
ccattagaattccacagctgcacagaggtgttccacacagtctcagcaagtggaaggatgg

SEQ ID NO: 6851304 - DNA, 69 bp, Homo sapiens
tctgaagaactttaaagcacttatgaaaagtatgatgatactcatggggtcactttagagtacacaaga

SEQ ID NO: 6851305 - DNA, 63 bp, Homo sapiens
gtaagcttggagcaatgattgcacctaaacatgttgactgcattcaaatctccaggctcaaac

SEQ ID NO: 6851306 - DNA, 87 bp, Homo sapiens
tgctttctgcttcctcaggcttgttattttattatcattttatgaaatatcctgtgactgtaaaatacataagtattgaagaaagta

SEQ ID NO: 6851307 - DNA, 82 bp, Homo sapiens
agttttagggtacatgtgcacaacgtgcaggtttgttacatatgtatacatgtgccatattgatgtgctgtacccattaact

SEQ ID NO: 6851308 - DNA, 55 bp, Homo sapiens
ctgtctcttggtgtccagaggaggctctgcctcccgctgggcagagaggagaggg

SEQ ID NO: 6851309 - DNA, 67 bp, Homo sapiens
gccaaaggagagaaaatgtgcttagtagaaccagttttgttcactttagttcagtctctctgttggt

SEQ ID NO: 6851310 - DNA, 65 bp, Homo sapiens
tcctggttttatagctttttggtatagatggtcacctgattaattagctataaaactacacagga

SEQ ID NO: 6851311 - DNA, 82 bp, Homo sapiens
gtatatatatacatatatatgagtatgtgtatgcctatatatgtgtacatatgtaaacatgtataaaaatgtgtatatatac

SEQ ID NO: 6851312 - DNA, 91 bp, Homo sapiens
gagaacagaagtaaatagaatacaaacacagaggacatacatgtttatgtcttcgtctctgtgggtatttatatgtattgaagtggttctt

SEQ ID NO: 6851313 - DNA, 57 bp, Homo sapiens
gaagccactgcggtttcccatccctgggcccccgggatgcacccttgcactggcatc

SEQ ID NO: 6851314 - DNA, 57 bp, Homo sapiens
ggtggggccaggatttgaacctcagcattttgggcttcaaaattggcactcttaacc

SEQ ID NO: 6851315 - DNA, 60 bp, Homo sapiens
ctttgtcacatccccttcttgcagcaagcatcacactaagggttggggcatgagacgaag

SEQ ID NO: 6851316 - DNA, 56 bp, Homo sapiens
aaggggccagcctatcacttgaggagactgcattcttattggagagttgggccctt

SEQ ID NO: 6851317 - DNA, 86 bp, Homo sapiens
tgactccagcttagctgtttttgtctgctgatcctggttgttgagcttgtggacactgacagacagaaagggacctgctggtgtca

SEQ ID NO: 6851318 - DNA, 85 bp, Homo sapiens
ttagagccagagaatgcagggcttcggacaacaaagacctctggggacagggcagatgtccctgagcctggattcctgcctctga

SEQ ID NO: 6851319 - DNA, 77 bp, Homo sapiens
ccaagttggtcaatccacagactattaagtgatctacacatgcaagtaggcttttaaaagcttctgtactaatttgg

SEQ ID NO: 6851320 - DNA, 88 bp, Homo sapiens
gagtatgaggtggaggtcaggcaatataggctttgcaaaaggaggacttatctattgctttcagttgctttgagctttttctctgctc

SEQ ID NO: 6851321 - DNA, 94 bp, Homo sapiens
ccagcatttaggagggtctggcagtcacttttgcttgtgccctgtggttcacatgtctgtctggcatgagtgaggtgggttgacctctttctgg

SEQ ID NO: 6851322 - DNA, 81 bp, Homo sapiens
cgggctcagaggggtgggcacagcgcccaggagacagtaagtgtgagatgaggcctctgtgccatccaggcatgagcactg

SEQ ID NO: 6851323 - DNA, 63 bp, Homo sapiens
cctcttgtcacttcaggaagcaacagccaggagtgaaacatgtaacctgaggtgggaggaagg

SEQ ID NO: 6851324 - DNA, 55 bp, Homo sapiens
tctggactttcggtgcaagagtcttggaattgattctaaaacttgtaggtccaga

SEQ ID NO: 6851325 - DNA, 55 bp, Homo sapiens
tcccacaggaggagttggaaatgaatctcaaatttcaccaaggcccctgctgggg

SEQ ID NO: 6851326 - DNA, 65 bp, Homo sapiens
tgacccccagtggctgattgccaggatggcctgtggaaagcacatgagttaagctggggcagtca

SEQ ID NO: 6851327 - DNA, 79 bp, Homo sapiens
cccacactcttcacctcctcctctgtgggcagcaggtccctgcctgaagccgacagacaggaagtcggatctgtgtagg

SEQ ID NO: 6851328 - DNA, 79 bp, Homo sapiens
gttggcactgcaggcagacttcctgcttggatctctcctatctggagggatgagatggggactctgtcacatgcacaat

SEQ ID NO: 6851329 - DNA, 60 bp, Homo sapiens
gtggtcatcttacatacagactgtcatcacttgtgagcatgtgtgtgtgaagaaggcgac

SEQ ID NO: 6851330 - DNA, 86 bp, Homo sapiens
ctgtgcaggttaaatattgatccacagaggtacttagttttagagtatggtactccagacattctgtcctcgttagacctgcagag

SEQ ID NO: 6851331 - DNA, 58 bp, Homo sapiens
tctgacccacaagcatcctggaccacctcaagatggaccaggggaaagctaggtccgg

SEQ ID NO: 6851332 - DNA, 57 bp, Homo sapiens
gtgccatgtctgttgaggtcattgccagtcccctgcaccgtccccaggacttggcac

SEQ ID NO: 6851333 - DNA, 87 bp, Homo sapiens
gagaatcgcttgaacccgggaggcggaggttgcagtgagccaagatcgtgccactgcgctccagcctgggtgacaagagcgaggctt

SEQ ID NO: 6851334 - DNA, 89 bp, Homo sapiens
ctagtcagagtggaagtctaggctccccactcagccttcattggcatgagggtggctggggccacagttttcctgtgctgtttgactgg

SEQ ID NO: 6851335 - DNA, 96 bp, Homo sapiens
ggtctgttaaaaagctgtgtgccattccagctttctaggtatttctggtgtgacttttctggggccagcggggaggactcagctctttctcaggtc

SEQ ID NO: 6851336 - DNA, 76 bp, Homo sapiens
cggaataatttttatgggtcttggaatgcaatataaacttaaaatattgtgtttgcaagtcctattggcatgaccg

SEQ ID NO: 6851337 - DNA, 59 bp, Homo sapiens
ctaacctcaatttaattatctgtgaaatgggggataatcatagatattgtgagggttag

SEQ ID NO: 6851338 - DNA, 96 bp, Homo sapiens
tcaagccaggcttcacccccggcccctgccacctcaccctccgtcatcagacacagaggactgtagcggggagtgtttgggaggtgtcctggctga

SEQ ID NO: 6851339 - DNA, 59 bp, Homo sapiens
tgaactcagtccaaagttttatgtaagtcatgaggctctttctttggacttcagagtca

SEQ ID NO: 6851340 - DNA, 88 bp, Homo sapiens
caacagctgacagtatttagaggaattgggagaacgtttctaggtttggaacacttttaagactttaatgaacactttgttgttgttg

SEQ ID NO: 6851341 - DNA, 60 bp, Homo sapiens
gaatcctcatgggtagctctggaacctcagagtcagcggttctagaaccgtgggcggttc

SEQ ID NO: 6851342 - DNA, 77 bp, Homo sapiens
tttcttccttctgtgtcttcttgttctgtgacttaaaaaaatgaaagcgagagagagagagagataggaagaaggaa

SEQ ID NO: 6851343 - DNA, 67 bp, Homo sapiens
ggagttagtcatgtatgaaggagcacatttctacataaaaattcttcttaaatatttggctgactct

SEQ ID NO: 6851344 - DNA, 60 bp, Homo sapiens
acatctatatttctcaagtataagatgtcactgagtgctcacttgagagatattagaagt

SEQ ID NO: 6851345 - DNA, 55 bp, Homo sapiens
ggatacgctccaaaatcagaattgaacactcatctgtctaattggggtgttgtcc

SEQ ID NO: 6851346 - DNA, 72 bp, Homo sapiens
ggtgctggtgaattcggtgatggcacatagctaagcaattggcatgtttcatggctgcaaaccacctgtgcc

SEQ ID NO: 6851347 - DNA, 91 bp, Homo sapiens
cttgtagtcgccaccagctgcaacaccatctcctgcagctccagcagcttcacctggagggaggggtgctcagctgtcacgctgctgccag

SEQ ID NO: 6851348 - DNA, 61 bp, Homo sapiens
tctggcccctcccctttctgggtcagagcacccaaggcaggtctgaggaggttgggccaga

SEQ ID NO: 6851349 - DNA, 73 bp, Homo sapiens
ctttcctgctgtgtcctcacacagcctttcctcagctcataggaggggaaatgtaggaggagcagagggagag

SEQ ID NO: 6851350 - DNA, 77 bp, Homo sapiens
tgtaaaaattccaagaataacacttaggttttgctcttgaggaggggcagttctatattattcttgggattcttaca

SEQ ID NO: 6851351 - DNA, 120 bp, Homo sapiens
gcatgacagtagccatgagaagtcaccttagacctgagcaggagctaatgatggtgaattactgtccccaccactgcgggagctcctgcacccagccttgagcagatctcatcttcgtgc

SEQ ID NO: 6851352 - DNA, 59 bp, Homo sapiens
aatattcctgttggtgccactagtaattccatggactttttggaatcagcaagaatatt

SEQ ID NO: 6851353 - DNA, 58 bp, Homo sapiens
ggtaggcagatcactgtctatggaaatccagaatacatggacaggaagacaacctacc

SEQ ID NO: 6851354 - DNA, 107 bp, Homo sapiens
agtgagtgcagaattatgtgaacatgagacagcagaagtgcatttgtgattctcccatgggatcttagttccttacttttgcagttttaacatctcactgcactgct

SEQ ID NO: 6851355 - DNA, 67 bp, Homo sapiens
gtgcatgccataatgcttaattcaatactgtgtccatggacgctggttctaagtgtttggtgggcac

SEQ ID NO: 6851356 - DNA, 57 bp, Homo sapiens
tgagggagcacacactgaagtgctgatccactgcaccatttgttgttgcttccttca

SEQ ID NO: 6851357 - DNA, 76 bp, Homo sapiens
tactcacctttattgttgttgttagtctgttttcagagtttatagacaaatttcctgcaatgaagtttaaggagta

SEQ ID NO: 6851358 - DNA, 57 bp, Homo sapiens
gcaaagagctgggacttaaagtgcagttggcctgaattcaaagcccagctctgctgt

SEQ ID NO: 6851359 - DNA, 57 bp, Homo sapiens
ggaggcggaatggagtaggaagcctccctgtcaggaggtgggtgccgtctgtcctct

SEQ ID NO: 6851360 - DNA, 100 bp, Homo sapiens
ctactagaacccaaaagctgatggaagcttcagaaaacatcctcggtctctatattaccctaggaactattctaagtttctcagtttcagtcctatgtag

SEQ ID NO: 6851361 - DNA, 56 bp, Homo sapiens
agccttgacactggggaaactgggaatgtggtcgcagacttcctatgtcaagtgtt

SEQ ID NO: 6851362 - DNA, 72 bp, Homo sapiens
gaggtagtattttaaagagactgtagatttaagactaataaagtcagttaaactttgtaaagtagatacctc

SEQ ID NO: 6851363 - DNA, 70 bp, Homo sapiens
tgtgccgtcagtgccttatacagagccaaccacatcataggtgctcaggaaataatgtctgtgcggtgta

SEQ ID NO: 6851364 - DNA, 59 bp, Homo sapiens
cataccaggaggctctgactggacccttggtcactggggaccaggcccttcctggtttg

SEQ ID NO: 6851365 - DNA, 125 bp, Homo sapiens
tgtgccaggcgcatgcaaaacttatcccacttgatccttacaaatctgtgagctagccatcattatcccctcttacagatgaggaaacagggtcagaggggtaaaatgctatgcccaaaggtaca

SEQ ID NO: 6851366 - DNA, 56 bp, Homo sapiens
agccacctctatcttgggctccatgttccccaccttagctcctggtataggtgcct

SEQ ID NO: 6851367 - DNA, 58 bp, Homo sapiens
cctgaattgtccaatatcagaaagccctaacaggatgttttgacatatacagttcagg

SEQ ID NO: 6851368 - DNA, 63 bp, Homo sapiens
agtactttgtccatttgcaggcagatgttaaatacagcagttggctcgtgtggatacagtact

SEQ ID NO: 6851369 - DNA, 104 bp, Homo sapiens
acttttactttactgcctagcatattagttttcagtaaatattagtgatctgcattttacacatgggtcctatgtgcttactgaagatggctgtatcttaaagt

SEQ ID NO: 6851370 - DNA, 94 bp, Homo sapiens
caaaggatctttaaagtcctttctcttgagcaagagctgtgtatttattaacagtgttttcttaaggagaaaaatgggcaactgtgaacttttg

SEQ ID NO: 6851371 - DNA, 62 bp, Homo sapiens
ggagctactgtttacagatgccacagtgacaccgcacctcatggcactgcttagcaggttcc

SEQ ID NO: 6851372 - DNA, 71 bp, Homo sapiens
gtgttcacgtgaattgcaccctagctggaagttaacagactaaacaatagcagcagcaattaagtggatat

SEQ ID NO: 6851373 - DNA, 87 bp, Homo sapiens
gctttacataggatttctctttttgcaacttcattgtggattttaacaggaagggagaagaaagaaattctattgcacacgtggagc

SEQ ID NO: 6851374 - DNA, 60 bp, Homo sapiens
tatgccaccatgaactgtagagaatcccacaaaaggatttcagaccaagctggtggcatg

SEQ ID NO: 6851375 - DNA, 82 bp, Homo sapiens
ccgctgggaagtggagtcagaatgcgacaggcctcataattctccagtgggcctccatcttatcttactctgtattccctgg

SEQ ID NO: 6851376 - DNA, 79 bp, Homo sapiens
attcttatggtttcacattgtagattaaagtctttaatccatcctgggttgatttttatataaagtgagaaacgagaat

SEQ ID NO: 6851377 - DNA, 99 bp, Homo sapiens
taaatgagatagtcacagagaacaacaaaaatagtaatttaagctcccatacaacatcaagtgtgttcagtctatttttggttcttcgggttctcttta

SEQ ID NO: 6851378 - DNA, 67 bp, Homo sapiens
gggctcgcatgcagagaatacctgtgatccagtgccagctttcatcaccgctttgcatagccagctt

SEQ ID NO: 6851379 - DNA, 65 bp, Homo sapiens
ttcctccagtatgcctaatattcttagaagaagatgaaattaggacacatacatgtacagaggga

SEQ ID NO: 6851380 - DNA, 75 bp, Homo sapiens
cattgtagccaatgaatatatttcatatgattttgatccttttaaattcattgagacttgttttgtggcccagtg

SEQ ID NO: 6851381 - DNA, 78 bp, Homo sapiens
gctgaccctgactgtctcttctcccatgagcctttcagagccaaaccagctgtgggagatgtgcggcagctggtcagc

SEQ ID NO: 6851382 - DNA, 118 bp, Homo sapiens
tgtgggtgtatttatgtaagtgtgagagtgtgaagaaagcagtaaaatctccgtgcgaggctttaaaatgacatatgtagacaggctgcttttcctccgcactacagatatgtcttcg

SEQ ID NO: 6851383 - DNA, 80 bp, Homo sapiens
tcccaggcctctgttccccatgttttccttcctagacatgaaaatatgaatggaaaaacaaggagaacagggctaaagga

SEQ ID NO: 6851384 - DNA, 64 bp, Homo sapiens
ctgggaacagacgatgctgctgtgtttgccaaaggaagacagctccaagtgtctctgttttcag

SEQ ID NO: 6851385 - DNA, 72 bp, Homo sapiens
ccgttgtccagaactgagtctcatggccatatctagctgaaagatgggctaggaaatgtagttttaaaatgg

SEQ ID NO: 6851386 - DNA, 67 bp, Homo sapiens
cttcttccttccctcacttgcctgcttttcaaacccacttgaacagtgcttggggagcggagagaag

SEQ ID NO: 6851387 - DNA, 104 bp, Homo sapiens
ctgaggcaggagaattgcttgaacccatgaggtggaggttgcagtgagtcaagattgtgccattgcactccagcctgggcaacaagagcgaaactccatctcag

SEQ ID NO: 6851388 - DNA, 55 bp, Homo sapiens
caggcatggaaaagcccagaggagaaggcctctggagccaaacatcacatgcctg

SEQ ID NO: 6851389 - DNA, 78 bp, Homo sapiens
tttttgccctgctttctattatattcttatttacttttagtggatgatggttttattaataggacccaatggcaaaaa

SEQ ID NO: 6851390 - DNA, 61 bp, Homo sapiens
ggcaaggtactctagagcacataccaagagtggaattgctaagttatagagtatctttgct

SEQ ID NO: 6851391 - DNA, 60 bp, Homo sapiens
tggttttgttccagacttgagacccgggagaacggatggtttagttcaagtacagaacca

SEQ ID NO: 6851392 - DNA, 62 bp, Homo sapiens
ctggtgtccttcaggatgaaggaggcagcagaaatgctccctgactcagttcctgagaccag

SEQ ID NO: 6851393 - DNA, 129 bp, Homo sapiens
aacaatataattggattaatgtgggtggactaatttgttttatcatcacttaaaggacactttgtttttagatgttctagaagtgtggtgttcacatttgccccctttgctacttaaatccagtttgtt

SEQ ID NO: 6851394 - DNA, 127 bp, Homo sapiens
tttgaattactatgttgcaaagttggtaatcttagtgagaatacaagaaaacataaggttattcacattcaggtttattttgttttgtatccactgtgatgattaaaattgggattaaatattcaag

SEQ ID NO: 6851395 - DNA, 102 bp, Homo sapiens
gagacggggtttcactgtgttagccaggatggtctcgatctccaggatggtctcgatctccaggatggtctcgatctcctgacgtcgtgatccacccgcctc

SEQ ID NO: 6851396 - DNA, 58 bp, Homo sapiens
gtgatgtgtctctcctcttctgccggtcttgccaaaagtggggattgtgacatattac

SEQ ID NO: 6851397 - DNA, 64 bp, Homo sapiens
cccaactccaggcagggaggccactgagccacttgaatcagcctcttgttcgctgcttggaggg

SEQ ID NO: 6851398 - DNA, 56 bp, Homo sapiens
gagacaaaagttggagtgcaagtctcaccaaagaggagaaactcagcttttgattc

SEQ ID NO: 6851399 - DNA, 69 bp, Homo sapiens
gatagaaagctgcagatcttgtgtacttgtctgagctcagcgtttaagtgatgatcgtctttttttatc

SEQ ID NO: 6851400 - DNA, 62 bp, Homo sapiens
agaggccttggctgtcttattcgttgctgaatcttcagtgcctaggacagggcctggcttct

SEQ ID NO: 6851401 - DNA, 80 bp, Homo sapiens
gttcgtcattcttttgtggcaatggttaagagctcctagaggcacgcggatgcttatttactgatccacagatgacggat

SEQ ID NO: 6851402 - DNA, 67 bp, Homo sapiens
tgctgtggctgccctcatgggcctgatatccacagagggatgacagctatgatgggggagccaggca

SEQ ID NO: 6851403 - DNA, 108 bp, Homo sapiens
ttttggccttcttatatctggctccactggctcatgaaattgtggtatttcagaaagaactgcagaaagcaggaaatgctatcatagctgagcatgaggagttcaaaa

SEQ ID NO: 6851404 - DNA, 130 bp, Homo sapiens
tcaatatgcacctgtttgaagtaatttctttagtaagtgaatctgtgccacaatagttacgtgttcataacattattttctgaagatatcaaagtgttatatcaaaactgcatgtttagctgtcacctga

SEQ ID NO: 6851405 - DNA, 92 bp, Homo sapiens
ctttgatattcaggcatttaatccatctgattgatttataggtatcggattaaggtggagttgaaatcattgcttgagatctgacatcaagg

SEQ ID NO: 6851406 - DNA, 77 bp, Homo sapiens
tgagggggcagatggtagcagtagcttgcttaggtcttttgccctgagctttggagactgactccatcctctcctca

SEQ ID NO: 6851407 - DNA, 82 bp, Homo sapiens
tggggaggtgctgctggcatccaggatgcagaggccagggatgctgcataacatcctacaatgcacagaatagccctcacca

SEQ ID NO: 6851408 - DNA, 83 bp, Homo sapiens
tctcagataatcatgtaactggaatcacatggcatataagcttttgtgtctggctttcttcagttagcatgatgtttttgaga

SEQ ID NO: 6851409 - DNA, 67 bp, Homo sapiens
tctgaagggcaggtcagaagtagaatagtgtttgttctgatgcctttgaagttgactgccttccaga

SEQ ID NO: 6851410 - DNA, 61 bp, Homo sapiens
atgaactgcttagtgatggatgaccctgcaggtctatagggttttcaaagaggcatttcat

SEQ ID NO: 6851411 - DNA, 58 bp, Homo sapiens
ggaactgggacctccgtgtaggactggtggttctctagttctcgagcgtccctgtttc

SEQ ID NO: 6851412 - DNA, 70 bp, Homo sapiens
gcacgggaggtggtcgaggaggggtaccctggttccaggggtccccaaacaggcttgagcatctacctgc

SEQ ID NO: 6851413 - DNA, 68 bp, Homo sapiens
tcccactctcttcactctaccttttgactccacagtggaaaccagaagtagtccagtggaaagtagga

SEQ ID NO: 6851414 - DNA, 55 bp, Homo sapiens
cagacactaggtgacagagtgccacagggcagacaactcgctacgcctgggtctg

SEQ ID NO: 6851415 - DNA, 68 bp, Homo sapiens
gatgacaagatctggatttgaatctcccggctgttccttcctgggggtgcaattctggatcatgtatc

SEQ ID NO: 6851416 - DNA, 64 bp, Homo sapiens
cttctgtacagtaataaaatgagctacatgagacagtgatgtggtttttcagttgctggagaag

SEQ ID NO: 6851417 - DNA, 57 bp, Homo sapiens
tccttcattaagcatgaggcagccactggaggctttgctgcctcagggctttgagga

SEQ ID NO: 6851418 - DNA, 96 bp, Homo sapiens
attatagacattttccctaccctcatgggggttgcaattagcagcagggacatggtggggtgtacaattaaatgggaaattaggatgtcatgtgat

SEQ ID NO: 6851419 - DNA, 84 bp, Homo sapiens
cattgtctttgccaaatgtttttattctacaacagttgatcacatatgttatacttttaatgggaacaggcaagtcagataatg

SEQ ID NO: 6851420 - DNA, 67 bp, Homo sapiens
ctgttattggtagtaagtggaacacactgggtaaatacgtcccaagttattcctttacactatacag

SEQ ID NO: 6851421 - DNA, 101 bp, Homo sapiens
gataagggcctgttggtgggcctggctcagagatgtctgctgccttgctacagagcagaaagcaccctgcactttctggacaggacacccaggtttttatc

SEQ ID NO: 6851422 - DNA, 74 bp, Homo sapiens
ccatccacgtcctctgcttcatgccctgatgcgtgtttctgcatgaagggacacggggcaggggagtgaggggg

SEQ ID NO: 6851423 - DNA, 79 bp, Homo sapiens
cagccatcgtagggtcggctgcccatgcgctggtaccaaactaagccatcacaggggccggctgtccgtgccctggttg

SEQ ID NO: 6851424 - DNA, 71 bp, Homo sapiens
cacaaggttatctgtaggttagatgtgagcacccaaacaaaatatttagccaactatatgactagtttgtg

SEQ ID NO: 6851425 - DNA, 69 bp, Homo sapiens
tgaatatcaatgttttgataataagtgtaatgcagcccttttgcagagtattcagtccattgatgttta

SEQ ID NO: 6851426 - DNA, 102 bp, Homo sapiens
tgtttagatagacactaatttttcggtctgatgatttatgtatcttgggggaattttgttataaatgactgcaaaagttcatagcgggtctatataaaatca

SEQ ID NO: 6851427 - DNA, 72 bp, Homo sapiens
agatcccaagagctactcaatggaatcagctagttacctgtttttccgagtgtggccttatggcaaagatct

SEQ ID NO: 6851428 - DNA, 61 bp, Homo sapiens
gtgctgaggaaggaagacttatctatttgataagtccttcttgttttttctgactctgcat

SEQ ID NO: 6851429 - DNA, 55 bp, Homo sapiens
ggaggctggtctttgcaggtctgttattaacttggcctgacttgatcggctctct

SEQ ID NO: 6851430 - DNA, 83 bp, Homo sapiens
ggctttccttcttggcacagatgagattcttcttgtgagaaatggtggaatcttcagccatgccaagatacagggaccgagtc

SEQ ID NO: 6851431 - DNA, 74 bp, Homo sapiens
ttggcgtattaagggcaagggttgaagataagatagcaatgtctactttatatttttggtcctgactatgctaa

SEQ ID NO: 6851432 - DNA, 59 bp, Homo sapiens
agctgacattggagaagtgcctggagtgtgctgggcactttattgaccccaggtcagtt

SEQ ID NO: 6851433 - DNA, 64 bp, Homo sapiens
ggtgggggaggcacggagcttggagttggtaatgatggagatgccagcaaggtgcctcctcccc

SEQ ID NO: 6851434 - DNA, 88 bp, Homo sapiens
tttggtcttctcttgcctgagatcaaagtcagactggaacttacaccataggctttcctgattctcaggttttcagacttggactgga

SEQ ID NO: 6851435 - DNA, 87 bp, Homo sapiens
ggtatttggtcaggtaaaggtcatttaacaatttatgactacagttggatggtgcaaatgatctcgtatcaaaatataccaaatgcc

SEQ ID NO: 6851436 - DNA, 55 bp, Homo sapiens
gaggggggctgtcagggcaagcccagggatcactgatgctgccctagctcccctc

SEQ ID NO: 6851437 - DNA, 70 bp, Homo sapiens
agtaaaattggaggggttgctataggaacacacaaagtgatgcagagcaataaccactctaatttatact

SEQ ID NO: 6851438 - DNA, 71 bp, Homo sapiens
tgtgggaagctctgcctagatttcagaagatgtatggaaatgcctggatgtccaggtagaagtttgctaca

SEQ ID NO: 6851439 - DNA, 61 bp, Homo sapiens
tgacaaggggaaacaattgatgtggaccattattaaggctttaagtgtttctccattgtta

SEQ ID NO: 6851440 - DNA, 56 bp, Homo sapiens
ctaagagtctagaatatctcagagttttcagaagaaattttgtattctagttctag

SEQ ID NO: 6851441 - DNA, 64 bp, Homo sapiens
tctcctctgtgacatagggcaaataatgtgtctgcttgccttttgaagcctcacaggtaggaga

SEQ ID NO: 6851442 - DNA, 63 bp, Homo sapiens
agattgctgggtcccatccaaggcctcttagatgagaaaccttggggtacaacctaggagtct

SEQ ID NO: 6851443 - DNA, 94 bp, Homo sapiens
gcattttaaggctattgtctcttcatgtgtttaatttttacataaaacaatgataataaaaaatgaatatgatggaggattctctgtaaagtgc

SEQ ID NO: 6851444 - DNA, 112 bp, Homo sapiens
agcggtatctcattatgattttaacatgcatttccctaatgtctaacgctattgagtatctttttatgtgcttattggccatttgcatgtattattttgtgaagtgtctgtt

SEQ ID NO: 6851445 - DNA, 81 bp, Homo sapiens
atggttttattgttttcatttctttgagttggatttgctgctctcttatcttgattattgaaatggaagctataacattgt

SEQ ID NO: 6851446 - DNA, 68 bp, Homo sapiens
gctgacatggtctctggtaagcagctttaatttgatatggctggatgtactttggggctggctgcagc

SEQ ID NO: 6851447 - DNA, 110 bp, Homo sapiens
gctgacgttttatacacttttgcagatgaacctctttgtgaatgtcatgagcagttatcagtctatcatgcagagtagaaagggcaaagctgaactgtaagggcgtcagc

SEQ ID NO: 6851448 - DNA, 68 bp, Homo sapiens
ggctaggcaggctcagagcctataaaggattatgccatctgaggaaaggactctagtgtgttctagct

SEQ ID NO: 6851449 - DNA, 63 bp, Homo sapiens
ggccctggcagccacgaaagccctccagatgccttgaggacgccgtctctagccgggtgggcc

SEQ ID NO: 6851450 - DNA, 119 bp, Homo sapiens
ctgcacatggcttgtgttttgattcagaacaggtagaaattcatctatatgaatttctgtatatcaggtagattaatttctgcctgttctgaatcaaaacaaaaacaagccatggatgg

SEQ ID NO: 6851451 - DNA, 57 bp, Homo sapiens
agagctttgggacatttgctaggacaccggatattctggcatttatgaaccaagcct

SEQ ID NO: 6851452 - DNA, 57 bp, Homo sapiens
gggagttgcagaggcctattgttggctggctattttagccttggccttgctatttcc

SEQ ID NO: 6851453 - DNA, 71 bp, Homo sapiens
taaggtagggatagctttgagggctccttaggagggagtgaaacccctgagggtcaaggagccctagtttg

SEQ ID NO: 6851454 - DNA, 63 bp, Homo sapiens
atggtatatcatactgcagttgcattttaacaccctttgcattgtcaaaagtggtatgaccat

SEQ ID NO: 6851455 - DNA, 59 bp, Homo sapiens
attttggaatttatacagtaatggttggtaaatatcacctattgcctaaataccagaat

SEQ ID NO: 6851456 - DNA, 62 bp, Homo sapiens
cattggatctagccaggaaaacctgaggcctggctctgcctcttcctggctctaggaccttg

SEQ ID NO: 6851457 - DNA, 55 bp, Homo sapiens
gcggtggctctcgggagcttctcccaggctggcagaagggagctccagctactgc

SEQ ID NO: 6851458 - DNA, 89 bp, Homo sapiens
agtctgttttgagatgcaagcaagtctattttacagtttaaaaagagagagagaaaggaagaaagaaaatgctagccttaacacaggct

SEQ ID NO: 6851459 - DNA, 73 bp, Homo sapiens
acgtgcatatgtatacacacatacacttattttacaacaatcaggtcatattgtgtatactgttgtagcatgt

SEQ ID NO: 6851460 - DNA, 59 bp, Homo sapiens
aggcacctggccagttgtcttgcttttgtcttctctagcaaccagctgctgggttgtct

SEQ ID NO: 6851461 - DNA, 103 bp, Homo sapiens
aagggtacttgttggggtcaagtcgctgcacgatctcctcgatgctcttgtgcttctggattagatccacagcccgcttgggcccaatactccagatactctt

SEQ ID NO: 6851462 - DNA, 92 bp, Homo sapiens
tttccttggttatggcaggtgcatggtgtattgggttcatgtttttagttgacaacttttgacacgtgtgctaactttcaggatgaaggaag

SEQ ID NO: 6851463 - DNA, 61 bp, Homo sapiens
ggtagattggggcctgtcagggactctacccctatagtccttacaggtcatccaagtcacc

SEQ ID NO: 6851464 - DNA, 85 bp, Homo sapiens
tatctccatgatggcttgtttagcataggtcactgggagcctcccagacctggaaaacaggcttgcccatggtttatgccaggta

SEQ ID NO: 6851465 - DNA, 95 bp, Homo sapiens
ctgcacgtgctcctaatctagttccagggacaaacaaggttggggatagttcctatctcccacaaagagttttaactggatgtaggtgtctgcag

SEQ ID NO: 6851466 - DNA, 70 bp, Homo sapiens
ctgtgtcccagtaccttgggtaactgccatcttcatggttacatcactatccagggtgactgtgaagcag

SEQ ID NO: 6851467 - DNA, 60 bp, Homo sapiens
tatgatttctaagttttaccacaaatatttctcagtatagtggaaacttagagcattgtg

SEQ ID NO: 6851468 - DNA, 90 bp, Homo sapiens
gggagtatgtgtgtgtgtatatatgtatgtgtgtgtgttgctaaaagtgatttactacagtatgtgtgttatacttcaataaaattttcc

SEQ ID NO: 6851469 - DNA, 60 bp, Homo sapiens
cactagatagtggctgcttggagtaccacatgaaacatgatccagaggccacatccagtg

SEQ ID NO: 6851470 - DNA, 55 bp, Homo sapiens
attgaaaaatgactattgcttaagtttgttttcttaagctgagtgtttttttaat

SEQ ID NO: 6851471 - DNA, 109 bp, Homo sapiens
gaaataggagagagaaatggacgaggagaggaaaagcgaggctattattgaatagtaaaatggaagccattgttgtcttcatcttcagcccatccccaacactcctttc

SEQ ID NO: 6851472 - DNA, 62 bp, Homo sapiens
tctggtgggttgtatcttttaggccttaaacacagatagtttgaaagtatcaactcgcctga

SEQ ID NO: 6851473 - DNA, 59 bp, Homo sapiens
ttcagcttttgtgtgactaacagttgggaagggacaatcctagaagcagggaagctgag

SEQ ID NO: 6851474 - DNA, 77 bp, Homo sapiens
tcaggtgcgcagctagagaggaagaggcgggctcttcaatatggcaaggccttcgtctcctagcttctaggctctga

SEQ ID NO: 6851475 - DNA, 76 bp, Homo sapiens
gccacattcaagctcttgacagctacatctggccagtggctactgaactggacatgcagttctcaagggtagtggt

SEQ ID NO: 6851476 - DNA, 60 bp, Homo sapiens
gactggatgttttgaacatgagaactgtctaatgtaggttagcatgaaaaataaccagtt

SEQ ID NO: 6851477 - DNA, 102 bp, Homo sapiens
taaaattttatatactggatattaatataatgctatataataaaacatttttcccagttgtttgccctttagctttgtgtatgatgtctgtgtattttttta

SEQ ID NO: 6851478 - DNA, 128 bp, Homo sapiens
cctgacacatgataaattgctttatagttgttgattaagtgttggtaattacaatgatcataatttatagtattcttgtgaaagctaagcaaatgagcaactaactgtaatgtaaacaatgtagaagg

SEQ ID NO: 6851479 - DNA, 76 bp, Homo sapiens
catttgactgtgaactttttggcctggattctggagaacagatttccaggattgtcagccagaaggcagacagatg

SEQ ID NO: 6851480 - DNA, 77 bp, Homo sapiens
aacagagtggatgtggcacatgctgctgcttctgggcgcaagttttaagagccattgtgcataccaccagctctgtt

SEQ ID NO: 6851481 - DNA, 77 bp, Homo sapiens
gcccagtgggcggcaccatggccatgagccttttgcaggactagtgccaggggcctggacatggacgcgcacagggc

SEQ ID NO: 6851482 - DNA, 58 bp, Homo sapiens
gggctcaggaaggctcaaccaggacttaacagcagtttccgaagggccttctgagccc

SEQ ID NO: 6851483 - DNA, 62 bp, Homo sapiens
gctatttctaattagggaaaatttacttgtagggggttacaagtatattctagtgatatagc

SEQ ID NO: 6851484 - DNA, 59 bp, Homo sapiens
gtaggtcaatatttctgtcttaattttccagttgagaaagaaacagaaatataacttac

SEQ ID NO: 6851485 - DNA, 67 bp, Homo sapiens
ttggggtgttctataaatatcagccacatttcccaaagctgtccatggtttatacagaagaccccaa

SEQ ID NO: 6851486 - DNA, 58 bp, Homo sapiens
cagctagcagagggttttacagacatttccaaaggtctgtccacctactgactagttg

SEQ ID NO: 6851487 - DNA, 61 bp, Homo sapiens
cctgagaataacagctgctcttaggatgctcaaagctccttgcagctgattatttttcagg

SEQ ID NO: 6851488 - DNA, 65 bp, Homo sapiens
atgaaaacagacagccagtgtagagacagtccgtatcctgtttctactgtatgactctgattcat

SEQ ID NO: 6851489 - DNA, 65 bp, Homo sapiens
tgtccttttctttagtgcagctgctggctgataaacctgctcctgctctctctaaggcaaggcca

SEQ ID NO: 6851490 - DNA, 76 bp, Homo sapiens
tgcttttctagagagtactgagatggtcaagatatgcactgttgatgggctaattttcagtgttcatagcacagca

SEQ ID NO: 6851491 - DNA, 62 bp, Homo sapiens
gagttatttcagaaggaaagatctagtgaacatggtcctttaaatccttctgaaaagggctt

SEQ ID NO: 6851492 - DNA, 67 bp, Homo sapiens
gtttgttattccaaatcatggttgcatttgtggacaagctgcctcctgagatttgggcatgttagat

SEQ ID NO: 6851493 - DNA, 87 bp, Homo sapiens
ataacttttctttctgctttaggcagttcctgcagatccatttattaaagatagaatctggctcacctgggtaaatagttgagttat

SEQ ID NO: 6851494 - DNA, 79 bp, Homo sapiens
tttttgaacattcctatctaactccttaagctctgcgtagaccccttgagagctgaagatatgttaactggatcaaaga

SEQ ID NO: 6851495 - DNA, 68 bp, Homo sapiens
catcacatctactataagtgatctgttactctttagcaggctagcccaaacttgttttggaggtgatg

SEQ ID NO: 6851496 - DNA, 125 bp, Homo sapiens
tagagatcagggaaaaattatagcctatgtcttaactctttatggtgtttaagagctgttatgaggctttcagttacagctgcaccagagcctgagaataggcttctctctttcctccttctttg

SEQ ID NO: 6851497 - DNA, 58 bp, Homo sapiens
gctttgctgaggtctgaggattggctcagccaagggaccctcaagcctgagctgaagc

SEQ ID NO: 6851498 - DNA, 61 bp, Homo sapiens
tagcctttctccaaggccacccaaggagcccagtgaaagctccagccctggagccaggcta

SEQ ID NO: 6851499 - DNA, 81 bp, Homo sapiens
aacctgttctctagttttgacgaggattagtttaagtgttatcttaagaaaagtctttgccaagtctctgagaccagtgtt

SEQ ID NO: 6851500 - DNA, 86 bp, Homo sapiens
tttctcaaatggagaattagcagtttgattaattacacccctagatctcaaggccatttctaagctgctaatgcatttccaaggag

SEQ ID NO: 6851501 - DNA, 69 bp, Homo sapiens
ggccagttcatgaggccacaggaaagggcccgggcttcccgggtctcttggggcctgtgtgctagaacc

SEQ ID NO: 6851502 - DNA, 61 bp, Homo sapiens
gtccctgcatcaccacgggacttgggctgttccaatggtcctggtgaagatgaaaagggac

SEQ ID NO: 6851503 - DNA, 78 bp, Homo sapiens
ctgcatatcatacaaatatatgcatgtgtgtatatttatgtgttgtgtgtgtacatacatgtatgtgtgtatttacag

SEQ ID NO: 6851504 - DNA, 82 bp, Homo sapiens
ggttgcccagcttcctttggttggagcgccgtctcctggccagagaatgtgaagctcagccaaaggagatctttgggcttcc

SEQ ID NO: 6851505 - DNA, 61 bp, Homo sapiens
ggcatagcagggatgtcagcaagtagaaaagctaggtctactatggttattatccctctcc

SEQ ID NO: 6851506 - DNA, 130 bp, Homo sapiens
gaccttctatgccctctcagctccagaaaaacttgatcgtattggcgcctacctctctgagaggctcatccgtgacgtgggtcgccatcgatatgggtaagtagtttggaagagagggagagagattgtc

SEQ ID NO: 6851507 - DNA, 72 bp, Homo sapiens
gcatgtgtttcttttcaaaattgctctgaaaaatattagttatttcaagcagcgtgaaaaacgacagagtgt

SEQ ID NO: 6851508 - DNA, 57 bp, Homo sapiens
acatattcttcatcagagatgcactagaaaacactgtctagtgcgtaaagaaggtgt

SEQ ID NO: 6851509 - DNA, 84 bp, Homo sapiens
agccctgcttgtcaaaaagacttattcactagtttccatcagtttaagcattaagaataatgtctttggcttgaccagcaagct

SEQ ID NO: 6851510 - DNA, 96 bp, Homo sapiens
cactttcaggtgtctttagagcaatgctctactccttggtaccaattttctgtattagtaagttctcgcattgttataaagaaatacctgagactg

SEQ ID NO: 6851511 - DNA, 81 bp, Homo sapiens
gctccaaagagaacagagttgtgtttgtacaacgctgcacatgctagtgttggaaggcaagcagcaattttctctgaaagc

SEQ ID NO: 6851512 - DNA, 61 bp, Homo sapiens
agtgggcatgatctggtgtctggaaaggtggcttcggggactcattgttgtgcctttcact

SEQ ID NO: 6851513 - DNA, 56 bp, Homo sapiens
cccttagctctgggcagccggtggctttggcggccactggccaccactggcagggg

SEQ ID NO: 6851514 - DNA, 65 bp, Homo sapiens
ggttgctgagacgccctttacgacaagcttttggggtactgaagcgtttgtaggggtgttttgcc

SEQ ID NO: 6851515 - DNA, 80 bp, Homo sapiens
aagtgagatgtgaggacgtggaggcagtggctattggcccatctaccaagagcttctgctcttcatggaaacatgtactt

SEQ ID NO: 6851516 - DNA, 88 bp, Homo sapiens
ctcccctctgccctgagattcttggattctgcctcacctcatcggtgttttggtagaattcaagattcaacaggctttttgatgggag

SEQ ID NO: 6851517 - DNA, 57 bp, Homo sapiens
acacaggggaaagtggagctgagagatcaaccagttacccaagccaacccctgatgt

SEQ ID NO: 6851518 - DNA, 66 bp, Homo sapiens
ctaggctgcatttgaaccaatgtcggccttcccttaggaccagcagagacggtaagcagaacttag

SEQ ID NO: 6851519 - DNA, 60 bp, Homo sapiens
cctgctgtaatgtgtctttatttgttgctcaccatttaatgttggctatattgaagtagg

SEQ ID NO: 6851520 - DNA, 60 bp, Homo sapiens
cctctgtggggaagagtatgacttggcagactagagatgcggagaatcagccccgggagg

SEQ ID NO: 6851521 - DNA, 76 bp, Homo sapiens
ggggcaagctaggaggccctgcacgcttaccctgagagtggggctccccagtaagagtgcatcttccagcagcccc

SEQ ID NO: 6851522 - DNA, 57 bp, Homo sapiens
gctggagtccagtggcatgatcatagctcactataacctcaactcctgggctcaagc

SEQ ID NO: 6851523 - DNA, 107 bp, Homo sapiens
cagcccctcctccttgctcggcctgcctttgcctgtcgcctggtcctctctggaagctgctctgcctctggaccagccgagggggtaggatgagctgggtggggctg

SEQ ID NO: 6851524 - DNA, 63 bp, Homo sapiens
cctgtctgcatgatccctgccagccggtatcaggttgaggcagggaactttgcagcttgcggg

SEQ ID NO: 6851525 - DNA, 85 bp, Homo sapiens
catagtacattcagagaaagtttccatcctggggggcttaaaataaagcatctaattgagtgaaacttttcctgtaatgattgtg

SEQ ID NO: 6851526 - DNA, 101 bp, Homo sapiens
atatataaatttgttcagaattcctattatgtaaaggttattgcagggtacagtgtgctgtagtgatatctgctgatttttctctgtgataaattatatat

SEQ ID NO: 6851527 - DNA, 70 bp, Homo sapiens
ggtgacattctggtggccaaacgcatgcgaacactgtcctcccgcattcagtgagtgtttaccggaagcc

SEQ ID NO: 6851528 - DNA, 55 bp, Homo sapiens
atatatatcgagttcatgtctcttgttttcatgaggagacacacttgatatgtgt

SEQ ID NO: 6851529 - DNA, 86 bp, Homo sapiens
tcaggttgctatgacagaataccatagattgtgtggcataaactacaaacatgtatttctcatggttctggagactggtaatctga

SEQ ID NO: 6851530 - DNA, 75 bp, Homo sapiens
tgagcccagaagagtatgtgtttgctgcgctgaacctgtacacagacatcatcaacatcttcctgtacatcctca

SEQ ID NO: 6851531 - DNA, 58 bp, Homo sapiens
ctcctaaccagcctcacctccccactgaacagatgggaaactgaggctcggtgaggag

SEQ ID NO: 6851532 - DNA, 64 bp, Homo sapiens
ggaacacttcaggctgcgtcagcagatctggattataaatcagtccgacagcagcttttgttct

SEQ ID NO: 6851533 - DNA, 80 bp, Homo sapiens
ggcaggaagagcagcatgtggggtgtgtgggacaggaggtgcatgcactgctgccagctggcccagctgtgctccctgcc

SEQ ID NO: 6851534 - DNA, 67 bp, Homo sapiens
cactgtgtctggagtgagctgggtttttcttctgctgttggcctggctcactcatgcagccgcagtg

SEQ ID NO: 6851535 - DNA, 55 bp, Homo sapiens
agcccctgtcctctctgatgaccacctgtccaggttgtcccaggactgaggggtt

SEQ ID NO: 6851536 - DNA, 76 bp, Homo sapiens
tagcctcacatctacttgacgtttggcagaatgaagtcccagagtgcccagctgtcaaagtagataagtcttgcta

SEQ ID NO: 6851537 - DNA, 77 bp, Homo sapiens
gtgaggccgatcaacactgaaggaatggggctttttgggggaagagcagcctccaggggtggaggagcaggcctcac

SEQ ID NO: 6851538 - DNA, 62 bp, Homo sapiens
gatgtgcaggctctcgttcttgacatctgaacctaagtgcaaggtttaagtgcctgggcatt

SEQ ID NO: 6851539 - DNA, 114 bp, Homo sapiens
cctgccagggttgggaaagcttctcacactcccagcctcccacagtctgggactggatggcaatcacagcatctgcagagggagtgctgggtcagggagggcaggcttggcagg

SEQ ID NO: 6851540 - DNA, 103 bp, Homo sapiens
gaagatggaacttttgattctggaaattttgaacagtttctaaaaggttaaaatcaatggaaaaactgaaaatctcacagatgttgttaacagtgaatgcttc

SEQ ID NO: 6851541 - DNA, 103 bp, Homo sapiens
aaaagttgccttgttaatgcagtagagcagctctggggtgaagatccaagtcttacacccttctcctgagtgtgtttctattgctttaattcaacagactttt

SEQ ID NO: 6851542 - DNA, 63 bp, Homo sapiens
gatttacaggttaggtcctgtaaaagggcacttgtatgaccctctaggcctgcgctgtatatc

SEQ ID NO: 6851543 - DNA, 58 bp, Homo sapiens
cttccttccttccccgaaatgcttttgccaattacccagccagggtgaaggaaagaag

SEQ ID NO: 6851544 - DNA, 93 bp, Homo sapiens
ttcctttggctttttgacatacacagtgctatgctttcccccaatgttttcacaaaagaacttgctggcaggcactgaagcagagcagaggaa

SEQ ID NO: 6851545 - DNA, 74 bp, Homo sapiens
gcttcacttggcagattcctcaagagttggatgaactccagccaatgtctgagtctctgtatcccatgtggggc

SEQ ID NO: 6851546 - DNA, 58 bp, Homo sapiens
tatttgatgctgtgcggtcatcctgattctggaggatgatgtttttggtagtcaaatg

SEQ ID NO: 6851547 - DNA, 77 bp, Homo sapiens
caagcatgcacgctcgtggcagtaatgacgtgtgggtgtacccaggcttcactcgacatgccaatgatgcaaacttg

SEQ ID NO: 6851548 - DNA, 109 bp, Homo sapiens
aaacagagaaggaggcaatcagtgtgagaggagttactatttccgaggcctggcctttggcgctcgggtctcctcctcttatacccttttgctgctttgaaatctgttt

SEQ ID NO: 6851549 - DNA, 56 bp, Homo sapiens
gcagtgaagatttgggctctggagtcaaaatatctaggatcaaataaaatctctgc

SEQ ID NO: 6851550 - DNA, 56 bp, Homo sapiens
gccctgtgcgctgagttcaggggtcagattggctgccggatgactctcacaagggc

SEQ ID NO: 6851551 - DNA, 66 bp, Homo sapiens
tttagccatgagctgggcgactctagggctgcaacacagtccccgagtggtggagccatggctgga

SEQ ID NO: 6851552 - DNA, 83 bp, Homo sapiens
aatgatttctgcttagtagacttcctgtcttggcggtatcactcagagaggattttaataagtgttgtttttcagagatcgtt

SEQ ID NO: 6851553 - DNA, 69 bp, Homo sapiens
cgctccttctcagatgctatcgctggtcagtgacccagactggcgagacagctatttgggaagccagtg

SEQ ID NO: 6851554 - DNA, 62 bp, Homo sapiens
gtcgtcatcttcctcttcctccattggttctgaagatggggtctcctaatggaggatgacac

SEQ ID NO: 6851555 - DNA, 110 bp, Homo sapiens
ggtgtcctctctgtcacaggtgtcctttctctcactagctgtgtgcagtcaccaaaaacgcagccagtgggatgagaaagaaggcccagaaccagacagacaggtgcacc

SEQ ID NO: 6851556 - DNA, 61 bp, Homo sapiens
ggccttacttgtctcttctgacaaagtttgaaattctattttgtctgaaataagtacagcc

SEQ ID NO: 6851557 - DNA, 74 bp, Homo sapiens
gtctccatggtgctttttaatttattgacagcgtgttgttgaagtctaattgataaggttctgagccatgagat

SEQ ID NO: 6851558 - DNA, 65 bp, Homo sapiens
catctcatttcctggattatctttcctgtgccaactcacagtgtgggacattaggaaatggtatg

SEQ ID NO: 6851559 - DNA, 81 bp, Homo sapiens
tgaatattgttttatctttctacagactctcatatcagcagccagatcacttagggtcttgaaggagtttagatttattta

SEQ ID NO: 6851560 - DNA, 64 bp, Homo sapiens
gcactgtgataaatatgtgaattatttcattgactcttcagtgagataggtattattatcatgc

SEQ ID NO: 6851561 - DNA, 87 bp, Homo sapiens
gtgtgcatctgtgcccatgtatgtgcacgtgtgtttgtgtgtgtgcatgcacacatgtgtctgcatgcagtgtctcagatcctacat

SEQ ID NO: 6851562 - DNA, 55 bp, Homo sapiens
accagatccaagccaccctctcaccagccttattgggagcagcttcctatctggt

SEQ ID NO: 6851563 - DNA, 122 bp, Homo sapiens
gaattaactagggaattttcaaaaacttcccatgcctggcccctatccttagagaatcagatttaactcgtttggattagttcccaggtgtgggtattttttagaagttcacacagtgattc

SEQ ID NO: 6851564 - DNA, 92 bp, Homo sapiens
atgagatagatggctcgagaatggggcctcttagactctgcctcttacagtggtcctgggatttgcccttttctcttaacataattttacat

SEQ ID NO: 6851565 - DNA, 78 bp, Homo sapiens
gtgactcgaactcggggaaattgttcctgtaatggagttctcaatttattggtcaatttcaccttgattttgtgtcac

SEQ ID NO: 6851566 - DNA, 61 bp, Homo sapiens
gtcttgcaaagtagctgagaggttctaaccaaaaggatgaatgtcaaagtgctttgcaaac

SEQ ID NO: 6851567 - DNA, 65 bp, Homo sapiens
ctgcagtgagttggggtctggggaagctacaagggcagcactcagtctgcagcccacttgggcag

SEQ ID NO: 6851568 - DNA, 65 bp, Homo sapiens
aaaggactaggtgttgccaaaaagttaacattttttaaagaagtttggttaaacattagttcttt

SEQ ID NO: 6851569 - DNA, 75 bp, Homo sapiens
tctatgtcaaccttgcagtgcagtagaggaagggctgaggttggcagccaggatgcggtgcaaggattgcgggga

SEQ ID NO: 6851570 - DNA, 65 bp, Homo sapiens
gttttgatgcttttttgttcctaaataaatgagatagagttgaagagaagcaaaagtatcaaagc

SEQ ID NO: 6851571 - DNA, 61 bp, Homo sapiens
ggagagggtaggggtcctgcccacctgcagtcacccctcagccaggcctcttaccctctct

SEQ ID NO: 6851572 - DNA, 72 bp, Homo sapiens
attgttcactgtcctgcaactctagagcctgggaagtccaagatcaaggtatctgcagatatggtgtctggt

SEQ ID NO: 6851573 - DNA, 84 bp, Homo sapiens
gttagtgtacaaaatgatagataaatatttgctgttgctaaaagcatcttagtgataacctttgtactatggtttttcactaac

SEQ ID NO: 6851574 - DNA, 60 bp, Homo sapiens
ctccaggagctgtgtctttctttcaggataacatagaagttaagagcacagaatctggag

SEQ ID NO: 6851575 - DNA, 64 bp, Homo sapiens
gcttgaattactgctgcctcctggctgagtttaaatgtttctcaaggaggcaatgtagataagc

SEQ ID NO: 6851576 - DNA, 122 bp, Homo sapiens
gtgcaatactgggctttgtcaatagaggatgtgagagaaatgtgggaaggtgtagaaagaacaaagcgcttgtcatctttgttcctgtattttccttcctcttgtggctctcagtggtgtgc

SEQ ID NO: 6851577 - DNA, 58 bp, Homo sapiens
gtccttggtatgacatgcaaaatgtgtgctgggcactgcacctgtgtaccaagatgac

SEQ ID NO: 6851578 - DNA, 84 bp, Homo sapiens
tgctcaggaaagtcacttgtctcttgtaccagaccataaggggtttacatggcctgggagagggatagtgcagatcctgttgta

SEQ ID NO: 6851579 - DNA, 60 bp, Homo sapiens
gtctctgagctctgagctggctggggtcagcctgagcagcggtggaaggagcacagagac

SEQ ID NO: 6851580 - DNA, 68 bp, Homo sapiens
ccaagtaagtaaacactatgacacatgcgtgtgtgtgcatgagtatatgatttgtgtttgcttggtgg

SEQ ID NO: 6851581 - DNA, 94 bp, Homo sapiens
gttattcttctacatcttggtgtgaaacaggtacacaggacaaagtacttggaacaagtagttgctggtgtcctttatattgaggtgtcatagc

SEQ ID NO: 6851582 - DNA, 57 bp, Homo sapiens
tggcagcctctggttgcttcaggatgggaactagtcaccagagagaccaaggcgcca

SEQ ID NO: 6851583 - DNA, 68 bp, Homo sapiens
gagaacaggagaatgacaaggcaaaatcaggaaataaagcagactaatttggtcatttacttgttctt

SEQ ID NO: 6851584 - DNA, 61 bp, Homo sapiens
ccagtaagtgcataataggtacaacatattttggatgagtgaaggtttctgcatttattgg

SEQ ID NO: 6851585 - DNA, 61 bp, Homo sapiens
tttcagagccctgctcctccccaaggccaggtgcagcaattggagaggaagggcactcaga

SEQ ID NO: 6851586 - DNA, 93 bp, Homo sapiens
gctctgaaacgtgatctgtacatttatttttgcagcatattgaggtattcattgtggcttaataaatgacagatttttatgacttttatgagt

SEQ ID NO: 6851587 - DNA, 60 bp, Homo sapiens
tgcggctcagacttcccaagaacaggccatcttctgtgggatgggagctctggagcaacg

SEQ ID NO: 6851588 - DNA, 59 bp, Homo sapiens
gctgagctgacatattggaatagcatgtttggtgatttgaaaatatgtctagttacagc

SEQ ID NO: 6851589 - DNA, 78 bp, Homo sapiens
ggagcgtttagataggatttattctacaatattgcatagaggctgtgcttcgtattattaatcctgttaaaaatctct

SEQ ID NO: 6851590 - DNA, 103 bp, Homo sapiens
cccagggccctggggctggccctgcccacctgtctctgcagggccctgccttgacaaaagccaggacctcagatgcagggcctggcctcccagggtcccaggg

SEQ ID NO: 6851591 - DNA, 69 bp, Homo sapiens
ttgcctcattttctggtgaaatgggcttaatcaactacatcagtcaatttcctactataaaagaggtaa

SEQ ID NO: 6851592 - DNA, 71 bp, Homo sapiens
tacaatatgtggccttttgtgactggcttttttctcttagcataatgtctgcaaggctcattcttgttgta

SEQ ID NO: 6851593 - DNA, 65 bp, Homo sapiens
tcagtggctcccatgtcttgcacttcaatataaaccctgtagcatggtgtagtggggccacctga

SEQ ID NO: 6851594 - DNA, 67 bp, Homo sapiens
aggtttaggctcctgagtccacagcacaccaacagtctgtagtgcagtatctctgggagtgggacct

SEQ ID NO: 6851595 - DNA, 62 bp, Homo sapiens
cctctgcacccacaggcacttccctttaaaaaatttcacctagggaaagtgcggggcagggg

SEQ ID NO: 6851596 - DNA, 100 bp, Homo sapiens
tgctcggtcacccaggctggagtgcagtggcacaatcttggctcacagcaacctccgctgccagggttcaagctattctccagcctcagcctcccgagca

SEQ ID NO: 6851597 - DNA, 56 bp, Homo sapiens
acagtccctgtgcaggctgcgggcatcttcatgctgctggcctgtccacgggctgt

SEQ ID NO: 6851598 - DNA, 70 bp, Homo sapiens
gtgtgccaagcactgaggacattgttgacacctttgtaaatacttcagcattggtccttatttggtttat

SEQ ID NO: 6851599 - DNA, 83 bp, Homo sapiens
gtggtcttcagttgtcatactgccttggtgacaatctttcaatttcaattcagtaagttcagcaatatggattgaagacacac

SEQ ID NO: 6851600 - DNA, 100 bp, Homo sapiens
gcctgcagaggtccctgggaggagttgtatacacttaggcagatagatggttaaatgactgccttgattatcagctaacaccttccagggccttgtgggc

SEQ ID NO: 6851601 - DNA, 64 bp, Homo sapiens
ggaaggtcagagggccaaagttttctagtaattcatctaggaaattaaccacctttggcttttc

SEQ ID NO: 6851602 - DNA, 95 bp, Homo sapiens
gccaaacttcagagttttcacattttttatataccaaggtgggttaaagcagcctctttgtataaggaatatttttgaaactgttgacatttggc

SEQ ID NO: 6851603 - DNA, 65 bp, Homo sapiens
cagctggctccacctctgggctcacctaagcagggactcacacgcccggagctggggtgaggctg

SEQ ID NO: 6851604 - DNA, 72 bp, Homo sapiens
gggttcttttggggaagagggttggccagtggcattttctgcagatttgctttcccttccctgacagattcc

SEQ ID NO: 6851605 - DNA, 68 bp, Homo sapiens
tgcttcatttttttgtatgtcattattgtttttacttaagcaaagctcatgacattacaggaggagca

SEQ ID NO: 6851606 - DNA, 64 bp, Homo sapiens
tagggatgacgaaaggacagagaacaccaccagttttctccaaaaaacccttttctcatctcta

SEQ ID NO: 6851607 - DNA, 84 bp, Homo sapiens
gaaagaaacagtttggaatatggtgaattttgccttgtgacatttggtaaattatttaacatattctagacctttgtttttttc

SEQ ID NO: 6851608 - DNA, 57 bp, Homo sapiens
cttgaggctggggtcacttcaggattcaccgcagttccagaatgctccaacctgaag

SEQ ID NO: 6851609 - DNA, 74 bp, Homo sapiens
aaactttgattctctctggatcccatggatatgggaactgtgatgtccaggagatccagagagaatcagagttt

SEQ ID NO: 6851610 - DNA, 129 bp, Homo sapiens
acattatcttttagttaataagtcaactatcctgaatgcttggagtcataaaatgtctaagccatagtgcattgggaattttaaactgcagctttacatgacctgtatgaatgactaaaatattgatgt

SEQ ID NO: 6851611 - DNA, 76 bp, Homo sapiens
ggggaagtgcagattaacaaatttcatatccaataatatttattgagtgtttgctttgttaaactgaaaattctcc

SEQ ID NO: 6851612 - DNA, 55 bp, Homo sapiens
aagagcatcaatgactcgcagttaggatttaagtctgtttgttattattgctttt

SEQ ID NO: 6851613 - DNA, 81 bp, Homo sapiens
ttagactatagtattggttgcacactctgttaatatactaactgaaccgtatactttaacgtggcgaaccttatagtataa

SEQ ID NO: 6851614 - DNA, 59 bp, Homo sapiens
gctaacatgttcctgagctgtttagggcttttcccaccctcaggatcttatatattagt

SEQ ID NO: 6851615 - DNA, 90 bp, Homo sapiens
gctctgtcatcaggggcttgaggtgcatgtcgggtggctggctgaccacccagtgggcatagcggctcagcgtccagcaggcgatggagc

SEQ ID NO: 6851616 - DNA, 80 bp, Homo sapiens
ctggtatgaagtaaaattgatttggaatcctagctctttatggaaggagtttagagttcaaattagttcagcttcctcag

SEQ ID NO: 6851617 - DNA, 60 bp, Homo sapiens
gaagcagaacccactccccaacttctccactctctgaatgaggagtgatttttttgcttt

SEQ ID NO: 6851618 - DNA, 60 bp, Homo sapiens
gagctgcatagctgggatcctcaaggctacacacacacgcttggagcagggatgcggttc

SEQ ID NO: 6851619 - DNA, 90 bp, Homo sapiens
gtgggtccaagctgccttggctgaggagggagctgaggaggtgtgagcccctgccaggaaccccctgcccagaccatgtacttggcccac

SEQ ID NO: 6851620 - DNA, 76 bp, Homo sapiens
ggggatgttactgggcatctagtgggtagaagccagggggtatggctaaatatcctacaatgcataggacagctcc

SEQ ID NO: 6851621 - DNA, 78 bp, Homo sapiens
ccctggatccttctgaagaaattctactaagctgtgctggatggcagctggctgaatcttctgcaatacacttcaggg

SEQ ID NO: 6851622 - DNA, 127 bp, Homo sapiens
gctccccgaccccgctagtcatctgccttgttgtcagtggtgtcctttgtgtcccgccttggcacaggctcaggacctgggattgccagatgctgagaggagatgagatggaaaggatgagggaagc

SEQ ID NO: 6851623 - DNA, 88 bp, Homo sapiens
agggatgtgtgctaaaggtagatggacagagggtgggaagtcccttattatttccacttttttctccatctctgactctgccatctct

SEQ ID NO: 6851624 - DNA, 65 bp, Homo sapiens
ccatgaactgcagtataaacttgggcccagggagactggctccgatttattctgacagtttatgg

SEQ ID NO: 6851625 - DNA, 108 bp, Homo sapiens
agtagtttctcttctctaagcccttttcatggaatatctcatttcacagcctcaattacattatgacatgtatgctttatgaagtaggtccagaaaagagaaataact

SEQ ID NO: 6851626 - DNA, 130 bp, Homo sapiens
aacagataatgaattattgtcagcctactctcctccagctgtgcaagacgccatagactctgtcttcatgcacctcacagctaggtgggagtgctgggaaataaacgtaaaaataaattatttgtcattt

SEQ ID NO: 6851627 - DNA, 60 bp, Homo sapiens
gctgccctgacaagctactcccaggggagagtactgagagaagcctgatgcaggaacagc

SEQ ID NO: 6851628 - DNA, 129 bp, Homo sapiens
agttctttgcatagtgctaggcacaaagttggcttgcagtgaagactttctggggtgtaaaggtgactttcctttacacatggaatgggtctaatttacgaagctagattgcgtagttggcagttctct

SEQ ID NO: 6851629 - DNA, 70 bp, Homo sapiens
gtacaagttctactctataaattctggaaaccaaaaaggccaagtagttgtagtgtagctatttgcatac

SEQ ID NO: 6851630 - DNA, 62 bp, Homo sapiens
atagcactagagaatccagccatcgtttatgacgatcattgtaggggctgtttttaggctgt

SEQ ID NO: 6851631 - DNA, 76 bp, Homo sapiens
ggctggaaagcagtggtacaatcatagctcactccacctcaaactcctggactccagtgattgtcctgtctcagcc

SEQ ID NO: 6851632 - DNA, 84 bp, Homo sapiens
ataattgatgaatgcaatattttatgacagattatgcatttccttagacaggtaactgttacagaaatattgcttcttgattat

SEQ ID NO: 6851633 - DNA, 65 bp, Homo sapiens
ggaacctcaggcctgccagagccccacccctacaccgggaggttgggggcaggcgtgaggcagcc

SEQ ID NO: 6851634 - DNA, 65 bp, Homo sapiens
gcagctctcctctgtgaggaacctgggaagagtttcttcctcatgcctcctgaggatgaagttgc

SEQ ID NO: 6851635 - DNA, 64 bp, Homo sapiens
tcatctggggctgtctgctaatcgtgagcgtgtgtgtagaggggacagagagttttagacttgg

SEQ ID NO: 6851636 - DNA, 57 bp, Homo sapiens
caaattgctgggtctcaccctcagagcttatgatctggggtgtggcctgggaatttg

SEQ ID NO: 6851637 - DNA, 60 bp, Homo sapiens
ggtgggaagaggaaaaggaatggatatctaatcaagaaggtctacatgcctcttcccatc

SEQ ID NO: 6851638 - DNA, 85 bp, Homo sapiens
tgacaaattgtgtgtgtgtgtgtgtgtgtgtgtgtgtgtgtgtttacgcttgcacataagcacacacttctattcatgtgtgtta

SEQ ID NO: 6851639 - DNA, 75 bp, Homo sapiens
ttgcttctagctgacatttgagagagatatacagtaggtatatatgtataaaatggaatgtcagaattgaagtaa

SEQ ID NO: 6851640 - DNA, 72 bp, Homo sapiens
gttgagccctaggaaattgtcactactggacttgtttgatctacataaaacagcagtttcctatggttcagc

SEQ ID NO: 6851641 - DNA, 127 bp, Homo sapiens
gctaatgaaggaagtaggacctcagcaggtgctttgtttactcctggaacatctcaaacataagcattccagagtgagagaggaggtggtgaacatttgcatctgctccctgctgacctatcctagt

SEQ ID NO: 6851642 - DNA, 117 bp, Homo sapiens
tatattaaataaattgggagtgcattttgtagtttttggtatttgtaagctattattcttactgtctatttgaagcttataatgtaactaaggactacttttagattatttgatgta

SEQ ID NO: 6851643 - DNA, 86 bp, Homo sapiens
tcatgcctaaaattacttcattattggaaccagtgtttgatctgtgattaagagctggatgaagaaatcaagtaatcagccattga

SEQ ID NO: 6851644 - DNA, 56 bp, Homo sapiens
caccagcgactgtgaccagcaatagccccctggctccagctgtccggtagctggtg

SEQ ID NO: 6851645 - DNA, 73 bp, Homo sapiens
ggcacagaccctcttattcctacagtaacaggtccgctgctggccctggataggggtgggagtggcctgagtc

SEQ ID NO: 6851646 - DNA, 61 bp, Homo sapiens
tgtaatatatataaggagctttaagggactttttcctcgaaatgctctctaatgtaataca

SEQ ID NO: 6851647 - DNA, 88 bp, Homo sapiens
aaagatgactttgaattaacgacacaagtgaatatctgaattcaatttgagtttgtaattcttccaagtaaaacagagtttaatcttt

SEQ ID NO: 6851648 - DNA, 66 bp, Homo sapiens
tactggaatggaagtggcaggatgtggagtccagacatagtctaccactcatgctacttactagta

SEQ ID NO: 6851649 - DNA, 87 bp, Homo sapiens
tgggaggatctcatgagcccaggactttgaggctgcagtgagccatgattgcaccactgcagcctgggcaacagagtgagactgtca

SEQ ID NO: 6851650 - DNA, 67 bp, Homo sapiens
ccagaagtccaagatcaaggtgtcagcagggtttgtttcttctgaggcctctctcctgggcttgtgg

SEQ ID NO: 6851651 - DNA, 117 bp, Homo sapiens
gaatctctgggggtggagcttaggtgtccacattttaaacttatggaccaggtaaatctaattcatactaaagtgtaagatgtgagaaccacgttttatccactcccaaaggggttt

SEQ ID NO: 6851652 - DNA, 79 bp, Homo sapiens
gccgaatttgacactaagatgcagttatactgtgtagaaaatgcacaatttgtttgctcttagtcaggaacagtttggt

SEQ ID NO: 6851653 - DNA, 72 bp, Homo sapiens
cctccccagtttcctgggtcccacagcctcttgcttaaggctgcctgaactttggggaaacagaggaggagg

SEQ ID NO: 6851654 - DNA, 84 bp, Homo sapiens
ctgtgcctttttgtgttagagcacaattattttataaagatcatgaaatggctacaagatgtgctctgagaactaagcgttcgg

SEQ ID NO: 6851655 - DNA, 81 bp, Homo sapiens
caacttgtaggacaaaatacttactggagaacatttttgtaatgttgtttttcatgtgaatatatttgtcttagaacattg

SEQ ID NO: 6851656 - DNA, 110 bp, Homo sapiens
ccctgggtatcagctgaattctacctggtgttggcagtgcggtgttccaaagcaaagtcccacagatactgtactttcccaagcacacagattctctctgaaccacaggg

SEQ ID NO: 6851657 - DNA, 55 bp, Homo sapiens
tgttgctaaggggaatgagagcccaagtggggccagatgttccagtttggcaaca

SEQ ID NO: 6851658 - DNA, 85 bp, Homo sapiens
cctgtgctcctggaatccattgctgtgctgccagggcgaagcaatgttgctggtggcaatgctgataggatcaggtagcaattgg

SEQ ID NO: 6851659 - DNA, 88 bp, Homo sapiens
gggtatcagttgctagttatctctgtatttatccatgctgttacagagggaaagtacagatggtgaggttggatcagctgtcataccc

SEQ ID NO: 6851660 - DNA, 58 bp, Homo sapiens
ccatgtagagtagaatagtacaactgttccatggcacagttgtatttattttacctgg

SEQ ID NO: 6851661 - DNA, 96 bp, Homo sapiens
tctttctgtgttctgctgtaacaacacttccctgaggcaaagaatgcctaaaggtctggtttgaacagggaatgttccacaggacataaaaaaaga

SEQ ID NO: 6851662 - DNA, 73 bp, Homo sapiens
atctacaaatagtggaaaatattataaatggcagtaaatgaagtaaatgggagtttccactgtaatgtatgat

SEQ ID NO: 6851663 - DNA, 84 bp, Homo sapiens
gcaccagtgctgagtggcagatctctggtctggaagccacgttcttctcactataccatgttgccatttttcagcaactggtgc

SEQ ID NO: 6851664 - DNA, 63 bp, Homo sapiens
agtattatttgaatgttcccaggcttttgaaagtgagtttagggcacagcttagataaatgct

SEQ ID NO: 6851665 - DNA, 71 bp, Homo sapiens
agtcacttagtctatgatattttgttatagcagccccagctgaccaagatacagcatcatagatactggct

SEQ ID NO: 6851666 - DNA, 57 bp, Homo sapiens
tcaacaggaacgggaggattatctacttctaaaatagttcattcacgtagctgttga

SEQ ID NO: 6851667 - DNA, 92 bp, Homo sapiens
cagttctggggtccaaaattaagggtggcagggttggttccttctgtaggctctgagggagaagccaatccttgtctctctcccagcttctg

SEQ ID NO: 6851668 - DNA, 83 bp, Homo sapiens
cagaggccagtttcttattcttagttatgtagccaagttaatagggtcacgtgacacaaagattgggcaaagaactgcttctg

SEQ ID NO: 6851669 - DNA, 96 bp, Homo sapiens
ctccttttcttcccttccttccttgcggcccctgcctaggagtctccctcctgtgcggctctgggctgtaaagagagacacggggctgggaagggg

SEQ ID NO: 6851670 - DNA, 66 bp, Homo sapiens
gctgctcttgaggggctcactgtgagaagggccctcagcaatcccattcccaggcctctttgcagc

SEQ ID NO: 6851671 - DNA, 73 bp, Homo sapiens
ccaccaacagttagcatgttcatcttctgttggtttcacaaaaccacggtgatggtcatgcttctgtgcctgg

SEQ ID NO: 6851672 - DNA, 88 bp, Homo sapiens
ggtgttatctgagcttttcagatgtgtgtctctgaaggtccaggattttcaaaagatgaacgtttaaatctactttcagtgtgaggcc

SEQ ID NO: 6851673 - DNA, 76 bp, Homo sapiens
cagggggtggtccaggctgcgctagacctggggtggagttggtgtatcaggtgcggtcctaggtggccactgcttg

SEQ ID NO: 6851674 - DNA, 125 bp, Homo sapiens
gcctttctgtcatttctcctttattccctcatggttcatttagatgtaaacactttccagagtagaaaattacagttaatgtgactaaccagcgagggctgaaacgggaacatgggctcagaggt

SEQ ID NO: 6851675 - DNA, 63 bp, Homo sapiens
tggtgtctgcactccctggcgtggtctgcaggagacagaagcaccctgggtctgctgatgcca

SEQ ID NO: 6851676 - DNA, 66 bp, Homo sapiens
tggattctgggagagagttgataaagggcactattaaatgaccatcacacatctcttctagtacca

SEQ ID NO: 6851677 - DNA, 63 bp, Homo sapiens
gccaaagcagtcttgcctctgccattcttttttcactcaaagcagaggcctcatgctctgtgc

SEQ ID NO: 6851678 - DNA, 71 bp, Homo sapiens
cctgcagcctaggggctgtccccagcgagcaaggcgagcaaggccccgctgtggccacccctagctggagg

SEQ ID NO: 6851679 - DNA, 74 bp, Homo sapiens
ggtacttcatgtaagtggaatcacacaatatttatctttttgtgactggctgattttacttagcatgatgttct

SEQ ID NO: 6851680 - DNA, 55 bp, Homo sapiens
ggggatgggagtgtggtaggcagaatactggccccctaaaggtgtcctcatcctc

SEQ ID NO: 6851681 - DNA, 84 bp, Homo sapiens
ggccctggggtctggttgctttacagctggtgacagggggaccactccactaccacatgtgaattaatcctcaactccagagcc

SEQ ID NO: 6851682 - DNA, 58 bp, Homo sapiens
gcagcgataagagaactgggacgaggcaccgtttttcaccccatttcttttattttgc

SEQ ID NO: 6851683 - DNA, 73 bp, Homo sapiens
tgtgagtgatgtgggacaggaagaggcacaagggcctggtctttcagccacttacctgtctaggatcctcaca

SEQ ID NO: 6851684 - DNA, 67 bp, Homo sapiens
acttatagcaagcaggacagtctcagaaagagcacactccatatgttagactctgtgtgctatgtgt

SEQ ID NO: 6851685 - DNA, 84 bp, Homo sapiens
tgtcacactcttattgttagacccagctgagctactcacagagtgccagcaccagctactagtcacaagagtgagtctttgata

SEQ ID NO: 6851686 - DNA, 55 bp, Homo sapiens
aagcacacagaggcggaaggacataaagttcctggttgatttccctttggtgttt

SEQ ID NO: 6851687 - DNA, 76 bp, Homo sapiens
tctactgtttcccaaatgtttttaggtacacaggagttatttgattaagtctggtaaactgaaaaatattagtaga

SEQ ID NO: 6851688 - DNA, 67 bp, Homo sapiens
tgtcagtctgagtctaattgaacgtaccatctgattctgagatgaacatgtgactcagacctggata

SEQ ID NO: 6851689 - DNA, 57 bp, Homo sapiens
ggcatgtctttgtctcaatataacttatataaataagtcagaagcagactacatgcc

SEQ ID NO: 6851690 - DNA, 91 bp, Homo sapiens
ggcttctgccccactcaatctggctcgctaggctctggggtccatctggccagctctcctgggcttagtggctaggtctggggtgggagcc

SEQ ID NO: 6851691 - DNA, 100 bp, Homo sapiens
cgagcgggcgccgcgcctcctggctggcaccgcggcccggagcgaagtggcgcgcggggctggaaaggaacttctgcgggcgcgtgcggcccggggctcg

SEQ ID NO: 6851692 - DNA, 115 bp, Homo sapiens
gcagcatggcttgctcatgcatttaactaaggaatatgacaaactcaaccaaagtaataatatggttgggtttttctcccttctttctgtaatatgggcgtctcacatggattgc

SEQ ID NO: 6851693 - DNA, 82 bp, Homo sapiens
catgcacagtgatatctgaagaattattgcttcctttccaatatcattccacaagcattattgagatgatcctgcatgcatg

SEQ ID NO: 6851694 - DNA, 76 bp, Homo sapiens
gttttcagcacagtatcttttgagtaagcatgcaaggttttactgtattggatgcttttaagaatatgtgaaaagc

SEQ ID NO: 6851695 - DNA, 66 bp, Homo sapiens
tccaacacagtagccaccaaccatgtgtggctattccatacttgaagtgtggctggtgtgaatgga

SEQ ID NO: 6851696 - DNA, 70 bp, Homo sapiens
gggaaattccaaagcctgaataatggaatggatacatttcaatttaacatatattctggctttagatccc

SEQ ID NO: 6851697 - DNA, 67 bp, Homo sapiens
tctgaagcatatcatgccaagtttttgtatttgggttctgatttaacttgagtaatgatatgaagga

SEQ ID NO: 6851698 - DNA, 59 bp, Homo sapiens
ggatgaatgggcagtgttgggggaaggtataatctgaaaaagcactccctgttctgtct

SEQ ID NO: 6851699 - DNA, 71 bp, Homo sapiens
agttgaaggccactgcctgcatgtgacaaactagagattctagttaacacagtcaggagtaaccctcaatt

SEQ ID NO: 6851700 - DNA, 127 bp, Homo sapiens
tgtatctgttaggaggcacagttgtttctaagagggtgtagaaaagcataacttgctgcacatagtgggggctgtcagtatcttgtgtccctcccagtagacagctgggtgccccatgtgcggtgca

SEQ ID NO: 6851701 - DNA, 57 bp, Homo sapiens
gccatgttggaacttcacattctacagtctcactgtggagattatcctgggcatggc

SEQ ID NO: 6851702 - DNA, 72 bp, Homo sapiens
tgctgagcttccactgcttctggaccatgtcttcattataataattatctttaacagtgacaggcatcagca

SEQ ID NO: 6851703 - DNA, 63 bp, Homo sapiens
tggaaatctcaggtgtttgcggggagaaaacatagcttcatttgggccagatctgagtttcta

SEQ ID NO: 6851704 - DNA, 88 bp, Homo sapiens
gaacacagaccctggcagccccttggtttggtttcttggaggaacaagtcttctttagaaactaaagccaagggctctaaatgtgttt

SEQ ID NO: 6851705 - DNA, 66 bp, Homo sapiens
gtgcatgatatttttatcaaactgcttaagaaaatattttatgagtttgtaaagaaatatttgcac

SEQ ID NO: 6851706 - DNA, 122 bp, Homo sapiens
ctctgtctaggtattttagatgaggacgcaatccactagtttgagtaattgtaatgtgggaagttgactttaactcttaagctagttatgcatcactttctaataacgtaacttggtcatag

SEQ ID NO: 6851707 - DNA, 73 bp, Homo sapiens
ctggggtcccgcagtcggaatttctcagtgttctacgtaggggatgctaggagcctcgactctggagtctcag

SEQ ID NO: 6851708 - DNA, 78 bp, Homo sapiens
gggatcttgttaaagtgcagattctgacttactgggtctggggtggggcctgagagtctgcatttctaacaagctccc

SEQ ID NO: 6851709 - DNA, 106 bp, Homo sapiens
gtctctttcattccctgatttagtgaggcagatttgatgaggtggaaaaacatctttagcatgtttaagtactcacaggttctgcagctcacaggttgagagagac

SEQ ID NO: 6851710 - DNA, 63 bp, Homo sapiens
ggggacaggcagagtcaggttgggttcagaagtcatgaggcccagaggtgactgcttcccccc

SEQ ID NO: 6851711 - DNA, 73 bp, Homo sapiens
gttttcactctgtcctctcaagcaataaactaaaatatgtctttttattgcaattggcagagtgctatgaaat

SEQ ID NO: 6851712 - DNA, 80 bp, Homo sapiens
ctgtgttgttttgggaacttggttcagggaaatgatgatgccagcagggcagattccctgagctgcccagaatcccagag

SEQ ID NO: 6851713 - DNA, 56 bp, Homo sapiens
agctgaatcttgactaggaagaacttattcctttctttctgtcctttccatcagct

SEQ ID NO: 6851714 - DNA, 61 bp, Homo sapiens
cagggcacgcggtgggctggtggtttcatagccgacacacagcgcctaccatgtgcagctg

SEQ ID NO: 6851715 - DNA, 114 bp, Homo sapiens
gagattcgctgttcctctgggtgaagggatttggagtctctgaagctgaggtactttgggggtttcatgctgaggggattttaaatccctcaaggtggcaggatttggggtctc

SEQ ID NO: 6851716 - DNA, 73 bp, Homo sapiens
gctctttcttatccgtgttccctagatgcacaattccgcttggactgtgtgcccttttgacagtgagagaagc

SEQ ID NO: 6851717 - DNA, 59 bp, Homo sapiens
gcagcactgatcctaaacttagagctggggtgagtctgagtgtggggacagtggtttgc

SEQ ID NO: 6851718 - DNA, 75 bp, Homo sapiens
aggtacaggtgggcttaagagtcggcatttctcacaagctcccaggcaatgctgattctgctggccctctgacct

SEQ ID NO: 6851719 - DNA, 56 bp, Homo sapiens
gctgggctgtttggggacccaggaagtgaggaacgtgagtctcccttagcccacgc

SEQ ID NO: 6851720 - DNA, 63 bp, Homo sapiens
tttactgtgttcaaaactagtgctctttctctgtgaagggcatatttatgagaacttagtaga

SEQ ID NO: 6851721 - DNA, 81 bp, Homo sapiens
cttgggtcattgcatgaagagggtccctgctgcccaggctgggaacagccaggcatcaggagcttcttcaggtgacccagg

SEQ ID NO: 6851722 - DNA, 56 bp, Homo sapiens
gagatccccacaggagaagagcgggctccgcattcctgcttttcccctttggactc

SEQ ID NO: 6851723 - DNA, 62 bp, Homo sapiens
aaaatggcaagcagaatatggtgtccagctgtggatttgcttacatattgtgcttgcatttt

SEQ ID NO: 6851724 - DNA, 65 bp, Homo sapiens
ctgaaagccaaggagagaggcctgaagaaaccaaaccttccaaaaccttgatcttggacttccag

SEQ ID NO: 6851725 - DNA, 73 bp, Homo sapiens
gttgcagtattagcatatatagagaacattttcatcatcacagaaagttctattggatagtgctggtctcgat

SEQ ID NO: 6851726 - DNA, 64 bp, Homo sapiens
ggcagctgggtagtgtgggggctggattggaattttctagaaagttagcagactcttggctgcc

SEQ ID NO: 6851727 - DNA, 69 bp, Homo sapiens
ttgctgaggctgggcttgccttcttggttacgaggccatgacgggcagtcgctcagccctccttaggaa

SEQ ID NO: 6851728 - DNA, 90 bp, Homo sapiens
gtataccttttgtatttctgaagcttgataaactataaagccttgagtattcaggttcatggcaaggtttagatggatggggaggtatac

SEQ ID NO: 6851729 - DNA, 74 bp, Homo sapiens
tgtgtgtgctcaagggcaggaacctggcattaccaaagggattagccacctctggtttgcctttagcacggata

SEQ ID NO: 6851730 - DNA, 115 bp, Homo sapiens
ttgatgtatataatgacttggaagtaaaaatattgtttgccgtgggatattgttgtctttttcttatggttaattcctggcataatggctttgctcctttattataaaacattaa

SEQ ID NO: 6851731 - DNA, 55 bp, Homo sapiens
ccctctccctgcagaatgtggcaggcggacctggaatgtgttggagggaaggggg

SEQ ID NO: 6851732 - DNA, 73 bp, Homo sapiens
gccttgaggtctgagcagcttctgtctgaaggccaggaggtaggactgggttgcaggggctgctgggcagggc

SEQ ID NO: 6851733 - DNA, 62 bp, Homo sapiens
acctctcagagctcgtgggaccttggagaccactctaaggacttcagctttgatttttgggt

SEQ ID NO: 6851734 - DNA, 56 bp, Homo sapiens
agtttgataaacaccagctagtccggtacctgggctatctggcaaaatgtcaaact

SEQ ID NO: 6851735 - DNA, 83 bp, Homo sapiens
tatatttagactactagtggctacaataatgaaattactgtggattgtaaacatgaggtattgctactgtggtctaccatgta

SEQ ID NO: 6851736 - DNA, 56 bp, Homo sapiens
ccacattctcatgtaatcctttcaacaagccaatgaaataggttaaggagaatggg

SEQ ID NO: 6851737 - DNA, 55 bp, Homo sapiens
gctggctgggacagattccattgagtcattcctctaaagaaatgcctagtccagc

SEQ ID NO: 6851738 - DNA, 129 bp, Homo sapiens
tcggaatcaacttgggagcattagaaaagtactgatgcttgggtcctaaccgagatattttgattttcttggtcctggggtgcaggctgaccaatgggattttatttaaagtgtcctgggttattctga

SEQ ID NO: 6851739 - DNA, 55 bp, Homo sapiens
ttcagctaaaaatgcccacttgtttagacttccgcagcttgggcatgaagctgga

SEQ ID NO: 6851740 - DNA, 77 bp, Homo sapiens
cgcactccacctctgaaggtttctgttactgtcttttcaagagaatctagtttcagactttgagttctgtggctgtg

SEQ ID NO: 6851741 - DNA, 83 bp, Homo sapiens
attacccaaggacatttatactattttgaaggttaattccaacctcactcattcagcatatgtttggagtgtccttgcctaat

SEQ ID NO: 6851742 - DNA, 64 bp, Homo sapiens
tccagtgaggctgaatggccactcatcctgcattaatctcagccagggctctggcctcagtggg

SEQ ID NO: 6851743 - DNA, 77 bp, Homo sapiens
atccaagagcacttgacattttgtggacatgatgtttatctttgaggttaaccacaagatgcaaactctaacaagat

SEQ ID NO: 6851744 - DNA, 69 bp, Homo sapiens
ggctttgggccctcaagtctcctgggtaccatggctgaatcttcctggggctgtaggccgcccagggcc

SEQ ID NO: 6851745 - DNA, 70 bp, Homo sapiens
ttactagattttttgagacagatgtaaatggagattttccagctccagcagcaggcttaaggaaaagtaa

SEQ ID NO: 6851746 - DNA, 56 bp, Homo sapiens
tagattgtgaacaagtatttgggaaccacagttccagatgcatttctaacaattta

SEQ ID NO: 6851747 - DNA, 65 bp, Homo sapiens
tcttttaaaagaccttgagggtccgattctaatctgagttgtaccataatgagtctcttaaaaga

SEQ ID NO: 6851748 - DNA, 85 bp, Homo sapiens
ggtgggaccagcgctgtcctggggccccgagccagaagcggggaacccgactatctgccaggtcccagggcgcgcctgggccccc

SEQ ID NO: 6851749 - DNA, 74 bp, Homo sapiens
ggtggtagataacatcagataagcagaattaatttcaacccaatacgtctgtaactttgacgttgaatatcact

SEQ ID NO: 6851750 - DNA, 58 bp, Homo sapiens
gcatgctacaggagccccacttagatgagacagtttagggaaagcctcctgaggcggc

SEQ ID NO: 6851751 - DNA, 79 bp, Homo sapiens
gtggccaacagcgatgattgcagccctacagctgtcacaacaacccattgaccactgtgtgcaatgctgtgcttgccac

SEQ ID NO: 6851752 - DNA, 63 bp, Homo sapiens
gggaacgattcggatggtggtgttgacagtcatgtttacattgctgtttgtgtcttttttccc

SEQ ID NO: 6851753 - DNA, 120 bp, Homo sapiens
gggattatttggtattcatgtgagcagttaggttttgtgtcagagtagaatgaccactctatcaaaagctccatactattttgacatgaaattgatctgcaaacacctatccagaatccc

SEQ ID NO: 6851754 - DNA, 130 bp, Homo sapiens
ggccccatcctcagagctctgtgtacatatataagtagcattctccctctacactcaggagtagtgctccagtgaagatggcagacatgtgtactgtgtaaatttgcaatggctgctgtaacaaagtgcc

SEQ ID NO: 6851755 - DNA, 75 bp, Homo sapiens
tgagcagctggcctccggcagggccaggactgaagagatgtctgaagttaaatgctggaaggtccaatttgctca

SEQ ID NO: 6851756 - DNA, 80 bp, Homo sapiens
agtggctggaattgcaggtgcgccctaacacatgaggcttctgcagggcatggcgagtgcacctgtaaattccggctact

SEQ ID NO: 6851757 - DNA, 69 bp, Homo sapiens
gtttatgctgtttgcttttagtctgcagatggggaagatgcctctggagagagaccagacaccatgaac

SEQ ID NO: 6851758 - DNA, 84 bp, Homo sapiens
cttctttcttaggtcaggttccctagcagcaaagcctgagacagactttcttgtgctagggaaaacctgtaaggaagaaagagg

SEQ ID NO: 6851759 - DNA, 72 bp, Homo sapiens
agcagttgggctcttcctggcaaaaggtattctaagtgtaggagggacttgatgtcagggagattctctgct

SEQ ID NO: 6851760 - DNA, 60 bp, Homo sapiens
cttaaatcgttataatgttaagcctttatcagtggaggtatagaattgaaagggtttaag

SEQ ID NO: 6851761 - DNA, 65 bp, Homo sapiens
ggagttagacatccccagttagcatcctcgcttcactagctgtgtaactttgggcatgttgcttc

SEQ ID NO: 6851762 - DNA, 87 bp, Homo sapiens
tggcctgcctcccccagcccagtggccatgggtattctagaaacaaaccattcttccctctgccctgggattgggtggaggctgcca

SEQ ID NO: 6851763 - DNA, 110 bp, Homo sapiens
ctgggccgggaaaggcctgtgctggtctccgccgctccctgatctagagccatgagaagcccgttcatgggagcaaggtggggcaccagccactcctgtctctctcccag

SEQ ID NO: 6851764 - DNA, 63 bp, Homo sapiens
gctgagcaagctatctggcctctctgagtgcacttccaagcaggaggagaaggcttggttggc

SEQ ID NO: 6851765 - DNA, 74 bp, Homo sapiens
tctacaagaactggagctgttcaaggtagtggatatctcactacagtgaagactagctatagtagaattgagga

SEQ ID NO: 6851766 - DNA, 58 bp, Homo sapiens
tgcgctggtggcggataagggtggagctcatgatgaagctcttgccgcagtcggcgca

SEQ ID NO: 6851767 - DNA, 65 bp, Homo sapiens
cccaaaaattagatacacatatattatgttttggaaatatgtgtacagtatactggtttcttggg

SEQ ID NO: 6851768 - DNA, 59 bp, Homo sapiens
aaagcagacatctggagagaagaaacaatgtttgctctccagcagatgtagtctgtttt

SEQ ID NO: 6851769 - DNA, 70 bp, Homo sapiens
attcatcttaaattaaagcttaaggaatctacctttaccttgtttcttttgctgcatgttttaggtgact

SEQ ID NO: 6851770 - DNA, 69 bp, Homo sapiens
atctcaccaagttattacgagatgcaaactttaaactgtaacttctatgtaaatgtgagttggtgggat

SEQ ID NO: 6851771 - DNA, 58 bp, Homo sapiens
ggatgtgtggctggctctttgtctctaggcagggacacagctgcagccacacccatcc

SEQ ID NO: 6851772 - DNA, 103 bp, Homo sapiens
gtgaatgaatgagagttgagagtctatcaaatagcttatgaacttagagaaagttaactagatctcaagtatgtttgaatttctcattactcttttccctcat

SEQ ID NO: 6851773 - DNA, 62 bp, Homo sapiens
ggtcaggaagaagggtggtgagtcctattatttagtctcctttggtaccctttttcaaaacc

SEQ ID NO: 6851774 - DNA, 81 bp, Homo sapiens
tttttatcagtcaaggtccttgaggaaacagatgtgaccaataggttacagatggcacactcaaggggtgattgatgagaa

SEQ ID NO: 6851775 - DNA, 130 bp, Homo sapiens
tccgagcaactaccactgactgggaagggcactttgaccctgaggggtatagcagaagagtgtacacattttcattatacagcttcataaacagggtgtctttcctataggtatgtggtaatcagttgtg

SEQ ID NO: 6851776 - DNA, 100 bp, Homo sapiens
gaggcaggagaatcacttgaacccagaaggtggaggttgcagtgagctgagaccatgccattgcactccagcctgagcagcagagtgaaactcttgtctc

SEQ ID NO: 6851777 - DNA, 82 bp, Homo sapiens
gtctgatagttctgtggccagatggtgccagttcacttccagctgaactggtacagcctgaccacactccatgctgacagat

SEQ ID NO: 6851778 - DNA, 70 bp, Homo sapiens
ttgtctctcatgtttctggtactccttggatagctcgtccagggctgtaaaatggatatatgagcgatga

SEQ ID NO: 6851779 - DNA, 62 bp, Homo sapiens
cagctccaggataataaagttgttctcacctggggagccttttggagttattctgggagttg

SEQ ID NO: 6851780 - DNA, 57 bp, Homo sapiens
agcactttgggagataaagctgataattagtaaagagcttcaaacccactaagtgct

SEQ ID NO: 6851781 - DNA, 56 bp, Homo sapiens
gctgctttgtgaaaatcattcatcagatagtgattgttttatataagcagagcggt

SEQ ID NO: 6851782 - DNA, 80 bp, Homo sapiens
ccgtttctgccactgaaatccttaacatgatctattaacccggagataaaagatatcttagggatttgtgtaagacttgg

SEQ ID NO: 6851783 - DNA, 73 bp, Homo sapiens
ctgcatgtctgtgtctaatcaggtcagtcagaactctgcgatgtctagttgccttttagcacaacccatgtgg

SEQ ID NO: 6851784 - DNA, 72 bp, Homo sapiens
gaagttgaaaagtttattttccctggttagtgctaaatgtatatcatcaaggaaaaataaatgagcaacttc

SEQ ID NO: 6851785 - DNA, 63 bp, Homo sapiens
ggtcagaggtgtccaggccgggacagaggaacggaacctgggcctgcttgggcccctctggcc

SEQ ID NO: 6851786 - DNA, 80 bp, Homo sapiens
tccttggccatgtagtctaatggggaggacattgttttttataatgcagtacctgctatgttatacgtattggttaagga

SEQ ID NO: 6851787 - DNA, 62 bp, Homo sapiens
ccgatgaaaagggagtgatatttgttgaaaaggaacaaaaagaagaactcccttttcactgg

SEQ ID NO: 6851788 - DNA, 107 bp, Homo sapiens
ggcaattcactactaactacagttgtttagaaggctcttagtgattcagaaagcacattatgcatttagagctgatagtacactggtaggattggtgtagtcatgcc

SEQ ID NO: 6851789 - DNA, 64 bp, Homo sapiens
tcttggctttctcctagggatgtggcctgagtcctctagtttcaatccttggcagaatccagga

SEQ ID NO: 6851790 - DNA, 61 bp, Homo sapiens
cccaggaaagaaagtatatggtacatgtgaaaacggacaccatgtttctctttttcctggg

SEQ ID NO: 6851791 - DNA, 56 bp, Homo sapiens
ctcagggaggcctctgctggttcctggtgctgaagtagcacaactcctccctgcag

SEQ ID NO: 6851792 - DNA, 77 bp, Homo sapiens
taaattgaggtatgatttacatgcagtaaaatgcttaagtctaggtgtgcagctcagtgaatttttgcccatgttta

SEQ ID NO: 6851793 - DNA, 63 bp, Homo sapiens
agatagaaggattggagtgaccactgtgctgccctctgcatggagttgatgtccttctgtgct

SEQ ID NO: 6851794 - DNA, 68 bp, Homo sapiens
taacttatttctcagtacattatacatgcataatattgtacaccagttatgtgctgggcaatatgtta

SEQ ID NO: 6851795 - DNA, 60 bp, Homo sapiens
acagggctggggcacttggctggcacaggatggccaagcctctgaagagtcttttcctgt

SEQ ID NO: 6851796 - DNA, 57 bp, Homo sapiens
tttcagaggtgtcattatttttcatataagcagatgaaagagaagaagtctttgaaa

SEQ ID NO: 6851797 - DNA, 118 bp, Homo sapiens
tgaattaatgcttccctaggtctatgagagctgttatttagaacatggaatcttggtgctcctgggttccatctttaataacacactctctctctccctttcaatagcaataatgaca

SEQ ID NO: 6851798 - DNA, 56 bp, Homo sapiens
tccccctcattacctcattcaactctctcaatagccttgtgagtaatcagggagga

SEQ ID NO: 6851799 - DNA, 65 bp, Homo sapiens
gctgagcagcgtggggagctggccattaaggatgccaacgccaagctgtccgagctggaggcggc

SEQ ID NO: 6851800 - DNA, 62 bp, Homo sapiens
gaagtgtttaagttacacacatatcagcgtacaccgctatatggggcggaatttgacacttt

SEQ ID NO: 6851801 - DNA, 60 bp, Homo sapiens
attttacaaagtgggaaacgaaggttcctcttaggaacctagttgtcacctttgtataat

SEQ ID NO: 6851802 - DNA, 124 bp, Homo sapiens
gatactccaaactatttctggtaaaactgtaagatttacgaggtggataggtacatggactttagagctagagccagagacctgggttcacagtgtaaactctgccactcagtagcaaggtgtc

SEQ ID NO: 6851803 - DNA, 130 bp, Homo sapiens
gttccacaatatcaaaatccagtaatacaaaattgcttccttcaatttcactctccctgccacttaccaatgaggtggtgctagtagagggtgggcaagggagtgaattggagaaatgggataaatgaac

SEQ ID NO: 6851804 - DNA, 71 bp, Homo sapiens
ggaggtgattcaggcctgcatctcagcaaaactacaaattgctgcatgtcacaggccctgagataaccccc

SEQ ID NO: 6851805 - DNA, 68 bp, Homo sapiens
gagctgtagccagaaggttcttagtttcccctcagtaaactgaggttcaggacatttctggggcactt

SEQ ID NO: 6851806 - DNA, 69 bp, Homo sapiens
agaattccacacagtgctgtttgtaaagagaaatgaatcattttttcccatttaggcattgggaatttt

SEQ ID NO: 6851807 - DNA, 80 bp, Homo sapiens
ttgaagcttctttgggtgaagacttgaatacatagtgtttctatagcattatggcaaaactctttatccaacagtatcaa

SEQ ID NO: 6851808 - DNA, 72 bp, Homo sapiens
caggacagggcagaaggcactctactcccagttatcagctctactgggaggtaatgtatctgtcctgccctg

SEQ ID NO: 6851809 - DNA, 62 bp, Homo sapiens
tctggcttctcctctgagtcctgggagaccacgtcttccctgaagcagggagagtagccaga

SEQ ID NO: 6851810 - DNA, 70 bp, Homo sapiens
gcagattccaggtcccgttccccagagattctgactcaataaagtctgagtatgaggtcctagaatctgc

SEQ ID NO: 6851811 - DNA, 81 bp, Homo sapiens
gctttgtctggttgacagcatgtggccctcgtaaccaaggggtgattcaaccctggccacagggctgaacgtggacaaggc

SEQ ID NO: 6851812 - DNA, 58 bp, Homo sapiens
ttccccatgggtggggacacatatgatggagcatccccatgtgcccacccacggggaa

SEQ ID NO: 6851813 - DNA, 62 bp, Homo sapiens
gagtaagggagcagaagctgtgaaatgctgtattgccctttcacagcgtctttctcttgctt

SEQ ID NO: 6851814 - DNA, 67 bp, Homo sapiens
atagtttcacaggaaagaattttgcctccgaaactctagtttagtgctttccttcttgtgacattgt

SEQ ID NO: 6851815 - DNA, 58 bp, Homo sapiens
cctagacatgagaaacccaccagagtctgagaaactcacgtgaccagctcatgtcagg

SEQ ID NO: 6851816 - DNA, 78 bp, Homo sapiens
cagaaatataaagatagaatgctttcctgtgtgttgaatgagtcgatttatggaagtcattcttttttatctaatatg

SEQ ID NO: 6851817 - DNA, 66 bp, Homo sapiens
ggtttatagttgctaggatgtgtttattaacctttgttaatttcaaatttcttagcgtgctgtgct

SEQ ID NO: 6851818 - DNA, 65 bp, Homo sapiens
gcttgaaaatgttttttggtctgatgaatgcaatcatcatcatcaacaagaaacatttgttgagt

SEQ ID NO: 6851819 - DNA, 55 bp, Homo sapiens
ggcttgcagccctcctgccttgcctgcccatctaaggtgggagaccatgtaggtc

SEQ ID NO: 6851820 - DNA, 63 bp, Homo sapiens
ctgggctatgagaagattagagctgaatttacttaccatagctttaaataatacaaggtccag

SEQ ID NO: 6851821 - DNA, 61 bp, Homo sapiens
tgtccttacaaggtccctttcgtgggcatttctagcttttaggacgatggtgtgtggggca

SEQ ID NO: 6851822 - DNA, 79 bp, Homo sapiens
ggtactgtagatattcctgacttaatttttgacagaaaagttaagggtaatcttgagtcatggcatatattgaaagacc

SEQ ID NO: 6851823 - DNA, 80 bp, Homo sapiens
gacctggatatatgtttttctaattagggaattggagatacatgaacagtctctcatagagaaaaatatatccattagtc

SEQ ID NO: 6851824 - DNA, 72 bp, Homo sapiens
ctcttgtaacagtcagtatcccaggcaaatatttacccaacatgtacttatttaatggctactggataggag

SEQ ID NO: 6851825 - DNA, 57 bp, Homo sapiens
gaggccacgtgcttatgtttctgaatgctagcagccagcctgtgagcccgtgacctc

SEQ ID NO: 6851826 - DNA, 55 bp, Homo sapiens
ctattgcatttgcatcttcatccttttaaagatggagcaacttaaatgcacatag

SEQ ID NO: 6851827 - DNA, 69 bp, Homo sapiens
tcatttgcttttagacccacattttgaatcagacaatattagatacaatggtggtgtcagaagagatgg

SEQ ID NO: 6851828 - DNA, 73 bp, Homo sapiens
atattacaagcaagttatgtaagcctgcttttagcttttaacttcagctaggtctacaagcttaaagtaatgt

SEQ ID NO: 6851829 - DNA, 114 bp, Homo sapiens
gccctctctctgagctctgttggactctaaatcttaaaaagctggtttatctgttttctatcttattgcagattagaaatcacaaaccagtagttggaggaggtagggaggggc

SEQ ID NO: 6851830 - DNA, 72 bp, Homo sapiens
ctcctactgggacattataagaaacattatatattaaatgcacttaataactgtccttctgaaagatgggag

SEQ ID NO: 6851831 - DNA, 95 bp, Homo sapiens
tggtcagaggccctggcccctgtggctaaaatcaggattatgtctgtactgatttacttcccagctgggtttcaggaaaagcctcaaaaagacca

SEQ ID NO: 6851832 - DNA, 79 bp, Homo sapiens
tggtgttttctgggaattttgtcaatcttcagagaagtctgatcatttgtggattgtgttaaattcctgagaaacacta

SEQ ID NO: 6851833 - DNA, 58 bp, Homo sapiens
ctagcacagcccattcagtctaaagcttctagtgagcagtaatactggctgtagctgg

SEQ ID NO: 6851834 - DNA, 56 bp, Homo sapiens
ttacagaaaggaaggactgactcctaaattccaggatgtctcctttaagtctgtaa

SEQ ID NO: 6851835 - DNA, 61 bp, Homo sapiens
gcctgtttctggagtgatctgtgctttcagcccctggaatgcaggctccatgaggacaggc

SEQ ID NO: 6851836 - DNA, 59 bp, Homo sapiens
agtaacttagtttagggtattgattgatttggtattcacaatactataagctgggttct

SEQ ID NO: 6851837 - DNA, 61 bp, Homo sapiens
aaggtggatgtaagcggcaatgtttgggtgccaaatattactgctgccctaagaccacctt

SEQ ID NO: 6851838 - DNA, 92 bp, Homo sapiens
tttattttagggacataattaggcagttgatcattcgaagctaatgctttactaataatgagcttgtctaattgtgtattccacagaatgaa

SEQ ID NO: 6851839 - DNA, 74 bp, Homo sapiens
gggctggccagtgtcccagggatcaggagcggggagcggtccgcgtgggtcccggaggggacagatggctgccc

SEQ ID NO: 6851840 - DNA, 59 bp, Homo sapiens
ttcttgattcttccttgaaggatactgcatggtccattcctacacaggataattaagaa

SEQ ID NO: 6851841 - DNA, 92 bp, Homo sapiens
gggacacatgccacctctgctcacatttcattggccaaagcaagtcacatggccacccccaatgtcagtagggtgggaaatatgattgtcct

SEQ ID NO: 6851842 - DNA, 108 bp, Homo sapiens
gggtctgtgcaagttatggagattttgcctgattctaagagctcatccaagtactcaatttaagggtgagagcagggtagggcaaagtgtcattactcaaacaggccc

SEQ ID NO: 6851843 - DNA, 55 bp, Homo sapiens
gcctcacagactgactgaaagccggtgaacacatgtgccagcagaatgatgaggc

SEQ ID NO: 6851844 - DNA, 81 bp, Homo sapiens
gtgtctgtgttcacatgtgtccacccttgaacacatacttatccttccatacatgtgttcatctgtgcatacgtcgggcac

SEQ ID NO: 6851845 - DNA, 97 bp, Homo sapiens
ttgtctgatgtatttaaatttattcacagaaaattcatttatgtggaagaatttggggataaatttttggtagatacatagaaaacagagcagacag

SEQ ID NO: 6851846 - DNA, 86 bp, Homo sapiens
tgcaataatttgttttctgttttatcatttttaaaacctttgttatcggggagatcatggtggacgggagacaggactagattgca

SEQ ID NO: 6851847 - DNA, 69 bp, Homo sapiens
ttaaaaaaatgtctttatctcatgtaacatgaggatttctccatggacagagaaaggagatttctgtaa

SEQ ID NO: 6851848 - DNA, 78 bp, Homo sapiens
tggagctcaatgcaagattttgacactcgtctcatgcaatataaagcgttaagaaatggaagattttcattgacttca

SEQ ID NO: 6851849 - DNA, 81 bp, Homo sapiens
ccattgatagcctttttctgtccccagaatgtggccaacatatgtatgactcacattcacaggacagaaggattgttctgg

SEQ ID NO: 6851850 - DNA, 61 bp, Homo sapiens
catctgtgccgggtgtttgtcattattaagtgaccctgatgagaataaccttgcacggctg

SEQ ID NO: 6851851 - DNA, 68 bp, Homo sapiens
gggcaggcactgacctgcttccttgatagggagaagccatcatttcctgtagtcattgcctgaatccc

SEQ ID NO: 6851852 - DNA, 73 bp, Homo sapiens
gaaggatcctctctcgtggcttcacttgttttctctggaagcagacaaggcgtgacggagagaggaactcttc

SEQ ID NO: 6851853 - DNA, 56 bp, Homo sapiens
gtaatcccagcactttaggaggccaaggtaggtggatcacttgaggttgggatttc

SEQ ID NO: 6851854 - DNA, 85 bp, Homo sapiens
gctggggaaggcaaggaaggcaacaccaggatgcactgaatggtagattgtctctgtgggcacctgggatgccaccccccttggc

SEQ ID NO: 6851855 - DNA, 55 bp, Homo sapiens
agtgacaacaagttgactagaattgctggaaagttttggttggtcttgatgcatt

SEQ ID NO: 6851856 - DNA, 65 bp, Homo sapiens
aaggcaggagaaaggtgaattcactctgtcttcaagagctggcacagccatcttctcctgctctt

SEQ ID NO: 6851857 - DNA, 86 bp, Homo sapiens
gacggtacaggtcaaaggttagttatgttaatatatttatttgcgaaaatatacaaaagccctgattaaccttggcttttgaagtc

SEQ ID NO: 6851858 - DNA, 63 bp, Homo sapiens
tccaagcttgaactgaaattgtcacactctctagtgttggcgcaactcattcatggtgttggg

SEQ ID NO: 6851859 - DNA, 68 bp, Homo sapiens
ccagagagctacaaggcataaatttagatttcagaacattttttatgaaccaacatgatggcctctgg

SEQ ID NO: 6851860 - DNA, 58 bp, Homo sapiens
gctataactatctgtcaaagtttgataaggcaaactttgccccaaagaagttggtagc

SEQ ID NO: 6851861 - DNA, 91 bp, Homo sapiens
gtcaggcatggtggcttacgcctgtaatcccagcactttgggaggccgaggtgggcggatcacgaggtcaggagcttgagaccagcctgac

SEQ ID NO: 6851862 - DNA, 63 bp, Homo sapiens
tgcaagtctgtctgctcctgtgtgtctgcccagaggacacctctagagaatgagagatttgca

SEQ ID NO: 6851863 - DNA, 111 bp, Homo sapiens
catcaataccgttttaatatgaacctgtaaatcacatttagtggctatagaaaaaccttttggcacagcaacatgtggtagtgtaggtaaacattagctgaaggtaatatg

SEQ ID NO: 6851864 - DNA, 120 bp, Homo sapiens
tgaaagcatggatgttatttgttcagctgttttagtggttggaacgttaggaacaaaagctattattgttcgatgtattttttcacaggaaatagacagtggcaaacatacagtagttca

SEQ ID NO: 6851865 - DNA, 74 bp, Homo sapiens
gattcgtgcattgagtcagaagcacgtttggaccagctctggtattaactagctgtgtgacttgtgtatctatc

SEQ ID NO: 6851866 - DNA, 129 bp, Homo sapiens
tggcttcccccagattgagtgatccaacagggagagaggaagaagtcacatgtcttttatgacttggcctcctaagtcccatgtcattatttctgctatgtcctattggttcacaagtcattcctccta

SEQ ID NO: 6851867 - DNA, 83 bp, Homo sapiens
agctaaaaaaccagctggaaacaaatagagtgaacaatatggattatgtatttttttagtttttagtttttggtcatgtggct

SEQ ID NO: 6851868 - DNA, 65 bp, Homo sapiens
atgtcactttacactcctactaaatctttctcgggatccgggctttgggggagggtggggtgcat

SEQ ID NO: 6851869 - DNA, 72 bp, Homo sapiens
catcctacagcagttatgtgtctcttgacttcgatttattcactaaaatagtttgcatataattgatgggtg

SEQ ID NO: 6851870 - DNA, 62 bp, Homo sapiens
ggacctggagctgagaagtggagctctggtcctagggccacctctctgggttcccaaagtcc

SEQ ID NO: 6851871 - DNA, 72 bp, Homo sapiens
caggtggcaatgcaatcagatgattatttctgtaagaatcaagaaattcagcatcatgcattgtaacccctg

SEQ ID NO: 6851872 - DNA, 61 bp, Homo sapiens
cttggaggaacacttatgcaagaagatttaagcatcttaatgcagaaatggtttttctaag

SEQ ID NO: 6851873 - DNA, 64 bp, Homo sapiens
gggctttatgtgtactttccattttatcacacagaatgttgaaaagataagtactcaagggtcc

SEQ ID NO: 6851874 - DNA, 86 bp, Homo sapiens
atgtaataagtgaacttttcttcttgtaaatatggtctttctttagagatctttgaacaatctggaaaagttaactattgtgacgt

SEQ ID NO: 6851875 - DNA, 60 bp, Homo sapiens
cacagctctgacacagtacaaaattcagtggctctctgaagtatgctgcccagagctttg

SEQ ID NO: 6851876 - DNA, 58 bp, Homo sapiens
gccgccccaaaccagttgagaggtggagatgggaactttataatagatttggggcggc

SEQ ID NO: 6851877 - DNA, 56 bp, Homo sapiens
tgggtggctctgttgtcaactgatattaccatatccttttggctatgagtcagcta

SEQ ID NO: 6851878 - DNA, 95 bp, Homo sapiens
agtttctttatgatgtgtagcagtatgacaagaaatacagaggtaggtgaacacacctggcctttacttgtttatagtgcaataatatgggagct

SEQ ID NO: 6851879 - DNA, 61 bp, Homo sapiens
agcagtgagtaacacagaccagcccctgctatcatgaagccttttccttgttgccgctgct

SEQ ID NO: 6851880 - DNA, 59 bp, Homo sapiens
ggtagatgggccaggcaacctggggaggcctctgggcttggaggtctggcctacctgcc

SEQ ID NO: 6851881 - DNA, 57 bp, Homo sapiens
ggcgtttgggctgtatctccccaggctaccatcttgggggggccagcagcagacgcc

SEQ ID NO: 6851882 - DNA, 68 bp, Homo sapiens
agggattgctgtataaataatgacctctgcttgtattttctgagtagttccaattttacccagtccct

SEQ ID NO: 6851883 - DNA, 62 bp, Homo sapiens
acaagtatgtaagatcagtaggattcctgcctggagtcagatggattcattacatgacttgt

SEQ ID NO: 6851884 - DNA, 75 bp, Homo sapiens
aaactacggcattgaaggcattttatctacttcaatattttctgtgttgtgtaaatgccacttaatgtaaagttt

SEQ ID NO: 6851885 - DNA, 66 bp, Homo sapiens
caagtgttttgaccctgtggaaactaagttttgttacctatggctctctacaggtcaagaccattg

SEQ ID NO: 6851886 - DNA, 74 bp, Homo sapiens
gagcaggctccccttgtttccatggtgacagcagctggctcacatgtgtggttgctttggaaacgagtctggtt

SEQ ID NO: 6851887 - DNA, 65 bp, Homo sapiens
gagatcctcagtggattggatgatgccacccacactggggaaggctgtccactccactcggtctc

SEQ ID NO: 6851888 - DNA, 86 bp, Homo sapiens
ggtaacaaagaattaactgcaattgaatctgaacattttttcaagagatccagggttggatttgcatatttaaaatttatgttacc

SEQ ID NO: 6851889 - DNA, 58 bp, Homo sapiens
tgagattgggtcttgctctgtcacccaggctggagtgcagtggcgtgatctcgactta

SEQ ID NO: 6851890 - DNA, 61 bp, Homo sapiens
tgcttgagttctctcccctgctgttcagttaataagcttaaaagtaggctgagattgagta

SEQ ID NO: 6851891 - DNA, 75 bp, Homo sapiens
ggaatagaggctttagacataaagttcttcatctgtagcaatattttgactatctttatgctggaatctttatcc

SEQ ID NO: 6851892 - DNA, 58 bp, Homo sapiens
agggcaggattttgagtatattagtcttcacctacaaatgccaaacttcttctgccct

SEQ ID NO: 6851893 - DNA, 56 bp, Homo sapiens
gagctgggatttgaacctgggacttccacctttgtagtccctgtttctcccggctt

SEQ ID NO: 6851894 - DNA, 114 bp, Homo sapiens
gcagcgagagggccccgaggaaacctgacccccaccttgcaattgttccctgaggtccaggtctgagggagcatagagagtgggtggcccagggctccagctgcccctccctgc

SEQ ID NO: 6851895 - DNA, 59 bp, Homo sapiens
cttggtgccacagcagcttgcgccagagcaggcgcaggtgaaagaggctgggcagcaag

SEQ ID NO: 6851896 - DNA, 55 bp, Homo sapiens
caagtgtccatgatagtcttagactaagttttctgtgctatatgctggacatatg

SEQ ID NO: 6851897 - DNA, 55 bp, Homo sapiens
aggaagagcatctttgggtctgcataaatttacacaggccatggtgacctttcct

SEQ ID NO: 6851898 - DNA, 72 bp, Homo sapiens
ctgctctatccagtgtgtatgaggtttgcagtgggagcgtccttacattaacttacgtccacatggtggcag

SEQ ID NO: 6851899 - DNA, 67 bp, Homo sapiens
caggagatgaaagtggcagctctacctcaggggcggtgcctgaagcagcttctttctgtcaatcctg

SEQ ID NO: 6851900 - DNA, 58 bp, Homo sapiens
gggtaatgggggcttatgcctcttgagtgcactggtcttagcatatcccccatcaccc

SEQ ID NO: 6851901 - DNA, 60 bp, Homo sapiens
tggcatgattactactaatcaggaagctaagggcattgattagacaaaggaatcatgcta

SEQ ID NO: 6851902 - DNA, 79 bp, Homo sapiens
ctattcatactattatttgcaatatgtctttattatacaaaatgctgtgataaacattcttgcacatgtgtgtgagtgg

SEQ ID NO: 6851903 - DNA, 74 bp, Homo sapiens
atgcttcaatccacagtgataaccatgtgtgaattaatgcttgataagcttcaggttatcaggtggagaagtgt

SEQ ID NO: 6851904 - DNA, 73 bp, Homo sapiens
ctggagaaggtggcctgcaggaccccacagaagcaacaacagcttaccttcccctgtggtgccagatcgccag

SEQ ID NO: 6851905 - DNA, 77 bp, Homo sapiens
tggagcatgtgggcccctttagaggcctggcagagtctaagtgggcctccagagggtttcccatgaaaaagtgacca

SEQ ID NO: 6851906 - DNA, 66 bp, Homo sapiens
ggcaggctgtctaaagttagagtcatctgaacaaccacaggcattctaatggcagagactcctgtc

SEQ ID NO: 6851907 - DNA, 60 bp, Homo sapiens
agtaaagtctggctgaaacatgccaccatttctggggctgttgttctcccaggaattact

SEQ ID NO: 6851908 - DNA, 67 bp, Homo sapiens
gctgtgtaatactccattgtatggatggaccacattttgtttatcctttcatctggtaatatatagc

SEQ ID NO: 6851909 - DNA, 112 bp, Homo sapiens
tgtcttcctctgggacagtgaactagcacaatccacacctcatgaaagactaaggctgatgtgggtttgtgagatggattgggttggttcccaccttgtttcaactggtaca

SEQ ID NO: 6851910 - DNA, 61 bp, Homo sapiens
gcctgcagcctcttctgaaaatctggtaaagactgtgattcagaatgcagagactgtaggc

SEQ ID NO: 6851911 - DNA, 63 bp, Homo sapiens
agtgggaggtggagacacagctgaaggctgccaacaaaccttagctgccagaccattcttact

SEQ ID NO: 6851912 - DNA, 87 bp, Homo sapiens
ttggcatttttaaattagtagtcactttctagggtgggacaagatatttcaatctcttgcaaggaactgacttggtttaaatgtcga

SEQ ID NO: 6851913 - DNA, 63 bp, Homo sapiens
tttgggttttgcttgatataaatgaagccagagatctcttatgaaactcaagccagatccaag

SEQ ID NO: 6851914 - DNA, 100 bp, Homo sapiens
gcaggaggcgagtcccatgaggaatggggacgctggtggactcttacagctttgttcctacaaacgtccccagttctttatgccagatcaagtgccctgt

SEQ ID NO: 6851915 - DNA, 82 bp, Homo sapiens
ggctgataaggaagaaactgaaaggggttggtgtcacgggttatgctgcgggaccccccatttgtgttttcaagaatcagcc

SEQ ID NO: 6851916 - DNA, 66 bp, Homo sapiens
gggagctgtcacagaatttctatagtgttgaaatgcctttagagtaaaaactgtgacctcgttcct

SEQ ID NO: 6851917 - DNA, 89 bp, Homo sapiens
tggcttataacataagtattatgttgcaaatgattcaaaatatattagcacagactgaacactgtaaagtgatgcttaaatttaggcta

SEQ ID NO: 6851918 - DNA, 62 bp, Homo sapiens
aagatgctggcaggaatagctagcggtgatcccttatacatagcttctcttttcaacatctt

SEQ ID NO: 6851919 - DNA, 91 bp, Homo sapiens
gtcgtcaagccaaagagagaggtctcaggagaaaccatgcttgctggcactggcaccttgatcttgaacttctagcctctggaactgtgac

SEQ ID NO: 6851920 - DNA, 101 bp, Homo sapiens
gttataagggattttgggtatcatctaaccccttcattttacaggataacagattcattgaggtgagatggctaccccaagttaggaatcccatcagtagc

SEQ ID NO: 6851921 - DNA, 59 bp, Homo sapiens
agtgagtgggttacagatgggaaggaacagatctccagcatttcaggatccactctact

SEQ ID NO: 6851922 - DNA, 81 bp, Homo sapiens
cctattctctgaccaccagaggtccgtgggtatgtgttcgtgagtatgtgggctttgggggttttggctgaagagggaagg

SEQ ID NO: 6851923 - DNA, 90 bp, Homo sapiens
ccaccatggccgcctcctctgggaagattcagagcccttctgcagcctcagcacttttctgcctgccccagagaggccaggcctgcgtgg

SEQ ID NO: 6851924 - DNA, 60 bp, Homo sapiens
agatatatcagttggtggcatctgcaacgtcaggcagcagagaagccaagtgacatgttt

SEQ ID NO: 6851925 - DNA, 62 bp, Homo sapiens
gttaactggcttcaaaccgtttcacctccataaagtccaaacaggggtttgggccaagtaac

SEQ ID NO: 6851926 - DNA, 64 bp, Homo sapiens
gcagcagttttccctttaactgttcatatataaaacattctcagttgaatatacttgctgttgc

SEQ ID NO: 6851927 - DNA, 73 bp, Homo sapiens
gggtaaagactggcccagcttcacggagagcaggaagtaattgtcctctgtagggctgggccacaagttagcc

SEQ ID NO: 6851928 - DNA, 76 bp, Homo sapiens
ccttctcaggacctccagggatctctgagtctctgggccagcccagtgactcctgggcctctgagaggcctgaagg

SEQ ID NO: 6851929 - DNA, 61 bp, Homo sapiens
gtacagctgtgaaaatccacaggatggtcatcacttatcattccactgtggaacagcttac

SEQ ID NO: 6851930 - DNA, 63 bp, Homo sapiens
gaattaggtaatagaactagtaattaagatggttcacctctaacacagttctgtggcctgttc

SEQ ID NO: 6851931 - DNA, 77 bp, Homo sapiens
cattcacaactcatagaccagaacttgtcacctggctacacccaatctctgggagccagaaagttcagctgtgaatg

SEQ ID NO: 6851932 - DNA, 67 bp, Homo sapiens
ctccttgcacccatgagatgccaagtgcctgctgtgaacacagtagtattttctgtgatgtaggggg

SEQ ID NO: 6851933 - DNA, 69 bp, Homo sapiens
cctgggctccctcgtgttctgagttctcttgaccttctagaaacctggttctgcgtgagggggtgtggg

SEQ ID NO: 6851934 - DNA, 55 bp, Homo sapiens
tattgttgggtagtttgttcagcttatttccagctttatagttctcccaacatta

SEQ ID NO: 6851935 - DNA, 86 bp, Homo sapiens
cttccaagttcctcatccagtcatgactaaggcagcaaataatcaagttgcttcagctacatagtagtggctggaagagggtttag

SEQ ID NO: 6851936 - DNA, 78 bp, Homo sapiens
gcatgtgatattgcactcttcaatggcttagccccagcttttttccaggccagctgtctaagagagtaaaacaggtgc

SEQ ID NO: 6851937 - DNA, 69 bp, Homo sapiens
gtcgaggctaagaaggctttgttccttctggctgtgcagccacaccagggcagggcctctagtctagat

SEQ ID NO: 6851938 - DNA, 59 bp, Homo sapiens
tggtgagctctggcagtctgtggctcaccttgctcagtctagatacccaatgctcatca

SEQ ID NO: 6851939 - DNA, 57 bp, Homo sapiens
gctcccaggtccccacctgtctgctgccttggtcagcagccctgggacctggcctgc

SEQ ID NO: 6851940 - DNA, 64 bp, Homo sapiens
ttgtttactcactgtatccacaaatcaatgcctggaattttgctgatacatagtgggcaaacaa

SEQ ID NO: 6851941 - DNA, 66 bp, Homo sapiens
taaactgtagaaagagtgtgactactagcattatctctggtagctctctttatctttctatatttg

SEQ ID NO: 6851942 - DNA, 90 bp, Homo sapiens
ccctgatggatctcttccagctgtgcttctctttggtggcctctctctccccaaccagaagaggacacagtgtggaattgcctgttgggg

SEQ ID NO: 6851943 - DNA, 63 bp, Homo sapiens
gaagcagcacgagatcgatgtgcctttgctcgtggtaagagcagtgggctcgtgcatattttc

SEQ ID NO: 6851944 - DNA, 61 bp, Homo sapiens
ccaggtctgtcagcagcaaagcgggataaaaatagtttctcctgtctgctcacagagctgg

SEQ ID NO: 6851945 - DNA, 73 bp, Homo sapiens
agtcatctgaagccctgtcttatggaagactagtagcttgttctgcatgacttcagggtgtcctaaaatgact

SEQ ID NO: 6851946 - DNA, 60 bp, Homo sapiens
gagtctgtggtctgggttcccctgtttccttaggctgagccagttgtagccacagaactc

SEQ ID NO: 6851947 - DNA, 68 bp, Homo sapiens
gctggtgccctccctgtactgtcaggaggccagagggcccttctccagctcatcagggagggaactgc

SEQ ID NO: 6851948 - DNA, 80 bp, Homo sapiens
aggaggatggcaagaatgctcagtccctggaagctgaacacctcattatagtaccagagcctggcatctgcataattcct

SEQ ID NO: 6851949 - DNA, 61 bp, Homo sapiens
atgtggcagtgggaggtgaattagagggtaaccaagtaatgttagctttctatggctgtgt

SEQ ID NO: 6851950 - DNA, 129 bp, Homo sapiens
cacagagccccccggcgcgcctgccgtgcccccagctcctgcagctggctcccagggagcagggacacctctggagccaccatgtctgccatggagctgttcacaggcactgggctgggggtgcctgtg

SEQ ID NO: 6851951 - DNA, 61 bp, Homo sapiens
gtggaaggccaggcctagcacggaggctgtgagggcgccctgccctgggcccggcctgcgc

SEQ ID NO: 6851952 - DNA, 100 bp, Homo sapiens
ggccagggagaagcgggtgctctgcagtggccaggaaaggtccagcccctgaggccgaggggcttcctgtttcgtgcgggcattgcactctgtctctgcc

SEQ ID NO: 6851953 - DNA, 64 bp, Homo sapiens
tcacgttctctcatgatcttcccgaaatgttatccttaagcttcggggagaggtgagcaacgga

SEQ ID NO: 6851954 - DNA, 63 bp, Homo sapiens
gctacctggtgactgcagtatcctcacacggcccagctgtgaatggagggagtcagtaggagc

SEQ ID NO: 6851955 - DNA, 95 bp, Homo sapiens
tgatattttgtgaatagttttatcacggggcatagttttatcaaccaggctggaggctagtgaactgtggcccgtgaactggatacagattgttg

SEQ ID NO: 6851956 - DNA, 80 bp, Homo sapiens
cttcctgcctctttctttgtccaccaacaatggactggtctacctgtctatagctttgctgagaaaaagagaactggaag

SEQ ID NO: 6851957 - DNA, 55 bp, Homo sapiens
gcctggacagaaaccagtcctggggggatggcttcctttctggggctgtcctggc

SEQ ID NO: 6851958 - DNA, 63 bp, Homo sapiens
taagtgaaatggtgcatcaaatggcactagtagccatttggaacttctttccattttgactta

SEQ ID NO: 6851959 - DNA, 91 bp, Homo sapiens
gtgtctccctgatggactgggaggtcatcttctttgaagacatttggccagagcgagaggcatccaggtccctgagaaacaggggaggcac

SEQ ID NO: 6851960 - DNA, 58 bp, Homo sapiens
tgactcatagctccattcactccctcaatagttgctgaatgaatgacgggcatgagca

SEQ ID NO: 6851961 - DNA, 61 bp, Homo sapiens
ggaggctggaggtcaaagatgaagtgctggcagtctggggttcttctgaggcctctcctcc

SEQ ID NO: 6851962 - DNA, 66 bp, Homo sapiens
ggaccaagcgtctaattgggggttgcccaggtctcactggtgcctggcttcccttggagcatttcc

SEQ ID NO: 6851963 - DNA, 130 bp, Homo sapiens
tgagcatctgcctcactatggattatgctgtatttgctttctgacaaaaggtaatgttagaaaatatctaacattgtttttcacagattatgaacaaacctgctgctaaatcatagacaaattgtgctca

SEQ ID NO: 6851964 - DNA, 66 bp, Homo sapiens
caggtgtctgacctagcctgctgtctgctgggctcacttcaaagcaataggttaggtcaagatctg

SEQ ID NO: 6851965 - DNA, 58 bp, Homo sapiens
gatgcatcctttctgtcttctctgctaaacagtgagctccaggaagaaaaggatcatc

SEQ ID NO: 6851966 - DNA, 63 bp, Homo sapiens
gatctgtttcattcacagtctggcacacacgaggtgccagataaatttactgaatacagaatc

SEQ ID NO: 6851967 - DNA, 62 bp, Homo sapiens
cctgcgcacagggcacccgagatcactcagcacgatgtcatcgggccaagaccgtgcccagg

SEQ ID NO: 6851968 - DNA, 55 bp, Homo sapiens
ggagggccctctgggcactgtggcagtgattggaattgccacaaaacgggccccc

SEQ ID NO: 6851969 - DNA, 71 bp, Homo sapiens
gggcaggtctcattaaaatatctcatggtgttgatttgtggaagttactcaacatggaggtggcactgctc

SEQ ID NO: 6851970 - DNA, 61 bp, Homo sapiens
tccaagatcaaggtgtcagcaggtttgatttctcctgaggactgactctccttggcttgga

SEQ ID NO: 6851971 - DNA, 92 bp, Homo sapiens
gtttgccatttaagccactgttatgttaggttttctgtcacactgcacaacccaaatcctaataatgcactagtgaagtagataaggcagat

SEQ ID NO: 6851972 - DNA, 69 bp, Homo sapiens
attcccctcacttaatattaaatagtgtttgacataaatgtcttggtttgtacattgaggaggcagaat

SEQ ID NO: 6851973 - DNA, 88 bp, Homo sapiens
tgtaggagatgagattgcagagttgagcatctgtgtgttggtgggagcatgaagtatacaggctctgctaaggtctttggcttctata

SEQ ID NO: 6851974 - DNA, 62 bp, Homo sapiens
tctgaggtggcagatgggggtgctcgcccatgaaactagaggggtgtgccctgttacccaga

SEQ ID NO: 6851975 - DNA, 82 bp, Homo sapiens
ggcctgtggctagagtaagcctctgctctatctggtgtttccaccagaccttatagggcagggcattgccaggaggcatgcc

SEQ ID NO: 6851976 - DNA, 65 bp, Homo sapiens
agggaagaggcaaggtttatggaacactggattctttccagagacccaacttggcactctttcct

SEQ ID NO: 6851977 - DNA, 105 bp, Homo sapiens
cctcctgagaactgttgttccaaagtctggttccaggacgggtttgtggaatgagtgccaatccagccctgtgtctgggagagaggccagggagctgctgggagg

SEQ ID NO: 6851978 - DNA, 62 bp, Homo sapiens
ggcctgaccctgccgagctgctccgggaagtgtttgctggaagctcaaggcagggtgagccc

SEQ ID NO: 6851979 - DNA, 64 bp, Homo sapiens
caggcccttctttgtaataaagattaggcaataactccctgattttgagacacagaaggaattg

SEQ ID NO: 6851980 - DNA, 75 bp, Homo sapiens
tcccctggaagagaactacatcaaaggcaatataaccagatttatataaggcttttaaaggttcaccaagtggga

SEQ ID NO: 6851981 - DNA, 71 bp, Homo sapiens
gtacacatatttccaagggtaaataaacaccagcctgaatgtttggtgagattagctttggcaatagtgac

SEQ ID NO: 6851982 - DNA, 64 bp, Homo sapiens
aggcctttgtacaataatcatagtatcctaaaacttccccaatagtatgagctgacaaaggcct

SEQ ID NO: 6851983 - DNA, 57 bp, Homo sapiens
aacaggcggcgggtcgggctgtgccagtggtctggcggatctttcctgcctcccgtt

SEQ ID NO: 6851984 - DNA, 81 bp, Homo sapiens
tcccattcactttcactcccttctctctttccaagctcatatatgattgggttggcttgggactggagaatagggttggga

SEQ ID NO: 6851985 - DNA, 71 bp, Homo sapiens
gctccaggagctcacagctcgctccagctacatcactggcctccacgctgggacgtggagctctctggggc

SEQ ID NO: 6851986 - DNA, 64 bp, Homo sapiens
caagaatgcctgtgtagtgctggagcagttcctcttcactgagctccctctgctcaggcacttg

SEQ ID NO: 6851987 - DNA, 59 bp, Homo sapiens
gtgggaagggaaaattcattcggcttccaccctgggaactgggcacagtctgttcccac

SEQ ID NO: 6851988 - DNA, 56 bp, Homo sapiens
cctttcctgcctggacctctgcttgagaacaggaagaggtgtgggcggggttgagg

SEQ ID NO: 6851989 - DNA, 64 bp, Homo sapiens
gatttttgtcctctggggataagcacacccagggtgaattcattctccagagtgggaggaaatc

SEQ ID NO: 6851990 - DNA, 61 bp, Homo sapiens
actgcctttcctagaaggaagagctttgtttataaacagctgggtcaataggaaatgtagt

SEQ ID NO: 6851991 - DNA, 55 bp, Homo sapiens
gtgtccccacccaaatctcatcttgaattgtaatgccagatgttggtggggagac

SEQ ID NO: 6851992 - DNA, 73 bp, Homo sapiens
gtggtgatttatagtatgtgctttcagattcgccctactttaatcatgaaagcttcattctatagaccaccac

SEQ ID NO: 6851993 - DNA, 82 bp, Homo sapiens
gcagcctcttgcagccggggagccgtgcccactgagcgcaaacagggagcacatctgagcacccggctgctgggggaagtgc

SEQ ID NO: 6851994 - DNA, 69 bp, Homo sapiens
cagtgagccagtgtttctgtgccccagtgttcctgagagttagaacacagaaaacagagcaggctcttg

SEQ ID NO: 6851995 - DNA, 83 bp, Homo sapiens
catccttgcttcttcttgttccatgaaagacagacctgaagctagatttcacatcatgggatggaagctgcttattgaggatg

SEQ ID NO: 6851996 - DNA, 71 bp, Homo sapiens
ctcagctgttgagacacagacacaagcctagtgtatcataaaaggtaagagtaagtctttcaatagctggg

SEQ ID NO: 6851997 - DNA, 62 bp, Homo sapiens
gagagacccagacaccatgcatctgatgataagcatcttctcttggtgccttggagtctctc

SEQ ID NO: 6851998 - DNA, 114 bp, Homo sapiens
ctaacatacaaaactggtggtttcaagggtattattgtttaaagccatgtaaagttttagaaaaggaagtttatttaaagaaaaatactaagtgaatagtagtgtaggtgttag

SEQ ID NO: 6851999 - DNA, 71 bp, Homo sapiens
tgatgttatctggaggcctgtcttatccctaccacagagtggggggtaggtggggtgttccagagttttca

SEQ ID NO: 6852000 - DNA, 59 bp, Homo sapiens
tggtggcagcaggagggcccctcagaaaagggatgggcttgtggtcccctctgccctca

SEQ ID NO: 6852001 - DNA, 88 bp, Homo sapiens
gtcagggatactgtctggatggaagccagcgacccctgttctaaccatttctgttggacgttggcttttccaagacgatttttctgac

SEQ ID NO: 6852002 - DNA, 69 bp, Homo sapiens
cctatctcttgttttcctgaagcctccctggctccggggtgttctgctaggggaagggagagaatgagg

SEQ ID NO: 6852003 - DNA, 81 bp, Homo sapiens
ggaggaggctgaagatgtgtttctagttcctgcatgctgctttgttgtgtgacctcggacatgtcacctccagccttcttc

SEQ ID NO: 6852004 - DNA, 57 bp, Homo sapiens
tccagctggcccggccatgaatctatttccccatgggattggcttctgctagctgga

SEQ ID NO: 6852005 - DNA, 85 bp, Homo sapiens
cgccggtccggcatcctaagacgtgtggtttgagttgcgggcgagaccaggctttttttaggaccttgggcctgataagtgggcg

SEQ ID NO: 6852006 - DNA, 55 bp, Homo sapiens
gtacccactgtcatattcagggtatctagtaccctgggtcatatacagtgtgtac

SEQ ID NO: 6852007 - DNA, 72 bp, Homo sapiens
gtattctcaggccttcagacctggcccggaatctatgtctttggctctccagctctaaggccttaactatac

SEQ ID NO: 6852008 - DNA, 68 bp, Homo sapiens
ctggtgacattctagaagtctttgcaatgcctaaaactttaaaggtatcaatagctagaatgtaccag

SEQ ID NO: 6852009 - DNA, 130 bp, Homo sapiens
tttgtctttaaaattcacaggtctccaagagaagttgaatcaagatctggcattgatcatgagatcctggacataatgtcaatgcaatcattggacaagtcttttgggatatcttggggaagaggatgag

SEQ ID NO: 6852010 - DNA, 103 bp, Homo sapiens
ataatgatgatgataataaccagccttcagtaagggcttagcaggtggccgggaactgtgctaagtgaaccctatgaggttggtactattgtcttcccattat

SEQ ID NO: 6852011 - DNA, 123 bp, Homo sapiens
cactgaagactcaggcttctctgaaggcaaaattacaaagttattaggaattctcttaatggtttactctgatttatggatgtgtttagtcagcccatcatcatccatgagtattcaaaagtg

SEQ ID NO: 6852012 - DNA, 57 bp, Homo sapiens
gctggagtccctgcctttccttttgttccagtggtggaggtgggcaggacctgtagc

SEQ ID NO: 6852013 - DNA, 60 bp, Homo sapiens
agtaggttggggattcatttagcacaaacactaaatgtgaacttactgtccccacagact

SEQ ID NO: 6852014 - DNA, 58 bp, Homo sapiens
tggttggcttttcaatgcctgtaaagagaattagagataggccactgaatgccaatca

SEQ ID NO: 6852015 - DNA, 83 bp, Homo sapiens
gggtcagcggccggccgggctctcgccgagctatgtgcgttggccaccaggttccgggcagagctgaagccaggcagggaccc

SEQ ID NO: 6852016 - DNA, 109 bp, Homo sapiens
aagcagtaaaatgatatggactgttagaatgtaaaatatatgaaataagtcattatatgttagtgctgctctgacatagggacgtattattgagaatcaacttttgctt

SEQ ID NO: 6852017 - DNA, 58 bp, Homo sapiens
tgtatagtgtggaaagaacagttggtcaggcaaaggttttttcagccacacctgttca

SEQ ID NO: 6852018 - DNA, 78 bp, Homo sapiens
cctcatgtatgccttatactaccccataggttttgactctggcagaacaggacacagaataaggcagttttatggagg

SEQ ID NO: 6852019 - DNA, 71 bp, Homo sapiens
atgaatgcatgaaggttgggtgaatagaatgtcgttgattaggataagtagctcctagcctccaagctcat

SEQ ID NO: 6852020 - DNA, 58 bp, Homo sapiens
gcttctggaagcatatgcaagaaactgttcacagtgcacagtgttgccttccaggagt

SEQ ID NO: 6852021 - DNA, 65 bp, Homo sapiens
cagattctgggagatccaagcagaactacccatagtattacttctggagcctctcaaggaatctg

SEQ ID NO: 6852022 - DNA, 75 bp, Homo sapiens
agtggaagaagctggtgtaaccttagcctttgggatctctcagccagtttgtttattccggctctcacttcaact

SEQ ID NO: 6852023 - DNA, 69 bp, Homo sapiens
ggatgatcagtgcatagagagctcctgacacaatgaagactgtgatcatggatttcattcactaaatcc

SEQ ID NO: 6852024 - DNA, 55 bp, Homo sapiens
tctcagggttttcttcagcttggtatgtagaactgctgatctatcacctctgaga

SEQ ID NO: 6852025 - DNA, 67 bp, Homo sapiens
ttagagcctggatagccttgttccagaagcgacttttccaatggagcaaatgtccatgaggctctgg

SEQ ID NO: 6852026 - DNA, 61 bp, Homo sapiens
ctgtttttgtttatagtaaatggtctcagcctgctgggttgaaatactagaatagagacag

SEQ ID NO: 6852027 - DNA, 75 bp, Homo sapiens
gagcagggtgggggtctgagtggtgctgactcaggactgggtcctcctcactccttctcaggggccaccctgctc

SEQ ID NO: 6852028 - DNA, 56 bp, Homo sapiens
actggagaggccccaagatatttggtcaacgaccaaatatcttggcccctcctggt

SEQ ID NO: 6852029 - DNA, 71 bp, Homo sapiens
tctgtctgagtggtgttagagttgtccagagcaattatcctgagggaccacacagacatcagatagacaga

SEQ ID NO: 6852030 - DNA, 65 bp, Homo sapiens
tttacagagtggtgagatcttttgaatgagtgtctagagtacaaaggttatgaaccacttgtaaa

SEQ ID NO: 6852031 - DNA, 115 bp, Homo sapiens
ggttgaaaatgggggatagggaaagagcgtggggtgccgtgactgtcctttgcatgtgtctgctcaggctctgcagtccatcccgtgtctcttcttcttgtccaaaaattctacc

SEQ ID NO: 6852032 - DNA, 65 bp, Homo sapiens
ctgcctggaaggttctcttccagaacctgcagagagctactgctagaggataggaccttaggcag

SEQ ID NO: 6852033 - DNA, 83 bp, Homo sapiens
aggcacacggccacctctgctgtccacaggatgttagcacaactcactcccgtgtcccccaccagaggcctggtctgtctcct

SEQ ID NO: 6852034 - DNA, 55 bp, Homo sapiens
ccctgggaagtattccagctattcctggctgagcccgttgtgaatattcccaggg

SEQ ID NO: 6852035 - DNA, 63 bp, Homo sapiens
gtggattttaaaagtagagatgatcattattattttatgatcctttaagttaataaaattcac

SEQ ID NO: 6852036 - DNA, 59 bp, Homo sapiens
gctggctggagtaaggagggagtaagtttcactccgtcctttgcttcctggccttgggc

SEQ ID NO: 6852037 - DNA, 67 bp, Homo sapiens
gttataatgataatgatgggcactagtggaatatctgccagaaggtcattacaattatcattttaat

SEQ ID NO: 6852038 - DNA, 61 bp, Homo sapiens
actctctgggcatgccccaccagagcaattacaggtgatggagctgggcagctgggaaagt

SEQ ID NO: 6852039 - DNA, 73 bp, Homo sapiens
ggcagctgtcaaacaccaacatttctccctgagaataggtttagtgtagtgtgtttttcaaggacaagttgct

SEQ ID NO: 6852040 - DNA, 64 bp, Homo sapiens
tgcagtgaggtggatggatggcctggcctgttggcaagggcagaaatcgattacacctcttgta

SEQ ID NO: 6852041 - DNA, 66 bp, Homo sapiens
gggagccatggcagaatcaagccgacagccttagtcaggctgcagccttcttgccattaaactctc

SEQ ID NO: 6852042 - DNA, 64 bp, Homo sapiens
gctctgcagatgtgttctgaagctcaggtcacagatggagctgtgagggacacattgctagggc

SEQ ID NO: 6852043 - DNA, 57 bp, Homo sapiens
ctgccctgtggttgtgggttctctgtgcaaggcaggtctcacccatccccagggcag

SEQ ID NO: 6852044 - DNA, 75 bp, Homo sapiens
caacattcaacatggctggtctagtaactattttattattttagagatgggatctcactatgttgcccatgcttg

SEQ ID NO: 6852045 - DNA, 57 bp, Homo sapiens
gtgaccttatttggagacacagtctttacagagataatcatattgaaataaggtcac

SEQ ID NO: 6852046 - DNA, 57 bp, Homo sapiens
tcttggcaactgaagactggctgtacgatgctgcagctctctgcttttttgctatga

SEQ ID NO: 6852047 - DNA, 58 bp, Homo sapiens
gcaacatagttttgggggctgagaaggccacttaaggccttgtccagaaaggcattgc

SEQ ID NO: 6852048 - DNA, 106 bp, Homo sapiens
aggaaaatgaaagggggcagtacctggttctttttctcttctctggaaatgactttgacaacagaggaggccatgtactaggttccttctgccctttcataagcct

SEQ ID NO: 6852049 - DNA, 96 bp, Homo sapiens
gtttagttggagatattgcgagagtacagttctacctaacggacacagctccgggtgggtgtgccatattccatttcgtacgagtctcttagaaac

SEQ ID NO: 6852050 - DNA, 73 bp, Homo sapiens
atctgaagcttaagcatggtggtaaaagaggttgttataattacttcctaaacctcagctttagcctggagat

SEQ ID NO: 6852051 - DNA, 60 bp, Homo sapiens
agtcatctgacctcttctcagagttcagggttttaccttctccaggaggttagtgtggct

SEQ ID NO: 6852052 - DNA, 100 bp, Homo sapiens
aggctgctgggcggaggctgggtgaccaaggaagaggggagccagggctgggcctgagggctgtctgaagcttgggagtcacggtctcagctcagcacct

SEQ ID NO: 6852053 - DNA, 84 bp, Homo sapiens
tgtgatgtggggaggttgctaggcagtgtcacagattatggcacccagccactgagctgtgacaatgcttaactccataatgca

SEQ ID NO: 6852054 - DNA, 72 bp, Homo sapiens
ccagggtgccaaagaacaaatatggcaactttccccccaagttcttgcaatgtttgcagtaacccatcctgg

SEQ ID NO: 6852055 - DNA, 98 bp, Homo sapiens
gagcagaggaatcataatgcatagcttttgtttaagccactaagttttgctgtggtttattatacaacaaaagctaagtgttagaataatctctcctc

SEQ ID NO: 6852056 - DNA, 93 bp, Homo sapiens
tcttttctatacagataaactcatgccaagaaatgatcctggaaatatatttcagactgatggtttctggtctgagtttatctcaagactaga

SEQ ID NO: 6852057 - DNA, 79 bp, Homo sapiens
aggtattaagtggcagagctgtgtcttgaaaacagaggttctgattctaagtagaagcctgtcctactaattcatgcct

SEQ ID NO: 6852058 - DNA, 61 bp, Homo sapiens
gcagcaagatgcaaacatccgtcccccagaagccggggccctgatttgcttattttgcagc

SEQ ID NO: 6852059 - DNA, 109 bp, Homo sapiens
gggaaaaagttgcagccgagcttcttgtttcttcatctgacttcaaagcatgactcacacatgctctccccagaatggagtgcagcgagaggcaggcagcagagacccc

SEQ ID NO: 6852060 - DNA, 92 bp, Homo sapiens
gcttcagctttccttgctttagattcctaactcactgttcactaaattagctgtgggccttgtccttaatctgaggctaggagagcatatgc

SEQ ID NO: 6852061 - DNA, 76 bp, Homo sapiens
gtcatttatagaaatctattgaagcagatgatcaaagaatctattgaacttgctttcagggatgtctgtgagaagc

SEQ ID NO: 6852062 - DNA, 126 bp, Homo sapiens
ggtgttggaattgcaggagttaccaaataggtaggcagccaggtcccctcatggctccttggcaattcaaacccaggtgctcacaggctggcctgaactgccttgcttgcctgcttctatctcacc

SEQ ID NO: 6852063 - DNA, 100 bp, Homo sapiens
agaaccaaatacagaaggagaaagcttgtgtttctgtcgcctttctttcaatgaaataaaagttcaagagagtacagatttcccctctgttcacagttct

SEQ ID NO: 6852064 - DNA, 130 bp, Homo sapiens
ccgtcccccaccctctccagggtggaagactgctccaaggaggccccaggtcagctgctggagaagcagagaggctgcccagtgaggcctcttgtgagcagacttccaccctgggagggtcccctgccgg

SEQ ID NO: 6852065 - DNA, 73 bp, Homo sapiens
tctattgttgacctactttctttttgtcttaagggatttttttgcagaatgggaaggtagttgtaaatgtaga

SEQ ID NO: 6852066 - DNA, 75 bp, Homo sapiens
gctcactgcacacatgtttaagtggaaaatccgatttcacaactcctttccataattgttcatgtgagtaggagc

SEQ ID NO: 6852067 - DNA, 81 bp, Homo sapiens
gttgttctccatgggaggcagtggagaaggtttgtgacagaccctgtgagccttcatttatggctgccacggattacacac

SEQ ID NO: 6852068 - DNA, 76 bp, Homo sapiens
agtttttgtgtgagcctaggtttccgattctcttgggtatatatctaggaatagaattgctgggtcacatgatact

SEQ ID NO: 6852069 - DNA, 120 bp, Homo sapiens
cattattatctctatctgacatataaggaaactggatcccttaaagttaagttacctgtcctggatgacatagctattaagtgatgccaagtctcctttattttagatgtgtatataatg

SEQ ID NO: 6852070 - DNA, 83 bp, Homo sapiens
gaagacaacgttaaaggtaacatgaactgcttttgccatgaggcaataaagctgtaaatgattatctttttagttcagttttt

SEQ ID NO: 6852071 - DNA, 95 bp, Homo sapiens
attgcagccacctgtttttctcatttccaggagaaaggattttatgtatgcaatgaagcaacttttttttggagaaagaaaatttgctctgcagt

SEQ ID NO: 6852072 - DNA, 60 bp, Homo sapiens
tgtttggagaaaggctgtgaacatatgattgtcatacttgatcatagtgcttctcagaca

SEQ ID NO: 6852073 - DNA, 90 bp, Homo sapiens
ggtgtcagaagaacagctcgcagagggcaggcagtgctggtgggtacccagccactattttatcctgtcccttggttctctctgaacacc

SEQ ID NO: 6852074 - DNA, 79 bp, Homo sapiens
aaggcattagagctaaatcatcatttatgtttgtcacaggggttgcaaatgtataatgagattccagagttaatgtttt

SEQ ID NO: 6852075 - DNA, 90 bp, Homo sapiens
ttagctttgggatgttttgtcaaatcaaaccacattctttagataaggagtttggtttgctttgatatttagtgaccttcccttagctag

SEQ ID NO: 6852076 - DNA, 59 bp, Homo sapiens
gtctgcagtcccagggaggtgatgggttaaatgctgtttgttgactgtggactgcagat

SEQ ID NO: 6852077 - DNA, 66 bp, Homo sapiens
gctaccatagctttcccaatgttctcagaaatagtaatcagagaacattgggaaagctagacaggc

SEQ ID NO: 6852078 - DNA, 65 bp, Homo sapiens
aaatagaacaaaatcaaaggagtgattcagtttatcactgtcctgctttgattttgtatgtattt

SEQ ID NO: 6852079 - DNA, 59 bp, Homo sapiens
gattatttgtcactgcacttgaaatttaaatcaaatttaatgtttggtggcaaaaagtc

SEQ ID NO: 6852080 - DNA, 77 bp, Homo sapiens
tgtctcagagaacactgagagtcttagaaacacatagtgtttatgttttcttcatggagtcttattgtttagaaaca

SEQ ID NO: 6852081 - DNA, 91 bp, Homo sapiens
aaaaatgtagataagctggaagagaagagtcacagttataattttcaatatgatttcttctaatttccatcatgtattcatttgcattttt

SEQ ID NO: 6852082 - DNA, 74 bp, Homo sapiens
gtttctcctatttggcacactgggttctcgtgtcatttaaagtcagataatcctgtgtggccaaagtcagatac

SEQ ID NO: 6852083 - DNA, 58 bp, Homo sapiens
tggcagagcccagactccagtcagatttgcctggccccagagtgggtgttctgaacca

SEQ ID NO: 6852084 - DNA, 62 bp, Homo sapiens
agtacacagagttattttgtgtacttaccgaggaaaaagtacacagagttattatgtgaact

SEQ ID NO: 6852085 - DNA, 59 bp, Homo sapiens
tgctcagctgctctgtattcttgtagcagctattattacatactgaagcagctgaagta

SEQ ID NO: 6852086 - DNA, 76 bp, Homo sapiens
gggatagatatttcaggccaaagaaacagcatgaacaaaagtcttatgctgaatgaagcactgtaattctcattcc

SEQ ID NO: 6852087 - DNA, 74 bp, Homo sapiens
aaaggggccggggagctgtgacacgcagcccagggctgtcttagtcaaggctgtctccagcttccaaccccttt

SEQ ID NO: 6852088 - DNA, 69 bp, Homo sapiens
tgctgagccttagaaactactagaataagagatacatcgagattctcttatgaagtggattctctcgta

SEQ ID NO: 6852089 - DNA, 64 bp, Homo sapiens
ctgtcgcgggctaggtgttcctcgggtgatggagcccacctccccagcaccatagccctgaaag

SEQ ID NO: 6852090 - DNA, 66 bp, Homo sapiens
gtggttgcctatttgattatgattgggggttattaacatttttttccataaacagatggtaactgt

SEQ ID NO: 6852091 - DNA, 95 bp, Homo sapiens
ttccattcttttattatttctgttccttctaattttacacctgactgctctgagtgggtgtgtttgtaggagggggtggaagattaaagaaggaa

SEQ ID NO: 6852092 - DNA, 66 bp, Homo sapiens
ccgttagaggcctgtggctgtcgctgtgagctgattctccagctaacacctactggccattgatgg

SEQ ID NO: 6852093 - DNA, 72 bp, Homo sapiens
ggaggtgagggtctctggggctggcatttgtccttcctctgttcttggcatccagagccccaattcacctct

SEQ ID NO: 6852094 - DNA, 106 bp, Homo sapiens
ttgagttttgcaactgtgtttaacatgcatataatggccagaacaaatgtgttacattgttattttgtctgtaattataaggcataaaatataggcaaatattcaa

SEQ ID NO: 6852095 - DNA, 97 bp, Homo sapiens
cactatatctctccttatgaagcattatactcaattgttagctcttactgttagagctaacaattgagtataatgcttcataaggagagacatagtg

SEQ ID NO: 6852096 - DNA, 78 bp, Homo sapiens
aatatgcttctttttcacttatcctgaataaacatatgtaagtcttacatcatggagggtattgaatgaggctgtgtt

SEQ ID NO: 6852097 - DNA, 65 bp, Homo sapiens
gctgagctgctgcatcgcttctcccctctctttccctttcctaggggagctgacagcagcacggc

SEQ ID NO: 6852098 - DNA, 63 bp, Homo sapiens
gcttttctctttgacaggaatcagaggtgtttcctttgtcccctactctgtagaagaggatgc

SEQ ID NO: 6852099 - DNA, 57 bp, Homo sapiens
ggatgccttaattttctaagctgtgcccaaggttgcttactggaaattaagggatct

SEQ ID NO: 6852100 - DNA, 88 bp, Homo sapiens
tctgagaacaggtggtgcatgctatcccatcgaggttctctattagatgccagaaaatgatggctgcagccccagccatgggctcaga

SEQ ID NO: 6852101 - DNA, 75 bp, Homo sapiens
gtttaaattgtatcaaagtctgttactcctgccttatcaaggcataaacaaccagctttgatacgcattataggc

SEQ ID NO: 6852102 - DNA, 68 bp, Homo sapiens
gtaatgaacaatctggcaagaacttgaaaacctgacaggcttaaaggttacatgccagagtgctctgc

SEQ ID NO: 6852103 - DNA, 65 bp, Homo sapiens
tttatttaaagtcgtgtgttaacagtagaaaatattcctctaatgatgacatgacttgaaatgga

SEQ ID NO: 6852104 - DNA, 100 bp, Homo sapiens
ggcctcagactaattcacagcatttgcccatctgggatcctaccgcagatggctggaggtagatgctcactgaacagagttcaaaaaacacaaaggggct

SEQ ID NO: 6852105 - DNA, 58 bp, Homo sapiens
ttgtaattgtcatagcttaggttttatacatattgtgttgtaagcaatgacattgcaa

SEQ ID NO: 6852106 - DNA, 67 bp, Homo sapiens
tatctttaggaagtttcagataggaatgttaaggtattatttctcatttgtaatttactagcagata

SEQ ID NO: 6852107 - DNA, 90 bp, Homo sapiens
tcatattgtagtctctcaaagtgctctagaaatagtcagtggtttacaagaagtggccacgggtgtctggagcaccctgaaactgtatga

SEQ ID NO: 6852108 - DNA, 64 bp, Homo sapiens
gattccctggaggcagagcagagctcttgtctttgcaggagctgcagattctgccttgggtatc

SEQ ID NO: 6852109 - DNA, 87 bp, Homo sapiens
ggagtctcgctctgtcaccaggctggagtgcagtggcatgatctcagctcactgcaacctccacctcccgggttcaagcaattctcc

SEQ ID NO: 6852110 - DNA, 76 bp, Homo sapiens
caccctagtcaaggagcaagcttgccggctgcccaccggggatgcccagcccttggctggctccttgcctgatgtg

SEQ ID NO: 6852111 - DNA, 69 bp, Homo sapiens
taaagaaaatgaaaagaagcttcaaggtgtgcatatgtgtcttcttgaaagcattttcttcatcctttg

SEQ ID NO: 6852112 - DNA, 55 bp, Homo sapiens
gagaggtgaccaggggtgactggctgccctacagtcaagttcaccttctcctctc

SEQ ID NO: 6852113 - DNA, 59 bp, Homo sapiens
ttatagcaggtgactaatgagtatttcaccaccatgatattttgagttgcaagctatag

SEQ ID NO: 6852114 - DNA, 57 bp, Homo sapiens
tgtctgaagtgctgtatgcatgttgttgttctcaaggagaggcaggacactcagaca

SEQ ID NO: 6852115 - DNA, 57 bp, Homo sapiens
tgttaagttgccagtgtatgacggaagcagcgttattaaacgaacgcagcttgtaca

SEQ ID NO: 6852116 - DNA, 108 bp, Homo sapiens
caaacccactaatgactccattgagggttgggtaattaggcgattggtgtttcagatgctctctattatgcagaagtcctcagtggattgtaatactgtgtatgtttg

SEQ ID NO: 6852117 - DNA, 61 bp, Homo sapiens
catgcatgtttactacagtgacgtagaatgatttttctaggagctgtattaaagatacatg

SEQ ID NO: 6852118 - DNA, 88 bp, Homo sapiens
atgctgagaatggcagtggatccaatggtatcttctctgtaaagttgaggaatgcgagaattgcttttttacctgccattcttctcat

SEQ ID NO: 6852119 - DNA, 58 bp, Homo sapiens
aggatgacctacaagcaatagaggtcttagggaaccacctctgagtgagggttatcct

SEQ ID NO: 6852120 - DNA, 81 bp, Homo sapiens
gttattctcaaatgcagacttattcaagttggttatgatagagcagttagaacttagaagatgattctgtgtttggaatgc

SEQ ID NO: 6852121 - DNA, 61 bp, Homo sapiens
gccagtgaatcagcacatccagcagtgagatgtcacttctgtatgtcctgcattcaaaggc

SEQ ID NO: 6852122 - DNA, 126 bp, Homo sapiens
ggactgctgggtgtttgccctctccccctccctagtctgctcaccctccttcctggatgttaatgggagagggggtgtcagcactgcagtgtgggaggggagaggcgatttcagtccagacaggcc

SEQ ID NO: 6852123 - DNA, 87 bp, Homo sapiens
cttcctgagtcttaatttcttcagctctaaaatggagataataacatacatcccatggagttgacatgaaggttaactcaagtgaag

SEQ ID NO: 6852124 - DNA, 76 bp, Homo sapiens
tgagcacatgcaccagaaatcaacataagaataagtccttttgagtgttcaaaactggtgtattatttgtgactca

SEQ ID NO: 6852125 - DNA, 70 bp, Homo sapiens
tctcagggctcagagctcaggcagacctaagtccaaatcccatctctagctttagctctatgtcctgagg

SEQ ID NO: 6852126 - DNA, 73 bp, Homo sapiens
aggctggagtgcagtggcgtgatctcagctcactgcaagttccgcctcctgggttcacgccattctcctgcct

SEQ ID NO: 6852127 - DNA, 84 bp, Homo sapiens
attacaagcctatgaaaatttctgtttactctatcttgaaaactaagagtttaaaacagcagaacattttcagggctgtgtgat

SEQ ID NO: 6852128 - DNA, 78 bp, Homo sapiens
gttatcccttgaatacctagtgggatgatagatttctttattaggaataaatcaatcctattggtagtcagtcatgac

SEQ ID NO: 6852129 - DNA, 71 bp, Homo sapiens
tctttgtttatatttctcctcgaacgtcttcctgagggctgaagaagtccagagaggcatatttacaagga

SEQ ID NO: 6852130 - DNA, 101 bp, Homo sapiens
tggaatatgttctttagttgtatcagtcaagttggctaggttatgctacagtaaaaagcaacaacaaaacttcactggcttcagtaacagaattttatcta

SEQ ID NO: 6852131 - DNA, 60 bp, Homo sapiens
cggtgtggtgtgtgaggaagctgagccattcagagcgtggccttcctccacagagcgctg

SEQ ID NO: 6852132 - DNA, 58 bp, Homo sapiens
taggaggaactttttgtttggatattctccttccttaagcattcaaaagtttcttcta

SEQ ID NO: 6852133 - DNA, 66 bp, Homo sapiens
gcagttacatgactgccggcggtgctgcaattatgattgatgcatgcgtctggagtctgaggctgc

SEQ ID NO: 6852134 - DNA, 82 bp, Homo sapiens
caaatgcccccagagccagcaagtccccttcctgccccgctaaaagaggaataagaacttgtctctggcagcctcttatttg

SEQ ID NO: 6852135 - DNA, 82 bp, Homo sapiens
agccagttctgaggctcctgctgtcctttgaagcctctgcagggcagtagcagggaggagggcaggcagagcaggcctggtt

SEQ ID NO: 6852136 - DNA, 82 bp, Homo sapiens
agttctagggtactggcgcacaatgtgcaggtttgttacatatgtatacatgtgccatgttggtgtgctacacccattaact

SEQ ID NO: 6852137 - DNA, 66 bp, Homo sapiens
ggctcttcatcatcagcaagccatggggcatatgccacaggaagtgcctggtgagaggatcctgcc

SEQ ID NO: 6852138 - DNA, 55 bp, Homo sapiens
ttcccttaaccgtaggacagtctgtggggtcacaggaagtcttttcttaggggaa

SEQ ID NO: 6852139 - DNA, 58 bp, Homo sapiens
gtccttccaacggcaatccaaatgccagatataagggcataaaaggatgtggaaggat

SEQ ID NO: 6852140 - DNA, 91 bp, Homo sapiens
gagagggttgataagtgattccttgcagacacacctttctctctgtgacagtgtgtttctgaaaaaggtttgaatacacaaaaccctactt

SEQ ID NO: 6852141 - DNA, 55 bp, Homo sapiens
gacatatgatattaaatgagcatcttttcatatgcttattcgccatctgtatgtc

SEQ ID NO: 6852142 - DNA, 67 bp, Homo sapiens
gtgtgtgtgtgtgtatgtgtgcgtgtgtgtgcgcctgcacacatatgtatgcatcatgtgcacgtgc

SEQ ID NO: 6852143 - DNA, 91 bp, Homo sapiens
agttgttcagtgttcattccgtctgtcctttatcttgtctgctccttgggaaagctgggtgaaggcagatggctttggcgcaggctcagct

SEQ ID NO: 6852144 - DNA, 99 bp, Homo sapiens
gctggttgccctaatggtggattctctgttcaaggatggtgagctagtgttcagctcaggaagccactccacagagatggccaccaaaagggcttcagt

SEQ ID NO: 6852145 - DNA, 59 bp, Homo sapiens
ccagagtgtgttcgaccttccagagtcttctttctaaaggctctttggacaactactgg

SEQ ID NO: 6852146 - DNA, 60 bp, Homo sapiens
aactgtgaaagctaacatcttagcttgcaagtaggttaaaatattggatgctttacagtt

SEQ ID NO: 6852147 - DNA, 85 bp, Homo sapiens
ctgagtatctaaacttgttcaatgttgggaatagagaacatctctttcccttagaacattaacaaagcatcagtttatgactcag

SEQ ID NO: 6852148 - DNA, 59 bp, Homo sapiens
cttacaagcaaaacaactgtagaatttagcccaaagtctatgttagtgatgtttgtagg

SEQ ID NO: 6852149 - DNA, 71 bp, Homo sapiens
gcaaggatttcagccaacagaatcttgtcaaaattcctgaattgattcttcatggctgtgagtcctcatgc

SEQ ID NO: 6852150 - DNA, 56 bp, Homo sapiens
gcccaggagttgaatgcagcagtgagctattattaccactgtactccagcctgggc

SEQ ID NO: 6852151 - DNA, 121 bp, Homo sapiens
cttttaaaatttctagaaaatctggtattcttctgaaggtaggaagcattttgaattaaaaatgtctttggaaatgtggatccttacagataccagaatatttaagagagattattcaaag

SEQ ID NO: 6852152 - DNA, 61 bp, Homo sapiens
ggcaggtgctcttgtgaacccatgaatgcataagtatttgggggcagagggagcatctgcc

SEQ ID NO: 6852153 - DNA, 71 bp, Homo sapiens
gcatcatgcttcctccaaactaccctctactgtattctgaagaggttatttgcagatggaattcatagtgc

SEQ ID NO: 6852154 - DNA, 111 bp, Homo sapiens
taaggaattttcaaagacaaggatgtattcagaatgtactgatagaacagtaataactaatatgtatagtgttcttactaagtacctgaaatatttttgtaaaacttctta

SEQ ID NO: 6852155 - DNA, 93 bp, Homo sapiens
cacgttagctcattatggtagctagaatgcttcgtgatatgttaggcatctattctgtactaccaggcgttctagattgcagagctccacgtg

SEQ ID NO: 6852156 - DNA, 129 bp, Homo sapiens
cagtccaaaaagaggtcctgcaattggcctgttttctatctccgtcatatcattcattccttgcagtcacacatgaagacaatggagagcagagtactctgggcatggtgggtcctcaaaagatatttg

SEQ ID NO: 6852157 - DNA, 96 bp, Homo sapiens
gctgggggaggtttaaataacttgccaaggtggcacagctagttactggctgcatgccaggctttgagcaagaccgtctaacttcagaaccccagc

SEQ ID NO: 6852158 - DNA, 89 bp, Homo sapiens
gcacttccccagtgatcttagttcttggttcttagttcttggtttggtgtccaggatgggagataggaacagatcttgaggagaacagc

SEQ ID NO: 6852159 - DNA, 63 bp, Homo sapiens
tgtcaaggccttggaaagatacccagctctctggagcctcggtttcctccaaggtagaagaca

SEQ ID NO: 6852160 - DNA, 75 bp, Homo sapiens
tgccttttggtgattggaatatgcagagagcatgaataggtaaccctgtgataatctgcataccagtaaaaggta

SEQ ID NO: 6852161 - DNA, 76 bp, Homo sapiens
gcctctttccccagccacccctgtcattgctcaatgggctcatgaatacagtggccatggtggcaggggtggaggt

SEQ ID NO: 6852162 - DNA, 57 bp, Homo sapiens
atttgacctttgtttttacagagttgctgtggctgcttggtagataaaaggttggat

SEQ ID NO: 6852163 - DNA, 64 bp, Homo sapiens
tcctgctcacttatccagttccactccactgtggtggggtctgagctgtggagctgggcagtga

SEQ ID NO: 6852164 - DNA, 76 bp, Homo sapiens
acagtgcattgtgtatttctgtagtactgttttgcattttccatagagacagaaaactttgcaagtcaatcactgt

SEQ ID NO: 6852165 - DNA, 66 bp, Homo sapiens
caggagagaagcacactgattttatttctgtgggaccccaggttggagtgcagtggctcaatcttg

SEQ ID NO: 6852166 - DNA, 78 bp, Homo sapiens
tgtgaaagtcgcccaagcattgtgtttaacagctctaatgccaaagtggttgttcattagcgcttgggcactgacaca

SEQ ID NO: 6852167 - DNA, 72 bp, Homo sapiens
ttgtctcccagtggtagagagatactttaggcaaaataattgaacttctaaagtactactactgttggataa

SEQ ID NO: 6852168 - DNA, 64 bp, Homo sapiens
aatttactgaggtgtaacacaaatacagagtactccgtatcccacgtgtacagctcagtgaatt

SEQ ID NO: 6852169 - DNA, 80 bp, Homo sapiens
ttgccttcagggagcttgtgtgcaggtgcacggtttgattcctaatcataaatagttgtgcctgaatgcagtgaaggcag

SEQ ID NO: 6852170 - DNA, 66 bp, Homo sapiens
aggttcatgctatgtaatcatgagaagtaaagtttatgaagacaatgatagcatgaaaaaatgcct

SEQ ID NO: 6852171 - DNA, 56 bp, Homo sapiens
catatcatagtagcttgcacgtgtgccttatgtttgggtacagtaactatgttatg

SEQ ID NO: 6852172 - DNA, 80 bp, Homo sapiens
aataaattagttgaagatttataggagcctattaactcttgtgcatgagttgtaggttaattgaactataacagtatgtt

SEQ ID NO: 6852173 - DNA, 56 bp, Homo sapiens
gtggtggctcacgtctgtaatctcagtactttgggaggccgaggtgggccgatcac

SEQ ID NO: 6852174 - DNA, 63 bp, Homo sapiens
gcaagtcgttcccttgtcctctcacaaccatacacagcaaaggaggtgcaaggcatggcatgt

SEQ ID NO: 6852175 - DNA, 80 bp, Homo sapiens
ctgtaactctcagaaatatcctttcttgaggaaagcgattaaccagattctggctttggagaggatagcagggaaagcag

SEQ ID NO: 6852176 - DNA, 85 bp, Homo sapiens
tgtttccttggttgtgcttcaacttctaaaatatgttttttctatgaacattttaatgaggggttggacataagacagaaaaata

SEQ ID NO: 6852177 - DNA, 56 bp, Homo sapiens
tgcaattttccaacacatttttggaacttccacaattgtgcagaattggaattgca

SEQ ID NO: 6852178 - DNA, 66 bp, Homo sapiens
tcattgccatggcatttgcagactgtcctggtgctggtgggagtgtctttatgctatgagcagtga

SEQ ID NO: 6852179 - DNA, 63 bp, Homo sapiens
gtaatacagtgtttcccccaggatagcatctaattgctatttgaacgaacccactgtctttac

SEQ ID NO: 6852180 - DNA, 58 bp, Homo sapiens
cctgattgtagctaatagtagtttaacagcttgaaattggaaaatgctacatatcagg

SEQ ID NO: 6852181 - DNA, 63 bp, Homo sapiens
agtatcgaagcattactgtggtatatagtaaggatacccttctccccatagagtgtttatact

SEQ ID NO: 6852182 - DNA, 65 bp, Homo sapiens
ttttatcatcttctgaatttggaatcaatggaaaaacagatccaggagtcagacagatggtgaga

SEQ ID NO: 6852183 - DNA, 62 bp, Homo sapiens
gtgctattcatattgtaaaagaagtgatcaaattatttctttttcttatagtgtgattgtac

SEQ ID NO: 6852184 - DNA, 72 bp, Homo sapiens
tgtttctgtggactctgcttaggaattgactgtctccacagtttcatctgagtgacgtcctgacaggacaca

SEQ ID NO: 6852185 - DNA, 68 bp, Homo sapiens
gcgggcgggcggttccgcagctgcggggcacaatgagcgctcccagtgcgcaggcgccacctgtcagc

SEQ ID NO: 6852186 - DNA, 130 bp, Homo sapiens
ttctgtgtcttacctgatctatgcaatcattcttggatttggctctagtgaaaaatgcaacgtaaagttaatttgaaatactcaagctgcaatctatgaactattctttacaagggacaagcccacagag

SEQ ID NO: 6852187 - DNA, 60 bp, Homo sapiens
gactactcagcaaacatttgctggttactctctgtgttctaggaactgttctgagtggtc

SEQ ID NO: 6852188 - DNA, 130 bp, Homo sapiens
ctgtcattgtgccactgtataccagtctggactacagagcaagaccatctttaaaaaagcctgcatatccaactttttgagatggagtcttgctctgtcaccaggctggggtgcagtggcaccatctcag

SEQ ID NO: 6852189 - DNA, 60 bp, Homo sapiens
ctccagagatacctgatttgctggtatctgcccagtatttcctggcttatctgctgtggg

SEQ ID NO: 6852190 - DNA, 93 bp, Homo sapiens
tgtttaattacttagcttgagaattctgttgctgaggttgcttagtatccatgaaacctaatttcagcaacgggagcctagagtttaatagca

SEQ ID NO: 6852191 - DNA, 75 bp, Homo sapiens
aaggagcattctatgtgaacgttatagtttgagcttacagtaaacaggaagagcattcacatggtagtgcttgtt

SEQ ID NO: 6852192 - DNA, 93 bp, Homo sapiens
gtgcacaagttgtctggattctgtactgtaaagttatcacagaacaggggactcacagtgaagccagaatcatcccagatccagcatgtgggc

SEQ ID NO: 6852193 - DNA, 84 bp, Homo sapiens
atttccagccaaagagaattctggtgctaacaaggtatattactacctgtttttttagagagttgtcattgtttagctggaaat

SEQ ID NO: 6852194 - DNA, 74 bp, Homo sapiens
acaatccactctcattgaaatgtgactgagtgaaatattttcactgtgctaagtcactgagattttggaattgt

SEQ ID NO: 6852195 - DNA, 55 bp, Homo sapiens
ggctggcaggggatgtcagatggcacggagccgaggccatcatccctttgcagct

SEQ ID NO: 6852196 - DNA, 67 bp, Homo sapiens
gcacaaatttctggccctatggcatgtacctgctgacagagtacacttatatttgtcaattttgtgt

SEQ ID NO: 6852197 - DNA, 59 bp, Homo sapiens
ggctgtgaagtacgttgaaggtggatcttgtcacatgccccttcagtgttcacctggcc

SEQ ID NO: 6852198 - DNA, 56 bp, Homo sapiens
gaccctttctgagtgagcagttcacctgctgtgtgcagccaccttggagaggcgtc

SEQ ID NO: 6852199 - DNA, 82 bp, Homo sapiens
ggctcctacttagtcatccagggcactggatatggattttgccatagcaagattactatccactgctggtgagaaaggggct

SEQ ID NO: 6852200 - DNA, 77 bp, Homo sapiens
ggaaaatcacaggcttagaagattgaccctggtttgaaactgggcaggctgcttcacttttttgagcctctgtttcc

SEQ ID NO: 6852201 - DNA, 58 bp, Homo sapiens
tgagcatggtgggtgcagagcaggcagggcactgtcagcgtctgctgcgtatatgtca

SEQ ID NO: 6852202 - DNA, 58 bp, Homo sapiens
ccatgtgtgctaatgtatgctctaagaataaagtttttaaagcagtttgtatacatgg

SEQ ID NO: 6852203 - DNA, 78 bp, Homo sapiens
ctgtctctcttatagggcatgtagtgtgcatagagactcggtgtcatatgcacactaggtgtcaggaataggtgtcag

SEQ ID NO: 6852204 - DNA, 56 bp, Homo sapiens
ctcctccctctttgccacacatttcctatggaaagactgtcacggggaaggaggag

SEQ ID NO: 6852205 - DNA, 61 bp, Homo sapiens
attctgctcagcatttgtgattgaatttgactctcaaattattcaaaaagctgtgttgagt

SEQ ID NO: 6852206 - DNA, 76 bp, Homo sapiens
catgtagggtaagttcctgacattgccatggcatttgtaaactgtcatggtgctagcgggaatgtctcttagcatg

SEQ ID NO: 6852207 - DNA, 67 bp, Homo sapiens
gttccttggaagacagccgtctttatttcttagtgctgggaaattcaggacaaatgttttcaagaat

SEQ ID NO: 6852208 - DNA, 73 bp, Homo sapiens
agagctttagtacttgtgagtaaaacatagtagttacaaattattattgactattcagaatgtgctgcactct

SEQ ID NO: 6852209 - DNA, 129 bp, Homo sapiens
tagtactgcagagggctcgaatgtcagagtaaaaagatgacactctctttgctgaaggacatccagtaaaagtttttgagcagaagggtgacatgcattgtgatttcggaaaaccaacatgacaaccta

SEQ ID NO: 6852210 - DNA, 88 bp, Homo sapiens
ggtagctggtacaaaggagaatagggtagcaagcatagtaagcatgctgcttaattttttgttcagcatcctttttctagaaactgcc

SEQ ID NO: 6852211 - DNA, 57 bp, Homo sapiens
tttctgcaggtattgcataagtcaggacctccctgttctcatccagtgcctcaggaa

SEQ ID NO: 6852212 - DNA, 70 bp, Homo sapiens
gaggcctaccctggaggctggccctgctgggcactgtctgccaggctgccagaagccttcaggaggcttc

SEQ ID NO: 6852213 - DNA, 66 bp, Homo sapiens
gcctagtcttgctgtgctatgagtttgcctggattgccattacttataggccaagtagactgtggt

SEQ ID NO: 6852214 - DNA, 123 bp, Homo sapiens
agttttgggttatgtttttatgtggactgttgttgtttggtttatttcaattgaaaggaaaagatcaatagataaagctacataaactactgtccatgcaccaaaagcatcatatgcaaaatt

SEQ ID NO: 6852215 - DNA, 57 bp, Homo sapiens
tacattgactctctgtccctaaatgaactgagattttggaggggagagaattgtgta

SEQ ID NO: 6852216 - DNA, 64 bp, Homo sapiens
tttgtggactcgcatggctgaggcggtgatatctgtggtcacgttgaagtaaggcagccacagg

SEQ ID NO: 6852217 - DNA, 63 bp, Homo sapiens
tccctgggagctcagccctggggtgtgccctgtaacgcccgaggccttgatgcttctgcggga

SEQ ID NO: 6852218 - DNA, 60 bp, Homo sapiens
gaagcagcagaattccatggcagattgttcaaaactagtctctttgtggactctgccttc

SEQ ID NO: 6852219 - DNA, 72 bp, Homo sapiens
caggcctgcaggttgcagaggcggaagcgcttccgcttacccacacagtatctgcctttgtatctgggcctg

SEQ ID NO: 6852220 - DNA, 78 bp, Homo sapiens
tcctcagacaaggccggaggcccgattgtgtttttctcgactcgccagcatccagtcagggcctggcctgctgaagga

SEQ ID NO: 6852221 - DNA, 55 bp, Homo sapiens
gggagaatgggtattcaacctggtacagccagtaagaatcttactacattctctc

SEQ ID NO: 6852222 - DNA, 56 bp, Homo sapiens
cattgctgtttctttcactgcctcagattatatctgaacagaaaagatgcacaatg

SEQ ID NO: 6852223 - DNA, 65 bp, Homo sapiens
ctgcttagctcctgtcatctccacacggacctgttttaaggagaagctggaggaagactaagcag

SEQ ID NO: 6852224 - DNA, 64 bp, Homo sapiens
ccatgttttccacccaagataggtagatgagtcctctactattcttgtgtggtggaagatatgg

SEQ ID NO: 6852225 - DNA, 92 bp, Homo sapiens
aagcaaagggagaaaatattagcagtgatcaaaatggagttctaaatatataggtctttattaggttattctctgtacttttccaaatgctt

SEQ ID NO: 6852226 - DNA, 74 bp, Homo sapiens
acaattatattaactgtccatttaatagttgctgaggatttttttggccactgatggatagtcaagatacttgt

SEQ ID NO: 6852227 - DNA, 56 bp, Homo sapiens
ccatatcagaagattgtcacccaattcagaaatagatttagggtggcttgagatgg

SEQ ID NO: 6852228 - DNA, 68 bp, Homo sapiens
cctgaagtcctgtcattgctttgccaagttctttctccagccattggtaaacttgacagagaatcagg

SEQ ID NO: 6852229 - DNA, 64 bp, Homo sapiens
caaaactgccttataatatgtcaacagaattacttcctgttgctaaacatagaggggcatcttg

SEQ ID NO: 6852230 - DNA, 82 bp, Homo sapiens
gagagagagagagaatatgaatggctttttgatacatgtccatgatcatgttttgcggtggtcattatactcctttcctttc

SEQ ID NO: 6852231 - DNA, 78 bp, Homo sapiens
ctgttatctggtaaaagagccacttatgacctcaggtgctacttaacctggggggcaattgtttcttaggcctagcag

SEQ ID NO: 6852232 - DNA, 130 bp, Homo sapiens
gtgtggttgggtctgtggtcctgtgctctgctattgctcagagaaggagatgtcccaggatgccccagtggcacattggtcactgaagaatgagagacatgcataggagacctgaactcaactggtggcc

SEQ ID NO: 6852233 - DNA, 65 bp, Homo sapiens
gtgctgtgatgagatgtacatggactctataaacctgagtgattcccgtatatctgcacatatac

SEQ ID NO: 6852234 - DNA, 57 bp, Homo sapiens
taggcactggttgtggatagttgccatggtgacaatcaagataatccagatgaccta

SEQ ID NO: 6852235 - DNA, 63 bp, Homo sapiens
ttaggaaggcactgggtgccaaagtctgtctttgaggtcaggatctgcgcctgtgcctcctaa

SEQ ID NO: 6852236 - DNA, 61 bp, Homo sapiens
gccccaggccaggggtctgtgttgtggtaagaagctcagagcacagggttttgtgccgggc

SEQ ID NO: 6852237 - DNA, 83 bp, Homo sapiens
aggcttgcaccaaagtggcagtgtggagggaggagtgtggtctttggagccagcccaggcctgcactgcccttgggcaagtct

SEQ ID NO: 6852238 - DNA, 61 bp, Homo sapiens
gctgcctccactggctcccagtagaacccaaactggcaatatgctttcagtggccggcagc

SEQ ID NO: 6852239 - DNA, 70 bp, Homo sapiens
tggaatacagtgagaataattcttagttctgagctagaaattgagcttagggatgctctcctgtcctcta

SEQ ID NO: 6852240 - DNA, 63 bp, Homo sapiens
ccttcaggatgtggtgtacatattaagccaatgactgttatatgatactatgtctccaaaagg

SEQ ID NO: 6852241 - DNA, 55 bp, Homo sapiens
atgccccttcttactttcttgatgcttttttgcatggcagagagaaaagggccat

SEQ ID NO: 6852242 - DNA, 108 bp, Homo sapiens
gatgaaaactgaaaaagtcagtcagtcatccagatgtctccaaatgtctgggtgtttgtcattgccaaagaacatctggatggctgctttttttaaatagtttttatt

SEQ ID NO: 6852243 - DNA, 84 bp, Homo sapiens
tactcaaactttacaatggataaggaaaattgggttgtatgtaaaaatacattatcctgtctttgtccttgtagacttagggta

SEQ ID NO: 6852244 - DNA, 61 bp, Homo sapiens
gagtgtatgtgtgcacgcacttgtgtatgtgtacatgtgcatgtgtgcacacatgacattc

SEQ ID NO: 6852245 - DNA, 86 bp, Homo sapiens
aggggaagttgatgaatgcatcagaaatgtgtataattaagattgaaaactaattgtgggatggttgatgtttctctctctctcct

SEQ ID NO: 6852246 - DNA, 89 bp, Homo sapiens
cccctagaattcggatggggaaactgaggctggggggcttctcaaggtcacagagtaagttcaaggaagcctccagtttccccaggggg

SEQ ID NO: 6852247 - DNA, 129 bp, Homo sapiens
tcatcgtgtccattcctacataattcacattgaaggtgctttcttcattttgatacactgtaggattttagtagaggaaaaagaaagcattaaagtgaatattgttctgtggagatttccttatagtgg

SEQ ID NO: 6852248 - DNA, 107 bp, Homo sapiens
gaggcatgagaatcacttgaacctgggaggcagaagttgcagtgagcagagatcacagcactgcagcactgcacttcagcctgggtgacagagtgagactctgtctt

SEQ ID NO: 6852249 - DNA, 65 bp, Homo sapiens
gcaatgtgaacgtactgaatgccactgcacacttgaaagtggctaatatagtcaagtttacatgt

SEQ ID NO: 6852250 - DNA, 75 bp, Homo sapiens
gtcactttcaaacataaacacttagtagaatggttgttaggttccatatctgtgaaatgtgtttgtataagtgac

SEQ ID NO: 6852251 - DNA, 58 bp, Homo sapiens
ggaatagggagagaatcgtttgccccaaagaaagcatcaaaccctcttttcctgtttc

SEQ ID NO: 6852252 - DNA, 63 bp, Homo sapiens
ggcacagctaactttcactgagcagtttttattgtccactgcttttatgccaggcgctgtgcc

SEQ ID NO: 6852253 - DNA, 62 bp, Homo sapiens
cttcttcaacctgaaagtttcatatatatgaaaatgagggaaactatcaagtgttgggggag

SEQ ID NO: 6852254 - DNA, 75 bp, Homo sapiens
tttcagttgattgcttgggttactctttatactctgctgcaacacagaatctgagaactgaagcagggactgaaa

SEQ ID NO: 6852255 - DNA, 67 bp, Homo sapiens
tgtccatcatcttcgaaaaaagtcagacttaagctggacttctggctgttttagatgagctcagaca

SEQ ID NO: 6852256 - DNA, 92 bp, Homo sapiens
cagtctatcccattttaatgcatgttagaggttttccacatgttaggcaaattttctagaatgttttgaaagggaaaaaattctgcagactg

SEQ ID NO: 6852257 - DNA, 56 bp, Homo sapiens
gaagaagatgagtaatttttccttaatgatggaaacattctctccatgtcttcttt

SEQ ID NO: 6852258 - DNA, 64 bp, Homo sapiens
atcacctgagcctgacccagagccacctagatatgagtacttgtttcaaggctccctgagggat

SEQ ID NO: 6852259 - DNA, 72 bp, Homo sapiens
cagccaccagacctgatagagaaggaacactgattgaaccaaaatggtggagctatacgggatggctggctg

SEQ ID NO: 6852260 - DNA, 58 bp, Homo sapiens
ggtggctctgagctggcctttccatggcatgcactgcccagagcccctcagcgtcacc

SEQ ID NO: 6852261 - DNA, 78 bp, Homo sapiens
ctgggttgtcttcctggggtcgagggttctctggcaggcataccatggtgcccttgcccctctaccccgacatcccag

SEQ ID NO: 6852262 - DNA, 68 bp, Homo sapiens
cagatgacacaccatttttacttacacaaccaacttatcaatgactgtgaggtctggtgggtcatctg

SEQ ID NO: 6852263 - DNA, 66 bp, Homo sapiens
tcagattctagatcagtgctgtccaatagaacacttgaagtgtggccagtgcaactgaagaactga

SEQ ID NO: 6852264 - DNA, 98 bp, Homo sapiens
gctctaggttaacctttaaatgtgacttaatccttgggtggggcatagtatgatgggcagcatcccacccactcctgagatgctaaaggttgaggagc

SEQ ID NO: 6852265 - DNA, 61 bp, Homo sapiens
tgagctcaagccatccttctgcctcagccttgtgaggagctagaactatggctatgtgcca

SEQ ID NO: 6852266 - DNA, 72 bp, Homo sapiens
tggagaatataactgggtgcctggtggatgtgtgaatcctatttttacattacactgtggtcctgttctcca

SEQ ID NO: 6852267 - DNA, 72 bp, Homo sapiens
ggctcctcaggggcagccggggaagccagtcccagggcacaggctggcatcacactctgcctctgagggacc

SEQ ID NO: 6852268 - DNA, 56 bp, Homo sapiens
cacttttccttttctcacggggatccagctgatttggaaggagactgggaagtgtg

SEQ ID NO: 6852269 - DNA, 85 bp, Homo sapiens
gcaactggaatgtttgtgtttcccattcaggctaaggttttcttggtatgaaggttcttggaacgctgcatcataatctactagc

SEQ ID NO: 6852270 - DNA, 71 bp, Homo sapiens
ctatgtggggtggggaaggttactgggcctgaaactccagcattcagagatggcctcccacacttccatgg

SEQ ID NO: 6852271 - DNA, 69 bp, Homo sapiens
gtacctcatatcagcatatgtccttggcatagtgcctgctggctaagaattggcagctgctgaggtcac

SEQ ID NO: 6852272 - DNA, 76 bp, Homo sapiens
ggggagccagctccctccttgtgatccgaacctttcatttccgggcgtgataaagatggggctgtgtttaatttcc

SEQ ID NO: 6852273 - DNA, 59 bp, Homo sapiens
acatgagttagtttcttgtctagaaaagagccatatctcatcagaatgactactcatgt

SEQ ID NO: 6852274 - DNA, 60 bp, Homo sapiens
gcaattgtactagaaaacaatagtgattttctaatagctattgttttctagcataattgc

SEQ ID NO: 6852275 - DNA, 60 bp, Homo sapiens
tcttcccccgtgctccagtgcagcgggtactcgtggccctgccggggccctgggggaagg

SEQ ID NO: 6852276 - DNA, 75 bp, Homo sapiens
gagacaacctgatagaagcagaagcataccaattcccaggagttaatgctgtttactttagtctccgttgttctt

SEQ ID NO: 6852277 - DNA, 64 bp, Homo sapiens
gtgagttcaagactgctttaggatgttcagatgcagatgtcctcagcatggaatctggacttgc

SEQ ID NO: 6852278 - DNA, 60 bp, Homo sapiens
tcctgttctccctcagataagactcagatctcttacatggtccagtggaggaggacagga

SEQ ID NO: 6852279 - DNA, 65 bp, Homo sapiens
cctcaaggagctgtgatgtgtccagaaacagacgaagccatcgacatcacacgccttccaggagg

SEQ ID NO: 6852280 - DNA, 89 bp, Homo sapiens
atggagatgggcatatgtagcgtgtgttctggacacggcacgtggaggcagagcacacatgcatagagtgtgtaatgcttcacttccat

SEQ ID NO: 6852281 - DNA, 66 bp, Homo sapiens
cctataatgaattttagattagctactctttgaaaagggacatttgctatcggagttctggttagg

SEQ ID NO: 6852282 - DNA, 77 bp, Homo sapiens
gcaggactgaattccttctggatgtgctaaggaagaatctattaatttgccttttccagttcctagaagccacctgc

SEQ ID NO: 6852283 - DNA, 129 bp, Homo sapiens
tcttttatcctgttcttctattcttctaacatgaaataccatataaatatccttgtttggagtttgtttttccaggaaggagggcagatattaagtttgtatgttagactcaagaggggaaaaagttaa

SEQ ID NO: 6852284 - DNA, 68 bp, Homo sapiens
acagcagagggctgtccacctaccatgccggcggtgccctgccgagcggctctggacagcactgctgt

SEQ ID NO: 6852285 - DNA, 76 bp, Homo sapiens
ctattttgctttatgtaaatatgtatgtaggtaaatgaggaaaagtctggaagcatgtatactaaatgcagagtag

SEQ ID NO: 6852286 - DNA, 84 bp, Homo sapiens
gccccactcccaaagtgattttcttcttagttattgcctcattccacatacagtgattgatgagaaaggcataggagatttggc

SEQ ID NO: 6852287 - DNA, 82 bp, Homo sapiens
tatagtaccagattaatgaatgagaatataacagaggatttggacttctgttaagcccattctctttaaaataaggactatg

SEQ ID NO: 6852288 - DNA, 61 bp, Homo sapiens
gtctggaccctgggctgtgatttttggccaggaggacacagccacttagggtacctgtcac

SEQ ID NO: 6852289 - DNA, 56 bp, Homo sapiens
gcacccctagtccacaggttcctggaaggcgttccttctcctgtccactagagtgc

SEQ ID NO: 6852290 - DNA, 62 bp, Homo sapiens
cagatatattttccttattagggagaaggttactaattttctaatactgaaagtgacatctg

SEQ ID NO: 6852291 - DNA, 55 bp, Homo sapiens
ctggctccactccctgcctgacccctcctggggtctctgggataaactgggccag

SEQ ID NO: 6852292 - DNA, 64 bp, Homo sapiens
tacctgcgaaagagagcacttgtgaaatactaaagtacctgcagctttaagctttcatcaggta

SEQ ID NO: 6852293 - DNA, 127 bp, Homo sapiens
aagaagtgcagcttgaagtgggctaaaggcagtgtgtttattgggtattgtggagcctggagacctgtttttctcccaggtactcatttatagagaactgttcaagtcctgccattagtcatttctt

SEQ ID NO: 6852294 - DNA, 56 bp, Homo sapiens
tggctgagagtcatcctgtgtggggagaagcggggccacgcgtggactctcagtca

SEQ ID NO: 6852295 - DNA, 57 bp, Homo sapiens
tcaatgcataatggtttgtgacaaattttagcattttgctcttaccattatgtgtga

SEQ ID NO: 6852296 - DNA, 76 bp, Homo sapiens
ccttgtggtaggaagtgagctaaggagtttttagttttaaagtggaaggctgtgattactgtgcctgctcataagg

SEQ ID NO: 6852297 - DNA, 60 bp, Homo sapiens
acccaggacacagagatgacccatgagtcaaagatcaagagatcatctactggtccaggt

SEQ ID NO: 6852298 - DNA, 78 bp, Homo sapiens
agctcgtggtctgcacaccgccaggctgactcctgttcccaggcagtgggtgtgtgtggtgttcgcagggcactggct

SEQ ID NO: 6852299 - DNA, 99 bp, Homo sapiens
gcggcccggccgccggggcggaagagggacagcgccagcctgggctcctcctccggctggacgatctccccttcctcgatctccgagtcgccgggcggc

SEQ ID NO: 6852300 - DNA, 64 bp, Homo sapiens
caacctagtactcctagccctgaagggcaggggatgccacatcagcagcagaagtgctgggatg

SEQ ID NO: 6852301 - DNA, 60 bp, Homo sapiens
ggatcgctggcttgggagtcagacagatctgggtccaggtgtctgctaagctcagcttcc

SEQ ID NO: 6852302 - DNA, 78 bp, Homo sapiens
ttttgtataatctgttctactctattcagagccattttattttattgtgctcactcttggagtataatagagacaaag

SEQ ID NO: 6852303 - DNA, 66 bp, Homo sapiens
tcttaatgtacaatttttgcttagggggtttattttctctcccatggttaaaataatacattttgg

SEQ ID NO: 6852304 - DNA, 60 bp, Homo sapiens
gggatgcggggttccaggtagcagctgagaacacggctggtgcctcctccctgtgcttcc

SEQ ID NO: 6852305 - DNA, 55 bp, Homo sapiens
gttttagccgtttgcgtggaatgccaaactgtggacactgtgcagatgctagtgc

SEQ ID NO: 6852306 - DNA, 82 bp, Homo sapiens
tgttatgtacaggttagcaaaaatatctcatattactgtgtagttacttaaaaatttttgctttagggctgtgtacataata

SEQ ID NO: 6852307 - DNA, 62 bp, Homo sapiens
tgtttatttctttgttactgaggttatgtatctagacatgtttcataaagaggaaataaata

SEQ ID NO: 6852308 - DNA, 81 bp, Homo sapiens
gagcggccagccagataagcagcagccgttataggcttgagcctgataaaaaatgttgcttgaggccgggcatggtagctc

SEQ ID NO: 6852309 - DNA, 83 bp, Homo sapiens
tgattagcctaggtccttcgccacatattggtacattcaccccaggagtggaagtccctgtgtgtggccttctgaactggtca

SEQ ID NO: 6852310 - DNA, 91 bp, Homo sapiens
atcatggtcagaagaactgtaagaagcaggtcacagacagggcttgtggggcaagcctctctctttctgctctctgggttcctgtccaggt

SEQ ID NO: 6852311 - DNA, 58 bp, Homo sapiens
atggggagttccaggctctgatgtgagatctaactcccagagctgggaagctccctat

SEQ ID NO: 6852312 - DNA, 59 bp, Homo sapiens
cagtggtcagctgtccactgtggacagagcccctggtacacagtggaaattgatgtctg

SEQ ID NO: 6852313 - DNA, 75 bp, Homo sapiens
gtttcctctccaaggctggcctttgattatcttaatctgtgtcaaagctatttgttatgagagaaccaaggagat

SEQ ID NO: 6852314 - DNA, 76 bp, Homo sapiens
tgtgtgtgtgtgtgtgtatgtgttcatacatgtgtgtctgaaagcacatgtatgtttttgcagatacatgaatgta

SEQ ID NO: 6852315 - DNA, 67 bp, Homo sapiens
ctttccttttcatatgccccgcgtcagaattcttgttcctttatctgagtggcagggaaatggaaag

SEQ ID NO: 6852316 - DNA, 66 bp, Homo sapiens
gcattttcttttatgagcctgggagtcttattagtgaaagatttggcaaaagttagaagaaaatgt

SEQ ID NO: 6852317 - DNA, 78 bp, Homo sapiens
gatgctatggaaggagctaaggacctgggaccagaatgaaatcacattcttcctaccccagttagttgcttccacatc

SEQ ID NO: 6852318 - DNA, 72 bp, Homo sapiens
ggaaccttgagaggaacgtggtcatgcaacctgagtccggtggcatgcaggcgcaacttctacaagttttcc

SEQ ID NO: 6852319 - DNA, 66 bp, Homo sapiens
gtgagcttggaaggagaaacagacatgtgaatctctgcccctgcctttctccctttctaaggaagc

SEQ ID NO: 6852320 - DNA, 89 bp, Homo sapiens
tggtctaattccagctgaggatttaatgggactcattctgacaagatataggatattgtcccaatagatgctcatttggaaatgggcca

SEQ ID NO: 6852321 - DNA, 84 bp, Homo sapiens
ggagacaggaacaatacctcttgccagaagctgagttgcactgagttttgatgctctggtattgagttgttgcttcctctttcc

SEQ ID NO: 6852322 - DNA, 81 bp, Homo sapiens
ctttctaggagtctggagctctccagagccccgtccccagccctgggcagctgggagtgaagggcaccaggcccctgaaag

SEQ ID NO: 6852323 - DNA, 61 bp, Homo sapiens
gctgagagcagtgtggccttaaataatattccttagctgagaaataccactagctctctgc

SEQ ID NO: 6852324 - DNA, 86 bp, Homo sapiens
ggtgccttcccacccggcctctcccagcctgtgctccctcctgtgagcagctggtaggagtggccactgggtggcgtgtgggcacc

SEQ ID NO: 6852325 - DNA, 86 bp, Homo sapiens
tttggtctctttacatacttcttggaagttttgttcattgaagattttaattaggaaacaaagcttagcaggagaggagagccaga

SEQ ID NO: 6852326 - DNA, 59 bp, Homo sapiens
aaggcaagcattgggaacagggcggtggagcaactagcctaggtgaccctgcttggctt

SEQ ID NO: 6852327 - DNA, 67 bp, Homo sapiens
atgacatttaatccctaaatatttgagtgtgtgctttttaccaagtgttgtattgaatgaatgttat

SEQ ID NO: 6852328 - DNA, 87 bp, Homo sapiens
agagaggccacctgacgagcagtctataaagtatgttaaatgagaaaaacagaggttgggtgtgatgcttgtcaagatgggttctct

SEQ ID NO: 6852329 - DNA, 59 bp, Homo sapiens
gggtttcctgggttcaactgtggggaccccactccatacaagatcactccagaaaatcc

SEQ ID NO: 6852330 - DNA, 80 bp, Homo sapiens
gtttaaaactgagtctcccagcgttaaacctaatgagcacctgctaagagagagctgcgggaagactgagacatttagat

SEQ ID NO: 6852331 - DNA, 75 bp, Homo sapiens
ccagttacttcagtttctgcctctacccttcttcttgaaggactgaaatgtagaggcagaaactgaaggacctgg

SEQ ID NO: 6852332 - DNA, 57 bp, Homo sapiens
ccagactccagggctccatcccttgtcagcacagagaagctgggagcctggggatgg

SEQ ID NO: 6852333 - DNA, 58 bp, Homo sapiens
cagtctgcagctgtggtgggcttcagccatattgaatcctatataaccttggaggctg

SEQ ID NO: 6852334 - DNA, 82 bp, Homo sapiens
gctgttcatgggtttaattcagaggctgtatgactagatctttcctacctataagaggtcgcagcacttacctgatagcagc

SEQ ID NO: 6852335 - DNA, 99 bp, Homo sapiens
atattgaatgtttcactgttccgggaactattttaagcacttgatatggattatctcattaatgcttacagtgtcctgcgagctagaaacaattattat

SEQ ID NO: 6852336 - DNA, 82 bp, Homo sapiens
gtggctggggtatctgttctcctgagactgtgcctggcatgagcacaggtgctcctcggggagctggggatgtcccagctac

SEQ ID NO: 6852337 - DNA, 81 bp, Homo sapiens
gcattcacaggctctccaccatgaggcctcacacacacatctccaatcctgtgttcctccatggcaagggtctgtggatgt

SEQ ID NO: 6852338 - DNA, 70 bp, Homo sapiens
agttaaaaagcgcgctttcttgctaacttgcctttcttggttagtgccagagacgtgcactttataaact

SEQ ID NO: 6852339 - DNA, 61 bp, Homo sapiens
gggagctgttgattgtttgaggactatttgttgcataatctcctttcttttagcagcttct

SEQ ID NO: 6852340 - DNA, 96 bp, Homo sapiens
ggtgatcatatataatttattatccacactgggatgttttgagattaaatatatgttcttaataattacactgggataacagacttaagtgatgcc

SEQ ID NO: 6852341 - DNA, 56 bp, Homo sapiens
ctgctctctgcttccaagatggtgcctatcgctgtgtcttcaaaggcagtgggcag

SEQ ID NO: 6852342 - DNA, 67 bp, Homo sapiens
aacccagggaagtgtccagtcccaagttccagctttgcctggagccactttgcatctaccttgggtt

SEQ ID NO: 6852343 - DNA, 59 bp, Homo sapiens
aactggagtcctgagcattctggacccatgaagtctgcacatgttctatcctccaagtt

SEQ ID NO: 6852344 - DNA, 56 bp, Homo sapiens
tagcatggaatcgtttatgctctgggttttgatggctcagacttgattctatgcta

SEQ ID NO: 6852345 - DNA, 63 bp, Homo sapiens
gtggggccctagtactgggaaagagggctggctaggccacgtctgcctgtctggggtccccac

SEQ ID NO: 6852346 - DNA, 57 bp, Homo sapiens
agtttcataacctcaagctacagtcagtactttctagactctgtaggtaatgagact

SEQ ID NO: 6852347 - DNA, 58 bp, Homo sapiens
tatattcatattgttgtctctcactctgagaggtcctggagatatagttatgagtgtg

SEQ ID NO: 6852348 - DNA, 105 bp, Homo sapiens
actttagtgaagacttcatcctgcgcattcttattttaaaagttgattaatttttttagaattagcttcctatagtaaggggatggggtggagtaattgctttgt

SEQ ID NO: 6852349 - DNA, 70 bp, Homo sapiens
actagaatggaaagactggagagtgattttgtaattttaaaacattagatttgtttttctagcctctagt

SEQ ID NO: 6852350 - DNA, 55 bp, Homo sapiens
gagtggggtgcagtgacagggagtctggtgggagctctgaggctgagctctactt

SEQ ID NO: 6852351 - DNA, 55 bp, Homo sapiens
ctcctggaagcccgccctgctgccatcactggcccgaggaccccggctccaggag

SEQ ID NO: 6852352 - DNA, 69 bp, Homo sapiens
ctccctttggcagggcatcagacacgtggaccactttgggtttatctgtcgggagtcttccggaggtgg

SEQ ID NO: 6852353 - DNA, 77 bp, Homo sapiens
ggtgtgagagaatcaattgaagtggaactgaagaacagccttctagatagtaaacatgtaattgttcatttcacatt

SEQ ID NO: 6852354 - DNA, 118 bp, Homo sapiens
ctgttgttaaattgcaggtcatgttggtgagtctggggcacacacacacagcctgtctattccactgcgggacttgttctgccagcacttctcagctttgacctgctaagtgattcag

SEQ ID NO: 6852355 - DNA, 91 bp, Homo sapiens
tcagcctctatgatctgtattttgtattgttgtattcattatcacaggagttgaaacctcaggccagtgggaaatagggatatggaactga

SEQ ID NO: 6852356 - DNA, 56 bp, Homo sapiens
tcgcagcactagccctgcattgctaatgcacagagctgttgggactattgctgggg

SEQ ID NO: 6852357 - DNA, 97 bp, Homo sapiens
tagagattgtctgttcaccggggaaaggggcccagtgactgacgatggaccagctggaatgcagtcagcttggctcctcccatgaaccacagctctg

SEQ ID NO: 6852358 - DNA, 88 bp, Homo sapiens
ggagtcttgctctgtcgcccaggctggagtgcagtggcgcaatctccgctcactgcaagctctgccacctgggttcacaccattctcc

SEQ ID NO: 6852359 - DNA, 60 bp, Homo sapiens
tgctaattgtgccttaaactgcataatttatataaccatgtagagtacagcacaacagca

SEQ ID NO: 6852360 - DNA, 59 bp, Homo sapiens
ctgtttagaattctaactttaaggagaaaagctctttttggtgttggttctgatcccag

SEQ ID NO: 6852361 - DNA, 58 bp, Homo sapiens
tctgcttctcctacttcatgggccaatgtttctgagacacacagtgggaggagaaaga

SEQ ID NO: 6852362 - DNA, 80 bp, Homo sapiens
agccttccataacatacttgtactatgcatatttaatcatcttataatacgcttagtagaggaatgtgccttggaaatct

SEQ ID NO: 6852363 - DNA, 99 bp, Homo sapiens
gaggcaggagaatcgcttgaacctggaaggcagaggttgcagtgagccaagattgtgccattgtactccagcctgggtgacagagcgagactccatctc

SEQ ID NO: 6852364 - DNA, 67 bp, Homo sapiens
gggatgaggcaagccagaggactggtggacagagaactttcgtcttctgaatattgtcttatttccc

SEQ ID NO: 6852365 - DNA, 126 bp, Homo sapiens
gccctgcttactggagttgcggggtagggtctggtctcccactgtcctgctcagccattctctgggccctctgaggctggatgggatgcctccccaccccgtcattgtcctgttctgagtcagggt

SEQ ID NO: 6852366 - DNA, 61 bp, Homo sapiens
gttaagggctctgtgcttgtcccatgtgttaacatcctatgggccaagcaagacccatgac

SEQ ID NO: 6852367 - DNA, 64 bp, Homo sapiens
tttctgtaaagaccaagccagctgttctctgccagcctataattggccattgagtctatagaaa

SEQ ID NO: 6852368 - DNA, 61 bp, Homo sapiens
tctttccatgatagactggtgctttttaaggaatatctcaagtgccagtaggtatggagga

SEQ ID NO: 6852369 - DNA, 56 bp, Homo sapiens
tggttttaatgttctagctcatctcattacccagtgaaggtgaaagattgaagcca

SEQ ID NO: 6852370 - DNA, 63 bp, Homo sapiens
cctgctatatctggactttatcaggcaatgagctaatcagccaaagagacacaggtaagtagg

SEQ ID NO: 6852371 - DNA, 63 bp, Homo sapiens
tgtgagctttctgctctcctgtagatgtcgggagtgaatacaaggagatggagaagctgcaca

SEQ ID NO: 6852372 - DNA, 71 bp, Homo sapiens
gtacaaccatttctttcaaagccctagggaggcacaggagcatccaggaggtttggaggaagcaaaagtat

SEQ ID NO: 6852373 - DNA, 55 bp, Homo sapiens
ggctgaggcagatatttattgggttgtctcccaaaacagtgattatctcttctcc

SEQ ID NO: 6852374 - DNA, 66 bp, Homo sapiens
ggtgttccagcctcttcccctcaggttgaagccaactacagacctgctgaggagggggaattaacc

SEQ ID NO: 6852375 - DNA, 66 bp, Homo sapiens
ccaggtctggaccatgtggctttcatctagacaatggagaagcactacgataggtggtcctcctgg

SEQ ID NO: 6852376 - DNA, 78 bp, Homo sapiens
gtggttctcttcctcctgactgagagctctagccttcacatccgtgttccagtcagcaggatggaggaagagaaatgc

SEQ ID NO: 6852377 - DNA, 70 bp, Homo sapiens
ggtttggaggattagctctgcctgaaatctgtaggagaaagtggatacaggagaggttaatgtccatgct

SEQ ID NO: 6852378 - DNA, 71 bp, Homo sapiens
ttctgtgtttctgtaagtggcaaataatggcaggacctctgcacatttagcagactgtatagaaattagaa

SEQ ID NO: 6852379 - DNA, 56 bp, Homo sapiens
ggtcaggtccagtaaaaagagtcctccggtggaggagggtgaggctggagtttgct

SEQ ID NO: 6852380 - DNA, 128 bp, Homo sapiens
ggccaggcccaagggattgtgaaagagctccgtcctttatttactggatggccttgggcacctcacttcatttctctgaaccccaatgtcatgtctgtgaaacgaggactcatagtctccacccggcc

SEQ ID NO: 6852381 - DNA, 90 bp, Homo sapiens
atatagatgaaataagaaggtagaaataattattggagctgggttatgagtaaataatggtttttctatactgtcctattttatttgtat

SEQ ID NO: 6852382 - DNA, 57 bp, Homo sapiens
ctgttaaaagaacaactcggaggtaattggatttgcccctgaaactgcttttgccag

SEQ ID NO: 6852383 - DNA, 62 bp, Homo sapiens
ggggtgacagcagctaatgacagctgcctttactgtacccaggccctgtgctgtgttaccct

SEQ ID NO: 6852384 - DNA, 68 bp, Homo sapiens
ggcccccacagaagaaagctacacatagagtggaaatcctgtgtttactggctcctgtggttcaggcc

SEQ ID NO: 6852385 - DNA, 63 bp, Homo sapiens
ggctcccagggtctaggctgctggcacctggcccaagatggtccctacagctctcctggtgct

SEQ ID NO: 6852386 - DNA, 71 bp, Homo sapiens
agaaagggaatggagtggaaaagtactgcagaaacctttcctttcttcacactttggaattccacctttct

SEQ ID NO: 6852387 - DNA, 99 bp, Homo sapiens
ataagactgaaacattgtctaacttagggaatactttagtgtatgttggatgaatatgtttaaatgattctcagatttggacaggtaaatcatttttat

SEQ ID NO: 6852388 - DNA, 69 bp, Homo sapiens
ttcaaaccaacctcttctttttccaaagcgcatagctttctgggatgtgaatggtttaaaaggtttgag

SEQ ID NO: 6852389 - DNA, 55 bp, Homo sapiens
agggccactttgaggtgaaatggcttttttacatactcagcatcaatttggtcct

SEQ ID NO: 6852390 - DNA, 62 bp, Homo sapiens
catccgtatttccatgttgtataattttccttaacatttcttatagtgtggatatgctgatg

SEQ ID NO: 6852391 - DNA, 79 bp, Homo sapiens
gtgccctggtgattctgatgtgcactgaagtttggggacccaggctcgtgtccagtatagaaagctttaccaaggccac

SEQ ID NO: 6852392 - DNA, 67 bp, Homo sapiens
tgccaacgagggctctaccaagtaactctggcattttctgccagggatggtcagagtcctcggagca

SEQ ID NO: 6852393 - DNA, 81 bp, Homo sapiens
tagggtggtcaggctggggtggaggagctcccctggaatgttccagagcttcccccactcctgccgttctgagtcaccctg

SEQ ID NO: 6852394 - DNA, 91 bp, Homo sapiens
gttttatccatgttcattactttttttgtgtctacatagagggaaaactggtaaatgtgtcaagagtaatgagccaatggtcatatgaaac

SEQ ID NO: 6852395 - DNA, 106 bp, Homo sapiens
ctctgcaatgtgtcaggagattcatcagtgtccttatcacttatgttttctcatattggttataagtcagggtcattgtgattttttcagacagcgtatgaaaggg

SEQ ID NO: 6852396 - DNA, 128 bp, Homo sapiens
ttcctcttcctttttcttggtggtccacagtgactgcttgagaaggaacaaattgctttcacttctgtcatttccactttctcaagtcttcttctgttaccactataacttcctgaaaatgagtagaa

SEQ ID NO: 6852397 - DNA, 77 bp, Homo sapiens
gaccttgattttctcttatgggatagagaggggtgggaatggcacacccatcccttcctcataggcagaagggggtc

SEQ ID NO: 6852398 - DNA, 103 bp, Homo sapiens
gttcagtaacatttatacattcccagcattaatgcctgtcagggctgaaattccacttaccaaaccataggctaaatgtgggaagaaaatgtttctaaagaac

SEQ ID NO: 6852399 - DNA, 82 bp, Homo sapiens
cttccagtccaggattcctagcaaactcttggagggcttataactcatctgctccaacagttttgggaatgtgggctagagg

SEQ ID NO: 6852400 - DNA, 101 bp, Homo sapiens
cctggacgggaggctcgccgtctcccatgcaggtgcccgatgcctgtgtgtgcccaggcacagggcagagggtccgtggcgagcggcagcaccttgtcagg

SEQ ID NO: 6852401 - DNA, 67 bp, Homo sapiens
atggaataagaatggtctacctgagttctgaggctcagcaattaatggccattttcactcattccat

SEQ ID NO: 6852402 - DNA, 72 bp, Homo sapiens
tcctaaagacaatgcattgtgattgtgaccagaaggaaacttaagtccaagtcctcagtgaattatctggga

SEQ ID NO: 6852403 - DNA, 83 bp, Homo sapiens
tgtatgtgggctagctgactgtagtgggaacatggactcactgaattatgggagttccctgcagtaggcagccctccattgca

SEQ ID NO: 6852404 - DNA, 83 bp, Homo sapiens
gatgatgtggaagcactcattctgacctgaatagacttggtatatataccatgtgtggaagttagagatgtttcctcctcatt

SEQ ID NO: 6852405 - DNA, 68 bp, Homo sapiens
cctccctgggtgctgggattgcaggcgtgagccaccgcgcccccggtccaatttagtaaccagaaagg

SEQ ID NO: 6852406 - DNA, 71 bp, Homo sapiens
ctccaggactgaggacagagctgctcttcttcttctacgttactgtggccctcttgtctggcagcctggag

SEQ ID NO: 6852407 - DNA, 69 bp, Homo sapiens
tggtcagaatgtgcttctggctgtggtcatagacgggtgtgagtcagccccaggagacatactttgcca

SEQ ID NO: 6852408 - DNA, 67 bp, Homo sapiens
taggaggtttgtcttttttgtgttggttcaaaagagttctttatatattagggagattagccctcta

SEQ ID NO: 6852409 - DNA, 85 bp, Homo sapiens
catcagaaacctggacaggaagaattgggagcctgatccaatgtagcaagacccattaggctctgatctgtgccaggtttgtgtg

SEQ ID NO: 6852410 - DNA, 90 bp, Homo sapiens
ggactccctaatctgctgagcccatcttgattgtatttctgctgccctttcacagtccctagtggagctcacagtccctagtggttttcc

SEQ ID NO: 6852411 - DNA, 93 bp, Homo sapiens
aactaactcctctccctgcctgctctatccaggcctgcttaccttggcccctggagcctcccagagcagaggctgggacttggacaattagtt

SEQ ID NO: 6852412 - DNA, 79 bp, Homo sapiens
cctccatagaaagagctggtccattggcactgctcagaaggcctgagtcagcagaatcggaaccaggtcttggtagagg

SEQ ID NO: 6852413 - DNA, 57 bp, Homo sapiens
agagtctgctccagatgtgtcctttattccagaatccaggctgaaggagcagatttt

SEQ ID NO: 6852414 - DNA, 61 bp, Homo sapiens
ggcaggcggtggggcagagctgggcagtttctgaaagccctgctgtgcctgactgccatcc

SEQ ID NO: 6852415 - DNA, 58 bp, Homo sapiens
gctctggtgagtgtagttcaggaatgctgacagccctaagcatcttcacttattaggc

SEQ ID NO: 6852416 - DNA, 76 bp, Homo sapiens
gagatgataaagccttgtgctcatgtcctttcactgcatcgctgggtgtcaatggaggtgacatgagtgttttctc

SEQ ID NO: 6852417 - DNA, 60 bp, Homo sapiens
ggcgccaggcttcactttaaagatggggaagctgagtctcagggaagtggggtctgtgcc

SEQ ID NO: 6852418 - DNA, 78 bp, Homo sapiens
gaatgtgagatcgtgagaacacacagctggttggcaagcagcatcaaccagctctttcttttcactatattacatatc

SEQ ID NO: 6852419 - DNA, 64 bp, Homo sapiens
tctgcaggcttggagtggcagccttttaatggttttgctcaagcccggctcccgtgcctgcaga

SEQ ID NO: 6852420 - DNA, 76 bp, Homo sapiens
gaaatatcagtttgtgtgtgtacgtgtggtttatatcagaaggatgtctcccatacacacaccaaatttgtatttc

SEQ ID NO: 6852421 - DNA, 64 bp, Homo sapiens
aagatcaagatttaggttgaggatcagaaagttcccttttagcctcaagtccaaatcagatttt

SEQ ID NO: 6852422 - DNA, 73 bp, Homo sapiens
gcaggacagacccaagcagtctggtttcatagcacagcttcctaaccaccgcactgttttgcgttttgtctgt

SEQ ID NO: 6852423 - DNA, 76 bp, Homo sapiens
cagggaatattgatggaggtgttagacagataattctacaaactaacatgtctcatcctaaacaataaaatccctg

SEQ ID NO: 6852424 - DNA, 86 bp, Homo sapiens
attttgttcagtgatggttcggtgacacctttagacatttacgatcctaaggattattctgttactgtctcatcattggatgaaat

SEQ ID NO: 6852425 - DNA, 55 bp, Homo sapiens
agaggaatgcagccaacccttccagggacaagaaggacttggctctattgcctct

SEQ ID NO: 6852426 - DNA, 74 bp, Homo sapiens
taaacgtgcagagatcaatagcattttgtctgttaaggatcagaatttgcttctgtttgtttctgtcatgttta

SEQ ID NO: 6852427 - DNA, 58 bp, Homo sapiens
taatacagagcactgacctatgggggagaaaagcctaaattttagtgtatctgttttg

SEQ ID NO: 6852428 - DNA, 72 bp, Homo sapiens
tagaaatcaaattcagttatggaaataaaaagataattgtcttttattttgcaaacctgagtttgaggtcta

SEQ ID NO: 6852429 - DNA, 75 bp, Homo sapiens
gggcgcgcaaggggcgagtctgtccagccggcagcaccccaggccggatggacgcttgttcctggttctgtgccc

SEQ ID NO: 6852430 - DNA, 70 bp, Homo sapiens
tgcatgtgtgacaaggacagttttccaaacaatagtccttgaagagaaaatttactccttggaatgtgca

SEQ ID NO: 6852431 - DNA, 102 bp, Homo sapiens
ggtaggcatttacacatcagatgacactagttcaacttaatttctatttttaaattttgtaggaaacaaagtaatgcaactcaggttctgtgaaagctgacc

SEQ ID NO: 6852432 - DNA, 82 bp, Homo sapiens
tcccaagccagggagccagagatggaggaggaggtggaagagtccgggctgcctctgtagctttggaccctaggcagaggga

SEQ ID NO: 6852433 - DNA, 68 bp, Homo sapiens
tcagattaatgcagagcattgtttttggcaagttgttgaaaacagctacttctgtataatgatgctga

SEQ ID NO: 6852434 - DNA, 78 bp, Homo sapiens
tccgcgccgacttctccgacaaccgacgccggggcttcgaggagcagaggtaccggcgaccgctgtcggaggcgcgga

SEQ ID NO: 6852435 - DNA, 123 bp, Homo sapiens
tgaagataccaaagcattcttataaagaaaggcacggtgttgcctgttgttaggagatgactgctgacaaaggaacaatactctcttctcttctccttgagattctgctcgtctgagtcttca

SEQ ID NO: 6852436 - DNA, 88 bp, Homo sapiens
tcccctgtgctccttctgggacttgggctgagggccagcagctgtcagggcgtgctgttctcaggctcgattaccagggtacaaggga

SEQ ID NO: 6852437 - DNA, 80 bp, Homo sapiens
agtttattacagtaacgtgagagcatctaactgaaggctaattttatttggatttagcttatcaacgtagctgtcaaact

SEQ ID NO: 6852438 - DNA, 90 bp, Homo sapiens
cactctatcttcccatcacatttgcaattgcattgtttgaattgtattgtttgaatatgtatttgtacatgtgtttgtgattattgattg

SEQ ID NO: 6852439 - DNA, 68 bp, Homo sapiens
gccaaaatcgcatcaacagatgggtgactgtcaattagccatttgttaaccagtgtggatttcttggc

SEQ ID NO: 6852440 - DNA, 78 bp, Homo sapiens
atgtcacttattttctaaccaaaggaaactaaatcaaaactgtaaccttcaggtagaggagatgagtaattaagatat

SEQ ID NO: 6852441 - DNA, 65 bp, Homo sapiens
ctggtcttgtttcttaaactatgtgctagaggaattaaggtatatttataagcaagcaggactgg

SEQ ID NO: 6852442 - DNA, 82 bp, Homo sapiens
tgttaaaatgcagactccagggctccaccccagattgagtcagaatctgaagaggtaaggccctggacacagcattttaaca

SEQ ID NO: 6852443 - DNA, 74 bp, Homo sapiens
ggaggtattggtgcttctcaagctcgcacattgaggaagacccttctcttgtgaggagaggcccagctccctcc

SEQ ID NO: 6852444 - DNA, 77 bp, Homo sapiens
ggaagaagagtgggcactgtgtgtggtaaaataggaagttttgtttatttttccagacagggctcactctatcaccc

SEQ ID NO: 6852445 - DNA, 57 bp, Homo sapiens
ttattattttgtgtacagcaaagtcacagttaaaggaaaatgtgcatagaataatga

SEQ ID NO: 6852446 - DNA, 56 bp, Homo sapiens
atgcagttggtcatactacataccccatggttgcagttttgacagaccaaatgcat

SEQ ID NO: 6852447 - DNA, 58 bp, Homo sapiens
ggctccaggaacctcctctcctgttggttaagagccaggagtgcaggcttttggagcc

SEQ ID NO: 6852448 - DNA, 112 bp, Homo sapiens
ttcacagatacagaaactgaggcctgcattgctcaggtcacctagctaataagagctgaaggtgggtgaaatctaggtgtgtgtggctcctcggtggactgccatctctgga

SEQ ID NO: 6852449 - DNA, 62 bp, Homo sapiens
cctgttcctcctaccccaggccccacctaggtgctggggaggcctgggcaagggggtctggg

SEQ ID NO: 6852450 - DNA, 62 bp, Homo sapiens
agaccccgatgactccagtttataaccctggattcccaggggtgctcagagccatgggggct

SEQ ID NO: 6852451 - DNA, 67 bp, Homo sapiens
actgagtaagaagctgtttggatttttcatggtcatcaaatccccagacagttccttgaggttcagt

SEQ ID NO: 6852452 - DNA, 55 bp, Homo sapiens
taggacagcatgagagtagcaaaaggagtccttgctgaaactcttagtagttgta

SEQ ID NO: 6852453 - DNA, 74 bp, Homo sapiens
aggggtattacttattgactctgaattaagacttggctgagtgtcaagtttccactggcagtccgtagacccct

SEQ ID NO: 6852454 - DNA, 83 bp, Homo sapiens
ctttggatcgtgcctcagtcattggcctacactttaccttttcctgaggcgtagatgattgaagcaagagtagagatccagag

SEQ ID NO: 6852455 - DNA, 78 bp, Homo sapiens
gtacatttctcttgttcttattatgtaagtctgtctttaaggaatggtgggcaatcttaagagcaaaagaagttgtat

SEQ ID NO: 6852456 - DNA, 71 bp, Homo sapiens
atgtcttagtatgttgtcacactgggtagaactggaatgcaacacccatagtcattacagtgctaagatgt

SEQ ID NO: 6852457 - DNA, 64 bp, Homo sapiens
gggtaggatggtagaagggacctgatgtaaaggaaggtagtaggtttcttttactctctaattc

SEQ ID NO: 6852458 - DNA, 64 bp, Homo sapiens
ggtggagagcaggctagagggaggctggcgagatgggccaggtcaccatggcatgctccacact

SEQ ID NO: 6852459 - DNA, 76 bp, Homo sapiens
gctgggaaaaagaattcagtgatatttctcctatttgcttttgaaagaagagaaatatggctcagttccacccggc

SEQ ID NO: 6852460 - DNA, 59 bp, Homo sapiens
tccctgtattcgaaagtgatcgtgggctgcctttgccctggtcattgatagtgcaggga

SEQ ID NO: 6852461 - DNA, 100 bp, Homo sapiens
gtacttttcaaaaacataaaatgttcaccctttagaaggcatctcagtttttaaaaaactggcagccacaactggcaggggagattttagtaataggtac

SEQ ID NO: 6852462 - DNA, 64 bp, Homo sapiens
gccacggccttgggtggccactgctgggtggatcccactggacagtggcacccacgggctgggc

SEQ ID NO: 6852463 - DNA, 67 bp, Homo sapiens
ttcagaaggatgacaccagttgaacgcagagttaactttctgaagccagcttgtctcctcagctgag

SEQ ID NO: 6852464 - DNA, 86 bp, Homo sapiens
atgtgaatgtatgtatctgtgtataggtgtgtaaccaaaatgggaccatattatacatgctatacatgctggcctgcaatttatat

SEQ ID NO: 6852465 - DNA, 66 bp, Homo sapiens
tctctattttctctcttggaagctcagggaaagtgattctgatctggaccttggaggaaaaggaga

SEQ ID NO: 6852466 - DNA, 66 bp, Homo sapiens
ctgaaggagctcaggagatagtcaccagtagcatggaggctgagatctgtctcagagctcttctag

SEQ ID NO: 6852467 - DNA, 82 bp, Homo sapiens
cctctaggcaagttcgaagtggctgggaaggcctatctggaagaagataaatccaaggcggccatcattcagctgacggagg

SEQ ID NO: 6852468 - DNA, 95 bp, Homo sapiens
agaagcctctttttcatgtccagggacagcgggactctgacagctgagagctggtgggcggctgtctcagttcccttctctggacaagagcttct

SEQ ID NO: 6852469 - DNA, 129 bp, Homo sapiens
ttgaacccgggcagtctaactccagtgtccatattcctaaccactgtgccaaataatgccttctatattaaggaggcactgcagtacagtgactagcatgtaactggaatgtattagataactcatcaa

SEQ ID NO: 6852470 - DNA, 97 bp, Homo sapiens
tcatgttcacttgaatctgtcatgttgtattatgttattgtcttctaatccaaaataaatgaatgcaatgaaattgagcatgacacaagggaagaga

SEQ ID NO: 6852471 - DNA, 62 bp, Homo sapiens
ccagacttgacttattccagggcctcactcctgttacatattctggagtctaggagtactgg

SEQ ID NO: 6852472 - DNA, 111 bp, Homo sapiens
agctgccggaggccacacagcatgtctgaggcatacccaggccccctaatcagtttctctctcctgcaggggacaggcaaaggtatgcttcagtcatgaactcaagcagtt

SEQ ID NO: 6852473 - DNA, 66 bp, Homo sapiens
atcctgtgccacgtcgcttcttctcttctgattgtagcagtgatgaggttttgattggcacaggat

SEQ ID NO: 6852474 - DNA, 59 bp, Homo sapiens
gggagctgatgatgtaagtcccaggccaagggcaggaaaagaccaatgtctcagctctc

SEQ ID NO: 6852475 - DNA, 59 bp, Homo sapiens
gccttccggagccaaatggcaggcggaagacagcagccaggcatgggcttctgggcggt

SEQ ID NO: 6852476 - DNA, 101 bp, Homo sapiens
gccctactacagacaaaaatcactgtgtcctttgtgtatctatagtagtttgaatttccagatacagtgcatagaggcatgatactttggtcttctggggc

SEQ ID NO: 6852477 - DNA, 82 bp, Homo sapiens
gggccgcctgctgggggcgtaggccgacttgatgtccagagagaaggagggcttgaggcggctggtgtcctgcaggtggtcc

SEQ ID NO: 6852478 - DNA, 56 bp, Homo sapiens
tggcttctgctttcagtggaggcattgagaagctgacaagctgagtgcagatgtta

SEQ ID NO: 6852479 - DNA, 57 bp, Homo sapiens
aggctgtccaaggtggcgaagtcagtggcaagactgggtcatgaactcagggcacct

SEQ ID NO: 6852480 - DNA, 55 bp, Homo sapiens
attcacacacagcttcctattgtctatgctaatggaggtaaaggctggtgtgaat

SEQ ID NO: 6852481 - DNA, 91 bp, Homo sapiens
ttccatgtcagacatccagacattgaagtatttttgtcgataaagtgtcaaggaaattgaccaaagtgttcagtttgcggatgatatggaa

SEQ ID NO: 6852482 - DNA, 63 bp, Homo sapiens
ctgtcctgcaaatgtgttttaaaccaaagaaatcatctttggcatgggctatttgctttatag

SEQ ID NO: 6852483 - DNA, 55 bp, Homo sapiens
ggccaggaggcaatatcaagtccacacatgtctgtggagcagaacctctttggcc

SEQ ID NO: 6852484 - DNA, 66 bp, Homo sapiens
tcctggtacttgtcccctcccgtggcctggatccagtgataccaaggcttgtgggggcaactcgga

SEQ ID NO: 6852485 - DNA, 62 bp, Homo sapiens
ttctcaaaggtattttagctcacagctatgagctgtggtttttaatgtacctttgttgggaa

SEQ ID NO: 6852486 - DNA, 72 bp, Homo sapiens
ttctttcactcaagaaatgtttactgagcatcatttatgtgcctgtgcttggtgtcatttccattgaaaggg

SEQ ID NO: 6852487 - DNA, 98 bp, Homo sapiens
ggtgagggcacagttggaggtggggtccatgtattcatagtggcaccagcaccagtctgtgtgaatgtgggctttttcctctgtttgcagctgtcacc

SEQ ID NO: 6852488 - DNA, 95 bp, Homo sapiens
ggcaggtcactcgtggcatgagtggttctaattagatcagcgagacatggagcaaggctctttgctgagctggttgttcaacatgagtggtcacc

SEQ ID NO: 6852489 - DNA, 61 bp, Homo sapiens
gttccttagctgtccctggaaatagatttaatctcatctactttcacatgagcaaagggat

SEQ ID NO: 6852490 - DNA, 57 bp, Homo sapiens
ctttctcaatgccggaaggcacgtcattgcatcatgatgccttctagggttggaaag

SEQ ID NO: 6852491 - DNA, 72 bp, Homo sapiens
aacacactttgaaggctttagatctttgtagctgaaatttgcaacagatatcctcagtctccaacagttgtt

SEQ ID NO: 6852492 - DNA, 91 bp, Homo sapiens
ctctctcactttctcacttttcaatccccagcagatttccatacccacaaagacatctgtacagatatcaggagtgaggaccgagcctgag

SEQ ID NO: 6852493 - DNA, 64 bp, Homo sapiens
agctaatgatgagatacagatagtatatgcaccatgaaaatgtttgtgtcttatccatgagact

SEQ ID NO: 6852494 - DNA, 84 bp, Homo sapiens
atggcaatgcaggtttatttcactctccggatactgtcacaaaaatctggttgtgggtgggatggggaaaaaaccaaaggccat

SEQ ID NO: 6852495 - DNA, 70 bp, Homo sapiens
ctcagaaaaccagaggcagcagtacctgagggcctccaacttgacctttcctcctcctgcttctactgag

SEQ ID NO: 6852496 - DNA, 71 bp, Homo sapiens
tctctaaacctttccaaaatgaatctaatgcaggattgtcctgcatggatctttctggaagaaaatggaga

SEQ ID NO: 6852497 - DNA, 57 bp, Homo sapiens
gtccagccaggcctgtctctgggaaggggtttgagagctttgggccactggctggat

SEQ ID NO: 6852498 - DNA, 73 bp, Homo sapiens
tagtttggtgcataagtaattgcagcaatttgccaataatggcaaaacccgcaattacttttgcactagccta

SEQ ID NO: 6852499 - DNA, 81 bp, Homo sapiens
gtatattctggaatgggagtcagacagagaaatgtgatcacctcaccaggctttagtctgctctcactcgcagaagaagac

SEQ ID NO: 6852500 - DNA, 65 bp, Homo sapiens
ctagcaatatgctaccttaaatgttgattgaattcatcagtatatttatggataggtactgctag

SEQ ID NO: 6852501 - DNA, 74 bp, Homo sapiens
gtcatggaaatacacaagaggtttccattcttggtcagtctgagtttggggtttgatctggtgtgtttttagat

SEQ ID NO: 6852502 - DNA, 61 bp, Homo sapiens
cagtggcttacaatgaactagagaggggccttgtcctggtctactccacctgtgagccctg

SEQ ID NO: 6852503 - DNA, 130 bp, Homo sapiens
cattatctatctgttgctgaaacctctgtgtttcccacaccccaccagtaactgagggtcttcccagtccctctgtgtgctgctggggagggctcggcagagagggaagcaagagttaaaatggatattg

SEQ ID NO: 6852504 - DNA, 81 bp, Homo sapiens
gttgaggaggactatcggacttagtgttttgctgtagacacagtactgagtactgagttggattaagagtgctgccccaac

SEQ ID NO: 6852505 - DNA, 81 bp, Homo sapiens
ggcaattatttattgagcacctacagtattaccaagcacacatctaggttctgtgtctggtgcacaaaacaaatttttgcc

SEQ ID NO: 6852506 - DNA, 84 bp, Homo sapiens
ggatagggaaaggcaggaagatgagctcaggtaaactccaagtttgtttggtcaaattatctcctcctgtgcctcgttttattc

SEQ ID NO: 6852507 - DNA, 100 bp, Homo sapiens
gaaattcccaggaagtctccctcctaaaacatgtagcagtttttcattatccagagtgatcattctgaaattgctttagggggaaagacgtgggaacttc

SEQ ID NO: 6852508 - DNA, 76 bp, Homo sapiens
ggaggctacttggtggacaggattgagagctgccttggagaggcctgagtcagatctgtttgccagatcagcctcc

SEQ ID NO: 6852509 - DNA, 61 bp, Homo sapiens
atggatcttccctcatttctgaggttaaaatactttttaataaatgatgggaataatctat

SEQ ID NO: 6852510 - DNA, 59 bp, Homo sapiens
gaagttacaggcttatgggggcccactggaaagggaaaatcaaaaggcctgtggatttc

SEQ ID NO: 6852511 - DNA, 101 bp, Homo sapiens
ctgcggaactgcacggtgccagtgcctgccttttattttgttatttacatagagcaaatgcgtagtgtacacggcccttgcaaacaagcaccaatctgcag

SEQ ID NO: 6852512 - DNA, 59 bp, Homo sapiens
gtaaatagatggttactgagtgtctcccctactccttcacccagtaactatgttgttac

SEQ ID NO: 6852513 - DNA, 55 bp, Homo sapiens
tttaccaaatagattatgtcagctgttcagtagtcagcttgatattattggtaaa

SEQ ID NO: 6852514 - DNA, 56 bp, Homo sapiens
gactattttataaactagtgaatcagtctaactagattgctggtaggtgaatagtc

SEQ ID NO: 6852515 - DNA, 106 bp, Homo sapiens
ttgatttgatgatttgggttaatataatgaggatttgcatattaggctagcattcctattttaatttaagtgaaagtcttcattatttccccagacaccaactcag

SEQ ID NO: 6852516 - DNA, 57 bp, Homo sapiens
gaacttgggagaagggagtgtgtcgatgagccggccttgctccctataccacagttc

SEQ ID NO: 6852517 - DNA, 69 bp, Homo sapiens
ttaactttgagaagcaatttccaactgtgctgtgttcagcggttgagcgtgtttactcccctaagttag

SEQ ID NO: 6852518 - DNA, 65 bp, Homo sapiens
cctgccctgccccaggcggcttcactcacctggacttgaggggctgtagagggagcagggtcagg

SEQ ID NO: 6852519 - DNA, 70 bp, Homo sapiens
ctgggctatgtaggagtggagttttcaacacacaattttcaaatgggtaattgcactaagcatagtccag

SEQ ID NO: 6852520 - DNA, 56 bp, Homo sapiens
ggtccttcatatcatggattatattcctgtgcatattttccagtttgtcaaggatc

SEQ ID NO: 6852521 - DNA, 60 bp, Homo sapiens
aggactgtctgagactttcatttgttctgtgcaacatataagtcaatacagataagtctt

SEQ ID NO: 6852522 - DNA, 60 bp, Homo sapiens
gggcccggcgcaaggggtggctgggaaggggcgctcagtgtccacccctttgctgggccc

SEQ ID NO: 6852523 - DNA, 69 bp, Homo sapiens
ttctatcttgtgtgaaggctctccattctctaatcagctgtggtgtcctgcccttatgcagtgatggga

SEQ ID NO: 6852524 - DNA, 101 bp, Homo sapiens
tagcttacctggatggtgttgcttgtttttgtcttacagatcccctatgcagcaagtttgatcaggaaagaaaagcttggcgcccatctcagcaaaagcta

SEQ ID NO: 6852525 - DNA, 61 bp, Homo sapiens
gtctaaaaccctagaggatgaatgacatcctttatgatatctgtcacctgtagggtaggat

SEQ ID NO: 6852526 - DNA, 128 bp, Homo sapiens
gctttggcatggccatccatccttcttatgccttttctgcccaggagcatgctggtccagccaactgagaaatggattaacagctcctgggtggtgagagaaaaagctgctggccacctgccacttgc

SEQ ID NO: 6852527 - DNA, 119 bp, Homo sapiens
cagacccatctgctgggtttgttgcagtacagattgccgggcctcgagagaatctgatttggcaggtctacagtggggtctgagtatctgcatttctaacaagtttcccggagatgctg

SEQ ID NO: 6852528 - DNA, 78 bp, Homo sapiens
tttctgaactgtgggtaatatattagacgtagaaaagtacatcatgttatgtgtgaaagagtcttatagtttcagaga

SEQ ID NO: 6852529 - DNA, 64 bp, Homo sapiens
tccacatcacaggtccctcagatatgaccagagacctcctcaagtctgagacttgtagtgtgga

SEQ ID NO: 6852530 - DNA, 100 bp, Homo sapiens
ggagaacatagagcaaagaacatgaaaactacctgtgattttacaacccagtgtaatcgcttggtaattttaaaagtgtttttttaacctatttatctcc

SEQ ID NO: 6852531 - DNA, 96 bp, Homo sapiens
ctctagtggcttttctggaaggctctgctgcctgtctggtgccagtcttctgtcttggactgggcaacagggcctcccagaacttttctactaggg

SEQ ID NO: 6852532 - DNA, 86 bp, Homo sapiens
cacctcttctgcccatttcagcagcccatgtttggatttttaggccctactggattccaaacagtcaccatgggaagagtggggtg

SEQ ID NO: 6852533 - DNA, 67 bp, Homo sapiens
tcagattctgcaaccttggtggctaggaactagtttatgactgtgcccaaaggctctggagatttga

SEQ ID NO: 6852534 - DNA, 55 bp, Homo sapiens
tgctttcagccagtgtctggatgctaaaaatcagactgactagtcaatgaaagcg

SEQ ID NO: 6852535 - DNA, 58 bp, Homo sapiens
ttaaggtatagcttgcatacagaaaagttaactcttttcagtgtatagctaattttga

SEQ ID NO: 6852536 - DNA, 80 bp, Homo sapiens
accttctatggttttatatttctggtagccttcaggatcttggtgtttattcctgattgttttgtgtgacacctagtggt

SEQ ID NO: 6852537 - DNA, 71 bp, Homo sapiens
cagcgggcagggcctcgaagcctctgggcagcacattggcctggcgggcttgggggcccgggctgctgctg

SEQ ID NO: 6852538 - DNA, 122 bp, Homo sapiens
gacccacccaaataatgaatacatgtcctagacatagaaaattcatacatttttattaatgcaccataggaatgctattatttctgtgtgtggattcctatgttcttattaatacatacgtc

SEQ ID NO: 6852539 - DNA, 78 bp, Homo sapiens
gtttatcagtaacctttagcacagttgaatgtttattttgctaatttagcttcaggtgctatggttatcattataaac

SEQ ID NO: 6852540 - DNA, 71 bp, Homo sapiens
ttgtctctgagcatgccatattgcttttgttacaactcatcaaaatgtcccttctttggtgctcagagtaa

SEQ ID NO: 6852541 - DNA, 59 bp, Homo sapiens
gacagagctcccagagatttgcagaagatcttcctcaaatcttcaactgagtactgatc

SEQ ID NO: 6852542 - DNA, 62 bp, Homo sapiens
tggtattgcttggttgcctagcaacagtcacctgatgtgtttggggaaccaggcaatgagca

SEQ ID NO: 6852543 - DNA, 66 bp, Homo sapiens
agtttttatgtctgtgaattggcaagcattttcttctgctctgctttcattgtgggcatttgaatt

SEQ ID NO: 6852544 - DNA, 58 bp, Homo sapiens
ctgtgcctccctttactttgagttcgcatctgccctcacagtatctctggagccatag

SEQ ID NO: 6852545 - DNA, 86 bp, Homo sapiens
cttaggaactcatttaacttttccaagctgtgatttgctttgttgtaaaatgaaatacagttgggaggaggtaataagcatctgag

SEQ ID NO: 6852546 - DNA, 84 bp, Homo sapiens
tgtgtagtatgtattcttttctctaaatgatgaaatgctaaagaatcatttcacgttgttgaagaaaataccgttgctacaaca

SEQ ID NO: 6852547 - DNA, 72 bp, Homo sapiens
tgagtcctttacattttagttaacctgtgatatgtcactctaacctagggaaagtgtggagagcctgattca

SEQ ID NO: 6852548 - DNA, 89 bp, Homo sapiens
cagtaagacccagagttagtatacaaagtaacagctagtgtcaaattgagatgttcacttatgtattgcatgcctcgtgtctcttactg

SEQ ID NO: 6852549 - DNA, 96 bp, Homo sapiens
gagccaggtgtatttcacagcttgttttgttgaatacttaagaaacctcttacatctatttgacagatacagtaatgaagatttagagacttgttc

SEQ ID NO: 6852550 - DNA, 99 bp, Homo sapiens
ccatttccaagtagagtattcaggttagcattaagacttcattagtaatatggtgcatgctgttaaaatgtggtcttaaaattatacctgtgttaatgg

SEQ ID NO: 6852551 - DNA, 130 bp, Homo sapiens
tagaggctgaggcttcctagtggatgggcaaactggtagctcgcctgcccgtggccattggtaccaggctggctggtgttcaggctccctggccagttggcctctcctagaggagccctcaaatccatta

SEQ ID NO: 6852552 - DNA, 81 bp, Homo sapiens
cagatgaatgagagtaagtgcagaaaagatgtggttgcaaaggaaatcacatgtttctgccccttgaatctctcaaatctg

SEQ ID NO: 6852553 - DNA, 102 bp, Homo sapiens
cgtgatgtttagcataatatttgtaaaggaactagcatgatgtgtagtacatgacagtttagaaattttgttacttcttttagttaatgccaaacacttacg

SEQ ID NO: 6852554 - DNA, 56 bp, Homo sapiens
ttgtgtggctgacaaccactggaggaggcttcttgcttcctggttcagccatggaa

SEQ ID NO: 6852555 - DNA, 130 bp, Homo sapiens
ctataatagcattattatcacttagggcagctgggtcatctctgatattttaaatgtcaagccattttggcaattatatcaccagagatctggctcaagtatgaccaaagaattgactgttcatctatag

SEQ ID NO: 6852556 - DNA, 64 bp, Homo sapiens
ggaaactgatctcctctccccacctgaaggtttctggatatgggagagggagcatcagagagcc

SEQ ID NO: 6852557 - DNA, 111 bp, Homo sapiens
catattagaattacatccattttctcccccttagctcttgtctttttttcagagcataaaatggaggagatgagaggaaggggaagggaagaaacttgcttttctaaaatg

SEQ ID NO: 6852558 - DNA, 69 bp, Homo sapiens
tttgatccagggcttacacataccaagagacttcgttacaatcaccaaatgtgtcaggccctgattaaa

SEQ ID NO: 6852559 - DNA, 61 bp, Homo sapiens
cagcaggtctgcatttgaggtctgaaaatgtacatttctaacaagtgtccagatgctgctg

SEQ ID NO: 6852560 - DNA, 107 bp, Homo sapiens
gacaggagggatcaggacaggtgggccttggggtggccttgtccctgtgcctctctagggctgggcctgaccccaggatgaagcatcctcattccatcccttctgtc

SEQ ID NO: 6852561 - DNA, 78 bp, Homo sapiens
gtagactgatgggaaatgaatgttttaaggcataaagctttattcgctcatgcttttatgatatttactcatgtctat

SEQ ID NO: 6852562 - DNA, 77 bp, Homo sapiens
taggggaaggtttgcaccaggagtgaaacctatgtgactgcagagggcacaggttgtacttgggcacccctcccctg

SEQ ID NO: 6852563 - DNA, 79 bp, Homo sapiens
attttgttttataggtcctgtgagatttatgctttaaagaggttctgtttggatgtgtttccaggatttgtttcaagat

SEQ ID NO: 6852564 - DNA, 96 bp, Homo sapiens
aggccagactgctacccttagggaagtggtctgggaacttgggatttccgagtgtccctaccatttcctaactggtaagggtggtttactgggcct

SEQ ID NO: 6852565 - DNA, 57 bp, Homo sapiens
ggaatatagccagtaacagtcatgcaattatttgctttctgtttcttgctgtatttc

SEQ ID NO: 6852566 - DNA, 97 bp, Homo sapiens
gctaattaccttttccaaagaactggggtaccatgtaatgtcttcgaaaaggtaatttagtgaatgatgccctgttatcttggaagagttaatatgc

SEQ ID NO: 6852567 - DNA, 75 bp, Homo sapiens
tgtagccactgaaatggtatttactctgtattacttttcatcagttgtatagaatttactcttttgtggagcgca

SEQ ID NO: 6852568 - DNA, 65 bp, Homo sapiens
cagcacttaagaaagactaaaaagctgtatcaaccagtgataatgcatggatctttatgaggctg

SEQ ID NO: 6852569 - DNA, 74 bp, Homo sapiens
gttatggtgcaaccccagattgtatctccaaggaaattgacaggagaagcacctgcagttgacaaaaatatgac

SEQ ID NO: 6852570 - DNA, 77 bp, Homo sapiens
accacagtatataaagtcaaggcattttatgatcttcctggatgtaattattttccatgactttgtgtaatcatggt

SEQ ID NO: 6852571 - DNA, 70 bp, Homo sapiens
gtgatttaggcatataggtaggaattgtctatagacattttattcaatatcctatttatgtcctttttat

SEQ ID NO: 6852572 - DNA, 78 bp, Homo sapiens
ctcctctgtctctcacaggtaccagcaccctccctggttcaggcagggaatgaggaataggtttgtgtgagatgggag

SEQ ID NO: 6852573 - DNA, 66 bp, Homo sapiens
gtgtgttccaaacatggcacccagatctcaaaagcttcttcaacgctcccatggtttgggatacac

SEQ ID NO: 6852574 - DNA, 57 bp, Homo sapiens
gtatgaactgaggtccaccagggtactcagaagatgtccctcactcctcattcaggc

SEQ ID NO: 6852575 - DNA, 98 bp, Homo sapiens
ttatttacaaaaatggcacttgtgtatgttctacttaatattactgtggtaacatgatggtattacttctagacacaagcatgtgccttggtgaatga

SEQ ID NO: 6852576 - DNA, 80 bp, Homo sapiens
gatgagggagttatatgttaggcaatctttcttgttatattatagctggattcaatttcttgatacaaactctccttttc

SEQ ID NO: 6852577 - DNA, 78 bp, Homo sapiens
ctatccgtggacagttactgagcttgagtaagtttttgatgtcaaaataattcaggtcacagtctgaacatttgacag

SEQ ID NO: 6852578 - DNA, 129 bp, Homo sapiens
ccttaaaaacttctgtgcatttgtatcacgctgtctgctcttcggggccactgcttgtgttgcagggaagacacaaagcatgagagttccgagcagtgggcaaagatgcttgtcaagagtgttataagg

SEQ ID NO: 6852579 - DNA, 92 bp, Homo sapiens
tacattgaggaggggtataataatttttttcaattaaaagaagtcatacatttctcaactttgagaaacattgttcttaccttcccagtgtg

SEQ ID NO: 6852580 - DNA, 60 bp, Homo sapiens
ggccaagagacactgtgtacagaaaaagaaaccaatttcctggcggcactgtcttgggcc

SEQ ID NO: 6852581 - DNA, 80 bp, Homo sapiens
aggggcagaagcctgtggatttgggggtcctggaaataagcattcacctgagggccctcagtcccaggccttctggtcct

SEQ ID NO: 6852582 - DNA, 112 bp, Homo sapiens
agccctctccaaggtacctgaaaagatggttgaccatagaacatgcgctatctctgtgtcgtatgtaatatggtccacatcttctcaatatcaaattcagtcatagagggct

SEQ ID NO: 6852583 - DNA, 67 bp, Homo sapiens
tcacagcacatggaccgagtcctgtggatttgttttgcaaatgggttttcgcatgtgttaactgtga

SEQ ID NO: 6852584 - DNA, 62 bp, Homo sapiens
ttccaaggaagtttgcactattggccgtttggaattgcttgtttatgacaactttcttggaa

SEQ ID NO: 6852585 - DNA, 56 bp, Homo sapiens
gtgctaggtgttggagatacagagatacatagcatgcatctcctacatttaggtac

SEQ ID NO: 6852586 - DNA, 70 bp, Homo sapiens
gtcagtggtcccaggtggtcacagcctacagcttcccttgctgtgctgttcccatgtggggctcagagac

SEQ ID NO: 6852587 - DNA, 63 bp, Homo sapiens
ccaaagtctattaagaaactttcaaagataggtggacctgggaaagactcttgatgtctttgg

SEQ ID NO: 6852588 - DNA, 130 bp, Homo sapiens
gtaaagaactgaccatgcttccactgaaatgttacagtcacctagaatgaccaagagtgttttatatgaagcctcttggagtctatcattctgtttggagtgacagctgaagttttatatttatttttcc

SEQ ID NO: 6852589 - DNA, 62 bp, Homo sapiens
gagtcctggctctacgggcttcaaagaggggctcccctgaggacctgctggacccaggactc

SEQ ID NO: 6852590 - DNA, 73 bp, Homo sapiens
cattattttgtttcctttggagtagagaaacgtgaattcatgatgaaatctaaagcctagaggaaaggtaatg

SEQ ID NO: 6852591 - DNA, 75 bp, Homo sapiens
cttcatacctgaggtagctgtgaatgttctgggtctcctgcccaggcatactcagagcatgccacaagtgggaag

SEQ ID NO: 6852592 - DNA, 67 bp, Homo sapiens
ctgggaagtgaggagcgcctctgcccagccgcccatcgtctgggatgtgaggagcgcctctgcccag

SEQ ID NO: 6852593 - DNA, 57 bp, Homo sapiens
ccagtctccacagaaagaagaccctggtcctcagactctggtctgctgtggacctgg

SEQ ID NO: 6852594 - DNA, 67 bp, Homo sapiens
ctcattgcaccccagtcccagctacacctttcctgactccaggaagctgaggctgtgggtgtcagag

SEQ ID NO: 6852595 - DNA, 58 bp, Homo sapiens
gttgattctcatttacagtaattattttctatacagtcactgtgaatgctgaattagc

SEQ ID NO: 6852596 - DNA, 129 bp, Homo sapiens
ggctttctctctctgttttcagatcaatggtagcttctttttctcagctttgttaggatagaatctataatcttcacagacacagggagaagcatataaacattaatttaaaaagagagcaatactgcc

SEQ ID NO: 6852597 - DNA, 86 bp, Homo sapiens
ttcctgttgttcaactaagctcccaactgaagaggctgaaatcacagccccctcaaagaggaagctctggcttaaacaacaaggaa

SEQ ID NO: 6852598 - DNA, 61 bp, Homo sapiens
tgtacaatgctgaggtttggggtatgaataatcccgtcacccaggcactgagcattgtaca

SEQ ID NO: 6852599 - DNA, 85 bp, Homo sapiens
cacaggatctctacttatttgtcaatcccttgaaaacctcccataaaacaaaggtgagggctctggggtggcagagatctctgtg

SEQ ID NO: 6852600 - DNA, 106 bp, Homo sapiens
ggctggttttagtcaaagcccttttgctacatggtaagcccacttaagttatccccaagacaagtggaaagagtgttgcaagggcatgcttggattggaactagcc

SEQ ID NO: 6852601 - DNA, 58 bp, Homo sapiens
ttactttaagggtgtcttattagatgatgaaaagttggctgagacacccttcaagtga

SEQ ID NO: 6852602 - DNA, 129 bp, Homo sapiens
gatgtgcagggagatggatgctaacctgggccaaagatgtataaggctcctttggagaactggaggcctccctggggagctgagacactgccctcagaaaaggttctgagtaacatctgctttcaaatc

SEQ ID NO: 6852603 - DNA, 114 bp, Homo sapiens
gtgcactgggcggtgaggactcgaacgagctcgtcccggggctggcgcactcacttcggagaaacccctgctcccgggacgcgttcactccggccgcgcaggcagcccgggcac

SEQ ID NO: 6852604 - DNA, 80 bp, Homo sapiens
gcaagaaaaatgcccatacttttgccctgacattcttagacacctattaagaatgaggaaaagtaaggtaccatctatgt

SEQ ID NO: 6852605 - DNA, 55 bp, Homo sapiens
ttgagatggagtcttgctctctcgcccaggctggagggcagtggcgctatctcag

SEQ ID NO: 6852606 - DNA, 64 bp, Homo sapiens
cactctccttccttgcccctcatattagataatcatgaaagtaaccaagggaaggtcttgagtg

SEQ ID NO: 6852607 - DNA, 56 bp, Homo sapiens
aggtcaagggcaagagtgaggtcaggggcctgtccccaccatgtgcccattggctt

SEQ ID NO: 6852608 - DNA, 57 bp, Homo sapiens
cacctccttgctctttctctttgtgacccagtaacacaggatgatgggaaggtggtg

SEQ ID NO: 6852609 - DNA, 86 bp, Homo sapiens
ggcagtcacataagttgcagagggtgcattggacaccaggccctccagatgccaactctctctgcagctctctgactatccatgcc

SEQ ID NO: 6852610 - DNA, 116 bp, Homo sapiens
ttgagaatatgctggtgtggctggttatgaggctgacagggtagacagagggcagagggtgccttcttttcaactttgtttctctggctccgtgcctggtgcacagtagtccttaa

SEQ ID NO: 6852611 - DNA, 72 bp, Homo sapiens
tcaccttagctggcatggccctgtgggattggcctcccttgtcttactttttccttgttcaggctgctgtga

SEQ ID NO: 6852612 - DNA, 66 bp, Homo sapiens
agtggcaaggacttaggatattacagaacaacttgaaaaagatggacttgtctgagttcttccatt

SEQ ID NO: 6852613 - DNA, 63 bp, Homo sapiens
caggaaacaaaccactcatggtggtgctctttttgccttcactatgaagtgtttgtctgcctg

SEQ ID NO: 6852614 - DNA, 111 bp, Homo sapiens
cgtcagtgaactagtggtagaaaggagcaaatgccaagtgggaggcacagaatcacctccctttgcttccagcttgtggcgctttccttctgtctgtctacaatgctggcg

SEQ ID NO: 6852615 - DNA, 59 bp, Homo sapiens
tgcatttttctgctgtgctcggaccgttgtggatgcttctgttccagtagaaaggtgca

SEQ ID NO: 6852616 - DNA, 80 bp, Homo sapiens
tatgaattggggatagatgattatatttaccatagcttattctgcgtaagtttgaagtccatctgtacctcagattcatg

SEQ ID NO: 6852617 - DNA, 58 bp, Homo sapiens
ggctcctgtgccatcctgagcatccctttgatggaaagggaggtggcagcaggaagcc

SEQ ID NO: 6852618 - DNA, 71 bp, Homo sapiens
tgaggacacctcttctgtttgctttactcatcacagattcatgaataaagacaaacaggggagccacctca

SEQ ID NO: 6852619 - DNA, 61 bp, Homo sapiens
agtccattatggtggtctcatggagtgagtcttgtttggtccaagtccattatggtggtct

SEQ ID NO: 6852620 - DNA, 68 bp, Homo sapiens
tgattaaagagattaagatttgatacagtgcacataaagcctgtatcaaaccaaattaattctagtca

SEQ ID NO: 6852621 - DNA, 72 bp, Homo sapiens
atttttatttggtttgattttctcaattcttgtccagatctggggtcttttgaaagattgctaagtaaaaat

SEQ ID NO: 6852622 - DNA, 84 bp, Homo sapiens
ggtaaagagtggtgaggggcatgtgtgatttgagaaagtcccatcaatgcgtcaaatacacacagaatccaccatacccatgcc

SEQ ID NO: 6852623 - DNA, 66 bp, Homo sapiens
cccagggaaggcatgtgtcctcagagagaaacactagtttctgttttctggccacagccccttggg

SEQ ID NO: 6852624 - DNA, 126 bp, Homo sapiens
tagaattaatttttgtgttcccccctcattcatatgttgacatttaaacctccactgtgatgataccaggtggctttgggaggtgattaggtgataacgatgaagccctcataaatgtgattactg

SEQ ID NO: 6852625 - DNA, 71 bp, Homo sapiens
ctaggggcatgaaatagagaattcagtagcccaataaatatagtacacattcttgtcatttcatgttctag

SEQ ID NO: 6852626 - DNA, 65 bp, Homo sapiens
tcacccatgcatgttttgcaacaagtgacccctgtttggggtcatgcttgtgcagcgtcaggtga

SEQ ID NO: 6852627 - DNA, 80 bp, Homo sapiens
gccagctgaggcttctaggcttgacatctccctccaccccgggaagaagatggaggcttggtgccaaggagcctgctggt

SEQ ID NO: 6852628 - DNA, 72 bp, Homo sapiens
gcaggagcagagggagtattagagcttggatgctcatttctaaacctctctgaggttccctcaactacctgt

SEQ ID NO: 6852629 - DNA, 129 bp, Homo sapiens
ttagtgttttggaggagaatgaagcctggcaattggtcagattgggcttccatttctctatacctctaggctagtggtttctaactttgattgatgttaatagtttatcattcctttcctagacattaa

SEQ ID NO: 6852630 - DNA, 59 bp, Homo sapiens
gcctggtgtctccccaaggaagtggtgggacagggtcttcatgggggcaggccccaggc

SEQ ID NO: 6852631 - DNA, 70 bp, Homo sapiens
tgaaagaaaatgaatgaatgaatgaatgaggacacttttgttcttctgggtaattcttcttcatctttca

SEQ ID NO: 6852632 - DNA, 74 bp, Homo sapiens
tcctgccactgcacatatacttgcatgatgcattagtcatataccattccatagcatatgagcttgtggcaggg

SEQ ID NO: 6852633 - DNA, 79 bp, Homo sapiens
ctgtcttaagaaaatgagcttcccactacatacatgtacttaaatgcactgaggttgtagtaggaattccttgagagag

SEQ ID NO: 6852634 - DNA, 129 bp, Homo sapiens
cagcctggcttagccagcttgctctctgtccctgtcctttgttccctgtctctggctccttctcctacaatggcacaagacagaaaaggcaaagtgctgaggtatagagggcaagtggctccgaattag

SEQ ID NO: 6852635 - DNA, 102 bp, Homo sapiens
atgggtggtttttctgttaaggtttttaataagaagtcccaacttgtattttaagttttaatacatagttccacttctgttttccagaagagagacacccat

SEQ ID NO: 6852636 - DNA, 70 bp, Homo sapiens
gatgatcattgttcctatttggcaagattactttaaattctgagattatcttgcaaggaagaacttcatt

SEQ ID NO: 6852637 - DNA, 65 bp, Homo sapiens
cagccacagtggtgagtgactgataggctctcctcctgatgctcttcacacccacgctgtccctg

SEQ ID NO: 6852638 - DNA, 81 bp, Homo sapiens
ctgagttgaggggtggtcagccccggtgagccctggtgtctcatcatggtttccccatggctgtctccacccctcttccag

SEQ ID NO: 6852639 - DNA, 70 bp, Homo sapiens
atggatctcttccaggttctggttgggaagcagaggaatgaacttaacggcctctggaagtaatgtctat

SEQ ID NO: 6852640 - DNA, 60 bp, Homo sapiens
ctatactgattgatattcccatgactttagagtataaggtacagggaatagagtcaatag

SEQ ID NO: 6852641 - DNA, 94 bp, Homo sapiens
tggtaccaccctacctctgctgccaccagaaccacttttatctgtttcttatttggagtctctgtagtggagaagagtataggctgtggagcca

SEQ ID NO: 6852642 - DNA, 61 bp, Homo sapiens
ggcattcttggtatgaaggacagactggtagacacaacctagcctatgttatcaagaagct

SEQ ID NO: 6852643 - DNA, 130 bp, Homo sapiens
gtgtatacaggtgtgcacacatacatgtatacatgtatgtatatatgtgtacacacagtgcacacaagcacacgtgtgtgcatgtatgtgcaggtatgtatgcatgtgcttgtgtgcacatgtgtggcac

SEQ ID NO: 6852644 - DNA, 57 bp, Homo sapiens
ctctgttaagccatgtaagtactatagtaagcagatactcacctgggctaagcagag

SEQ ID NO: 6852645 - DNA, 78 bp, Homo sapiens
atgctggacatatggagaggttcaatacatgttggtgaccaaatgaagtgatgttgattttaccacttactccagtat

SEQ ID NO: 6852646 - DNA, 85 bp, Homo sapiens
ggttcaggtgtgagtttgttttagagagaatatggggaggaagataaaaaaggtccttattcataagtcagacacacctagtact

SEQ ID NO: 6852647 - DNA, 82 bp, Homo sapiens
gctgaccttttggggactgggaacgtgcttagctgactggcccaccaccacctgcacagtttccatacttgtactggtccgc

SEQ ID NO: 6852648 - DNA, 57 bp, Homo sapiens
cctggtcctaggggtggaaccatggaggaacaccctggtcacccactgggactgcgg

SEQ ID NO: 6852649 - DNA, 104 bp, Homo sapiens
ttgagacggagtctcgctcttgttgcccaggctggagtgcagtggcatgatctcagctcactgcaacctctgccacctgggttcaagctgttctcctgcctcag

SEQ ID NO: 6852650 - DNA, 62 bp, Homo sapiens
tccttgtgtctagaaggtgggcttgcttaagctggagctagggctttcgtagacagtttgga

SEQ ID NO: 6852651 - DNA, 79 bp, Homo sapiens
tctaagcgctttcgatgcattcttgctttacttcattattttattgaattctccaggaatgtatgatacagtggttagg

SEQ ID NO: 6852652 - DNA, 60 bp, Homo sapiens
ctaggttagtgtttgattgaatacctggggactgtaacccagtcaagttgacacaccaag

SEQ ID NO: 6852653 - DNA, 66 bp, Homo sapiens
ctctgttgcagttactcacctctgctgttgtagcacaaaagcagctgtgggcaatatgtaaatgag

SEQ ID NO: 6852654 - DNA, 64 bp, Homo sapiens
ctgctccttgtggcactgggcagggcctacgttcaaggctagcagtgtactcaacaagggacag

SEQ ID NO: 6852655 - DNA, 56 bp, Homo sapiens
ccaagtgcctgagtcagaaacgtgacatttttcaacatcctggccagtgtacttgg

SEQ ID NO: 6852656 - DNA, 62 bp, Homo sapiens
ttttctgagctcagtgacttaccaggaagagacacttgtgtgatgtaactgatttcagaagg

SEQ ID NO: 6852657 - DNA, 102 bp, Homo sapiens
gagggcaggattaattgagctgctctggtccctgcttgattttatagtgtttgcggagcaccttgagatcaagcagtgtagagttactgacttctgcccctc

SEQ ID NO: 6852658 - DNA, 69 bp, Homo sapiens
cagaccccagcctctgcgtgctgtggcttcactcaacatttgggaccactgagaaggggttggggtctg

SEQ ID NO: 6852659 - DNA, 56 bp, Homo sapiens
gggcgcccccttcaaacagagcacagcccaggagctgctccaggagggggcagtcc

SEQ ID NO: 6852660 - DNA, 77 bp, Homo sapiens
gccccgggagagtcagcaaatgtatgctcatttttctcttattataaaatggccatatcattgcagagccatggggt

SEQ ID NO: 6852661 - DNA, 61 bp, Homo sapiens
tcagcaataatgtctacaaatcttctaggtacatagcagattgtgcaacaatgttgctaga

SEQ ID NO: 6852662 - DNA, 62 bp, Homo sapiens
gcatcatgagaagtggccttcaaaaagagagttggaactttttgcaagcttcttctctgtgt

SEQ ID NO: 6852663 - DNA, 79 bp, Homo sapiens
tttgtcatttactgtgaatattttataaattgatgggttttaattctaaaacttagtagagttcatattatgtgataga

SEQ ID NO: 6852664 - DNA, 81 bp, Homo sapiens
tcttttagtccacaccaggtgtgccttgcaggggtgctttccccaccccacaaaggtaactggagtatttatctataaaga

SEQ ID NO: 6852665 - DNA, 62 bp, Homo sapiens
gcgggtcaaatgataattgcttctaattggcatccccagaagcaccttaattatttatctgc

SEQ ID NO: 6852666 - DNA, 66 bp, Homo sapiens
ttgagacggggtctcactgtgtcacctaagctaaagtgtagtggcacaattttgactccccctcaa

SEQ ID NO: 6852667 - DNA, 84 bp, Homo sapiens
ctggtcttttcagccccttgggaattcctccactaggtccatttggaaaagagtaccaaggaggctcaggggactgaaaaccag

SEQ ID NO: 6852668 - DNA, 76 bp, Homo sapiens
ttgatagatttggcggaagttcatcatttccaggggtatttagctgctgaatgataatcttttgctggtctttcaa

SEQ ID NO: 6852669 - DNA, 56 bp, Homo sapiens
ttccactggtatttgaaaatagatgtttaatatttatttagtggtggcagtgagaa

SEQ ID NO: 6852670 - DNA, 72 bp, Homo sapiens
cagttgtaggcatgtgcatggagggaagggccagcaaccattctggatcagctgcatgcatgtgcacaactg

SEQ ID NO: 6852671 - DNA, 79 bp, Homo sapiens
ggacacgtccatgtattttggggaaggcctgggtgtcatgggataagttcagttgtccccaaaatatacggacatgtcc

SEQ ID NO: 6852672 - DNA, 59 bp, Homo sapiens
gagctacctgtggaagggacctcagcgaaaaccagtgattgcccacacagcagtagctc

SEQ ID NO: 6852673 - DNA, 56 bp, Homo sapiens
tcatctgtcatggaaccagaatctaaatccaaataggctgttgccagtacagatgg

SEQ ID NO: 6852674 - DNA, 71 bp, Homo sapiens
tatacatgtaattgattttgtgttagccagtcatgtcatgtttgactaacactgaaaatgatgcatgtgta

SEQ ID NO: 6852675 - DNA, 79 bp, Homo sapiens
gcttctctgagaagctgaggctgggtgggtgttacataaagctttcctagcaacttagctttatcacagaatgggaggc

SEQ ID NO: 6852676 - DNA, 55 bp, Homo sapiens
tctgtttgtactcctaaaggtgtctcatgagacaactttggagaaagctaacaga

SEQ ID NO: 6852677 - DNA, 81 bp, Homo sapiens
tgaggtaatgagttaacaaatagtttcttaacaataaaatgtgttttgtcttgaaactgatattaactcagtgttgccaca

SEQ ID NO: 6852678 - DNA, 102 bp, Homo sapiens
ggtggaattgaggtggagcaagtccgtgagtctgtgggtgggaactgcctcctccactatgcccctctcagccatgggctcctattgtcaccagaaatcacc

SEQ ID NO: 6852679 - DNA, 86 bp, Homo sapiens
gctggtggctgagaaggaggctccccaaagtctgagggcttggccccgggcccactcgaagcctccagcacttgagagccgccagt

SEQ ID NO: 6852680 - DNA, 77 bp, Homo sapiens
agagccagcagcagcattgagcgcttgtagggcaccacctttgtgctaggcacgtgctcagagctttgatggcctct

SEQ ID NO: 6852681 - DNA, 63 bp, Homo sapiens
gcaacctgtgatgaagtgggcagagctgactgtgagcttcatgccctgctaaatataggtagc

SEQ ID NO: 6852682 - DNA, 76 bp, Homo sapiens
ccatttgtggttaagtcactgtcaaagccacacactccttgggggagtgggggttgcactgtgactgctccagtgg

SEQ ID NO: 6852683 - DNA, 59 bp, Homo sapiens
caggagtccctgggatgcccttctggggacacagccctgaaaggtaatctgagggcctg

SEQ ID NO: 6852684 - DNA, 69 bp, Homo sapiens
caatttctgatgcattgctgctactattgttctagaacaaaggagaagattggtgtgtgcatcaaattg

SEQ ID NO: 6852685 - DNA, 56 bp, Homo sapiens
aaaggagcctccgaactttgttttaaatcttgaggggacaaagtgcgtgctctttt

SEQ ID NO: 6852686 - DNA, 93 bp, Homo sapiens
gccacttttctgtaggatttctacctggtttctgtttggaaactgtatttaactaccaattagaaacctcagggaaatctttggggtagtagc

SEQ ID NO: 6852687 - DNA, 66 bp, Homo sapiens
tacacactagatggtaggtgcggggctctcccaccccacctgttcattacccatcccaggtctgtg

SEQ ID NO: 6852688 - DNA, 67 bp, Homo sapiens
tactcatttgacactttaaactgttttgtcatttagtctcaaaatggtttggatttacaaatgagta

SEQ ID NO: 6852689 - DNA, 75 bp, Homo sapiens
tcctaggaaatttatgaaagagagaggtgttgacttaatattcagaccctttgttggataagttggctcctggga

SEQ ID NO: 6852690 - DNA, 68 bp, Homo sapiens
cagtcctttttgactcagattttgtggatttgaaataatcaacgtgccattcatgtgagcaagaactg

SEQ ID NO: 6852691 - DNA, 83 bp, Homo sapiens
gctgtacctgcattgtgccctcaaagggtgcgtcttcttgttttgaggacctgcccactctgaggacatcttgtgggaccagt

SEQ ID NO: 6852692 - DNA, 81 bp, Homo sapiens
gtagggacttcttagaaatcacagatagggtcatgttcttcctcctaagtggaatatggtcgtgatggctgaagcacctgc

SEQ ID NO: 6852693 - DNA, 58 bp, Homo sapiens
gcctaaaactgcatgcatgcatgttttatatttttatgtacagtgtatgtatttaggc

SEQ ID NO: 6852694 - DNA, 76 bp, Homo sapiens
gtattcccaggatatcaaagctagtggaaatttccatatggaaaaccttctagactttatatttttggaacaatgc

SEQ ID NO: 6852695 - DNA, 101 bp, Homo sapiens
ctatctctgccacttcttatttgtggcatatgagacgagtctcttaatacctctgagcctcagtttcctcatctacaaaagagaaatggtaccagtgatag

SEQ ID NO: 6852696 - DNA, 79 bp, Homo sapiens
gggagttctagagttaaatcattttgagcaatgctagatttagcaaagcgaaagagatttatttattgcaggacatctc

SEQ ID NO: 6852697 - DNA, 88 bp, Homo sapiens
tttaggatttttaagtggacagttttagatttatagagatttattttcattatagcagtataacatgtttactatagaagatgctaaa

SEQ ID NO: 6852698 - DNA, 89 bp, Homo sapiens
cacctgagtctgcatctctgactttttctcagtgtaccccacaggctgttacacagatttaaaagcagggaaagagaggctcaagggtg

SEQ ID NO: 6852699 - DNA, 82 bp, Homo sapiens
gcaaaactcagtatcacttttgagagtgagaagacagcctgtcttcttaatttcagcaggataccacgtaactaatttttgc

SEQ ID NO: 6852700 - DNA, 94 bp, Homo sapiens
tcatttgtgcagggacaactgtgcacctgatcttggtaatctccttaccctgactaatttcagtgtcacaggatgctatgcataccacccatga

SEQ ID NO: 6852701 - DNA, 127 bp, Homo sapiens
gatcttaggaggcaacgcctggcttgcaccgtgggacatggagacgtttgcagggcaggaatgtttggagcagatgttctgtgtctcacaaaccatgccttatagggggcttgtcctggctaagatt

SEQ ID NO: 6852702 - DNA, 65 bp, Homo sapiens
tcagtgtgcctgaatcaagtgttatgctttctttaccaaataacgaaacttgccaggcatagtgg

SEQ ID NO: 6852703 - DNA, 65 bp, Homo sapiens
gcattcctgactgttagagtttgctgaccctcaactgaaagcaaaataagaacagaaagggatgt

SEQ ID NO: 6852704 - DNA, 62 bp, Homo sapiens
gctccatccctggagaagctgacccagacagggctcattggctcttgggggacagatggagt

SEQ ID NO: 6852705 - DNA, 76 bp, Homo sapiens
cacccgatgttggtgctctagtatctgtgatagctccttttgatccacaagtattagttgcaaaacattgactgtg

SEQ ID NO: 6852706 - DNA, 67 bp, Homo sapiens
agcccatcaagagtgaaccctggacgttgctgcaagccaagggtggaaatatttttaagggtgggct

SEQ ID NO: 6852707 - DNA, 130 bp, Homo sapiens
ccatccacagaactggggcctccagctcttcccggctgagggtcccagaccctaagggcaacacatccttggggcaagagggggaccctggaggcaggggctgcggtatggccattgggttctgtttcgg

SEQ ID NO: 6852708 - DNA, 63 bp, Homo sapiens
agtcttggcagcagctgcctttcagacccatctggtttgaattggcaaaactgcagctgtgct

SEQ ID NO: 6852709 - DNA, 73 bp, Homo sapiens
actcgtctttttgcttttaatttctctagaatgagtggactcagaatggtggcaaaagaggcaaagtgagagt

SEQ ID NO: 6852710 - DNA, 122 bp, Homo sapiens
gggcaacaccgaggtgagtatgaccatccctgtcctcaaggagcttcagtctagtaggggatgagacatactagactgtgagctcctcgagggcaggaaaagtgttttagtcatctttgccc

SEQ ID NO: 6852711 - DNA, 80 bp, Homo sapiens
ggtatttgaagatgcggttgaccatggtgtgtacgctttatttgtgacgtaggacacatggtctacttcttctcaatatc

SEQ ID NO: 6852712 - DNA, 62 bp, Homo sapiens
cctttcaacaagatttctggcctggaaaaaagtgatgatggctggaaatggtgcttgaaagg

SEQ ID NO: 6852713 - DNA, 80 bp, Homo sapiens
tgaggagcttgttaaaatgcaaattctgattcattaagtctgagtggaactcaaaagtctgcattcttcacaagcttcca

SEQ ID NO: 6852714 - DNA, 70 bp, Homo sapiens
tatttattgaggctttactttatgcaagccacttggctaggcacagtaagagataaagctatgatttatg

SEQ ID NO: 6852715 - DNA, 61 bp, Homo sapiens
cattgttggtcattgtcggttgaaagggacctcatgaataaggcaatgacatgaaacaatg

SEQ ID NO: 6852716 - DNA, 57 bp, Homo sapiens
gagtgtcctgcacagcaccttgcagacctcccatggctgcctgctctgtagggcctc

SEQ ID NO: 6852717 - DNA, 76 bp, Homo sapiens
gtccctggccaggctggctggatggttggttcgctgtctgacgagcagccagccctccaccagcagctccgggggc

SEQ ID NO: 6852718 - DNA, 85 bp, Homo sapiens
cctactctaacttacttgaaatggcttcttggatttctgggttgagaagaattctgaggctatgttcaggctaagtgaaaaatgg

SEQ ID NO: 6852719 - DNA, 66 bp, Homo sapiens
atgaagtgtcacagaatgacagagttataaggaaactttactactggaaactgtagataattttat

SEQ ID NO: 6852720 - DNA, 65 bp, Homo sapiens
ctgtttataaaccaccagtttagggcatttttattaatgcagcccaaatggcctcagataagcag

SEQ ID NO: 6852721 - DNA, 56 bp, Homo sapiens
tacaaaggcggtttttctgggctccttcactctgagatcagtaagaatgccttgta

SEQ ID NO: 6852722 - DNA, 64 bp, Homo sapiens
ctgctccagcccagctgtccccttcacgctgctgagagtgatatccacctggagttgggtgtag

SEQ ID NO: 6852723 - DNA, 75 bp, Homo sapiens
cagcagctcagcctccttcccattggttctcacaaagcatgcttctctgggtggagcaggctggtgcttcagttg

SEQ ID NO: 6852724 - DNA, 66 bp, Homo sapiens
gtcattagtaaatctggcctcagcaaacatttactgagtgtctgccagctgccaggtgctgaggac

SEQ ID NO: 6852725 - DNA, 56 bp, Homo sapiens
tgcaggagaaagtacggagcgtttagctttagctggcattttgtgtttattctgca

SEQ ID NO: 6852726 - DNA, 75 bp, Homo sapiens
ccaccctgaggaatggtccggccgggcctagcgaggatgtccctaccgcgatgctggttccgttacccagggtgg

SEQ ID NO: 6852727 - DNA, 103 bp, Homo sapiens
caccattcttctgagaatccttaacagaagcttctgctcctttgggtcctccttggatgtcagtaaatgagcaaaaatttccacattttcaggagagaggctg

SEQ ID NO: 6852728 - DNA, 78 bp, Homo sapiens
tctttgagtgagtaggtggttaagcatggatgcctctcagctctcctctgatttgattacctagtttaaacttccaga

SEQ ID NO: 6852729 - DNA, 90 bp, Homo sapiens
ttcagtaggtctgaggtcaggcctcagaaattgcactggtgacaagatcccaggtaatctgatggtgctggtctagggccccacttcgag

SEQ ID NO: 6852730 - DNA, 66 bp, Homo sapiens
tgtcttttgggcaatcctaaactgctgctttcacagccagttgatgggtttccaatcatatagaca

SEQ ID NO: 6852731 - DNA, 69 bp, Homo sapiens
tagtaccctttaagtcctggaacaaagttctctcagggggcttgaaatccagatttcagagggaaactg

SEQ ID NO: 6852732 - DNA, 86 bp, Homo sapiens
ggccacacgagcaggatgccatgccccaatacaggccaccttgcacaggcctcggtgggtcttgcagggcagcttcttggtgtgcc

SEQ ID NO: 6852733 - DNA, 66 bp, Homo sapiens
cattagtcaaaactttgggcaggggctatctactagaattaatcctcctcatatctttgactagtg

SEQ ID NO: 6852734 - DNA, 74 bp, Homo sapiens
caggatataatgaatgcagaaaaggatgagcattttacagtgggagcttcctttttctgcatgacatatcactg

SEQ ID NO: 6852735 - DNA, 62 bp, Homo sapiens
acaaattgtgagcaagtatcccaagatgggtgcagagcccaacttccttctagttcatatgt

SEQ ID NO: 6852736 - DNA, 86 bp, Homo sapiens
ttgttggaacacagcagctgattttgaacagctccaaaatgtaactcaaaatccttttggctgaatatatatttgtgttttaacaa

SEQ ID NO: 6852737 - DNA, 76 bp, Homo sapiens
ttcaggcctgttgcaggcccagggagggagaccaagtgtcctcggttcccagcctggccctgctagaggccccgaa

SEQ ID NO: 6852738 - DNA, 60 bp, Homo sapiens
tacatttcactattcactaaaaggacatttagtcactttgatttgtgatgtgagactgtg

SEQ ID NO: 6852739 - DNA, 56 bp, Homo sapiens
ttcctggtcctattatatacacttaaagagaagtgggtgtttatgtaatctaggaa

SEQ ID NO: 6852740 - DNA, 67 bp, Homo sapiens
aacttagcagtggtacttatatgaagcatcaagtccgatgacgctacagcatagtgctctgtaggtt

SEQ ID NO: 6852741 - DNA, 78 bp, Homo sapiens
tagagaattggaggcaccttgttttcacaactaggataaaaataggtgttgattcttgcagggtcctttccattccta

SEQ ID NO: 6852742 - DNA, 61 bp, Homo sapiens
taccactttagttcagactttcattatcttgctggattactgcaaagctgctgaagtggta

SEQ ID NO: 6852743 - DNA, 77 bp, Homo sapiens
gctctcaacagcataggactttctgacctggacgttggtcacttctaattcagaagtcctggctggatcccaggagc

SEQ ID NO: 6852744 - DNA, 63 bp, Homo sapiens
tctggcgttggtatcaaaatatagcagccttttttggctctagcttttgataccagtgtggga

SEQ ID NO: 6852745 - DNA, 56 bp, Homo sapiens
gtggtccctggtgttttgatgcagagatcgttcatagtaaacaggcaagggaccac

SEQ ID NO: 6852746 - DNA, 62 bp, Homo sapiens
gtccagagagtaaagggggtaagcaagctcttgttattagcccatatgtacttaccctgggc

SEQ ID NO: 6852747 - DNA, 80 bp, Homo sapiens
ggtccttcgaggcctggagccgcctaggcgctgagccactgcccgccgtgatctgtgcgactccaggtctgggcaggacc

SEQ ID NO: 6852748 - DNA, 76 bp, Homo sapiens
aaccttttttcaatgagaaaaacattagccttcttttgttacacataagagagttctttctagttgaagagatgtt

SEQ ID NO: 6852749 - DNA, 82 bp, Homo sapiens
caaaacccataagcagtggttattgcattgtgaaaaaccatgtcttacacagagaatgatgagtcactgtggtggtgttttg

SEQ ID NO: 6852750 - DNA, 68 bp, Homo sapiens
ggcagattcctagattctactctagatccatgggatcagcatcctgtagtgggagccagggatctacc

SEQ ID NO: 6852751 - DNA, 69 bp, Homo sapiens
agagctcaatgaaagaaatagttatgttaaaaataaatgacatgtattctggatctgtcatcgagtttt

SEQ ID NO: 6852752 - DNA, 61 bp, Homo sapiens
agcatggggcaggtggggggctgcagccccagggatctgagcttcctccctgcatccatct

SEQ ID NO: 6852753 - DNA, 58 bp, Homo sapiens
catggtaggtgcttagatttctgctaactgactagcttagttatagtatctagccatg

SEQ ID NO: 6852754 - DNA, 57 bp, Homo sapiens
gaggttgatgtaattagcatggcacagcgtttcagccagttaaacaacatccatttc

SEQ ID NO: 6852755 - DNA, 64 bp, Homo sapiens
tgaagccctttatcaaaagagagagaataaaagtattttctgactggtgtataatagggcttta

SEQ ID NO: 6852756 - DNA, 64 bp, Homo sapiens
tcagatgctaaattatttgcacattagaggcaaaacgtgccttctatgtagatgatttatttga

SEQ ID NO: 6852757 - DNA, 94 bp, Homo sapiens
tccagtcatgcacagagcttggctgtggttgtgataaaatacctctgtatcactcctctaccttcaagtaaactctgccagcaaggaatctgga

SEQ ID NO: 6852758 - DNA, 77 bp, Homo sapiens
agaatgctacagaagtgatcttggatgactttcaaggcaagatgagaggaggtcgagcaacttctgcttggttctct

SEQ ID NO: 6852759 - DNA, 98 bp, Homo sapiens
aaacaagtcctgaatgctagaggatgttctaggcactcatgaggtcttcccttatgactcatgtttgtccctgacatcctctcccatttatcttgttt

SEQ ID NO: 6852760 - DNA, 59 bp, Homo sapiens
ggagacaggccagttttgatttaagcccttactgcaaggcttgggtgaattgcctttcc

SEQ ID NO: 6852761 - DNA, 130 bp, Homo sapiens
catttgaagcttctgagaatttttagcaataaatgggaaaggtacactctcatttttgtcttggacaaaatgctgagttttgatagagtgttgcctctcaattatagcttttactgtttgagcttcatcg

SEQ ID NO: 6852762 - DNA, 87 bp, Homo sapiens
cctagatctaacttggttgtgcaaaatgggaaactctattgttagcctttaggcagacagtttatcctaaataactaagtttctagg

SEQ ID NO: 6852763 - DNA, 56 bp, Homo sapiens
ctgagatggagttttgctcttgtcgcctaggctggagtgcaatggcaccatctcag

SEQ ID NO: 6852764 - DNA, 81 bp, Homo sapiens
gccagatttgtcttctgtattcaagtctattgtatgctctactaatataatactgctttcaacagaagtatgcatcatggt

SEQ ID NO: 6852765 - DNA, 57 bp, Homo sapiens
ggctgagcactttaggcaggagcccattctggctgggattcctgcctgcgggctccc

SEQ ID NO: 6852766 - DNA, 79 bp, Homo sapiens
ctcccactcactcttcatgctatgctcaactggcttccagaaccattgagtttctgttgtgttggctgagaaatggggg

SEQ ID NO: 6852767 - DNA, 67 bp, Homo sapiens
gctaccttcttctatcttagatgactgtaaggaattagggctttcagcacaagactagacaggtggc

SEQ ID NO: 6852768 - DNA, 64 bp, Homo sapiens
atatactgtgcacaattctaagtcctggctatatagcagggagcttaatcctgtgcacttatat

SEQ ID NO: 6852769 - DNA, 63 bp, Homo sapiens
gaggtggtttgtggtgactcataaaaggataactaccttattgataaatacaagaccagcctc

SEQ ID NO: 6852770 - DNA, 76 bp, Homo sapiens
atgagtaaaaaactagaagccaacattccaagtagaatggcctgggttctgtcttgtgttgagcattctggctcat

SEQ ID NO: 6852771 - DNA, 86 bp, Homo sapiens
ctagtctttcaatattgtggccacagagatccaattctgggttttctaggaatgggtttgaactgggccagatccccaagggctgg

SEQ ID NO: 6852772 - DNA, 70 bp, Homo sapiens
tcagactagtgagtttgtactttagcatctgtgctctggtatgtcacctgaagcccaaggcactgtctga

SEQ ID NO: 6852773 - DNA, 56 bp, Homo sapiens
gagctctgatgtttagtggagataataccccccacctccatgcaaatacagagttt

SEQ ID NO: 6852774 - DNA, 88 bp, Homo sapiens
tccctgggtcttgttctatcaccttcctttgtccttttctgtgtggcagggattgagacagtggagggctgatgttaaagctctggga

SEQ ID NO: 6852775 - DNA, 64 bp, Homo sapiens
ttaattttaacctgtttgtgtctttgaatacaaagtgtatcttttgtagacaggttatagttga

SEQ ID NO: 6852776 - DNA, 73 bp, Homo sapiens
tcattcatgctgctacacacaacagggagtcatggaaggaagaaggtctggagtgtaaagagcatagaagtga

SEQ ID NO: 6852777 - DNA, 83 bp, Homo sapiens
ctttgccacattcattacatttgtaaggcttttctctggtatgaattatccaatgttctataaagtgtgaactgtgagtaaag

SEQ ID NO: 6852778 - DNA, 71 bp, Homo sapiens
ttccaggtcctactggcccatagtgtcaggaccctggctgtttgggctgtgggctctcatgggacctggag

SEQ ID NO: 6852779 - DNA, 102 bp, Homo sapiens
gctcgatagaagatcaacatgccttagtatctatgaagtgaaaagaacatttaaacaattgaagctttgtcttcagatatgtgtggtgaatattttctatgc

SEQ ID NO: 6852780 - DNA, 85 bp, Homo sapiens
gaatttctaaaactcctcatgccgggtctcacgctacagattcagatttaatcagtgtaagatgtggtctgagcatcaggatttt

SEQ ID NO: 6852781 - DNA, 68 bp, Homo sapiens
attatgctggtttacacatttttaattgagtgtgcatatgtgcatttgtgtgtgtgagaggacatggt

SEQ ID NO: 6852782 - DNA, 65 bp, Homo sapiens
agcccttcagtgtttgtagagataactgtcagtgtcaactttgaaagttgtagcactgcagggct

SEQ ID NO: 6852783 - DNA, 127 bp, Homo sapiens
ctcgggcggggtcctgtgctgggcggtgggctcatcccccgggtgggctcctcccaggcggggtcctgtgctgggcggtgggctcatcccccgggtgggctcctcccaggcggggtcctgtgctggg

SEQ ID NO: 6852784 - DNA, 57 bp, Homo sapiens
ccacctgcaaacagtcacctcttggccattcttggatttagggatgtatgctggtgg

SEQ ID NO: 6852785 - DNA, 57 bp, Homo sapiens
gctctggtagatcctcaggctctgaaatacctagaagctgactggggtccccagagc

SEQ ID NO: 6852786 - DNA, 63 bp, Homo sapiens
ctgagcccctgcacccctgcccacccaggtggaggaatgtggcaggggctgctgggaactcgg

SEQ ID NO: 6852787 - DNA, 101 bp, Homo sapiens
atacaatcttttctgcattattcatgttctcttaatgttaactagtttatacatggttaataaagtagagaatgacatagaatttgttggaatttatgtat

SEQ ID NO: 6852788 - DNA, 59 bp, Homo sapiens
agcatacattttctttggtactggagaattggtaatgacagtgccaaatgttgtttgtt

SEQ ID NO: 6852789 - DNA, 76 bp, Homo sapiens
tgcctccatagcaggaagaaagctactcaggagacagctcttatcactgagacactcttatctgcataacaaggca

SEQ ID NO: 6852790 - DNA, 130 bp, Homo sapiens
gtacctcatttttattattaagggacttacagtacaaacgatctgtcatttgagcaggaacacccatatgtcagatgtggtcggtttgattagtggtgctaaacccctgctagcagttaaaagaggtgac

SEQ ID NO: 6852791 - DNA, 99 bp, Homo sapiens
ttagcacagtttctgacatggaaagtactccacaattattaactatatttaatttgacatatttatgaagcattttctatgtcctgggaggtgtgttaa

SEQ ID NO: 6852792 - DNA, 66 bp, Homo sapiens
ggtgaggtaaagatggcggcagagcctccggaagctaggagagaggcatgcaacagattatttccc

SEQ ID NO: 6852793 - DNA, 66 bp, Homo sapiens
agtactgtagattggcttctgccctggccccggtcaggctgaaggaggcctatctctggctgtgct

SEQ ID NO: 6852794 - DNA, 71 bp, Homo sapiens
gcacatccagatgcagaggccttggctgggaagcggttctcagctcaggtagactcagcatctgcctgtgc

SEQ ID NO: 6852795 - DNA, 87 bp, Homo sapiens
atacctgctggtctgcctcagtctcctctatatctgaaatcaacttcagaggcagaatggagatttggttaggtaaatagtgggtat

SEQ ID NO: 6852796 - DNA, 69 bp, Homo sapiens
ctgaggccatgcatctattcccaagggcagacacaaaggtttgagctctctgaatagatcagccagcag

SEQ ID NO: 6852797 - DNA, 117 bp, Homo sapiens
atggcacctcatataaatgtgaaaaagtgacctttgtgctagaaacatatgagaatttttattgccttagatttccagagagaattttttgcattacttgtttatataaggtgtcat

SEQ ID NO: 6852798 - DNA, 112 bp, Homo sapiens
aagacatttatttttatatgtcaagccatattttgaagaatgaataatattacagaaaatgacatcatttatgcaggaatggcataacatgtagataaatagtatttgtttt

SEQ ID NO: 6852799 - DNA, 58 bp, Homo sapiens
acccatgagattctgaatttggcctgggttggccaggttttggaattttttgaaaggt

SEQ ID NO: 6852800 - DNA, 71 bp, Homo sapiens
agcccaaccctgggttcccgcagcaccaccttctctctcaggttgtgagctccaggaagccagggatggct

SEQ ID NO: 6852801 - DNA, 118 bp, Homo sapiens
ggtgctgagcccccaccacacctttccagcttttgcactggactgggaatgagttttcacctgctcattcccagtccagtgcaagagctgaaaagttaaattcaccacagccagcacc

SEQ ID NO: 6852802 - DNA, 56 bp, Homo sapiens
gacatcaggaagacatgagaggctaggctcagtgcctctccagtggttcctgattc

SEQ ID NO: 6852803 - DNA, 76 bp, Homo sapiens
aagagcatagtatatgggaaacttagtaccttttaaatgcagagagacaaagtttcaaatgttgattatgccactt

SEQ ID NO: 6852804 - DNA, 70 bp, Homo sapiens
gggcagctggatagttttaaataagagggaaccgagatcattatttttgaaactgtcagcttttacgcct

SEQ ID NO: 6852805 - DNA, 89 bp, Homo sapiens
gtgatatagcttatatgagatagactatgtcatacaggttatatgatataggttatgtgatataggctatttgatataggttatatgat

SEQ ID NO: 6852806 - DNA, 65 bp, Homo sapiens
gctgtgctgattattagtgtcaggttggttgtttgaagggctcatggcaggggtagtagtacagc

SEQ ID NO: 6852807 - DNA, 65 bp, Homo sapiens
atcaaaacttctttagagtttaaaccaggcatattaaatgcctaattgagaaggaaagttttgat

SEQ ID NO: 6852808 - DNA, 58 bp, Homo sapiens
tccttgaagaaacgggctcagatggaaagacgtctggtcaagagcccgttatcgggga

SEQ ID NO: 6852809 - DNA, 57 bp, Homo sapiens
acatttttggagtacttgtgtggaaccaggaagccacaagagagacactaggaatgt

SEQ ID NO: 6852810 - DNA, 59 bp, Homo sapiens
ccaaagtgtgggaagttgctaaaatatggacatatttttgacattttcctaccttatgg

SEQ ID NO: 6852811 - DNA, 78 bp, Homo sapiens
gccacctgcctgaagttgagctgatgccttcaagatctgtttccccaaggcccttctgctgttaggtagccagtgagc

SEQ ID NO: 6852812 - DNA, 55 bp, Homo sapiens
gatggtggaaataaacatccaattctgcacagagttttgtttgtttctcactttt

SEQ ID NO: 6852813 - DNA, 99 bp, Homo sapiens
ggagcaggccttgccctcagcattgggttacctttgtttatgttcacagaaagaaaagccagcccagagcccgagaccccccagcagaggcctgatttc

SEQ ID NO: 6852814 - DNA, 64 bp, Homo sapiens
gctcgagcctgggaggcagagggtgcagtgagccgagattgcaccactgcattccagcctgggc

SEQ ID NO: 6852815 - DNA, 62 bp, Homo sapiens
ggtctccctgcagacccagcctggaactcccttgctgccaaggctggacatcccaggagact

SEQ ID NO: 6852816 - DNA, 67 bp, Homo sapiens
ggaatctattttgctgtgatgcggctggcacccctttgactcactgtatcaccccagggttcttttc

SEQ ID NO: 6852817 - DNA, 88 bp, Homo sapiens
acaattataagcatttattgagtgccctgggagtgccagccactacttcagtcatagggggatactcagatgaataagatatggttgt

SEQ ID NO: 6852818 - DNA, 64 bp, Homo sapiens
tgtcaaaaccagcaattttgttcctaggtagataaccaacagagatgcaagtgtgtatttgaca

SEQ ID NO: 6852819 - DNA, 95 bp, Homo sapiens
tgatggaaaagctcgtgttagtattggcaaatttgtttggaagaaaatatattccagcaaaattccaaaatgctaatttaagtttttctcagtca

SEQ ID NO: 6852820 - DNA, 104 bp, Homo sapiens
tactattttccctgtgatctcagtttcttcttcccatccctcaaatgctttttgtgtgtgtgtggtgggggaagagagtaaaattgaaattcgtggaaaatgta

SEQ ID NO: 6852821 - DNA, 81 bp, Homo sapiens
tagggatggccttgggccaactgtccccatagccctgaaggaagcaaggagctgaggaagtcaggtggcccagcaacccta

SEQ ID NO: 6852822 - DNA, 61 bp, Homo sapiens
tggtagagtcaggacggcaattctgggattcctgatgccagacttactgttttgtctgcca

SEQ ID NO: 6852823 - DNA, 94 bp, Homo sapiens
aaggaagaagtgattgaagggctctttgtattttggaatcaatgtatgcaacatatgactcatgataacaaaagctaccagttttttttttttt

SEQ ID NO: 6852824 - DNA, 67 bp, Homo sapiens
catacctggatatcattcattctcctcaaaagaaggagaatccactcaaaatgaacatcaggatgtg

SEQ ID NO: 6852825 - DNA, 65 bp, Homo sapiens
tgaggccctgctctgaataaccatccaatctgcaggtgtttattgcagccgcagggcgctgctca

SEQ ID NO: 6852826 - DNA, 92 bp, Homo sapiens
ggacagtggtattccttttagctgacattcttggagtcagccaaccaaatctgggctagcagagaggtttcagctaatgtaccaatttgtcc

SEQ ID NO: 6852827 - DNA, 66 bp, Homo sapiens
tggctccatcatccatgcaagatcatgctccctgctctgcattctcttgcatggtgatggctgcca

SEQ ID NO: 6852828 - DNA, 65 bp, Homo sapiens
ccttacagtttaacactttggagaaaaagttcacattttcttttctttggaattgggctgcaagg

SEQ ID NO: 6852829 - DNA, 60 bp, Homo sapiens
ggagctcccaggccccagcaaggattttgattaacaggaccttatgggctgggtgctgcc

SEQ ID NO: 6852830 - DNA, 79 bp, Homo sapiens
ggggaaacattagaagaaagtgaagctggggactgaggtgggtcccatctccccagcttgctacttctgctccatcccc

SEQ ID NO: 6852831 - DNA, 64 bp, Homo sapiens
cttctttcactctttaacttcctgccattggccaaatccacctggaagccagaggggaaaggag

SEQ ID NO: 6852832 - DNA, 60 bp, Homo sapiens
gcctcggtttcttcatctttcacattcttggagggttgctgagatgaatagagacctcgc

SEQ ID NO: 6852833 - DNA, 79 bp, Homo sapiens
ggctcagatcctcagccggcgggaagttcttgcccactttcataaagagggctgcaatcttattgctgcgtaggaagcc

SEQ ID NO: 6852834 - DNA, 60 bp, Homo sapiens
agtgacaggggaggcaggtgtggcaagacagcgatgtgagcatttggtgccctgtctgct

SEQ ID NO: 6852835 - DNA, 59 bp, Homo sapiens
agggaggaaggatgttccaaagtgtccagactgtgcgatttaatttccttcacctccct

SEQ ID NO: 6852836 - DNA, 56 bp, Homo sapiens
aggtgacaggctgtgatggccgggagtggacattccttgtaagcaggcttgaatct

SEQ ID NO: 6852837 - DNA, 70 bp, Homo sapiens
ctcagagataatgggcccaaaggagctgagaaaagattttcttgccacttaaaggcactatcaatttgag

SEQ ID NO: 6852838 - DNA, 78 bp, Homo sapiens
gaacttcctttcagaggggcgtacacagcaccgcggccgtgtgcctgtgatctccttctgagtttgaaaaagaagatc

SEQ ID NO: 6852839 - DNA, 82 bp, Homo sapiens
attgctggaagaagcaggtcttgctctcaacaggcatatgaattatcttcctgtaccaagcacctgcatagcttcaggggat

SEQ ID NO: 6852840 - DNA, 99 bp, Homo sapiens
gtttggtgtgtgacaaagagttggcagttgaaactttttttatgtattaacatgcaaaaatgttatctactgtccgaactattccacaacataccaaat

SEQ ID NO: 6852841 - DNA, 65 bp, Homo sapiens
gctgggtctgtacacattgtgatgttattattagccaagactctagctatgtttatatatccagt

SEQ ID NO: 6852842 - DNA, 104 bp, Homo sapiens
gcctgggagttgggaaactggatttggtagaggctcggtgttatgggttgaattgtgatgccgcccccctgccaaaaagatacgttagaatcccagcccccggt

SEQ ID NO: 6852843 - DNA, 64 bp, Homo sapiens
gactgtacttgagagaggaactgcactagttcagcagtagatggtcttagcttaagtcatggtc

SEQ ID NO: 6852844 - DNA, 69 bp, Homo sapiens
gctcatcaccacatataacaaaggtattggatttccaaggcaaactttgcttgaattcttgggaagagc

SEQ ID NO: 6852845 - DNA, 75 bp, Homo sapiens
gagcaaatgtacaatagtccctgtttggatgcaccatactttattcaagttcactactgttggacatttatgttc

SEQ ID NO: 6852846 - DNA, 100 bp, Homo sapiens
actgttgccagtgaatcttgactactcttgtgcctgatgcgaccgtgagtctgcgtatctctgttttaggagatagtgaatgaaactgggaaccaacagt

SEQ ID NO: 6852847 - DNA, 69 bp, Homo sapiens
gagaaataggcaatggtatctaaaagcggaatgaggggttttggagaggatggctatgctctggttctt

SEQ ID NO: 6852848 - DNA, 68 bp, Homo sapiens
gcagagaccatgattcacccaccactgtatcttcgggacctacagtagtgctcaatcagtgtttttgt

SEQ ID NO: 6852849 - DNA, 84 bp, Homo sapiens
gaagaaattaaatgacaggggaagatgataataatggagaccagactgcaatgatggctgtttgttccttcatttaattccttc

SEQ ID NO: 6852850 - DNA, 120 bp, Homo sapiens
ctaaagagtatgcgtcactctgtaagtagaggcacccacatactattcattgattcaacaaattaattcaacaaatatgtattgagtgccaactgtgctaggctttgaagcaacatttag

SEQ ID NO: 6852851 - DNA, 72 bp, Homo sapiens
gggagatggctctggcaaggggaggctacttttccattggctggtatttcctcgcttgtgggattcattccc

SEQ ID NO: 6852852 - DNA, 81 bp, Homo sapiens
gatcctatagaccagtttaggtactaggctctaggttacaaccctagaaggttggtactaagccagggttttgtaggcatt

SEQ ID NO: 6852853 - DNA, 69 bp, Homo sapiens
aggcttgttctggggagatttgttttggaacttcaactctgttctgaagaattcctaggaactaagctt

SEQ ID NO: 6852854 - DNA, 62 bp, Homo sapiens
gggtgattgagcaaaggaacagaaaaattcacatgattttattgctcctggtttcatcactc

SEQ ID NO: 6852855 - DNA, 61 bp, Homo sapiens
ggctggatcccatgctgcaaggcgagggcaaaggctttaggctgcagcagggatggaggct

SEQ ID NO: 6852856 - DNA, 57 bp, Homo sapiens
gctgggtctggtgtcaggcgacgtggatcacatcatttcacctgtctcagcctcagt

SEQ ID NO: 6852857 - DNA, 57 bp, Homo sapiens
tgtccaggcggccttgcctgttgaacatatcgcttgaccagcactgcttcctggata

SEQ ID NO: 6852858 - DNA, 103 bp, Homo sapiens
ggtcttagttctctttattagaattgtttctatttgccaaagtaactcaagcacttggaacaaattaaacaatacagggatagataaagagaaatgtagcatc

SEQ ID NO: 6852859 - DNA, 69 bp, Homo sapiens
ccaatatgcctctccccacttttgttaagctgggccctgtgtgaccagtgtgggcagcaggcatactgg

SEQ ID NO: 6852860 - DNA, 61 bp, Homo sapiens
gaacagggaaccacagcggtgctacctcaccaatttttacagctgtggtttgtttctgttc

SEQ ID NO: 6852861 - DNA, 79 bp, Homo sapiens
cagcactccactcgacatcattgtccgttgtcatgacaccaagttacagcatttgatcaatggttcctgtgccatgttg

SEQ ID NO: 6852862 - DNA, 59 bp, Homo sapiens
agctctgcaggagcaaagcctctgctcgtcagagatagagctgctttgcctgctctgtt

SEQ ID NO: 6852863 - DNA, 85 bp, Homo sapiens
cagatgcgtctctccttcttgtgccaagtgaccctgctccttccccgcaaggagcacctggtctcctggcgctggaggaggtctg

SEQ ID NO: 6852864 - DNA, 66 bp, Homo sapiens
ttgtagagtaaatagtatgagaaaggacatggttggatatgtattttttctacatttactctataa

SEQ ID NO: 6852865 - DNA, 127 bp, Homo sapiens
tatttgctgagcaaggactttccagctaggattggataaagcagtagctaggttcgagagtaagagttttattgctatcatttagagtatttcttcattcgttcatgcatgcctttgctcataaata

SEQ ID NO: 6852866 - DNA, 122 bp, Homo sapiens
cacctcttatgattaattaaccttttgtggagtaactaggacatctgtgtgggatgagatgtactttggtcagacttcagtttttagttgttcagcaagaggataattaattataagagctg

SEQ ID NO: 6852867 - DNA, 68 bp, Homo sapiens
gggacaggtgccagggtcagctgcagctctccttccgggagcagggtgtggtggccctggatggtccc

SEQ ID NO: 6852868 - DNA, 82 bp, Homo sapiens
ctgggttgcttatttaaaatgtaggttgggacttagagggtgcagcagttcccatcctagacctactgaatcagactctcag

SEQ ID NO: 6852869 - DNA, 64 bp, Homo sapiens
tcacaaatcgaagccttataattgacttcaaaatttttgttaagccatatgaggcagtttgtga

SEQ ID NO: 6852870 - DNA, 58 bp, Homo sapiens
ccagatgtgagcagagccttgacacacagccgcttccaggagctcgtgctcagcctgg

SEQ ID NO: 6852871 - DNA, 67 bp, Homo sapiens
ccaagttgtggctgtgcaccgctgcctgggtatcacttccagggggatgggcctgctacctccttgg

SEQ ID NO: 6852872 - DNA, 130 bp, Homo sapiens
gaatcaacaatgactttttggagtgaatgaaatggtttagcaaacaaatgaaatggttttagcaaacaaaacatttgtcttgtttctcaaccctcatttattgtttcctgttcttgtttgaattttattt

SEQ ID NO: 6852873 - DNA, 74 bp, Homo sapiens
atggtatactgttttaaaaggtacttgtctaaaactttaagttggagaagcatcttggaagtcattagatccat

SEQ ID NO: 6852874 - DNA, 66 bp, Homo sapiens
gagacttgtctgattgccattctctatatgataacttcatatacctgaagttggtaattaagtttc

SEQ ID NO: 6852875 - DNA, 72 bp, Homo sapiens
gtccaagggcaggagaagacggatatcccagctccagcagagtgagaagttgctctttttctgcctttttgc

SEQ ID NO: 6852876 - DNA, 72 bp, Homo sapiens
gcccaagacatttagtaaagagaattgggtttgaggtttgatcatgctacttctgaactgtgtgaattgggc

SEQ ID NO: 6852877 - DNA, 64 bp, Homo sapiens
ctttatccaccttaccctgttccacctaagagagaaaaatggtgggtggggaggatgggaagag

SEQ ID NO: 6852878 - DNA, 65 bp, Homo sapiens
tctgttagtcttttgcaggagagtaaaaaggtaatttacaactccagtactcaaatgacagcaga

SEQ ID NO: 6852879 - DNA, 61 bp, Homo sapiens
gcactcaggttacctccctttgtaagcaagtgcctcttttgatcaaagcaggtgacagtgt

SEQ ID NO: 6852880 - DNA, 70 bp, Homo sapiens
ggagagataggagtcctggactaatgtggctatttactcaccccctcagtaattcaggctctttctttct

SEQ ID NO: 6852881 - DNA, 73 bp, Homo sapiens
cagagacccaccttgccttacagtgtcttgatagtggagccacaccaagctactcaggcaagatgtgtcactg

SEQ ID NO: 6852882 - DNA, 70 bp, Homo sapiens
gaaatgttaaaatgcagattctgattcagtagattctaggtgaggctgaaattctgcatttctaacaagc

SEQ ID NO: 6852883 - DNA, 60 bp, Homo sapiens
tcctgagaaggcacagcttgcacgtgacctcctgggcctggcggctgtgtcttcacagga

SEQ ID NO: 6852884 - DNA, 59 bp, Homo sapiens
gcctggtgattcactctataatgaggcagaacacaatgtctcgagtcaagacactaggc

SEQ ID NO: 6852885 - DNA, 60 bp, Homo sapiens
ctgtttatctctaacctgtttattgaccctgtgtttataggcaggactcagatatgacag

SEQ ID NO: 6852886 - DNA, 71 bp, Homo sapiens
gtcagtattgaactttcagttaaagcaacctgtttttcacacaggcagctttaactggtagtagaaatggc

SEQ ID NO: 6852887 - DNA, 71 bp, Homo sapiens
cacccaggacatgggcacccgtgacgatgtccccgaaggtaaggggcaccatgggaggcctgctgctggtg

SEQ ID NO: 6852888 - DNA, 58 bp, Homo sapiens
gtgccagcagtatacagcaggtgttcaataaaggacaactgtcagtatattgttacat

SEQ ID NO: 6852889 - DNA, 70 bp, Homo sapiens
aagatatgaggtcacctgctgggctctttcctgtgtatctgagtatagctggcaggtcatttgatatctt

SEQ ID NO: 6852890 - DNA, 97 bp, Homo sapiens
tttctctgtgtactaactttgttttattaagttttgggttttattttaaatgtgctcaaagcataagacatctaaagtagttagtgggcgtgaggaa

SEQ ID NO: 6852891 - DNA, 78 bp, Homo sapiens
cctgcaaactacatttcccagctgccttcctgttagagtcagccaagagggggcactgggaggagatggaaaagcagg

SEQ ID NO: 6852892 - DNA, 84 bp, Homo sapiens
gaaatatgtgaaaagtgattttttttcagaggttgtatcacagactcaagttttagagtaagaattactgtttaacaaaatttc

SEQ ID NO: 6852893 - DNA, 63 bp, Homo sapiens
agtgctaaagggttatgaacaagacaatattgaagttggtttcttcatagtctttttagcatt

SEQ ID NO: 6852894 - DNA, 56 bp, Homo sapiens
tcatgttgccagagcttttcaatattcctcaactttggaaatgctaggctacatga

SEQ ID NO: 6852895 - DNA, 66 bp, Homo sapiens
gagaatgtggagcctgtggttgccaatccaagttcaacagcttcaaagcccagtttccaaattttc

SEQ ID NO: 6852896 - DNA, 93 bp, Homo sapiens
taagaagacagggctccaaggaagtgtagctatttgtccaaagtcacaataccattcagtggctaagctgtgacttggacccgagtctgatta

SEQ ID NO: 6852897 - DNA, 74 bp, Homo sapiens
tctcacaaccggaccatcctgccagcctctgttcccgccaaggagtctgaagccagtggtagtccggccagaga

SEQ ID NO: 6852898 - DNA, 76 bp, Homo sapiens
gcctgggactgactgggaggctctgaccatttacccaccacaggtaggttgtgttctgagcctcaggttcacaggt

SEQ ID NO: 6852899 - DNA, 62 bp, Homo sapiens
tggctcatctttttagacttatcgaaaccatatagcaggaggatggtctttgaggtgaacca

SEQ ID NO: 6852900 - DNA, 70 bp, Homo sapiens
ttttagcctgggctaggctgagggcatttccattacctgaaatggaaatccgtcattggcctggttggag

SEQ ID NO: 6852901 - DNA, 60 bp, Homo sapiens
gggaaatctcgtcctctatttacccttcgttttgaagatgggtgcaatgacatgattccc

SEQ ID NO: 6852902 - DNA, 78 bp, Homo sapiens
aggcgcaggcatgtctctgctgtcattgcctccctctctcttgctccgggccccctcagcacaggcctgtctttgtct

SEQ ID NO: 6852903 - DNA, 64 bp, Homo sapiens
ggcgccgggcaaggcgagactaggcccccgcggagcgggggaagcacagaccccagcccgggcc

SEQ ID NO: 6852904 - DNA, 84 bp, Homo sapiens
gtaggaagtgggtattcttgcagcttctaacagcttcagcaactttgttgttcaaagccagagctgcaagacaccttatctcac

SEQ ID NO: 6852905 - DNA, 64 bp, Homo sapiens
tccctgtatggtccttcctgaccagccaggtccaacagtgcatctgggtcggaagccccaggga

SEQ ID NO: 6852906 - DNA, 74 bp, Homo sapiens
cttcacaggaaggcaggagcagcaccacctgaggctttttccctccagaggggcagccctgtgctttggtgagg

SEQ ID NO: 6852907 - DNA, 65 bp, Homo sapiens
ggaggtctgttttgatgccacctctcttcatatgtgctcgggaggtggcctgaaaatgtggccct

SEQ ID NO: 6852908 - DNA, 62 bp, Homo sapiens
gcaaacctgtccttttgtctccttaggcattttcttgaagtgggattgctggatgggcatgc

SEQ ID NO: 6852909 - DNA, 72 bp, Homo sapiens
ccagcctgacctgctccaggaaagcctgaggcccggaggtccctgggaagggagtttcttggagtgggctgg

SEQ ID NO: 6852910 - DNA, 56 bp, Homo sapiens
aacaggtgagggagctttgtgcctggtagactccttggccttgggtttcgcctgtt

SEQ ID NO: 6852911 - DNA, 69 bp, Homo sapiens
tgataatatctaagatgtattgagcacttgctttctgcctggcaatgttctaagcacttagattcatca

SEQ ID NO: 6852912 - DNA, 117 bp, Homo sapiens
gggtggtagatatggattctacactacagggccgggatggaagcaaagggctcctctccttaccacctcccactcccaggctccagtccagagtctgtaaggattttctgcccaccc

SEQ ID NO: 6852913 - DNA, 57 bp, Homo sapiens
tcagggagaggtgagagcctgtgaaggcggctcttcacatgtctctaatctcagtga

SEQ ID NO: 6852914 - DNA, 62 bp, Homo sapiens
gattgtaattttcaagaggtaaggagtttaaactcatgacctagtttttgagaattttaatc

SEQ ID NO: 6852915 - DNA, 59 bp, Homo sapiens
tcagtcctcacttggttctaaggtttgaccatcaaactttgagcttgcatgagccttga

SEQ ID NO: 6852916 - DNA, 56 bp, Homo sapiens
gagagaagggggatatgagcctgacatccagccccatgcattcctcccctttcctc

SEQ ID NO: 6852917 - DNA, 64 bp, Homo sapiens
tatttgctttgctttatagagattgaccattggccttatttggttactctgttcaaagcaagta

SEQ ID NO: 6852918 - DNA, 55 bp, Homo sapiens
gaaatggatcagagcaagctttttttggtcattcatcagtcttctgatccatttt

SEQ ID NO: 6852919 - DNA, 71 bp, Homo sapiens
ccttgtcttgggtagttgtgaggaagtgaggagagaggagagcttgtgtctcacagcgatctaggaagagg

SEQ ID NO: 6852920 - DNA, 79 bp, Homo sapiens
aaaggcagcaggtgcatttggtgactctcaccctgtatgttaatatgcgggggagttaaattcaagtgcacccgtcttt

SEQ ID NO: 6852921 - DNA, 68 bp, Homo sapiens
tcagtgaattgggcctagaatgaacaggacttggcagcagtcctggactcaggaccacaggacaccga

SEQ ID NO: 6852922 - DNA, 58 bp, Homo sapiens
cctcagagcagcacccagatgacgaagtcaccattctgagatgctgctggttttgggg

SEQ ID NO: 6852923 - DNA, 66 bp, Homo sapiens
ggggccagctggttcagtgtctggtgagggcctgttcctcactgatggcactggataggtatcctc

SEQ ID NO: 6852924 - DNA, 94 bp, Homo sapiens
ggcaggtgtgccgtcccagccatggtcctgttgccacagagctgcaacggcctcagactgggcttaggacctggtgcggagcaggacattggcc

SEQ ID NO: 6852925 - DNA, 81 bp, Homo sapiens
cagccttagcaatctgggtgaccctgggcaaggcctatcccctctctgggcctttgtttctccacctgtgcaatgaggctg

SEQ ID NO: 6852926 - DNA, 66 bp, Homo sapiens
gccaggaaaatgtgacagtgtttgacagatgctcagctgggctttccccaggcattgcattctggc

SEQ ID NO: 6852927 - DNA, 129 bp, Homo sapiens
acttggtaaccagcatgatcttctaacgctagttttacccttgtcagcactttgccgaaaacctcaaataaagacttttttaaaaatgtgcgatggaaaactaaagttataaattatatcataaccatt

SEQ ID NO: 6852928 - DNA, 90 bp, Homo sapiens
cttgcttgctttttgtttctctcaaagtttctcatggtatgtttttacccagaccacatagactgtgagggagatacagggggaaggaag

SEQ ID NO: 6852929 - DNA, 107 bp, Homo sapiens
cacttaaaattaatctcttctcaggaaaactgtatttgaataacttggggcaactactaatgttttctgggtgaatgggttttcagagctgctggattgtgtgtgtg

SEQ ID NO: 6852930 - DNA, 69 bp, Homo sapiens
tcctcattctggagtatgtgtgaacggtgagctccctgtctctgccccactttgctcctagagggggga

SEQ ID NO: 6852931 - DNA, 130 bp, Homo sapiens
tttatgttcttctctttacttcctaaagaatggtagatgcatttcaaacatcctgacatcttggctgctgaggattctgtatggaaaagcactatgaggtctttaatgcttggttggaaggagaactaaa

SEQ ID NO: 6852932 - DNA, 61 bp, Homo sapiens
acttactaggtttctcccttgtgctaggatttttgctcaagcctgggagacactaagttgt

SEQ ID NO: 6852933 - DNA, 74 bp, Homo sapiens
gctggctggaactagcagttggcaggggattagataagggtggtgtcaagaatgacggctggattcctgcctgc

SEQ ID NO: 6852934 - DNA, 55 bp, Homo sapiens
ggggttttgggaggcctggtaaattacaccccctaccctgggttctccataccct

SEQ ID NO: 6852935 - DNA, 61 bp, Homo sapiens
gctgtcatagagtgggtgggcctctgatatttatgtggctgatttcatgtactctgacagt

SEQ ID NO: 6852936 - DNA, 64 bp, Homo sapiens
aatcctcggaagcctgaagattttaaccttgttgaatggcttctaggttctcccttaaaggatt

SEQ ID NO: 6852937 - DNA, 56 bp, Homo sapiens
cctgagctttgattcaatggccacacaggattgggggaaagaaggcaaggctcagg

SEQ ID NO: 6852938 - DNA, 60 bp, Homo sapiens
aagtacattatatgagcagaatgaaacatgttccaaaatattttgcttgtaagtgtagtt

SEQ ID NO: 6852939 - DNA, 56 bp, Homo sapiens
gacatgagtatcagagtccttccatatgagtgagaggaaggcttcttggctcagtc

SEQ ID NO: 6852940 - DNA, 101 bp, Homo sapiens
aggcacttctgcattgggctgggtctgtctcaggattgtccagacaaaggatatgggcatatttccaggagaccagatgtaggcccaatgtgagatagcct

SEQ ID NO: 6852941 - DNA, 58 bp, Homo sapiens
tgggttttccatctatttactcaggtgattgtacacttgggagaggagggaacaccca

SEQ ID NO: 6852942 - DNA, 60 bp, Homo sapiens
gagtcactgggtgacttttggaggtagcaacaagctcatgaagaaggcattcagtggctt

SEQ ID NO: 6852943 - DNA, 86 bp, Homo sapiens
gataattggattctcataattgctcctgtattcaagctgttgcaatatgttgttttggtttaagtatatgaagaaaatccattatc

SEQ ID NO: 6852944 - DNA, 76 bp, Homo sapiens
gtagacagttgatatatgggtctggagttaagggcaagatcaagactggagataaaaccatgagtcatctgagtat

SEQ ID NO: 6852945 - DNA, 57 bp, Homo sapiens
ccctggggagcaggcgaaggaggagctgcagccaccacgtcctctctttccccaggg

SEQ ID NO: 6852946 - DNA, 65 bp, Homo sapiens
acaggactaactggaggcggggtcaaagctgtaataccacactcctacttccagtttagtattgt

SEQ ID NO: 6852947 - DNA, 72 bp, Homo sapiens
gttgggagggtcatagtttttcttactgatgatttaaagtgtttctgtattaaaggcagtgatctttttagc

SEQ ID NO: 6852948 - DNA, 67 bp, Homo sapiens
cctgcagttgcctggtcagtggatcccatgtgcagagggcgagacggggccctggccaggcgttggg

SEQ ID NO: 6852949 - DNA, 76 bp, Homo sapiens
gaagtgaacacggaaagcgttacagtcatggccttctttctcataaatgactctgaattggctgcgtgtttaagtc

SEQ ID NO: 6852950 - DNA, 67 bp, Homo sapiens
ttgagaactagcatggtctatcagtttgaatgctttcagctgcaagtaatagaacctgcagtttcaa

SEQ ID NO: 6852951 - DNA, 129 bp, Homo sapiens
gttttatttaacatttcttataaataatttgtgttttactgagaaatttccagacttgcagcagactgtattttggtgtaaggaaatgtcaagtagctaataatacactgtagagatgtattttggggc

SEQ ID NO: 6852952 - DNA, 59 bp, Homo sapiens
ggccggggcaggggcagagactgtccagaccaggttgaactccagcccctgccctggtc

SEQ ID NO: 6852953 - DNA, 76 bp, Homo sapiens
gccctgcgagcttggaggggtgcgcggtccgcgcaaaagtgcgcgccggggctgcacgcctctcagcttgcggggc

SEQ ID NO: 6852954 - DNA, 66 bp, Homo sapiens
aggcctttttgcagtagacatcttattttccacttttaagaccaagatttttgttgcaataggcct

SEQ ID NO: 6852955 - DNA, 67 bp, Homo sapiens
acagctctgcatggcagttatttcatcaattacttaccaagcaatgaaacggctgctttggggttgt

SEQ ID NO: 6852956 - DNA, 88 bp, Homo sapiens
gggagcttcagatgcactgtgagagtgaggggtgtttcaggctgctgtcggcacgctgccctttctggcctcgcagtgagaagctgcc

SEQ ID NO: 6852957 - DNA, 59 bp, Homo sapiens
ctggagggtggagagaagtctcagctgcccactcaggaagtcacttcccacccctccag

SEQ ID NO: 6852958 - DNA, 72 bp, Homo sapiens
tgggagtccgtgcctttagtttcttctgtagcatgagccacaggacaaaaatctggatggcaagtgttccca

SEQ ID NO: 6852959 - DNA, 77 bp, Homo sapiens
atgcagacatttcaaatagaatctttccaaagtactgctttttttggattttttttggctttgattttgtattgtat

SEQ ID NO: 6852960 - DNA, 108 bp, Homo sapiens
aagtcacagcgtatctgtcccgtgaaacaaatatgtgatatctaggaatttaaaataaagatgttacatttctctttcttggacaatgaacagaaatttctgtgactt

SEQ ID NO: 6852961 - DNA, 60 bp, Homo sapiens
gtgtgtgtgtgtgtgtgtgtgtgtgtgtgtgtgtgtgtgtatacatgtgtgcatacgtgt

SEQ ID NO: 6852962 - DNA, 69 bp, Homo sapiens
tggtcttattcttggatctgagtctctgagtttcagctcagctgcagtaaagctctccagggcacgcca

SEQ ID NO: 6852963 - DNA, 88 bp, Homo sapiens
aagtgcccatatctgtacaaacttaagatgttcagataatttggaggcattgttaactgtttttctggatatcagtgcatgggcactt

SEQ ID NO: 6852964 - DNA, 58 bp, Homo sapiens
tacaaaggcaggtttcccaggagaaatttataggaagtagtctggggtgtgctgtgta

SEQ ID NO: 6852965 - DNA, 74 bp, Homo sapiens
actgtaaaattttcatgtaaattgtactgacacacgcccagtagtgtttgttgtgcaggtttattaagtacagt

SEQ ID NO: 6852966 - DNA, 58 bp, Homo sapiens
cgggcagctgccaagtgcatcgcagccttgatcagctcgcggcctgacctgctgcccg

SEQ ID NO: 6852967 - DNA, 60 bp, Homo sapiens
ccagagaaaaatgtgtccctgtgtaggcaactgccctgaggaatgtattattccttctgg

SEQ ID NO: 6852968 - DNA, 74 bp, Homo sapiens
tgagcacttcctgccatgggctgtcctgctacaacggctctaaagctcccttggccacagtccatgcatgccca

SEQ ID NO: 6852969 - DNA, 81 bp, Homo sapiens
gagtatgacatgcttaagggaagtagagaagagtctgcatttctgtagtctccttaaatatttcccagagcaaacttactc

SEQ ID NO: 6852970 - DNA, 117 bp, Homo sapiens
aaagggccttgaatgattttttgttcattttctgtttacatgtaatgtgttattgatgtcattaccttataatacggcagcttgtttcatagaaaaaccaggaattattcattcttt

SEQ ID NO: 6852971 - DNA, 130 bp, Homo sapiens
ggccccttaaagattgggaatttggggagtaactgatgctaactgggcaggtaggccatgggtcttttcaggtattacttgggcccacgttaaaagtccttctcatagatacatttttccttttggggcc

SEQ ID NO: 6852972 - DNA, 95 bp, Homo sapiens
tggattttttcctgggaaaacagagaactactttttatatgtgtatctttttatgcaattagcattgtattcttagttcagggaaaatatatcca

SEQ ID NO: 6852973 - DNA, 67 bp, Homo sapiens
ttgagggttactcctgactgtgttaactagaatctctagtttgtcacatgcaggcagtggccttcaa

SEQ ID NO: 6852974 - DNA, 61 bp, Homo sapiens
gccaaggtgctccaggtcgctcagagagtcttcaggattcctgagtcgccgagtctatggc

SEQ ID NO: 6852975 - DNA, 89 bp, Homo sapiens
gtgcctctgagtccttggactcatgatcacttcggggtttcctaaaggcaattttgtgcagtggttaagaccatgggctctggaggcac

SEQ ID NO: 6852976 - DNA, 58 bp, Homo sapiens
agacccagggtttgagctctgcaggaatggccgactccttgtggtttgagcctgggct

SEQ ID NO: 6852977 - DNA, 61 bp, Homo sapiens
gctcatggccaaagtcaggagtgtgcatcttctgagcgcagtgggaaggttggcacatggt

SEQ ID NO: 6852978 - DNA, 109 bp, Homo sapiens
tcaagcccattattaacactacagatatgtttaatgcctcagtatttgcacgtttgcaaaagctgtgtcctagaggtgtaaatggtagtgctaaattacattggcttga

SEQ ID NO: 6852979 - DNA, 97 bp, Homo sapiens
gagaggtgaagtcatttgctgaaggttcatattactgctgaatgtcagagtcaggatttaaactcagacaaatctgatttcaaaagtattccctttc

SEQ ID NO: 6852980 - DNA, 89 bp, Homo sapiens
gccaatgcattagatgaagcttagaagggcattttctaaccattacaaattgcctagtctagcatctcaatttcatctacgtgaagagc

SEQ ID NO: 6852981 - DNA, 60 bp, Homo sapiens
cacaggggacaggaagatggtagtggatggcttccttcccaccctccactgttcactgtg

SEQ ID NO: 6852982 - DNA, 117 bp, Homo sapiens
aaaaatattcaaagagtggatagctttgcataaatgcttaaaatttgtatacaataaacccaaatatatacttttttgatactttgtggctagttactttaattgtgaaatattttt

SEQ ID NO: 6852983 - DNA, 60 bp, Homo sapiens
aggtatcatccagctaagttacatatggtttccatattagcttgtttggcaggatgacct

SEQ ID NO: 6852984 - DNA, 65 bp, Homo sapiens
ctgctctaactgcattagtttttctagacttttttctattgtggattaagaagttggaaatgcag

SEQ ID NO: 6852985 - DNA, 68 bp, Homo sapiens
tgattctcttccttttttcctctgggcggttagtactgcatgcaggaggagggaataagaaagagtca

SEQ ID NO: 6852986 - DNA, 71 bp, Homo sapiens
gaggactgaggagcggggtcaccttgagtaactattctactgaatggggagtgctcctctccccagtgccc

SEQ ID NO: 6852987 - DNA, 101 bp, Homo sapiens
tgagacggagtcttgctctgtcacccaggctggagtgcagtggcttgatctcggctcactgcaaccttcgcctcccgggttcaagtgattctcctgcctca

SEQ ID NO: 6852988 - DNA, 97 bp, Homo sapiens
ggttacacgattatgttaatttactaaaaaccattgcatcgtatactttaaagggtggactgcatggtttgtgaattataccttaataaagtagtcc

SEQ ID NO: 6852989 - DNA, 65 bp, Homo sapiens
ctgaggctggttcccttgatctttcctgaccccagttttgggaggagacagtggagccgctacag

SEQ ID NO: 6852990 - DNA, 69 bp, Homo sapiens
gcaggggatgctaataaaatgcaggattttggacactgagcaaggtaagagtctgcctttttctcctgc

SEQ ID NO: 6852991 - DNA, 72 bp, Homo sapiens
agaagcagtgccattttgtgatagtttttgatgctccaaatctgaattaatacacagaatggcattcatttt

SEQ ID NO: 6852992 - DNA, 62 bp, Homo sapiens
tattaggttagtgcaaaagttttaatggcaacaaccacagttacttttgcaccaatttaata

SEQ ID NO: 6852993 - DNA, 85 bp, Homo sapiens
tgcaattctcacttgttgtgatttagtttaatctgttttctttggttccaagtataagccaaaatcaggacacagagaaggggca

SEQ ID NO: 6852994 - DNA, 55 bp, Homo sapiens
gctccctgaagagatttggtctttataggtttgacattcagatctttgcgggggt

SEQ ID NO: 6852995 - DNA, 59 bp, Homo sapiens
gtcccagccacttgggagactgaggtgggaggatcacctgagcctagggaggttgaggc

SEQ ID NO: 6852996 - DNA, 60 bp, Homo sapiens
attggggtttatttttatccagattatttttattaattgtacaaaaaagtagaccttggt

SEQ ID NO: 6852997 - DNA, 68 bp, Homo sapiens
tgccaacttctccatgcctcagtttctcagctgtaaaatgaactccactgagtggctggggagtggca

SEQ ID NO: 6852998 - DNA, 61 bp, Homo sapiens
aagttatgaaatttggacagcttggaaatgctgattccaagctgtccaaatttcataactt

SEQ ID NO: 6852999 - DNA, 55 bp, Homo sapiens
gaggcactggaggaaaggagaagccaggggattcctctctcttcccctctacctc

SEQ ID NO: 6853000 - DNA, 63 bp, Homo sapiens
tttttaacccaatcattgtttcagcatgcatcatttgtcaaatgctatgtttggtgttggaga

SEQ ID NO: 6853001 - DNA, 71 bp, Homo sapiens
aaacagtgatgttgagtgtaaaagcttgcacttgaaataagcacatgaaaaaatgctcaacatcattattt

SEQ ID NO: 6853002 - DNA, 73 bp, Homo sapiens
taggtcagaacaagcagtatcgttgacattctgaaacaccagccatgtcccagacactgcttactctgaccta

SEQ ID NO: 6853003 - DNA, 71 bp, Homo sapiens
gcccagcctggctccaggaggctcccgcgtctgccatgcaggcgttcttccttttgggaggaggcatgggc

SEQ ID NO: 6853004 - DNA, 125 bp, Homo sapiens
gagattaagaaaaaaaaattctatttttgttgtaatgtcctcgcggctctggggacgctaaaagaaccgggcctgccccgccctgcgcggggataacgaaagctgagtgtttttccctttttttt

SEQ ID NO: 6853005 - DNA, 60 bp, Homo sapiens
acatgaacatgctcaaataactcgaggctcacgtgccaaagtgtgtgtgtgtgtgtgtgt

SEQ ID NO: 6853006 - DNA, 68 bp, Homo sapiens
atgtacacgtgtcctcacacgtagggagtaatttttttaaattctctcaaaagtagaggacatgacat

SEQ ID NO: 6853007 - DNA, 56 bp, Homo sapiens
tcctttctgactcctgatattatgaatagagatgatgcagcagagtaagcagggga

SEQ ID NO: 6853008 - DNA, 73 bp, Homo sapiens
ggcaggtttgaaattatgataaatctgctacatattcattctatgagcaggtttaaactctaatgcatctgcc

SEQ ID NO: 6853009 - DNA, 80 bp, Homo sapiens
tccccctctctaatccttgctatctgggtgctagtgctggctcaatgcaatgcacctgggcaaggattcagagaggggga

SEQ ID NO: 6853010 - DNA, 91 bp, Homo sapiens
gatggcgtcattgtacaatcctcacattccatgagcttctggctttccataaacaaggcaagaacagacatgggagtgggcacaggctatt

SEQ ID NO: 6853011 - DNA, 70 bp, Homo sapiens
gagccaagggcgtgctggagaggcctgagagaagaaggaacggcccttctgaccagtgcccttttggttc

SEQ ID NO: 6853012 - DNA, 60 bp, Homo sapiens
aaggtgagcctcaagtgacctttgcccacttgggatcgggtttccttctggctcctcctt

SEQ ID NO: 6853013 - DNA, 61 bp, Homo sapiens
caggagtctgttcctcatttgtattctaaaccaggtcatggtggggagtcaggcattcttg

SEQ ID NO: 6853014 - DNA, 94 bp, Homo sapiens
tgggattgggagggggcatgacttttggagtgggagcgcagggccctgacctcccattctgccaaggacattgccctcactttcaacagtctca

SEQ ID NO: 6853015 - DNA, 57 bp, Homo sapiens
catgcactgatgcaaggtctgcaggcttagtgagctcggggccgtatggggtgcatg

SEQ ID NO: 6853016 - DNA, 57 bp, Homo sapiens
ggggcagtgaggtggcagcccggaccctctctccttctctgacaaatccactgtcct

SEQ ID NO: 6853017 - DNA, 72 bp, Homo sapiens
atggtccttgtgtcttgtatctgtatttaaaattgctgggaggatacacaagatcagtataataaggaccat

SEQ ID NO: 6853018 - DNA, 130 bp, Homo sapiens
ggtctccaactggtctggattagttaataacgcaagctctgaccatggctttagggttaccaaatccaatgtgtatggaatcttgcgggcacatggcagaggtattgattcttttcaggccctcagggac

SEQ ID NO: 6853019 - DNA, 64 bp, Homo sapiens
gtggcagagaagttgtctttcttgtttgtaactgagtgctcagagcctgaaagacttctggcac

SEQ ID NO: 6853020 - DNA, 62 bp, Homo sapiens
gtgtggtggcagagaacaaggagaggtgctagtcaccattcaactcttctttgtcccttcac

SEQ ID NO: 6853021 - DNA, 73 bp, Homo sapiens
ttcattgaatccagtagctatttatgatactcatgttagtgatatgaggtatgataatagcttgggatatgag

SEQ ID NO: 6853022 - DNA, 64 bp, Homo sapiens
aatttgaaacatagtcaccactgatgagtggacaacctgctatttctttgactggtttcaaatt

SEQ ID NO: 6853023 - DNA, 82 bp, Homo sapiens
gccccttccatcagacctgctgtgagcaacaacctgtggctgtggctgtggctgtgactggcagaggtgtctggggtggggc

SEQ ID NO: 6853024 - DNA, 75 bp, Homo sapiens
gccccagaagtgtcctagagcaggagtctccgagaagtcttggaacagctggggctttgctctgggttctagggt

SEQ ID NO: 6853025 - DNA, 97 bp, Homo sapiens
gacttgaaggctttttcttgccctcttagccatagggaagcatagtctgttacatcgttggctaggagatccgcagcacagagccaaatcagaggtc

SEQ ID NO: 6853026 - DNA, 98 bp, Homo sapiens
ggggggggattgagaggggaagattatacttttgaatatctcaatatttgataatttttaatagtattttttccaggctcagaataatgtcccttctc

SEQ ID NO: 6853027 - DNA, 72 bp, Homo sapiens
tccattcagagtatttctctttggggagagcaggttttcctttttgtccttcccatcaaaatctcttgtgga

SEQ ID NO: 6853028 - DNA, 77 bp, Homo sapiens
ccaattcagttccttgtgcgaattccaagctgaaggcatttagaaaaggagagagcgagaggagagaaattgaatgg

SEQ ID NO: 6853029 - DNA, 65 bp, Homo sapiens
ggagtattgtcagtgcctgcctcatacattggcattatgtatgactggatacatggcaagactct

SEQ ID NO: 6853030 - DNA, 62 bp, Homo sapiens
agggaaggcttttactatttgttaactcacttgagggacataaactgtcaaaagccagccct

SEQ ID NO: 6853031 - DNA, 71 bp, Homo sapiens
ttggctgtagggcattaataatattatgtactattagtgcgttaataacattaataatgccctatagccaa

SEQ ID NO: 6853032 - DNA, 62 bp, Homo sapiens
gtatgactgcagcctttgggctcataaatgccatgctttactgtctggaggctaggtcagcc

SEQ ID NO: 6853033 - DNA, 59 bp, Homo sapiens
gggctaagctcgcccagggccaacaaacgctgagctctccacccgggccggcaaggcct

SEQ ID NO: 6853034 - DNA, 90 bp, Homo sapiens
acttttgagtacgttttgtaagagactttcaggagttgatacaagaagggaaaatgagctcctgggcacctctttcacatgtagtgaagt

SEQ ID NO: 6853035 - DNA, 73 bp, Homo sapiens
gtctgtgggagtcggaacttgtcaggaagacttagtgtagctgtgcttctaaggatgtgctattctcacaggc

SEQ ID NO: 6853036 - DNA, 81 bp, Homo sapiens
gcccatccccacttatcccctgggcctggcgctggacacagccatccagcagaggacaggaaaggggtaggtgtggacggc

SEQ ID NO: 6853037 - DNA, 71 bp, Homo sapiens
ctgtctattgccctcttaggtctgcgcagctctgctgtgagaggctgagcaggtgtaaggaaggctagcag

SEQ ID NO: 6853038 - DNA, 100 bp, Homo sapiens
tggaccaggtgtctgtgtgtatttatgcatgtatgtatgtatgcatgtatgaatatatgcatgtgttggtttatgcatgtgcatgtaggctgcctatcca

SEQ ID NO: 6853039 - DNA, 71 bp, Homo sapiens
gggcctttaggaggtaattaggtcatgagaatggatctctctgaatgagattactgcctttatagaagccc

SEQ ID NO: 6853040 - DNA, 58 bp, Homo sapiens
atttctagaggcagcttctaggtatacataacaacttggatttatggtctcaggaaat

SEQ ID NO: 6853041 - DNA, 82 bp, Homo sapiens
gaaatgaccttggtttaattacctgcatctcaatgagtgaatctacatagaaagtgaaggttaattaatgaaggatcgtttc

SEQ ID NO: 6853042 - DNA, 58 bp, Homo sapiens
gcagtgtgtttatccggccacaccctgaggtcagggctgcttgctggagacagactgc

SEQ ID NO: 6853043 - DNA, 93 bp, Homo sapiens
ttggtattcagagtttggggattttggaattgctcataagagagaacatgagtctgtctcagtcaatttcaccactaaataaatgagtttcag

SEQ ID NO: 6853044 - DNA, 94 bp, Homo sapiens
aacagacatatccttgggcctggggtagtgtcggacaaagcaccttgtaactctctttctctgaatttcccaaggctatctggggtatgtggtt

SEQ ID NO: 6853045 - DNA, 91 bp, Homo sapiens
tttttctcacctgcatctctgaacagtacttttcacccattctccacccagatatgggtcatgtgatgttcaaaggatggggaatgaaaga

SEQ ID NO: 6853046 - DNA, 55 bp, Homo sapiens
agggatacttgaagctgggaagctgggatccttcagatgtccaagaagtgcccct

SEQ ID NO: 6853047 - DNA, 74 bp, Homo sapiens
tctgagactgtgatttctctgccacctttactcctgattagggagggtggctcaaagagagcacagagttcagg

SEQ ID NO: 6853048 - DNA, 83 bp, Homo sapiens
tatgtgtcatttttctgtgcataagcaagaatatgcatagccatgcatacacccacacctgtgtacacgagaggttatatata

SEQ ID NO: 6853049 - DNA, 60 bp, Homo sapiens
aagccagatttcagtgggatgaggcaggaaattgctgattattgtcttaaatttggtctt

SEQ ID NO: 6853050 - DNA, 88 bp, Homo sapiens
caattaaaagcatgcgtcaaaagctaatttgttatttttctaatgtgtttaagatttggcattcagtttttacacatgtggttcagtg

SEQ ID NO: 6853051 - DNA, 68 bp, Homo sapiens
cggggtggggatggaacagctgtctgtgcccttcaccaggagcatgcatttccattctcacatccctg

SEQ ID NO: 6853052 - DNA, 74 bp, Homo sapiens
gcagttttacagtccttgtttcggtcagatgtgttccattcaactgctgtttagcaaggctgactaagatgagc

SEQ ID NO: 6853053 - DNA, 58 bp, Homo sapiens
gggcctgactgagagctcctcacatcttccccctgcccggctccttctttcatggccc

SEQ ID NO: 6853054 - DNA, 60 bp, Homo sapiens
gactgtatatacagctcaaggaagtaagccatattatcttttggtagcttatgtgcagtt

SEQ ID NO: 6853055 - DNA, 58 bp, Homo sapiens
gtagtacagtgagacaatgttttccttcttctctgaaaataatgcaatcactgtctat

SEQ ID NO: 6853056 - DNA, 76 bp, Homo sapiens
gtgctttttcagtaattaggttccatctttgatcaagagaaaatcaaagtgaggacttgagtactgtgggagtcac

SEQ ID NO: 6853057 - DNA, 58 bp, Homo sapiens
agcagtaggtcacctgagactttgcatatctaatgtgctcccaggtgacgctgctgtt

SEQ ID NO: 6853058 - DNA, 94 bp, Homo sapiens
ttgggcctggtgccagggttaaaactgatattatgggtgatcatacagcttggtggctcattttagtcagtctttaacaccacagacctcccaa

SEQ ID NO: 6853059 - DNA, 65 bp, Homo sapiens
gaggagctgttccctcacctctggaagaaaaggacctccctgaggccaggggagtcagcgtcctc

SEQ ID NO: 6853060 - DNA, 75 bp, Homo sapiens
gacactcagagatatggtggttgatgacaagacactgcttcacagatgtatcaaaccaccttatctcttgtgatc

SEQ ID NO: 6853061 - DNA, 86 bp, Homo sapiens
ggtgctgagctgggcagatgtcagcatgaatgcaaagtgccaagttggtactggggtatgctcagatatattctcatctttgtacc

SEQ ID NO: 6853062 - DNA, 56 bp, Homo sapiens
gggaggggagagttacggctccagggccttgtccttgagatagatctcatcttccc

SEQ ID NO: 6853063 - DNA, 67 bp, Homo sapiens
tttcccagaggactgttggtgctaggcctgactgattttcacctagcagctccatttctctggcaag

SEQ ID NO: 6853064 - DNA, 86 bp, Homo sapiens
ccatctgttttgagataggctcttccactggggagctcctagcagagccttccagtcctgggagcctttctgggtctgtcagatgg

SEQ ID NO: 6853065 - DNA, 64 bp, Homo sapiens
gaaaactgtggctggagtatgaggaaaggcgtaccccttgcttctgatttgggccaggggattt

SEQ ID NO: 6853066 - DNA, 70 bp, Homo sapiens
ggaagagttcattgttttgagaacaacctgaataagttcagaattgattttcaaaacagccttttcttcc

SEQ ID NO: 6853067 - DNA, 56 bp, Homo sapiens
ggtttcaatgagaagtgcttgtccatgagttaaagggagaggcctcaggtgaaacc

SEQ ID NO: 6853068 - DNA, 63 bp, Homo sapiens
aacccatatgtgaccttctttatccagcagtgtttttactgcagggtctctgcaaatgaggtt

SEQ ID NO: 6853069 - DNA, 113 bp, Homo sapiens
tactggttttttttggaagtgtttcttaaaccacaaaattcagagattgaaatgaattgttctttgggaattgatttggtggtatattagctaacaaaaccgagaacacagtg

SEQ ID NO: 6853070 - DNA, 83 bp, Homo sapiens
ctctgtccagctggcctaacttcagggcctcctgaaattcctctgggttctccaggcccctggagtcctggcagttgatgggg

SEQ ID NO: 6853071 - DNA, 61 bp, Homo sapiens
caaagagtgctcctgccagctttctggtttgtctccggaaccagattcaggggcaactttg

SEQ ID NO: 6853072 - DNA, 124 bp, Homo sapiens
gtttatatgctgatatcaactctgccctggttgatttttattctagggtatttgcagagttcccactttcaaatgcacgtagagaaaataatccccatcaggacatctggcattgtttttaaac

SEQ ID NO: 6853073 - DNA, 58 bp, Homo sapiens
ggtgaagtatgaggaaatggagaaggcattgtccaaggagcagtcttcaaccttcacc

SEQ ID NO: 6853074 - DNA, 129 bp, Homo sapiens
tcaggagaaatgagctaaggccaggggtggtcctatcaggtggcagaggacaggatttggacgagtcgcagggctattactgatggagatttagcactctggcctctgagaaaacagccaggtttctga

SEQ ID NO: 6853075 - DNA, 62 bp, Homo sapiens
ggaagtgtttccttgggcagcagagccaggctccttaatgactgcttcagctgagcatttct

SEQ ID NO: 6853076 - DNA, 84 bp, Homo sapiens
gagataatatgtggcaacagctcagctcagagcccagtacccagtaggggctcttgaagtactgggtgttgttatatctgtttt

SEQ ID NO: 6853077 - DNA, 58 bp, Homo sapiens
ctgtctcctccactgcatgggagactcatcacggaagcttgcacagagaaggaggcag

SEQ ID NO: 6853078 - DNA, 130 bp, Homo sapiens
tacaagtaacagaaaaaccttatacatactgtcttcaaacgcaatatatggtactagtgcacacaactggaagaacacagacagggcaggtatcatgtatggctgaatagtggtttcaggcactgtctta

SEQ ID NO: 6853079 - DNA, 58 bp, Homo sapiens
caagattctagttgaggttcaaggtcaatctcaaatgctaccacctccaagaatcttg

SEQ ID NO: 6853080 - DNA, 66 bp, Homo sapiens
ttcagaataactttttattgaaatcagccagtgagctggctaaacacaagagaaagagttattgaa

SEQ ID NO: 6853081 - DNA, 79 bp, Homo sapiens
atttgttctgcgtcatgccacataaccagttcactttccatgaaatcaactgattgtttggcattggatacacacagat

SEQ ID NO: 6853082 - DNA, 96 bp, Homo sapiens
ttcctgattcttcttgtgattccttttctctagaggaacatagatcaacttctctatggaaattctgtaagggatttattctgaagaactcagggg

SEQ ID NO: 6853083 - DNA, 70 bp, Homo sapiens
atcaagtacaggtcttatctcctaggaatcctctcatctcattcctgtaagtatgtgatctgtggttggt

SEQ ID NO: 6853084 - DNA, 99 bp, Homo sapiens
tcttagggtttgtcatctaagatgatggtttttcctcctggctgcactgtagcctgtgcagccaggatggagaactgttggtatgagagaacctgaaga

SEQ ID NO: 6853085 - DNA, 123 bp, Homo sapiens
gtaccattagtaaaattgaaatgtgtgtgtgtgtgtgtgtgtgtgtgtgtgtgtgtaatacatgtataatatacatacgtacatacgtatgtgtatgcatatatatagtttgtaaaatgaaac

SEQ ID NO: 6853086 - DNA, 55 bp, Homo sapiens
ctggtaagaaggtctaagtcaatccattagttgattcacagaatagttttaccag

SEQ ID NO: 6853087 - DNA, 55 bp, Homo sapiens
attgtgttactggtctcagtctgacatcaggtctttgactcttaagtggctcaat

SEQ ID NO: 6853088 - DNA, 58 bp, Homo sapiens
gacgtaggatgaaagatatgtatatacgtatgtatgtattgtctcttttccttaagtc

SEQ ID NO: 6853089 - DNA, 58 bp, Homo sapiens
ggctctggtttctgacctgaatttggaccctgccacgtacagaccagaaacagggacc

SEQ ID NO: 6853090 - DNA, 63 bp, Homo sapiens
tgagtgttctgtgaggcagagctgaataacccacccacgccctgtagctgacaggatcactta

SEQ ID NO: 6853091 - DNA, 76 bp, Homo sapiens
ctgacatgtgtgttcttgaatgttggtgaaaatatgtattcatttccacagatgcctttaggagtaaaattgtcag

SEQ ID NO: 6853092 - DNA, 70 bp, Homo sapiens
ctgtcaggaagagtttgacctgtgccatccagaggcacctatgcatggacagtcagtcaaaagaccacag

SEQ ID NO: 6853093 - DNA, 56 bp, Homo sapiens
ggcccagcctggcaacaatgacgctgctcgctacgcttgtcctgcgaggtagggct

SEQ ID NO: 6853094 - DNA, 71 bp, Homo sapiens
tggcccacttctgagattaagcagagatggaaataaaactttccctttcctgactgatctcattatagcca

SEQ ID NO: 6853095 - DNA, 71 bp, Homo sapiens
catctggtcagcagaggggaaggcatctgtctctccaatggctcctgcagagccccccttctgatcacatg

SEQ ID NO: 6853096 - DNA, 117 bp, Homo sapiens
ctcaccctacttcataggaaagatatttggattatttaattagtgattgtagagtgttactaagacacactatgtaattattattgaactggtatctcctcctatgtattcagtgag

SEQ ID NO: 6853097 - DNA, 74 bp, Homo sapiens
tagttttttggtagctattaactttgccccactagacacaaataagcagagttccagctgtgaccagaaaattg

SEQ ID NO: 6853098 - DNA, 76 bp, Homo sapiens
ctgagcctcagtgttcttatctgtaaaatgggaataattacagcaagtcccccggcagggtgatagtgaggctcag

SEQ ID NO: 6853099 - DNA, 58 bp, Homo sapiens
ttgggaagtttgcatcagccattttagccttgccaaagtctgtcattaaacttcccaa

SEQ ID NO: 6853100 - DNA, 62 bp, Homo sapiens
aatctaagcaattgtcctgtctctacagacttataatttttaggatatggataatgcagatt

SEQ ID NO: 6853101 - DNA, 55 bp, Homo sapiens
gggagatgcttgtctgtcttatcatcggggcctggtgactctgcaaccgtctctc

SEQ ID NO: 6853102 - DNA, 60 bp, Homo sapiens
ctggcatggaggactactgagcttccagctgcgcttcacagagtcgctccatggctgtag

SEQ ID NO: 6853103 - DNA, 79 bp, Homo sapiens
ttgcatgcggatacaatagacaaagtgaatggctcctaaatgaaggacatacgcattttatcattgattgttgctgcag

SEQ ID NO: 6853104 - DNA, 75 bp, Homo sapiens
ggtagagacaggatcgccctgttgcccagattggtctctcaaattcctgagctcaagcgatcctcccatctcacc

SEQ ID NO: 6853105 - DNA, 88 bp, Homo sapiens
tttgtttgtcatattctgtctgtaaagacactaactatggaggaaaatattgctctgttactgtcttggaatatgcagtataaacaga

SEQ ID NO: 6853106 - DNA, 63 bp, Homo sapiens
aatttcacctgcactacatcgccaggccttcttctggttaggtgaatgtgagctggtggaatt

SEQ ID NO: 6853107 - DNA, 62 bp, Homo sapiens
ggaaaagagaatgctaaatggattcttctctaggtggagggggatcaacataggatttttcc

SEQ ID NO: 6853108 - DNA, 59 bp, Homo sapiens
ctctcctcctgtcctgcacatttggcctggtttgattagtaggtgagggaggcacaggg

SEQ ID NO: 6853109 - DNA, 65 bp, Homo sapiens
actggaagaatatggctctcagcaatattcctttgagtattactctagaaatatatttattcagt

SEQ ID NO: 6853110 - DNA, 73 bp, Homo sapiens
tctctctaactccctgggttaggaatgtacagacagaatattgtctgtaatcttccccagctcagatgagaga

SEQ ID NO: 6853111 - DNA, 93 bp, Homo sapiens
tgccctgactttccctacccagtgccaccctctgagggctgcccatcggggcggttgttattgtcgctgcactgggattggggcagaggggcg

SEQ ID NO: 6853112 - DNA, 64 bp, Homo sapiens
ttgtggctgccatctgtgtaatacggaattaaatgtctttctggctctacagaaggcaccacaa

SEQ ID NO: 6853113 - DNA, 75 bp, Homo sapiens
gcagaatggctgccagggcaggaggtacgctggaattcttcatggagccttttcttccctttagcagccagtggc

SEQ ID NO: 6853114 - DNA, 62 bp, Homo sapiens
ctcactcaggctgtgtcaggaggaaggaagagtaaacctccagctgacatctcctgagggag

SEQ ID NO: 6853115 - DNA, 55 bp, Homo sapiens
acagcttttcaattctgctgagtgacaaatcttctcttagctagtaagaagctgt

SEQ ID NO: 6853116 - DNA, 78 bp, Homo sapiens
ctccgcctcctctctgtcctgatttaccccctgcctggcacaaaaatgaacagagaagtcaccaagaggaaggcggag

SEQ ID NO: 6853117 - DNA, 61 bp, Homo sapiens
ctgtgatgaaacctgagacgccaagggcaagaattcttttgaagtctcagttttctcatag

SEQ ID NO: 6853118 - DNA, 55 bp, Homo sapiens
aacctgggtgtacattatggtcatcttttaaatgttatataaacacacttaggtt

SEQ ID NO: 6853119 - DNA, 86 bp, Homo sapiens
tagtggtaacagtggatgggctgctctcaggctggggagcacacactttgttccctgtgtcctgggggcacctccctgatatgcta

SEQ ID NO: 6853120 - DNA, 64 bp, Homo sapiens
gagagctttcatgttgggaatgctccagaaacaaactaaaggatctcctggcaggagggctctc

SEQ ID NO: 6853121 - DNA, 78 bp, Homo sapiens
ataatgaatgaaactagccaaggagagatagaggaaatcttgtaattaaatccatcttttcttgctgtgatgcattat

SEQ ID NO: 6853122 - DNA, 95 bp, Homo sapiens
ccctataaaaatgcaaacgctgctgggagggatcgtaaatcattaataccactctgtgagtttatcagatcactccttgctatgttgtaggaggg

SEQ ID NO: 6853123 - DNA, 58 bp, Homo sapiens
gctctttctgtcttgcagagaccaccttttcactgtgttctcatatggcagagagagt

SEQ ID NO: 6853124 - DNA, 62 bp, Homo sapiens
aaaaaatcatgcttatagagcaccttcgcttgaacagtgttcaaaatgtaggtagatttttt

SEQ ID NO: 6853125 - DNA, 62 bp, Homo sapiens
aggaaggcggacagtaaggaataggctagcagaaaaagtcttcaggctctggctgccttttt

SEQ ID NO: 6853126 - DNA, 69 bp, Homo sapiens
ctaagtttcaattcttttcacaaagagaacttttaaaagttgactttgtgctttgaatgatagctatag

SEQ ID NO: 6853127 - DNA, 56 bp, Homo sapiens
tttttaagagattctccagtctctggagatcccttattctggagtatccttgaaaa

SEQ ID NO: 6853128 - DNA, 85 bp, Homo sapiens
gcctagtacaattcctagcacataacttagaatagtttaaaaagtttaggagatatatgtgtgtgtgtaggggagtacatagagt

SEQ ID NO: 6853129 - DNA, 82 bp, Homo sapiens
gaaaacataatgttcttaaatcatgtggcaaactcccctcagtcatatgatttgtagacatttgattgacatgctaattttc

SEQ ID NO: 6853130 - DNA, 69 bp, Homo sapiens
ctgcaatggttaccacatccagttttccaaataccctgcaggaaaggtggagttgtgcccattttgcag

SEQ ID NO: 6853131 - DNA, 68 bp, Homo sapiens
tcccgaactcttcacctatgtcaagggcacataaaacattgatgagagtagggacagagagttggtga

SEQ ID NO: 6853132 - DNA, 78 bp, Homo sapiens
acaatgcatacttcgaaatttcagtggatgtttttctttatcattgtatgaataaggttttgaagtacaatgttttgt

SEQ ID NO: 6853133 - DNA, 92 bp, Homo sapiens
gtcctaaaaggccactggctgccgtggggctgaggctggagttctgccgaggctctgcaagtccagcccctggcacatggttctgatgggac

SEQ ID NO: 6853134 - DNA, 83 bp, Homo sapiens
ggaaggaatggagcaggggttcacattcaagtctgttatatgacaaacttcctgtatttatccatagcctcacacttccttct

SEQ ID NO: 6853135 - DNA, 58 bp, Homo sapiens
gagcatgcggtatttgtgtgggtgtcgagcatcctcgatcacaggaatgatgttggtc

SEQ ID NO: 6853136 - DNA, 62 bp, Homo sapiens
tcagcgttagtttttcatctaaacctggggtgcctggcccagcacttagagctacatgttga

SEQ ID NO: 6853137 - DNA, 70 bp, Homo sapiens
gcttccacttagtggatccttgtgtaatatttactaattaaaaataaagaatatccaaaaagatggaagt

SEQ ID NO: 6853138 - DNA, 61 bp, Homo sapiens
gttaatgagaggcttgactaggactgaatgatccagtttagacatggcttgctcacttggc

SEQ ID NO: 6853139 - DNA, 91 bp, Homo sapiens
aattttagattatttcacaattttaaggagcaaaataggttcacgattcatatccaaattatgctttgcaattggaaaagggtttaaaatt

SEQ ID NO: 6853140 - DNA, 76 bp, Homo sapiens
gtctcagggtgtgtagggaagggagcactggacagggaatcctgtctcttctgctactccctgtggcaccataggc

SEQ ID NO: 6853141 - DNA, 79 bp, Homo sapiens
gatgtggacacagtgactggcacatagtaagcgcttaataagtgttagattggcggtgtcaatcatttttaggcacatc

SEQ ID NO: 6853142 - DNA, 58 bp, Homo sapiens
aggcagctgaggtctggcgccccctggcccccagtggaagcaaggataaagctgctct

SEQ ID NO: 6853143 - DNA, 55 bp, Homo sapiens
gaggccacttcctactggaggagaccctggaagtctccctggaggtggtggcatc

SEQ ID NO: 6853144 - DNA, 70 bp, Homo sapiens
cgtgtgtgggtgtgtgtgtgttacttttatcaagataaacgaggaaaagctcagcatcacagataacacg

SEQ ID NO: 6853145 - DNA, 69 bp, Homo sapiens
gcagaacccacaagtggaaatgtctgatcactcttccaggtgagtccaacttccatttgacctctttgt

SEQ ID NO: 6853146 - DNA, 70 bp, Homo sapiens
attagagtaatattttctgagacaggatgaatttgctattctaaactgttatttgagagtgttgaataat

SEQ ID NO: 6853147 - DNA, 83 bp, Homo sapiens
gtaaagtttgatctcaagtagttgacatttatggagtatttaccatatgccaatctttgtgataattgctagacatattttat

SEQ ID NO: 6853148 - DNA, 83 bp, Homo sapiens
tgtatcccattaaccttgaccaggcccagaccacatcccaggagctggtttctgggtttgtctaggaccactagtgggaccca

SEQ ID NO: 6853149 - DNA, 61 bp, Homo sapiens
tgtcttgagatgtataaatcatcccttcgaaagaagtcctttgaggtatcaattcaaggca

SEQ ID NO: 6853150 - DNA, 71 bp, Homo sapiens
ggatgtgacatgcctgggccgtggagcactctgagatctcatcgcggacaccactgcccacacctccatcc

SEQ ID NO: 6853151 - DNA, 65 bp, Homo sapiens
gtgtggttggggtcagatagggaggaccgtacacaaggcatcatctctagcttccttaggaacac

SEQ ID NO: 6853152 - DNA, 79 bp, Homo sapiens
cccactagttatctgccatcttacatggtcactgtcttctcagacactgacatgcattggaggtggcatggcataaggg

SEQ ID NO: 6853153 - DNA, 103 bp, Homo sapiens
atttattaaccagatctcagaggggaaaatgtaacattgaattatatagtttataaatttgggctatatacatgttcattactctttaactctgcatttaaat

SEQ ID NO: 6853154 - DNA, 78 bp, Homo sapiens
gatgtctgtcacaggtgcggggtagtagctagcagatatttgttctgtgtttgccatccttgctccaggacatgcatt

SEQ ID NO: 6853155 - DNA, 68 bp, Homo sapiens
cccaagtgtaagcaaagctcaagcttacaggaaagccacacggaggatgggcttttttgcaatatggg

SEQ ID NO: 6853156 - DNA, 74 bp, Homo sapiens
tcatgcaatgttagtttgaaagcaccggttcattaaggatattaattttctgataactacacatttaagcatga

SEQ ID NO: 6853157 - DNA, 74 bp, Homo sapiens
tgtgtatgttaaaacagagttcttgcatgtattcccccgccattttgcatgccagactttaatttgatgatata

SEQ ID NO: 6853158 - DNA, 79 bp, Homo sapiens
ttttggcaaaggcattctcttttcaaattgcttaagaacaggcatagtgagatatcagagggagatgtttttctcaaga

SEQ ID NO: 6853159 - DNA, 88 bp, Homo sapiens
ggagaattctttgagcctaggaggcgggggctgcagtaagccaagactgtgctgctgcactcctgcctgggcaacagagcaagactcc

SEQ ID NO: 6853160 - DNA, 104 bp, Homo sapiens
tgcatgtgttggtggtcactgagacttgggtggcctgattctgtattgtgcatgatttgcttttctggccactaataggtctcacggtgaagacagcagaacca

SEQ ID NO: 6853161 - DNA, 104 bp, Homo sapiens
ggtggttggaggaagacccttggtgaaatgtagtcttgtgagatatgctcacaggggccaactctcagcttgagctacatgcccaggcttctaacccgaccacc

SEQ ID NO: 6853162 - DNA, 86 bp, Homo sapiens
gtcagccttggttctggcaatgagcaggtgctctggaagaagtcccaggcaagctctgctgtgccccttatctgaaccgagctgat

SEQ ID NO: 6853163 - DNA, 63 bp, Homo sapiens
tccctgttaccaggagttacaggcagcaggcagtcctcctgtcaataggctcctggcaggtga

SEQ ID NO: 6853164 - DNA, 70 bp, Homo sapiens
agaagacaacagcatatggactgtcatttagattaaaagatatctattgttagcctggtgctttgtttct

SEQ ID NO: 6853165 - DNA, 80 bp, Homo sapiens
gcaatttcatgaggggcaaaatctcagttgtttttctaggtcatctgcactatgagaagatttgctcttctgaggttagc

SEQ ID NO: 6853166 - DNA, 67 bp, Homo sapiens
gacaagacaatcctggacagtcagcattggattttcatctccagctgattgatttagtatttcatgc

SEQ ID NO: 6853167 - DNA, 78 bp, Homo sapiens
tcttgatcttgtttgaaaggagctttatccagaatacaatttctttattcagaatgaaatttctttcagatattagga

SEQ ID NO: 6853168 - DNA, 58 bp, Homo sapiens
ggcagggctgagtcaggtgctgggggtatttgcgcccagagatctactgagcccagcc

SEQ ID NO: 6853169 - DNA, 99 bp, Homo sapiens
actatcaattaatatagcatacttgaatgattttaaacagatgtccagcaaatcaggtgtgagaagggttcaggaatatgttaggattaattcttaagt

SEQ ID NO: 6853170 - DNA, 55 bp, Homo sapiens
tagggatagaagtgactggagcaaagaaatttgctgtcagttgtttttgtctcta

SEQ ID NO: 6853171 - DNA, 74 bp, Homo sapiens
gaccaaatggtgagatgcagcaacagacatggaacacgtgagggccagtgtctcagctgtgcttcattggggtt

SEQ ID NO: 6853172 - DNA, 60 bp, Homo sapiens
ccagatttaggtcactagaattttccttaaggatggaaaaactcagagaaccagatctgg

SEQ ID NO: 6853173 - DNA, 80 bp, Homo sapiens
gccaaagctcccagggaccgcagggcagtccccacagagccccgggctgctcctgagcttccctggacctagagcctggc

SEQ ID NO: 6853174 - DNA, 57 bp, Homo sapiens
gagtgagggaggggaagaggagtctagagttgctgggactggacctctgcctggctc

SEQ ID NO: 6853175 - DNA, 98 bp, Homo sapiens
ctgtctccttgctcttccctagccccagatatctcacacactccactttaatggatccgtgtgactatctggggttggatttagtcagagagatctgg

SEQ ID NO: 6853176 - DNA, 56 bp, Homo sapiens
aagaatggaacagttaaatgggaaagggtttatccttaactacttcttctattctt

SEQ ID NO: 6853177 - DNA, 66 bp, Homo sapiens
aagccttttcccatcataacacacatagaaagtaatttttgtactgcacccctgggaatgaggctt

SEQ ID NO: 6853178 - DNA, 74 bp, Homo sapiens
ggacatcagcagtggttgtgggactcacagtaaagaacacctatgacactcaccctcccactgcctggttaacc

SEQ ID NO: 6853179 - DNA, 91 bp, Homo sapiens
cctgctttaaagcataaacaagaattatttctagttaacagaattactgttgatatgcaaatggttctgcataaatggctgtaagtgcagg

SEQ ID NO: 6853180 - DNA, 63 bp, Homo sapiens
gggcttcaaagcagaaaaacccaggttcaggttctgactctgctactttctagctgtgaaccc

SEQ ID NO: 6853181 - DNA, 60 bp, Homo sapiens
agcttttaaagactttgaatccagggaaatgtcacttctgggcatggagcttcagaggct

SEQ ID NO: 6853182 - DNA, 66 bp, Homo sapiens
ataagacaaggtcatagtggattagtaaacatagccatgtttatccaacatgacttatgtccttat

SEQ ID NO: 6853183 - DNA, 82 bp, Homo sapiens
gtttctagtaacttaaattcaactcctggcagcctacttcacattctgatttgggcttctgatgttgagtgctgagggaagc

SEQ ID NO: 6853184 - DNA, 62 bp, Homo sapiens
tgtcctaacactcttcatcgcactggatagttaaggttgatgttaagaaggtagttaggata

SEQ ID NO: 6853185 - DNA, 62 bp, Homo sapiens
gctgactatttatatatttgattccttaaaagcaatgaggaatacaaagcagatggtccagc

SEQ ID NO: 6853186 - DNA, 60 bp, Homo sapiens
gcagtgccgaaggtagtggttgtaaagagaacttctggggagactcacaccttccgctgt

SEQ ID NO: 6853187 - DNA, 58 bp, Homo sapiens
ctctggttgcagctgaagttcctggagaaaatatattgagcttttgatgctgccaggg

SEQ ID NO: 6853188 - DNA, 58 bp, Homo sapiens
ctctgggtctacctgtggccagctgtgtccaaggtagttagggcccgcaggcctagag

SEQ ID NO: 6853189 - DNA, 104 bp, Homo sapiens
aagataaaccaacagatcaaaatctcattccttcatttgatgacagtaataaatctacatgatgtgcttgcagatgaaaggaagtcattgtgattttttatctt

SEQ ID NO: 6853190 - DNA, 75 bp, Homo sapiens
gcgtgtatgcaggtctgtgcagtgtgatgtggttgagtatgtgagtgtgccgtgtatatgatgtgtgatgtgtgc

SEQ ID NO: 6853191 - DNA, 74 bp, Homo sapiens
gggtgtgtgtgattctggcaggcagaagggccccgggtttctccagttggcctgtgtgtgttgtcaccacgtct

SEQ ID NO: 6853192 - DNA, 70 bp, Homo sapiens
gcagttccattttcatctcatgtataaattggagtttcaccatttagaaaaaatgtttgaaaagggctgt

SEQ ID NO: 6853193 - DNA, 84 bp, Homo sapiens
atttaattcatgggtgtgtgtgtgtgtacgtgtgtgtgtgtgtgtgtgtgtgtgttttcatgcacacaagcttatgtattagat

SEQ ID NO: 6853194 - DNA, 127 bp, Homo sapiens
gcttcttcaaattctagctcacaagagtttaaaatactgacaactttttctgtgaaaggtaggaaacaataggaaataggaccagacaaagccataactctttgagcaggcagaatgaggaggaagc

SEQ ID NO: 6853195 - DNA, 56 bp, Homo sapiens
ttgaggaagaaagttcagctctggtcctcataaattagtctaacttcttccttcaa

SEQ ID NO: 6853196 - DNA, 62 bp, Homo sapiens
gcctgaagcttaattatgaccagctgcattttagtgtccagaggtcaccatgagtttcttgc

SEQ ID NO: 6853197 - DNA, 74 bp, Homo sapiens
aaaggatgaactttcagcagtgctgaaaatcacgtaatatttgtgcttgtcagtgtgctagaaacaaatctttt

SEQ ID NO: 6853198 - DNA, 62 bp, Homo sapiens
ggcctggctccctcccccatgtcctgagctcactgcagaagccatggtggaggagcagggcc

SEQ ID NO: 6853199 - DNA, 78 bp, Homo sapiens
tccttttttcccagataaatgtcaaaatgtgaaatttctggctcacagtctacatgtatgtttatcttgagaaacgga

SEQ ID NO: 6853200 - DNA, 80 bp, Homo sapiens
gaagattgcgtctgagagcaggaggagctgctggaactcttcttcccagccttgttttaatgctcttgagcatcaccttc

SEQ ID NO: 6853201 - DNA, 73 bp, Homo sapiens
cctttgacttcccagacttgtgtttctttccaacagaggcgaataaacactcttggtatgtgaagattaaagg

SEQ ID NO: 6853202 - DNA, 69 bp, Homo sapiens
tagatacttacttttcttcagactacaatctagaatttgttggtagaaagacaaagtgcacagtgtctg

SEQ ID NO: 6853203 - DNA, 60 bp, Homo sapiens
gctgtctttcccctgctccagatcttgttactttccttttggattactgggcgggacagc

SEQ ID NO: 6853204 - DNA, 89 bp, Homo sapiens
tcttacagaagttcagtagcataggtcagtatagatggaagcacatcttttctgtttgctatgtctttgaggaacttctagtctcagga

SEQ ID NO: 6853205 - DNA, 56 bp, Homo sapiens
cctttggcattttgaggatgcgtctgtcaaggcttttgtcccctaaataccaaagg

SEQ ID NO: 6853206 - DNA, 65 bp, Homo sapiens
gatgacatggctagcactgtgaccctgaatgaagccagcatacctgtccagtgtagctggtcatt

SEQ ID NO: 6853207 - DNA, 69 bp, Homo sapiens
agtaactggcagggctggtattcaaaatccagtttatctgattttagagtgcctgttctttcccatgct

SEQ ID NO: 6853208 - DNA, 61 bp, Homo sapiens
tgtgcagctactccttggtcctagaatcaaattctctctctcaggccagagttgctccaca

SEQ ID NO: 6853209 - DNA, 71 bp, Homo sapiens
catctagaaggcggtttcccaagtgtggtaggcaggtttgccactgaacatatgcaagaccattttaggtg

SEQ ID NO: 6853210 - DNA, 94 bp, Homo sapiens
aagtataatgtggtatacctggctttaagagactttcagtctagagagtaggcagaatgtattctcataaagccactggtattacagtgtattt

SEQ ID NO: 6853211 - DNA, 76 bp, Homo sapiens
caggctttactatttggtcttggattatttctggaaatattgagaggttcagaattttaaaccaaggaaaagcctg

SEQ ID NO: 6853212 - DNA, 62 bp, Homo sapiens
gggtctgaatgtctaaaaagaattggcttaaattttagcaatttagtttgagacattagcct

SEQ ID NO: 6853213 - DNA, 98 bp, Homo sapiens
ctgggctgccggccacccttcaggcagagctgatgttctgtgatgaccttcacatcaagcatgaggtcgtgccccaagaagggtttcactgtgcccag

SEQ ID NO: 6853214 - DNA, 76 bp, Homo sapiens
tctgtttgtctgttattggtgtataagaatgcttgtgatttttgtacattgattttgggcgaaggacatgaacaga

SEQ ID NO: 6853215 - DNA, 62 bp, Homo sapiens
taggcacaggaggaaggggctctgtcatatgaccctattttctcacttcttccttttgtcta

SEQ ID NO: 6853216 - DNA, 85 bp, Homo sapiens
ttgtccaccaagtgatttgtggagatgaggactggtagtaacttagcaatgacttcagaatccagaatcagaattggagtgatag

SEQ ID NO: 6853217 - DNA, 90 bp, Homo sapiens
aggcgggcggccccgcggtgcattgctgttgcattgcacgtgtgtgaggcgggtgcagtgcctcggcagtgcagcccggagccggcccct

SEQ ID NO: 6853218 - DNA, 63 bp, Homo sapiens
cccaaacaggtgataagaaaactcgctagccaatgttttatagtgatgtcatcttaccttggg

SEQ ID NO: 6853219 - DNA, 77 bp, Homo sapiens
ctgtcccgccacagcttcgcagtctgctgcctctttgaggagcagtaggggctggagggctgtgagaggtgggacag

SEQ ID NO: 6853220 - DNA, 55 bp, Homo sapiens
gcgcgcgccctgacacgcaggcatgcgcgcgcctgtgggaagtcggggagcgcgc

SEQ ID NO: 6853221 - DNA, 80 bp, Homo sapiens
ggtgttctgggatgatggacaaagcattggtgagtataaactttccagggtccctgtacatcactgagaaaaatcatacc

SEQ ID NO: 6853222 - DNA, 72 bp, Homo sapiens
agtatcactgattatgaaaatgaaggcatgtggaagtcagatttggcctcattcattcaaaataggtgtatt

SEQ ID NO: 6853223 - DNA, 106 bp, Homo sapiens
tctcattgatgtaacaggcacacaccaatcaaatgtcagaagaacacagaaaattatctgactagggacttggtgtatgcttgtgtgtatgtgtgcatgtgtgaga

SEQ ID NO: 6853224 - DNA, 122 bp, Homo sapiens
gaggagaaaatcaaggctgagagactgttacttgtctgaggtcctactataagtggcagagccagaatttgaatccacatatgatagggcatctctaagagggtctccatgattctcccctc

SEQ ID NO: 6853225 - DNA, 66 bp, Homo sapiens
tctgatttataattttaaaagatcactacggaaaatgacgtgtaggcatctgagattataaacaga

SEQ ID NO: 6853226 - DNA, 70 bp, Homo sapiens
gacacaattcccacacttgaagccctctggtgtgaatatatgagagatggccttaggtgggaattgtctc

SEQ ID NO: 6853227 - DNA, 55 bp, Homo sapiens
gccacaggctccagcatcagtatgaaatccattactgtccgtcaagccctgtggc

SEQ ID NO: 6853228 - DNA, 56 bp, Homo sapiens
ggtgaggggcgcctctgcctggccgcccctactgggaagtgaggagcccctctgcc

SEQ ID NO: 6853229 - DNA, 57 bp, Homo sapiens
gttgtcaaatagtagaaagatggctgtgtcttggccaggctcctgctgtgtgacaat

SEQ ID NO: 6853230 - DNA, 56 bp, Homo sapiens
tccatgcttacttgtctcagcagattgagctttctgttgatttggtatgagctgga

SEQ ID NO: 6853231 - DNA, 68 bp, Homo sapiens
ttattgtgggtaggttgtgaaatggggtcatagtcccatagtttattttacaaactttcttacactga

SEQ ID NO: 6853232 - DNA, 109 bp, Homo sapiens
gggcaggagttcgagaccagcctggccaacgtggtgaaaccttgtctctactaaaaatacaaaaattcgctgggagtggccaggcacggtggctcacgcctgtaatccc

SEQ ID NO: 6853233 - DNA, 77 bp, Homo sapiens
gctgaaaagagctttagaaatctcagagttgtcccctcccactgcagctttagagagagatgagttcacattttcgc

SEQ ID NO: 6853234 - DNA, 72 bp, Homo sapiens
gtagaggcagggtttcaccatgttagcagggatggtctcgatctcctgacctggtgatacgcccacctcggc

SEQ ID NO: 6853235 - DNA, 71 bp, Homo sapiens
cagggcactgcaagggttgaagggagtagggagggtgaaatgtgctctcttggtctgtggcaggtgccgtg

SEQ ID NO: 6853236 - DNA, 60 bp, Homo sapiens
ttgtgagcatgtgcagcctctgcccgcgcctgcctgcctgcccgcctgcccagctcacag

SEQ ID NO: 6853237 - DNA, 110 bp, Homo sapiens
gaccagggagatgttagggagtgagctgggccttatgagtacctggaagagagcattctaggtgaaggggcagtcagtgcaaaggccctgaggtaggcgtatacctggtc

SEQ ID NO: 6853238 - DNA, 72 bp, Homo sapiens
gatggattacaatcccatttatgcctagtagtccattattggaatgctaagcatgtgggagttatttttatc

SEQ ID NO: 6853239 - DNA, 62 bp, Homo sapiens
ggcatcagaggtgtgttctgctccactgctattgcctctgcacagaatgcatttctgctgtc

SEQ ID NO: 6853240 - DNA, 61 bp, Homo sapiens
tgggctctctttacctcataaccctgatccctcatagagttctgagacaattgagagtcta

SEQ ID NO: 6853241 - DNA, 57 bp, Homo sapiens
tgtgtcctgcaggtgctgcctgcatttattgctgcctgcatttattgccaggacaca

SEQ ID NO: 6853242 - DNA, 70 bp, Homo sapiens
tgtcttttagggtggctttgctcctttggaaatgaccaatagcctttaggagccaacccttgtgaagaca

SEQ ID NO: 6853243 - DNA, 100 bp, Homo sapiens
gtctgttgctagttggacagtcggtatggcctggaggagaagggctgtttgtatttccatgcatcctcctttgtcctcttgccctgggtgaagcaatgac

SEQ ID NO: 6853244 - DNA, 64 bp, Homo sapiens
gtaaactgcacaagggtgcatagctggcaaacaagagttgggctgtgaaccctggcagtgtgac

SEQ ID NO: 6853245 - DNA, 55 bp, Homo sapiens
tagaagtactccttagcctttaccaaaagaaggaccaatttgaggtgtatttcta

SEQ ID NO: 6853246 - DNA, 66 bp, Homo sapiens
ccctccaccaggaagcatctggctagctaacatgtctatttagggttggggtgctgacctgaaggg

SEQ ID NO: 6853247 - DNA, 129 bp, Homo sapiens
tctctcagtggctgcaatctctgttgagcctcttgttttgtctttggaaatttaatgtttaattatttttaatatgtcaaaatattagtttctcaagagagaggctgtgcagtaacaggcatttggaga

SEQ ID NO: 6853248 - DNA, 57 bp, Homo sapiens
ggagaagccactctcccaggatcttgtcagcaagagggaaatccaggagtgcttccc

SEQ ID NO: 6853249 - DNA, 85 bp, Homo sapiens
tccctccttctcttctcatacactggctcacagtatggcctctcaaagaaaatggagccagatgtgagaaagaacactgtaggga

SEQ ID NO: 6853250 - DNA, 65 bp, Homo sapiens
gggaccagaagaaggatggtgaaattcccaggattatacaagctcactttcctctctttgggccc

SEQ ID NO: 6853251 - DNA, 58 bp, Homo sapiens
agtgaagagagaaaatggcagttcttagggccctagactgcccacatctctttccgct

SEQ ID NO: 6853252 - DNA, 71 bp, Homo sapiens
cagactcttggcttggatgaggtatgcatgcacaggcaaaagctaagcagaagtacctcgttctagttctg

SEQ ID NO: 6853253 - DNA, 129 bp, Homo sapiens
agcactgttcctgtcgatagcggctggaggggtattgatcccactcataagcacacaggagcccactcgggcccagagtcacatggggtgttcaataccccttcccgctaatgagcagcagcttcacct

SEQ ID NO: 6853254 - DNA, 55 bp, Homo sapiens
tcttctaggtgcattgtacctgtgctggataaagtaatgtgcaactactggaaga

SEQ ID NO: 6853255 - DNA, 60 bp, Homo sapiens
ttgactgaagtgctgttatgtggggcatgactgttttcctatatggctccgttcagtcgg

SEQ ID NO: 6853256 - DNA, 69 bp, Homo sapiens
tttcgaatagtggttctttttggaatgggaatgtttatcctatgcctgtctcaccattgtattttgaga

SEQ ID NO: 6853257 - DNA, 76 bp, Homo sapiens
ggtcaaagggtataaatatttttgaggtgattcatatattttatgaaacattatagaatatttatactctttgatc

SEQ ID NO: 6853258 - DNA, 71 bp, Homo sapiens
tggaagggtagagatcagtttaatcttcaggggtgactttagtctgccatgctgctgactttaccttacca

SEQ ID NO: 6853259 - DNA, 78 bp, Homo sapiens
atctcacttcttctctcctggcttccacagaggatgaaaccaggcattccttggcctaaggagaagagggagagggat

SEQ ID NO: 6853260 - DNA, 90 bp, Homo sapiens
tgggtgggatgaaggaaagacatataaatgacttctttctgctgtggagtcaaaacatgtactttccttaacctcatttacacccaccta

SEQ ID NO: 6853261 - DNA, 114 bp, Homo sapiens
atcacctagaaggcttgttgaaatagatctctgggtctcaccaccaggttttctgatttgggagggccacagtggggcctgagaatctgcatttctagcaagtgtccaggtgat

SEQ ID NO: 6853262 - DNA, 95 bp, Homo sapiens
tttgcttcttctctaattgaatctaagcatgttaaaatattgtttttcctcagtgaaggcagcttaatggattgaattagcaatacagaggtaaa

SEQ ID NO: 6853263 - DNA, 66 bp, Homo sapiens
tcagcactcacttttgggtttccagtagattttgttgagtctacattggaagctagggtgtgttga

SEQ ID NO: 6853264 - DNA, 60 bp, Homo sapiens
tcctcatgttccttactgacttcacaggtgagcattgtgttttggaaggaacatgcaggg

SEQ ID NO: 6853265 - DNA, 60 bp, Homo sapiens
gagctgggtctccaccttggcatctccagcactccaccatgccatgcaggacccagcatc

SEQ ID NO: 6853266 - DNA, 57 bp, Homo sapiens
tactttgtttgatccatgggaagtaatattggtaatatctcagggttcagcaaagta

SEQ ID NO: 6853267 - DNA, 57 bp, Homo sapiens
tcatcaatgtggcctacaaagagaattgtcatgctatggtccaggctggattgatga

SEQ ID NO: 6853268 - DNA, 92 bp, Homo sapiens
agaagccctctgcctctgagtaggacaccctcctctccttccctcccctgcagctgggtctgggctgtcctgttctggcgtgagtggtttct

SEQ ID NO: 6853269 - DNA, 73 bp, Homo sapiens
agtttgggactacaaatactgttcgctcagcacatctagaaattggtagctagcagttttgtggtttggaatt

SEQ ID NO: 6853270 - DNA, 129 bp, Homo sapiens
gtaaacactatgtaatgttctgtgctggaagttgtaaacaggctgctccagtcaaatttggctttgcagtcatgttttgctttgctgacctagtattttaaaaaaatcataattagttactaatgtttc

SEQ ID NO: 6853271 - DNA, 92 bp, Homo sapiens
tggtcaccatctcttacgcagagaattactatggcagctttggcttatgatccacagttattcatttgtgacaagagaaaaacctggggcca

SEQ ID NO: 6853272 - DNA, 57 bp, Homo sapiens
acagtgggtcctcagagtttgtagtcagaaacacgcacacactgagttttccactgt

SEQ ID NO: 6853273 - DNA, 67 bp, Homo sapiens
ttgttactatttggatgttagcctcagtccataaagggacttgctacacatcatcaaacagcggcaa

SEQ ID NO: 6853274 - DNA, 56 bp, Homo sapiens
tcatgtgaaagattgagaaagtaaatcctttgtgcaattcttagtctcatgcatga

SEQ ID NO: 6853275 - DNA, 56 bp, Homo sapiens
gtgagccaccccctgcccctgagtctgcagccgactctggggtggaggaggctgac

SEQ ID NO: 6853276 - DNA, 59 bp, Homo sapiens
tgtgaccttatttggaagtagggtctttgcaggtgtaatccagttaagatgaggtcata

SEQ ID NO: 6853277 - DNA, 107 bp, Homo sapiens
ccataagtaagagcatgaggctgcagcatcgccacctgcctcagtcgtgcttcatgtgcgtgagctgtgtgtgtgaacgtgtgtatcctcagtgtttgatgcaatgg

SEQ ID NO: 6853278 - DNA, 77 bp, Homo sapiens
gatttaaatctcacaagtagaatcagcctcttgatgggggatttttccattataaagctggtgctacgatctgaatt

SEQ ID NO: 6853279 - DNA, 69 bp, Homo sapiens
tgaagagtgaggactttagcaagtttagagaatgaattgtcttactgttttggtacctcattgcttaca

SEQ ID NO: 6853280 - DNA, 69 bp, Homo sapiens
gcgctcctgctcgcggcctctcccagtcccggaattggggctgcggatctaaggctgggaggggagtgc

SEQ ID NO: 6853281 - DNA, 56 bp, Homo sapiens
cttggtgcccagcaggtggctggagctggcgacaacaacacactggtggcatcagg

SEQ ID NO: 6853282 - DNA, 85 bp, Homo sapiens
aaattcacctagattcattatcttctttgtacagaaaaaactcgaccatggccacagagtttaatgggtactagaggtggtattt

SEQ ID NO: 6853283 - DNA, 83 bp, Homo sapiens
gaccagctacatcagaatgttatggggggctctcagaactcagactgccagtccctacctctgagattctggttcagcaggtc

SEQ ID NO: 6853284 - DNA, 92 bp, Homo sapiens
cagcatcttatctttcaatgtgttctttattcattgattcagggtatcattcctggggtatataggtgaatatgacgatgataatatgtctg

SEQ ID NO: 6853285 - DNA, 91 bp, Homo sapiens
ttcctcaggtgtagccatgagattatatgccctgaatggctgtcatagcattgaaagcaaggaaatgtagtcctcatctccatctgttgaa

SEQ ID NO: 6853286 - DNA, 63 bp, Homo sapiens
agagagtagtctttagggaattcagtgggcagtggctaatgaataaatcaaagactgccctct

SEQ ID NO: 6853287 - DNA, 79 bp, Homo sapiens
ttttgcccatttctatttcaagcttctgtgaatgaacttaatgtcaaataggtatgagtagaaatctcaaagggtgaaa

SEQ ID NO: 6853288 - DNA, 74 bp, Homo sapiens
aaggctagggacctgccagaactcaggctaactgtgatgttgagcacaggagtggcaggttctgacttggcctt

SEQ ID NO: 6853289 - DNA, 74 bp, Homo sapiens
tggtgaggactatttttgagctgacactccctcttagtttcttcatgtcacctttcgtcctggttcctccgcca

SEQ ID NO: 6853290 - DNA, 58 bp, Homo sapiens
aacagtcctgtgctctttcattctctctttctctgtgtatagatatctcaggactgtt

SEQ ID NO: 6853291 - DNA, 65 bp, Homo sapiens
tagtgaaataggcagtgattcatatttgtgcaaactcccactgatgcctgctgtctgcttcccta

SEQ ID NO: 6853292 - DNA, 59 bp, Homo sapiens
ggactgggcctcacacccaccaaatggaggcttcagctggtggaagggagcccaaaacc

SEQ ID NO: 6853293 - DNA, 109 bp, Homo sapiens
taatgcttttgtcactgtttgctgctgaattccagggaagtatatgtttcttctcatcccaattcagaagcaatcacagtgagttatttcatttattgcaaaaatatta

SEQ ID NO: 6853294 - DNA, 59 bp, Homo sapiens
gagtcaggtcaggcttgtagattcgagttctgttgcgagtttgattgcccctctgactt

SEQ ID NO: 6853295 - DNA, 86 bp, Homo sapiens
tttccaccctgaggacaacaggacatgtaccaggtggtctgtatggtcaactagactttggttttgttccttcttcagttaggaag

SEQ ID NO: 6853296 - DNA, 81 bp, Homo sapiens
ccagcttggtcgctgctgtgttgccagtgtcacctttctggagccaggtggctctcttaagggcagcgtttggtcagctgg

SEQ ID NO: 6853297 - DNA, 97 bp, Homo sapiens
acaggtgttgagtagtttcctgggcctttaatgctttaaatttattatttaacaactaaagccatactgaaagccacttggaaacttcagctgatgt

SEQ ID NO: 6853298 - DNA, 84 bp, Homo sapiens
gcacaggaggaaggcttgtttgaggatagtaattgtttgacttcccacagattattttgtccaaaaccctaaggactccattgc

SEQ ID NO: 6853299 - DNA, 65 bp, Homo sapiens
gggtgtcctgatggcattgtggtttgtgtcctgttgaaccgggatctgtgctgccgtcaacatcc

SEQ ID NO: 6853300 - DNA, 72 bp, Homo sapiens
cttagaaaaactagctttagttttggaaggagttagtgtaggtttttccagattggacttagtccttttaag

SEQ ID NO: 6853301 - DNA, 64 bp, Homo sapiens
gctcagagcatcccagtgaatgccaccagggaggtgtcagctcactttgatgtaattgaaaagc

SEQ ID NO: 6853302 - DNA, 69 bp, Homo sapiens
tgatgtggtcaggactggcaggcagatgggaatgaaggtgcctaggaagccagtctctggccagcatca

SEQ ID NO: 6853303 - DNA, 56 bp, Homo sapiens
gtgtgcaggggcttggtggagctgtggaagtgggtaccagccaaagcagggcgcat

SEQ ID NO: 6853304 - DNA, 66 bp, Homo sapiens
gcagattatcgaatgcaaggggccacatgctagcacatttatgggctctgcttgcatcatgactgc

SEQ ID NO: 6853305 - DNA, 73 bp, Homo sapiens
tccacacctgctgagctgctgggggttgggggtgaggtgttgtcctgggttctagcagccagccagggatggg

SEQ ID NO: 6853306 - DNA, 79 bp, Homo sapiens
tcctgtctttgggaagggttagttggattatttatactttataaattttcttgctgtacttagtgttaaagatgatgga

SEQ ID NO: 6853307 - DNA, 88 bp, Homo sapiens
gcccgttcttgctgtgttgtgctgcctccatatccgtcaggaagagcctttccagaatgattctgggcatatactaagaagagcaggt

SEQ ID NO: 6853308 - DNA, 94 bp, Homo sapiens
gtaacagacaaaaggcctgaggagcagggtggcttactcggctgtgaaacgacacctgggctgtcacgcccctgcacctctggccagtcagtgc

SEQ ID NO: 6853309 - DNA, 59 bp, Homo sapiens
gtcatgcctttaagagatactgaggactgtttttgcagcttaagtctgtaaaggatgac

SEQ ID NO: 6853310 - DNA, 55 bp, Homo sapiens
cttcttcacactggtctgaagcccaagaggctgaactacatagactatgaggaag

SEQ ID NO: 6853311 - DNA, 111 bp, Homo sapiens
ttattatctgacttgaatccaattctaggcacagacaccattaaatattttgtatgcttcataagaaaagtcctggctggtatctgtctggtggatctatctagattataa

SEQ ID NO: 6853312 - DNA, 74 bp, Homo sapiens
atccttagagccctagagaaccagcctgtgccaagtacctgtgtggcgcgggctgggtctctggccaacaggat

SEQ ID NO: 6853313 - DNA, 62 bp, Homo sapiens
agctgcctggagtcatttcctgcaggaattccatgtcttcccattgaagtgtttcagcagct

SEQ ID NO: 6853314 - DNA, 79 bp, Homo sapiens
ccctgtagcctgagtggtgaaaccccatccccctaggggcacatggacaatggaggtgcagcatcctcagcagcatggg

SEQ ID NO: 6853315 - DNA, 73 bp, Homo sapiens
gccaccagaacacaggttcaaattcaggtcgcttctatgtgaggaaacctacctgaaatgaattgttggtcgc

SEQ ID NO: 6853316 - DNA, 130 bp, Homo sapiens
aaaacccccaaatcagtgctccttcccttcccagggcactctgcagggaccacctgagtcagacacagagtctctgaccagggtgccaaggggatatcttaagggtccagggacatggagggggcacttt

SEQ ID NO: 6853317 - DNA, 60 bp, Homo sapiens
gctcaggagctgacagcctcaagtctagaacctcacttatgggggccgtctgcttctggc

SEQ ID NO: 6853318 - DNA, 77 bp, Homo sapiens
gaatttactgactcctttctgattcatgatccagttcttatatgaggaatgattcatggatcaggagaggaaaattc

SEQ ID NO: 6853319 - DNA, 75 bp, Homo sapiens
atcagtatgctgctttaagatgatccaactttttaaacagaagaaatgtggatcgttttaaaaaggcaggctggt

SEQ ID NO: 6853320 - DNA, 82 bp, Homo sapiens
ttgcagtaccaacactggggtgaccactacacttgccacattgtgcagcaaatgtatgttttcctatgtatctccactgtaa

SEQ ID NO: 6853321 - DNA, 69 bp, Homo sapiens
gagtcaaggcagagtctatcttggaagtttaattcattgaacctttattagatgtagactttcttactc

SEQ ID NO: 6853322 - DNA, 70 bp, Homo sapiens
ggtccccatctattataagatgtaattgcacttaatttgtagacatccttcaagtgatatgtgggtgacc

SEQ ID NO: 6853323 - DNA, 67 bp, Homo sapiens
ttcgctttgttaggggctcagggtggatagtttacttttaccctcacggaccacctgtacatgtgaa

SEQ ID NO: 6853324 - DNA, 73 bp, Homo sapiens
gccctcaggggtccccatcactcctaggacatttccccgactccctagcatggcactcaaggctcctgatggc

SEQ ID NO: 6853325 - DNA, 97 bp, Homo sapiens
ggctgttcaatggtatcagaaaatccaaagaggttaagaacgagaactcaaaatatgttgctggattttgatcctttgcaattgatggatgatagcc

SEQ ID NO: 6853326 - DNA, 91 bp, Homo sapiens
ggggtgtgggggaccgtaagccatcctcaggggcctgacctgggtttccgtttgcagcagcctggagggggccacgttcttcctgcgcccc

SEQ ID NO: 6853327 - DNA, 63 bp, Homo sapiens
tgctacagagccaggaagagtggtatgaagtgacattaagaaccatttttcttcctctgtgca

SEQ ID NO: 6853328 - DNA, 56 bp, Homo sapiens
acaagataggttgagtctagcctcatatgctagattaagaacgtggaccatcttgt

SEQ ID NO: 6853329 - DNA, 90 bp, Homo sapiens
tggatgccggagacctgcagggccaggcctgctctgcagtccctacggctgcccatccccgcaggcatggtcgctgccaggtcggcagca

SEQ ID NO: 6853330 - DNA, 83 bp, Homo sapiens
acaatactgtgattctaaagctttgagcagcagcctagggaatttcacctattctgtagaggtattaggggagcagaggttgt

SEQ ID NO: 6853331 - DNA, 62 bp, Homo sapiens
agtgatagcacagatatacctatactgtggttcaaatcatgtatagcaaatatttgttcact

SEQ ID NO: 6853332 - DNA, 64 bp, Homo sapiens
ttccaggcattgtgagtgggcaggtatgataatttcttcatctgtaaagccctggtacctggaa

SEQ ID NO: 6853333 - DNA, 57 bp, Homo sapiens
ccccaacatgagagatccttcatgagagattgggtcaacatggtattctttcagggg

SEQ ID NO: 6853334 - DNA, 95 bp, Homo sapiens
aaccttgagctctatgtattaaaactacatttgacattttgtcttagtctatgaagataaagtggaggtagtattcattccattagttgaaggtt

SEQ ID NO: 6853335 - DNA, 72 bp, Homo sapiens
ccatgctcatctgagtcaaatatttcatttgtgcagctcaacataacatagaataaatgagttaggggctgg

SEQ ID NO: 6853336 - DNA, 63 bp, Homo sapiens
gatggagtctgaagctgggaacgaccctgtccacccccaagttccttaagtcagacgcttatc

SEQ ID NO: 6853337 - DNA, 55 bp, Homo sapiens
ggggctctgctctgagccgtgtacaagtcttaactcgttcagccccagcagcccc

SEQ ID NO: 6853338 - DNA, 110 bp, Homo sapiens
ctcaaagctctccccaggccagcgtctaccaacctttctaacaggtgttttctgagacagctgtgcaggagaaggggctggggatgggggcgtgtaaaagagagcttgag

SEQ ID NO: 6853339 - DNA, 99 bp, Homo sapiens
aatttgtattgttctgaaaattgggtcatacttactctgcaagtggcttttcttaatatgtcataggtataactcagtctttagatataaagtcaaatt

SEQ ID NO: 6853340 - DNA, 68 bp, Homo sapiens
accagggctccaggggaccatcagttttataagcaggtgagagctgtgggatttgggtgtgcctgtgt

SEQ ID NO: 6853341 - DNA, 59 bp, Homo sapiens
agctgtggtgtgtgtcacagaacccaagtcaggactcttggggacccagaatcacagct

SEQ ID NO: 6853342 - DNA, 63 bp, Homo sapiens
agtaacatgctaatttgattattattgctttgtagtatgtttaaaatcaggtagtatgatgct

SEQ ID NO: 6853343 - DNA, 77 bp, Homo sapiens
ggctcatttggcgatttctgaaattataagtttagtctacctagattctcttcttgtccagaaaaaagccaagggcc

SEQ ID NO: 6853344 - DNA, 61 bp, Homo sapiens
tgtcgtgggtgcaggagagcttttggcacacataccagttactagtctcacatccctggca

SEQ ID NO: 6853345 - DNA, 56 bp, Homo sapiens
gtgtgctttttatgtgagggaagccagataaaggatctggctttggaagggtagac

SEQ ID NO: 6853346 - DNA, 82 bp, Homo sapiens
catgtctttcactgcatgtgacaataagtgtgagctgaaaaagaatcactggcaaagttgtcacatggggtgattttttatg

SEQ ID NO: 6853347 - DNA, 59 bp, Homo sapiens
caagaagcagggtcttagactttctgtgtaaccagaaacaggcttatattttgctcttg

SEQ ID NO: 6853348 - DNA, 90 bp, Homo sapiens
agttaaagtgaagattaagttacagttattatttaaaatgtagatatcattttaggtagtcatttctgaatggaatcacactgatgagct

SEQ ID NO: 6853349 - DNA, 76 bp, Homo sapiens
agactacctctgagctgtgggaaatgagatccagtagatacatgcttccctttctatcccccaggcagatggttct

SEQ ID NO: 6853350 - DNA, 62 bp, Homo sapiens
gctgctggccgcccagcttctccccgatctgggagatgctcggctctgggcggccaaacagc

SEQ ID NO: 6853351 - DNA, 55 bp, Homo sapiens
agggaaagaggtgaatgttggaaggagccagctgttcacatcctgctttttccct

SEQ ID NO: 6853352 - DNA, 61 bp, Homo sapiens
gatggaaaaacagaagctgaatttatactactcagaattgtcaggggctgtgttttccatc

SEQ ID NO: 6853353 - DNA, 55 bp, Homo sapiens
gcagatggtggaggcaagaggctttatctgagcctttgggaccctggccacctgc

SEQ ID NO: 6853354 - DNA, 81 bp, Homo sapiens
atctatggccaatttagtcactcaagcagtgctcaaaatctctgggttagggctgcaatgggagataacttgccataagat

SEQ ID NO: 6853355 - DNA, 67 bp, Homo sapiens
tagagacacaatagagtcagttctacattctcactgaaatgaaggtacaagaacaggctttactcta

SEQ ID NO: 6853356 - DNA, 77 bp, Homo sapiens
cctggcatggtacgctctgcttacatcctctcctctgtttggagagagacatgtaaacgcggtgagccaagtccagg

SEQ ID NO: 6853357 - DNA, 62 bp, Homo sapiens
tcagaggttacccatgggacagatggcatttaaactaggccttgaagcaagggtggctctga

SEQ ID NO: 6853358 - DNA, 91 bp, Homo sapiens
gcctgcagttggttcctgggcctgcattcaccatcacatcccccactggtgggctcttgggaattgacaatggcgtgggaacagatcaggc

SEQ ID NO: 6853359 - DNA, 69 bp, Homo sapiens
actgccagaagagaacaccagttcaaaaaaaacctagctaattctgaaatttggggcttttctagtagt

SEQ ID NO: 6853360 - DNA, 95 bp, Homo sapiens
tgttacatcaccttcttatttctttaatagtatttatcccagtctagcctagaagaggtctggcacttggtaaatatgtgttaagtgaaagaaca

SEQ ID NO: 6853361 - DNA, 107 bp, Homo sapiens
gttccagggggtggcacaggagccaaaaacgagacctgaggctgaagcccaacagaagatgaaacttgggagcagcctcagcttcgggaatcctcacttcctggcac

SEQ ID NO: 6853362 - DNA, 113 bp, Homo sapiens
ttgtggaattaattcagtcattcctgcgtggtgaaatatggaataggggcgtgtattctgaccctgttcaatttgtttcagttatcggcaggggaggtgagcagatttcacgg

SEQ ID NO: 6853363 - DNA, 117 bp, Homo sapiens
ataggtctgtctgtgaccctgtaatcatggctgtctcctcaatctgggaaaaggatgggccctgtctatctattactcttttaaggaaaagttattgctacagacaatttgatctat

SEQ ID NO: 6853364 - DNA, 99 bp, Homo sapiens
gtgaactgagacagaatcagggaacaagatgagaatggagtttgtggacagagaattcagcctgcggtcttgtcacccatgtccttgtgctcagattac

SEQ ID NO: 6853365 - DNA, 90 bp, Homo sapiens
aacagccacttctctcttccttcgcccttgctgtttcagtgggaggaatatgaattctgaaaggcttggcggagggagggggtggctgtt

SEQ ID NO: 6853366 - DNA, 69 bp, Homo sapiens
tctggaacagttacttgctgattgcacagataccttaaaatacagtgttaaaacaggtgatttttcaga

SEQ ID NO: 6853367 - DNA, 72 bp, Homo sapiens
accgaggagtaaatggttttttatatgctgccaagtttactttggcaatgtaaattgaactagaactagggt

SEQ ID NO: 6853368 - DNA, 71 bp, Homo sapiens
actggcatcccactggtacaggagtattcagtgttctaaccctggtagggtcttaccaatggattgtcagt

SEQ ID NO: 6853369 - DNA, 59 bp, Homo sapiens
ccattatagctggaaggagctatgtcaaggtgttaaaagtggctctctctagtaagtgg

SEQ ID NO: 6853370 - DNA, 112 bp, Homo sapiens
cacatgcatgtgtctatgtgcacatgtgtgcatagtcgtgcatgcatgcatgagtgtgtacgtgcatgcatgcatgagtgtgtacctgcatgcacatgtgcatctgtgtgtg

SEQ ID NO: 6853371 - DNA, 62 bp, Homo sapiens
aacatctgggccctgattttgggcatcctcacgaccattctgctcatcgtcatcccagtgtt

SEQ ID NO: 6853372 - DNA, 68 bp, Homo sapiens
cagattgcttcagtgctctgagcctgtttcctataaaattagataacagtatctgcctgacagcactg

SEQ ID NO: 6853373 - DNA, 59 bp, Homo sapiens
ctgggcagctccataccacccactgtcacttggactttgaggggcagagaggtgtccag

SEQ ID NO: 6853374 - DNA, 55 bp, Homo sapiens
caccgagagccacttccggaacaagcgtcgcgtttctgaggagaaactcttggtg

SEQ ID NO: 6853375 - DNA, 100 bp, Homo sapiens
gagaaaggcgccttggtttcaacagcagcagaccagcatatgtttacttaattcctaagacatgatgacagtggtctctgcgccactaaaagcttttctc

SEQ ID NO: 6853376 - DNA, 62 bp, Homo sapiens
tctggagttgagagtgtgcgagtgaaaaccagcttcatcgcatttccctctgtagcttcaga

SEQ ID NO: 6853377 - DNA, 77 bp, Homo sapiens
cagcactttgagggctcttaatcctcaccctgggctaaagatttggccgaccattaagtagccatccgaagatgctg

SEQ ID NO: 6853378 - DNA, 60 bp, Homo sapiens
cagaggcttctttctgatttgcgtatgtgtgccatagtgcctgatctacaaggggccctg

SEQ ID NO: 6853379 - DNA, 78 bp, Homo sapiens
gccaccagcttgcccacctgcttcctcgcttgggctctgtcatttctgatccaggtgagtgcaggtgcagatggtggc

SEQ ID NO: 6853380 - DNA, 61 bp, Homo sapiens
gcctccttgctgctcccaagaggcagctgcaaactgttgcactgcggagtagcgaggtagc

SEQ ID NO: 6853381 - DNA, 57 bp, Homo sapiens
tgtgctatttgactgtttgctaggtttctatgacatctaccaacagcaggaagcata

SEQ ID NO: 6853382 - DNA, 69 bp, Homo sapiens
aattctagcccaggcaaaactagtatatactgtgagaaagcaaatctgtgtttgcctagggccagggtt

SEQ ID NO: 6853383 - DNA, 99 bp, Homo sapiens
gctggctttgggtgggtgctggatggcagacagtgagtggctatgctgttagcagaagcctcagtggctggcattctgtgtgcccaacctaggcacagc

SEQ ID NO: 6853384 - DNA, 65 bp, Homo sapiens
gaagacccttctctgaggaggaagattaccagtgagaatttctttgctatagatgatggggattc

SEQ ID NO: 6853385 - DNA, 60 bp, Homo sapiens
agcgaggtgtggcagttctagacctgcgcactttggcaggatgctggctgcacttctgct

SEQ ID NO: 6853386 - DNA, 97 bp, Homo sapiens
tgccttagatgtacctcaatagctactagtgaattttggtacccaagtccagtctggttgccagaataaactgtgtgttgggggtgtgtctgtggta

SEQ ID NO: 6853387 - DNA, 80 bp, Homo sapiens
aaatggactttgcataaatatgtctttgtccatgtgcagtctttgggcgcacgtcaacaagggcagcaaggcagccattt

SEQ ID NO: 6853388 - DNA, 67 bp, Homo sapiens
ctggctctttcagccgctggagggctggtgtgatgacatccctgtactccggggtggctgaggccag

SEQ ID NO: 6853389 - DNA, 70 bp, Homo sapiens
cactgtatgtagaatagctgacaactgtgaagttgggataacaatgaatttgtcatgcattcttacagtg

SEQ ID NO: 6853390 - DNA, 93 bp, Homo sapiens
ctggggggtggcagagagggggtgaggacaggagcactgctttggagtctggaggctgcttctatcctcattctacttcctaccagctctcag

SEQ ID NO: 6853391 - DNA, 92 bp, Homo sapiens
cacagtaccagggcatctggatcaggatggcttctgcatcaaactacatagtgtgcacaggaagctattctctctaatcatcctgtcctgtg

SEQ ID NO: 6853392 - DNA, 61 bp, Homo sapiens
ggagcagacgctgcagtcttggggcagaatttcttctctaggaagcctcagtgtctgcttt

SEQ ID NO: 6853393 - DNA, 64 bp, Homo sapiens
tctgtttgtctggattgctgtgtccaacagaagtttacaactggccagcagtgtggcaagcaga

SEQ ID NO: 6853394 - DNA, 78 bp, Homo sapiens
tctttatttcactttttctctgcttgagactagccagagtgggtctggctcttaagcagagaagaagttgattaaaga

SEQ ID NO: 6853395 - DNA, 79 bp, Homo sapiens
tccacaataaagtgtaggcttcaaagagggatgacatgtattttccatcccttagttgtggaccctgcactggcctgga

SEQ ID NO: 6853396 - DNA, 89 bp, Homo sapiens
ggggatctcttccagtcgggacttctggggactgtagattgactggggtcgctctccttgctagaggttctagattggctatgatttcc

SEQ ID NO: 6853397 - DNA, 59 bp, Homo sapiens
gcaatcaagacatgcaattgccactttaatcttgaagatggtggttcatattttcttgc

SEQ ID NO: 6853398 - DNA, 127 bp, Homo sapiens
tctgggcagggcagacctggctgcaaggtggggcctggggctgggttggtgctggggtttccccttctctgccaaaccatccatctccaggctgcttgtgactggagtgagtccttccctgcccagg

SEQ ID NO: 6853399 - DNA, 83 bp, Homo sapiens
ctttatcctacatataacacagaagctttttctattccctggatgaacccacagggacagaaattcttgttggacaggtgaag

SEQ ID NO: 6853400 - DNA, 69 bp, Homo sapiens
cagcccagctccaggtgaatcctctcaccctttgtggggtcggaggccctgccttggagcatctggctg

SEQ ID NO: 6853401 - DNA, 55 bp, Homo sapiens
ctccagtcttgtttcctacctaatgagttagtcagaataggaacattgattggag

SEQ ID NO: 6853402 - DNA, 61 bp, Homo sapiens
catccagcatctgcactgcagcgtgctcctcgtccagcacactgtggtgtgagggctgatg

SEQ ID NO: 6853403 - DNA, 92 bp, Homo sapiens
acaatgggaattggagctctgaggaattctgcagtgagaaggtcagtttagctttgttcaacgcagcatttctcaagtttagttgccattgt

SEQ ID NO: 6853404 - DNA, 80 bp, Homo sapiens
gtgagtagggcttaggtttagtttgtggtccatgaagcaaaactgtggggcactgctgatttcataggcaggaaattcac

SEQ ID NO: 6853405 - DNA, 107 bp, Homo sapiens
atcccattctcttcagaccctcctcagggattaaggtcaaaggtgggaggaagaaggcttccattggccttttatcctagaggttctaatggaggggaaaaggggat

SEQ ID NO: 6853406 - DNA, 76 bp, Homo sapiens
tcctgcttttgttaattccactccagatgtatatggtctagtagaacactggtgtacaggaggtaaaaggagagga

SEQ ID NO: 6853407 - DNA, 86 bp, Homo sapiens
ggacttctctttttgtgcatgtttgttttcagggtttagctgatcaaagtggtatcgttgtaacaggcagctctaaatagaagtct

SEQ ID NO: 6853408 - DNA, 73 bp, Homo sapiens
tgggtgtggtccacttcctgcaggtaaggagcttccacaagggcagctctgaatcatcgggagtaatcgccca

SEQ ID NO: 6853409 - DNA, 59 bp, Homo sapiens
ccctctggtcagctgaagccccacacttaaaaggtggcctttcagtggatcaggagcgg

SEQ ID NO: 6853410 - DNA, 56 bp, Homo sapiens
caaacatctgcaccttgaccggactcgccatcccgccgtgggggtgcaggtgattg

SEQ ID NO: 6853411 - DNA, 63 bp, Homo sapiens
gtcctccgggcacgtcagtccctcagagcttgagttagaggtggttgtagtggttgtgaggat

SEQ ID NO: 6853412 - DNA, 102 bp, Homo sapiens
tggtagattccttctagtgactggtcaccttcaggtctgattaccaatgctagaaagcgtggctcctaacagatctgaaattggtcacttaggattctagca

SEQ ID NO: 6853413 - DNA, 73 bp, Homo sapiens
gctgtttggtggctgttgcagaactgagggagggatgatttgtttgatttactataagcagcacaaaggcagt

SEQ ID NO: 6853414 - DNA, 81 bp, Homo sapiens
gttttttcaattccaccaaagcgccctagaaaccacatgcagaacaaagtcgatggggcgctgcctggaaggcgagaggat

SEQ ID NO: 6853415 - DNA, 60 bp, Homo sapiens
ggttatgcttgttcacagaggtcaggggagaccctgattaaataaagaacacagataacc

SEQ ID NO: 6853416 - DNA, 66 bp, Homo sapiens
agttgctctatgtttgtaaacagacaatctctaatgtctgattatttgtatcacagatctgcagct

SEQ ID NO: 6853417 - DNA, 123 bp, Homo sapiens
tgcaacatttgtttcataagtgctttgtgtttagcaacactgtattcacgaccttgttggcttgcatttgcatgttttataccaaagcttatactgtactatgtgaagccatcagaagtcgca

SEQ ID NO: 6853418 - DNA, 57 bp, Homo sapiens
gcccaggattggaggctgtggtgaattgagattgcatcacagtactccagcctgggc

SEQ ID NO: 6853419 - DNA, 56 bp, Homo sapiens
cctctgctctggtccatgtgctaggctgtggaggtttgcaggccaggaggcggagg

SEQ ID NO: 6853420 - DNA, 75 bp, Homo sapiens
gagatactgattttaataagatccatttggtgccttaatcaccaaatctcggacaggattaagtatagatatctt

SEQ ID NO: 6853421 - DNA, 62 bp, Homo sapiens
tcagctcttccccccagccaggaaggactctagccacaaaacttgctgggtggaagagatga

SEQ ID NO: 6853422 - DNA, 78 bp, Homo sapiens
caaatggttaggctgagagaactagatgctttagtagctactgtatttggcatttatttgtctcattcttactatctg

SEQ ID NO: 6853423 - DNA, 58 bp, Homo sapiens
tccctcctgcttgcgttctgagaacacagttatttcaggacatgtaaatggagaggga

SEQ ID NO: 6853424 - DNA, 84 bp, Homo sapiens
ttctgttttccagtccatggattcccaaggtcatattggagggtttatttgaccaaaagccatggggacttcatggatttagaa

SEQ ID NO: 6853425 - DNA, 62 bp, Homo sapiens
agcccaggtctcaaagtacagggctgtgagtgatgactgtacctgtgctatcagcttgggtt

SEQ ID NO: 6853426 - DNA, 58 bp, Homo sapiens
ctagcagtatatgagagctattgttactctaaaccataacaactcttgatactgttag

SEQ ID NO: 6853427 - DNA, 79 bp, Homo sapiens
cttggattgagaaaattaagaaatggtgctctaagttggaacatttagacataattaattagttctactgcagtctgag

SEQ ID NO: 6853428 - DNA, 59 bp, Homo sapiens
ttgaccttggcttttaaaatatagctaaccaccaagtatacgctgaagactaaggtcaa

SEQ ID NO: 6853429 - DNA, 87 bp, Homo sapiens
agggctgaagtgggggagggcaaggacaggggaaaaggtcacaacatgacccttaatttccctttgcactctacaatttcagactct

SEQ ID NO: 6853430 - DNA, 96 bp, Homo sapiens
tccaagatctcaccagtcagtagtaagcggaggaggcccaaggacacagggtgtgttctggggttggtgcttacaccagcgtggcaggagcttggg

SEQ ID NO: 6853431 - DNA, 75 bp, Homo sapiens
agcacagcattcacagaaagacatcaatctgcactttttgtaaaagaagcacaatgtccttcttgagggcttgtt

SEQ ID NO: 6853432 - DNA, 58 bp, Homo sapiens
atttcaaaggttttgtcatgtctggcagtgatgcaaaggtaagcaaattttttggaat

SEQ ID NO: 6853433 - DNA, 71 bp, Homo sapiens
ccttacctgatgatatacttcctagaacagtttatgtttttatgctttcttagtgtgttaattgggtctgg

SEQ ID NO: 6853434 - DNA, 70 bp, Homo sapiens
agttaaggaggtgggaacatagtcctgttcgaagtacatttcttacatgattggactccttccccttgct

SEQ ID NO: 6853435 - DNA, 84 bp, Homo sapiens
caaattggtggtaagcagaagtagtgggacctcatgcaagtctgcaggattgagaagcccacactctttcctttccaccatttg

SEQ ID NO: 6853436 - DNA, 74 bp, Homo sapiens
ggtaacagtaggtgataatgcaaaaggaatttatacattaaaagctaaattcaaatgcaagttactactttact

SEQ ID NO: 6853437 - DNA, 57 bp, Homo sapiens
aaccaaattggtgattatgatcactaatgtagattttttaaagtcattaatttggtt

SEQ ID NO: 6853438 - DNA, 80 bp, Homo sapiens
gagtgagtaggtaggcccaggttgactgggcagctctgggacagaccctattgaccagtgcctgggaccccgcctcactc

SEQ ID NO: 6853439 - DNA, 55 bp, Homo sapiens
gcgcttctgaatggctaatggtctctaagcgtaggccctaggctacctggagcgc

SEQ ID NO: 6853440 - DNA, 77 bp, Homo sapiens
gtcttgacatcatttctagttcctgtcatcaacctgggcactgttcaaacttggaagaacaagaaatgagtcagggc

SEQ ID NO: 6853441 - DNA, 114 bp, Homo sapiens
gtcttcatggtaataagaacttctttttaggtttcgtatgtggacatgcattcttatctcattgggtgcaatacatacttagacccagagaacatgttcagattgtcataagac

SEQ ID NO: 6853442 - DNA, 84 bp, Homo sapiens
tgaattaatactaccccagatacacagagcatcttcagaggagtgcagtgcctcttctgagtcatttgtttttgtttgtcttca

SEQ ID NO: 6853443 - DNA, 130 bp, Homo sapiens
ctggtgggcgccgcccttctccgcggcctgctgctgagccttccggtcgctcggggcctggggcagtggtcgggtctggaggagggctctgcggctctgccagggtcgcggacggaggaacgcctaccgg

SEQ ID NO: 6853444 - DNA, 64 bp, Homo sapiens
gtttgaatggtgagattgccatttcagagtttcaatgtattgatctgacaatctcatttcaaac

SEQ ID NO: 6853445 - DNA, 63 bp, Homo sapiens
tcttcctggcagtgtctgagaacataccaaactgaaagcatctcaggattgtgcctagggaga

SEQ ID NO: 6853446 - DNA, 84 bp, Homo sapiens
ctgaagaaatagttttgtgacaataaagcattcaaatatttttggatcttgaatgtattagagcagtagaattatttcaaacag

SEQ ID NO: 6853447 - DNA, 82 bp, Homo sapiens
gcgcaggtttgttacataggtaaatgtgtgccacggtggtttgctgcacctgtcaacccatcacctaggtattaagcccagc

SEQ ID NO: 6853448 - DNA, 93 bp, Homo sapiens
gcaaaattcaaggaagcactccctctctagtccttgcaagtatagagttggcacttgtccagacctgaaagggagtgcttccttaaatcttgc

SEQ ID NO: 6853449 - DNA, 87 bp, Homo sapiens
cctctctaggtcatcttcttcattcccttacttccgagcccttcttcatggttttggatgtggggatggagtgggatgtttggaagg

SEQ ID NO: 6853450 - DNA, 62 bp, Homo sapiens
ccttgtcattgggaaacagctagacagataataaaaaggggctgatattttgaagggcaagg

SEQ ID NO: 6853451 - DNA, 68 bp, Homo sapiens
gtctttgatgtcagttctcacttacataaaaatatttttaggtaggccagaactagaggtctaatgac

SEQ ID NO: 6853452 - DNA, 85 bp, Homo sapiens
acagaattaggagcaccaggaggtgatgttgtcagttgcattgctgagcattctttttgactcctggttggcttactatgcctgt

SEQ ID NO: 6853453 - DNA, 129 bp, Homo sapiens
ttgggtcagatgtccatcccttacccaggctttacagctggcccactgtgtggtccattcccaaccatgggtccatcactgtgggccaggaggcagagtcgtgtaagaagaactgtattaatggcttga

SEQ ID NO: 6853454 - DNA, 77 bp, Homo sapiens
gatgatttctaccagtattctccagctttactctgtttcttatacttgacagactgagctccaagcctggaatcttc

SEQ ID NO: 6853455 - DNA, 88 bp, Homo sapiens
gctgacattaaggctttgtagtgattgcttcattaaaggttaaggatttcctaatcagctaaagtattactagaaagctgttgtttgc

SEQ ID NO: 6853456 - DNA, 58 bp, Homo sapiens
gtattgatgcaatatattgatacaatatattaattgtgtcagtgtatacatacagtat

SEQ ID NO: 6853457 - DNA, 66 bp, Homo sapiens
gcccacaggcggagtggcgggcaggagaagcccctggctccaggctgcccccagccacccgctggc

SEQ ID NO: 6853458 - DNA, 66 bp, Homo sapiens
gctattccagatgcctaaatctgggcaaggctgctcaagcttcagtcaggattgggtactaatagc

SEQ ID NO: 6853459 - DNA, 62 bp, Homo sapiens
caataaagaagatttttgcaatacatgtataaaagcaaaagcaacacagatcttctttgttg

SEQ ID NO: 6853460 - DNA, 88 bp, Homo sapiens
ggagaatcgctggaacccgagaggtggaggttgcagtgagccgagatggcatcactgcagtccagcctgggtgacagagcgagactcc

SEQ ID NO: 6853461 - DNA, 62 bp, Homo sapiens
gagctcaagtagaagcctcgggctgggctcctctcctggggtggaacccttctgctgggctc

SEQ ID NO: 6853462 - DNA, 88 bp, Homo sapiens
cagacagcctgggctccggaaggcagccttgcattgtcacaaagtcggccctgcagtgcttggcaaccttctgaccagcctgcttctg

SEQ ID NO: 6853463 - DNA, 60 bp, Homo sapiens
cctgagtgaattccctcactgtctgcttcccttgccaacatcagagttagttcaatcagg

SEQ ID NO: 6853464 - DNA, 60 bp, Homo sapiens
ttgagactgagtctcgccctgtcgtccaggctgcactgcagtggcgtgatctcagctcag

SEQ ID NO: 6853465 - DNA, 58 bp, Homo sapiens
agatttctttgaattagagaggttacttttcagtgagttttttaattcaggcagacct

SEQ ID NO: 6853466 - DNA, 69 bp, Homo sapiens
agacatttctgggccacaagcctgtgtgatgcttttcagatcaaaacccaggtcgtgcctgctatgttt

SEQ ID NO: 6853467 - DNA, 81 bp, Homo sapiens
aaatgaaaaaatgtcgaatttgcctctagcctttcctgacaaccttagaaagcactgaggaaaaatttgatagattcattt

SEQ ID NO: 6853468 - DNA, 88 bp, Homo sapiens
aaggggagtgggttctaaaatgaaagggaaatggcacttgacttcttagatggcgggaacatgctttcatttcagagaaactgccctt

SEQ ID NO: 6853469 - DNA, 80 bp, Homo sapiens
gaaggtttgctttggtagcagctatagatagctaagatcattctttgtgaaatgtatggcatgcaacttagcattaattc

SEQ ID NO: 6853470 - DNA, 80 bp, Homo sapiens
tctggctctctgtctgttattggtgtataagaatgcttgtgatttttacacattgattttggatcctgagactttgctga

SEQ ID NO: 6853471 - DNA, 66 bp, Homo sapiens
aggcaggtgcaggagctgtgcagggacagaatgcagaatgctcacctgttgtattcctcacttcct

SEQ ID NO: 6853472 - DNA, 98 bp, Homo sapiens
aggagggattctccccaagaggctcagagggagcatggtctggccaacaccttgactttgcaattctagcctcttgaactctgggagaataaatgtct

SEQ ID NO: 6853473 - DNA, 78 bp, Homo sapiens
acacccactcaatgtctgtctatctatttaaatagggcttcttcccccagtggatagaaggaagaattgatcacgtgt

SEQ ID NO: 6853474 - DNA, 66 bp, Homo sapiens
ggaataggatttacctctgtaaccaacaggatactgtggaaatgacagagcgtggcttccaggtct

SEQ ID NO: 6853475 - DNA, 67 bp, Homo sapiens
atggaagttggaaccattcataaatctagggctgcttggacagaatcgtggttccacaacttctcat

SEQ ID NO: 6853476 - DNA, 56 bp, Homo sapiens
tctcttttagctggcagcatctgtgaactggccttgcctgccatgcagaaagctga

SEQ ID NO: 6853477 - DNA, 68 bp, Homo sapiens
gttagaggttcagtcgctataatatgtcatgattggttcgttgagtagtgtaggctgaaaaatctgac

SEQ ID NO: 6853478 - DNA, 66 bp, Homo sapiens
gatactttctcatttacccaagaacagggctttcacaggcatggagagggtgggagagagggtgtt

SEQ ID NO: 6853479 - DNA, 91 bp, Homo sapiens
ggcagtatccatgattttcaatatccgagtagcctaagacagttcatttttgaactctagtgctccttggaggaaaacaaatgaatttgct

SEQ ID NO: 6853480 - DNA, 58 bp, Homo sapiens
ggatgggttgcctgctggtggaatccccattgagtccagatcatgcagcaaaccaacc

SEQ ID NO: 6853481 - DNA, 58 bp, Homo sapiens
gagcttctgccatagagggactttgcacccgctgccctctgtcaggctgcagatgctc

SEQ ID NO: 6853482 - DNA, 55 bp, Homo sapiens
gtgtgcagggggtccccatgccacccaaccctgggctgagtgggcccctgcagac

SEQ ID NO: 6853483 - DNA, 106 bp, Homo sapiens
ttttctatacttgacatttcaatctcattatgggtcaatgctcaatttttgctttatatatgggttccaataaagagaggaatgtctgtttcactgtcatagaaaa

SEQ ID NO: 6853484 - DNA, 71 bp, Homo sapiens
gttgaatgccagcccctgggggcagggtaagagccaagtcggcttcagctctgcaccaggtggttttcagc

SEQ ID NO: 6853485 - DNA, 114 bp, Homo sapiens
tccattttataagttaaagaatcatagcagtaaaaactttatagccatttcactctaattattagagtgagaacctcgaagattttgccctttgaaaatgacttgttatttggg

SEQ ID NO: 6853486 - DNA, 87 bp, Homo sapiens
aaaggactttctgttttcatggtgtaggtatattatataatttactttactggttacctattcatgaacatttagagggcttccttt

SEQ ID NO: 6853487 - DNA, 95 bp, Homo sapiens
ggagtggggcagggggcggcttattcactctggggattcgccatggacacgtctcaacagtgcaagctgctccccgtgtttccctgccccacttc

SEQ ID NO: 6853488 - DNA, 102 bp, Homo sapiens
gaggacactatgaagtaagtgataggattattcccatttccaagataagaaaattgaggcttggagaggttgaataacttgtcgaaggtcacatggctcctt

SEQ ID NO: 6853489 - DNA, 59 bp, Homo sapiens
tgccattcttgtctcttcagcagagctgctgtgctactgaaatgatgtacaagaaggca

SEQ ID NO: 6853490 - DNA, 68 bp, Homo sapiens
gtgacagagtctgtgtgtccccctgggtggtgagtcccaccttgtctgtgcacctgggctctggccat

SEQ ID NO: 6853491 - DNA, 94 bp, Homo sapiens
gtgtatattttctggtgagaaagttgtatctaagaaatgacctagagcttagttgcttatttccaaactggatatacctcagcagatgatacac

SEQ ID NO: 6853492 - DNA, 57 bp, Homo sapiens
gccagggttttgaatgccatgatggccaaatgaaggctataaattcagagctttggt

SEQ ID NO: 6853493 - DNA, 81 bp, Homo sapiens
gctcaggctggagtgcgatggcgtgatcttggctcactgcaacctccagctcccaggttcaagcgattctcctgcctcagc

SEQ ID NO: 6853494 - DNA, 63 bp, Homo sapiens
cagaatgacaggaaaggttacatttttcattctaaatggagtgtttttctctgtcgtcttctg

SEQ ID NO: 6853495 - DNA, 61 bp, Homo sapiens
tctgatgttgatgcttctgcctctctcttccacagtcaaggcccctgggtattacatcgga

SEQ ID NO: 6853496 - DNA, 56 bp, Homo sapiens
gctggggctgctcactggcatatctgaaaaggtgggcctggctagaagctcctagc

SEQ ID NO: 6853497 - DNA, 88 bp, Homo sapiens
ccatcccaaatgctttttttacaatgtgatgttgacatttctccatcaagaggtgggtcagtgttacattatatagaacttggggtgg

SEQ ID NO: 6853498 - DNA, 74 bp, Homo sapiens
gggtctgagacatagggtctttgcaaagcataccacagtgctcctgccaaaatatccctacctgttgcaaattc

SEQ ID NO: 6853499 - DNA, 59 bp, Homo sapiens
tcttctacagtgactgcagccatagcattgatgctggtggatgctgtgctgtgtgagga

SEQ ID NO: 6853500 - DNA, 61 bp, Homo sapiens
ttcccatcccccatctgctgccttcctccagctaacgacaacagcagaaatggggtgggaa

SEQ ID NO: 6853501 - DNA, 57 bp, Homo sapiens
gcatgtgggaacacttaggcactaataatttaagtaagttgcctaaagccacacagc

SEQ ID NO: 6853502 - DNA, 94 bp, Homo sapiens
cttagttttctgaactgtgaaaaaattgctggcagagctgtgaatccagtgtaaatactagcagtcctgtagcgacttttttcgttttactaag

SEQ ID NO: 6853503 - DNA, 60 bp, Homo sapiens
tggtacttatacatttgcttgatacaaagatggatgtgtacaagtaaattgtagatacca

SEQ ID NO: 6853504 - DNA, 65 bp, Homo sapiens
gccaaggatattttcattcggatgctcacatatgactgagttgccacatgaggatgatccgtggc

SEQ ID NO: 6853505 - DNA, 70 bp, Homo sapiens
agtgtctgttgttcagaactctccaggtcaaatcacaggatttgtaaagagattcaggacagcagtcact

SEQ ID NO: 6853506 - DNA, 65 bp, Homo sapiens
gatggagagaaggcccagtgaggcgtgcaggactggagttcagtgccgtgctgggtcgctgcatt

SEQ ID NO: 6853507 - DNA, 91 bp, Homo sapiens
tccttaatgaaagcctgatgataaagttcattggagatttttgttatctttggtactattcttatcatccaaggctagcctttgtgaagga

SEQ ID NO: 6853508 - DNA, 72 bp, Homo sapiens
ctggccttcttcaggctggggtgctaaggtgttttgtggaagaggctggtggtcgcctgagcctgaggccag

SEQ ID NO: 6853509 - DNA, 58 bp, Homo sapiens
tagctacactagagttgcaatggaaattcctttgtttctataaagctttagttagttg

SEQ ID NO: 6853510 - DNA, 57 bp, Homo sapiens
atccagcagaaacctccatctagcctcagagtcagggaaagagggaatcagttggat

SEQ ID NO: 6853511 - DNA, 110 bp, Homo sapiens
tctgcactggcttctgaggttgctgcctgaggagcaacactgacatatctggaggacaaaagtggcttccttggcagcaagaatctcagaccctttaagtctagtggaga

SEQ ID NO: 6853512 - DNA, 56 bp, Homo sapiens
aggcaagttattggctcagagctgaactgtaaaagtttagagcatctacattgcct

SEQ ID NO: 6853513 - DNA, 129 bp, Homo sapiens
aaaaatatgctctctttgtggctcttttacaataagttgcttcagcttggtgaacgcttggggcccccattctccctgtagacatggctggggtatacattaatgaaaacaaaagggtccattttcatt

SEQ ID NO: 6853514 - DNA, 72 bp, Homo sapiens
gtctagactctctgtggttctactttgccagctaagagatctggtaaaatgtgaagagcccaagacaatggc

SEQ ID NO: 6853515 - DNA, 91 bp, Homo sapiens
agaaaatagtagattgatctcatataaaggccatttggatgtagactgggctccagatgtgatacgatcagggtttctgcttagggtttct

SEQ ID NO: 6853516 - DNA, 69 bp, Homo sapiens
gacctgacatgttgttaattgtggacctccatttagagtaaatctacaaagaagaattaatgtctggtt

SEQ ID NO: 6853517 - DNA, 116 bp, Homo sapiens
gggtggctcagcttcttggggctatgtagctgagctcgtcagcttggggttccttctttgctgcccttgctgcgtgctagcacagacttaccccagcaagacagaactgttcactc

SEQ ID NO: 6853518 - DNA, 60 bp, Homo sapiens
gagacactggagagagaaacaggactgtcagataaagggcgtctgtgactcctagatctc

SEQ ID NO: 6853519 - DNA, 55 bp, Homo sapiens
tctcaggctaccttgcacaagggtttctcttcctgtgcaatggtttgtactgtga

SEQ ID NO: 6853520 - DNA, 57 bp, Homo sapiens
tgtttgtaaagcagagccagtaatatttatggttttactggccctgccttacaaata

SEQ ID NO: 6853521 - DNA, 61 bp, Homo sapiens
aggactggcttctccagaaatcttggtggccactgaacaccgaacaggaggagccactcct

SEQ ID NO: 6853522 - DNA, 69 bp, Homo sapiens
cactgtgggcctgtcgtgggtggggccagcagcacatgcatgcctggctcacagagcagcctttgggtg

SEQ ID NO: 6853523 - DNA, 119 bp, Homo sapiens
gactgggccctgcctgtccctgccgcctgctgccatggcctcctgcaaggacccgctggtggtccttggtggggtggagagctaggccgcctggcagcagggagagcaccaccccagtc

SEQ ID NO: 6853524 - DNA, 99 bp, Homo sapiens
acctcatattttgaaaaaaggaggggcaaactcaattattacaaatttatttaagtttgcaaaatgtcttgtgttagtaccttctgagtcaaaacaggt

SEQ ID NO: 6853525 - DNA, 60 bp, Homo sapiens
gcttctatctgacctcagggcagcttctcagggcaagaagatcctagagcagatggaagt

SEQ ID NO: 6853526 - DNA, 79 bp, Homo sapiens
ttttgaacacttaaagatagatggcattgtacccagagccagctggtacaatggcatctatctataattgtgtataaag

SEQ ID NO: 6853527 - DNA, 125 bp, Homo sapiens
ggtcgcgctcactgcagattggagaacaggtgcatctcgtagctcttctttggaaacaaaagaagccaccagctgaggaagatgctcaccggtcaccgtccctttatttatgcccagcgatgacc

SEQ ID NO: 6853528 - DNA, 78 bp, Homo sapiens
gtccaatcaactctgtaggatccaggtggacccagaaatggaaccagtgaccatctggagactgaccagaggcaggat

SEQ ID NO: 6853529 - DNA, 57 bp, Homo sapiens
gctcatccagcaagccagggcctgtcccaaaggccaaggctctggaatctggtgggc

SEQ ID NO: 6853530 - DNA, 86 bp, Homo sapiens
ttgcagagagacaatttagttcagaattatgtgccaccctgactctacctggcaggtgccttctgtgctagctcttctatctgcaa

SEQ ID NO: 6853531 - DNA, 90 bp, Homo sapiens
ctcagagacggtaacactgatttgctcttggtcacacatccaataagtgtcagggtgccagaataagaccaatcctgtgtacctcctgag

SEQ ID NO: 6853532 - DNA, 82 bp, Homo sapiens
ccccggatgggagaagttgggaaaggggtaggagtcatgcagtcctgagttcaaatcccagctcagcctctcacatgcgggg

SEQ ID NO: 6853533 - DNA, 73 bp, Homo sapiens
tggcatggaagaaaggatatatagatgaaagaggttaataaaagttctgtcatcaaatatgctttctctgcta

SEQ ID NO: 6853534 - DNA, 86 bp, Homo sapiens
gaactggccagccccagccttctccctgtcccctccctctgccagccccagtggagaggcctgagaggctgcggactagctaattc

SEQ ID NO: 6853535 - DNA, 73 bp, Homo sapiens
cttccagaaacaggattgctggcagggacaggctttgcacaaggtctgtctctcaagggccgtcctgtggagg

SEQ ID NO: 6853536 - DNA, 55 bp, Homo sapiens
cccttagccaggaaatcgacctctctaagaggtcagagagttccgtggctaaggg

SEQ ID NO: 6853537 - DNA, 72 bp, Homo sapiens
gaaagccctgcctggggggaagtagggggcagcttttgtcttcccctgagacccctcagcactgaagttttc

SEQ ID NO: 6853538 - DNA, 128 bp, Homo sapiens
atagcatatcatcactgttgccagttttcaccagatgatttttcttcagctcagtaattagttctctgtgtttgtagaaaatggtttggggatggtggaatcagagagatgacctttgtctgtgttgt

SEQ ID NO: 6853539 - DNA, 71 bp, Homo sapiens
ggagaggggaatggtggtatatgtggtaggctaaacaatggccctccagagatgttcacattctaatctcc

SEQ ID NO: 6853540 - DNA, 79 bp, Homo sapiens
gctggaaaccgttagggtacacatgatggaaggttcagaaattgagggctttctaagtgattctagctggacttctggt

SEQ ID NO: 6853541 - DNA, 78 bp, Homo sapiens
tcaacacttttatagctatttattgagctccattgtgtacaaggtactttaataagcgtagaaggtatatcaggttga

SEQ ID NO: 6853542 - DNA, 67 bp, Homo sapiens
ttattccagtgggtggtttctccctgtgttgcagagttcacaggctgtacctagctcagtggagtag

SEQ ID NO: 6853543 - DNA, 70 bp, Homo sapiens
ttgcattttagatgttttctttgggtggttcttgtagccatcacagaaataaacataccttagtttgcaa

SEQ ID NO: 6853544 - DNA, 91 bp, Homo sapiens
gtcattgagggctacttccagagagttattcccctggcacttccagccaagcagagcagcctctctggttgtggcaaaagccattagagac

SEQ ID NO: 6853545 - DNA, 70 bp, Homo sapiens
ttctctcctttatctgctcagaaagtacagggtgttctgtttctcctgtgcatacagatcaaggagcgga

SEQ ID NO: 6853546 - DNA, 92 bp, Homo sapiens
tgctatttctaattggttttgttatctccattctttgtgttgtatttccctgaggtgtggagaagttaaggccagagttaacgtttatagca

SEQ ID NO: 6853547 - DNA, 87 bp, Homo sapiens
cctcaactccactcctcctcccaccgacttttcagaggtgatttttaattgctttttcccaggtggagagagggagtggagatgagg

SEQ ID NO: 6853548 - DNA, 55 bp, Homo sapiens
gtctgcttcctatctaaagtgtgccatggcctcttttcaaagactggaggctgat

SEQ ID NO: 6853549 - DNA, 64 bp, Homo sapiens
ggctggctcattttagcatcaggtttcatttctaatgtcacctctgccaagatgtgctcccgcc

SEQ ID NO: 6853550 - DNA, 64 bp, Homo sapiens
tggatgctgctcttgctctgtgacacatctgtttctgctcaacaggcaataaagggagtctcca

SEQ ID NO: 6853551 - DNA, 104 bp, Homo sapiens
gaaataaaacagacagtgcactccaggtgggattttgctgcttgaaggaatcccttagtcaagcaaggaatccttttgtaaagtaagtgctcactgtggatttc

SEQ ID NO: 6853552 - DNA, 81 bp, Homo sapiens
tgttaacatcccaggttttgtgtagaatagcttatctggttcatcaggtgagtgtgactgcaagagatgggacaaatgaca

SEQ ID NO: 6853553 - DNA, 63 bp, Homo sapiens
tctttctcttcagcacccagccccggggccagcaccgtgggtggagcagtgtggggtgaaaga

SEQ ID NO: 6853554 - DNA, 129 bp, Homo sapiens
gccgcctcccacttgcgcttggtgatctgagctgccatgtccgccgcggtccaggagcgcaggtcctcgttcagagcgatgtaatccttgccgtcgtaggcgtgctgttcatacccgcagaggaagcgc

SEQ ID NO: 6853555 - DNA, 68 bp, Homo sapiens
ggagatcaaatctgggatttctaaagttaagaattcaggccttggaaatggattagattagatctacc

SEQ ID NO: 6853556 - DNA, 55 bp, Homo sapiens
gtgccctgtctcttgtctccagtcatctgcctgacttggctgcagtgacaggcat

SEQ ID NO: 6853557 - DNA, 70 bp, Homo sapiens
gtttctcttttgtgatgtgagatgggcgtcttactccagtgctgcaacatgttcattacagaggagaggc

SEQ ID NO: 6853558 - DNA, 84 bp, Homo sapiens
gggagcctgccaggcgctgcctggattccctttgtccatgatacagccggaaatacactccaggcagtaggctgggcggttgcc

SEQ ID NO: 6853559 - DNA, 55 bp, Homo sapiens
gcagtagttctgattggaactttgggtatgagaggtttctggccaggatgactgc

SEQ ID NO: 6853560 - DNA, 68 bp, Homo sapiens
gcaccatgcaggtgtaaattttcaagagctcagaaggaactctttgatcccttacacactcatgatgc

SEQ ID NO: 6853561 - DNA, 130 bp, Homo sapiens
gtaagctactggtgagttgtgagacaatttagggattgcttttagtgaaattatatagaatagaaaatatgagagttcatttaatttggtaagagttttgtaaatgtatatgcatacacagtcatattac

SEQ ID NO: 6853562 - DNA, 60 bp, Homo sapiens
tggcaggtggacgtgctaaagcttgcagagaattcgtgaagcacagcatatccaatgtca

SEQ ID NO: 6853563 - DNA, 57 bp, Homo sapiens
cacagccatgtcctcattcttcatctctgccaggggaagagtccaggcaggcctgtg

SEQ ID NO: 6853564 - DNA, 81 bp, Homo sapiens
gccaagtattgtacattttactttgtttgaatgctggatatatttgtattcttatagtcttgaggtgtgctgatatggggt

SEQ ID NO: 6853565 - DNA, 85 bp, Homo sapiens
cagagatagaagcccagctttgaaccatatcaatccaggtaactggattaagatgatcaccaaatgctggtgcctctggctgctg

SEQ ID NO: 6853566 - DNA, 69 bp, Homo sapiens
cgctctgatttcttcattcattagatggatatcatattggcctctacgaggatttgagaggtgggagcg

SEQ ID NO: 6853567 - DNA, 102 bp, Homo sapiens
gacaactctatcattcaactgtaaacttgttcactgacttccaccaaacctgtcagtggagtttaaggacagatgaggatgccacagtaaacctgagttttc

SEQ ID NO: 6853568 - DNA, 128 bp, Homo sapiens
atattagaatcattcgggaatcaaattttaagtgccagtgctccctcaggccacaccataaactacaatgcctgagctgggagcctggcaccagtatgttttaaagttctcccaagtgatgccaatgt

SEQ ID NO: 6853569 - DNA, 60 bp, Homo sapiens
aggtagtgtagctgagtgggatcccatctaagacccatctgactccaaaagccacgacct

SEQ ID NO: 6853570 - DNA, 103 bp, Homo sapiens
tccatcacaccccatcccagcagtggcagaggctgtgaggatgccgctgggtcaggtggtgtcctacttaaccactgtcagcttgggatatggcattcttgga

SEQ ID NO: 6853571 - DNA, 75 bp, Homo sapiens
tgcttgcataactttcttcacccttgctgttaaagtcaaaatatcaggggaaaaggagagaaaattatgcaagta

SEQ ID NO: 6853572 - DNA, 68 bp, Homo sapiens
gctcccagccctgcgtgccaggggactgccttcaacaggatggtccgggatggacgcgggctgggcgt

SEQ ID NO: 6853573 - DNA, 71 bp, Homo sapiens
tagcgcttcatgtttgtaggactgaggcctcagctcctgaaggatgcctgcctttgcctgcgacgtggctg

SEQ ID NO: 6853574 - DNA, 62 bp, Homo sapiens
gctctgctgggtgggcagttattttcatggcttgccagcaagctgccccattcagttgatgc

SEQ ID NO: 6853575 - DNA, 58 bp, Homo sapiens
ggaaaccaaacatttgcggtggtgcggggggttccgtggctgcaggtgggtttggtcc

SEQ ID NO: 6853576 - DNA, 58 bp, Homo sapiens
ggtgagatgttagagaaatttctgccctcaaatttgtgggtggcaggtgacagacacc

SEQ ID NO: 6853577 - DNA, 77 bp, Homo sapiens
gagatgccaaaagtggattgaatgtatcttgaaagtagaaccaacaggatttgcaggtggattcaatgtgggatgtc

SEQ ID NO: 6853578 - DNA, 66 bp, Homo sapiens
ctctctgggtggcccctgagactcctccagtgtccctggctgggagcagcactgccacacagaggg

SEQ ID NO: 6853579 - DNA, 66 bp, Homo sapiens
gttttacttgtttaggaaagatgctagagaactactgtagtatctattagtaacaagagatgaagc

SEQ ID NO: 6853580 - DNA, 59 bp, Homo sapiens
gtcttgacttgaaaattcttcagggtcatagaggcctaagtattttcagtgttaacgac

SEQ ID NO: 6853581 - DNA, 76 bp, Homo sapiens
atctagatgaaaagtaaaagggttaattatctatacataaagacaattgactgtatttttagcttgtgttctagat

SEQ ID NO: 6853582 - DNA, 80 bp, Homo sapiens
cacacacagatagagctctcagggcaagctcggcgggccaggtcgagaaggctgatccttggagttttcctgctgttgtg

SEQ ID NO: 6853583 - DNA, 57 bp, Homo sapiens
ggcctgctctggctgtggtcagcgcctcggggctcgtggcccgagccggggttggct

SEQ ID NO: 6853584 - DNA, 74 bp, Homo sapiens
ttgatagaattaacttatacccagggcagaaataatatttgcatgattcctgtggctgggtaaagtactattag

SEQ ID NO: 6853585 - DNA, 55 bp, Homo sapiens
gcccctccgggcgcgtcatagcgcagctgcagccggacgcggtcccgagacgggc

SEQ ID NO: 6853586 - DNA, 68 bp, Homo sapiens
ttcctgcattcatgccctggattcttaagaacaacgaatgggagaaacacacagaaatgaatgaggaa

SEQ ID NO: 6853587 - DNA, 56 bp, Homo sapiens
aagacatgactgcacagccaaatgtggcagagttagccacttttgcagtatgtttt

SEQ ID NO: 6853588 - DNA, 78 bp, Homo sapiens
ccttccgggctgctggggaggcgcctcgacgttccatctggagagcctcgacgttccgcccgagcccggcgcgggcgg

SEQ ID NO: 6853589 - DNA, 80 bp, Homo sapiens
gaagacggtgtccactttcaatatgaggcaggttctaattcagcctcatgcataaccttgactttgtggatatctccatc

SEQ ID NO: 6853590 - DNA, 77 bp, Homo sapiens
atggaggtttggggagttcctttaggcccccaataaacctgtttgtggaggcctggggagtttcttcagacccccat

SEQ ID NO: 6853591 - DNA, 65 bp, Homo sapiens
gagaagatacactagaggaatgagatctcctacatgagtaaagtgttttctaatgtgtttttctt

SEQ ID NO: 6853592 - DNA, 72 bp, Homo sapiens
ctgggagctagattcaataaagctgttctgaccatgaacttggaactggcccctttcattctggaagcccag

SEQ ID NO: 6853593 - DNA, 120 bp, Homo sapiens
gggggcttttggagcaggttgggttctctagggctgtagactgggctggctgtgaccagtttccagggatgtggcagcaccatagagtggcctaagactgattggcatctgattgtcctc

SEQ ID NO: 6853594 - DNA, 61 bp, Homo sapiens
cgccagggctcgctcttgcccttcgcctggaaggccgaggaacggagcgggccgagcagcg

SEQ ID NO: 6853595 - DNA, 68 bp, Homo sapiens
agggcagacatatgttttaacagattatagcattagtcttagttttaattttgatttgtgtcttccct

SEQ ID NO: 6853596 - DNA, 67 bp, Homo sapiens
ctcccagtccagccccctgctaaaaggccattgataaagccttgaggcagggtcttggaagtttgag

SEQ ID NO: 6853597 - DNA, 85 bp, Homo sapiens
tcttagagtgtgatgccatcaatggttaataaaacatgttaatataatacaatattgccattatgacaattgaggaattacagga

SEQ ID NO: 6853598 - DNA, 94 bp, Homo sapiens
agaggtcttaaaagcttagtgtacatttaattttgcaaatcaatactattattcctggtttgcagctgcagtaaatgttcacctgtagatctct

SEQ ID NO: 6853599 - DNA, 72 bp, Homo sapiens
tgaatggctctggtggcaattgactggatccctactggctcagacctcccttgtcccaggaaccccatatca

SEQ ID NO: 6853600 - DNA, 78 bp, Homo sapiens
tgactgtggcagaaatgttgttgacatagcagatggtcttgatatttctgaaaaccggcaacatctttgccatggcca

SEQ ID NO: 6853601 - DNA, 59 bp, Homo sapiens
ctgtgggatttgggaaggccagttagatacaataactttgtccccttccagtccagcag

SEQ ID NO: 6853602 - DNA, 83 bp, Homo sapiens
gtagagttcacataggaatgtgaatcgcttggtcccgagatgctcaaagaataggtaggtgtcataatccatgccatctctac

SEQ ID NO: 6853603 - DNA, 57 bp, Homo sapiens
tatagccatctaaaggacaatcactccagacaagtgctgtccaacagactggccatg

SEQ ID NO: 6853604 - DNA, 75 bp, Homo sapiens
cagacatctcctctagctgtttttagagctatttttttcatggagaaatgcctacgagatagggagagttgtgtg

SEQ ID NO: 6853605 - DNA, 96 bp, Homo sapiens
ggggctaaggttgacttgagcccaggaggttgaggctgcagtgagccaaaatcatgtcactgcactccagcctgggcaagagtaagatcctgtctc

SEQ ID NO: 6853606 - DNA, 84 bp, Homo sapiens
ccggagttctggaggcaggctgccaggatactgtgtatccatactcgaatattcatcctgcaaagtctgtttctaacgctgtgg

SEQ ID NO: 6853607 - DNA, 78 bp, Homo sapiens
ttacagtgaagattcaggttcccattgtactagagagtgcagaaaggaaaccttaattattacaccaccttcctgtaa

SEQ ID NO: 6853608 - DNA, 56 bp, Homo sapiens
cagcatcacagtgcccgaagtcaactactgaatttacttctctggactagatgctg

SEQ ID NO: 6853609 - DNA, 84 bp, Homo sapiens
atttgtacatttacaataaatctttaggaagctcaaactctccatgaggatttctaatagagaatttaattgtgagaaacaagt

SEQ ID NO: 6853610 - DNA, 65 bp, Homo sapiens
ggagtacacagagactcaaaagggcaagaaaaattcattactcttccctctcagaaagtgactcc

SEQ ID NO: 6853611 - DNA, 121 bp, Homo sapiens
tggtacccaaatttttttttctttttaatttaagaactaagaagtgctgaattgaatatgtattcatttgaatattttgctcaggcttctaagaaagttgcagaagaggcttttggggcca

SEQ ID NO: 6853612 - DNA, 70 bp, Homo sapiens
gactcaatcataaaacataaggcccacaaatacctagagaggtatagtaactggcatgtttatgatagtt

SEQ ID NO: 6853613 - DNA, 101 bp, Homo sapiens
agattgagaagaggcgccgaacatgttacatggtaaacactcttttattagtggtcttttgagggaaagttgctgtgttgttctttgctgttatttctgct

SEQ ID NO: 6853614 - DNA, 124 bp, Homo sapiens
actgttgaatttgtcctttttattcgtttttattctgtgctttcaaaagaagggtttttctcaaaggctaattcaagaaggagcagagaagcagagactgagggatagtctcaacatgttcagt

SEQ ID NO: 6853615 - DNA, 88 bp, Homo sapiens
ggtcttgagtgtgccaaggttgtgcacctaaatgcatttattcattcccctaacatttactaggcacccacttaggccagtcaatgcc

SEQ ID NO: 6853616 - DNA, 62 bp, Homo sapiens
tcaaaatcaatgattgaagtggtgaactcttaactttttcatcacatatgtcatgatttggg

SEQ ID NO: 6853617 - DNA, 78 bp, Homo sapiens
acggatggtctctgcaggccaggctcaaagggcctcccacaccttccctgggcactggcctggacaggacaggtccgt

SEQ ID NO: 6853618 - DNA, 72 bp, Homo sapiens
acatttttatcctgagtgccagtgttatttataagcttcccaaataaatagatcactagaggttaaagatgt

SEQ ID NO: 6853619 - DNA, 65 bp, Homo sapiens
agtggcagagccaagatatgatcctggatgtgtaaatccaaggcctgtattctttgctctccact

SEQ ID NO: 6853620 - DNA, 72 bp, Homo sapiens
taagaggcaaaagatactcagatttctgcctcaataataatttggtatttatttgagtgtttcttccccttg

SEQ ID NO: 6853621 - DNA, 77 bp, Homo sapiens
cagttagagttattagagtcacagtagtttatgtatatttgctattcacagactgcagactttttgctgaataactg

SEQ ID NO: 6853622 - DNA, 117 bp, Homo sapiens
gtttctctttctttgatattcctagaaaaatactttattgtgatgggatcagaaccttagagttggaaagacccttagaaaaaacgtcttctagtgaataaataaagaagttgagac

SEQ ID NO: 6853623 - DNA, 81 bp, Homo sapiens
gcggggcaccgtaggaggagggtggaagagctgctgagaccgcaagtttaccagcctcccacccaccacatggtgctcagc

SEQ ID NO: 6853624 - DNA, 63 bp, Homo sapiens
tagaggcagtgggaaataagtgagaaaggtgtcatttcgctcttcttctgcctattgtgtcta

SEQ ID NO: 6853625 - DNA, 74 bp, Homo sapiens
ctgtccagtgggatggcctggccagagctctgctcagttgaagcatcgctccaggccctccctactctggagag

SEQ ID NO: 6853626 - DNA, 70 bp, Homo sapiens
cctcattgggctgatctgtggaagaagacaagcagaaaaagaagagtcaactctgcagaggagtttgagg

SEQ ID NO: 6853627 - DNA, 71 bp, Homo sapiens
acatgggcaccttaaaatgaggcagatactatgtcccccggtattgaacagtctcacaaggtggcttacgt

SEQ ID NO: 6853628 - DNA, 88 bp, Homo sapiens
tccctgctgtttgcataatgctactcctttctcagaccatgttgtcatggctgttggagctggaagatggcttggtaggttgcaggga

SEQ ID NO: 6853629 - DNA, 61 bp, Homo sapiens
aaatagtttggggattttttgagttagggattactcctcatcactgaagcctaagatgttt

SEQ ID NO: 6853630 - DNA, 72 bp, Homo sapiens
tgtagagttccttgcccacaataggtcattaataaatctttgataagtgggtgaagaggaaatatttccacg

SEQ ID NO: 6853631 - DNA, 75 bp, Homo sapiens
gttgccaaaactgtgactgagcattcacatgggttttcaaggcaggttcagtgtttgcttaagttatatggtaac

SEQ ID NO: 6853632 - DNA, 82 bp, Homo sapiens
catgattttatttttcagtgcactttttctggaaaacaattttgcaaggtgcaaggtattcagatgaagtgctgaaatcttg

SEQ ID NO: 6853633 - DNA, 74 bp, Homo sapiens
tcactttacagcttagtggtatggatcatgacaacccaacagaagatatgtccatccagaacctgtgaatgtga

SEQ ID NO: 6853634 - DNA, 67 bp, Homo sapiens
aatttatctttagtaagcttctacttaactagaggaaagagtatctggccatactagagaatagatt

SEQ ID NO: 6853635 - DNA, 68 bp, Homo sapiens
gtaccttaagctaagtgaaataagtcagtcacgaaagaatactgtgtgattccacttgtttgaggtac

SEQ ID NO: 6853636 - DNA, 80 bp, Homo sapiens
acaaagatttcccactctactacatgcttgttccatgctgggagttaatcagagtaggaggaatatggagtggcctttgt

SEQ ID NO: 6853637 - DNA, 64 bp, Homo sapiens
ggaccgaagcttacagttccacgtagcagctcatctcactgttaaggaaactgtggggttagcc

SEQ ID NO: 6853638 - DNA, 68 bp, Homo sapiens
cttgatgatgacgtcggtgatggcatcaaacacgaactacgttcttggtatcggtggcgcatgtgaag

SEQ ID NO: 6853639 - DNA, 70 bp, Homo sapiens
agttgtgctgcagggaactgaggcccagaggctgagcccttgcctgctgggccctgccctgctgcccact

SEQ ID NO: 6853640 - DNA, 110 bp, Homo sapiens
gggcccactctgcacctgaggcctccagggagggcccgagttgccccggctaccccatcctatgccgagggctccagccagctccttgtggccacaggtaccctgggccc

SEQ ID NO: 6853641 - DNA, 64 bp, Homo sapiens
tttgctcctctgtcaaatgagagtgttggtctgaacgatctctaaagcctggaagaggagcaga

SEQ ID NO: 6853642 - DNA, 56 bp, Homo sapiens
ggcagaggaggggtgaatttgccctatctgagctgggacattcatcttcttctgcc

SEQ ID NO: 6853643 - DNA, 67 bp, Homo sapiens
gttgttatcgttttgtccagagagtggtttaagaagcagtgctggtctctgagcccaatgtagcaat

SEQ ID NO: 6853644 - DNA, 73 bp, Homo sapiens
gctccaaggcttccagtgatgcctctttgcctagcaaaggttaggacccacagcagtggccaagccctggagc

SEQ ID NO: 6853645 - DNA, 60 bp, Homo sapiens
gctgcctgaagtgtctacactgcacctctggtgcactgatgtggttaacttctggcaagt

SEQ ID NO: 6853646 - DNA, 86 bp, Homo sapiens
actctaagagctaatgtttctataaagaagtttggggctccacacaaaagccttatcattcttcaaagaggcagagttttttgagt

SEQ ID NO: 6853647 - DNA, 65 bp, Homo sapiens
atgagcagccaagtttgagaagcagagccctactggagcaatgcttctgcaacttgaatgtacat

SEQ ID NO: 6853648 - DNA, 60 bp, Homo sapiens
ggaagagggtactcctttcctcctgcttttcttactaggatttatcaggaactctcttct

SEQ ID NO: 6853649 - DNA, 84 bp, Homo sapiens
ctcttactgaatttacatgtcacatggcttcataactcatgaaaatactccttcattgattccatgcagtaaaaggcaagagag

SEQ ID NO: 6853650 - DNA, 91 bp, Homo sapiens
gttgcatatttctgcatgttaattaggaagaggatgtcagcattcaataatgttattgttttgcttcctagaaggtctgcaaaaaggcagc

SEQ ID NO: 6853651 - DNA, 87 bp, Homo sapiens
gggcggagaagggtccattgaatcccatccaactgcatctgtgcccttcagatcaggattacacggggatgctaaatctcctagccc

SEQ ID NO: 6853652 - DNA, 57 bp, Homo sapiens
cctgatgtccataatcctgtaagcattacaatgtcatagtatttttgggctattagg

SEQ ID NO: 6853653 - DNA, 64 bp, Homo sapiens
acgaattgagtcacaaacggtaggatacaggttgaaaacctgcagtgaaagtatcttaatttgt

SEQ ID NO: 6853654 - DNA, 65 bp, Homo sapiens
atttcctctcttatctctctgaagagtctcccctgatttccctcttttcagaattgggaggtgat

SEQ ID NO: 6853655 - DNA, 64 bp, Homo sapiens
ggtccttttcccactgtatgttcagtctacccagccaacgtgctgactgagacagggcaggccc

SEQ ID NO: 6853656 - DNA, 78 bp, Homo sapiens
gagtgttcctggtcttggtccctatgactaggttctctcacaatactagtgaagggcaaccccaggcccaggacattc

SEQ ID NO: 6853657 - DNA, 93 bp, Homo sapiens
agaaaaacaggccaaagagagtcagtctgagcaccaggatttaaacctagagagcctgactcaagagcctgactcatctttcaccagttttct

SEQ ID NO: 6853658 - DNA, 60 bp, Homo sapiens
ttctttatagcatctaggatgattgcagtattttgctatgataaataatgctacaaagaa

SEQ ID NO: 6853659 - DNA, 72 bp, Homo sapiens
gtgatttgcatgcccctgttgtcttaaaatggcctaatgtcacagcagatccaggggttgtgtctttgtcac

SEQ ID NO: 6853660 - DNA, 68 bp, Homo sapiens
cctccaggaccacagcactctgcctctttccagtgagggcctaagaggcagcccgctgaggctggggg

SEQ ID NO: 6853661 - DNA, 68 bp, Homo sapiens
gggccaagagctgcctggattcaaagctcatgtgagcacatgcagacgggatcctggcagttacaccc

SEQ ID NO: 6853662 - DNA, 85 bp, Homo sapiens
gaggaaatgttttaaaagtgtgcaccttttgtaaaaaggctagagaagccctttatactaaggcatacaatagactcattttctt

SEQ ID NO: 6853663 - DNA, 56 bp, Homo sapiens
ttgctcttgtgcttttttcattgctagtttagaagcttgagggacattgggagcag

SEQ ID NO: 6853664 - DNA, 83 bp, Homo sapiens
tgttttcttctccagatttcccagaaaagtgatctcctcccatagtggtcgagctgtttgttttctgggactgagatttagca

SEQ ID NO: 6853665 - DNA, 72 bp, Homo sapiens
cctgcttctagcaccaagtcccttgtgaccctccccaggcaccctcccaggcactgtgcagtcccaagcagg

SEQ ID NO: 6853666 - DNA, 55 bp, Homo sapiens
gctcccagctggagcctcaacagaggttgtgcctgcttggggtgcagctgggggt

SEQ ID NO: 6853667 - DNA, 58 bp, Homo sapiens
gaggcacaccagggagtcttgtaagcaactggtgacaaagtcaggcttccctggcctc

SEQ ID NO: 6853668 - DNA, 89 bp, Homo sapiens
ggagaattgcttgaacccaagaggtggaggttgcagtgagccaagattgcgccactgcactccagcctgggtgacaagagccaaactct

SEQ ID NO: 6853669 - DNA, 56 bp, Homo sapiens
gctgaaatgggcactgaaggcctctccaagtggaggggccttggcctctttgcagc

SEQ ID NO: 6853670 - DNA, 62 bp, Homo sapiens
atctgtaacatcagtagcagaaacttctgatttacagtatgttcatatctgatgttatagat

SEQ ID NO: 6853671 - DNA, 81 bp, Homo sapiens
tgcaatagagcagctaatggaaaggaaaatcttccaagtgataggaaaatgacatttcacattggcttctatttctaagca

SEQ ID NO: 6853672 - DNA, 114 bp, Homo sapiens
tattttatcagaagcctgtacctcatcgagttccttctattcagctccaagaagctttaaggatctgggagagggaaagaagacttactgaggacaggataactgtcttaaata

SEQ ID NO: 6853673 - DNA, 56 bp, Homo sapiens
tactaggaatgggctatcccaagctgcaacaccttggaaatgcccattgcctcgta

SEQ ID NO: 6853674 - DNA, 56 bp, Homo sapiens
gctgattcgaggcagagacacgtgggggaccctggtcttctaaccctcagtccagt

SEQ ID NO: 6853675 - DNA, 72 bp, Homo sapiens
ttgctttggatggagggagttgaaagtattagctataaaaaccattagcaattcctagtcgatctaaatcag

SEQ ID NO: 6853676 - DNA, 61 bp, Homo sapiens
tcagtaggtctgactgggccctaaagaacggcattgttaacaagcccccagatgctactga

SEQ ID NO: 6853677 - DNA, 55 bp, Homo sapiens
tggagttggtaagatccataggtgaaatcctcctatgcatctatcttctactcca

SEQ ID NO: 6853678 - DNA, 130 bp, Homo sapiens
cctgggtcagtgctctaagtgaatactgttgtgtgttctgagtgactgtgaactgtttctgatcctcctttctgatagagatgaaaagaacacagtccccagatcaaaggctgcacagcatgtacctggg

SEQ ID NO: 6853679 - DNA, 95 bp, Homo sapiens
tccaggagacaggtgctactattatccttctgacattacaggtgatgaaacagaggcacataatcatcctagctaagcacttgtctgagtctgga

SEQ ID NO: 6853680 - DNA, 113 bp, Homo sapiens
gggatctggccagtgggtggcataaatttggtggacctcatcagaaccggacattgctgtcacggatttgactgaggtcctgccaggagtcggcctttgctgcctccagacct

SEQ ID NO: 6853681 - DNA, 56 bp, Homo sapiens
atgccagctatagacttgttattagttataaaaacatggactgtagagctgtgcat

SEQ ID NO: 6853682 - DNA, 123 bp, Homo sapiens
cattagacagtgcattcgggtaaggtgatggttccctaggtctctttggagttgattactatagaaatgggcatctggtggagcctcaggttgccaattgcattactcttcattttactgatg

SEQ ID NO: 6853683 - DNA, 59 bp, Homo sapiens
attaatatttgcaccttctgtcttttgtcagctggcagatttgggtgagggtagttaat

SEQ ID NO: 6853684 - DNA, 59 bp, Homo sapiens
gattaagctggagaaacctgggagggtagcagctggctttcgagggaatctccaatatc

SEQ ID NO: 6853685 - DNA, 64 bp, Homo sapiens
ctagtgagcacagacagaatccctactccccagaagcagcctgggaggggtctgtaatcattag

SEQ ID NO: 6853686 - DNA, 76 bp, Homo sapiens
cattgactggtgcagagtcacccagataattaggccaaagccatagaaacaaaatctgatgactccatgtctaatg

SEQ ID NO: 6853687 - DNA, 60 bp, Homo sapiens
tgctcccatatgaatgattgttccgtacatcatatgtgtcaaaccattcatctggtggca

SEQ ID NO: 6853688 - DNA, 57 bp, Homo sapiens
gtgtttcctagtttaatgaatgacagcaccatcccattctagaaaccagggaggcat

SEQ ID NO: 6853689 - DNA, 55 bp, Homo sapiens
gtgcaagaggacagtaagggtggaggtgtggatgcttaacccagtctttttgcac

SEQ ID NO: 6853690 - DNA, 104 bp, Homo sapiens
tggaaaaatgcagcattatcaggttatagttttggaaaatcatagatgaaaacagtagacattttaagacatataccctatataatgctcagcaaattttttta

SEQ ID NO: 6853691 - DNA, 63 bp, Homo sapiens
ttcagccaaagactgttgatggctgaattcaccacagtgagtcaccttcaattgtttggtgaa

SEQ ID NO: 6853692 - DNA, 70 bp, Homo sapiens
aatggcagttgagatggagttttggggatatgggcttcttggaacatttccttttactccggctgctatt

SEQ ID NO: 6853693 - DNA, 87 bp, Homo sapiens
agctttcacatcagagttctcacttcagagctgccctcaaaggctcactggggcttgctcaggtggggattacatatgtgagtagct

SEQ ID NO: 6853694 - DNA, 55 bp, Homo sapiens
tggcttaagacgaaaagaagggagaggcaaacacccttcattttaattaaagcca

SEQ ID NO: 6853695 - DNA, 89 bp, Homo sapiens
gctgtcagctcatcagctcaccatggggaccacactctgcagaagtgcagaggctgggacctcaggcatgagatgcagccttttacagc

SEQ ID NO: 6853696 - DNA, 75 bp, Homo sapiens
gagcctgtcaaccaaggacagctagtgatgccacaaatgtggctgttctcacttccctgtctgtgcagacatctc

SEQ ID NO: 6853697 - DNA, 57 bp, Homo sapiens
tgccagaaattgctggcattcgtttaagaaaaacacacagccagtcagtctttggta

SEQ ID NO: 6853698 - DNA, 75 bp, Homo sapiens
ggtttgtcctggatcatgcctctgaatttagtctctgatttttatccaggggtgatttttgacttgtataaaacc

SEQ ID NO: 6853699 - DNA, 67 bp, Homo sapiens
gtgtgctcagccaggggcaggccatatcacaggcttggcattggtctcccttgctggttggctgcac

SEQ ID NO: 6853700 - DNA, 67 bp, Homo sapiens
catgcatattttctactatatcgaagtggaaaatatatccatgtgatatagtgaaaaatatctcatg

SEQ ID NO: 6853701 - DNA, 92 bp, Homo sapiens
cccagttgctgcttccctggcctcccttccccagcacatgacctcacccttatccagtctggtagaggaagaggcctggataggagccaggg

SEQ ID NO: 6853702 - DNA, 65 bp, Homo sapiens
atcctcttctcaaatcatggtgaaataaaatggatagacttcatcagaggagcaaaagaggggat

SEQ ID NO: 6853703 - DNA, 65 bp, Homo sapiens
caggatgctgtggaaatgcctaacatgaggttctaatctcatccaagggctctgaggcaagactg

SEQ ID NO: 6853704 - DNA, 82 bp, Homo sapiens
caggagagaaagtgtatatattttcatggggaacacttactttccttattacatgctgtgtattttactctttctacttctg

SEQ ID NO: 6853705 - DNA, 84 bp, Homo sapiens
acaaatatttgcattacgttttttatgtgtcagggctgtgcttatagtgtgtacactgtgtttacatagagaatataattttgt

SEQ ID NO: 6853706 - DNA, 83 bp, Homo sapiens
agggattgataacagaatcagcagtgagtggctttcatggtggtagtgatggaagccactcattctggctcttttttaaccct

SEQ ID NO: 6853707 - DNA, 79 bp, Homo sapiens
ggtagagagccatggtggagatggggtctttctggacagcacacactgagggctccccacacccctccatggctagacc

SEQ ID NO: 6853708 - DNA, 129 bp, Homo sapiens
taactatttagcctgagcttctgaaatgataacacgtgcatatgtgtttacaaagatttcttacatatgttgagcaagcatgattaatatgtttcatttcaaaaggttattgctcagactacactacaa

SEQ ID NO: 6853709 - DNA, 78 bp, Homo sapiens
accgcacgcatccccacacccggtccctcccgctcagccctggccggcacagagaggctgggttggagatcgagtggt

SEQ ID NO: 6853710 - DNA, 114 bp, Homo sapiens
acaaaatattagcttggtgtggtgacatgtgcctatagtcccagctagtccggaggctgaggcggaaggattgctagagcacaggagttcaagcctgcagtgagctatgattgt

SEQ ID NO: 6853711 - DNA, 55 bp, Homo sapiens
gagacctgctccctctttgttaaaaggagacattagcaaaggcaggagaggtttc

SEQ ID NO: 6853712 - DNA, 110 bp, Homo sapiens
ccagtcctcctggtcttgcctgtccgctgtgcatggggagggaagcgctcaggcctgttacctgcctggagtcctcaacggggagaggcggagggagccggctggactgg

SEQ ID NO: 6853713 - DNA, 67 bp, Homo sapiens
ggactcagtcttgtgctatgtgaggccacacagtggaatggtttacagggttcaagaatgaaactcc

SEQ ID NO: 6853714 - DNA, 83 bp, Homo sapiens
cctaacttgggagatttttcaacaagaataggatcttttagaaagacctttcacagagtttggaattgtttccttagttaagg

SEQ ID NO: 6853715 - DNA, 91 bp, Homo sapiens
aggccatttaaatatcacttcttttgtgattcttcagttacttcaggccatctggatgtatacatgcaggtcacaggggatgctatggctt

SEQ ID NO: 6853716 - DNA, 92 bp, Homo sapiens
agagctaaggaaagctgagagctgtgtcaagataattgtcctcctctgaattagcagatatctttcagctgttttcagttctccttatctct

SEQ ID NO: 6853717 - DNA, 60 bp, Homo sapiens
gatctctgctggaagggacaccagaaatatctaatctgtctcccttgccatgtagaaatt

SEQ ID NO: 6853718 - DNA, 86 bp, Homo sapiens
tatgccatgtgtttcattgctaattgggaattgtttttctctacttgatagacttatgcttcaaatagtaaccaaatatgtgcata

SEQ ID NO: 6853719 - DNA, 81 bp, Homo sapiens
tgtcatcccctaaggcaagtgttggtctgagaagcgaaaccaagctggcacagcactgtaggcctgggagggaaagtgaca

SEQ ID NO: 6853720 - DNA, 79 bp, Homo sapiens
tccagtaccccaaatgtgtagaggggagagccgcaccagggctggcatggcttcagacttctgctacgtggctactggg

SEQ ID NO: 6853721 - DNA, 67 bp, Homo sapiens
gtagagagagagcaagcatgcatatgtacttgcacaatacccaatgacatgattctttctttcatat

SEQ ID NO: 6853722 - DNA, 71 bp, Homo sapiens
gagacaattagtagtgatgttatttcaagcaaaatccttgttctggaattccgtcctgatctgcttttctc

SEQ ID NO: 6853723 - DNA, 58 bp, Homo sapiens
gacaagtggagcttgggatgagttgcagtccctacttgtttccttagctgagcttgtc

SEQ ID NO: 6853724 - DNA, 57 bp, Homo sapiens
ctcttctttagtccagaccatcagttatctgctttgatgtttctgacggtaggagag

SEQ ID NO: 6853725 - DNA, 67 bp, Homo sapiens
tgaaggcaacctctgtggtcctgttctacccccacctgcggttttgcggccaaggagtttgacttta

SEQ ID NO: 6853726 - DNA, 57 bp, Homo sapiens
tggacacatatctttgattcccagatctttatagggagctacagagtttggtgttca

SEQ ID NO: 6853727 - DNA, 66 bp, Homo sapiens
tgtgcactgatgaggcaataggtactatgctgagtgcgttacaaggattgtttcatttaatgtaca

SEQ ID NO: 6853728 - DNA, 65 bp, Homo sapiens
ggaggacctgcctgctggctccacagatcagactcccagacttgaccagctgcttgcaggccttc

SEQ ID NO: 6853729 - DNA, 56 bp, Homo sapiens
ggttgggatttggattcctctggagccacagaggtgttgggagccaggagcccacc

SEQ ID NO: 6853730 - DNA, 55 bp, Homo sapiens
gctttggccaaagaaatgtgagtggaaataacacatgacatttctaggtgaaagc

SEQ ID NO: 6853731 - DNA, 82 bp, Homo sapiens
gctatatcatagatttgcttcacactaaaaatgttaaaggtttacaaatatttgattaaaatagtgttggtagtgtggtagc

SEQ ID NO: 6853732 - DNA, 56 bp, Homo sapiens
ttgggcacatcaggcccattttgttttcttctgggtcaaacaggccgagtgcctaa

SEQ ID NO: 6853733 - DNA, 55 bp, Homo sapiens
gtatttacagctgtgcctctggagtgctttctaaacgacagtgcagttgtagtac

SEQ ID NO: 6853734 - DNA, 84 bp, Homo sapiens
tgcactggccttgtacactgggtaagggactcctgaagccagaataaggcccccaggctgagcctcaggtgctggccatgagca

SEQ ID NO: 6853735 - DNA, 103 bp, Homo sapiens
cgcactaggcagccaagcccggggggaagagatggaacgctccaaggtcaaggtctcctggccgcggagcccttccagcccccagtgtttggcctcctctccg

SEQ ID NO: 6853736 - DNA, 59 bp, Homo sapiens
cctcacacagggagtctgaggggatagtgtttaagtgagcactcaggcttcctctgagg

SEQ ID NO: 6853737 - DNA, 63 bp, Homo sapiens
cctgtttcagaatttttagtgagtgtttttctcatgaatttttagtaaaattctgtaaagagg

SEQ ID NO: 6853738 - DNA, 84 bp, Homo sapiens
aggtgtagctcatattccagagtttcctgtatgagcaggctaaaattactgaccacaggactctctgaaaatgtacctatactt

SEQ ID NO: 6853739 - DNA, 76 bp, Homo sapiens
caccaagactgtataccaggcactgtggacctgtaaacaaatattaattgattcctgccctgggtggggcttggtg

SEQ ID NO: 6853740 - DNA, 75 bp, Homo sapiens
tttcagggcttttcttgtgactatcgaagggtcaacaggtgtgattcttcacaaatatatagaagggttgtggaa

SEQ ID NO: 6853741 - DNA, 103 bp, Homo sapiens
gcagatggtgtcctgcacatgggctgatgtgctcccaggtgggcctatgcgtagtgctcgtgtctgggagtgacatcattgcctaagatgggataaagttcgc

SEQ ID NO: 6853742 - DNA, 62 bp, Homo sapiens
ctggggaacaatttgccacactttcctagtttactttagcctctgggcagttgctttcccag

SEQ ID NO: 6853743 - DNA, 58 bp, Homo sapiens
tttcatttgagcatataagtggcccagttgtgcaactggggacttttgccagaggaag

SEQ ID NO: 6853744 - DNA, 67 bp, Homo sapiens
agacaaccacgcccttcatttgggtcagacttttagacaaaaccctgggaaggcttttggtatgttt

SEQ ID NO: 6853745 - DNA, 83 bp, Homo sapiens
ttttcagaaagcaaataaatgattcagcaggaaataggtggcatttatttcttatgcctagctctatcatttggtgctgaaaa

SEQ ID NO: 6853746 - DNA, 80 bp, Homo sapiens
gtggttaattatggaatgttgaggatgttgctgagatatatttcttcctaagtactcagattcttcatattcagaatcac

SEQ ID NO: 6853747 - DNA, 59 bp, Homo sapiens
ctgggatgctccggcctggatggaggctctccgccctctcccagctccgagcgccccag

SEQ ID NO: 6853748 - DNA, 83 bp, Homo sapiens
gtcagaggctgggctagggagacagagggcatgggcacaagtcctggctctgcccctcgctcaccagctctgaggccttagac

SEQ ID NO: 6853749 - DNA, 89 bp, Homo sapiens
cagagggctaaagccagctccctgtatcccatcagctcactgggaatggagagctcctggacgaacagggagtttgtgttgccttcctg

SEQ ID NO: 6853750 - DNA, 64 bp, Homo sapiens
agattccagggggacattggaggcaaatgatatatgccccaaagaaaacagtacctcaggagct

SEQ ID NO: 6853751 - DNA, 68 bp, Homo sapiens
tgggttctagcaccacattaaatagcaacaacctagtggtaatgctataaagtagatgggtgaaccca

SEQ ID NO: 6853752 - DNA, 118 bp, Homo sapiens
tatttatctgataaccagctcaaatctatggaaaagggatggatcttggccctggaagctcctggatttaagcttctgccctgccattcactggaagagagccaaccttggatgagta

SEQ ID NO: 6853753 - DNA, 98 bp, Homo sapiens
gtgagtatcctttctgctttttaaaatgcttgggttttctttctatgaatttccattaatgagcatctttaggaagagaaagattctgctttattcat

SEQ ID NO: 6853754 - DNA, 71 bp, Homo sapiens
ctggttttaagccactgagttctggagctgtttgttatgcagcattatccagcagaggttgataataccag

SEQ ID NO: 6853755 - DNA, 116 bp, Homo sapiens
ccaacctcaggtgatccaccagcctcagcctcccaaagtgctaggattacaggtgtgagccactgcacctggcagttttttgtatttttagtagagatggggtttcaccatgttgg

SEQ ID NO: 6853756 - DNA, 63 bp, Homo sapiens
tacacattcacaagcctacaaggttgtcagaggcaacccggtggaagcattgtggaaagtgtg

SEQ ID NO: 6853757 - DNA, 55 bp, Homo sapiens
tagtgtgttatctgccttagctcgtcagatacatgagaaatcagaccacacacta

SEQ ID NO: 6853758 - DNA, 59 bp, Homo sapiens
acaatgatggtattgatgagctaatttgaattgagtgcaatcattgccattaccattgt

SEQ ID NO: 6853759 - DNA, 75 bp, Homo sapiens
ccacgtgccaagatggaggtgtggagtcaaagggaaaggcgcctccctgctgcactcacacctacacttgtgtgg

SEQ ID NO: 6853760 - DNA, 130 bp, Homo sapiens
cacattttctttatccagttcaccattattggacacctaggttgattctatgttgttgtctcagtgaataatgctgtgataaacatatgagtgcatgtgtccttttggtaggattatttgttttccttgg

SEQ ID NO: 6853761 - DNA, 78 bp, Homo sapiens
aggatgtccagaagggtcccctgttctgacagactccacacctgaggaagcagaacaggagggcagatctgacatctt

SEQ ID NO: 6853762 - DNA, 74 bp, Homo sapiens
tttatcattttttctcagttctaattaataggagtaatgatcattgttagtgtgtttaggactgaaaagataga

SEQ ID NO: 6853763 - DNA, 106 bp, Homo sapiens
gcattttaagtgaagctatttatttatactttatactacatcattatggttcaaaaccaaaaggaatcgtgtggtataaaatgaagtatgtttctgtgaaaaatgc

SEQ ID NO: 6853764 - DNA, 61 bp, Homo sapiens
gactcctttcatgaacaggtttcatattgctttgtggtgttcctggagcctggaaggagtc

SEQ ID NO: 6853765 - DNA, 66 bp, Homo sapiens
aggaggagcatgggaaggctctggtggagagaacccttgaccaccagatctcccctgatgcctcct

SEQ ID NO: 6853766 - DNA, 72 bp, Homo sapiens
ttagcactttgattcatgcagattatgtgaagttgtttccccttttgtcctgcatatataatcataggctga

SEQ ID NO: 6853767 - DNA, 70 bp, Homo sapiens
ttctgaaaggcatgtcaggtagttagacaaggttttatcagtatgaattgcctttcatgccttcccagag

SEQ ID NO: 6853768 - DNA, 80 bp, Homo sapiens
tgctagatttctacctggctggggaatagccagcccgacagagccgggactgggccatgggccagcgaggcagtttcgca

SEQ ID NO: 6853769 - DNA, 77 bp, Homo sapiens
tctgtttgctcatttttaggaaggagactctattttcttcttggagatatagtaatattcctgaactcagccacaga

SEQ ID NO: 6853770 - DNA, 55 bp, Homo sapiens
tgctataagagtcacttttcctcccagtccttaggaaaagtgattttttctggca

SEQ ID NO: 6853771 - DNA, 74 bp, Homo sapiens
gacagataaagtaggcatttgataaattgaaacaggttttgaattattttgagagaatgtgtgctacatctgtc

SEQ ID NO: 6853772 - DNA, 76 bp, Homo sapiens
ggcactattcatgttgtactctgtggaatgaagcttccaggagcactgctccatagaatgcagtgtaaattgtgcc

SEQ ID NO: 6853773 - DNA, 93 bp, Homo sapiens
tctctgggcctttcccttccaaattctagggccttggttctcactttataaggaaaacaggtgataagaagaatgggaggctggcctggcagg

SEQ ID NO: 6853774 - DNA, 68 bp, Homo sapiens
tctactggtcagcttcagagtgttccatgaatcacatccatgtcacttggagaagctgatcccacaga

SEQ ID NO: 6853775 - DNA, 76 bp, Homo sapiens
ccttccccaaaacctgccagctgagaagggtgtcccctcagggtggactctgtcatggctggacaggcagggaggg

SEQ ID NO: 6853776 - DNA, 69 bp, Homo sapiens
gcctctggagtcagaccagcttgggttcaaaccctgacaccatcgctcacgagctgtgtcactttgggc

SEQ ID NO: 6853777 - DNA, 82 bp, Homo sapiens
ggctgagtctttctcggagggagggcatgctggcagacagagctttgtaaacagcatcctccttcccagagatgcttctgct

SEQ ID NO: 6853778 - DNA, 87 bp, Homo sapiens
gatgagaacccaaccatggcaccttgattgcaaccttgtgagatcctatacccaagggcccagccaagctatgctggattccttatc

SEQ ID NO: 6853779 - DNA, 110 bp, Homo sapiens
aatgactctaagaaggcaagagatgagactgtatgatttgagtttattgtgctatttacctgttgaccacattatgcagtaatacctgtttgctttctaaagaggttgtt

SEQ ID NO: 6853780 - DNA, 80 bp, Homo sapiens
aggcctgtaccttgccttgtttctcttctgtaggaaacaagtcctgaattaggaagcttggggcagggctactaggacct

SEQ ID NO: 6853781 - DNA, 79 bp, Homo sapiens
ctgttggcaatatttactgaagttgaaaatatgcatgttctctcaccaccagttctacttccagttatatagccagcag

SEQ ID NO: 6853782 - DNA, 77 bp, Homo sapiens
tgtgcaagtgttttcatgagcttaactgtgaaatgggtgcaagcagcatgccacacagagctctgcacacttttaca

SEQ ID NO: 6853783 - DNA, 84 bp, Homo sapiens
agtatggatgctttaattaatccggggtgaatttaattgctttagttaagtggaaatcgggttaaaaatgatgcagagcatgct

SEQ ID NO: 6853784 - DNA, 78 bp, Homo sapiens
ccctgacttttttctcatcccagaataggagaatggggccaagcccctcctgaaggcagatggggatcaaggttgggg

SEQ ID NO: 6853785 - DNA, 130 bp, Homo sapiens
agagggttagatgatacgggttaagtttcaattgcacagctgaatattttggggcttatccaacctgagcctttcaagactcattgagtattggtgtaagttgaccctgtggcttgatcgtcttccttct

SEQ ID NO: 6853786 - DNA, 84 bp, Homo sapiens
agctcaaagcacatcatgttgttcagacctcagctgtttctccttgacagaaggaagtctgtccaggtgaatgcttcaggagct

SEQ ID NO: 6853787 - DNA, 95 bp, Homo sapiens
ggccaaattgtagaagaaagtgttgatggattgtggatgcaggggtcctcttccccttctccccaactccatcaacactcttaaaaagtgtggcc

SEQ ID NO: 6853788 - DNA, 63 bp, Homo sapiens
taggtaaacttccctatgaggactctgctgttacattttcctcctctgtagttaagtttccta

SEQ ID NO: 6853789 - DNA, 58 bp, Homo sapiens
gcaggatgggagcttcactttgtctcagttgctctggcaaagagaagcctcaccttgt

SEQ ID NO: 6853790 - DNA, 77 bp, Homo sapiens
ttacttgagtattgtatttccagcttgaatgtccatatagtagtggcaaacattttgctagtgtaatgctttggtaa

SEQ ID NO: 6853791 - DNA, 66 bp, Homo sapiens
caatgtgaacatgagctctgtgtttggcacatagtaagtgctcaacatacatacatggtcaggttg

SEQ ID NO: 6853792 - DNA, 66 bp, Homo sapiens
gtaggcaaatctcagttggcctctggttgcttttgcctgagaggtgtgctgagatcatctgcctat

SEQ ID NO: 6853793 - DNA, 60 bp, Homo sapiens
agtaaatattttaggctttccaggctgtaatattacagtctgtgcctgaactatttcact

SEQ ID NO: 6853794 - DNA, 110 bp, Homo sapiens
tacagctggcctgtctcattctctcattttcctggctcagcttctgtgggaatttcagtttgttgccaccctgagctaaatgaccagaaatgcaaggtggctggcctgta

SEQ ID NO: 6853795 - DNA, 92 bp, Homo sapiens
aggtgagcagaaacatcttgggaagagggaaccacgactgtatcttcctcagcagacatgatggtgcagggtaccccttcccctgcccacct

SEQ ID NO: 6853796 - DNA, 89 bp, Homo sapiens
cctacaattcagattcctaggtttcattttagactcactgactctgaatctgccaatagtgagggccaggaatctgccgttttagtagg

SEQ ID NO: 6853797 - DNA, 79 bp, Homo sapiens
gagctgtggtgttaactggatttctttctgaacaaagtcattgaccattttgtaagcaaaaagtccattctccaagctc

SEQ ID NO: 6853798 - DNA, 56 bp, Homo sapiens
gtggcctttgtattcctgactgatccctgacaaagcagaataatagaaaggcacac

SEQ ID NO: 6853799 - DNA, 86 bp, Homo sapiens
atagcacaaagtcttgcccttttgtgaatctggaaatactgaatagcaccctgtactttggccaaaagggtaatacttcttgctgt

SEQ ID NO: 6853800 - DNA, 66 bp, Homo sapiens
tttgattaagatgcagattctgactcattaaatctgagatgggcaagagtctgcatttctgacaag

SEQ ID NO: 6853801 - DNA, 64 bp, Homo sapiens
agtgtcaaggttgagaaaccctgctctgtactataccctggggtcattctgtgactttggcatt

SEQ ID NO: 6853802 - DNA, 60 bp, Homo sapiens
ttgggataagtcatttggagccactggagggttttgagtgcgaaaaatgacttgatctga

SEQ ID NO: 6853803 - DNA, 78 bp, Homo sapiens
aggactcaaacaagtttgctaataagattagagtgaaaactttattaaactctggttcgtggtagattttatggtttt

SEQ ID NO: 6853804 - DNA, 59 bp, Homo sapiens
gttgttggccaagactcatgtcctatgtcaaaagcatgaacatttggtttggcagcagc

SEQ ID NO: 6853805 - DNA, 77 bp, Homo sapiens
agcaaacctttgggaatagcagggactgagctttagatgatggctctgaactgctggtttccaaccactagggtgct

SEQ ID NO: 6853806 - DNA, 65 bp, Homo sapiens
tctctagaaccctaggctggtaatgaacttaataatattaagtcctaacagactgggggcaggga

SEQ ID NO: 6853807 - DNA, 123 bp, Homo sapiens
catttttatctttgtaacttcctcatacagctcacttgtttcatcttctcttttcccatagtggagagaagctaaaccctgaagctaagattgttctgtgtgcttgaagtcaaagagagaatg

SEQ ID NO: 6853808 - DNA, 93 bp, Homo sapiens
gaggtgggatttgtggggcacgtgcctaaggagcaggcctaggaaagagtgagatgaagcaggctggtccccattgcccacccctcccacctc

SEQ ID NO: 6853809 - DNA, 87 bp, Homo sapiens
tctgtgctgaactgggtgatggtgaggcaaagttcaagctgaaaccatggtttggggctgcatttgcccactaaattagcagtcaga

SEQ ID NO: 6853810 - DNA, 82 bp, Homo sapiens
tcaggtgagtgtggggagctgccttagaccggaggtgtggacttttccttcccttttaggaagaaggcattcccgtatgtga

SEQ ID NO: 6853811 - DNA, 76 bp, Homo sapiens
gtcagtcaagtctggagcagatggggtccttgtgccattgacagctaccatggtttgttccagtctcaatctcggc

SEQ ID NO: 6853812 - DNA, 75 bp, Homo sapiens
tgtttttaaacttttttgggaataagggctgcctgttaactttctaatcccattaatcctagtagtttggaggca

SEQ ID NO: 6853813 - DNA, 56 bp, Homo sapiens
tctcagaaattacaaaagggacatttaggaattgttcacaaggtgatgctttgaga

SEQ ID NO: 6853814 - DNA, 55 bp, Homo sapiens
caatggtcgctattttctcacagcagccaactgtggaatgaaaatggagatcttg

SEQ ID NO: 6853815 - DNA, 90 bp, Homo sapiens
tgtctgttacatagtagatcctaaagaaatatttattaaaccaccacttatttagccaatgttgattgggaatcttctctatgctaggca

SEQ ID NO: 6853816 - DNA, 60 bp, Homo sapiens
gaaagtctccagcaagtctttggaagccctggggtttcaaagggaagacgctggaatttc

SEQ ID NO: 6853817 - DNA, 101 bp, Homo sapiens
gcgctatcctgggacagagctgtgggccccagccctgtatggaatggagatcccagatcctgagggctcggggctcatggtgcctatcctgggcatggagc

SEQ ID NO: 6853818 - DNA, 74 bp, Homo sapiens
gttaagctaaagtgaagttcagaatggcttgttaactgggtttattagctgttgaccttccctttcagcataat

SEQ ID NO: 6853819 - DNA, 60 bp, Homo sapiens
gctccgggccgcgccggcagcccggggacccggcgcaacttgccgggcagcctgaggagt

SEQ ID NO: 6853820 - DNA, 125 bp, Homo sapiens
tttccgtggtgagggaagcacaggtggtgggagcaggcttggcagggaggctggtttctagcggggagctcgccttctccgctcagctatttccataaaccaattatcgccgatcatctcgggag

SEQ ID NO: 6853821 - DNA, 74 bp, Homo sapiens
aatggagaagagagagctgagggagagaggcaccagagggccaatactcacctagggttttcaaacccttcatt

SEQ ID NO: 6853822 - DNA, 66 bp, Homo sapiens
ctggggacaccaggaggacaggcccctactttgctgagactagacctgtgcttcctggcaccccag

SEQ ID NO: 6853823 - DNA, 109 bp, Homo sapiens
gggaaatggtacaatatcaatattagtgtattaaaatgctcctaagagtatgctaagatttttgttgtttttggtatattggtactaagggtgttgttgtcatttacct

SEQ ID NO: 6853824 - DNA, 55 bp, Homo sapiens
cggcagaacgcttgtggccgccgttacgctcgtgtggaaacagcgccatctgccg

SEQ ID NO: 6853825 - DNA, 69 bp, Homo sapiens
tctagttagtggttgatactgtgtgttcatgataaattctgtttaggccaggtacaaacatcaactgga

SEQ ID NO: 6853826 - DNA, 73 bp, Homo sapiens
cctggcggaagaagtgtttgcccggtgttgcagtgagctcctgaaaagcgcttgcttcctgcactcagccagg

SEQ ID NO: 6853827 - DNA, 59 bp, Homo sapiens
gaagggctcggtagcagtcctgaggctcatggcgcctagagaaagccaccgagtctctc

SEQ ID NO: 6853828 - DNA, 130 bp, Homo sapiens
taacttcctttcacactcacaggtgctttgcaagcggaggcaccactcatcatcctcatcaccagacaataacgagagcctgggaggaaggtgagggagccctgtgctctgccctgtcggtggttgggaa

SEQ ID NO: 6853829 - DNA, 62 bp, Homo sapiens
taaagccaatatacctagcatatagtttatatagttgttgagatatgctgggtgttgcttta

SEQ ID NO: 6853830 - DNA, 60 bp, Homo sapiens
gacattttgcccttccttaagaaaataaataaattaatcataggtgaggggcaccatgtc

SEQ ID NO: 6853831 - DNA, 80 bp, Homo sapiens
aaacaggtgaaaatactggagaaaggtgctatgttgtttttaaactatgtatgttacttctgtatctgctttccctgttt

SEQ ID NO: 6853832 - DNA, 59 bp, Homo sapiens
gtggccactggcttccactgagtcacagagggctgggtgcggaggcagctgggctccac

SEQ ID NO: 6853833 - DNA, 108 bp, Homo sapiens
tcagtggccagaggcttcaaggcattcagggctctgggggctcttattataatggtaatgaaaattggaccctagaactttggacctccccagccttaaatccactga

SEQ ID NO: 6853834 - DNA, 70 bp, Homo sapiens
gcttctataagactcatatttctttatatttgagaaaggaaagaaatattgggccttataaaccggaagc

SEQ ID NO: 6853835 - DNA, 72 bp, Homo sapiens
gaaatttcccatcccttcaatttcattacctacattggtgactgatttttcaggagggccttttgggagctc

SEQ ID NO: 6853836 - DNA, 106 bp, Homo sapiens
ggagggagaagggaatgctcagtttgggacactttgagttgaaggggtctacaggagtagaccttcaactcaaagtgtcccaaactgagcattcccttctccctcc

SEQ ID NO: 6853837 - DNA, 69 bp, Homo sapiens
ggtgcccacaaccctcagcctgagcatctgtgtggtagctgcagcagctcagttctgggagggggcatc

SEQ ID NO: 6853838 - DNA, 57 bp, Homo sapiens
aaatttcttgaggctctctagctctggtcaaattatcatcagagttttaagaaattt

SEQ ID NO: 6853839 - DNA, 62 bp, Homo sapiens
caggggacattaaagctccatacccaatattctctgagtagggaaagtagtaatggcctttg

SEQ ID NO: 6853840 - DNA, 113 bp, Homo sapiens
ggatgatagttaacatttattgagtgtttatctgcaggaatctgtgctaggtgctgcatagacattacctcatttattcctcacaacaacattcaaggtagaacttatcatcc

SEQ ID NO: 6853841 - DNA, 81 bp, Homo sapiens
ctctgttcaccaggagcattttttattagttgctattgtgcagttattactgactgaaaaatactcatgggattattagag

SEQ ID NO: 6853842 - DNA, 70 bp, Homo sapiens
gtaacccttactagagacaccagtaccattctgcaaatagtagatggaaattgctttctgagagggctac

SEQ ID NO: 6853843 - DNA, 104 bp, Homo sapiens
caaaagaatactttgctctgagctttagctgggattttcttctctcacattattttggctttttcaggatttcagtttgaagtttaagtagagtcattcttttg

SEQ ID NO: 6853844 - DNA, 105 bp, Homo sapiens
gcaaattttctgagtatggtgtaatattcagctattgagttgaagagtgttgttcactgtaactactagttttgaatataatatgaataatcagcatgaaatagc

SEQ ID NO: 6853845 - DNA, 57 bp, Homo sapiens
actgctctgtggttggaagcctgaatgtgaatcgctgcaaccagaccacagggcagt

SEQ ID NO: 6853846 - DNA, 92 bp, Homo sapiens
aggctggagggaggtgtgagggttggggtgggaggcttgaattgagcacagccttgtagcatcttagcccagtgcatctctttccatctcct

SEQ ID NO: 6853847 - DNA, 58 bp, Homo sapiens
ctttgtggctcctgcaggccatttggatgtatacgggcaggtcacaggggttacaagg

SEQ ID NO: 6853848 - DNA, 55 bp, Homo sapiens
gttttcctgagcccagagatgcatgaaaaatggggaaaatgaggcttagggaggc

SEQ ID NO: 6853849 - DNA, 65 bp, Homo sapiens
ttggctgagattggttattccattaccctcccttagggatgaccatgtgacccagttttagccaa

SEQ ID NO: 6853850 - DNA, 129 bp, Homo sapiens
atactcacaaaaagactgaagatgtaacagatggtgccttgggatgggtggatgttatggatgcagaactgtcaacacacctatctcaattccattttaactttcacattatgtctccctgtggactgt

SEQ ID NO: 6853851 - DNA, 68 bp, Homo sapiens
tccgtagtatgatttctgagctcccttgttctccttcttcaagggagcagagctcttcatctgcaggg

SEQ ID NO: 6853852 - DNA, 111 bp, Homo sapiens
cattatgaacttggtaactagatatgcttttagaagacagcccttctattttagaaatggattttctagctgctttaaaatcagcatagctgtacaccaagtaaatcaatg

SEQ ID NO: 6853853 - DNA, 83 bp, Homo sapiens
tgaaaaagctccttataactggccacaaagaaggcatcaatgactttactaggtgaaaatgtggactagtgtttggattttca

SEQ ID NO: 6853854 - DNA, 63 bp, Homo sapiens
ctagggcagttcaacttcatagtggtgcagacggcgctctgttggttagctgagctggcctag

SEQ ID NO: 6853855 - DNA, 102 bp, Homo sapiens
aggtgattagcaaagttaatcagaattctgaagggcacaaaaaacaatatgaatgtaatagaattgtactttgtgctactcagatcagatgtgctgtcacct

SEQ ID NO: 6853856 - DNA, 61 bp, Homo sapiens
gaagtttacactaagcaggtgtgaggataaagtaacttcacatcagtttaggtcagatttt

SEQ ID NO: 6853857 - DNA, 86 bp, Homo sapiens
cagggccttccattgctcttttctaggtgggcagcctataggaaaggggatttacaacagtggaaaggagcagtaaaagtgctgtg

SEQ ID NO: 6853858 - DNA, 102 bp, Homo sapiens
aagtatgaaacgaaagtgcatctctacagaatctatgcttcacagtctctttagtgctctgtagcactgattctgctacagcttccattttcatttatgctt

SEQ ID NO: 6853859 - DNA, 70 bp, Homo sapiens
agcttcctctgtgacaaacagtcctggcatcatttctggatggctgggcagtggtcacagcagagattct

SEQ ID NO: 6853860 - DNA, 59 bp, Homo sapiens
gcagcatcctgggccacagtcctcacgactggctgggccaaagagacccaggacgctgc

SEQ ID NO: 6853861 - DNA, 78 bp, Homo sapiens
gtcaaaagctatagtcttgccagtgaattcagaactatcacagaagaaacgctggcattagggcagtggccttatgac

SEQ ID NO: 6853862 - DNA, 62 bp, Homo sapiens
tctgaaggattcagatttcattctgtaaagctagctacaacttgaggtgaatgtcttttaga

SEQ ID NO: 6853863 - DNA, 67 bp, Homo sapiens
cctactataaaatacacatctgtgatgagtaaaatcattttatagggaaggatattttaatggtagg

SEQ ID NO: 6853864 - DNA, 81 bp, Homo sapiens
tagcagagcagcagtgtggcttagggaataggcctgtgctttaaagtcagacaggcctgagtttgaactctagctctgcta

SEQ ID NO: 6853865 - DNA, 79 bp, Homo sapiens
tggcttagcaaggaccttcctgggaggtaaaccagcatcccctgtggggagcttatctactcagagtcaccgctgtcca

SEQ ID NO: 6853866 - DNA, 63 bp, Homo sapiens
ttgcaggctccccattgatctgcaggctacatcagcctaagatgagtggggagtcttaagcaa

SEQ ID NO: 6853867 - DNA, 58 bp, Homo sapiens
acccaggctggagtgcagtgggtccatctcggctcactgcaagctccgcctcccgggt

SEQ ID NO: 6853868 - DNA, 61 bp, Homo sapiens
ggccaacattggtcaactgtatcttggagagaccacaggtggccttggccagtgcatggcc

SEQ ID NO: 6853869 - DNA, 76 bp, Homo sapiens
tgtgtgtgtgtgtgtgtgtgtgtgtgtgcatgcgcacgtgcgtgtgtgaaggaatatatactcacatatgtacaca

SEQ ID NO: 6853870 - DNA, 114 bp, Homo sapiens
tcattccaacaatgacattacttatgcagaaagcggcaaacaggtgacattgagatcgaaggctttccatctgcaggtgctgctactgtgttgtgggcttgtccttgggaatga

SEQ ID NO: 6853871 - DNA, 59 bp, Homo sapiens
tggttccagttttcaatagagctgtcaaaataggcttgagaaggtgaaaactggcatca

SEQ ID NO: 6853872 - DNA, 59 bp, Homo sapiens
ctctatgtggatggtctgattccaaagcccaaatgagctaattttactgtcctatagag

SEQ ID NO: 6853873 - DNA, 65 bp, Homo sapiens
gagaaaggaatggtgtccaacctctgccagtcccaggagtggagcaggtcggcaccatttgtctc

SEQ ID NO: 6853874 - DNA, 66 bp, Homo sapiens
ctgcagtttgctaagagacaaaagaatattttataattagccttgtgttttgcttgcaaactttag

SEQ ID NO: 6853875 - DNA, 57 bp, Homo sapiens
gcgagcagacagctgtcctggatgctgctaacgtggcgctgcatcctgcctgcttgc

SEQ ID NO: 6853876 - DNA, 76 bp, Homo sapiens
agcccagaaaccagcctagaatgtgggggaggacatcggcactccatcccctcattacaggcggggagctgaggct

SEQ ID NO: 6853877 - DNA, 77 bp, Homo sapiens
atgaaaagatattttatctgccagagtggagacatgctttgaatgtctgttatttctgccaggtgagtttctatcat

SEQ ID NO: 6853878 - DNA, 74 bp, Homo sapiens
tgcctggaaggcccatgggaagaggccaggatctggactcagataaaccaagttccactgggcaatcttaggca

SEQ ID NO: 6853879 - DNA, 111 bp, Homo sapiens
gtgtgtgtacacataggatctagaatgacatgcaagagtatacacttaaaaatatgatgctttaatattcttattttgcttttcctgtgtttttcaattctttatacacac

SEQ ID NO: 6853880 - DNA, 90 bp, Homo sapiens
tcaataaatagtggaaaaaagggtattctggcatgaagactgtttatatgttatactggatttgtgctcattttccattaaactcattga

SEQ ID NO: 6853881 - DNA, 85 bp, Homo sapiens
tcttacttaaaacctagtcagcactgctgtgatttaagccccactataccaggttcccctccagccctgctggttttgggcaagg

SEQ ID NO: 6853882 - DNA, 106 bp, Homo sapiens
acccagagacaaagaccgatgctgtatcagactctgcttgaggttggatcagtgtggcctctgagaatgaggtttggtaaccgcgtgtgttctgtgtctgtgtggt

SEQ ID NO: 6853883 - DNA, 55 bp, Homo sapiens
ccttctttagaaggctgaaagctttgcctcttcccagtcttcccccagaagaggg

SEQ ID NO: 6853884 - DNA, 65 bp, Homo sapiens
aggagaaaatggaagacagataaggcagaaaatatgctttacaactttctgttctgtattctgtt

SEQ ID NO: 6853885 - DNA, 74 bp, Homo sapiens
gtctcatgactaagtgcattttaattgatattgtctggctgcttggatccaattagaactgtattggtctggac

SEQ ID NO: 6853886 - DNA, 92 bp, Homo sapiens
ggtttgtgctagctgactgttgctgttgatgaggcactcaatggctgcagccttctagatcttcagaaataacaacaattactgtacacgcc

SEQ ID NO: 6853887 - DNA, 70 bp, Homo sapiens
actggtgcccacccttcagagtgacattgatctgttaaccgtcattctctggtgtggttgtttaaccagt

SEQ ID NO: 6853888 - DNA, 67 bp, Homo sapiens
caaagttggggctgttgaaccaaactgacatttcttaacagttgatcttcttaaagacctcactttg

SEQ ID NO: 6853889 - DNA, 55 bp, Homo sapiens
gatcattaacaaccttacccttaaaaatcaaagtaatggtaagagttgagtgatc

SEQ ID NO: 6853890 - DNA, 80 bp, Homo sapiens
cctcctcctgcagggtagatgcaggctgtgggatcacttccttttcctttcagccccagtctggcctctgtggggggagg

SEQ ID NO: 6853891 - DNA, 64 bp, Homo sapiens
gagtgtctgcatccaataagtactcaataaatacaagttaattgacaaatggatgttgacattt

SEQ ID NO: 6853892 - DNA, 69 bp, Homo sapiens
tttgtttagcctttaacacttcacattgatggaatacatgagtgtagaagtgtgtagaagccagacaga

SEQ ID NO: 6853893 - DNA, 70 bp, Homo sapiens
ttgtgtttgttgcatttcttgtgtaactgagcttactcatatgcataaaatatgagaaatgtattcataa

SEQ ID NO: 6853894 - DNA, 129 bp, Homo sapiens
cttgcccaaactcaattagtaggaagtgggtacccagtctcttcaattccctctgtggcattagaggtatctctcagccatgagaagaaatgaagggcttttctgctttcttgattgggggtgacaaag

SEQ ID NO: 6853895 - DNA, 55 bp, Homo sapiens
attaggcataaaggttgtatgcaaaagtgttgcatagaacacttttgtgtctagt

SEQ ID NO: 6853896 - DNA, 72 bp, Homo sapiens
ggggccctctcaccttatagactcttgttgttagaagaaattcacagaatagcactgtaagcgcagggctcc

SEQ ID NO: 6853897 - DNA, 64 bp, Homo sapiens
ctcctgggtatcccttcctcggggttggtttgtcacagccagctctgggccaggaaccctaaag

SEQ ID NO: 6853898 - DNA, 55 bp, Homo sapiens
gagcttcctggagaacaacccctcgtgtggggtctgggctgagacttggaaggtc

SEQ ID NO: 6853899 - DNA, 97 bp, Homo sapiens
gctgggcccccagggatcccactggattgcaggctctgacaccaggctctggctggagctgtcttgctcactcttgcagccatccctggggaacagc

SEQ ID NO: 6853900 - DNA, 77 bp, Homo sapiens
gcttggggatgctgaagtgaagtgatcttgaacagatgtcagcatcaggacctgtacctcagcatctaacaccaagc

SEQ ID NO: 6853901 - DNA, 85 bp, Homo sapiens
tgtgtgtgtgagggagacggtggagatgctgccgtggccatactcagatttggaaaggtcagttccacttccatcatgccacaca

SEQ ID NO: 6853902 - DNA, 63 bp, Homo sapiens
ctacattcacttgttgaaggtggcaaagcccctgtggcctgaacccggagtgattatgtgtag

SEQ ID NO: 6853903 - DNA, 85 bp, Homo sapiens
gtcaaccagcagataccgggtcagcttcagaggaacttacattagctgtgccatttcctttggagcttgactggtagtcattgac

SEQ ID NO: 6853904 - DNA, 56 bp, Homo sapiens
atatctaatagatacagtaatgtgtgcataagcactcacactgtagatatagctat

SEQ ID NO: 6853905 - DNA, 57 bp, Homo sapiens
tggagaggcttgagaaagtgttcctaggcggctattgaaacctgctcaggctctcca

SEQ ID NO: 6853906 - DNA, 70 bp, Homo sapiens
tgaaaaattgtaccaacttttctctttaaatttgctttaaaagcaaattcagaaaattggtagagggtca

SEQ ID NO: 6853907 - DNA, 80 bp, Homo sapiens
tggtaaggatgagggaaagatgaaaatctaggagtctgctctcagatttctttgcccatgtttcctaagctctttatcca

SEQ ID NO: 6853908 - DNA, 106 bp, Homo sapiens
tttgctctattctgctgttctattccccttatctgtgactcaaagaggtgccaagaaaagagtctgagatgactttgggaagaaagagagggcagaagagagggaa

SEQ ID NO: 6853909 - DNA, 116 bp, Homo sapiens
tcttaagtgtttctttttggaatgggacagacatttcctgatccaatttgtaaacgaagattatctgttggcttgagtaatgtctgcatctttctcccaagaagaaggtcttagga

SEQ ID NO: 6853910 - DNA, 60 bp, Homo sapiens
aagttgcaagatgttcatgggctgttttgataatagagagaacacgtgcatctgcaattt

SEQ ID NO: 6853911 - DNA, 93 bp, Homo sapiens
attgttaggttgttccacccactgccgatgttccatcttgtcccaggaatgctcaggatggcaggataggcagggaacagccattcatacagt

SEQ ID NO: 6853912 - DNA, 71 bp, Homo sapiens
ttggattcagtcttgcagattcatttgtaacagctcacaaaaacaagtcagatttgtattattggttccaa

SEQ ID NO: 6853913 - DNA, 66 bp, Homo sapiens
caggaacaggggagtgaacctgaattggacgactaggaagaatttcaggctctgccattgtccctg

SEQ ID NO: 6853914 - DNA, 80 bp, Homo sapiens
tgtgtgactgattttcaaaatgtgttaaatgaaatatactttcaaggtccatttattcaagatgaggttcatgtcatata

SEQ ID NO: 6853915 - DNA, 61 bp, Homo sapiens
aggaagccaggctgggggatctgattagaaaacttctgcagtctccagtcttggacttact

SEQ ID NO: 6853916 - DNA, 59 bp, Homo sapiens
ggaagattcagttatctcatgaaagcctgaaatgctagtatgaggtctatgagatttct

SEQ ID NO: 6853917 - DNA, 63 bp, Homo sapiens
tgcagtgtcttgtggacttgaggcgtgctctaccaggaaagcccacaggccccaagacctgta

SEQ ID NO: 6853918 - DNA, 58 bp, Homo sapiens
tccactgtcccctgcttccttgcccttcagaaaggtcttggaaacaggggccagagga

SEQ ID NO: 6853919 - DNA, 67 bp, Homo sapiens
gatgtccctgttctgtggctctcaaagggaagatccctgagcacacatcagaatcacccaggacatt

SEQ ID NO: 6853920 - DNA, 63 bp, Homo sapiens
ttttgcagggtttgcattaaagcataagaaatgacaacttgctgaagagcaaaccaggcaaaa

SEQ ID NO: 6853921 - DNA, 63 bp, Homo sapiens
taattgcccatatttgagaatgactttattaattatgttgtttctttcatttagggctagttg

SEQ ID NO: 6853922 - DNA, 62 bp, Homo sapiens
gagggggcgtgcaaggctccgccggcccccccgcagcccgcgcccgacttgggcgccccctc

SEQ ID NO: 6853923 - DNA, 82 bp, Homo sapiens
ggggcggggcctgaggttcggggcccggcgctgcgttggcgggttcgccgcggcgcctaagccccgacctccctcccgctcc

SEQ ID NO: 6853924 - DNA, 92 bp, Homo sapiens
gccctagggtgtgccttctccctaaccaaatcctgaaataagccagtataccaaggatgtggggttagagggggtctggacttccttggggc

SEQ ID NO: 6853925 - DNA, 57 bp, Homo sapiens
ggtatcagagacccaccccaagcatgtatttagacagctttctgtggactctgcacc

SEQ ID NO: 6853926 - DNA, 69 bp, Homo sapiens
gcccaggtctgcagggttcggagagttccctgcttgttcacgggagctgaggagccccgtcggtctggc

SEQ ID NO: 6853927 - DNA, 56 bp, Homo sapiens
tgtgctttggagatgaggacatgcctcgtgggctatgctccttggcttcaaagcca

SEQ ID NO: 6853928 - DNA, 115 bp, Homo sapiens
caggtggctattgagcacttgaaatgtgtctgaccactgtattggacattactattgtagacagaactcgtgaacctgcagaggtcaaaaacaatattttatcatccattacctg

SEQ ID NO: 6853929 - DNA, 72 bp, Homo sapiens
gtttcagatctggattctagatctagatctgggttagatctagatcagatctagaatcatagattctagaat

SEQ ID NO: 6853930 - DNA, 58 bp, Homo sapiens
ccattgtaaagagtatactttgtttcaaaacagaaaaatgtatatgtctttagggtgg

SEQ ID NO: 6853931 - DNA, 56 bp, Homo sapiens
cattccttcttccatctccccaactgaaacttggggagatcttgcttgaaggcatg

SEQ ID NO: 6853932 - DNA, 60 bp, Homo sapiens
aagcttctttcattcaatataatgtatgtgagatcatacacattgtgtatgcgagagttt

SEQ ID NO: 6853933 - DNA, 81 bp, Homo sapiens
gagggctactctgtgcatttcaggacctgaacatcctgtctaattgtgtatcattccaggagtgtacagttccccatcctc

SEQ ID NO: 6853934 - DNA, 56 bp, Homo sapiens
gagaagaacttgggcaaagtcaaatctccccacttgattttgtttatgttcctctc

SEQ ID NO: 6853935 - DNA, 77 bp, Homo sapiens
tttctcccatcaaaggcaacattaggttgttctaatgctcagtagtgtgaccaatgcatgattttgtctgggagaaa

SEQ ID NO: 6853936 - DNA, 118 bp, Homo sapiens
actttactaaaaatttatactatactgcttactactgcatgtgtttgatgatggctgggaacattattctcatgtactgcagtaaaagcagagcttccgtaagattaatttcaaaagt

SEQ ID NO: 6853937 - DNA, 80 bp, Homo sapiens
cggagagcagccgcgggccctttaagggccgcgaggtgcgcggtctctttaaggcgggtcctggtggtttctgttttctg

SEQ ID NO: 6853938 - DNA, 81 bp, Homo sapiens
ggggaagggcagcagagccaggctggggcaggtcagggctccgccgccatgcctgtcgagcttggcagcaattccttcctt

SEQ ID NO: 6853939 - DNA, 56 bp, Homo sapiens
gggcatggtgctggtgttcatgggatacagaactgttgaagatacacaccctgcct

SEQ ID NO: 6853940 - DNA, 74 bp, Homo sapiens
agaagaaaccatgacaaaccatagacatgatgctttaaaataatggccctgctggtttgatcgttgatacttct

SEQ ID NO: 6853941 - DNA, 57 bp, Homo sapiens
tggaataactcaccaaggtcatctatgagaatagccgacctggagagattattacca

SEQ ID NO: 6853942 - DNA, 62 bp, Homo sapiens
tcactctcaaatattaatctttggcatgtctttatttgcttggggtatattttgagaagtga

SEQ ID NO: 6853943 - DNA, 66 bp, Homo sapiens
gttgatgttgacgctaagacttagaaccctaatgtttttggtcttcatccgtcacagcatatcaat

SEQ ID NO: 6853944 - DNA, 128 bp, Homo sapiens
tctgaacattgagaaaatattaatggaatgcctgttttatttcaagtgttgagctcataatgcatatttcaagttgtttatgaaacatttaaatctaggtgttccatctagaacctagtatgttcaga

SEQ ID NO: 6853945 - DNA, 89 bp, Homo sapiens
gggacctgccaatttcctgatcaggttcccatgtgtaactgaatcttctctaccagctatggaaacctaatcaggagagctaggatcct

SEQ ID NO: 6853946 - DNA, 55 bp, Homo sapiens
ggagaggagcagctccccctgctactggagggttgggaggaagctgcttctctct

SEQ ID NO: 6853947 - DNA, 55 bp, Homo sapiens
cagcagtggctgcaggcagctgggtacacgctgtaatttgcatggctgaatgctg

SEQ ID NO: 6853948 - DNA, 72 bp, Homo sapiens
gtggggttgcaggttccagagtacttacatccttaaaggacataaacatctgtagccttcagtcacccccac

SEQ ID NO: 6853949 - DNA, 55 bp, Homo sapiens
ggtggctcatgcctgtaatctcagcactttgggaggccgagatgggtggatcacc

SEQ ID NO: 6853950 - DNA, 57 bp, Homo sapiens
gtctgagccaaaataaacagcatttgccactacaaagcttgttggagatggccagat

SEQ ID NO: 6853951 - DNA, 87 bp, Homo sapiens
tctagttttcttttcctcacctatctctctcccatcagagagatagaggtagagatagagagggatgtggtgggagagaaagagaga

SEQ ID NO: 6853952 - DNA, 59 bp, Homo sapiens
tagtcaagattggaataatgtactgtacttaggctgtacttagggtttagatctgactg

SEQ ID NO: 6853953 - DNA, 100 bp, Homo sapiens
atgttctgggaaaactttttctgctgttatagtatgtatgtattcaggaagtgcaacattattaaactaagcataattcagaagctaagtttcctttcat

SEQ ID NO: 6853954 - DNA, 58 bp, Homo sapiens
ggccccgtggagctggacccaggcctctgaggaggggccacaggccggttccagggcc

SEQ ID NO: 6853955 - DNA, 56 bp, Homo sapiens
gtctgagacccactcccagagattctgatttcactgggctgaggtgtgtcccgggc

SEQ ID NO: 6853956 - DNA, 77 bp, Homo sapiens
ggcagctgccagcccaggtctctcttccagtccaggggaactccaaaggctgagggggcctgggtgggaatcaggcc

SEQ ID NO: 6853957 - DNA, 85 bp, Homo sapiens
tgtttttaaagccagatatacagcagtgaataagataaatgaatcattttgagcttataattgatgtgtggatatggcaaaagca

SEQ ID NO: 6853958 - DNA, 125 bp, Homo sapiens
ggattaaaggcatgcacctaattgttaaatattagtttttaaaaaactagtctgagtctgtctttatgggctctgagtggtttcacctttagaagcttgttttaggatcttgtgccaaccagtcc

SEQ ID NO: 6853959 - DNA, 55 bp, Homo sapiens
tgttggaattaggatacagaggagtgcaggcatcattggtccttgaattccaata

SEQ ID NO: 6853960 - DNA, 94 bp, Homo sapiens
atttggcaatgcctggatctatgatttggttgtcacaattgtggggaaggcactcctgacatctagtaggtagagaccaggaatgttgctaaat

SEQ ID NO: 6853961 - DNA, 82 bp, Homo sapiens
gtaggtggggagagggcccatgttgggctgctgggacctccagaccagcgggagaagggccttagactccagattcacttac

SEQ ID NO: 6853962 - DNA, 55 bp, Homo sapiens
gacttaaatgctcccctcagggcagcaacagccttaaggaagagcattttaggtc

SEQ ID NO: 6853963 - DNA, 87 bp, Homo sapiens
gtgtatctcttttatttcctttttttgtcttattgcattagaaagggctttggtgcaatgttgaaagggagtagtgagagagaacat

SEQ ID NO: 6853964 - DNA, 61 bp, Homo sapiens
cctgcaggcctgtggggagagatctcttagggccagctgccctgagcccccagcctgcagg

SEQ ID NO: 6853965 - DNA, 66 bp, Homo sapiens
gtggaagcagtaaggcaagtttagaagatggaatattctataaacaaatgacctgatttcttccac

SEQ ID NO: 6853966 - DNA, 68 bp, Homo sapiens
gttttagaggtctgtttcacatcactgctttaatttcttgtttgtcaatgtgtatagatttctggtgc

SEQ ID NO: 6853967 - DNA, 55 bp, Homo sapiens
gggagaagtcatctctaggttggcagtccctgtcagcctcttaggacttctcacc

SEQ ID NO: 6853968 - DNA, 60 bp, Homo sapiens
gaaacagggcagccatagggtccaggaaattgcccatcctgtggccctgcctctgctttc

SEQ ID NO: 6853969 - DNA, 71 bp, Homo sapiens
tcatttgtttcagagaaagcccaaagactgtaacctgcagtcatttgtcatttttttgaggtctcaaatga

SEQ ID NO: 6853970 - DNA, 67 bp, Homo sapiens
cttcttcaagggcgaggtccaatgtccttggaggtgtcaggggctttggtgctggtcctgtaagagg

SEQ ID NO: 6853971 - DNA, 129 bp, Homo sapiens
cacttcagaaagtctcatccaaaatgagtttgcaagtttttaatagtttccaaaggatcctggatgtcatattcaacctagagtgctattaaaaattcaggatagtttaattcgagactttaaaaagtg

SEQ ID NO: 6853972 - DNA, 74 bp, Homo sapiens
tggactacttgagttctcataatttatctatgtcatcagcactcaattgacaatttggaattcgagtaattcca

SEQ ID NO: 6853973 - DNA, 78 bp, Homo sapiens
ggagtctggtcattttctctccctgtaaccaactctatgtgttttaaatctggtgggtcatgaaattgaacaggctcc

SEQ ID NO: 6853974 - DNA, 65 bp, Homo sapiens
gttttctgtggtgggtagttcagaggtgtatagggcaggtttgagaatgtcaatcacaagagaac

SEQ ID NO: 6853975 - DNA, 73 bp, Homo sapiens
cttctctgcctggtgagttcctcagcttaaatgttacctctattgtgatgcctaactccaccaggcaggtaag

SEQ ID NO: 6853976 - DNA, 65 bp, Homo sapiens
ggcagcatgcaagtccagatgtgggtctgctcatgcacttccatggccaattgcaccttgctgct

SEQ ID NO: 6853977 - DNA, 69 bp, Homo sapiens
cagccctctgagctagtcaccatcattaactgagacggtggctaagacggtggaggctcagagaggttg

SEQ ID NO: 6853978 - DNA, 101 bp, Homo sapiens
gttgaattgttatgagtgtgtgtgtgtgctactggcatctagtgggaaagaccagggatgctgctaagtggtctacaatgcacaagatagccctccgcaac

SEQ ID NO: 6853979 - DNA, 87 bp, Homo sapiens
gaagtgagtcattagtcattgcattttctggaaaagtcggtagagaaaagtttaagtgaaatgtaatacagtgttataattcacttt

SEQ ID NO: 6853980 - DNA, 62 bp, Homo sapiens
ggggaatgacagtattccctttatcattcggtcctctgtggtagacagaataatgcatcccc

SEQ ID NO: 6853981 - DNA, 74 bp, Homo sapiens
agaaagacgtgatgaagaagtatcctaatatccatgctctaaatcctgggagcttttctttccacatcttctct

SEQ ID NO: 6853982 - DNA, 56 bp, Homo sapiens
tttctccctccactacaggctcctaacactggagtgagcccaagttaggggagaaa

SEQ ID NO: 6853983 - DNA, 59 bp, Homo sapiens
gaatgctgcctgtggcccttctgggtgaaattcacctattcgatacaggcaggcttttc

SEQ ID NO: 6853984 - DNA, 63 bp, Homo sapiens
tggtggggcgatcggaatcgcatcgtcaaaatactaattattgttgcatccaaagccccacca

SEQ ID NO: 6853985 - DNA, 66 bp, Homo sapiens
agtgctgatgaaggtgcttatcttttacaagtagattactgctgtaactaagcacattatctaact

SEQ ID NO: 6853986 - DNA, 56 bp, Homo sapiens
ggacaagcctgtgagtgggtttcactcagtggaatccctccaagcaggtcttgttc

SEQ ID NO: 6853987 - DNA, 61 bp, Homo sapiens
gggagagtagctggaaggttctgggagaccaagagcttgattaaagcctaacaactctcct

SEQ ID NO: 6853988 - DNA, 62 bp, Homo sapiens
gctattcatcaattgttctagccctcagttttgggatgcctaggacacattgaagtgaaggc

SEQ ID NO: 6853989 - DNA, 73 bp, Homo sapiens
gtcatagtgaggaaccatatttcaaatgacttcttttggtaagtgattatttaatgcggttttacataatgac

SEQ ID NO: 6853990 - DNA, 66 bp, Homo sapiens
aaattcttcttgaaactttaggttgttgtttgtgcaaagctcttcaacatgttgcaggaaggattt

SEQ ID NO: 6853991 - DNA, 68 bp, Homo sapiens
cagtagaaggaaagagcactttttgaggcttttgatacctcaagcaaatgtccttttgttctagactg

SEQ ID NO: 6853992 - DNA, 70 bp, Homo sapiens
tccctcatgaatggtctccgctggcgtatttctgatgtgcaaagaatgccagtgtctgctatctgagaga

SEQ ID NO: 6853993 - DNA, 60 bp, Homo sapiens
gcccctcctatgtaccaggctgtggtaagccctggggatacagccaggaacatgaggggc

SEQ ID NO: 6853994 - DNA, 69 bp, Homo sapiens
tctcatagggctgttgtgaggattgagcacagtggtatgctggtcagtgtttaacaaccagctctgagg

SEQ ID NO: 6853995 - DNA, 82 bp, Homo sapiens
ggttttggagactgagttgccctgccctgtgcttgcagatccactcagtgtgaagggcaggacagcttcccctttccacacc

SEQ ID NO: 6853996 - DNA, 62 bp, Homo sapiens
aagcagcttccccaaagtgccttggctcccaagggccctttacttactgggaaaatctgctt

SEQ ID NO: 6853997 - DNA, 64 bp, Homo sapiens
gttcaggtatatgtgcatccatagacgtgcttggtttcataattgtcttactataaacctgaac

SEQ ID NO: 6853998 - DNA, 63 bp, Homo sapiens
ggatgtgtgtgtgtgcatacgtatgtttaaacgactatatgcttgtcacacacatccacatcc

SEQ ID NO: 6853999 - DNA, 63 bp, Homo sapiens
tccctgaacacataggttcagtttgttgactattgagcctcactataatgtgttcagtgtgga

SEQ ID NO: 6854000 - DNA, 126 bp, Homo sapiens
cttaaaagttttgttgctagcatgagatattctttggcaaacataagcctttctcaattgtcctcaactggggaaacaggagaggcttattttgcctaagatccagccagcaataaaaaaataaag

SEQ ID NO: 6854001 - DNA, 84 bp, Homo sapiens
gtcctagtagtaccaaagtgctcatagtgcaggtagttttggcatgactctactgtagtatgggcacttccagtactcttggat

SEQ ID NO: 6854002 - DNA, 77 bp, Homo sapiens
ttgatcatctgccctgcccaggccttgggctttatgccagcacagagctcaaaggccaggtagcagcacatcctcaa

SEQ ID NO: 6854003 - DNA, 74 bp, Homo sapiens
cctgggatctgatagtcatttcaggctgcctccaaaactgagggacctgtcaatgacagttattcatttccagg

SEQ ID NO: 6854004 - DNA, 89 bp, Homo sapiens
tctgctcaccagagcgccttgccactagcatgctgtctgggtgtgcctggcagtcagagtgtgcaggccggctttgacaaagtgacaga

SEQ ID NO: 6854005 - DNA, 88 bp, Homo sapiens
tctatggccttggcaacagacagtagacatgggagctcttaactccctcctaaatgtaactgttatattttgttgctatggcaataga

SEQ ID NO: 6854006 - DNA, 62 bp, Homo sapiens
gaaagctggcaaggctttagattcagacagccatgggttcaagtgtcaggtcagccactttc

SEQ ID NO: 6854007 - DNA, 97 bp, Homo sapiens
tgtaagaactaccagagaaccatctgcttgaggaatcctttaaaaattgccatgggtcgtttagcagttcatggttccatcttgctctgttcttgca

SEQ ID NO: 6854008 - DNA, 79 bp, Homo sapiens
cttagctcattcttctgatgtgatgcctagctgcctctgcctgtgatacatgaggcattcacagaaggcaccagctaag

SEQ ID NO: 6854009 - DNA, 63 bp, Homo sapiens
gcttcccctccaagcactgcctgattccttttagccccttgcggctccttggaggcttggagc

SEQ ID NO: 6854010 - DNA, 55 bp, Homo sapiens
ggcgggcagcgtcttgctggcctcggtgctgctctccccaaggatgctgccggcc

SEQ ID NO: 6854011 - DNA, 63 bp, Homo sapiens
cggcaggactcagatccttccggagcctccaaacctgcggatctcagggttctggtctggtcg

SEQ ID NO: 6854012 - DNA, 62 bp, Homo sapiens
cctgggcagggctggactctcaaggaatcagtaaacaagttgagaagtccggcaggctgagg

SEQ ID NO: 6854013 - DNA, 75 bp, Homo sapiens
ggtaatagaaatttacagaccctcccactaagctttaagtaacaggcagaagggacagggtttgtagaggttacc

SEQ ID NO: 6854014 - DNA, 83 bp, Homo sapiens
tgtcgactttgtttccaaccccaccaaagtgccatccttcagtgaagtacaaggaggggcttgagaggtacgaagtcacgaca

SEQ ID NO: 6854015 - DNA, 65 bp, Homo sapiens
agtgctggataaatggtgtcttttctcatcctcttggagtattagaaacatcattgtttggtatt

SEQ ID NO: 6854016 - DNA, 130 bp, Homo sapiens
ctctgcctccagcttcagctgctcctggcccagaatgtacagctgctgctgaaggttgttgatgtagctctcgagcatgttgtccatgttgctctgtgccgtcttctgctgctactggaggctacacttg

SEQ ID NO: 6854017 - DNA, 61 bp, Homo sapiens
acttccagctgattggcatccaggatgggtacctatcactgctccaggacagcggggaggt

SEQ ID NO: 6854018 - DNA, 72 bp, Homo sapiens
atggctgcttctctgatggagtccaatgccttctctaggtttatcctgaacttccagtagggaggtggttat

SEQ ID NO: 6854019 - DNA, 72 bp, Homo sapiens
actgcccagaacttggcaaagccgactgacgttttggatgacgcagagggcttggggtcaggtgggggctgt

SEQ ID NO: 6854020 - DNA, 108 bp, Homo sapiens
aagggttcccagccaagtgcaatgatcaggatcagggctagcagagccacacagccatgtgcctttcacagccttcgttctgaaacacttaactcgggctgacctctt

SEQ ID NO: 6854021 - DNA, 66 bp, Homo sapiens
aagatgaaggaactaactatgtagagattcaggctctcttatctctcgtttttattccctcgtgtt

SEQ ID NO: 6854022 - DNA, 70 bp, Homo sapiens
ctttcattacaaccccaaattacaaatttatgtcttaagccttgtctttgtagaaagggttgtatgaaag

SEQ ID NO: 6854023 - DNA, 74 bp, Homo sapiens
acgtatgggaaggacattctgggctcaggaacatccagtacaaaggccctgaggtgggagtttttctcatatgt

SEQ ID NO: 6854024 - DNA, 58 bp, Homo sapiens
gctcatcttgtgactggtttttaaatattgatgttctatattctcttcacagatgagc

SEQ ID NO: 6854025 - DNA, 95 bp, Homo sapiens
agcacaaaaacttataaccaaagagagacctttcttctcagtgctcaagtcattctttgagaaagaagctctttttgatcatgaggctttaggct

SEQ ID NO: 6854026 - DNA, 60 bp, Homo sapiens
gttctttttccttcatatagatgccatatatatatggcagtagaatgggggaaaaagaac

SEQ ID NO: 6854027 - DNA, 66 bp, Homo sapiens
gggaatcattctgttttccatagcactggcagagcagctgctatggaaaacagaatggcacttcct

SEQ ID NO: 6854028 - DNA, 76 bp, Homo sapiens
tgactacctcttaatattgcaccttctcttttccagaggacagaacttttagaaggttaaagttaagggatgatca

SEQ ID NO: 6854029 - DNA, 65 bp, Homo sapiens
gggtaagaacaagctgggggttccactagcatgggctgtgagaatagaaagagctgtcattacct

SEQ ID NO: 6854030 - DNA, 68 bp, Homo sapiens
ctcttgtttcctttctgcagtcttcaacccctttgtttgtcctgaaactcagggagatagggcaagag

SEQ ID NO: 6854031 - DNA, 84 bp, Homo sapiens
ccttaccaaatattgctcttgccttcctctgcagtgattggttctgatcactgtagagaaagcatggaagctcattttacaagg

SEQ ID NO: 6854032 - DNA, 59 bp, Homo sapiens
acccctaggaaaagacatcgagtcgcttgcagaagcagtgtgttttctctctgggaggt

SEQ ID NO: 6854033 - DNA, 60 bp, Homo sapiens
gcattgagtccactctgtcttttgaaacacttcattttgccagtgagtggattttcatgc

SEQ ID NO: 6854034 - DNA, 59 bp, Homo sapiens
gacccagagacagtttcacagggtctacaaagagatagacccagagactggctctgctc

SEQ ID NO: 6854035 - DNA, 63 bp, Homo sapiens
ctttgccaggagctcatctgagggaagagacacagaccttccctggagctagtctgagcgggg

SEQ ID NO: 6854036 - DNA, 76 bp, Homo sapiens
ttgcttgagcccaggagtttgaggctgtggtgaactatgatcacaccactgcactccagcctgggcaacacagcaa

SEQ ID NO: 6854037 - DNA, 86 bp, Homo sapiens
gctgtcaccatgcaggcaccagacccgggcccggcaccagacactacctcaccccgcccaggtctgccagcctgtgggacctcagc

SEQ ID NO: 6854038 - DNA, 61 bp, Homo sapiens
actgtgcttgctggccagtagctgtgcccccattttacagctaaggaagctgaggcacagt

SEQ ID NO: 6854039 - DNA, 61 bp, Homo sapiens
aggctactgtctctttcttcccaaaatattctgttttggtaattaagtagatatttggcct

SEQ ID NO: 6854040 - DNA, 92 bp, Homo sapiens
gtgtgcatctgtatttatatataaacatctgtatatgtgcatatatgtgtgcatatacacatttgcttatgtgtatatatgtgggtgcatat

SEQ ID NO: 6854041 - DNA, 106 bp, Homo sapiens
cccgcgggcggagcggcgtacctgagcgcggtccccacggaggatcagtgactttcccagaccccgcgggcgagcccgcgcttgggacccggcagctctgcgcggg

SEQ ID NO: 6854042 - DNA, 67 bp, Homo sapiens
gagaagtgcacttgctcctggaaaaaccattattcaaaagcttttgcagaagtaagggtaacttctc

SEQ ID NO: 6854043 - DNA, 61 bp, Homo sapiens
gcaatgcacctgaactccatcagctgatgcttctccagctgctgagccaggctgatgttgt

SEQ ID NO: 6854044 - DNA, 104 bp, Homo sapiens
gcatcatgagtatcatctgaaagcttgttggaaatgtagcatcttccccagatttgctgaatcagaatctgcattttgaacaagattcctggtgattcatgtgc

SEQ ID NO: 6854045 - DNA, 88 bp, Homo sapiens
agtgtgtccatgttaaatgcagattcctaggccccattgactagcccaggatgtgggtggacctgggaatctgcatccttagcacgct

SEQ ID NO: 6854046 - DNA, 58 bp, Homo sapiens
ggattcagggtaaagtttcagttatgtcccagtaatcatttattttaccctcgaatct

SEQ ID NO: 6854047 - DNA, 74 bp, Homo sapiens
ttttctaaattagctttcctactaataaataaaatatttttcttatgctcggtcaggaaagctaaatgggagag

SEQ ID NO: 6854048 - DNA, 74 bp, Homo sapiens
ggaagtctggttattgggtcaaaggatatgaacgtttttttatgtctcttgttaatgattactaaattgcttcc

SEQ ID NO: 6854049 - DNA, 90 bp, Homo sapiens
ttgactggaatggacccaaggaataccctccctttttgcctattgaagaggctaagcaggagatgggtgcttttcatgttagccagtcaa

SEQ ID NO: 6854050 - DNA, 109 bp, Homo sapiens
ggaaagttttgcagtggggggctaatgtggaaaatataattggttttatataaaagtccataatataagacacaaatatcttttacattaactgatgggcaacacatcc

SEQ ID NO: 6854051 - DNA, 76 bp, Homo sapiens
tgcacaagaatatgaggaaactgtgaatcagcaaatattgcaaagcaatagaatcacagttctcattttttatgca

SEQ ID NO: 6854052 - DNA, 78 bp, Homo sapiens
tgcttagaaattaatgtgagcaagtgagcctcctctttttaaagccattttggattgagagtatttgttttctgagca

SEQ ID NO: 6854053 - DNA, 75 bp, Homo sapiens
tgctgaagcattctatagtctacattacataaaataagatgttccatgtgatttcctttgaagaatgcttgagta

SEQ ID NO: 6854054 - DNA, 121 bp, Homo sapiens
tgatgttaaggtagtgttcaccaggtttctctactgctaagttagtatttttccctttataattaataagtaatttgtgcagagatactttgagactatgtaaatatctatttcctcatta

SEQ ID NO: 6854055 - DNA, 95 bp, Homo sapiens
ctctagatgacaagtagaaggcaggttttaaaatgtctgaaaattgcaacttcagcgcttttgcaacacctgcttttacgatctgtcacgtggag

SEQ ID NO: 6854056 - DNA, 60 bp, Homo sapiens
gctgtgggcagttgccgggagactggcctcaggcatcagtctccgccagctcctcacagc

SEQ ID NO: 6854057 - DNA, 55 bp, Homo sapiens
acccaagcttctcacagtgatagcatttgcatattacacagtgaaagcatggagt

SEQ ID NO: 6854058 - DNA, 75 bp, Homo sapiens
agagtggaaatatctgatgacgtgactatgtcttagtgagaagacagtgcatggttagacatcaatgtgagctct

SEQ ID NO: 6854059 - DNA, 56 bp, Homo sapiens
taggtactggacataatataagcaaataaaataagttcaaattatgtcagtactta

SEQ ID NO: 6854060 - DNA, 64 bp, Homo sapiens
tgctagtgcagggttttcagttctatataggtataatcaagccactgactgcctctgcagtgca

SEQ ID NO: 6854061 - DNA, 71 bp, Homo sapiens
tatagctaaaataactcagcacattcctgtttacaaggaattatttgagtaactggggaatttgagctatg

SEQ ID NO: 6854062 - DNA, 57 bp, Homo sapiens
cctgttgatgttggagttggccatgtgacttgctttggccaataaactgttagcagg

SEQ ID NO: 6854063 - DNA, 74 bp, Homo sapiens
ttctctcaaacccttttcagagttgatatcattcccacatgggatgaggagtcgagaaggggtaatttagagaa

SEQ ID NO: 6854064 - DNA, 129 bp, Homo sapiens
cttcagggtcacctggggtgccagttcagaattcagagtcctggccccacgcctgaaaatactgactcactaggcctggggtggggcctggaaatctctatctttaacacgccactgctgactctgacg

SEQ ID NO: 6854065 - DNA, 75 bp, Homo sapiens
tatctctttgagcagtttggtcatttgtcttgtagagttctgacaccggatttggccaactgcaactctgaggtg

SEQ ID NO: 6854066 - DNA, 74 bp, Homo sapiens
acaagctccttctatagcccttcgggggtctacttgtcattaagtgctctctccccagtgctactggagtttgt

SEQ ID NO: 6854067 - DNA, 94 bp, Homo sapiens
ggcccctcattacctatctcactggccagctttgcttctttccacctggaggcatttgagccattggcctgtgatctatataatgtctggtgtc

SEQ ID NO: 6854068 - DNA, 64 bp, Homo sapiens
ccaggctgtgcttttcataaataagattcatgttctttattctggaacctagcactgtgcctgg

SEQ ID NO: 6854069 - DNA, 81 bp, Homo sapiens
tattttgtttctcccataaaatttatgcttatgcgttatcttgtttggccattagactgattctatgggataagcaggata

SEQ ID NO: 6854070 - DNA, 68 bp, Homo sapiens
ggaaaactgtgtttttggtctgatctatcagatcatcattgaagatcaagatcagagaacagctctct

SEQ ID NO: 6854071 - DNA, 81 bp, Homo sapiens
tttggctgtgtccccacccaaatctcatcttgaattgtagctccgacaattcccacatgtcgtgggagggacccagtggga

SEQ ID NO: 6854072 - DNA, 57 bp, Homo sapiens
ctgcacatgagagagagtagctgaagtctactgactttaatgaaattctctgtgaag

SEQ ID NO: 6854073 - DNA, 85 bp, Homo sapiens
agctgttggctttgccatttgctagtcctctgacttcttcttcagtattgacttagaggcattaatgaataaacagggccaggct

SEQ ID NO: 6854074 - DNA, 70 bp, Homo sapiens
tctgctagtgatttgttggtctgtttcttggcaactgaatggcttctgggatatcaaattattaggtaga

SEQ ID NO: 6854075 - DNA, 72 bp, Homo sapiens
gtcccatctatgcctggcattctggaagggtctaagagagtgggctgcaaagaggccaggctgcagagggat

SEQ ID NO: 6854076 - DNA, 66 bp, Homo sapiens
ctgacatgcagagcgtctgggcagcggccctcacccctgtcccctttacctccgcagccctgtcag

SEQ ID NO: 6854077 - DNA, 55 bp, Homo sapiens
ctgaggttcctgagaggctttaggggtttcccagaggttccttagggaccaccag

SEQ ID NO: 6854078 - DNA, 83 bp, Homo sapiens
ttctcgcgggagttttggaagccgcggctgggcatcagcaaacagctcttgcacagggcagtggctcccgaggagacgcagaa

SEQ ID NO: 6854079 - DNA, 60 bp, Homo sapiens
ggacttctatggatgtttgatcttcctaatggcagaccatttactcccattggaagtacc

SEQ ID NO: 6854080 - DNA, 69 bp, Homo sapiens
cttaaaatggtctatatatttgagcaaatcataattgcttggctagctgagtatacagactatgttaag

SEQ ID NO: 6854081 - DNA, 84 bp, Homo sapiens
gggtttgggaataacacatagatattttaacttttcgagagaggaaaaggaaaaaatggcttgtgatagacattttttggaccc

SEQ ID NO: 6854082 - DNA, 57 bp, Homo sapiens
tgcatagaggcaaaatggctgtactggtaaaaacgtgtatgccaatgtttttatgta

SEQ ID NO: 6854083 - DNA, 88 bp, Homo sapiens
gagatcctgcagagtggccctgtgtgcaggctgcactggtgcccctaaaagcatctgtggatcctggccagggccctccttggccctc

SEQ ID NO: 6854084 - DNA, 95 bp, Homo sapiens
gttaagttgctcaattgatttttcactgatagaaagaatatagattccacccatgggtcttagtttttttctctcttgaaagagagagacttaat

SEQ ID NO: 6854085 - DNA, 59 bp, Homo sapiens
gcttcctccagggaggggcctgctggacccatgcctgctcagcccctcctggcagtggc

SEQ ID NO: 6854086 - DNA, 104 bp, Homo sapiens
agagatgtgggaccacattcaagtatatttaacatcgtatcaagcagttaatcttttgaaaatctatggtgttaaatggtatttagcataatcctacaaactct

SEQ ID NO: 6854087 - DNA, 59 bp, Homo sapiens
gtcagatcttctatgtaatgaagtgtctttacagtttaagagactttctaggagctgac

SEQ ID NO: 6854088 - DNA, 88 bp, Homo sapiens
tgagtacgttgacatttcaagattgaatacagtatttccaaaaccaactgggatacaaattcatgtctgaattaaacaaatgtgatta

SEQ ID NO: 6854089 - DNA, 56 bp, Homo sapiens
gcgtggagccgagctccggagcgctttctgaccgtgtggagctccagcgtccatgt

SEQ ID NO: 6854090 - DNA, 64 bp, Homo sapiens
cggggtcttgctgtgttgcccaggctaacgtgcagtggcacgatcagggcacactgcagcctcg

SEQ ID NO: 6854091 - DNA, 83 bp, Homo sapiens
tttgtgccatatgcccagttatttccagtgtatgcttttgtagaatgcaaagctgggtgtgaatgcacatgtggttttacaaa

SEQ ID NO: 6854092 - DNA, 73 bp, Homo sapiens
ggagggtaactcagagacaatttggcttcaggaaggtacagttagaagctgccaatgattcaagttgccctcc

SEQ ID NO: 6854093 - DNA, 61 bp, Homo sapiens
ggtgggtattgaatacaggtgtgcttcatcccattccccagctgtctttcattacctcatt

SEQ ID NO: 6854094 - DNA, 63 bp, Homo sapiens
catggtgtcatcatagagccttgtagtccatgttggcaccataaggctaaaagtgatatcctg

SEQ ID NO: 6854095 - DNA, 68 bp, Homo sapiens
gcgagcatagtcaacacgcaaagccgactccgccagataaggagttgctttggaaactggccctgcgc

SEQ ID NO: 6854096 - DNA, 85 bp, Homo sapiens
acaggcctgtatgctgattataagccagacgtttcagacattttgtgaaaagattttagtgtctggctatatttaaatgctctgt

SEQ ID NO: 6854097 - DNA, 91 bp, Homo sapiens
cctgcaggtcgcccacataattgaagtaggaagttttagaggcagtgagacattgatacaggctctatttcatcctgtgggtgccctctgg

SEQ ID NO: 6854098 - DNA, 76 bp, Homo sapiens
ttcctagtactcagtccttggaggattctcttgctgactgaaaagtaagttggaatctggaactgatcaaaaggaa

SEQ ID NO: 6854099 - DNA, 80 bp, Homo sapiens
gagggtccctggctgtgctgcaggctttggggcttgtgttttctccattcatttgttgtcagccttctttatggactctt

SEQ ID NO: 6854100 - DNA, 61 bp, Homo sapiens
atgtctgtttatccttcaagatacagctcaagtattatctctgtaaggaagaattagatgt

SEQ ID NO: 6854101 - DNA, 66 bp, Homo sapiens
ttggccttgtgacacagctgggcctatagtggaggttacactgtgccagttttgtctaagccccga

SEQ ID NO: 6854102 - DNA, 77 bp, Homo sapiens
gcatttaccacagtgcctgtctaatgccccaagtattcaataaatataaactattggccgggcgcggtggctcatgc

SEQ ID NO: 6854103 - DNA, 64 bp, Homo sapiens
gcaaagtgattaacatggagcttttgctaattaaatcagcagaagatttaggttgacgctatgc

SEQ ID NO: 6854104 - DNA, 55 bp, Homo sapiens
gtcttttggactggacttggaggatgaatagaagttcccaggacaggcaaaaggt

SEQ ID NO: 6854105 - DNA, 71 bp, Homo sapiens
gatagaatctgttcctgaggcaccagagaactccagggaatattctctgattgtttagtgaatagagcatc

SEQ ID NO: 6854106 - DNA, 73 bp, Homo sapiens
acctacaggtgagcctctcctcctggattccaggtaaggatgcctagaaacagagcaggtggcccatgtaggt

SEQ ID NO: 6854107 - DNA, 83 bp, Homo sapiens
ggtcgaggatcctggagctgactccgtttgagaggcgaagatcccttttgttagatgaacagtcacttccccatccatcgact

SEQ ID NO: 6854108 - DNA, 96 bp, Homo sapiens
gttgttactggacaggtaaagcttcaaatcacttgctgtcatttcacagcacatgaaaaatgtttgcagttttcttttcaacctccagcctgacac

SEQ ID NO: 6854109 - DNA, 66 bp, Homo sapiens
tgaagacatgttatctctggcttcaaaagagcatatagttttgaataggaagaaagcatgtattca

SEQ ID NO: 6854110 - DNA, 77 bp, Homo sapiens
gagatttatcactaaagtgcacccctttgagatatattaaccagatgtccagaatgccactttggtcctttcatctt

SEQ ID NO: 6854111 - DNA, 128 bp, Homo sapiens
gtgtggctatctctgacaggttagacaccctggaggtacatgtacacacaaagggacaatgtagaaggatacattgcctttacctgagcatgaatgagcccagggtgttgtgccagcagtccccacac

SEQ ID NO: 6854112 - DNA, 79 bp, Homo sapiens
agggtatgtgtccttataagaagaagagacaccagagatctctgtctgccttgtgagggcacagcaaaaactcaaccct

SEQ ID NO: 6854113 - DNA, 77 bp, Homo sapiens
gagaagcagcttgtcatgtttctgccaccaggaatcatgttggaatgattccagtcgcttaaacctgagctcttttc

SEQ ID NO: 6854114 - DNA, 61 bp, Homo sapiens
atgcccttttcatatctcaacctctcatcataggtgaggtccagttttctgacaagggcat

SEQ ID NO: 6854115 - DNA, 56 bp, Homo sapiens
gctgcactttgactgctggggtctggagagtcagactgcagccaccaaaagtcagc

SEQ ID NO: 6854116 - DNA, 77 bp, Homo sapiens
tgatgaggatatactctgagaaacgtgtcactgggtaattttgccattgtgcaaacatcatagagtgtacttacaca

SEQ ID NO: 6854117 - DNA, 90 bp, Homo sapiens
cccaggcttgtgctctctaggttctggtccctgggacagtggtcacacagacaaaggaggtggacgcagccgagggagcaggggcctggg

SEQ ID NO: 6854118 - DNA, 60 bp, Homo sapiens
aatgctcttctaagatgtctagcatatgctagcataaaggtcaacgttttagggggcatt

SEQ ID NO: 6854119 - DNA, 70 bp, Homo sapiens
cacttgacccctgggacacagattccagcataagaatgtgcctgtgccagcctgtcccaggaggcaggtg

SEQ ID NO: 6854120 - DNA, 90 bp, Homo sapiens
cctcttgcacactgaagcatggtttctgacgtcatgctgactgcttcaatttgccaacataactctgaggctgtgctctcaggcaagggg

SEQ ID NO: 6854121 - DNA, 72 bp, Homo sapiens
ccaagtgtggcccttctgagcacagggccctgtgtggctgcacaggtctcgtgcccacgaagccagcactgg

SEQ ID NO: 6854122 - DNA, 104 bp, Homo sapiens
catgtttactatttcctgttgtctttgcctgaaagtgttttaacaaaaattagggtagagcatacaaacatttgaggcaggggatgaaaggagttgttattatg

SEQ ID NO: 6854123 - DNA, 70 bp, Homo sapiens
gacgtgaacttcacaaatccttggttactgaatcctgcattgcctgagagcttatttgtgatgtaacgtc

SEQ ID NO: 6854124 - DNA, 55 bp, Homo sapiens
ttgcccaagttccagctgctgctcccacaatcactagctgtgcaactttgggcaa

SEQ ID NO: 6854125 - DNA, 58 bp, Homo sapiens
aagacttttctgcaagtttaacagtgtaaccatcacctcttaaagtgcgagaagtctt

SEQ ID NO: 6854126 - DNA, 61 bp, Homo sapiens
ggcagtgttctcctgaaggtcatagaatttgaaaatctaaaccttttgtagaacaattgct

SEQ ID NO: 6854127 - DNA, 61 bp, Homo sapiens
aaggcagtactttatgtccatatcagttaaatcgtttgaaatgaccatcatctgctgcttt

SEQ ID NO: 6854128 - DNA, 96 bp, Homo sapiens
agtttaggtggaagaaggcgagttcagtttggggtatttgaagtatgatgcgtctctaagtctttcaaattgtcttgctaaccaaatcctaaaact

SEQ ID NO: 6854129 - DNA, 117 bp, Homo sapiens
gcctgtgactctcctcctgtcaccaacccactatgattgtcctcatggttgaataggaagcttatgaggccacagttatagatttagtttctgggaaggctggatagagttccaggt

SEQ ID NO: 6854130 - DNA, 84 bp, Homo sapiens
gctgtgtcagggctttgagaatagtggaacagtttccttgacatggtatacgttcccagtgtatttcagagcccattccagagc

SEQ ID NO: 6854131 - DNA, 56 bp, Homo sapiens
aagagtggaggctcctgttggaagattacctgttcccagcccagcctccttctctt

SEQ ID NO: 6854132 - DNA, 129 bp, Homo sapiens
ttgctccatggcccccctcgcccccacccacccccaatcccagcccagaacggtggcagtcattctgcccagcagtggggcgctgggagttggtggctgggtggggcgacgaggtggcgtctgctgcag

SEQ ID NO: 6854133 - DNA, 76 bp, Homo sapiens
ggagctcagtagagtcctctttgatcatctgacctgccccagagaatagacctaaagagactgatacggaagttcc

SEQ ID NO: 6854134 - DNA, 103 bp, Homo sapiens
cacagtttgcagctcagacgttgtaggtatgccaattaggtcaagtagcttatatctttatttttgttggtgtgttattctataaattactgagacaagtgtg

SEQ ID NO: 6854135 - DNA, 63 bp, Homo sapiens
gagagatggccagagagagcacacctgtgctatcgcataggacagtttactttggttactctc

SEQ ID NO: 6854136 - DNA, 58 bp, Homo sapiens
ggaggaggggggccgcacctgaaatctcatttgcagctgttacggaccctgtcattcc

SEQ ID NO: 6854137 - DNA, 126 bp, Homo sapiens
gggccttcgagtcctttgcctggcgtggcagggcagtggcacaggttctgcacaaggcaggaaaatgggacctgatgccactgcctgtcacatccgtgctaaagaaaggcacaatgctcaaggccc

SEQ ID NO: 6854138 - DNA, 58 bp, Homo sapiens
tctcagcaacgatccggagtaagtcactggacttcgtaccactggatgttggtgatga

SEQ ID NO: 6854139 - DNA, 84 bp, Homo sapiens
ggtatgggaaagtaatgcaggaggaggtgaggtagaactgtgctttgtcatccacacgagccccgattcctcctgttcccaacc

SEQ ID NO: 6854140 - DNA, 108 bp, Homo sapiens
gcaggcaggtgtgtgtgtgtgtgtgtgtgtgtgtgtgtgtgtgtatgtatgtatgtgtgggtatgtatgtctgcatacacatacatttatacaactctgctggtctgt

SEQ ID NO: 6854141 - DNA, 83 bp, Homo sapiens
gctctcagctctgtgttggccttagaacctgctctgccacaggaagtgcttactgtggctctgagacacaggctctcctgagt

SEQ ID NO: 6854142 - DNA, 90 bp, Homo sapiens
ggcagagactgtggattgctgtaaattatcttattaattggaacatcacttgttatattggagcaattatagcatgttcaaagctttgct

SEQ ID NO: 6854143 - DNA, 110 bp, Homo sapiens
ctttcctcacctgtacagtgaagggttttcaaggtcttctccagaacaatattctaagaatgctttgcaaaattaaatatgcatttattgataatttactatgtggaaag

SEQ ID NO: 6854144 - DNA, 67 bp, Homo sapiens
ggcaggagagtcctttctgtagatggaacccctcttctggtcacatctgaaaaggcattttcttccc

SEQ ID NO: 6854145 - DNA, 88 bp, Homo sapiens
tagaactctgactgacctggaatgaatgtattccagtggaataaatatggaatgaatgtatattcattccaggtcagtcagacttcta

SEQ ID NO: 6854146 - DNA, 61 bp, Homo sapiens
gctgcccattgcacgttgtggccgtgaatcaacattgtgacagagagggcactgggtcagc

SEQ ID NO: 6854147 - DNA, 75 bp, Homo sapiens
ctggctatttggaatgaaacagcagagccccaaagagaaaaattttgaaagggctccatgttcatttaataccgg

SEQ ID NO: 6854148 - DNA, 62 bp, Homo sapiens
tacaatgtcacctctcatgttttagacacaaagaggtccagaaatgaaagatggctattgta

SEQ ID NO: 6854149 - DNA, 61 bp, Homo sapiens
aaggctgcttttaacatgcatacaacacgtatgggagtgtatgtgtgtatcaagctgcctt

SEQ ID NO: 6854150 - DNA, 61 bp, Homo sapiens
ggtgtgtgtgtgtatgtgtgtgtgtgtgtgtgtgtgcatgcatgtgtacatgcatagcacc

SEQ ID NO: 6854151 - DNA, 88 bp, Homo sapiens
taacactttttatttagttttttgctgtgtttcattggacatttgctagttatccatcaagcacagtaaaagcagattttaggtgtta

SEQ ID NO: 6854152 - DNA, 68 bp, Homo sapiens
ttgcttgaatccgggaggcaaaagttgcagtgagccgagatcgtgccattgcactccagcctgagcaa

SEQ ID NO: 6854153 - DNA, 88 bp, Homo sapiens
cccagaagttattaaaggatgaggctggacacttcttgatgaggtcccttaatctctaagagaccttcagtattcacttcataacggg

SEQ ID NO: 6854154 - DNA, 80 bp, Homo sapiens
aagcatttttatcttgcttatgttgaattgttcaagagaccaaaggaatttggcaaagatcaacatgttaggatgtgctt

SEQ ID NO: 6854155 - DNA, 66 bp, Homo sapiens
cagctaccggttggcccagcctggcctagtatacgcttgcgattgggccctggagtcgccagtctg

SEQ ID NO: 6854156 - DNA, 63 bp, Homo sapiens
gcccctgggggcccctgccctggctccctgaccacacacagaggctgcagggagccctggggt

SEQ ID NO: 6854157 - DNA, 67 bp, Homo sapiens
tgtgtgtgtgtaaaaatccagagcccatcaaaagacatctggtttgctttggtatttcactcacata

SEQ ID NO: 6854158 - DNA, 63 bp, Homo sapiens
acttgcaggagggcaagaattgttctgaaaactgatatgagaacacaggccagcctgtgcagt

SEQ ID NO: 6854159 - DNA, 63 bp, Homo sapiens
cagcattcctgagaatgcagagtgtcagctggggagacacagcgcagcatcagagagctgctg

SEQ ID NO: 6854160 - DNA, 91 bp, Homo sapiens
gtgcctagtgcatagtggttgttcagtgtttgttgaatgtataaattatttatgctatttttatcttgatcaaaattgtccatctggtcat

SEQ ID NO: 6854161 - DNA, 84 bp, Homo sapiens
gtttcccactagtaaggcaagaaactcctgtgtacccttcacaatgccctgtgaattatgacgtttccttgccagtaggaacac

SEQ ID NO: 6854162 - DNA, 86 bp, Homo sapiens
cgctatgttacttccaatggaagctttgcaaaggaatccggttgcctaaaaacgtattcttttaagccccagggatttgcatggtg

SEQ ID NO: 6854163 - DNA, 69 bp, Homo sapiens
caaaggtcagatgaccatactgatcttgtcttgacttctcagtgtttcctgtggtacagctgacctctg

SEQ ID NO: 6854164 - DNA, 58 bp, Homo sapiens
ggcatgtgcctgaggtcacacagcaaggagtggctgcgtgggaattgggctacatgcc

SEQ ID NO: 6854165 - DNA, 115 bp, Homo sapiens
ttctctctcctcagtcctcacccagggcttctgatgctgccagtcaatcccaagtcatgcttggtgtttggggaccacggcagtgcaaaacctctgagggcctggggagaaggaa

SEQ ID NO: 6854166 - DNA, 105 bp, Homo sapiens
ttggaactaaaaaagaactttggaaatgatctgtttcaattgtcttagttaaacttgtggaaactaaagttgaagaaggtcaaattatttgttttaattgtccaa

SEQ ID NO: 6854167 - DNA, 87 bp, Homo sapiens
ctcttttctaataaatacgtggccctgggcccggctcccttctctgctttgtcatgagggacccgttatttatgacttggagatgag

SEQ ID NO: 6854168 - DNA, 65 bp, Homo sapiens
tgactctgaattgggaaatgggagccttgggtccaccccggccatgccattgataatagcagtca

SEQ ID NO: 6854169 - DNA, 94 bp, Homo sapiens
gcggcagttccctctgccaacacttctttgtcacctgcttcgaggccaataactctgaagaaggtggcccaggggtaggtggaggggctgccgc

SEQ ID NO: 6854170 - DNA, 126 bp, Homo sapiens
aagttttgtgataaaaaggatggagcaacacatgtgtgcatgtgggtgcatgggtgtgtgtgtctgttgtgtatccttattcacacacattatgctcatcatcctgaaaaattattaacaaagctt

SEQ ID NO: 6854171 - DNA, 71 bp, Homo sapiens
tctttgaccctttggaggtagtcaccactctttatccagtgactggctgcctctaaggagtataacagagg

SEQ ID NO: 6854172 - DNA, 65 bp, Homo sapiens
gcctatattgtctgtttgaatgactatattgggctatattgtctgtttgaatgactatattgggc

SEQ ID NO: 6854173 - DNA, 72 bp, Homo sapiens
ataatatttggataggacagtagggagtaactagttaattttcccaaagttgtagctatccaggaatattgt

SEQ ID NO: 6854174 - DNA, 93 bp, Homo sapiens
gggttctgtctacagccctggctcccagcagcgctgtcctctcacaggcatagttgcccccagctgggctgtgctccactgtgacagtagccc

SEQ ID NO: 6854175 - DNA, 57 bp, Homo sapiens
ccagcatgagaaaatgaatcagacgatgaccgctttgagaaatgggctctgtgctgg

SEQ ID NO: 6854176 - DNA, 129 bp, Homo sapiens
ttttaacaagaagccctggaaagaaatgctggtttaataattagttattgatcgtggctaatgccatcgtgaataccactggattagtcagagaccagtaaatcggagcacgggcatttcccttgtcaa

SEQ ID NO: 6854177 - DNA, 77 bp, Homo sapiens
tgagtagaataggggtattgcttcagattctgacaaatcatacacagaaaatgaaaatgccctctatgtctcactca

SEQ ID NO: 6854178 - DNA, 72 bp, Homo sapiens
ttgcctgcagattccttccctacccaggcctgagacagagtctgtagggatggaatacagatgtgagggcaa

SEQ ID NO: 6854179 - DNA, 60 bp, Homo sapiens
acacttttgtgtatatccagttctatcctcattgaactttagaatatagctcagaagtgt

SEQ ID NO: 6854180 - DNA, 57 bp, Homo sapiens
agacctgaagagtatcttcagagccatctagaggcctggggtatgtcttttagggct

SEQ ID NO: 6854181 - DNA, 70 bp, Homo sapiens
cattttttgtctctatttacttggaagtagatgctaaatgctgcttcctggtagataggagtagatgatg

SEQ ID NO: 6854182 - DNA, 88 bp, Homo sapiens
tcaagacgtcagtcatggctgtagtcatctgaaggcttgcctgggtctgaagggtggttctcggatggctcacccacatggctcttgg

SEQ ID NO: 6854183 - DNA, 60 bp, Homo sapiens
aggaaccagacagaactgaatggagaaagcagaacaagacgcatggttcgtgtggtttct

SEQ ID NO: 6854184 - DNA, 64 bp, Homo sapiens
tgcaggtgtggttcctcagccactggtctagtagaagcctgtggggagggaagtcatttctgta

SEQ ID NO: 6854185 - DNA, 58 bp, Homo sapiens
gtgagggcagcttggtcagtgtgagtttaaaacagcatgacctctgagctcccgttgc

SEQ ID NO: 6854186 - DNA, 73 bp, Homo sapiens
aaagggatgttgctaagatatgctgtggatctcatttttttatatgtacatcttgagcaatgaagctcccttt

SEQ ID NO: 6854187 - DNA, 106 bp, Homo sapiens
gagtgttggtctcagaacctggcctggaccttggggcgaggccagctttggagatggccacgcttactgcccaggtgttccaggtaagtgcctctgagccacactc

SEQ ID NO: 6854188 - DNA, 63 bp, Homo sapiens
gacttagagcttgggttttcaacttggcttttctgcttgtcagagatgtgagctctgatagtc

SEQ ID NO: 6854189 - DNA, 58 bp, Homo sapiens
agctcagggcaaagactcaaatccaagctggctggctttagagttgtagctctcagct

SEQ ID NO: 6854190 - DNA, 58 bp, Homo sapiens
cacaaggactggatggagtgggcttcccctgttttgcccttccaccttctgccatgtg

SEQ ID NO: 6854191 - DNA, 75 bp, Homo sapiens
gtggctcagcctccattgggcctttgtgtctgggccagaccctccaggcaagcccccagtgaggctcttgggccc

SEQ ID NO: 6854192 - DNA, 96 bp, Homo sapiens
tacaagttcattttaatgcattttgatattatagagaaatgtcagatccacagttggactacaatactcttagtaaaagtgaattctgagcctgta

SEQ ID NO: 6854193 - DNA, 61 bp, Homo sapiens
tggagatggagttactgttgagagtcactgttgtgagccactctgctgagctccattttca

SEQ ID NO: 6854194 - DNA, 85 bp, Homo sapiens
gtttgcaaccttgactataaaaaatgtgcatttctagtacgcaccttcagaggttcacatttaattggtttagggtggagcaggc

SEQ ID NO: 6854195 - DNA, 55 bp, Homo sapiens
agcagggctcacattagtggataaaagcaggtgtgcggttgactatggcctggct

SEQ ID NO: 6854196 - DNA, 101 bp, Homo sapiens
ctacccccttcctcaaaacactttcctgccatctattgggaacttgtagtaactacacatatctaagatagatgacaatgaaattgaggagtagggggtgg

SEQ ID NO: 6854197 - DNA, 61 bp, Homo sapiens
ccaaggtcttggacagctaatgtgaatgaacatatgcaatactgtaaaccaggcttcttgg

SEQ ID NO: 6854198 - DNA, 113 bp, Homo sapiens
tcaggaaaagaccttcacaagtcagctcatccagagattctaggcaagccatctgacacgatttgtaggtgagcttgctgctagaggcttaggcaggctggtctgatgcctga

SEQ ID NO: 6854199 - DNA, 61 bp, Homo sapiens
gagcagccacagagagtggatgggcaaggactctcctctggcctctcatgtcctgggcttc

SEQ ID NO: 6854200 - DNA, 83 bp, Homo sapiens
gcttatattcacatcccattcccataagtggaaaagcaaatgaagcttattcatttgtgtgggcatggtgtgtgtgtgtgtgt

SEQ ID NO: 6854201 - DNA, 70 bp, Homo sapiens
tgtggcttccctgtttgctgtgcctgtcagcaaaactggcttgaggaccgggaagcatagggaagaaaca

SEQ ID NO: 6854202 - DNA, 74 bp, Homo sapiens
gagacaggatcttctatagatattctgaagggaacttccagactttttcagaaggcttaggagtttacggtttt

SEQ ID NO: 6854203 - DNA, 57 bp, Homo sapiens
ctggcagctttctcacccatgacctgaggcagattcttgggttaagaaggttgtgag

SEQ ID NO: 6854204 - DNA, 55 bp, Homo sapiens
cagggccaccgtgtttgctgctcgatgagagaggaggcatggaaatggcacactg

SEQ ID NO: 6854205 - DNA, 81 bp, Homo sapiens
gcccatctccatagctgtggaagatgtgggaaggcagatatagcctttcccaatctctgcacagccatgagggatgctggc

SEQ ID NO: 6854206 - DNA, 67 bp, Homo sapiens
tgcttttacactactgtgtgcccactttaaagtttaagaagctgaggaacagagaggtaaaatagca

SEQ ID NO: 6854207 - DNA, 61 bp, Homo sapiens
tggtccatggcatttccgtcacatcttaattggatgtggactttgaaattgtcatggagca

SEQ ID NO: 6854208 - DNA, 106 bp, Homo sapiens
ttctagtacatcattactgatacatatgtgaaaggacggaagtatgtattgaacattcagtgtatactaggttctattccagtacagacttattgacatacaagag

SEQ ID NO: 6854209 - DNA, 72 bp, Homo sapiens
gtgactgtgagggtgacagttctggtctctctgtgtgagcatggggaagccccctatgttccctcacagcac

SEQ ID NO: 6854210 - DNA, 70 bp, Homo sapiens
tttcattttacgcttataggacagcctcttttgcatttgaatgagactacctgtaatgtggcaaatggaa

SEQ ID NO: 6854211 - DNA, 60 bp, Homo sapiens
gatggatatgctgttagatgaactggagccaaatgctgtgtatactaacatatatctgtt

SEQ ID NO: 6854212 - DNA, 72 bp, Homo sapiens
acattccacagctctggggcagagtgactaaggctcacctgtagtccttaaatggagagcaatttgggatgt

SEQ ID NO: 6854213 - DNA, 60 bp, Homo sapiens
ttgtagatggcttatttctgtgccaaagtgtcaatactggagtagaagtgtgctatacaa

SEQ ID NO: 6854214 - DNA, 70 bp, Homo sapiens
aggagagctggggtgctgcttgttgaagtagaaaaacgaggtgctggacatgcaaaaatcacagtctcct

SEQ ID NO: 6854215 - DNA, 79 bp, Homo sapiens
gcttttttattattgacagatgcattatgttgtaagcccataagtggctacatctatttctcctctgtcagaaagaagt

SEQ ID NO: 6854216 - DNA, 78 bp, Homo sapiens
aggagtcgggtaccatccctcctactcacagtcatccccagttggttgatgacatcactgaggtggtgccaggctcct

SEQ ID NO: 6854217 - DNA, 80 bp, Homo sapiens
tcctggtctcttcaaatcctgtgtagggctataggtatgtctattgacagttagcactatcttgggatttggaaacagga

SEQ ID NO: 6854218 - DNA, 63 bp, Homo sapiens
tctcctggtagccccaaccactgacctgtgggctgcacccgggctcagggggctgataggagg

SEQ ID NO: 6854219 - DNA, 62 bp, Homo sapiens
ggcttgaaagaataggaatgcataaaacagagtcaagacttcattccaatttgggttaggcc

SEQ ID NO: 6854220 - DNA, 76 bp, Homo sapiens
tgtcaaggtgctgaacaaagaaatagtcatggcattggagccagagatgaccatgagtagactttttccctggaca

SEQ ID NO: 6854221 - DNA, 69 bp, Homo sapiens
tctctagggcgggttgaaatgatggagagaaagctcaaaaaggtgcctcattctagcctgccaaagaga

SEQ ID NO: 6854222 - DNA, 70 bp, Homo sapiens
agaggtcacagtaaaagtcactctaaaacagagctccaaattcaatagggatgtggctttttgacctgct

SEQ ID NO: 6854223 - DNA, 95 bp, Homo sapiens
cgggggtcggggcgcatttgccaggggacatctggagcccggccctgcttctgtcgggctccagggtacccctggatggctgcgctgtgccctcg

SEQ ID NO: 6854224 - DNA, 121 bp, Homo sapiens
gtatacacggtcatggggtttgggctctgggttcagatgcctgcatttaaatcttggctcccttatggatgagcaatgcaatcttaaccttgactgctctgtgcctcagttccacatctgc

SEQ ID NO: 6854225 - DNA, 114 bp, Homo sapiens
gtcagctgctgtgggtgagttgggggacacgggggacactgtggggagtgagcactggacatagagctcagaggccaagtgcccgccctgcccatacttagccatggccttgac

SEQ ID NO: 6854226 - DNA, 71 bp, Homo sapiens
acatgaacaccaggcatgaacaaacattttttactttcaagtttggccatcatttagcctggtctttatgt

SEQ ID NO: 6854227 - DNA, 73 bp, Homo sapiens
taatagtgcattctatcaaatggtacaatagtccaggtgataatgtgctaaaaaatggaatgagtcactattg

SEQ ID NO: 6854228 - DNA, 57 bp, Homo sapiens
ggcatttgttctccatcccgaaggtcacagcccacccaaggtggcaggtcagatgcc

SEQ ID NO: 6854229 - DNA, 73 bp, Homo sapiens
gcccaccacagcggcgggagcgcgggtcgctcacctccagcgagctcgcggccgtccccgccgcgcactgggc

SEQ ID NO: 6854230 - DNA, 79 bp, Homo sapiens
gaatccacagctagtgactgctagagcaaggatgcaaatccaagctgatccagttccaaagatcatttactgtgctttc

SEQ ID NO: 6854231 - DNA, 66 bp, Homo sapiens
cttcctgggcagcagcaggaggtctctgctctaaactgcagaccccagggctgcatgctgggggag

SEQ ID NO: 6854232 - DNA, 60 bp, Homo sapiens
gaatacatatcagatgtgtttctaggaaacctggacagattttacatctatatagtgttt

SEQ ID NO: 6854233 - DNA, 71 bp, Homo sapiens
gcgcatttgtccttacagcgccatggcttccatgagtaattagatgaggcctcctgcagggatgagtgtgt

SEQ ID NO: 6854234 - DNA, 60 bp, Homo sapiens
aattaatagcaacacatgctgcagggtgcatacccaccagtacttagtgtagcgttaatt

SEQ ID NO: 6854235 - DNA, 67 bp, Homo sapiens
ggaccagtggcagggtgctgtggaagctgtcgaatctcctccctctgtccagtacccccgctcgtct

SEQ ID NO: 6854236 - DNA, 104 bp, Homo sapiens
cactggatcatttaactcaataggttgagatcttcgcctgtgatttttaacctagaaacatccttaaggttagggtttccattcattggttcttttgtctagtg

SEQ ID NO: 6854237 - DNA, 76 bp, Homo sapiens
gggtgtgagctcagccttgggagacctgtcagcttcaacccctcaacatctccctcctgtgctcagctacatgccc

SEQ ID NO: 6854238 - DNA, 129 bp, Homo sapiens
gttctaaagttgcatcatttttgggttatggcattaccttcctcctgttttggtttgtatctttggggataagggtcagggtggaatggaatgctggccaatccttaatgagaagcccaactctagagc

SEQ ID NO: 6854239 - DNA, 127 bp, Homo sapiens
actattgcttcagtacattatttttgcttaaattaggtctcattagtttctgtttgttgcaaccaagaatgctgacagaactcaaacatgagaaggagcagaaagtaatgcaatgaaagctaaaagt

SEQ ID NO: 6854240 - DNA, 88 bp, Homo sapiens
gtaaaagggactcaaatatttgggagcaataaaaatattccatgtcaatcgtcaagggacattatagcttccagattgtccagcttac

SEQ ID NO: 6854241 - DNA, 56 bp, Homo sapiens
atatgtatgtgcatgcgtgcatgtatacatatttgtgaatgtatgtacatatttat

SEQ ID NO: 6854242 - DNA, 81 bp, Homo sapiens
acttagctgagttgacccatcaggccacatgaggtccttgtggctggagacctgtgtggccaggctggagtcttgctaggt

SEQ ID NO: 6854243 - DNA, 89 bp, Homo sapiens
ggtaacaatgaagtactactttacctccatcagactgaaatagccatttcggctgcttgatatggggaaagtttacttcaagtattgct

SEQ ID NO: 6854244 - DNA, 60 bp, Homo sapiens
gagagaggctccccttgccccatgaccagtaactggggctgaggcaggggtgcttttgtc

SEQ ID NO: 6854245 - DNA, 68 bp, Homo sapiens
ccacacatgctcctcgtagccatggctctggcacagtgccaggtgctggcctcagagggtcatggtgg

SEQ ID NO: 6854246 - DNA, 61 bp, Homo sapiens
tggggctgaaaatatagataaaggtcagagtgtggaagaccttatctgtcaatctgtctca

SEQ ID NO: 6854247 - DNA, 88 bp, Homo sapiens
ttttaagagctttacttctgactggtgctcattgctttggaatgtttctattaaccgcccagtgggaagctaaggtggatttttaaaa

SEQ ID NO: 6854248 - DNA, 62 bp, Homo sapiens
atcacattctttcaaagcagtcacggcccacctaaaatcaagggcaggagagggaatgtggt

SEQ ID NO: 6854249 - DNA, 87 bp, Homo sapiens
cactgggtggtgtgtgaattagagagggaatacagcctgggcaggatggagaaaccccatctctacaaaaattagcatgcacctgtg

SEQ ID NO: 6854250 - DNA, 119 bp, Homo sapiens
ggatggctaatgcaaactgcaaccctatagaatatccacttcaatacaggcatcacggctcgggtggtgtctgtattgaggtgcatattatatggggctgcagcttgcattattcctcc

SEQ ID NO: 6854251 - DNA, 111 bp, Homo sapiens
ccttcaatctgtacacgttatgtgatggtttatagacctagaagtcatcctgtttctttaagggaaattttctctctaagacttaaacgataacatgtaaaagatcaaagg

SEQ ID NO: 6854252 - DNA, 59 bp, Homo sapiens
ggggccaagggtgcgtggcaggacgtactaatcaagtgtctcttgggtcccttggccct

SEQ ID NO: 6854253 - DNA, 70 bp, Homo sapiens
ccattggaggctattatttttatgtcaaggacaacaaacctgaggcttagatttggtaactcgccaaagg

SEQ ID NO: 6854254 - DNA, 57 bp, Homo sapiens
gggtgaaaggatggggagaaagtgcatacagctagacaaatttccctccttccactc

SEQ ID NO: 6854255 - DNA, 128 bp, Homo sapiens
ttttaaatgcagtctttgttgagaggagctgttctcccagatgctggataatacctaagccttacatggttgtaggcctatgtccagcaattggtgggagcactgttaatttttaactgtaggtttta

SEQ ID NO: 6854256 - DNA, 55 bp, Homo sapiens
tccccactcctgggcagatgcgtacccagtgcagcgagaatgtctgcgaggggga

SEQ ID NO: 6854257 - DNA, 64 bp, Homo sapiens
tctctcttggccagacacagaggcatcctgtgttgatggctgcctttcttatggccaaggaagg

SEQ ID NO: 6854258 - DNA, 58 bp, Homo sapiens
acccaggctggagtgcagtgatgccatctcggctcactgcaactcctgtctcccgggt

SEQ ID NO: 6854259 - DNA, 70 bp, Homo sapiens
ggattaagtgcaatgttttacttaaaagtagtttcctactcttttcaggaatattattggcaattaatct

SEQ ID NO: 6854260 - DNA, 64 bp, Homo sapiens
ccatttgtaaccttagagcaatagttctcagccaggggtgattttgttccaagggtatgtttgg

SEQ ID NO: 6854261 - DNA, 68 bp, Homo sapiens
gcatgtgttagagtgtgcatgcgggccgtggggcctcacagcatgtgtgtgcacaatctggcgtgtgc

SEQ ID NO: 6854262 - DNA, 56 bp, Homo sapiens
agtggcagacagagacagtacctggactctaaggagctgggctccagtctgccgct

SEQ ID NO: 6854263 - DNA, 62 bp, Homo sapiens
gggctgggggagatggccaggctcactctgcctggctttattaactcatccgtaattagccc

SEQ ID NO: 6854264 - DNA, 60 bp, Homo sapiens
ggcacgagccagtgtgtgtgtttccaaagtaggtttggagcagcaggtgacctcgatgcc

SEQ ID NO: 6854265 - DNA, 63 bp, Homo sapiens
ctcagaattacatcccattttaaagattcagcgttttctcctttgagaagggtcatttctgag

SEQ ID NO: 6854266 - DNA, 92 bp, Homo sapiens
aggccacaaagcttgttaaattgaagaattaggacgtgagtacagatcttctggtgccaagtcagtgttctttatgacatctgaggtggtct

SEQ ID NO: 6854267 - DNA, 109 bp, Homo sapiens
aagggctcacataagcatagttactctggattctaaggtgtttactagagtgcttaataaacactgacctgtagaattgagaagttcgggattctgttacttagccttt

SEQ ID NO: 6854268 - DNA, 56 bp, Homo sapiens
tgccacattttgctttgcctaggttcaggtcagaactttcagataaaaatgtagca

SEQ ID NO: 6854269 - DNA, 59 bp, Homo sapiens
gcattatggcttttatcctctcttgaggtcatcctctggaaggtaacaaggccattagc

SEQ ID NO: 6854270 - DNA, 86 bp, Homo sapiens
tgctctactcggcgcctctccatggggctacggcaaggcttgctgcctacgagcagaatggagggtgccgagttctcctagagaca

SEQ ID NO: 6854271 - DNA, 57 bp, Homo sapiens
ttctgagggtgctattcttgccttgtctgggaaaggtctctacagcatctttcagaa

SEQ ID NO: 6854272 - DNA, 60 bp, Homo sapiens
tttcatgcattaacacttcattttgtgaaaaagtaaaacacaaaagcaggttgcatgaaa

SEQ ID NO: 6854273 - DNA, 117 bp, Homo sapiens
ttcttggtcactatttggttctgattggttgcctggctgacaaaataaattttaggtgtaacttgatagtattatatgtgtctagtattaatcagttattttcaatgcactcaagga

SEQ ID NO: 6854274 - DNA, 56 bp, Homo sapiens
tgagaacggatactaagggctgggaagaatgcccagttctgacctaacctttctca

SEQ ID NO: 6854275 - DNA, 74 bp, Homo sapiens
ttttcatcctattgctttttcctctggcttcagtctgtggcatattagaaatgggcctggaaagaggatgtaaa

SEQ ID NO: 6854276 - DNA, 55 bp, Homo sapiens
gctaagaggctatatctttctcctctaaagggagtggtttacagcatctcttggt

SEQ ID NO: 6854277 - DNA, 86 bp, Homo sapiens
tctaagttgaagtatgctgagtcgtattattttttaaatgctgaaactttttgaagctattttgcattcagttatttcaattaaga

SEQ ID NO: 6854278 - DNA, 130 bp, Homo sapiens
caaagcttttatttcatgtaacatgggctgttgttaagtaccagattgtctgaagccattcgttttatgtttagagtgctctggtcactaatgccatctcaaaatgttccagggagatacggagtgtgtg

SEQ ID NO: 6854279 - DNA, 56 bp, Homo sapiens
ccaagcctcacttcccttttcattggcaaatacatttgtcatgaggtagaggctgg

SEQ ID NO: 6854280 - DNA, 57 bp, Homo sapiens
ggttaaaagcaaggactttggagactgacttcccaggcttaaatccttggttttgcc

SEQ ID NO: 6854281 - DNA, 71 bp, Homo sapiens
ggcctccctgcagtagtggctaagatcatctgtgagtttatcctactgagctgttaggtcccaagagagcc

SEQ ID NO: 6854282 - DNA, 75 bp, Homo sapiens
cagctctgacctgcgggctgtgctgaagcctgggcctctctctataccaggccgtctgcaggcctgcaggggctg

SEQ ID NO: 6854283 - DNA, 82 bp, Homo sapiens
agtgtcatcttcgcagagtgatttttcttaaaaccctggcctctgtgatattgagaaagtcacaatattggaaggtgacact

SEQ ID NO: 6854284 - DNA, 76 bp, Homo sapiens
aaatgttgtgagttaatatcgtggtttcaggggaacaatttttctcctcaaatctttagagttatttccagaattt

SEQ ID NO: 6854285 - DNA, 69 bp, Homo sapiens
accacccccagctaatttttgaatttttagtagagacgggatttcaccatgttggttggctaggatggt

SEQ ID NO: 6854286 - DNA, 62 bp, Homo sapiens
tgcaattccaaacagtgctgcagacttctccaagcccggagtcagtgtaagtttggaatgca

SEQ ID NO: 6854287 - DNA, 73 bp, Homo sapiens
ggcctcccaggagcttctctctgcctctgagttgctacagagcgtgaggcccacgaggcaagttcctcaggct

SEQ ID NO: 6854288 - DNA, 68 bp, Homo sapiens
attttacaacttggtgtgaataatttaactctacctagagtgtgagctcttctaactaattgtggaat

SEQ ID NO: 6854289 - DNA, 73 bp, Homo sapiens
ggcaagcctggatctttctgactgacaaaagagactgtttccccttggtagtggtaaagaatcaccccttgcc

SEQ ID NO: 6854290 - DNA, 62 bp, Homo sapiens
acagaacttccagggaacatacgccttccctttcaaacatatgttccgaggggaatgtttgt

SEQ ID NO: 6854291 - DNA, 78 bp, Homo sapiens
ctcggggactcaagatgtaaggtggggggctccagccactgcatgtgctgctgggccctgcccttgtctgtccttgag

SEQ ID NO: 6854292 - DNA, 63 bp, Homo sapiens
ggccagcagggtatgttagagctgtagcagagaaggcttgcaaattgtattattttgctggct

SEQ ID NO: 6854293 - DNA, 90 bp, Homo sapiens
gttacaataatcactggaaaaagttcaatggaaaagctttagttcctttgaatctgtagtttttcttgagctaatcagtcatttgataac

SEQ ID NO: 6854294 - DNA, 56 bp, Homo sapiens
ggatccacaggtcatgtaatgtggagttcttctgggatccattgtcctgaggatcc

SEQ ID NO: 6854295 - DNA, 58 bp, Homo sapiens
agtagagctgcataaaactctgacctaaccagccttaccatcagagagcagctttatt

SEQ ID NO: 6854296 - DNA, 62 bp, Homo sapiens
agtgctttcttgctccatcagtaagggcatactttatgattgttggggtcaggagctagcct

SEQ ID NO: 6854297 - DNA, 73 bp, Homo sapiens
cttcccttacaaacaagatcttattctttaagtgcgtactgatgccaagaaagagattagtttggtgggggag

SEQ ID NO: 6854298 - DNA, 85 bp, Homo sapiens
tcactgtttttggaatatcttggaagtgcgtaaaactgcttcagtttattatgtagaagtgcatttccagatttctggagtgtgg

SEQ ID NO: 6854299 - DNA, 85 bp, Homo sapiens
gcaccccccagaggctgttcagtgtccagcttgtttaaccctgagcagggtctggaagttagggacctacaggctatggtggtgt

SEQ ID NO: 6854300 - DNA, 70 bp, Homo sapiens
gagccaccatgtctcacgcgctctataggatgctgccttcagaacagtcagcatgggacatggctggctc

SEQ ID NO: 6854301 - DNA, 93 bp, Homo sapiens
cgtgtggggcagggagatggcaggccctgtgggggtgtcactggcccaggtcactttgcagggcttgatatccagacccacttgcccgtcacg

SEQ ID NO: 6854302 - DNA, 64 bp, Homo sapiens
cctgactatctagaatctgaatattcttatttgggaagaatccccaaacaggtgagatagcagg

SEQ ID NO: 6854303 - DNA, 83 bp, Homo sapiens
taaagtcatagaatcatagcacatttgaactagaaagctttagttagtcagtttttagatgtgtaaatggtactatgttttta

SEQ ID NO: 6854304 - DNA, 75 bp, Homo sapiens
attgtgtatcaatcatgtaatttggtggtggtgggaagactgaccctacactaaactgcacagatgggtcataat

SEQ ID NO: 6854305 - DNA, 71 bp, Homo sapiens
aggctgtgaccaaggaggaatttcagggtgaatggactgctctagctcctgagttcactgctactcagcct

SEQ ID NO: 6854306 - DNA, 59 bp, Homo sapiens
tgggcagttgctcctcagacccttctgggccaccagcactgggcagggagggactccca

SEQ ID NO: 6854307 - DNA, 62 bp, Homo sapiens
tcaaaaagctggagaataggaattagtgtagctcccctatactaattatcatccagttatga

SEQ ID NO: 6854308 - DNA, 78 bp, Homo sapiens
tatttgaaggtaatcagcctttccacaattatttcatggtcatggattttgtgttgatgctggttaattagccaaata

SEQ ID NO: 6854309 - DNA, 99 bp, Homo sapiens
cctgtctgtctggttctgggccttctttctcatcccactggctgcgtttttggtgactgcacacagctagtgagagaaaggacacctgtgacagagagg

SEQ ID NO: 6854310 - DNA, 72 bp, Homo sapiens
ctaagtaggattaatgccgatttgaggcttaggaataaacttaagcctcaaattggcattaattaagctaag

SEQ ID NO: 6854311 - DNA, 88 bp, Homo sapiens
ttgttccttctctttttgttgtccacactaggagacagtgattctcgccaagctcctgtgtgggcaggatgagaacgaggaggaataa

SEQ ID NO: 6854312 - DNA, 77 bp, Homo sapiens
tctcaatcgtgagcaccaggcaaaaccacaggagcagtaccattgttctggagagtttagtctggggcctactggga

SEQ ID NO: 6854313 - DNA, 78 bp, Homo sapiens
attttataatttcaccttttacatttaggtaggtgatctattttaggttaactttagtgtatgaggtaagataaaagt

SEQ ID NO: 6854314 - DNA, 94 bp, Homo sapiens
aggccatgggtctgttgcacctgctagctagcagcattacaacaaatggaggcatttgttttctgcagcagcattatcaggggtcccagggtct

SEQ ID NO: 6854315 - DNA, 108 bp, Homo sapiens
ccaattcagttcagccagcctccctgaacacttctattccctgcacaaagggtgctgtgctcagtgctggtggtggtggtgtggtgggggtgggttggaaagatgtgg

SEQ ID NO: 6854316 - DNA, 74 bp, Homo sapiens
tgttcccacgtgtctactgtgcatttgaagatgaagattatttatgtttagagagcactgtagacacttagata

SEQ ID NO: 6854317 - DNA, 77 bp, Homo sapiens
tagttttaagaagtctatattggagcttatttaccgtaatatattgtaaatgagtaatatagctgtttgccaaacta

SEQ ID NO: 6854318 - DNA, 70 bp, Homo sapiens
tttcacacgcatctgtctgcccggtcaccatgtgtgaacccctgtgttaagatatctgcgtggtgtgaga

SEQ ID NO: 6854319 - DNA, 63 bp, Homo sapiens
agttgtcagtcaaagacatttgtgttaaatgagtttcaggtgtttctattttggctgctagct

SEQ ID NO: 6854320 - DNA, 55 bp, Homo sapiens
tacttgggttttaatcagagttgatttttttaaacatttgaaataaactcaagtg

SEQ ID NO: 6854321 - DNA, 95 bp, Homo sapiens
ctgagtctgtctcccccaagcccttcctgcgtggtcaggcacagatcactgggccaggtggataaggtttctggacaactgggggatgggtacgg

SEQ ID NO: 6854322 - DNA, 80 bp, Homo sapiens
tgtctttctctgtgtttcacatgctggccttgatcatgggtggcccacactaagttgtgagaaacagaatgagctaagca

SEQ ID NO: 6854323 - DNA, 73 bp, Homo sapiens
cactgaagtgcatgcatgtcagggatcctggaactattttgcttcttttcttggagatgcatgcccgttagtg

SEQ ID NO: 6854324 - DNA, 57 bp, Homo sapiens
tttttttctgattgcatgacgtgtagtcctcttttcttgtcagcaattaggagaaaa

SEQ ID NO: 6854325 - DNA, 69 bp, Homo sapiens
atgcctttgttgaccactataattgagttccatttcatgctcacaaatctagttggtgatacagtgcat

SEQ ID NO: 6854326 - DNA, 80 bp, Homo sapiens
tcttctcccctgtccttgctttggagcaggctaggtggctcccacttcttggcctgttagagcagggactggggtgggga

SEQ ID NO: 6854327 - DNA, 89 bp, Homo sapiens
gcttagttttctgccttgcctttatgtgtgcttttggttaagataatacaataaggaaatgtacaaatgaagatggctaaggactgggt

SEQ ID NO: 6854328 - DNA, 71 bp, Homo sapiens
gagatcttgagtctgtaacagaaccctgggccgctgacttgacgtgtctcaggtacagatttgtggatttt

SEQ ID NO: 6854329 - DNA, 60 bp, Homo sapiens
ctgcagtcagcttttaagatcttctatcaaaaatagctgattggtaaaagtgattgacag

SEQ ID NO: 6854330 - DNA, 68 bp, Homo sapiens
agctctgtccagtgccagtgaagacaggtcagcaacaacacgtctccatccagcactggccacagact

SEQ ID NO: 6854331 - DNA, 84 bp, Homo sapiens
gaattgattcaatggatgtatggtttcttctgcacaacattatgtgttgaagtcagttcatatttttataaggagttatagttc

SEQ ID NO: 6854332 - DNA, 61 bp, Homo sapiens
tcactctgtgattgcagcattccactgtccagggaaatcaagccttgctgtcagagaagga

SEQ ID NO: 6854333 - DNA, 75 bp, Homo sapiens
gtttcttcagttactcaacagaggtggatagagtactggctccgtgccaaattacatgggtaaacactggagaac

SEQ ID NO: 6854334 - DNA, 68 bp, Homo sapiens
agttttgtttgaaagtctctacagcaactcttacataatatctgttgctgaagagaaagaacaatcct

SEQ ID NO: 6854335 - DNA, 106 bp, Homo sapiens
tgagctaagaggctagtgaaatctttagtcaggcgtgggtattggaaatacttcttttctggtcctgtgtactcctgatacttgggattcatttgctcatctctca

SEQ ID NO: 6854336 - DNA, 59 bp, Homo sapiens
aagtctgggatcagggtgccagcatggttgatttctggtgagggctctcttccagactt

SEQ ID NO: 6854337 - DNA, 57 bp, Homo sapiens
tatcaggatctgggagcctgaaacaaagagaatgtattccaggcacagatgttgatg

SEQ ID NO: 6854338 - DNA, 61 bp, Homo sapiens
tgtttacttgaggtggaaacaattctctcatctatgtgttgtttattctcttcagtgaaca

SEQ ID NO: 6854339 - DNA, 70 bp, Homo sapiens
gctgacagcgagagacaaagagctgtgctgttgaacactgcccagagcaacctgtctcttcctgctcagc

SEQ ID NO: 6854340 - DNA, 56 bp, Homo sapiens
agcacttaactgacagtactatttatcttgtcacttagttaaattcagtaagtgct

SEQ ID NO: 6854341 - DNA, 65 bp, Homo sapiens
ggttggctcccggcacttggcatgtcatggttctatcatgctaattccatatgccggagctcatt

SEQ ID NO: 6854342 - DNA, 56 bp, Homo sapiens
gcaggtgagagaaggtttccctgagcaaggccagggcttcattttaattcagctgc

SEQ ID NO: 6854343 - DNA, 64 bp, Homo sapiens
caataactagtaattattccggtccccaaacagaagaggactggaaaatcttgactagctgttg

SEQ ID NO: 6854344 - DNA, 58 bp, Homo sapiens
aatttacacttcatttggagggctgagatttggatcagtgcccagtgaaggtcaaatt

SEQ ID NO: 6854345 - DNA, 60 bp, Homo sapiens
ttttgggggggagccgcagggaaccgttgggagaggggccctgtgtgtgtccctttaaga

SEQ ID NO: 6854346 - DNA, 55 bp, Homo sapiens
aaactgaggaatgacagcattatcctagatggtttgtgttatcctttctgggttt

SEQ ID NO: 6854347 - DNA, 83 bp, Homo sapiens
ggacccatcttacagacttgtgcctccttggctgtcctgcctggtcagccccttggaacacagggctggccctaagttggtcc

SEQ ID NO: 6854348 - DNA, 68 bp, Homo sapiens
gaacagctggggcagccacgtgcgggttcttaaagcaccgccccactgggacctctggcccagatttc

SEQ ID NO: 6854349 - DNA, 74 bp, Homo sapiens
gaggaggaggtggatgcctaggctgggcatctctcaaaaccctgccccggagcacacagtcttccttcctcctc

SEQ ID NO: 6854350 - DNA, 66 bp, Homo sapiens
ggtgcctccctgttgactagggttaaggcaacagtaggaaccctcctggccaagagggctggtatc

SEQ ID NO: 6854351 - DNA, 78 bp, Homo sapiens
ctgtgattcacctctccagtggcgttgaggattacctgactgttctcattgttagtgtgggagcaatgttctttgcag

SEQ ID NO: 6854352 - DNA, 61 bp, Homo sapiens
gtccccctgaaagcagccgcagaaacagctgccacctatttgcatagctgagcaggaggac

SEQ ID NO: 6854353 - DNA, 66 bp, Homo sapiens
gtgcccagcaggtccatgtttctatcccggagacccttgggttaggaaatattgattgctctgtat

SEQ ID NO: 6854354 - DNA, 86 bp, Homo sapiens
ctatcacaatcttcttcctacgcacttccagaatctttcttttaggagggtttggcaatatttgtggaacactaagcatgtggtag

SEQ ID NO: 6854355 - DNA, 81 bp, Homo sapiens
cacgagaaaatggcagaagtgatataatgtgacttcagaggctgagtcacaaaaggccatgtggcttccgccatgtttgtg

SEQ ID NO: 6854356 - DNA, 56 bp, Homo sapiens
actccagctctgtgcagcagggggactggtgtttattccctgttacacactggggt

SEQ ID NO: 6854357 - DNA, 107 bp, Homo sapiens
atgttttttctttcctcctactcaaaaagttatgaatcataggaatgagttaatgtttcaaagatgtttattgctttttttgtggggggaggtgcatgatgaaatat

SEQ ID NO: 6854358 - DNA, 64 bp, Homo sapiens
gagaagttggcatgtagtggctgcagtaggaagcagttaagggctggtgtagactctatgtctc

SEQ ID NO: 6854359 - DNA, 57 bp, Homo sapiens
tttcaacatacctcagtgtatgtacattgtataaaacattgaatgtatgtgatgaaa

SEQ ID NO: 6854360 - DNA, 65 bp, Homo sapiens
aggaagataatttcagaaaagtgatacgaacgtgatatcaaagtttcccagaagttgtctatcct

SEQ ID NO: 6854361 - DNA, 60 bp, Homo sapiens
tttccacagctgtataaaataaggaaataactattttgattattgagacatttgtggaaa

SEQ ID NO: 6854362 - DNA, 72 bp, Homo sapiens
tccaaatctttgagtgacatagtgaaaaatcagatttacatttgagtttcagttctgtcatttatagctgga

SEQ ID NO: 6854363 - DNA, 80 bp, Homo sapiens
tgtcttctgctggcatttaacctgtaaaatatgtgagttctaaatctgtgccttgcttaacaagatggcagtaaagggca

SEQ ID NO: 6854364 - DNA, 59 bp, Homo sapiens
agataagagcctgtgtttggaattaagcctggcttggccacttattttagctcttattt

SEQ ID NO: 6854365 - DNA, 57 bp, Homo sapiens
ttcattcattacgtgccaggcactattctaagtaagtgctcggcatatgtgagtgaa

SEQ ID NO: 6854366 - DNA, 56 bp, Homo sapiens
gactgagcctgaggttttggagctggacaggctcagctttgaatcctggctctgtc

SEQ ID NO: 6854367 - DNA, 84 bp, Homo sapiens
ctgccatggccaggactagagggaggtgagtaaagcactggaccccagctcatttcaccctagttctggcccaaatccctgcag

SEQ ID NO: 6854368 - DNA, 84 bp, Homo sapiens
tgcccggatcttggtttctgaatgccattttctataaaaagaatctaggttccttggagagttggtggattccaaggctgggca

SEQ ID NO: 6854369 - DNA, 77 bp, Homo sapiens
cacatttcataaagtaacatggaccttaaaaattatattgaagaatttgaggtattgatattttatgactgaatgtg

SEQ ID NO: 6854370 - DNA, 76 bp, Homo sapiens
gggcttgggctgggcaacgctgtggttgttgggaacgctaatttctgttatttggtggtgctcatatctcaggcct

SEQ ID NO: 6854371 - DNA, 72 bp, Homo sapiens
ggtgccccgccttctgtccaaccccacgatggatgccagtgctggaaagggacggaggaatgcatgggcacc

SEQ ID NO: 6854372 - DNA, 58 bp, Homo sapiens
tgggagagataggcttctggaccttactttgctacctctaatgcttcctctcatccca

SEQ ID NO: 6854373 - DNA, 63 bp, Homo sapiens
tccaggcaccagtgagaagggcctttcaccagacttgagaggtcagcaagggtgctctaagga

SEQ ID NO: 6854374 - DNA, 61 bp, Homo sapiens
gaccctgagccaaaccagttagatgtcatccatacagcattcctttctggagctcaaggtc

SEQ ID NO: 6854375 - DNA, 92 bp, Homo sapiens
tttatttttgtaaacaaaaagcagtttatagtcagttgaacaactggaaatcagttgataagtaactagatatagattgttttaaaaataaa

SEQ ID NO: 6854376 - DNA, 88 bp, Homo sapiens
ggtcaggtgctctttgcagttttctgcctcatttccaaggtaacctaggatttgtcacggttgagagccaagaagcaggcacgctgcc

SEQ ID NO: 6854377 - DNA, 82 bp, Homo sapiens
ctgggcaaagtcagaaggctaaaattgagtaggagtttttattagactgggctggttagttttactatctgagaatgaccag

SEQ ID NO: 6854378 - DNA, 81 bp, Homo sapiens
gttgagtgatgtgcattgtactgctcgcattgggttgagtttcccttaaagtgtcttcagtaaaatacactatgattcagc

SEQ ID NO: 6854379 - DNA, 59 bp, Homo sapiens
ggagccctcaccggcgagtgcctgacacctcggccttttctcttccggaggggcgctcc

SEQ ID NO: 6854380 - DNA, 130 bp, Homo sapiens
cagaagtgcctgagaggtgcagggcccgagtctggttaggtgacagcgggtcaagaggaggacattgtcctctctcttgtgttgctgcagatgccacaaaactgggccacggcacgatcaggcagttctg

SEQ ID NO: 6854381 - DNA, 69 bp, Homo sapiens
gctgcgggcaggcggggcccagctctgctccgtgcggaggctgtgttctgccctctccctgcccacagc

SEQ ID NO: 6854382 - DNA, 86 bp, Homo sapiens
tatattcaaatagatgacaggatattatgatagattctttctataaagcagtttggcagtttgtttttaaaaactatatgaatgta

SEQ ID NO: 6854383 - DNA, 64 bp, Homo sapiens
gctgctaagggtgggaactaccagtgaaatgctacgtgctgcagggtcagccccacctggcagc

SEQ ID NO: 6854384 - DNA, 60 bp, Homo sapiens
gactgccccagttcaaatcctagctgtgctacttaccagctgtgtggccttgggcaagtt

SEQ ID NO: 6854385 - DNA, 72 bp, Homo sapiens
acatttcactcccctccccactgcaccctggcaacagctctgcaggactggggagcggaaggtgagtgatgt

SEQ ID NO: 6854386 - DNA, 129 bp, Homo sapiens
tccatctgggtgttaccgcaaagggcaggatggaagtcagtgtggcccagggctgtgtcccagctagtttaccaaattgatcttccctagtgattctgacatctctgtggagggctagggtgggaataa

SEQ ID NO: 6854387 - DNA, 81 bp, Homo sapiens
cagagatctaatttaccatttactttttaatgacaatggtaagtttttctgtcatgtaaagagtaaatggtgacttttctg

SEQ ID NO: 6854388 - DNA, 90 bp, Homo sapiens
cttgtgccagaaggatttcttctcccagagagcaggtgggccgtgtcaagggacatactgctgtgtgctctgggaccctctctggacaag

SEQ ID NO: 6854389 - DNA, 55 bp, Homo sapiens
ggcaggctgttcacctgcttttgcaaataaagttttattggaacatagccatgcc

SEQ ID NO: 6854390 - DNA, 82 bp, Homo sapiens
ggttattgttctatggtgaggcagccacagcgtcactcttgagctttctgcatgcctgcctcccataccaaacattacagcc

SEQ ID NO: 6854391 - DNA, 62 bp, Homo sapiens
ccagaagtcaatgcagatgtgattatataagaaaatcaagatcatatctttgttacttctgg

SEQ ID NO: 6854392 - DNA, 57 bp, Homo sapiens
gcagtgccttgcttctctgtctccctgctcaggagacagggctcccagcaggtctgt

SEQ ID NO: 6854393 - DNA, 75 bp, Homo sapiens
gtttccaagcctgttctcctccatcatttgctcagagaataatattacaggtgttgggagagctggttttgtaac

SEQ ID NO: 6854394 - DNA, 68 bp, Homo sapiens
gcgcttgcagactgccttcatgcagacccctgactccagcacgtctgggctgccaggtaggcacacgc

SEQ ID NO: 6854395 - DNA, 57 bp, Homo sapiens
atgcttactgtaaaggtcacatggtgttaaattagcactttgatatacagaaagtat

SEQ ID NO: 6854396 - DNA, 57 bp, Homo sapiens
ccgctttctgtgattgcagcctctccggatgcccgatcgctgcagcagagaaactgg

SEQ ID NO: 6854397 - DNA, 61 bp, Homo sapiens
cccgcggtgaggaactggtgggaagaggcggcctcctccctgccggcctgcactgcccggg

SEQ ID NO: 6854398 - DNA, 60 bp, Homo sapiens
cccatatgtctgtggcaattgttgatggttgtagaagtatctgctagatcaggatgtggg

SEQ ID NO: 6854399 - DNA, 55 bp, Homo sapiens
gcacagactttgattgcagtcaattcacgcaccctgaggcatagcaggtctgtgt

SEQ ID NO: 6854400 - DNA, 68 bp, Homo sapiens
aacttctcatacaaagaacaagatgggaataattctacattggaagatctgctttgtgttgagtagtt

SEQ ID NO: 6854401 - DNA, 100 bp, Homo sapiens
gtttttgtagtaggaacactgggcttatgctgtggagtaggatataacaattctacaaaccagcagaataggtccacccacagccaatgctactaggaat

SEQ ID NO: 6854402 - DNA, 62 bp, Homo sapiens
attttagtcttgggacatttagggtggtggcaaataactctgcagtgtaacagcgcttgaat

SEQ ID NO: 6854403 - DNA, 88 bp, Homo sapiens
gttaaggctattttcacttgtggatcttcagttgcttcaggccatctggatgtatacgtgcaggtcacaggggatatgatggcttagc

SEQ ID NO: 6854404 - DNA, 71 bp, Homo sapiens
cccttcacacaggtagaagcagaggctcatcataagcctcacctctttctgtctagctgagtgattcaggg

SEQ ID NO: 6854405 - DNA, 70 bp, Homo sapiens
ggttagcttgctgagttgtccttagggatagcattttctgttcttacaagtatgacgtagcaggctggct

SEQ ID NO: 6854406 - DNA, 64 bp, Homo sapiens
aaggaaaaaaaggttagcatggctgtatctgggtaagggaactacaaatggcttttatttcctt

SEQ ID NO: 6854407 - DNA, 129 bp, Homo sapiens
tacagagggaagttactttattgcttccatgcaaaggcattctctggaagaagataaaaactccaagctaagcagttattaacttcttcccagagacactgctaagtggtaagaaacactgcctctgta

SEQ ID NO: 6854408 - DNA, 56 bp, Homo sapiens
tgctggagattagtgaaaataaccaagaaaatattatttaaaatagtgctccagca

SEQ ID NO: 6854409 - DNA, 70 bp, Homo sapiens
ccaaagcatgaagcatttttattcttgtgaaagtgatgcttttgcagaataaactgctttagggcagtgg

SEQ ID NO: 6854410 - DNA, 57 bp, Homo sapiens
ctttgaggctggtgttattatccccaattaggagataagaaaacagtaggctcagag

SEQ ID NO: 6854411 - DNA, 55 bp, Homo sapiens
tgtgtgtgcatttgtcatctgtgctagaggagcaaagatgagtccggcagacata

SEQ ID NO: 6854412 - DNA, 73 bp, Homo sapiens
ctggaaaattgatcaaggatttatttaagctccatagagtgggctctggaaagtgtccttgatggaaattcag

SEQ ID NO: 6854413 - DNA, 66 bp, Homo sapiens
ggtagatctgccttaacctgggagtggcgagggagtgatgcatctgccaaaacgaggagggtcact

SEQ ID NO: 6854414 - DNA, 89 bp, Homo sapiens
gctacctcagccaggttatcaaggtccctgtcagcattcacaaatcatgttgacagtacgtacccttgatatgacctgatgaaaatggc

SEQ ID NO: 6854415 - DNA, 80 bp, Homo sapiens
ggaacacattgttgagattgtcattgacgatgagcagctcctctgtcagctgctcattggcgatctgagggatgagctcc

SEQ ID NO: 6854416 - DNA, 77 bp, Homo sapiens
tcagtcatgggaaggataccttggaacatttaataattttttggagtttcagcttgattctcccaaaatgtgactga

SEQ ID NO: 6854417 - DNA, 68 bp, Homo sapiens
tttgttatagcaggccaaactaactaacacagaaattgatatggggagtagggtgttgctataacaag

SEQ ID NO: 6854418 - DNA, 67 bp, Homo sapiens
ttggatccaggagcagggagaagaggaaggtaatgctttttacttcattcctgacttcaacgtccag

SEQ ID NO: 6854419 - DNA, 66 bp, Homo sapiens
tctaggattcttcctctggctccaaccttgctctagatgagtggagccaaaaagggaaggagaaga

SEQ ID NO: 6854420 - DNA, 74 bp, Homo sapiens
ctgtcatagccaaaggattctatggagatattaacaaacaaatgtgatgtgtgctggatggaatcctggaacag

SEQ ID NO: 6854421 - DNA, 65 bp, Homo sapiens
tgttctaagctgccaaaatgctcaggtagacttacgtaagcacctgctttggctgttcaagagca

SEQ ID NO: 6854422 - DNA, 102 bp, Homo sapiens
ctctgcctcagtctgcaccctatccccagattgagcacttgaacccctctgtgacttcatcttgccactggggctaggactgttcctgacttgaggccagag

SEQ ID NO: 6854423 - DNA, 78 bp, Homo sapiens
tccatgtacgtatatatgcatgcccatgtatacacatacagacatgtgtatacatacatatgtgtgtgtataaatgga

SEQ ID NO: 6854424 - DNA, 57 bp, Homo sapiens
tcaagatgcatgggtggcataaatgtatttcataggcgttctcacccatgtatgtgg

SEQ ID NO: 6854425 - DNA, 90 bp, Homo sapiens
tccagacccagaccccatggtgaccaggtactgaccatgaggactgaagggcatggtcagtacctggtcaccataaggtctgtgtctgga

SEQ ID NO: 6854426 - DNA, 65 bp, Homo sapiens
ttttggcaaaagattgggtacttagtttcctgttactgagttagctctattcttttggaccaaag

SEQ ID NO: 6854427 - DNA, 60 bp, Homo sapiens
gaaagggtgtgctgctatcccactaccaagtttccaggcagctggcagtgccaccttctc

SEQ ID NO: 6854428 - DNA, 85 bp, Homo sapiens
gtatgcaggtttatatcagaaggtgagattgaataatgcttgatgcagaatcgaaacttctcatttatctgtatattatgtttac

SEQ ID NO: 6854429 - DNA, 78 bp, Homo sapiens
aaaaatagagcaaagtggaccaaaagaagaggtaagcagattttattacacttatttttgtccacttcctcagttttt

SEQ ID NO: 6854430 - DNA, 75 bp, Homo sapiens
tagtggttccggaagtgactgatccgcacatgttcatccatgtaggtgtggtcgaagttctcccggagccagctg

SEQ ID NO: 6854431 - DNA, 88 bp, Homo sapiens
ccttagagctaattagtttcttttcaagtaattgcaaatagtacattttccaggcccttggagtagaggctgacaactagctcgctgg

SEQ ID NO: 6854432 - DNA, 61 bp, Homo sapiens
tggagctcaaggaccttgacagaaattccccaaaactttgttaaggtcacttctgagccta

SEQ ID NO: 6854433 - DNA, 107 bp, Homo sapiens
gtggaaccagctaccggagataatttaaaactccaggctgtggtttttctgacccaacattgacctgattttgaagacagtcttatttccttggtggtgagtttcat

SEQ ID NO: 6854434 - DNA, 80 bp, Homo sapiens
caggagcagccagttctctgtggtaggaaaatctgaggactccctggactgggttacccacagcagagctgggttcactg

SEQ ID NO: 6854435 - DNA, 121 bp, Homo sapiens
gaagacatctgtacaggccatccatgcaggagggtgacaactgcaaaggaggctaggacactttggggtgattaatgtttgcagttgtcatcctcctgcacagatgccttcaagtgccttc

SEQ ID NO: 6854436 - DNA, 66 bp, Homo sapiens
gccacagcccgagcaccatgagctccggagaccctgcacacctcggcctctgcctctggctgtggc

SEQ ID NO: 6854437 - DNA, 77 bp, Homo sapiens
aggtagtttcctgtgcttattcttctctgatgctcctagcagccctctgaggcagaaaaagcaagggttgttaacct

SEQ ID NO: 6854438 - DNA, 76 bp, Homo sapiens
agtgaacagatgcgcttggttgccagaccgcgccctttgcgggtctatcaaaagggcaagcgcatattctggagct

SEQ ID NO: 6854439 - DNA, 106 bp, Homo sapiens
gagaagaaagggagagagttggatgatctcagagcagtagaaaacagccttttaaacatagaaggtatgtctgttttagactataggatgatcttttttttttctt

SEQ ID NO: 6854440 - DNA, 72 bp, Homo sapiens
aaccaccaaaaccattgaaagaaaggataatgggatttgacctaatcagttcttccaaggtgctttgtggtt

SEQ ID NO: 6854441 - DNA, 56 bp, Homo sapiens
tgggcagggccagggtgctatgggagcatataagaatggcacagaacccttgccta

SEQ ID NO: 6854442 - DNA, 63 bp, Homo sapiens
agctaggaagtagaagcttctggacttgaaaccagattttgactggctttaactcttgtagct

SEQ ID NO: 6854443 - DNA, 63 bp, Homo sapiens
ggccagaggtctcctgcacgggatgtgccttctcaatatcctctcagggccagtacctcaccc

SEQ ID NO: 6854444 - DNA, 57 bp, Homo sapiens
ctacggatgtacttaaatgagggcaaactgatttgcagtttatctagtcatccatag

SEQ ID NO: 6854445 - DNA, 63 bp, Homo sapiens
agatagccctccaataagcttggagtcttgtgttctaaacgagctaaggactggagggtttct

SEQ ID NO: 6854446 - DNA, 66 bp, Homo sapiens
aatgtaggtcaaaatcaggcagggaagttccttgaatttcaagcttagaaattttgacattatatt

SEQ ID NO: 6854447 - DNA, 72 bp, Homo sapiens
ataggactccttgtgccataaccaccctgactggggatctagatccataaggtggggatggggcaggcctgt

SEQ ID NO: 6854448 - DNA, 56 bp, Homo sapiens
cagggaatactatgacacacaggtgattcactggagcatctcttggtattcctctg

SEQ ID NO: 6854449 - DNA, 127 bp, Homo sapiens
ccctcctctgggacccatagcttcccacagagtttggccaaggggatgctgaagatgttggtgcttcccctgctgcagccagcatcgacttcctgcctgaactttgagtggaggaattagaggaggg

SEQ ID NO: 6854450 - DNA, 79 bp, Homo sapiens
tctgtgtaagtcccagcggggcatttcctggccatgtgagccatctgagtgtcagtgcttggggctacatctgcgcaga

SEQ ID NO: 6854451 - DNA, 61 bp, Homo sapiens
ggcttcagaagactggacaggtggcttggtaattaaaacctttcccttctaactgcaggcc

SEQ ID NO: 6854452 - DNA, 56 bp, Homo sapiens
gccacttctctcgggaagccaggaaggctcctcgcaaatcctggtggagaagtggt

SEQ ID NO: 6854453 - DNA, 94 bp, Homo sapiens
ggaacaaaagcacaagtcctggcttatttttatagcagtgcgatcagaatgcctgaactgacagaaagaatgtctatggacctggtttggttcc

SEQ ID NO: 6854454 - DNA, 57 bp, Homo sapiens
tgtttcctggaccttgactgatataaaaattatcaccaggagttgtctcaggaaaca

SEQ ID NO: 6854455 - DNA, 129 bp, Homo sapiens
ctgccctgtgtggagacgggctgagtgacatgttcttcaggaggtgagcaagaagggggcatcatctcccacccttcctccacctgcacacacctggcacgtgtgctcctccacctttctgcaagggag

SEQ ID NO: 6854456 - DNA, 83 bp, Homo sapiens
agagaactctcttattactgtattaatccagagcagccagtttgctaaggaaaggaaatacagtaatctccttgaggttttct

SEQ ID NO: 6854457 - DNA, 77 bp, Homo sapiens
gagggcaaataggagtcaaggctattatgtgggaaatctggcaccagattacctgctttagaactccagtttccctc

SEQ ID NO: 6854458 - DNA, 56 bp, Homo sapiens
ccccggaagctgaaggatgactgcgggagtttcagtcccctacatagttcctgggg

SEQ ID NO: 6854459 - DNA, 64 bp, Homo sapiens
gccagcagctcttgggcgggcagagggcgaggaaagggcgccactgccagggagagcggctggc

SEQ ID NO: 6854460 - DNA, 62 bp, Homo sapiens
atttttagtgtcttgctttgggaaagggtgctactggcctttagtgtacagacactagaaat

SEQ ID NO: 6854461 - DNA, 72 bp, Homo sapiens
ctgctgcctttccaccttctggtgctccagctcctcttccagctcttgaaggtgggatcgagaggacagcag

SEQ ID NO: 6854462 - DNA, 56 bp, Homo sapiens
gagaagtggaaactgcccgagcttcaaaaagttactacagtcctttccgctttctc

SEQ ID NO: 6854463 - DNA, 60 bp, Homo sapiens
cagagcctcatcatccactccacagagagcccatcacagtggctggatagatgggaactg

SEQ ID NO: 6854464 - DNA, 65 bp, Homo sapiens
agagcaggcactgggtaattagtagctctacctcttagcaaggtatgagctcccacttttggtct

SEQ ID NO: 6854465 - DNA, 121 bp, Homo sapiens
gattaatcaatgttagaaattgtagaaattttcaaagatgcatctaggttctttattcatgttttagtggacaaaagaataagatgagtcatttacttcaacgctaacatttggtttaatc

SEQ ID NO: 6854466 - DNA, 62 bp, Homo sapiens
catcaaaatgaaagacatctcatagacaatagtacagtaggtcagattctctcattttgatg

SEQ ID NO: 6854467 - DNA, 57 bp, Homo sapiens
tctgtggagttgaggaaggttgtaatactttacatctacaacttaagatttcacaga

SEQ ID NO: 6854468 - DNA, 95 bp, Homo sapiens
ctgatgggttagagttagtcatgtgtttcttggtctttccctgagtcttccctttgagtaaacagatattgactttccagcacttttcccatcag

SEQ ID NO: 6854469 - DNA, 78 bp, Homo sapiens
gcatgtggttgcattttaaatgcatgttgactaaataaaaacaatcaagatggctttttaaagtgcgttaaaatttgc

SEQ ID NO: 6854470 - DNA, 80 bp, Homo sapiens
ggcattatgccaagaaggtgggagggaacgtgaggcggactgttgttgcttttgtgagctctcactttgtggccaatgtt

SEQ ID NO: 6854471 - DNA, 57 bp, Homo sapiens
agcctgtggttatgaattttcagagaatatgtaatattctgacccagagcccaggct

SEQ ID NO: 6854472 - DNA, 69 bp, Homo sapiens
tcagctcctccgtggacacagtgcagtgcaaatatcatgagctttggagtcacacaggcctggagctga

SEQ ID NO: 6854473 - DNA, 63 bp, Homo sapiens
cagcttctgctatcgaacatctcaggggaataacaggtcagaagtgttgagtacagaaagctg

SEQ ID NO: 6854474 - DNA, 103 bp, Homo sapiens
ggcttttctctctgtgtacagggtcccacagctatctgactttgactcatttttctaacccagtgattctcaaagtgtggctggcccatggactgaaatggcc

SEQ ID NO: 6854475 - DNA, 80 bp, Homo sapiens
atagatgtaaaattgagactattctgggaaaaccaggatgtttgggccccctggtaatagtctaatcattatacatctgt

SEQ ID NO: 6854476 - DNA, 68 bp, Homo sapiens
agttagtaatcagaggtaaactttaatagtacaaggtaagaactaaagccttatcctgattggtagct

SEQ ID NO: 6854477 - DNA, 64 bp, Homo sapiens
gtggtgaacacatcacattttacagtgggaaaggccctgtggtcagtggacagtgtcgcatcac

SEQ ID NO: 6854478 - DNA, 61 bp, Homo sapiens
ttcacaaccaatctgtggggtacggttaccatgtgtcccaggccagaacttggttgctgag

SEQ ID NO: 6854479 - DNA, 69 bp, Homo sapiens
ttacaatgtgctggaaccctactctgtgtagacaccgttttgagcaaagtaaagggttccagatagtaa

SEQ ID NO: 6854480 - DNA, 62 bp, Homo sapiens
accagctaccttaacagtgtcaagcctctgctttggggatagacacaaagggtagtaatggt

SEQ ID NO: 6854481 - DNA, 80 bp, Homo sapiens
aggtcgttttccagagctgcaggtaaaatgcttccccactgcttctgaggcttttgtttcagctctgctactagtggcct

SEQ ID NO: 6854482 - DNA, 65 bp, Homo sapiens
tgtagaactcccagtggtattgttccctgattctcactcaccagcagccactgggagtgcttata

SEQ ID NO: 6854483 - DNA, 85 bp, Homo sapiens
cattcagtttgttcccagagctctgacaccagctgacttagattaaatagcagtgagctggaaaagcattctgggtattggtatg

SEQ ID NO: 6854484 - DNA, 70 bp, Homo sapiens
ctagggccatggcattgcataacggggctctgaaagacatggctgccaaggtgctgtcatgtgtacctag

SEQ ID NO: 6854485 - DNA, 63 bp, Homo sapiens
cctcattagatcagatcggcagtaatccaggaggaagactggtgattggatctaaggaaaagg

SEQ ID NO: 6854486 - DNA, 56 bp, Homo sapiens
cagaaagcgggatgcagcatgtggctagctgtgcagcaataactccttgctttctg

SEQ ID NO: 6854487 - DNA, 59 bp, Homo sapiens
gaacgccccatcaacacggccttggggagtcgtagatcaaggtcactgttagggcattc

SEQ ID NO: 6854488 - DNA, 67 bp, Homo sapiens
tgctgactccgccacttcctaaactttggtgccacaaaacaggaagcaaaaggcagggtctaaagca

SEQ ID NO: 6854489 - DNA, 69 bp, Homo sapiens
gcatttgtaaaagtatatggtgcaagaatgttattgttattaaggcaccataatatatttaatgtatgc

SEQ ID NO: 6854490 - DNA, 57 bp, Homo sapiens
cagctgctgtgacatctggaagcattaacactttgttgccagcatgtaggctagttg

SEQ ID NO: 6854491 - DNA, 56 bp, Homo sapiens
gggaattaggcacacaacttctgttaagagtaaaggaagcttaatgcctaatttcc

SEQ ID NO: 6854492 - DNA, 115 bp, Homo sapiens
gttcaagctcattccattcatcattagttttaaaatagaggttagagaattttgttattttaattctaactaaagtctttgttttgagaatctgaagaacaggaaattcttgaat

SEQ ID NO: 6854493 - DNA, 123 bp, Homo sapiens
tttaagagagttggggaggggtcctgagagaatgaagaatctgaggacagtcattcttccttgtgagtgacttgcattggaatgtttgtctcatcttctcctctggattataagctccttaaa

SEQ ID NO: 6854494 - DNA, 71 bp, Homo sapiens
gagcctagagacataagttcaagaacaaagtctttgaccacaacaagtttttgagcatgtactttgtgctt

SEQ ID NO: 6854495 - DNA, 62 bp, Homo sapiens
taggtatccaggaaggatggcattgagctgacacagtggagatgcagatcttggtttacctg

SEQ ID NO: 6854496 - DNA, 75 bp, Homo sapiens
cttctctcccagtgtcattctaagggaggtgctgtgtaggacgagagacttctcccaagtgaggctggagggagg

SEQ ID NO: 6854497 - DNA, 56 bp, Homo sapiens
gccagccaggaagaaagtaagaactctaaccttactttgtttttcttctggttggc

SEQ ID NO: 6854498 - DNA, 85 bp, Homo sapiens
gaggagacagcacagacactgagacccccttgtcttcctcatctgggggaaggaaggtactcagtgattctgtcagaagctcttc

SEQ ID NO: 6854499 - DNA, 66 bp, Homo sapiens
cacagccttgaaaataaataaaaatcattgcctgcataaaatccaggtatatattttggggttgtg

SEQ ID NO: 6854500 - DNA, 73 bp, Homo sapiens
gctttgcaagatatgtgttgttagctctctcttcacagacgaggtatcacattgcatctcatctggcaggagc

SEQ ID NO: 6854501 - DNA, 70 bp, Homo sapiens
gaggtaagggcaggagagtgaacagcacatctggcctgtcttgtgtgatcctgtccacagccctgacctc

SEQ ID NO: 6854502 - DNA, 83 bp, Homo sapiens
ctgttctggaggccagaagtctgagatcagggtgccaatatggtcaggttctggtgaagactctctttctggctttcagacag

SEQ ID NO: 6854503 - DNA, 61 bp, Homo sapiens
ggagttccaggtgagaacaagaaatttttataatgatggccaattttcatctgggaccacc

SEQ ID NO: 6854504 - DNA, 74 bp, Homo sapiens
ttggctaccaatgtgtagggtgcctgtttttgtcttgaaccagatataccctatcctgcacacttgattgctga

SEQ ID NO: 6854505 - DNA, 130 bp, Homo sapiens
acctgggacttgtggccttaggaaagcgaaaatccacaaggtgtcttcagggtgagacagaggcaggcaccttttcaaccctcctgttactgcctgcaggacacctcgctaattaagctgccttccctgt

SEQ ID NO: 6854506 - DNA, 86 bp, Homo sapiens
ggttattaagatgtgtcttcagaattaagagtatgctgtaaggatgaagacagccatcttaattctaaagacaaagcacaatgacc

SEQ ID NO: 6854507 - DNA, 70 bp, Homo sapiens
ggtcacacagtgagtcagaggtagattgtgcaagttaaggccatgctttctcttagttcattgaaagacc

SEQ ID NO: 6854508 - DNA, 85 bp, Homo sapiens
taatttacggcagctcaggaaaggccatgcaagggcaaggggcaatgcctttagttattttcttggggaatttgtccttaaatta

SEQ ID NO: 6854509 - DNA, 58 bp, Homo sapiens
agtgccctggatgactttggtctgtaacaacaaacagtacctcatggcgccggggcct

SEQ ID NO: 6854510 - DNA, 61 bp, Homo sapiens
caggtatattttgatcaccctctatgagtaaggttttataatggtgaacaaaatgactctg

SEQ ID NO: 6854511 - DNA, 61 bp, Homo sapiens
ctagaatgagggacagctaaagagaaatttcagaatatccttagagctatccctagaatag

SEQ ID NO: 6854512 - DNA, 104 bp, Homo sapiens
ggcagtggggccaggagcagaatgaggcagtctggcctgagggcacagggacgctagcacctcaccatctcctcctgccggagcctcttctctggtccattgtc

SEQ ID NO: 6854513 - DNA, 62 bp, Homo sapiens
tgtggtcataaaacaaagtaaagctaacaaagccactcagaagctaaacttatgtgaccaca

SEQ ID NO: 6854514 - DNA, 70 bp, Homo sapiens
ttactattaacctgtattattttcttagctctgaactattttagggcattgaagcaatatggaatggtaa

SEQ ID NO: 6854515 - DNA, 79 bp, Homo sapiens
acttctcagctctagtggcatctcctaattgtgtagaaaataaaagtatttacacaaaatgttagtagatgctgggtgt

SEQ ID NO: 6854516 - DNA, 72 bp, Homo sapiens
cccaaagatacacgttgtattgaatacaagtgtggtaaacaacaagactattttttacaacttgtttctggg

SEQ ID NO: 6854517 - DNA, 64 bp, Homo sapiens
catctttctcttgatcctgctttccgatcttgattggactgaagacagcgaggacagaggggtg

SEQ ID NO: 6854518 - DNA, 61 bp, Homo sapiens
ccttttatgtacttggttccagcctaggtgatgagtgcaaggtgctaagtactgtgaaggg

SEQ ID NO: 6854519 - DNA, 69 bp, Homo sapiens
cccacatgtggtttgcacagcgttgggggagtcaccagccccttcagcctgtctgcagacccctgtggg

SEQ ID NO: 6854520 - DNA, 76 bp, Homo sapiens
gggcggcccgtgcgggatccccgcgctctccacctgcgaggggcgggccggagctgggtcccgcgcgcggtttccc

SEQ ID NO: 6854521 - DNA, 99 bp, Homo sapiens
cctggcacagggtaccccatgtgatgtggcagtttaagaggctgggcagacacaagaatcccagcactgccattggtcaaatgagtgacttgtgcaagg

SEQ ID NO: 6854522 - DNA, 92 bp, Homo sapiens
tttgtaaacttataatttttaggttgggcttactattttgatgagaagggtgaatctgtcaaagggtaagctggataactgtatgttgcaaa

SEQ ID NO: 6854523 - DNA, 64 bp, Homo sapiens
gcctcctttttgaaatagacttataaaggatacaactctattattttctcctcagaaagtgggc

SEQ ID NO: 6854524 - DNA, 81 bp, Homo sapiens
gtccatgggttaggctggaattgatggacacgtggtggtccaagtcccagatgaccgtcttccagccagagggccctggac

SEQ ID NO: 6854525 - DNA, 68 bp, Homo sapiens
gaacaaataaatattaagcatttggccctgtgcctggcacagagtaggtgctcagtaaatatcagttc

SEQ ID NO: 6854526 - DNA, 66 bp, Homo sapiens
gagtggtttgcaggatgcatcaagaagtgcacacaataaccttggcagcatccatggaggccgctt

SEQ ID NO: 6854527 - DNA, 66 bp, Homo sapiens
gaccggctttctccttgccttagtcttctatgccaataaagaagaaaggcagggatgaggattgtt

SEQ ID NO: 6854528 - DNA, 89 bp, Homo sapiens
tcatgaacagtgggggaccataactaggcatgatggcttcagatacagggcttgttcatctcttgttgtggtcaggcactgcctaatga

SEQ ID NO: 6854529 - DNA, 71 bp, Homo sapiens
agataactgtgtgtcatgcattacttccacccacatcccaatggctaaaatgcatgtgcatggctctatct

SEQ ID NO: 6854530 - DNA, 90 bp, Homo sapiens
gggagaggtggctcttttcacgtcccctctgacttccttgtcggcctgcagatggtggtgtgagaagagggaaaagccgcctctgcatcc

SEQ ID NO: 6854531 - DNA, 68 bp, Homo sapiens
aggtgcagtgatgtggtcagtgctgttcagaggcagctgcagggcaaagaaccacaccacgtgtgtct

SEQ ID NO: 6854532 - DNA, 66 bp, Homo sapiens
tgctttctaagcatgaaataatgtccttgttctcatgggagtaacacatgtttatgcttgggggca

SEQ ID NO: 6854533 - DNA, 96 bp, Homo sapiens
ccaggccctagtcttctcttcctttgtcaactgatcatgggcaacaacctatgaggccatcagtgcagggtgggagagagaaggcagggtggctgg

SEQ ID NO: 6854534 - DNA, 92 bp, Homo sapiens
gctttctgagtttctgggacaggcttactgtttcatagggtggagtgaccttcccaaagcagcttggccatgttctccggatgtcaggaagc

SEQ ID NO: 6854535 - DNA, 58 bp, Homo sapiens
ggcagctgagcgtgaggaagagtttcagcttgaattctgactcgaccactcagccacc

SEQ ID NO: 6854536 - DNA, 130 bp, Homo sapiens
atagctgtaaagtaatgaaatggattcttctgtgtagctttatgaaaatctttgtatatttactgtatattatgtagataaattagaaagtttacttgtagcacaaaggcatttttacatttacaacttt

SEQ ID NO: 6854537 - DNA, 56 bp, Homo sapiens
gcttttgacagtgacatgtcttacaaaatgtgagtagacctcacgtgtcagaatgc

SEQ ID NO: 6854538 - DNA, 70 bp, Homo sapiens
gtgttctgccctgcccatctaccctgtccgattcacctaaaggtaggccaggcaggacgggcagggccac

SEQ ID NO: 6854539 - DNA, 63 bp, Homo sapiens
cctcggaatctattctagttacttgaagcagaaagagacttattaaagggtagagtctgtagg

SEQ ID NO: 6854540 - DNA, 57 bp, Homo sapiens
gattaagggttatcatttgcagtgaagaccattacaaatgaccatagccacttattt

SEQ ID NO: 6854541 - DNA, 90 bp, Homo sapiens
ggcgggaggccgaagcccaggccgccctgccgcgcgaaaggccccgacgctgccgccgcggcactggcctggctcccggacatcgccgcc

SEQ ID NO: 6854542 - DNA, 61 bp, Homo sapiens
gttaaggagaaggcatcattcaagtgtccacagcagtgaaaagatgcatttctctgagaac

SEQ ID NO: 6854543 - DNA, 66 bp, Homo sapiens
actggcctgcctcccggcttctttctccaaggtaatgaaaaagccaagctgggaaggcaggctggt

SEQ ID NO: 6854544 - DNA, 89 bp, Homo sapiens
agtgcagggagggggcctggagggagtggggatagacacgccccctgcttgcctggcaccacagcctttcagactccttaccctgtcct

SEQ ID NO: 6854545 - DNA, 82 bp, Homo sapiens
aggcactgaaatgttgaggtttcgaggtatagtaagtatacaatgcacttcacttggatgccttttcatttttaggcagcct

SEQ ID NO: 6854546 - DNA, 84 bp, Homo sapiens
tgctatggctcaattcatagagttgacacagtttaacaggtggacagtatcatgtatctaagattagtcattgttgttatagca

SEQ ID NO: 6854547 - DNA, 61 bp, Homo sapiens
tccctccttaaagggagcagcagcttggcagtgagtatgctggcacctttgagtggtggga

SEQ ID NO: 6854548 - DNA, 108 bp, Homo sapiens
gagaagaaaattcatagagaaggggaaagaggcaggaaacatggatttatttcagaaattttgtaggtttctgctgtcctccttctcccctgctacctacttctgctc

SEQ ID NO: 6854549 - DNA, 76 bp, Homo sapiens
tgcatgttttctttcagattatctcaactttggtctcctgggaccactcgttgctgacagtcagaaagtaagtgta

SEQ ID NO: 6854550 - DNA, 71 bp, Homo sapiens
ttttaagatggcatctcctatagatggtaactgcacaggcccttctaagctgagaatgccttttcttgaaa

SEQ ID NO: 6854551 - DNA, 61 bp, Homo sapiens
ctcctctttggggatttacacagcagctgaagcacaacagagctgtcctagaaatgaggag

SEQ ID NO: 6854552 - DNA, 63 bp, Homo sapiens
agatggccccagctggtgtgctctggaatccttggcgccaaggccatgctgccaggggcttct

SEQ ID NO: 6854553 - DNA, 59 bp, Homo sapiens
cccatttatcccaaggttactccatgtccaccatcttaagtctgccactgggataaggg

SEQ ID NO: 6854554 - DNA, 69 bp, Homo sapiens
ttctgaattctctggcagacacctccctgagtacaggatctcgaggcagctatctttagagacacagaa

SEQ ID NO: 6854555 - DNA, 80 bp, Homo sapiens
tttttaatatactgtatatttcacatcttggagcaaaattcaaattgccaggaaatagacactgtatgatatgttaaaga

SEQ ID NO: 6854556 - DNA, 83 bp, Homo sapiens
ttgcctggctctctgagatattgagtcttcaacctttagctgcctgtgagtgactgctcaaatgtcatggggagcctctgcaa

SEQ ID NO: 6854557 - DNA, 117 bp, Homo sapiens
gaatatgtacatgaacaaaatagcagaaagaagtacaggacaaaatctaggcatgttcagaataacatgcctagattttgtcctgtacttctttctgctattttgttcatgttattc

SEQ ID NO: 6854558 - DNA, 58 bp, Homo sapiens
taggcatgagctatttgtagacagaaggaaaaacagtgaactaaatggcttaggctta

SEQ ID NO: 6854559 - DNA, 69 bp, Homo sapiens
gcttagtctcatatgaagactcatttattgggtaattgttacccgacaatctgtctttatttagaaagc

SEQ ID NO: 6854560 - DNA, 75 bp, Homo sapiens
ttggccttgtctctcagaaccgctgaaacaactcttttatttgctttttcagtgtttgctgacacaagagtccag

SEQ ID NO: 6854561 - DNA, 67 bp, Homo sapiens
catgctattgtgcgaggcactgctttgagacttatgcaatactcggagtgaatcttcacaatgtatg

SEQ ID NO: 6854562 - DNA, 96 bp, Homo sapiens
tactgaggaagcagcagacgtcattatgtgcgtacatgtatctgtgtgttatatgtgcatgtatgtatgtacatatgtaatctaattccctcagta

SEQ ID NO: 6854563 - DNA, 57 bp, Homo sapiens
aggaagatgagggctgagatctaagtggattcccaagtggtgtcaggcctctctcct

SEQ ID NO: 6854564 - DNA, 65 bp, Homo sapiens
cctgaggtggctgcagcactgccctggcttccagaaagctctcgagcatgctgggtctcctcagg

SEQ ID NO: 6854565 - DNA, 64 bp, Homo sapiens
gtagtttatgctgctgcagtgagaccctattataacaggttaacactacagtagtatagaatat

SEQ ID NO: 6854566 - DNA, 74 bp, Homo sapiens
aggcaaacaaatgggtgtggctgcgtgccaataaaactttatttacaacaccaggcagtatcctgaatttgtct

SEQ ID NO: 6854567 - DNA, 64 bp, Homo sapiens
agtcttcaatacttgactgtgctcattccttgttagaggagttatacactaagtatgaagtgct

SEQ ID NO: 6854568 - DNA, 65 bp, Homo sapiens
atatcagaaatagtaagcagagctcacggaatttgtgatttaatgcaatgctgtagtcttgatat

SEQ ID NO: 6854569 - DNA, 112 bp, Homo sapiens
atgtgtgagtacatttataaatagctttgacgtggtttcagttttctgttttgacaacatagaaacagattgaaattcgtagtattttctccttcctgctcccattccacat

SEQ ID NO: 6854570 - DNA, 68 bp, Homo sapiens
ggcagtttacagatgactgagaagttctttcctgatgcttagtaaatacctaagtcatttgaaatgcc

SEQ ID NO: 6854571 - DNA, 68 bp, Homo sapiens
tttgaacccaggaggcagaggttacagtgagccgagattgcaccactgcacttcagccccatctcaaa

SEQ ID NO: 6854572 - DNA, 110 bp, Homo sapiens
gcttattagtaaatccaccagaatgtttcatttggcatttttttgtaaacatctagatttgttcataaagaaatcagaaaagcattcgtcctttggggagtattaattgt

SEQ ID NO: 6854573 - DNA, 60 bp, Homo sapiens
gtgaggcattcttttgctgcatgtccaacattcttgatggcacagaggaccatgctttgc

SEQ ID NO: 6854574 - DNA, 58 bp, Homo sapiens
cattagggactgaggaataaggtatagaccttacattcaaggaactcattctctaatg

SEQ ID NO: 6854575 - DNA, 76 bp, Homo sapiens
ggaagcccagtttgttctcccgattcagtcccaagcatcccaaaggacttcaacttctggggagcaaagggcctcc

SEQ ID NO: 6854576 - DNA, 74 bp, Homo sapiens
gtgcacgtgaatgtgagtgtgcatgcgtgcgtatttctgtatgcatacacatgtgcacatacgcatacgtgtac

SEQ ID NO: 6854577 - DNA, 61 bp, Homo sapiens
agacaaattaatactgtgcttcattttcctggaagaaggaggacaaatatggtattggtct

SEQ ID NO: 6854578 - DNA, 63 bp, Homo sapiens
ccttctcaagctactaccttggatctgggacttactattgatcatggtcctagattgattagg

SEQ ID NO: 6854579 - DNA, 89 bp, Homo sapiens
tctgtactaggcatcaaagcagtgcgctcatctaagggttctgtttgaatgacacctttaggtattactgcagccccccttagtacaga

SEQ ID NO: 6854580 - DNA, 90 bp, Homo sapiens
tcttgatgtattctataacctgctgcaagtgatgcttgttagttttattaattctaacaagtcattccatttgacagtaaaacattgaga

SEQ ID NO: 6854581 - DNA, 64 bp, Homo sapiens
atccaggagtcctgaaatctgatgacttttatcctcacaaggttatgttaggattcaatgagat

SEQ ID NO: 6854582 - DNA, 61 bp, Homo sapiens
gctgtgagtggagttctgtgctaaaatctgcaggtgaaacttcagtaattccagctccagt

SEQ ID NO: 6854583 - DNA, 88 bp, Homo sapiens
ttcagtgtggggccaatagcaggagaaatgagagacagaacctaaatgttatcatttatcatttgtgctgtaggcctagggttttgaa

SEQ ID NO: 6854584 - DNA, 83 bp, Homo sapiens
ttgaaattaaaagataacagtgttgaggtgcttgtttccatgcatttgagaaattttagctgagcctgtgcttttgattttga

SEQ ID NO: 6854585 - DNA, 86 bp, Homo sapiens
cttaattctgctctcaatttaggcattgaattagaatagcgacatacactattttatataatgaataggaaggggagagaattaag

SEQ ID NO: 6854586 - DNA, 86 bp, Homo sapiens
tcttcagtagagctaaggctcctttgtagttcttttgggaatcctcaaaccaccatgtgaagaagcttgggctagcctgttggaga

SEQ ID NO: 6854587 - DNA, 77 bp, Homo sapiens
gaaaacatttggtggagtcattggcatatggtaggcttccgtagatttcattgtcctttggctttgcaaatgttttc

SEQ ID NO: 6854588 - DNA, 65 bp, Homo sapiens
cccttcagaagcctgcagcctttgattgtggcctgacttttaggggtctgcggcattttgggggg

SEQ ID NO: 6854589 - DNA, 71 bp, Homo sapiens
gcccttgtggcaggctgagttggcctggtgagtcaccttatcttgtgccaagtcacttgaatctgcagggc

SEQ ID NO: 6854590 - DNA, 75 bp, Homo sapiens
tcagggtatttaatttctaagagtattcaaggttttgttgaagatctaaacagtgcttagaaatttttaccctgg

SEQ ID NO: 6854591 - DNA, 83 bp, Homo sapiens
agtggcttagaattaaaccatttgaattattactgaaacatttcaagtggtgacattaaatgctttgtttgaaattagccatt

SEQ ID NO: 6854592 - DNA, 63 bp, Homo sapiens
ggaatcatcatcggtccaagattgttagtgatctgagaaatttcatgtgctgaggatgatgcc

SEQ ID NO: 6854593 - DNA, 82 bp, Homo sapiens
tggacaggggctgccacagggtcagccactctgcatgggaactcctgtaagggggaccgtgtggcccacctccacctgctca

SEQ ID NO: 6854594 - DNA, 62 bp, Homo sapiens
gggcagaggtggaaaaacaaccagagaaaattccactctcaggctgttagccacctcctccc

SEQ ID NO: 6854595 - DNA, 66 bp, Homo sapiens
tggagagggcgcccaggcccacgccaggatcactcagcttgatgaaggggctggtgccctctgcca

SEQ ID NO: 6854596 - DNA, 64 bp, Homo sapiens
ggcattccttgttcctaggagatcaatgcgctccctggtatttctcctgctagaacaaggagcc

SEQ ID NO: 6854597 - DNA, 81 bp, Homo sapiens
ttattcacccattcatttcattcaacaaacttttatggaatgccagtgtatgtaaaggattgagatgaataaagtgagtga

SEQ ID NO: 6854598 - DNA, 82 bp, Homo sapiens
atatacttcccaaatgggttagttggtctgtttgtactcctattactaacttccagcatttgcttaatttggagaaaggtat

SEQ ID NO: 6854599 - DNA, 68 bp, Homo sapiens
gtacagcttaagtgggtggcagcatgtgcgagccatttctatacatctgatttacctactgaatgtgc

SEQ ID NO: 6854600 - DNA, 59 bp, Homo sapiens
cctaaatttttccctagtgaatattggtgcttggcagatgtgagctggggagagtgggg

SEQ ID NO: 6854601 - DNA, 60 bp, Homo sapiens
cctgtgttcccctgctgctgaggacatttgtgtcactgctgtatttagggggaacaaagg

SEQ ID NO: 6854602 - DNA, 61 bp, Homo sapiens
ccaatgtttgtgatctactgactcgtaagctccctatgaggaaaatggaacaaaatattgg

SEQ ID NO: 6854603 - DNA, 75 bp, Homo sapiens
gaggggaattaggtcattccctgagcagatgaatttgctatctgaattatctggggaacagacctgattttcttc

SEQ ID NO: 6854604 - DNA, 60 bp, Homo sapiens
gaaggtgttcataccatattaagtaaagagaacggactataagacagtatgaatactttc

SEQ ID NO: 6854605 - DNA, 63 bp, Homo sapiens
tccaagtttcttctgcacaacagtataaatataactaaggtggggtggagaaggagatttgga

SEQ ID NO: 6854606 - DNA, 75 bp, Homo sapiens
tctctggaatttcatcttgattctatatggcctgggtgctgcagcctcctacctggtctctagagttttcagagg

SEQ ID NO: 6854607 - DNA, 61 bp, Homo sapiens
ggtgccatctggggtggactttaagcaaagggtgacacttagcaggtggtgactcgaagcc

SEQ ID NO: 6854608 - DNA, 79 bp, Homo sapiens
ggcatgtcagagacctggaccagagtgggtgctggggtctggagcacctcagcccagctcaggtctttctgtccatccc

SEQ ID NO: 6854609 - DNA, 130 bp, Homo sapiens
aatcccctgagagctcagctcctcaccatggactggacctggaggatcctcttcttggtggcagcagctacaggtaggaggctccctagtcccagtgatgagaaagagattgagtccagtccagggagat

SEQ ID NO: 6854610 - DNA, 63 bp, Homo sapiens
cccagatgtcaactttaagatctactctgcctgacacagctgtggtcttcaagttgccttggg

SEQ ID NO: 6854611 - DNA, 58 bp, Homo sapiens
gacaccctgggagtggaagtcagtgcatgcactaccttaaattggcccccatggtgtc

SEQ ID NO: 6854612 - DNA, 120 bp, Homo sapiens
gctggtgtggtatcagaactcagatttcctctgtcttgttctaccattttttgtgtcttctatcgttcagatcacctgatggtgaacaagggttagtccagcttctgtcagcccatcagc

SEQ ID NO: 6854613 - DNA, 57 bp, Homo sapiens
ctgtgctggagatgggccagagggggctggttcctagggcccagtgaaccaggacgg

SEQ ID NO: 6854614 - DNA, 57 bp, Homo sapiens
ctgtatgagttgggaatagaatcaaaagatagtggtttctattcttaatttacatag

SEQ ID NO: 6854615 - DNA, 72 bp, Homo sapiens
cttttgttttctgattctcgtgtggtagtgtatttactcctttttggccagttgagccccagaaaaaagaag

SEQ ID NO: 6854616 - DNA, 93 bp, Homo sapiens
gatgtgcctcagaaatggatgagatgtttcacccaaattatatcagtcatgaccttgggagagtttacatccttttccctgaagaggagcatc

SEQ ID NO: 6854617 - DNA, 75 bp, Homo sapiens
ttgtgaatagtcagcattttgttagaatcagcccgttgtgttaagggcactataattggtactgattatgtacaa

SEQ ID NO: 6854618 - DNA, 60 bp, Homo sapiens
gacttttcttgcaggctccaggtggcagtgagtcagccataaagctcgttcaggaaagtc

SEQ ID NO: 6854619 - DNA, 61 bp, Homo sapiens
cgggcagtattctcaaatcttagtggcatgaacatgcttaaggaattggagagtctggctg

SEQ ID NO: 6854620 - DNA, 87 bp, Homo sapiens
atggtttcaattcctgatgatgcaaagaagttatttggacttttgagtaaaaatgtgtatgatacctttgctgaggaatgtagctat

SEQ ID NO: 6854621 - DNA, 93 bp, Homo sapiens
catatctgataagaaattccctgcagcagcacttaggacttagcttgaaagctgcccagtggaattataatctgtccaaactctgagaatgtg

SEQ ID NO: 6854622 - DNA, 130 bp, Homo sapiens
actttggaaccacctggagatgttttaaaaatctctgtgctcaggctgaaccccaggccaattaagtcagaaactttgagggtgggccctgggcatctgtgcttttaaaagctccccagatgattccaat

SEQ ID NO: 6854623 - DNA, 67 bp, Homo sapiens
gactgtactcttctagccatctgaaatacgttttctaggtagagatagattgtgtaagggtacagtt

SEQ ID NO: 6854624 - DNA, 76 bp, Homo sapiens
agggagtaattggaggcttttgaataggagagtgatgtgatcagaacacttgaatgaaagagactcctttgtccct

SEQ ID NO: 6854625 - DNA, 76 bp, Homo sapiens
gcttcagctgacgtcaaaacacctggctctgggctggaatgaattacccaagaatttggttggctttagctgaagt

SEQ ID NO: 6854626 - DNA, 72 bp, Homo sapiens
gccatggcttctttctctgccagaccacgtagcactggctggttctgtatttgagaatgtagaggtcaaggc

SEQ ID NO: 6854627 - DNA, 83 bp, Homo sapiens
tcttaacccctacaaaggactgaaactggctgtcagctctggggcttgccacagtcatagcagcctttgttaacaagttaaga

SEQ ID NO: 6854628 - DNA, 56 bp, Homo sapiens
ctgagattctgtgaaacggacatttgttaaagcaagtgtcaattctcaaatctcgg

SEQ ID NO: 6854629 - DNA, 55 bp, Homo sapiens
tctgagggatcagcttggatacagagctctcctgggatcagctgaagccttcaga

SEQ ID NO: 6854630 - DNA, 68 bp, Homo sapiens
gggtttttgctgcccaggagcctacagtcagtactgcatgtagcacactcaggggtagcaatgtgccc

SEQ ID NO: 6854631 - DNA, 82 bp, Homo sapiens
agctttgttctgaatattgggagctgagatctattttgctacatatcttgtaaaattatccccaatttcaggacatagagct

SEQ ID NO: 6854632 - DNA, 57 bp, Homo sapiens
gcccctcctgcagcacctttcttaggttgattcagggagggaagctgtgggaggagt

SEQ ID NO: 6854633 - DNA, 85 bp, Homo sapiens
gtgaacacagagtctcttttggttccaaaaataataaaaaataccattattatttttagaaccaaaagagattctgtgtgttcac

SEQ ID NO: 6854634 - DNA, 76 bp, Homo sapiens
acacaaatctagtggtctaacttcatttaaccaggaaagaatcagcctggagatgtaaagcaaggcttaagagtgt

SEQ ID NO: 6854635 - DNA, 80 bp, Homo sapiens
attctgtttcctgttggtcctggtctaggcagagtgtacttcactttcaagccctctagagacaggacaggtaacttaat

SEQ ID NO: 6854636 - DNA, 59 bp, Homo sapiens
gccagttcctgtggagtcagagagatcttagctcagaagtgctgacagcaggggctggc

SEQ ID NO: 6854637 - DNA, 58 bp, Homo sapiens
taactttgagaactttctggtgtattttgaatgtatccaggactttcctccaaagtta

SEQ ID NO: 6854638 - DNA, 62 bp, Homo sapiens
cctgagtttctggctccttttttacaatgtgggtgcagagcaaggagcctaggaggctcagg

SEQ ID NO: 6854639 - DNA, 77 bp, Homo sapiens
gagtggtggggtgggcagcaccagggaagtgtatctaacacagcagcactgtcccttgctgtcactccttatggctt

SEQ ID NO: 6854640 - DNA, 59 bp, Homo sapiens
gaccatggagagggtattggctgccttgaccagaaatttaccaggacctttccagggtc

SEQ ID NO: 6854641 - DNA, 81 bp, Homo sapiens
tgaacaccttactgtgcaccaagtggtatatctccatggtttcccaggtaggttataaaatggtgtacaatattttcttca

SEQ ID NO: 6854642 - DNA, 125 bp, Homo sapiens
caggcatctgcttgtgagtgccagagggtgtgggtctgttttctagggctgaggtgagtagggctgctttccagagctgagaaggcttggccaccacctgggtgggctcagaggacagaacactg

SEQ ID NO: 6854643 - DNA, 75 bp, Homo sapiens
tttatagggttaatcaggttacaatgaaaccattaaggtagaccttaattacaatgtgactgatgtctttataaa

SEQ ID NO: 6854644 - DNA, 108 bp, Homo sapiens
ggtctataatgttgtttggttaacacagagttttaaatgtggattgattgtcagcggttgtttgtcgtttttaaaaatctggttaacaaccttgtggctttagttatc

SEQ ID NO: 6854645 - DNA, 61 bp, Homo sapiens
gggacagtaggtatggtctgatggatttgaaacctgtgtcagtaccacagctgcatgacct

SEQ ID NO: 6854646 - DNA, 63 bp, Homo sapiens
agcctgtattgctatatagtaggacttgggaagcaagtccatcagataagcaagacagcagct

SEQ ID NO: 6854647 - DNA, 76 bp, Homo sapiens
atctgtaaattgtatttgtacaagacatgtgattgccaagagctttctccacagtctttgcagaagcaatataaat

SEQ ID NO: 6854648 - DNA, 88 bp, Homo sapiens
ctgcctcggctcgccgcttccagagtaaggcgctgcccacctggtagctgtgttcattctggatgtaggctccggcgggtgggggcag

SEQ ID NO: 6854649 - DNA, 101 bp, Homo sapiens
aaagaggcagtcctgggagttttaatgagctgctgtggatactctttaatatttgaaagagaccagaaggaagattaaaaactcctgggctctgcttcttt

SEQ ID NO: 6854650 - DNA, 55 bp, Homo sapiens
atttttgtatccccagctcctggcacagggtctgctagagagaggatattaaagt

SEQ ID NO: 6854651 - DNA, 67 bp, Homo sapiens
gctttaaggtgatgagagatgcttctggatggtcctgggagcctgtgtccttctcacattcaggagt

SEQ ID NO: 6854652 - DNA, 87 bp, Homo sapiens
ctggaggggcgcaggtcaggctgtagggcccctggagctggctccctggcttgagagaaagggccacagtcaccttcgcctgcccag

SEQ ID NO: 6854653 - DNA, 63 bp, Homo sapiens
gaagccatagccaggacactggacccagtttggtggtgcctgtctgtcctgctcgtgaaattc

SEQ ID NO: 6854654 - DNA, 68 bp, Homo sapiens
ttctggaaaaacttccaacccagaagcctaaatacagtttggatgcttaggttggtgagacttcagag

SEQ ID NO: 6854655 - DNA, 86 bp, Homo sapiens
atctgggaagccccagctctgccaagcgtcagctccgagccctcgccagtctctgaagctgccagcgcagggctggggacccagat

SEQ ID NO: 6854656 - DNA, 70 bp, Homo sapiens
cattgctgaatcagataataagcaagcatttatctgtgctgtgatttattgggattctattgtggcaatg

SEQ ID NO: 6854657 - DNA, 95 bp, Homo sapiens
ggctttggctttctccatgtttttgctggtgacctcgtgcagagcacagcagatggctgcatggactcatcagacaagatactggggccattgcc

SEQ ID NO: 6854658 - DNA, 57 bp, Homo sapiens
ggggatactgtaggcctgaatctgcctcgtccttgaattaggttggacagtatcccc

SEQ ID NO: 6854659 - DNA, 71 bp, Homo sapiens
ctccttatcacactgcattttgatagtgcctttaatggtggtggcaagttaaagaatagatgggtagggag

SEQ ID NO: 6854660 - DNA, 69 bp, Homo sapiens
ttccaacctttcatttcacttggtagctgtttccttttagctgcagtatgaggctggtggggaccggaa

SEQ ID NO: 6854661 - DNA, 62 bp, Homo sapiens
tagttcacccctctttattttcccaataaggaaattaagacccagagaggttggctgaattg

SEQ ID NO: 6854662 - DNA, 60 bp, Homo sapiens
tcattatgatggtaattttctctaccaaaaatggggagagaatgatatattatttcttga

SEQ ID NO: 6854663 - DNA, 78 bp, Homo sapiens
cctggccgggcaaggtggctcatgcctgtaatcccagcacttcgagaggccgaggcgggcagatcacctgaggtcagg

SEQ ID NO: 6854664 - DNA, 116 bp, Homo sapiens
catactgcactctgtatcaattatttggctgtctgcagcacatagattagaataaagggcttgcttagtgtttgtgaatgttgcggattgctgattagtaattaaagtgctgaatg

SEQ ID NO: 6854665 - DNA, 86 bp, Homo sapiens
gcatggaaggcttaaataataatttctgtaactttcattatttaaacaaatgtaacagtagttaccattgattaagcatcacatgc

SEQ ID NO: 6854666 - DNA, 67 bp, Homo sapiens
ttctctaatactctgtgaactctatcagatacactgaaatgaggtgctggtagctgcggatggagag

SEQ ID NO: 6854667 - DNA, 83 bp, Homo sapiens
ggctggggctgcggggttgggactgtcatctggaggctcagaaacgctgccctccattgtctgggaccccagcagccccagcc

SEQ ID NO: 6854668 - DNA, 87 bp, Homo sapiens
gccttttccacattcactacatatataaggtttttctcctgtatgagttttctgatgtgtagtgagactgaactttgtagagaaggc

SEQ ID NO: 6854669 - DNA, 114 bp, Homo sapiens
atctgtgcacatccttcctgtctgcaagtatctaccattctctgttttcaagaccagaaacaagggaaagattggttagaccatttgctatgggtgtgtagtgaagacacagat

SEQ ID NO: 6854670 - DNA, 57 bp, Homo sapiens
tcctggcccggccgggcctgctcacaaaccgaaacgcaggcggctgcggcgccggga

SEQ ID NO: 6854671 - DNA, 81 bp, Homo sapiens
tgttctttatttcgaaagtgctcagcaggtgcaaagaatagatattcagtaaccatttgttgggacaatgaaaagagaata

SEQ ID NO: 6854672 - DNA, 68 bp, Homo sapiens
ggttacagtggagcgtgttacctttgctagtcaagcatggctgagtaatgctgctccagattttggcc

SEQ ID NO: 6854673 - DNA, 57 bp, Homo sapiens
gaaagatgtcagcttagcttttaggatgaattcttgatgtataagttgatatgtatc

SEQ ID NO: 6854674 - DNA, 59 bp, Homo sapiens
ttctagaagaactagccaggaaggtgggagggtgacatgatccaggtggtgttctagaa

SEQ ID NO: 6854675 - DNA, 73 bp, Homo sapiens
gacatagaacttcccagtgagcagggtcagctggtgctgtgcctaattaacatgcagcagaagtctctgtgtc

SEQ ID NO: 6854676 - DNA, 73 bp, Homo sapiens
ggggaaatgtcgtcttccctgcccaaggctgtgttgtgacggcggcatgtctgggcaagggagatggcgcctc

SEQ ID NO: 6854677 - DNA, 81 bp, Homo sapiens
gtcccagtggctaaggtcgatagaggcttgcagtggtgctgataacaaccaggtctcctatctgcctcagaaaactggggc

SEQ ID NO: 6854678 - DNA, 75 bp, Homo sapiens
ttggaatgagatgccctctgaagttagattcctactgtcccagagaaactgaaacatagggccactacatttcaa

SEQ ID NO: 6854679 - DNA, 89 bp, Homo sapiens
tataactcttctatagaaatggctctgttggcccaagacctcggatgccagttttcagccaggagcacatttttgcagggagggttata

SEQ ID NO: 6854680 - DNA, 65 bp, Homo sapiens
cgcccttctgtgcttcacagttgccaccaaagcaagttcatggtttctcagcatggaatgtggcg

SEQ ID NO: 6854681 - DNA, 62 bp, Homo sapiens
tttcctcttcttcccatgtcattttgtcttccggtaagttagggatgaggtggaggagggaa

SEQ ID NO: 6854682 - DNA, 69 bp, Homo sapiens
atgccttttgtccttcctccctcctcctgcctggaacatggatgtgagaccaggaagtacagcagccat

SEQ ID NO: 6854683 - DNA, 87 bp, Homo sapiens
gcgtagatgtcttcagtcttccctccagtgcaactgaaggtaaactcgtctttggggccctggtggaagggctgtatgtcatttggc

SEQ ID NO: 6854684 - DNA, 72 bp, Homo sapiens
caggatggtagccccacactcaccagtgactcttgtcattgtggtaaggatgtggctgatcatatcatcctg

SEQ ID NO: 6854685 - DNA, 58 bp, Homo sapiens
tagaactgctctcatacttgctgtatgttgtggatcagcaagtatagtcagccttcta

SEQ ID NO: 6854686 - DNA, 69 bp, Homo sapiens
ggactcttataaagatgtctctgttgcggggggtctcttacctggaatgggataggtcttcaggaattc

SEQ ID NO: 6854687 - DNA, 57 bp, Homo sapiens
gagaatcatcaagcaagcacatttgaaaaaatggctgatgtttctgatgacattctt

SEQ ID NO: 6854688 - DNA, 56 bp, Homo sapiens
gtttgcaccccttgattgagccttcttatggaaagtgaggcccagagaggtgaagc

SEQ ID NO: 6854689 - DNA, 90 bp, Homo sapiens
tttgcctcttttcctccctttctgccttctaaaataagcaggcacaagctcctttgataaggtagaaatggtttggaaggaacaggtgga

SEQ ID NO: 6854690 - DNA, 63 bp, Homo sapiens
gagattgagagtgtatagctgatctcactcctttgagctgatgatagaaactcttgtagtctc

SEQ ID NO: 6854691 - DNA, 82 bp, Homo sapiens
tgtcctgaggcctggctgggcccccacctgcctccggggtctccaagagaagacagtatggggcccagcggtgaccaggaca

SEQ ID NO: 6854692 - DNA, 68 bp, Homo sapiens
ggagggtgacgccagctgtgctggcctcgaagacgtgctcgaattccccagcatagcggctcacatcc

SEQ ID NO: 6854693 - DNA, 63 bp, Homo sapiens
gaaagcaagagttggagtgatgttagccagatggcagaataggaagcaccaaattctcctttc

SEQ ID NO: 6854694 - DNA, 64 bp, Homo sapiens
tgaaagagaggtcagatttctcctggtgatgaaagagtcaccgctggggactaacctcctttca

SEQ ID NO: 6854695 - DNA, 80 bp, Homo sapiens
tgatactgctgtaggagccacaacaggaaggctgcaagtatccagcttcatgccagccctgtgtggtaacagcaccatta

SEQ ID NO: 6854696 - DNA, 67 bp, Homo sapiens
gtgtaagcattgaaagagataaagcctttttttaaaagaggtgttaaagtctcttttaatcttatat

SEQ ID NO: 6854697 - DNA, 68 bp, Homo sapiens
gctgtcagtggaaggattgctgggcctattgcaaattgcagattataaaaatctttccacaatgaggc

SEQ ID NO: 6854698 - DNA, 58 bp, Homo sapiens
atcagtgtaccttatggatttttttaatcctctttaatcgatccctcagtatgctggt

SEQ ID NO: 6854699 - DNA, 71 bp, Homo sapiens
gctgatttgacaggaggcagagctcaggtggtaatgctcacttgccctccgctcacctcctgctctgcagc

SEQ ID NO: 6854700 - DNA, 78 bp, Homo sapiens
accagacagctatcaacaactttctccaaaatcagagaaaactggaaataaaggagagagtgtttttgtttgtttggt

SEQ ID NO: 6854701 - DNA, 66 bp, Homo sapiens
tgctcaggtgccttggctgctgtgttcaaagctagcctggacaaggacagctcctgcacttgagta

SEQ ID NO: 6854702 - DNA, 81 bp, Homo sapiens
tatgtctggattctaattctgtatttggtcattggatatagcatctgtgacataaaaacagcaatcagaagtacaggcata

SEQ ID NO: 6854703 - DNA, 59 bp, Homo sapiens
cttttctcctatgccaagatatgagcaaaactctctgcttggctgtctataggaaagag

SEQ ID NO: 6854704 - DNA, 56 bp, Homo sapiens
tccagatcctcagtgtttcgcttttccccatggaatggcaccaggctaggattgga

SEQ ID NO: 6854705 - DNA, 62 bp, Homo sapiens
ccagctggtttatattccccaccctttcttcatggggcatgggaggattcagaactatttgg

SEQ ID NO: 6854706 - DNA, 66 bp, Homo sapiens
tgttgacttgaaccaaagtgttgtgaaactggccaagttgtaaacattttaaaggtcaagtccaca

SEQ ID NO: 6854707 - DNA, 59 bp, Homo sapiens
gtgatagttcttactccaaagtgccatttcttagtgatccttgagttcagagctgtcat

SEQ ID NO: 6854708 - DNA, 69 bp, Homo sapiens
cggaccttaggatttaggctttaacatctccacatcatgagattcgaaacctttaggtcttttcttccg

SEQ ID NO: 6854709 - DNA, 80 bp, Homo sapiens
cttcctcagtccctcgcaccctgccattcccctctgcagcctgcactgacagcatgggggtgccgagggccctgggggag

SEQ ID NO: 6854710 - DNA, 129 bp, Homo sapiens
tgggatgacccagatcatgtttgagaccttctacaccccagccatgtaggtggccattcaggctgtgctttccctgtaagcctctggctgtaccactggcaccgtgatggactctggcagggtcaccca

SEQ ID NO: 6854711 - DNA, 79 bp, Homo sapiens
tcttaggctcggcttagcagttaatctgagccaagattgtctaaaataatcttagataaactgctccccttccctgaga

SEQ ID NO: 6854712 - DNA, 94 bp, Homo sapiens
ctggtcactgtgggacctaagtgtggggtctcagagctgagagggaatgaacccttgtctagcactccagctccacagttgggcacagagccag

SEQ ID NO: 6854713 - DNA, 87 bp, Homo sapiens
ggagggtcctagctctctccctcatgaaacagtgagagcaacttgtttcaaactgggagtgaggggacttagatctgggatcccttc

SEQ ID NO: 6854714 - DNA, 81 bp, Homo sapiens
ggccccaaaatgattgtcaaagttctgttcacttaaattcactgtaattagtaagaatagttatcatttattttgggtgcc

SEQ ID NO: 6854715 - DNA, 71 bp, Homo sapiens
cactagcaggctgtgtgtacatacaaacatacatatgtgtatgtatgtataacacccagctactgacagtg

SEQ ID NO: 6854716 - DNA, 57 bp, Homo sapiens
tctgtgtctgcagaagttcagcggtgaaggctacaccaggaaatctcaagagacaga

SEQ ID NO: 6854717 - DNA, 61 bp, Homo sapiens
cttcattctgccatctgcagaaggggaacgatcatgtctccattagtgggtggcagtgagg

SEQ ID NO: 6854718 - DNA, 113 bp, Homo sapiens
ccgcttgttcctggggagaggggcagctctgggagaggctaggggagaagcccccgtttccctgctcaccccacatcaggcttctccagaaaagtcccaaccagagcaggtgg

SEQ ID NO: 6854719 - DNA, 56 bp, Homo sapiens
agctgcgattgggcgggcgcggcgatccctttgaagtgtggctgccgatcgcggct

SEQ ID NO: 6854720 - DNA, 89 bp, Homo sapiens
ctactcattcatctactttgcacagaaggatatgtcatctaatatatggataaacatgaagttctgtgtactggataatggctgagaag

SEQ ID NO: 6854721 - DNA, 58 bp, Homo sapiens
ttcacagatttccctgcacatgggaatggccaatgagctagaaatggaaatctttgag

SEQ ID NO: 6854722 - DNA, 96 bp, Homo sapiens
tcataaaagttaaaatgccataagagtgtgttccccaagaaagaaataattttcttttcattgagaacacactggaggacataatatacttcttga

SEQ ID NO: 6854723 - DNA, 55 bp, Homo sapiens
caggctgctgacaggcttggagaggagtgaggactgggagtcgtcggagagtctg

SEQ ID NO: 6854724 - DNA, 60 bp, Homo sapiens
tcctccatggaatgcctttgcctattaaggtttagacgaggcacttcatgggttcaagga

SEQ ID NO: 6854725 - DNA, 58 bp, Homo sapiens
gttcctggatcatcccaagccctttcccacctcagggcctttggatatattcagggat

SEQ ID NO: 6854726 - DNA, 77 bp, Homo sapiens
agagatgtttctagagctttgtcccatgttaaaacacaaaattatttgctctgggagaatatatttaaaacttctct

SEQ ID NO: 6854727 - DNA, 55 bp, Homo sapiens
catagtggcaatgaccctgatagagtggcaacagtccagccctcttaccactgtg

SEQ ID NO: 6854728 - DNA, 63 bp, Homo sapiens
gactgtttaatactgtgagttctagtcagaattttctgggtttcacaaaaatgctgaacagtt

SEQ ID NO: 6854729 - DNA, 73 bp, Homo sapiens
taccgaagtgtgctcagttgagtgtttatacagtcatagtttaaactgatatacactccactgatacagggta

SEQ ID NO: 6854730 - DNA, 55 bp, Homo sapiens
ctggaagggcctgggaagagtcgtgcttctaattctgaacaagggcaccttccag

SEQ ID NO: 6854731 - DNA, 69 bp, Homo sapiens
ccgagtcccagagaggccaaggtcgtggtccaagttcacaaggctagaacccgagtctcctgacaccgg

SEQ ID NO: 6854732 - DNA, 105 bp, Homo sapiens
gggacaggaatggatgagcatacagggacttgcctcaactgacccttagggcttcctgagcacaggagccaggtccttcacatgcatttctcagctaattctccc

SEQ ID NO: 6854733 - DNA, 76 bp, Homo sapiens
agataaaatggttcaaaggctattttcaccacctactagacaaggtggttattaacggcctttgttccttttgtct

SEQ ID NO: 6854734 - DNA, 72 bp, Homo sapiens
ccatgttggggctgctggagggcgcagacaggctgtaaacacagcgcatgggcaccaggagcaccggacagg

SEQ ID NO: 6854735 - DNA, 82 bp, Homo sapiens
ggagaaggagaggctggtgggaaaccctcctgatgacttcatataaaaacaagagcttctcaacagttatctctttttctcc

SEQ ID NO: 6854736 - DNA, 68 bp, Homo sapiens
gaaatattgtttctggctgtggcagctttcatctctgaatgttccttagcagccagagataattggtc

SEQ ID NO: 6854737 - DNA, 64 bp, Homo sapiens
agaaactacttggaggaaagataacagggatgtaatcttggagtttttcctcgtaagaggatct

SEQ ID NO: 6854738 - DNA, 76 bp, Homo sapiens
cactcaatcctgtgtcaattcctcattctctttcccccaagaaaagagaaatgacaagactgatcaggagaaggtg

SEQ ID NO: 6854739 - DNA, 77 bp, Homo sapiens
aattttggcaggattaaatttgaactgggcataggttgtatatgcagaaaactaaacatgatgcctgtactaagatt

SEQ ID NO: 6854740 - DNA, 100 bp, Homo sapiens
accttgcaaagttattccttgggaattattgaatgtctctttgccagaaccgtaggctaaagcaaccattccataacaatcaacgagggggcagctaggt

SEQ ID NO: 6854741 - DNA, 76 bp, Homo sapiens
ggtcagtctggattagttgggggcaattacattaggagaaaaatcatgttttatccccaagtagttgagattattc

SEQ ID NO: 6854742 - DNA, 55 bp, Homo sapiens
ccaggctctgtctggtcagaagtcacacatcctctccttgctcaacaaagcctgg

SEQ ID NO: 6854743 - DNA, 75 bp, Homo sapiens
ccttgtgtatgtgagtacctgtcatgtgcccacgtatcctggtggcacaaaaggtacttcatgtagattgtcagg

SEQ ID NO: 6854744 - DNA, 67 bp, Homo sapiens
caagattctggccaattcggttcctgatgaagaaccccttcatggcttgcagatggccaccttcttg

SEQ ID NO: 6854745 - DNA, 69 bp, Homo sapiens
gggttaagtcaagagaagtgctccacagtagtttactgcttgagggatatttttcttggacatttgctc

SEQ ID NO: 6854746 - DNA, 72 bp, Homo sapiens
tcaactgcttctgtgctgtctcagataagcattgtaagcaatattgtctttcagatgcacagatcataatga

SEQ ID NO: 6854747 - DNA, 71 bp, Homo sapiens
ccattttacaaataaggacacttaggttattcaactttgcaaagttgtctagctagaatgtcataaagtgg

SEQ ID NO: 6854748 - DNA, 90 bp, Homo sapiens
tgacaaccataaatacttagttttgtgtctaattcagttaagtgttcttgtttgttcatggaccagaaaaaaagttttcgtgtgttttca

SEQ ID NO: 6854749 - DNA, 61 bp, Homo sapiens
ctgtgaatcatgacctctctggccataagagctcaaggcctttgaggtgaaatgtttatag

SEQ ID NO: 6854750 - DNA, 130 bp, Homo sapiens
tctagtcttctgggtgccaagtctgacttttctgggaatggttgatccacactggaaggtttccagatgtgttccccaggcattcctggtggtaggaagagtagaggcctgggtattctgtagatgctga

SEQ ID NO: 6854751 - DNA, 55 bp, Homo sapiens
acagtgatttctctccgttatttcagagaacactgaaataccagaaaatcagtgt

SEQ ID NO: 6854752 - DNA, 59 bp, Homo sapiens
tcatctctgcctatgctgtacctttgttaattctttaatagacatttggctagggatgg

SEQ ID NO: 6854753 - DNA, 66 bp, Homo sapiens
agtttatcgagatgaaacgcatgttttaggaaggtcgagttaaaatatgatcttcattttgtaact

SEQ ID NO: 6854754 - DNA, 58 bp, Homo sapiens
aatcttgagggactcatgaggtgacctatagaggcaaaaaacaggctccttccagatt

SEQ ID NO: 6854755 - DNA, 68 bp, Homo sapiens
tgattcggaggcaacattgagcttctgtattcagaaatctaatcagaatatttcatgtgccttactca

SEQ ID NO: 6854756 - DNA, 58 bp, Homo sapiens
tctctctttctcccactcttgctttgtattgaggcagaggtgttggtgaatggagaga

SEQ ID NO: 6854757 - DNA, 67 bp, Homo sapiens
ctctactccctgtacttgcctctcttgtagccctttcacatgggactgtaatctgcagtgagaagag

SEQ ID NO: 6854758 - DNA, 55 bp, Homo sapiens
ctgagagaaaaatgttccagctggtgtgggtggtaccagcacatgcttctctgag

SEQ ID NO: 6854759 - DNA, 84 bp, Homo sapiens
tcactcttttcagaacaaccatggttagatccagaaatccaggactgtgggccattgggttctgtatcaattttcaaaaggtga

SEQ ID NO: 6854760 - DNA, 70 bp, Homo sapiens
cttttattgctgagcagtgtttaattgtatggttgcactatataatgtttatccatttgccagctgaaag

SEQ ID NO: 6854761 - DNA, 77 bp, Homo sapiens
gagtggccattgtccctgaaagtttcttaatctaattagaaaatagatttgagaaaggagggaactttggagcattt

SEQ ID NO: 6854762 - DNA, 71 bp, Homo sapiens
gtgagcagtgtctacagtggctggagggttggtaagcaacaccttcacactttcacttggatattgctcat

SEQ ID NO: 6854763 - DNA, 108 bp, Homo sapiens
cagcagtgtgaaagccaggggacatatgggcagggaggaagttcagtgggagggcatttatgcaaacattcgcttgtctctgctcctgggcgtcttaaatattgtctg

SEQ ID NO: 6854764 - DNA, 63 bp, Homo sapiens
ggctgttattttcctctgaactctaattgttggtatcaaaaggattaaggggaaaaagcagct

SEQ ID NO: 6854765 - DNA, 71 bp, Homo sapiens
tattgtaaaggagttataagtgcatttgggtaaatacacttagtcaaagcttagataatttctttaagatg

SEQ ID NO: 6854766 - DNA, 71 bp, Homo sapiens
atgtcttgagccctggaccagaccgtgcctgaaatgctattgctgtactttggttataggagccaaaacat

SEQ ID NO: 6854767 - DNA, 85 bp, Homo sapiens
tcctcctatcttgaagttcatgttatagtgactttaatgaaatcatagaacactgtttcttcgtgaacaatgacgagggagagga

SEQ ID NO: 6854768 - DNA, 62 bp, Homo sapiens
ttacaataatgcagtgttttgtgatgagataggttaaattaaagaacactggtgtattgtga

SEQ ID NO: 6854769 - DNA, 76 bp, Homo sapiens
gagtatcagtggaagtgatacgtgtttatttccaggttaagacttggaaacactgcatgttcaccccaccattctc

SEQ ID NO: 6854770 - DNA, 56 bp, Homo sapiens
tcagggcaatgtccctcagaaggaaggtcacctactgaagaatgacagtgctttga

SEQ ID NO: 6854771 - DNA, 129 bp, Homo sapiens
gaaagatttcttttggaataaaagaaaatgcctggcaaagaaggtggtgattccaaggtgcttactatttttggccattttctgtcttgtttattcatagcttttttctccagcccatctctgtcttgc

SEQ ID NO: 6854772 - DNA, 60 bp, Homo sapiens
actctgggttctttcacttgacattatgattttagattcagtgatgttgaacctagcagt

SEQ ID NO: 6854773 - DNA, 109 bp, Homo sapiens
tctttcccctcaagtctgagatcagggtgccagagcaatcaggctctgggaagggccctcttccaggttgcagattcctgacttgttgtatcctctcacgggagaaaga

SEQ ID NO: 6854774 - DNA, 84 bp, Homo sapiens
actttctttgactaatttttcgtgaagtttacagggcaaaaattgtcaccccaaaagctggagagttaggtgaatacagaaagt

SEQ ID NO: 6854775 - DNA, 80 bp, Homo sapiens
ggttctggagaaagggtaggtccctcgcacatgcagggtgcagtggcatccactggtgaggacttaatggctccgggatc

SEQ ID NO: 6854776 - DNA, 95 bp, Homo sapiens
cagagaggaaacagggaaggagtgtgggagagacaaagctgtattcaccagatcccatatcttattccttattcctggaaaatgatacttctctg

SEQ ID NO: 6854777 - DNA, 80 bp, Homo sapiens
tagtttatgaaatattctttggtaagaagaaataaattccatgcctttttctttaccagtgaaatgttatatgaaagcta

SEQ ID NO: 6854778 - DNA, 70 bp, Homo sapiens
gtccttggtataacagatgacttacgctattcccagtacaacagcacttagcgtttctctttccaaggat

SEQ ID NO: 6854779 - DNA, 83 bp, Homo sapiens
actggggcttgcagtggtgatgcccgggccccacggcttcatgcagtcaccccgggacatctccagtgacgagagacctcagt

SEQ ID NO: 6854780 - DNA, 59 bp, Homo sapiens
gagtcacaaaagatgcccagggtcagtttctagtccttccttttgcatctgtgtgactt

SEQ ID NO: 6854781 - DNA, 80 bp, Homo sapiens
agaatgaagcttaggtctgtttataaaacagtcatcagatcatgtgcttccactgcttatagacagatcatgctcattct

SEQ ID NO: 6854782 - DNA, 57 bp, Homo sapiens
gggtgggttcattttacttggcccctggtattttcgtgggtcgctctgagcccatcc

SEQ ID NO: 6854783 - DNA, 123 bp, Homo sapiens
ggccatcgcagctggaaaggctggtttttagccacaggagccaagggccctgcagacgcccgctcccgggtgcctctccagaggtcccttgtctcttttggcaccctcctgctgtaagcagcc

SEQ ID NO: 6854784 - DNA, 61 bp, Homo sapiens
gctgcctgggctggcattcccacttggtgtgtgaagttgggcatgttgctggcctggcagt

SEQ ID NO: 6854785 - DNA, 55 bp, Homo sapiens
gaacttgaatgagaacttttgccaatctatgatttgagcatgtccattcacgttc

SEQ ID NO: 6854786 - DNA, 57 bp, Homo sapiens
gctgcccagtgtgctcatgcagttagaatgttcagagagtaggacactgggccaagc

SEQ ID NO: 6854787 - DNA, 89 bp, Homo sapiens
caggttccactcaatgccttataggctgaaaattgctctgtcttctcagagctagaaagggtgttcagataaggcagggtgggaccctg

SEQ ID NO: 6854788 - DNA, 90 bp, Homo sapiens
aggagatgcctggcctagggcttggtcatggcagggataaaagcccatcactgttatcttctacaaggcctgctggcctaggcaactcct

SEQ ID NO: 6854789 - DNA, 91 bp, Homo sapiens
acagtaaaatggccaagcaggatattctgtgtcaggatcagctggttcttccctggcattctggtgcttgcttcttccattaatgtattgt

SEQ ID NO: 6854790 - DNA, 70 bp, Homo sapiens
cccccccaggcaccccaggtgagcactgtcagctgccaagagcccagagctcccaaggggttggggtggg

SEQ ID NO: 6854791 - DNA, 127 bp, Homo sapiens
cctgtaagaactccacaggcaagccgaaagacctgctctacaggcaggaggtgcttccctggggttaatgcctccatgggacctacctcctgtgctggagggaaggaggctaaagccagggagattg

SEQ ID NO: 6854792 - DNA, 92 bp, Homo sapiens
gcggattactgtggtgccctaggctcagattctgctgagtcactgtgactgcggatttggaaggctgagagtcctggggagacatgctccgt

SEQ ID NO: 6854793 - DNA, 84 bp, Homo sapiens
gcctggctcagtgagctgtctgagtctcttggctttagggccaaggggcctttagacactatataggaaagcagtgggcttggc

SEQ ID NO: 6854794 - DNA, 57 bp, Homo sapiens
cgcaaggcacactggacggaacatagagtaagatgatccagtggtgtctagaatgtg

SEQ ID NO: 6854795 - DNA, 74 bp, Homo sapiens
gcaggggcctgatgggatcgggatctctccggcctcagggacggggaaggccggtccagtcaggtttcccctgc

SEQ ID NO: 6854796 - DNA, 62 bp, Homo sapiens
aagagcaggtccaccatgcctcaagccagctggcagctgcgcaggcccaggtggatgtactt

SEQ ID NO: 6854797 - DNA, 79 bp, Homo sapiens
gcaggaaaagcgtatgaatgcagggttctgggctagagaagtgacttcccttcttggggtcttgtgttgcctttcctgt

SEQ ID NO: 6854798 - DNA, 89 bp, Homo sapiens
acaataatacaatttcatcttgtgcttcaatgtttcatgtcctgggggcaagttaggttggtgctactggaaagaggttaaattattgt

SEQ ID NO: 6854799 - DNA, 58 bp, Homo sapiens
ccactccctaagctcttccctgggcgccttgttaacagctcagctctggggtcagtgg

SEQ ID NO: 6854800 - DNA, 65 bp, Homo sapiens
gagcagcgtgaggggctcccagcatcagacacaaacgtgatcttcagcagggcctctctgaggtc

SEQ ID NO: 6854801 - DNA, 55 bp, Homo sapiens
tgcactctgtgtcttaaagcacctcatgaaaatgtatgctgacactagatgtgca

SEQ ID NO: 6854802 - DNA, 69 bp, Homo sapiens
gttaattggcagttagtgacgaggctgcaggtctttgttacccagcctttcagctaactgatcattaac

SEQ ID NO: 6854803 - DNA, 75 bp, Homo sapiens
tccattgctctctccagaagacccatcctcatgctctgctcttccctgggcatgtgtctttatggagccacagga

SEQ ID NO: 6854804 - DNA, 87 bp, Homo sapiens
gcttttacctttgcctgggattgtgtaagtgaatatgaaataaggatttcaagaaagttcaggtgcacatgtcaagcatgggcaggc

SEQ ID NO: 6854805 - DNA, 122 bp, Homo sapiens
aaggtatatctggagttattttgaattctatggtcatctgtaattctgttcctttttcttctactaaaggaggatattagaatgcaggtgaataagagcaacttcactctaggaacatcctt

SEQ ID NO: 6854806 - DNA, 71 bp, Homo sapiens
gcatgggtcaatggctctagagggttgtgttgggcaacctgcagcttcagccagagggccagggacagtgc

SEQ ID NO: 6854807 - DNA, 59 bp, Homo sapiens
ctaatatcttggcatttctcacctggaattaggagacagttggaaactcctgatattag

SEQ ID NO: 6854808 - DNA, 64 bp, Homo sapiens
tgctattattgtcaccactgtatagatggtaggaaactgaggctagagaggtgacacagtggta

SEQ ID NO: 6854809 - DNA, 92 bp, Homo sapiens
gcatacttgaagtcttgagtcttattttctgtctactaaagttatgccaaatacttgtggagaacagtgagtgagtgaggagaatagtttgc

SEQ ID NO: 6854810 - DNA, 93 bp, Homo sapiens
atatcggtggatgggtggttatagagatcaactgaaagaaagaagtgaaacagatcgatttaaagtggatctcgtgatcactcttcggggtat

SEQ ID NO: 6854811 - DNA, 87 bp, Homo sapiens
gccaatgtccgtcattatcaatggaatctttcaatcaggaaaaatctcacgagtgtgaggaattggaagaccatgggtgacatctgc

SEQ ID NO: 6854812 - DNA, 67 bp, Homo sapiens
agggtggggcaggttggcacttccctctggctctccccggagcagggcttgccgcttgtcctcctct

SEQ ID NO: 6854813 - DNA, 100 bp, Homo sapiens
gctgaactttacacagcttttacatttccctctgtcagttcctcttgtaatggtgggtgggtagctgaagggaggatatgtacaataatgtatttttagt

SEQ ID NO: 6854814 - DNA, 55 bp, Homo sapiens
aattgatgtaaggaagacttagaaagacttaggtcttcctttattcacattaatt

SEQ ID NO: 6854815 - DNA, 67 bp, Homo sapiens
ctgttcatgctgattctgtatgtgatcttcgattaatttgacagttgcatataagttagcatagcag

SEQ ID NO: 6854816 - DNA, 73 bp, Homo sapiens
atgctacgtgatatttgtggtggatgaattactgaaaaacagaattcctcagcaaatcaagtgtctgatgcat

SEQ ID NO: 6854817 - DNA, 127 bp, Homo sapiens
ggaaagtgtagcttactaacggacagggaatgaagctgaggttctctttgaagcctcttctgtagctacttaaagcaacctcagccctcttcccataacatgaccaagctgagcacatcactgttcc

SEQ ID NO: 6854818 - DNA, 88 bp, Homo sapiens
ggagtctcactctgtcgcccaggctggagagcagtggcatgatctcagctcactgcaaccttcgcctctcgggttcaggtgattctcc

SEQ ID NO: 6854819 - DNA, 74 bp, Homo sapiens
agatccatcatcatattttctatatggcatatagtcaaatgcattatcactcctggaagatgtgtggtgggtct

SEQ ID NO: 6854820 - DNA, 106 bp, Homo sapiens
gttctcctggaaagcacaggttctctcagaggccagggtcctggaaccgtcttcccggggctgcccggcactctctgcaggtgctcctgtcaacaccaggtcaggc

SEQ ID NO: 6854821 - DNA, 93 bp, Homo sapiens
agggcagggcttcaagaatggggaaaacgtgttttcaattcaaattaaacaaggagtaacaggcaccgctcctcagtccagaggcctggccct

SEQ ID NO: 6854822 - DNA, 74 bp, Homo sapiens
cctgggcccaagccgcggctccagatgtggatttgtttccagtggggagaacgcgagcttcccccgggccttgg

SEQ ID NO: 6854823 - DNA, 61 bp, Homo sapiens
cctgctcccaggtgtggccgggccagcaggggcctgcctgccagacgcaccagggggccgg

SEQ ID NO: 6854824 - DNA, 74 bp, Homo sapiens
cagtgcttgtatatagcatgagtttgaccgaccctctttggattattccgctctagctgtttatacagccactg

SEQ ID NO: 6854825 - DNA, 76 bp, Homo sapiens
tcttttaataaaatcagtctgtgttagaaaagagttgggagaaaccttttcagagacagatgagtatcctaataga

SEQ ID NO: 6854826 - DNA, 123 bp, Homo sapiens
ctctgatgttgccatctctgtcagcaagccgaaccaaactgttcacacacggaggccacaggacactgaccattgcctgggcagggtgtgggggtcggcagggctgggcagaccggcaaaggg

SEQ ID NO: 6854827 - DNA, 56 bp, Homo sapiens
gttattagtaagactcgcacattgcccaaaccaatgtgtaggtttctttagtatac

SEQ ID NO: 6854828 - DNA, 74 bp, Homo sapiens
ttcctgagtacaatctttagtttcctgaaatagagtactgggtatttcatgctttgggttagaaacctttggaa

SEQ ID NO: 6854829 - DNA, 69 bp, Homo sapiens
taagactcatattcacactgtttagttacagaaaccctctacttgtggcagtttgaatttaaggtctta

SEQ ID NO: 6854830 - DNA, 60 bp, Homo sapiens
gtggaaaagctaggttttgaatctgagtttgtttttcttcaaagcttaagctctttccac

SEQ ID NO: 6854831 - DNA, 56 bp, Homo sapiens
agccctggtttgcagcatttgcccatttctgtggtgtaaatacttccaccatggct

SEQ ID NO: 6854832 - DNA, 94 bp, Homo sapiens
ggctacaaaggttattttcatttgttctatgtaacttgtcaataacaacaaggtacaaagttatacagcgtgggaatatataactagggtagtt

SEQ ID NO: 6854833 - DNA, 58 bp, Homo sapiens
ccaggcaaatccctctggcagattgtaagcatagtccctatgccagaaatttggttgg

SEQ ID NO: 6854834 - DNA, 79 bp, Homo sapiens
ctgattataacaacacattatgaagtcaatgacctgcttcttgaagagcatctgttgaatataatattgttatatttgg

SEQ ID NO: 6854835 - DNA, 105 bp, Homo sapiens
gatcttacttaattctcacgacacccctgtgggctacctatcaatctcctcattttgcaaatgaagaaacaggggcttggggaggtgaggtatctgagcaagatt

SEQ ID NO: 6854836 - DNA, 108 bp, Homo sapiens
gggctcccatccgggtacctgaggattttccacatagatcacaggtgttggggcccacatcggctcctgaaagactatgggaacgccataggcctggggcgggtgctc

SEQ ID NO: 6854837 - DNA, 65 bp, Homo sapiens
gctttagctcaggcttcttctataaagattgtctcatggtcttagatggcagctagagctccagc

SEQ ID NO: 6854838 - DNA, 86 bp, Homo sapiens
ggacattccagctatggtcataacatgattagtaggtggtaattcataacttggtacagctatgaagaaatagtatggaagagtct

SEQ ID NO: 6854839 - DNA, 111 bp, Homo sapiens
gaaatgaggcctcattcagtttcctaatttccaagattctttttcagcacccagctgaataaagtatgtcctgggaagagagaagaagaaagtcttaatgaggcccagctc

SEQ ID NO: 6854840 - DNA, 69 bp, Homo sapiens
ctcattttgcagccacatctgacctgacatgaacacattaggtggtagagcctggcttgcattgatggg

SEQ ID NO: 6854841 - DNA, 59 bp, Homo sapiens
ttgtttcccattacttagaggtactttattcatctgaagggcctaggaaagggaggcaa

SEQ ID NO: 6854842 - DNA, 130 bp, Homo sapiens
tgtttgttttaccatagaagctgagttcccattgccctagcttgtatcacatgcccatccctcaaccatacactagtgctgcagtggtgagctggtgtattattaatagtttcttatggctcccataaca

SEQ ID NO: 6854843 - DNA, 55 bp, Homo sapiens
gggaacacagacttgatgatgattcctggttccgagctcatgtcactgtgctccc

SEQ ID NO: 6854844 - DNA, 111 bp, Homo sapiens
ccagcaggcctggataaaatgtttctgttcatttgcctcggctctgagccaccagcctcagagtggaaggaaaaagagcagattctgggggtgttttgtctggcttgctgg

SEQ ID NO: 6854845 - DNA, 82 bp, Homo sapiens
cgatggcctttttgcaaggttttggaagattttcgtttcaacggactaaaaactactgccaatagcctctagacaggcctcg

SEQ ID NO: 6854846 - DNA, 67 bp, Homo sapiens
acagttagcctggcactgccccatccatgcagtccatgggcaggatgactttgcgtgccggaagtgt

SEQ ID NO: 6854847 - DNA, 63 bp, Homo sapiens
ctttagatggcttaggaggccccactggcacccttgcctccagccacactaagcatcttgaag

SEQ ID NO: 6854848 - DNA, 71 bp, Homo sapiens
gcattacatagtcaaggtgtctcatttctaacaaataccagaaattacacttgtaaatggcatgtatgtgt

SEQ ID NO: 6854849 - DNA, 68 bp, Homo sapiens
gtcctggttagtagcacagatgctgaatccagtcttcctgtgttcacatctcagcactgcctctggac

SEQ ID NO: 6854850 - DNA, 65 bp, Homo sapiens
ttggtcatttttcctgtgctcattaaaccattttaagcatttgggaacagtgtaaaagtggccaa

SEQ ID NO: 6854851 - DNA, 55 bp, Homo sapiens
gtcccttcttgagttagaacaggtgggtggacttgtacaagctcaccaagtggac

SEQ ID NO: 6854852 - DNA, 57 bp, Homo sapiens
aaggtgtggagtggtgcgactggcatttccattccagagtgcatcacttcaaacctt

SEQ ID NO: 6854853 - DNA, 69 bp, Homo sapiens
ggttgttttgtctttttttgtactgatctcagatgagaccactgatgagtaggcagacaaggccctgcc

SEQ ID NO: 6854854 - DNA, 63 bp, Homo sapiens
gccacagcaacaataatgcagccatattattaggtatcactactgttttgttctgctgtgagc

SEQ ID NO: 6854855 - DNA, 79 bp, Homo sapiens
acattcatttcctctgggctattttcatttatttggcaaagaatgccaaatagaaggtactcagagaaaaattagatgt

SEQ ID NO: 6854856 - DNA, 74 bp, Homo sapiens
ctgaatctccgtggggtttagggagacgaaaggaccccagatcgacgtcccctcgttcccactttggggatcgg

SEQ ID NO: 6854857 - DNA, 66 bp, Homo sapiens
gggtgaggaggacggtgcgacacttggggaaacaaactgcacaggtccagcctgccctctctcccc

SEQ ID NO: 6854858 - DNA, 60 bp, Homo sapiens
agccaatgccagagcccaagtatttccagttcagatgtgtttttattctggcatgtggtt

SEQ ID NO: 6854859 - DNA, 106 bp, Homo sapiens
gtgtgtgtgtgtgtgtgtatgtaagcaatggcttctgaagcacactttacaaaagtatgtgctttaaagaagccagctgaaggttttatgttcactgcatgctcat

SEQ ID NO: 6854860 - DNA, 83 bp, Homo sapiens
tgaacttttttaaagattatgaatttttgttagtgttttataaggtcacagataagaactcgtgatcatttgaaaatttgtca

SEQ ID NO: 6854861 - DNA, 77 bp, Homo sapiens
gtgatcttttaagttctgaagggttctgcagaaaagttacacttcttgagtttgggttgcccatcagagctggtcac

SEQ ID NO: 6854862 - DNA, 64 bp, Homo sapiens
ctagctttgcctgttaatcacaaaaggacaaacctttcacctgcttgtagatatgcgaagctgg

SEQ ID NO: 6854863 - DNA, 71 bp, Homo sapiens
ttataatttgttgtctttgacctgtaggaacccagttgtcttgattacagtgtctggatatcaaaggatga

SEQ ID NO: 6854864 - DNA, 59 bp, Homo sapiens
tgttggccaggctggtctcaagttcctgacttcaggtgatccaccagcctcggcctcca

SEQ ID NO: 6854865 - DNA, 79 bp, Homo sapiens
caggaatcagtacaaaggtgctctcaaggaacattcgatggtgtagtttgggattggccctatggattgtatcttcctg

SEQ ID NO: 6854866 - DNA, 94 bp, Homo sapiens
tctatctctgacatggatattatattactaattgacactgacacataaaacaccagagatgagtaatagctaatggttctcagatagagataga

SEQ ID NO: 6854867 - DNA, 111 bp, Homo sapiens
gggagtaaaccttttctgtcagggtgaggagaaagtgggtaaaggacttcagcatttacagttgagttagtatttgttgttctccaaatgtgcaggattcagggccctctc

SEQ ID NO: 6854868 - DNA, 66 bp, Homo sapiens
tgctcagctgcagcaggcaccatttactttgtagtctttgtgaaaggcgccccctagagctctgca

SEQ ID NO: 6854869 - DNA, 67 bp, Homo sapiens
cgaatagttattacttggaatttttcacacctagcagtggtgctgatgtttcaagtatagctttttg

SEQ ID NO: 6854870 - DNA, 72 bp, Homo sapiens
tggtgctcctgctgccttgtcccccaagtcaactgaggttgtccagggcccaaaaggcagcagtagcatcca

SEQ ID NO: 6854871 - DNA, 72 bp, Homo sapiens
ctcttatttgcaggtctccattttgatgagtttttctgatctgacaaagtaaaatggggactgtgaactgag

SEQ ID NO: 6854872 - DNA, 61 bp, Homo sapiens
caggagcttctgcccatggccaagaacagaccagcttggatcacgaaggactgagcacctg

SEQ ID NO: 6854873 - DNA, 65 bp, Homo sapiens
gcttacacagctaggaaatggaagaactagaatttgaatctaaattttctgtctccagctatagc

SEQ ID NO: 6854874 - DNA, 71 bp, Homo sapiens
ggggaggagagagctggctggactcaggaaaaaccccctttaattctctgaatgtcttttctcccttcctc

SEQ ID NO: 6854875 - DNA, 82 bp, Homo sapiens
gtgagcccaacggtttgatgctgcaaaggctgactgacaatgaaggtgggtgcacgtgcaagcacagatagaatgggctcat

SEQ ID NO: 6854876 - DNA, 71 bp, Homo sapiens
ggaagagagagacgagtggggtttggccttgtggggtcgcctaccacagccccccgctcagtttccaaacc

SEQ ID NO: 6854877 - DNA, 56 bp, Homo sapiens
agcatttgtgaattaagcatgtcaacattactgtgttgcttgttaggcacactgct

SEQ ID NO: 6854878 - DNA, 111 bp, Homo sapiens
ctcatttagcaaagaatagttctatatgcaatcttcctgctaggcctgtggcctggttcatggtggaatgacatgcatttggcaattttttttgactatgcttttagtgag

SEQ ID NO: 6854879 - DNA, 76 bp, Homo sapiens
tttgctcattgttaaaaaggtggaaatgcttcccatctttcattgtattctcaaaatttttgacaacttgatcaag

SEQ ID NO: 6854880 - DNA, 84 bp, Homo sapiens
tgtattaagttgtagtttctacaagggaagggatcttatctgtttaacttgatcagtagagcattcactgcagcataatgtgca

SEQ ID NO: 6854881 - DNA, 118 bp, Homo sapiens
taactaaagcattagtttctgaatttgtgcttctttatgatgtatgattatatatttgtgcttatacattttaataaagagtgtgttttgatgtaaacagtgctgatgtatttggtta

SEQ ID NO: 6854882 - DNA, 69 bp, Homo sapiens
ctccttgcaggcagggacactgtctcatttattttatagaccccgtgcccagtgcttggcatataggag

SEQ ID NO: 6854883 - DNA, 75 bp, Homo sapiens
tctggcatgtatctggctctcaacaaatatttattgaattagcaagtaaatgaatagagatcagattctgcttga

SEQ ID NO: 6854884 - DNA, 66 bp, Homo sapiens
ctcctacgcatggcaaatttataagtcgaggtagagttagagacacatgcacatgcatactaggag

SEQ ID NO: 6854885 - DNA, 76 bp, Homo sapiens
gggggaagcagatttctgagtcaatcaagtttgattttatttgaattatggaatttttagagaagtgttttatccc

SEQ ID NO: 6854886 - DNA, 129 bp, Homo sapiens
cctccttgcccctgtctgtctgacacctctgcctccagcttctcgcctgacagctcctttccgcctcagtggctgaagagctatgtccagggagcaggggttgcagaggagatggaagggccagtgggg

SEQ ID NO: 6854887 - DNA, 85 bp, Homo sapiens
gcagtgggaggaggccttgaggccaggagctgagtgagagccaggactctcagagacgctgggtttgggccttttccagacgggc

SEQ ID NO: 6854888 - DNA, 129 bp, Homo sapiens
gcattaaatggccacaaagttcccttccaatgttgaggttttgtgagatacgaggtttgcaaatgttcgctgtctgcatctctagagcttggctcaaagttggttcctaaatgttctgtgttcacgtgt

SEQ ID NO: 6854889 - DNA, 59 bp, Homo sapiens
gctccagcgcctcctggacctcctctgccactcgcagggagccctccaggccctgccgc

SEQ ID NO: 6854890 - DNA, 59 bp, Homo sapiens
gcctgctgccgagggtcttttggggcagtcccactgagtacccgatggctgcctgaggc

SEQ ID NO: 6854891 - DNA, 94 bp, Homo sapiens
ggatgcaggggcagggaagggcagggtctatgcaccaactgcctttgtgcagaaaacctttcctttcccccatatcaaaccctcaactgcattc

SEQ ID NO: 6854892 - DNA, 63 bp, Homo sapiens
ctgtctagtttctgcaaatctagtttctgcaaaaattagcagaataatagcagaaattagcag

SEQ ID NO: 6854893 - DNA, 93 bp, Homo sapiens
tcagtaagtttagagagatttttctgggattaatgatctgccagagcatcttcagcattctggaaagctattctctctgggtttgtttactga

SEQ ID NO: 6854894 - DNA, 90 bp, Homo sapiens
tacagccatctatgagccaaggagagaggcctcaggagaaactaatcttgctgacaccttgatcttggacttagagcctgaaggactgtg

SEQ ID NO: 6854895 - DNA, 66 bp, Homo sapiens
tgttaagtaccttattgattccaaagaattcatcagagagaaatggaataataaggtacattaaca

SEQ ID NO: 6854896 - DNA, 61 bp, Homo sapiens
agagctgtgttcatgaggagaaatattttaatatataatttattctcagatacataggtct

SEQ ID NO: 6854897 - DNA, 72 bp, Homo sapiens
tctcagagtttgaatctggagtttctgaaacctaaagtagttattaaactttccctggtctagactctgaga

SEQ ID NO: 6854898 - DNA, 62 bp, Homo sapiens
atcataaggaagcacctggagagctgtgttccttttcctgaggcttccctgttccttgtgat

SEQ ID NO: 6854899 - DNA, 55 bp, Homo sapiens
gcagcgctactcacagctctgaaatcgatccagagcattccacagtgagcgttgc

SEQ ID NO: 6854900 - DNA, 57 bp, Homo sapiens
agctgttatcttctaacttttcccctgaagggcctcgaagggcagagggaacagact

SEQ ID NO: 6854901 - DNA, 102 bp, Homo sapiens
ggagcccagcctggccccgtgctcttctgcagtggcccgcgtgcatgtgcatccgctcatcgccctggggtcctgcctttccgtgcatgggctgtgggcttt

SEQ ID NO: 6854902 - DNA, 63 bp, Homo sapiens
gctactggaagtgggagaaattagctctagttggatagattggggaaggttttactgactagc

SEQ ID NO: 6854903 - DNA, 57 bp, Homo sapiens
catttattcatttgctagggctagaggcttagcacagtccctggcacatggaaaatg

SEQ ID NO: 6854904 - DNA, 63 bp, Homo sapiens
ataacaaacatcagcgcatttacagtctcagctgcagggcggctggtgctctatgtctgttat

SEQ ID NO: 6854905 - DNA, 130 bp, Homo sapiens
agatttgtatttgtaaaaggtcatagtaactgctggatgaggaatggatgactcttaatgcaaatgcagagcagctaaaattctcatgcactgcaggtaggattatgaatataaagttgatacaaatgct

SEQ ID NO: 6854906 - DNA, 55 bp, Homo sapiens
gcctaagactgaggcttttgtctaacagtaagacacttaccactcagtctttggc

SEQ ID NO: 6854907 - DNA, 78 bp, Homo sapiens
taccccgcagggcgcctgctgtggccaccgaggtgttgcctggagcggggctgacagcaggtgtgctcctgtggagtg

SEQ ID NO: 6854908 - DNA, 73 bp, Homo sapiens
agtgacttttggtcctgagcaaaactatgtgtgatatgcacttcataagtgacagtttagggcaatggtcatt

SEQ ID NO: 6854909 - DNA, 84 bp, Homo sapiens
ttgtgcaaatgtgttttttcttctacatcgcccttgaagtaactctccatgtgtttctgtaaggaaaattcatgtcttgtagga

SEQ ID NO: 6854910 - DNA, 87 bp, Homo sapiens
gggactcatgtgacttcagctaccttgtttgtactgaccatcatcactaactacagaaatactacaaggccgaagctctcaagcccc

SEQ ID NO: 6854911 - DNA, 84 bp, Homo sapiens
ccaggtagaaaaagatgtgatcaaaagatttcattggttctgtttgctgtgtcttctttctggtctcgccttattctaccatgg

SEQ ID NO: 6854912 - DNA, 96 bp, Homo sapiens
gctcttcattctttcaatttgcagagataaattcctaagatttcaggggctggatacagtcttgagagttagagaaatatcttcaattagaagagt

SEQ ID NO: 6854913 - DNA, 63 bp, Homo sapiens
agattagcttgtgtacaaaggttgtacaaattgattgctgtgatttgtaggctgggctgatct

SEQ ID NO: 6854914 - DNA, 129 bp, Homo sapiens
gggtcattcacacaaaggtgactgggaggacaggcgccttcttcaggcctgttgccctggctgctgggccctcaggctgtcatggctataggcccaggggcagtcattcctctgctggcactttctccc

SEQ ID NO: 6854915 - DNA, 67 bp, Homo sapiens
tgaatgaatcatcctgaccactcagctacttggtgccttcaggagctgaattacggtgagtcattca

SEQ ID NO: 6854916 - DNA, 118 bp, Homo sapiens
tttcctttagtcttggaaattcagctctcaaaagattatttcctcgcaggcacctggcttacaatcaggatgagctgcctgtgggtgatgatttgattttctttgaaatatggggaaa

SEQ ID NO: 6854917 - DNA, 105 bp, Homo sapiens
aggtgatcggactcccacatgctggaattgtggcatcaggctggtagctgctgaccctgagcagctgggagcagagccacagcctggtgggaaagatgagtacct

SEQ ID NO: 6854918 - DNA, 67 bp, Homo sapiens
ttccctggtctatcctggttcaaacgtgtcagtgtgagacagacaggaataggacaggccatgggga

SEQ ID NO: 6854919 - DNA, 71 bp, Homo sapiens
tgtcccaagattctgagatacaaaatttacttttagagtcctaaaagtggggtatcttgaatagtcttaca

SEQ ID NO: 6854920 - DNA, 81 bp, Homo sapiens
ggtgccagaattcatactctatattgcttttgcaccattagtgcaaatgtcaacacaagagaaatgcaaattattggtatt

SEQ ID NO: 6854921 - DNA, 67 bp, Homo sapiens
gcatgatacaggtaataataacagaaaaacaaatctgtttttcagccatgaattacactgtgtctgt

SEQ ID NO: 6854922 - DNA, 62 bp, Homo sapiens
ttttcttggcacagatatttacagggaaagtaatgtctgagtgatcatttgtgtaaaggaga

SEQ ID NO: 6854923 - DNA, 62 bp, Homo sapiens
tagacacattccctgaagtgtaatagatttgaattgcacacaagttggagaatgaatgtcta

SEQ ID NO: 6854924 - DNA, 82 bp, Homo sapiens
atgctgattcctaggagttgaggagtgtgaggtctcccaggagcaactcagaggcttccttcctcggagctggaactggcat

SEQ ID NO: 6854925 - DNA, 69 bp, Homo sapiens
tgtactacatggttaagatggtaaattttatgctacgtatattttaccacaattttaaacaatggtgca

SEQ ID NO: 6854926 - DNA, 77 bp, Homo sapiens
gtccctccaaatttatgtttctattttggtcacaggcacactctttggactgctacaatatacaattaaagagggac

SEQ ID NO: 6854927 - DNA, 62 bp, Homo sapiens
tttctctcctgcagctctgacttgcttgtaattaaacgcaagtcagagctgcaggagagaaa

SEQ ID NO: 6854928 - DNA, 77 bp, Homo sapiens
cagaagcctggccagccagggctggggtggatgcacctttccctccctcccacccactcacctgcctggcctgcctg

SEQ ID NO: 6854929 - DNA, 82 bp, Homo sapiens
tcagttgagaaaagaacctagctcctcagtctcctttctaaaggtgtccgaatgttggagcaggatctcagattacagctga

SEQ ID NO: 6854930 - DNA, 76 bp, Homo sapiens
cgttgccatacgcagatgaggtgaaactttcttaaatgcccgtttaagtcacttaagtttgcatgtgttagtaatg

SEQ ID NO: 6854931 - DNA, 90 bp, Homo sapiens
ggccacacttctggcctggacagcagagaggaatgaagccatccatggagatcaggaaggctttctgttctgtgacgccccaggaaggcc

SEQ ID NO: 6854932 - DNA, 55 bp, Homo sapiens
gtctgatgtcataaaccttaggtaaagtattaaggctttaatctgatattcagat

SEQ ID NO: 6854933 - DNA, 60 bp, Homo sapiens
tctaatatgtattttaacgtgtaagggcttggatacaactaccctagaatacatagtaga

SEQ ID NO: 6854934 - DNA, 58 bp, Homo sapiens
ggttggcaaggccagtctctcaaggtgattgagaatacacagctggtccttggtaact

SEQ ID NO: 6854935 - DNA, 68 bp, Homo sapiens
ctcctgaaggcctgagttccaccaggaaagtgagctggcactggggtgggaatccaggccttcatcag

SEQ ID NO: 6854936 - DNA, 64 bp, Homo sapiens
gtggttagcgccccattcttctgctgtagttatttcaccccgggagggtgtgggccttagccat

SEQ ID NO: 6854937 - DNA, 80 bp, Homo sapiens
ggttatgagatgcaaggctggtggagtggggatgtccttttgggactgggtcatccaataccagtttgcaggctaagacc

SEQ ID NO: 6854938 - DNA, 76 bp, Homo sapiens
catttctgctctaatctctagcccatgcaaagacatgttttgtgtctttttcattcttagaggttgcactgaagtg

SEQ ID NO: 6854939 - DNA, 60 bp, Homo sapiens
gtggcagtgaggcaggagcagtcggcgcccacacgccggatctgccgcacccgctgccac

SEQ ID NO: 6854940 - DNA, 74 bp, Homo sapiens
gctccccttaaaacagcaccgaagtcgtctaagtttaggagcttgcgaactctgtctgctgtaacaagggaagt

SEQ ID NO: 6854941 - DNA, 101 bp, Homo sapiens
ctctgaacttggtgaaatcaatttttgacaaattgagatgaagaactaatatgaggcttggcatccactttgcaagtttatgatctaagttgcatacagag

SEQ ID NO: 6854942 - DNA, 100 bp, Homo sapiens
atttatattgtaagcagcagttcaattgttttgtaaaagtaatttcaattttaatcactgaactaaagaaatgggcaaggctgacttccgtaatataggt

SEQ ID NO: 6854943 - DNA, 115 bp, Homo sapiens
ggcagtgcggccagctcccgcaggcagcccgggttcccgtgaatgtaggacagtagtgtgtctggcccccacaggcgggctcgggttcctgtgccatgctcaccacttgtctgcc

SEQ ID NO: 6854944 - DNA, 55 bp, Homo sapiens
tttacaggaagctgaaaaacattgctattctaagtagctttcttcttcctgtaga

SEQ ID NO: 6854945 - DNA, 65 bp, Homo sapiens
taccacagcctccttcagagagcatcatgacgttaatgacgtgaacaggtggatggctgatggtg

SEQ ID NO: 6854946 - DNA, 56 bp, Homo sapiens
gaggagtctcagaaaagaagcatggaagactcttcccaattaactgagcattcctc

SEQ ID NO: 6854947 - DNA, 77 bp, Homo sapiens
gtgagctgctaacatctctctccattgtgccagcgggagcagctggtggaagtgatgctgaggtgacggctgctgac

SEQ ID NO: 6854948 - DNA, 64 bp, Homo sapiens
gtgttatgctctacaatctaaggggcctcttggggccgggctctgagggagtgggcagtggcac

SEQ ID NO: 6854949 - DNA, 63 bp, Homo sapiens
actgagcagcaggatcttctggtatattttacttattatatcaagagcctttgctggctgggt

SEQ ID NO: 6854950 - DNA, 57 bp, Homo sapiens
ttgcccagagtcacccagctcagaagctgcagagctggggctttcaaatctgggcag

SEQ ID NO: 6854951 - DNA, 57 bp, Homo sapiens
tgaaatgtcctgagattcaacttagatgccatctggggctgagctttggacattaca

SEQ ID NO: 6854952 - DNA, 103 bp, Homo sapiens
aaaaattctactatatttatattagatatatttagagaggttaagcttccatctctgccctctctcctgtgttctgatgttttccctataggtacaaattttt

SEQ ID NO: 6854953 - DNA, 69 bp, Homo sapiens
caccctgccactggggtgatgccgcctcatgttccacatgattagagcctcctccagaagggcagggtg

SEQ ID NO: 6854954 - DNA, 76 bp, Homo sapiens
ttatttttattcttttatgagattgcctttcaggggcacccccaagaggtgacataggagaggctcaggaaaatga

SEQ ID NO: 6854955 - DNA, 61 bp, Homo sapiens
gtgagatatatcagctacagttccactgagcatgcatgtgctcactactgtagcttctcac

SEQ ID NO: 6854956 - DNA, 65 bp, Homo sapiens
tggtcacgaatggtgctatctcaggccaagtttaaatctctggccagcatagatcattctgagta

SEQ ID NO: 6854957 - DNA, 130 bp, Homo sapiens
gggtagcccctccgcgtcccggggctccaaccagctgtgccggggacctggggcagaatagcaaacagcctcctccagagcctgcgcactggctggcggggccagggaaccgtgggctgaggagtccccc

SEQ ID NO: 6854958 - DNA, 56 bp, Homo sapiens
cctgagcccaggaatgcacttcagctcctggttgagcaatgtcactgaggcttggg

SEQ ID NO: 6854959 - DNA, 58 bp, Homo sapiens
gtgatggtcatccttcccttctggtaacacctgaatatagatagctgatgaccatcat

SEQ ID NO: 6854960 - DNA, 117 bp, Homo sapiens
gtcttatccataatgactattcaaatgaaaagtacaacaacagctgctaaagagttggtaagaagtggtgattcaagattggttagctgttagtttacatagtcattaaaataagat

SEQ ID NO: 6854961 - DNA, 62 bp, Homo sapiens
ggtaacattctagaaacttaacatctaatagagaagatggataggctaatagacatgttatt

SEQ ID NO: 6854962 - DNA, 56 bp, Homo sapiens
ttgcagtgcttcgcaaaggggcagcagcatggctgtcaccaaagcaggcactgtgg

SEQ ID NO: 6854963 - DNA, 69 bp, Homo sapiens
aggcaacatttcataggatcatgggctttttgagctggaagggaccctggatcaaatggaccgatgctt

SEQ ID NO: 6854964 - DNA, 80 bp, Homo sapiens
gacaggttggggagctggggaagaaccatgggaagcaaaccctggtctctccatgccctccaccctctcaataacctgtc

SEQ ID NO: 6854965 - DNA, 62 bp, Homo sapiens
ctgatagtataagggactctgtctcagttgaagaagcaagcatgatagaaacctttaatcag

SEQ ID NO: 6854966 - DNA, 59 bp, Homo sapiens
ggagcttgaagtctgtttgtatataagaggattgtctacatatgtgatttctaagttct

SEQ ID NO: 6854967 - DNA, 74 bp, Homo sapiens
gtaattagagtttttggcattaagatgctgtatccatatctgggttttggctagaaatgcttaaaatctattat

SEQ ID NO: 6854968 - DNA, 97 bp, Homo sapiens
aggttttgttgctactactcaactctgccatggtagcatacaagcagccatagacattgtgcagaagaatgggtgtggtcatgctccaagaaaactt

SEQ ID NO: 6854969 - DNA, 69 bp, Homo sapiens
acctcagcagtaagtgaagactagtttgaagcaaatgcttataaaatcagtacactttattttgcaggt

SEQ ID NO: 6854970 - DNA, 78 bp, Homo sapiens
aggagaaagagtttctgatactggaatcgatgccactgatcagtgccatctgataccaaatcaatgccactgtttcct

SEQ ID NO: 6854971 - DNA, 74 bp, Homo sapiens
ctggaaacttatgtcaaaatggttgagattgttagggatttagagatcaaatcattcaaccttttcatttccag

SEQ ID NO: 6854972 - DNA, 81 bp, Homo sapiens
gtttatgtaccttcagattcttaaaactgtctcatatacagtatgagtaaaataggtgagaatcaaatgaaggataagaac

SEQ ID NO: 6854973 - DNA, 82 bp, Homo sapiens
ggaagaggcccaagcaggcatcttggaggtcaagtgcggcatttgacctttgatttagggtgttatatgttggcatacttct

SEQ ID NO: 6854974 - DNA, 78 bp, Homo sapiens
gctccattttttgacatcattttcttcagtgtttgctctgctctgagctcagggaaactaattatgtccaggtggggt

SEQ ID NO: 6854975 - DNA, 69 bp, Homo sapiens
cgaggcagacaaaagttggaaggccggttaattttcccctccttctcctgcttcagctttgtctcctcg

SEQ ID NO: 6854976 - DNA, 75 bp, Homo sapiens
tctaggggcatcagtgtgtgcacacagcatggcttgtgaatgcggaagtgcctgtgtgcatagttgtgctcaaga

SEQ ID NO: 6854977 - DNA, 101 bp, Homo sapiens
actggcaatgaactctagtggcttcatggcaagtcttagtatctttgaagagtgatagactattaggactttgttgaaccctgtaaggtaacattactagt

SEQ ID NO: 6854978 - DNA, 60 bp, Homo sapiens
tttttcagtctgtccttgctgtgatcgctggaatatggaacacagagggcaactgagaaa

SEQ ID NO: 6854979 - DNA, 76 bp, Homo sapiens
tgatgaagtaataaactctttttatctccctaattcccttccctcatagggcaaggtaaagatttattgagtgtca

SEQ ID NO: 6854980 - DNA, 87 bp, Homo sapiens
agtgccaggtggtgcctccaggctggttatcagctggactgcaagaaagtgccaggtggtgcctccaggctggttatcagctggact

SEQ ID NO: 6854981 - DNA, 67 bp, Homo sapiens
tgagtgtgacctcatcttaactggaacccatctgcaaagatcctatttccaaagaagttcacattta

SEQ ID NO: 6854982 - DNA, 69 bp, Homo sapiens
atgtctagtgtctattgaccggaaagaatgacatgttttattgcatttttctcagtagcacttatccat

SEQ ID NO: 6854983 - DNA, 75 bp, Homo sapiens
gggccattgtgaaatgttaatgtaatcactgagcccaaatacagcttgtatattaacactttcatattttggccc

SEQ ID NO: 6854984 - DNA, 99 bp, Homo sapiens
ggaaaccagagcccggaatgttagtttgaacttgtctatgttacataccaggtaaacatgggtgcttcaaactaaatatgattccacagccctcattcc

SEQ ID NO: 6854985 - DNA, 58 bp, Homo sapiens
ttggctcctgttcctctgtctgggaccttaagaccatagaagaggcaggaggagctaa

SEQ ID NO: 6854986 - DNA, 129 bp, Homo sapiens
aaccatttctcgatgatttcagagccttcattctgagcatcagttatatgctctccagtgtaatgactttatagccaagcacagtaattgatattactgtgaaggcccttaacttatcaagaaatggtt

SEQ ID NO: 6854987 - DNA, 103 bp, Homo sapiens
gcaataacgtatatgtgtgttgtgtgtgcatgcatagacaccacacaatacatatgtgtgtgttgtgtgtgcatgcatagacaccgtgcagtaacataggtgc

SEQ ID NO: 6854988 - DNA, 55 bp, Homo sapiens
cgatgccagtgacaccagacccctgactaataggtcaatcggttcaatggcaatg

SEQ ID NO: 6854989 - DNA, 57 bp, Homo sapiens
catcactacaaatttaagaaatagctacagttaattcagtagatattgtagtgaatg

SEQ ID NO: 6854990 - DNA, 105 bp, Homo sapiens
gaatgaattcagcacatggaattcatgttcatatttacatttatagcttacagaatttctatgtcattgaccccaagctgataaacataattacaaagttcattt

SEQ ID NO: 6854991 - DNA, 57 bp, Homo sapiens
gatgtctactggtacatgttaagtgatttccggatcacatatgtagaagtggaattc

SEQ ID NO: 6854992 - DNA, 80 bp, Homo sapiens
gaatcaaattgaattgaattgaattgaattgaattgaattgaattgaattgaattgaattgaattgaattgaattgaatc

SEQ ID NO: 6854993 - DNA, 105 bp, Homo sapiens
tccagaatatgttacaagtatatttgttaagattattcagcatcaaggtaaattttagctgaagggcttttcacaatatcttgtatgacacatgcttcaattgga

SEQ ID NO: 6854994 - DNA, 75 bp, Homo sapiens
aacaaattaactgtagagaatctgagaaaaaggatagtttatcattttgtctcattaggttttctttgatttgtt

SEQ ID NO: 6854995 - DNA, 109 bp, Homo sapiens
tgagcaataatagtgataaaagtttttaagttaattgcatgttaatgactaagttaaactcaaaatggcaatcagcagaagctaggaaacatttgtcttgtttaaatca

SEQ ID NO: 6854996 - DNA, 57 bp, Homo sapiens
tgatgtaagtcttgacttcctccagtgtgaaatggagaaggaaggataactgcatta

SEQ ID NO: 6854997 - DNA, 72 bp, Homo sapiens
cctgttacatttctggatcatgcattgcttgtcccaattgggacagtaacctcatggttgcagagatacagg

SEQ ID NO: 6854998 - DNA, 129 bp, Homo sapiens
gggaagagggagtgggagggaggaggagggagaaaggagagagaatacattaaggaaattacagagtacctctttccttgaatgaatgttctctcccaatttccttctctcccagttggctgccacccc

SEQ ID NO: 6854999 - DNA, 104 bp, Homo sapiens
gtaactttcattctcacatttgctgtttcatggttgtttgatggcagctgcacctttaggcatgctgttggccagaaagaggagaaagaggcaatgactgttac

SEQ ID NO: 6855000 - DNA, 83 bp, Homo sapiens
tgcataaagttacagcttacatttacctcgtaatatatgtatatatatatattaggagttaaatgtattaggaggtaaatgta

SEQ ID NO: 6855001 - DNA, 78 bp, Homo sapiens
agctacatagtaatggatctaatactaacgttaagtgctgactttggttactttacagtattagataattacggagct

SEQ ID NO: 6855002 - DNA, 56 bp, Homo sapiens
ggacctgttctaatcttggggcagagaagactctcagtatgactagagcaggggcc

SEQ ID NO: 6855003 - DNA, 65 bp, Homo sapiens
gaggtcctgggagctagtagagtaaggaaagatgtttagtttccctgcctgacagcacccacctc

SEQ ID NO: 6855004 - DNA, 123 bp, Homo sapiens
ccagaactttttatgaagtctatgccctctcctcttgaacttggtcaggcttttgtaactgacttgactgtacagcaaccctgacttctgaggccaggtcataaaaggtaatgcaacttctgg

SEQ ID NO: 6855005 - DNA, 90 bp, Homo sapiens
tgaaaaatctgcaatacaaagcatgcagtagtagaaaaccgtgttcctctgaagcacaggtataacgtgcatgttgtaatggatttatca

SEQ ID NO: 6855006 - DNA, 77 bp, Homo sapiens
tgttcccagtgttccctgaacatatgttgtcttgagcagctgtgtgtcctgggagcccttttgttaccaagggaaca

SEQ ID NO: 6855007 - DNA, 66 bp, Homo sapiens
acttttctgggcatctccatgatatcctcattcagagattgagacaattcagaggtacagaaaagt

SEQ ID NO: 6855008 - DNA, 115 bp, Homo sapiens
acaagtgtttgctctgtctgtaccactccccaggcacttcatcattagggtggtcatctgattactctattggctgtgggttcctggaaagcaggttatcgagcaccatcactgt

SEQ ID NO: 6855009 - DNA, 57 bp, Homo sapiens
tccatgagaacccttggagataagcagaataaatcttatccccattattttcatggg

SEQ ID NO: 6855010 - DNA, 73 bp, Homo sapiens
tgaaggtcgattgatttcctctactagcaattatgcctcataattgtttgctgaaggagaaattggcatttta

SEQ ID NO: 6855011 - DNA, 123 bp, Homo sapiens
ccctctcactctgaagcgtgtttatttctctgggagttgcaggctctcatgttctcagggcttggtgagggcctgggtctgtactcctccaagtggaaatgaagagctacagatttatctggg

SEQ ID NO: 6855012 - DNA, 77 bp, Homo sapiens
ggagtattttgatttactggatattctcagagtcagtaaagaatgacagtgggtaatatgtgtggatcacagattct

SEQ ID NO: 6855013 - DNA, 93 bp, Homo sapiens
ctaagatccttcctggggtgtacaaggagagcacacatggggatggctgctgcctcactctgctcatctttgtctcacccttgtgcttcttgg

SEQ ID NO: 6855014 - DNA, 78 bp, Homo sapiens
ggccttgttgctcctatttgtttatccatgagttgtttaatctacgttagccaagcaagagggaatgtagcggaggcc

SEQ ID NO: 6855015 - DNA, 73 bp, Homo sapiens
ggcatctggtggagatgcctggcccctcctgggagcttcactcagcagaggctgggcttttctacctgtggcc

SEQ ID NO: 6855016 - DNA, 58 bp, Homo sapiens
acagagccccattgcttgcccaagtccttttccagaagaggccagcacagggctctgt

SEQ ID NO: 6855017 - DNA, 56 bp, Homo sapiens
tacctacttcctacctacttcagctctctgggcctgactgagggaggaagcaggtg

SEQ ID NO: 6855018 - DNA, 69 bp, Homo sapiens
ctgtttttaaactatgacatttgaagagcagttgaagaaagtaaagctgctcatggtggagaaaagcag

SEQ ID NO: 6855019 - DNA, 58 bp, Homo sapiens
gcagctgctggaagttcctgccagtagtaaacctttcaggcagaatgtgagcagctgc

SEQ ID NO: 6855020 - DNA, 130 bp, Homo sapiens
tctgtcagactcttactaactcttttgggttggaacgtggttgaggaagatccgggcagggtcctcggacagcctgtcagcagatctcctgcagccacagtcccacttgctggggatggcgagggctggg

SEQ ID NO: 6855021 - DNA, 61 bp, Homo sapiens
ttcattgatttccttggaataagatttttataactttctttattccatagaagtcaaggaa

SEQ ID NO: 6855022 - DNA, 61 bp, Homo sapiens
taaggttacctataatgggaagtctctacctgtatcatggtactgcctttaggtatccttg

SEQ ID NO: 6855023 - DNA, 68 bp, Homo sapiens
gccaccaggcccgctgctatggtggctgttccctgcccttaagtcaccggcagacgtggcctgatggc

SEQ ID NO: 6855024 - DNA, 66 bp, Homo sapiens
cgggctttcacagcagggagggacaaggcggaggagcggctcctgttttttcttgcgtgaggcctg

SEQ ID NO: 6855025 - DNA, 74 bp, Homo sapiens
ggttagtgcagggcaggcaggagcccaactgcctgggccacttccgggctctggtacttcctggctctgtgacc

SEQ ID NO: 6855026 - DNA, 56 bp, Homo sapiens
gcattttcctagagaatggagcactcttagctttagcaatatcataaggaagatgc

SEQ ID NO: 6855027 - DNA, 67 bp, Homo sapiens
tcccagctgcatgacattaggtgattaacatctctgtaacttacttttgtcatcagtaagatgagga

SEQ ID NO: 6855028 - DNA, 83 bp, Homo sapiens
gtaggtggctggctggaggtgaggaagaatttgctattcaaccagcagacatttatcctgtctcctccatgccaggcacaggc

SEQ ID NO: 6855029 - DNA, 63 bp, Homo sapiens
gagttgaccgtcactattttatattcaaggacaaagacttgagcaaatgtgatggtacaattc

SEQ ID NO: 6855030 - DNA, 62 bp, Homo sapiens
agctctgcagaacaattcctgctgttaacagacttaacagtctactgaatatctgcgtggct

SEQ ID NO: 6855031 - DNA, 71 bp, Homo sapiens
gaactggaatccaattatcagcatggccacatctgctttgtctccacgcaggcctagatggaaaccagttt

SEQ ID NO: 6855032 - DNA, 66 bp, Homo sapiens
tttctcagggaggtcctgtgctgaaagggaacttgactcaattccacggagatgctcccttagaaa

SEQ ID NO: 6855033 - DNA, 60 bp, Homo sapiens
gctttttatatcatcgtgttacattgcgtcatgtgcagagtaagatgagctataagaagt

SEQ ID NO: 6855034 - DNA, 58 bp, Homo sapiens
gtatcccggcatctatgtcttccagaacttgggttctgtggcatagtgcttgggaaac

SEQ ID NO: 6855035 - DNA, 56 bp, Homo sapiens
agctgcggtccaggcggtcatcgggaacaaagtcctccacactctggactgttgct

SEQ ID NO: 6855036 - DNA, 82 bp, Homo sapiens
tgatacaggtgtacacacatgcaaaaacttcctgagctgtacacttcagatcagcactcattgcatgtatgtgatctgttca

SEQ ID NO: 6855037 - DNA, 82 bp, Homo sapiens
aagctttagagatgagttcctttaaaagcaaactgattacacgaaaaactttccagtctttggaattgattatttgaagttt

SEQ ID NO: 6855038 - DNA, 59 bp, Homo sapiens
gctggcctgagggccgaggctccctgaccaggtaggacccaggccagccccaggccagc

SEQ ID NO: 6855039 - DNA, 94 bp, Homo sapiens
agaggccagggcgggaaggggaggaggaggaagtggaacccagctcccaaccctgccccgctggccctcaccttcctccctcaccgctgcctct

SEQ ID NO: 6855040 - DNA, 100 bp, Homo sapiens
ctgggctggcgtcttttcccagacagggacctcgctccagagctgaacagggttgtttctgggaggctgggtcccgtccgtgactcagagccaggcccag

SEQ ID NO: 6855041 - DNA, 92 bp, Homo sapiens
tccgcctgcgggaagtcattgtatgtacagtctgtctcctgtggactttctgttgagtgtgcatgctgcagtatgatttcctgtgagcagga

SEQ ID NO: 6855042 - DNA, 88 bp, Homo sapiens
tctcacttacgtgacctgcctgggctcggtagccatcgagtttgcattgcttgatgccacggagcccaggcaagtcacataaatgaga

SEQ ID NO: 6855043 - DNA, 117 bp, Homo sapiens
ttcctataaaacatggtcaaagaaacgaagttaaagtagataggcaaggtaaacacagatttaacagtagtttagtgttacatatacctgagcttatatgctttttaccaataggga

SEQ ID NO: 6855044 - DNA, 56 bp, Homo sapiens
ctaaccagagattagatttagtttctcttctagctgtacattttctctctggatag

SEQ ID NO: 6855045 - DNA, 55 bp, Homo sapiens
tccaggcacgaggccctgtgcagagaaagcacttagtaggagcctttgcactgga

SEQ ID NO: 6855046 - DNA, 103 bp, Homo sapiens
cagagtaggctgaggctgaggtggcagccacagaagtttcatagtctcgatttaggaatcaggggctgcttcagtcctcttctgctctctagccccttctctg

SEQ ID NO: 6855047 - DNA, 84 bp, Homo sapiens
tggggagttccatcttgcccttatgtgtagtctggggggattatcccatttacagaagccaaaggggccagatatgccttctta

SEQ ID NO: 6855048 - DNA, 77 bp, Homo sapiens
gaatgcagcttctcagaggcctcacttccagccagggaaacttaagacctgaaaggaataaggctctttgtgtattc

SEQ ID NO: 6855049 - DNA, 129 bp, Homo sapiens
ggccaatcagtattacatctattgtctcctaaccagtcctcagatggtctgtgccaagtgcctaagaaaagggggtgtcaaatcatctgaaactgtgagacaaataaaagagctataaggaaaaggcac

SEQ ID NO: 6855050 - DNA, 83 bp, Homo sapiens
gaggcaggtggtgccattagccctgctgttgggactgacagatcagtactgaagtggcatcagggtaggaaggtatcagcttc

SEQ ID NO: 6855051 - DNA, 65 bp, Homo sapiens
tagctggttctccaggagctaggatcagctcagcctggcacctagttagcaggaggaatcagtta

SEQ ID NO: 6855052 - DNA, 60 bp, Homo sapiens
ggcaattactttatgcaaatgtgggcatctctggatggctggcaaggctggagtcaggcc

SEQ ID NO: 6855053 - DNA, 77 bp, Homo sapiens
gaggagggcagagggtggctgagagtcgttgcaattctgaagcttatgcaatctctcagaaagcccatgtctgagtc

SEQ ID NO: 6855054 - DNA, 79 bp, Homo sapiens
gccaacttcatattgtttccactagatatcattttaaatattcctgtggtttcgtggtcctaagaatatgaaggcatgc

SEQ ID NO: 6855055 - DNA, 55 bp, Homo sapiens
tgtgacatattgaggtactgaggtattgaggtactgaggtactgaggttgtgaca

SEQ ID NO: 6855056 - DNA, 61 bp, Homo sapiens
tccgagtaatatgctttttgacctgctaaactttgcagctgagactctcatgttatttgga

SEQ ID NO: 6855057 - DNA, 58 bp, Homo sapiens
tccctccctacgtgtgtgacccattgtgaggtgggaagcattaatgatagggggtgga

SEQ ID NO: 6855058 - DNA, 72 bp, Homo sapiens
ggagtaggctgtatgaatataccacaatttagggaaccagaaccctgatatggtgtcatttaaacagcttcc

SEQ ID NO: 6855059 - DNA, 55 bp, Homo sapiens
gattatgatgcgaggtcagagcagttgttttctgtcctgaactggcatcagaatc

SEQ ID NO: 6855060 - DNA, 61 bp, Homo sapiens
ctctgccgtgctagatttggcttaggggattgagagtagagatggcagggccctagcagag

SEQ ID NO: 6855061 - DNA, 66 bp, Homo sapiens
tggctttgtgtattttcagactgtgaatatagctgttatgttaacaggtaactgaggctgcagcca

SEQ ID NO: 6855062 - DNA, 122 bp, Homo sapiens
gcccctgcgcaaggcctcacggctccaggctgttggaggtacctgcccactcaacctgggctggctgttggaggtacctgcccactcaacctggcgggctgtgcgtggcttgtgctttgggc

SEQ ID NO: 6855063 - DNA, 58 bp, Homo sapiens
agtgtggttctcaaggtgtggtcactgatgcagcatcagcatcacctgggaacttact

SEQ ID NO: 6855064 - DNA, 62 bp, Homo sapiens
tcaatgtcaatatcttggttgtactatattgtactatagtttttcaagatgttgccacttgg

SEQ ID NO: 6855065 - DNA, 72 bp, Homo sapiens
cagcgctggatgcggggtgagaacctgagtgtgcttcttgccagtcaaagttgtccccagcacctcatgctg

SEQ ID NO: 6855066 - DNA, 61 bp, Homo sapiens
tgtacaggagaacaatgagaaatggttaccaatgacaaacttatcaggtgttttctgtata

SEQ ID NO: 6855067 - DNA, 78 bp, Homo sapiens
gcatttctcagataagaagactgaagcccactcgtgtttagtaacatgtgtaaggtctctcagtctaagatctgatgc

SEQ ID NO: 6855068 - DNA, 57 bp, Homo sapiens
agcaagaaggcttcagagcccaggagcttcaagttcctggtctagtacttccttgct

SEQ ID NO: 6855069 - DNA, 57 bp, Homo sapiens
ggatgtcgaggatggggtagcagctcagtccgcccctaccccaggcccctcgatgcc

SEQ ID NO: 6855070 - DNA, 74 bp, Homo sapiens
gccgtattaagctgctttaaagatttatgttgtacccaatcttagagtgtttttgaagctagctcaaggacggc

SEQ ID NO: 6855071 - DNA, 62 bp, Homo sapiens
gaggaactggcagtgttgtgttgtgggtgagccacttacaatgggtatacttccatttcctc

SEQ ID NO: 6855072 - DNA, 56 bp, Homo sapiens
ggtgaggggcgcctctgcccggccgcccctactgggaagtgaggagcccctctgcc

SEQ ID NO: 6855073 - DNA, 66 bp, Homo sapiens
gtctggtcccatcaaatgcaattgaagacgtgaaaacacaaagtataacttgatggaaagaccgac

SEQ ID NO: 6855074 - DNA, 76 bp, Homo sapiens
ttccctgggctgactccttccagcagagctaggttagcccacccagctttgcagctgtgggaggagactcagggag

SEQ ID NO: 6855075 - DNA, 57 bp, Homo sapiens
aagggctcccaactcatcttttatcaactagtttgatgatggtagggtgtggccttt

SEQ ID NO: 6855076 - DNA, 70 bp, Homo sapiens
tgtgtttgtgtgtgcatatgtgttttcctagtggttacatgcttactaggcaattatgtaaataagcaca

SEQ ID NO: 6855077 - DNA, 85 bp, Homo sapiens
gtgtttatgatatctgtctatgtggctatgtatgaatttggttcattgcttctgactgctacgtagatatccatcttctgaatac

SEQ ID NO: 6855078 - DNA, 56 bp, Homo sapiens
agcttggctctgtgcttgttgtgtagccctgacaataataaagcaacgagcgagct

SEQ ID NO: 6855079 - DNA, 64 bp, Homo sapiens
gtcatgaagccatgtgtgcttttggcagtaccacctttgcctccacttttgctggcttctggat

SEQ ID NO: 6855080 - DNA, 58 bp, Homo sapiens
aaaagggcaaaaccatcatggaggtcacatttgacaaaccagtttgtttttccctttt

SEQ ID NO: 6855081 - DNA, 82 bp, Homo sapiens
ggcaatctcagaaacggagctgccattttatgtaacgtgaaaaagtaaaggagaggcagttttgtgaagctgaaagattctc

SEQ ID NO: 6855082 - DNA, 130 bp, Homo sapiens
gaaaactagaatttcatatctggaaaagtgatttctagattttggaactttatcatctagtaaatttttgaaaattggggtatggagtttaaaagtatttcattttttcaagtaagaatgttaagaaaat

SEQ ID NO: 6855083 - DNA, 80 bp, Homo sapiens
gtagaatttggagggctgagtggtgcagtcaaatgaattatttaatctcccactctcagcctaatcctcttgttttctat

SEQ ID NO: 6855084 - DNA, 71 bp, Homo sapiens
ttgtggcctctgggaaagcagattcccaataaggatgatctctccttgaggagcttcctatgagtccacaa

SEQ ID NO: 6855085 - DNA, 69 bp, Homo sapiens
gccaagccaccagctctgtcctgactttggggcaaaaccccacaaggaggacagcagttggggctgagt

SEQ ID NO: 6855086 - DNA, 57 bp, Homo sapiens
aagccaggagcgaggcctcggcagaaaacgccccagccgccccttgatcttggactt

SEQ ID NO: 6855087 - DNA, 81 bp, Homo sapiens
tagactgtggacctcagagcttgggttttcttaatggaggaattatcagggagaaaactggagcctggggttgctaagcta

SEQ ID NO: 6855088 - DNA, 70 bp, Homo sapiens
cagacccagagttttatacaactttttaaatgggtttatttccaaaggaattttaagaacttctggtctg

SEQ ID NO: 6855089 - DNA, 87 bp, Homo sapiens
ttagattcactggggtttgggaatatggtagcttattaggagggttggagtaggttcatattctagaatcatagccatagaatttga

SEQ ID NO: 6855090 - DNA, 79 bp, Homo sapiens
gcagtcagccagccagatcagggcaggggttgctgttagcatgttgcatctcttggaaagactggccaggcatgggggc

SEQ ID NO: 6855091 - DNA, 76 bp, Homo sapiens
gataatatgagcaagcagtgaagttgaatgtaatatataggttaagtaataatatcattgtttgcatagtgtaatc

SEQ ID NO: 6855092 - DNA, 60 bp, Homo sapiens
agctgcaagatttcttttgtatgtctgcatctgagatacaatgattattttgtcttagct

SEQ ID NO: 6855093 - DNA, 81 bp, Homo sapiens
tggcctattgaaatgtgatctgagcttggctctctcatgggaaagaccaggtttattacattcaaacagaattagcagcca

SEQ ID NO: 6855094 - DNA, 110 bp, Homo sapiens
ctcctagccagaaccctccaggatgcccaagccgagctctctgtttccccttccaaagccaggtccagcaggagactgggcttggctctctgatggattcaggacagggg

SEQ ID NO: 6855095 - DNA, 91 bp, Homo sapiens
aatgttcttccaaatgaagtgtttgctttgccttgaaaagacaaattaatattttacatggcaacaactctttattccttggtgggatatt

SEQ ID NO: 6855096 - DNA, 73 bp, Homo sapiens
ttaatgatcagattttagccagggccagatttcagttttagaaacatcactctggctgtaatatgaaagttag

SEQ ID NO: 6855097 - DNA, 86 bp, Homo sapiens
ggcatttctaactggtttcatatcatttccgggtggaaacaatccagatttacgaggaaagagattgcaatcttttagcaaatgcc

SEQ ID NO: 6855098 - DNA, 120 bp, Homo sapiens
gcttttccttttccttttaatgaatgttcatacataagcaaaggattttgatcttttgagtagccactttagagaatgttctttgcaatgtacatacagttttggaaagactagcaaagc

SEQ ID NO: 6855099 - DNA, 119 bp, Homo sapiens
tgttagtagacaaaagtgctgcagaatagtaaaaggtaagagacataaagctcattaacgattagaattgacaagtgttgcattttgccattattttgtttcattatagtattttaaca

SEQ ID NO: 6855100 - DNA, 71 bp, Homo sapiens
tggtcttgaattatttaataccttgttccacactgtcacttatgagcaatgtcttttgcagttcaagatta

SEQ ID NO: 6855101 - DNA, 76 bp, Homo sapiens
tgagaaaaatattcaagagataatgttaagtgcaaaaatagcataagtgagcaaatctatgaatgtatatttctca

SEQ ID NO: 6855102 - DNA, 70 bp, Homo sapiens
gtgaggaatcctgttttagataagcttatactaaaaaagtatacagaaaatgatgcagagtttttctcat

SEQ ID NO: 6855103 - DNA, 62 bp, Homo sapiens
tcagccagttgccccagttagttgaagctgcagtagaggattagtgggtgttgcatggctga

SEQ ID NO: 6855104 - DNA, 99 bp, Homo sapiens
gaggtagatgacctattccaagacttcaagaagagcttctattaagtatgggtatcttctatgaatcattggaacagggcacacaaggtcagctatctc

SEQ ID NO: 6855105 - DNA, 57 bp, Homo sapiens
tacctccttcctgggacagagctgggaagatctccagggctggtagggaagagcgtg

SEQ ID NO: 6855106 - DNA, 66 bp, Homo sapiens
gagtgtgcgtgctacatacagtaaagtaaattgtccatacttgtttctgtagggtgcagcaggctc

SEQ ID NO: 6855107 - DNA, 85 bp, Homo sapiens
aagccggggatcatttttgaccatgggtaggatcagggagattaaccttgttttacaggtgaaaaatgaagatccagagaggctt

SEQ ID NO: 6855108 - DNA, 76 bp, Homo sapiens
gtctagaaacacatacattaattgtattgaaatgttatatcaatacatcatttatgatgtgtgtgtggtcccagac

SEQ ID NO: 6855109 - DNA, 73 bp, Homo sapiens
ggttgacttagctaaactgtaactagaattctcagaattctcttccttgtacagttctaagttagggttggct

SEQ ID NO: 6855110 - DNA, 61 bp, Homo sapiens
gcataccacaattattttgctaagctcagcctctgaagtgcaaaaaagtgttgtgacatgc

SEQ ID NO: 6855111 - DNA, 56 bp, Homo sapiens
gagggggtagccctgcaggcgctggcttctgcctgctggcttccagctgctccctc

SEQ ID NO: 6855112 - DNA, 64 bp, Homo sapiens
gaagtggtcaaagactagatttcagtgctctgtcatttactgactatgtggccttgaccaagtc

SEQ ID NO: 6855113 - DNA, 67 bp, Homo sapiens
ggccacagaggtggggattcctgatcactgtgtagtacaagagatgacaggtcgccacaaatgggtc

SEQ ID NO: 6855114 - DNA, 72 bp, Homo sapiens
tacccaggagccctgcaggatgagggaggtctctggagaggccattgagaactcagggctcagcactgggtg

SEQ ID NO: 6855115 - DNA, 58 bp, Homo sapiens
tttgcacaagaaatcatggactgaatttccaagagttcaggtctcaattctttgcaga

SEQ ID NO: 6855116 - DNA, 117 bp, Homo sapiens
gtttgggtttttttaaatggacagtctacattttcatttgttctgctgaggccagtaatggctatgctaaacagtgagaaggtggacaggaatttaaaactgatcacaaatccaaac

SEQ ID NO: 6855117 - DNA, 66 bp, Homo sapiens
gaagcaagtgcaaggaagaggcagacacagatcagcaatacttgctaaatccttgagttttgcttc

SEQ ID NO: 6855118 - DNA, 57 bp, Homo sapiens
gtattggaagattcaggattgcatagataagctgtggcaagtttgactttcctttac

SEQ ID NO: 6855119 - DNA, 90 bp, Homo sapiens
cataattgttggctattctgtttgtctttattttcttggattaggtgttcaagttggtaggagacagaaggtgaagaattgcaatttatg

SEQ ID NO: 6855120 - DNA, 59 bp, Homo sapiens
ttgtccggtgagggggctgcagagtgagatgtgaccattctgggctaccttcccggcag

SEQ ID NO: 6855121 - DNA, 67 bp, Homo sapiens
tcaggagaaggcaatgtggaaatgaatgcttaagagaagtacctgttgcatcaattccttgtcctga

SEQ ID NO: 6855122 - DNA, 76 bp, Homo sapiens
ccacctcccccgccgggcctggccgccgtcccaacctcgagccacagctggcgcggccaggcccggcggggggtgg

SEQ ID NO: 6855123 - DNA, 129 bp, Homo sapiens
ttgcaacaggattagatagcaacatgtctctccataaatgttttgtgggttgagtttctttaaggagaacttaggaaaataaggcatgatggagagggtgcaattgatgaggtctgatacataaagcaa

SEQ ID NO: 6855124 - DNA, 66 bp, Homo sapiens
agtgaggtggggtcacagggacagccagataatggggagccatgagtccctggggccctacttcct

SEQ ID NO: 6855125 - DNA, 95 bp, Homo sapiens
gggcgcactgggggttcatgatcgcggttcccgggggcggcggcggcggcggctgctggctcccaggagccgctgtgacatcccccggcgagccc

SEQ ID NO: 6855126 - DNA, 127 bp, Homo sapiens
ataacagtttgttataagatattttaagtcttttgaaatggtttcaaacacactaagtaaagagtaactttcattctgctgttgtttttgtgctgtcgaggacttgggatgcatgacaaagatttgt

SEQ ID NO: 6855127 - DNA, 90 bp, Homo sapiens
gtattattttatccctgttttgtgagtcaatgtattgcagcaactattgattgttggcaagatgtattgatcattagggtctaatatggc

SEQ ID NO: 6855128 - DNA, 63 bp, Homo sapiens
gagagttccactcatggcttcagggtcaaccaacttgttgaccctgagagctgaatggctttc

SEQ ID NO: 6855129 - DNA, 61 bp, Homo sapiens
tttcattgtcagagctttgaataaatgggataatcaatcacccacaaagtgtgacttgaag

SEQ ID NO: 6855130 - DNA, 70 bp, Homo sapiens
cacacacccctctgtagagccctctgctctaaataagatctacggaagcgttctcagcaggggcaatgtg

SEQ ID NO: 6855131 - DNA, 68 bp, Homo sapiens
ggttatgcacctgctcacacatgtgactgttctttcacatcaccagtttgggttgggatgacatgacc

SEQ ID NO: 6855132 - DNA, 64 bp, Homo sapiens
gtgcccctttctgggacccctgtctccttccagaaagtacgagaccctcccagaagggggctac

SEQ ID NO: 6855133 - DNA, 101 bp, Homo sapiens
tgaggcagaagaatcacttgaacctgggaggcagaggttgcagtgagccgagatcgcaccactgcacttcagcctgggcgacacagtgagactctgtctca

SEQ ID NO: 6855134 - DNA, 61 bp, Homo sapiens
ctgtccctagaaatgaaagcatacgtccacacaaagacttgtatgtgaatgtttctagcag

SEQ ID NO: 6855135 - DNA, 73 bp, Homo sapiens
ggcgtcattccagtgtagctctccagccagcaaggcgcggccaaataccgtgtggcggggacttgtggctgcc

SEQ ID NO: 6855136 - DNA, 95 bp, Homo sapiens
cctcgggtgttcacagtattttgttgcccattttctgtttagtgactacttttcaggatcaagacagatgggtaacttggtatggtggcttgggg

SEQ ID NO: 6855137 - DNA, 69 bp, Homo sapiens
catgataaatagtgaagggagccggtctgcctgtgctacagggcctggttaattacactgtaaatcatg

SEQ ID NO: 6855138 - DNA, 120 bp, Homo sapiens
gctgccaaccctgtgccagggggtggtgtcttcagcacaggagctgcagtggttggacaggacactgctggtgaggtccttgctggactcagccacctcccgcacagggtgggaatcagc

SEQ ID NO: 6855139 - DNA, 82 bp, Homo sapiens
gggcagcgggtacagggggcagtcagctgagagctggcccatgggacacagctctggtactgctgaccgaagacctcagccc

SEQ ID NO: 6855140 - DNA, 91 bp, Homo sapiens
ttatttttgcccttcttagtatatgcattggataagaaccccattggcccttttttagctagtaatgtctaatgcaggaagacaggaataa

SEQ ID NO: 6855141 - DNA, 60 bp, Homo sapiens
gttgtcctgtgccaccttcctgagtggctaccacccaggaagttgatgcagaggacctgc

SEQ ID NO: 6855142 - DNA, 130 bp, Homo sapiens
agattgggttaatagcactgccacctggttttctagtttgcaatggtagttgttgctccatgactatggagcaatatctccattacttttgcagctccaacctcagttttataagtgttagcagcaatct

SEQ ID NO: 6855143 - DNA, 107 bp, Homo sapiens
tattcctctacagcagtgattttaaactatggatgatttctgcccccagggggcatctagcaatatccggagactttttaaattgtcataagtgaggtgggggaata

SEQ ID NO: 6855144 - DNA, 84 bp, Homo sapiens
tctggaggccttttacagaccattaattggtagggctattactatgctctcagttaatggattctgtcagattcaagctccaga

SEQ ID NO: 6855145 - DNA, 63 bp, Homo sapiens
agcctgggtgggggttcggagagccgggcacaccccgagtcctcctgcaccctccctgtggct

SEQ ID NO: 6855146 - DNA, 69 bp, Homo sapiens
gttatcaaggctggaagaatttatgttaaagagaaagaatttctttgtaagaaattcttccgtttttac

SEQ ID NO: 6855147 - DNA, 63 bp, Homo sapiens
ttcaaccactggtcagcatggtagaccagcccccaggggcttctcctgacaggccatggtgaa

SEQ ID NO: 6855148 - DNA, 95 bp, Homo sapiens
atccgtaaaatgtatgcatttttctgctaagactgctaattaatttaaaaagagattgttagaataaaaggtcagagagtaaacatattacagat

SEQ ID NO: 6855149 - DNA, 106 bp, Homo sapiens
ggggtctaggagtgaccaaggtgtgggcagggttgctttctccgaggcctctctcctcggcttgcagatggccatcctcactgcaccccgccttagtcttccctcc

SEQ ID NO: 6855150 - DNA, 95 bp, Homo sapiens
ttaaaccttgcaggtgtcagtgatgatatgaaagaatctttaatctgtttgtgttgaaattcccccagatcattttcacatctgtacatgtttaa

SEQ ID NO: 6855151 - DNA, 74 bp, Homo sapiens
ttttttatctatggtagtaccatcaagagtaattcactatcagaaatcttacctggattgccatttatagaaag

SEQ ID NO: 6855152 - DNA, 58 bp, Homo sapiens
gcccaggctggagttcagtggtgagatttcggatcactgcaagctccgccccctgggt

SEQ ID NO: 6855153 - DNA, 110 bp, Homo sapiens
agagctcactgaaattgccaatgatgtcaaatgctgcaaactcatcaaggaaaatgaagactgagaatgagttcattgcatttgacagttggagatctttggtgacatct

SEQ ID NO: 6855154 - DNA, 81 bp, Homo sapiens
gcttaattgtcagaaattatcccctgaatttaccacttttctgagggagggtggttcttttagtggaagaattggttaggc

SEQ ID NO: 6855155 - DNA, 64 bp, Homo sapiens
agcacgcatggtaaatccactgactttgcttttgaaagtcaagtgccaccaccatgtatctgct

SEQ ID NO: 6855156 - DNA, 77 bp, Homo sapiens
gaaatatacattgcaggaagagaatggattaccacatactgttaatttcgtccataattctgaccaatgtatatttt

SEQ ID NO: 6855157 - DNA, 70 bp, Homo sapiens
tttattagaggaaagcaatctagttccaattctggttctccggagttactggattgtgtctgaggataaa

SEQ ID NO: 6855158 - DNA, 98 bp, Homo sapiens
ggggggatttggaacagagattatctgcaggcttatactgtaactctgggtagattcttagtgtctgttacgcttgcagaagagttttaagttgccct

SEQ ID NO: 6855159 - DNA, 129 bp, Homo sapiens
cttgaccggacagctgatgaccaggcctttgcagggagagagagcccagtgattaggccattcaactgccatctcatctccctctgcagacaatccacagtggcctgtggtcccacacctgttccctgg

SEQ ID NO: 6855160 - DNA, 93 bp, Homo sapiens
acaggatcaaagggaacctgttagggttgcttttggctgcaactaacagaaaactgccccagtgaccctaacaggtagggctttggttcctgt

SEQ ID NO: 6855161 - DNA, 119 bp, Homo sapiens
atattctacatgtgatatgtaatttatttgttctttcttctgttgtttccaattattataaacagcaggcatgaatgacactgaatatgtaataagttgcacatgttatagtagactgt

SEQ ID NO: 6855162 - DNA, 67 bp, Homo sapiens
ctgaccatgctgtggatagcagttaataatcggggactagaataaactgttctctcagtgtggtgag

SEQ ID NO: 6855163 - DNA, 73 bp, Homo sapiens
acccaactcagactggattaaataaaaggggattttcttgcttatttaactctagattcagtggtaaatgggt

SEQ ID NO: 6855164 - DNA, 76 bp, Homo sapiens
ttttctcctaatgaagactgatattaactttagtgtaatttcacctgcataaaaagaatgtctgttttggagaaag

SEQ ID NO: 6855165 - DNA, 77 bp, Homo sapiens
cattttgaattctgatgatactgcattgtaatttatgatagttatagtgtcagaaaatcataagaaaaaacaagatg

SEQ ID NO: 6855166 - DNA, 81 bp, Homo sapiens
atgagaagattgagtcaggcctccaggttaccatttgttagctgtgtggcttttagtggctttgagcttcagttttctcat

SEQ ID NO: 6855167 - DNA, 64 bp, Homo sapiens
gtggttacccagtcgctggagttctgctcgatgcctgagcctggcgtgtgtgggttgtagccac

SEQ ID NO: 6855168 - DNA, 55 bp, Homo sapiens
cttacatatgcaagacaaagggatgtgaaaaaccctctgtgttgagggtgttgag

SEQ ID NO: 6855169 - DNA, 77 bp, Homo sapiens
tctatagttttatagtcaatactcaactctctgcacatttagtatatggcagagcataattgacatgaggtagtaga

SEQ ID NO: 6855170 - DNA, 66 bp, Homo sapiens
agaaatctgaaatagtgtgaagtaggctgtactgcattgtctgccactgtctctattctggtttct

SEQ ID NO: 6855171 - DNA, 105 bp, Homo sapiens
gctcctcctcatcgtcgtccgtgtcccgggggccgggggcccgggaacgagcccggctggagctgccagccctcggggtctgagtggctgttgaggtgtgggagc

SEQ ID NO: 6855172 - DNA, 56 bp, Homo sapiens
gccatgggtctgctggctcagctcatggaacacctgcttgataggcagacctgggc

SEQ ID NO: 6855173 - DNA, 70 bp, Homo sapiens
ttgctaaaagagcttggttgattttgcaacacctgcaaaggtctagtaaaaaggccaagcccttgtgcaa

SEQ ID NO: 6855174 - DNA, 61 bp, Homo sapiens
tagcaagtgaggtttctgctttcagacatgcctttgtgtttgaagctctaccttttttcta

SEQ ID NO: 6855175 - DNA, 72 bp, Homo sapiens
gctttatccaagggttttaactgtaaaacacagtcatctgagtaataagcaggtcaaatctttggatatagt

SEQ ID NO: 6855176 - DNA, 76 bp, Homo sapiens
ggccatttgtctttagtgtaattctgccttttgtggcttctttacaaaagcagttctatctgagttaaaataggcc

SEQ ID NO: 6855177 - DNA, 71 bp, Homo sapiens
tgaaccctggtctgtgcgtctcccaggacagctgcagcagctgcctgtcctaggccatcagtcctggttca

SEQ ID NO: 6855178 - DNA, 61 bp, Homo sapiens
ctagaagcatgaaatggccattctctgagatgaaaatttggagaggggcaagtttatctag

SEQ ID NO: 6855179 - DNA, 56 bp, Homo sapiens
ttggtcacttgctatgtgccaaagatgtttctcagagctcatagcttggtgaacaa

SEQ ID NO: 6855180 - DNA, 79 bp, Homo sapiens
gaggaaacagagaacaaattggatccaggatttcacattcatttcaccacatgatctttcaagttttactgttttcctc

SEQ ID NO: 6855181 - DNA, 113 bp, Homo sapiens
tctctgttactctcctttgcactgtccttcagctcttggtaaatgtttgggtctcacaataaacatttcttaaacatctactgtaggctggaggtagtgttggattccaggga

SEQ ID NO: 6855182 - DNA, 65 bp, Homo sapiens
atgaccctgagacattgtaatatccttgggcaccaaaaaagattctgcaatattcagttggttat

SEQ ID NO: 6855183 - DNA, 73 bp, Homo sapiens
caatatcacatttgttcttgaatctaagcccttgggatgccatccaattggaattgtgaactaagtgattttg

SEQ ID NO: 6855184 - DNA, 98 bp, Homo sapiens
gtgctctttcgaggggcctacaagagtctgttacttgtcccctaacgaactgtttggtatacagtagcaggctctgagctgggtaggtggtggagaac

SEQ ID NO: 6855185 - DNA, 88 bp, Homo sapiens
ttatgtgattacagatccaagtgatgaaatttactccacctcttgatgagaaggcagcaaagtcacatggaaaagggtaggcatataa

SEQ ID NO: 6855186 - DNA, 90 bp, Homo sapiens
acaggctgcatgggggtctggcttgcaaaggagctcgcatataaagtgaaagctgctcaggagagccaggtctccccacaggcgtcctgt

SEQ ID NO: 6855187 - DNA, 68 bp, Homo sapiens
tgctgaaaagtaaataggcctaaccacattttcaagcccctgtgcgtgggtcttttgtgcttatagca

SEQ ID NO: 6855188 - DNA, 94 bp, Homo sapiens
aggaggtagttctgtttttgcaaattccaatccaatatttatgacagtcaaagatgagtgagtcaaagggtaggttgtagaggaactgcttcct

SEQ ID NO: 6855189 - DNA, 83 bp, Homo sapiens
gtgaggagtagtgaaaggagcctgagactgggcaccaggagacctgggtcttggttcatgctctgttccacctgacctctcac

SEQ ID NO: 6855190 - DNA, 60 bp, Homo sapiens
acagttgagatgcaactttgggcgttcagccatttctctgccaaggacatctatgactgt

SEQ ID NO: 6855191 - DNA, 63 bp, Homo sapiens
tggattagagctgttagtgaagtgcgtattatgtgttaagtacttcataatgacagccttaca

SEQ ID NO: 6855192 - DNA, 84 bp, Homo sapiens
aaacatgtcatcaatctgtggttccaccactttgggaatcttcaaacttaaggagcagcagaatttgaagattttaaaatgttt

SEQ ID NO: 6855193 - DNA, 58 bp, Homo sapiens
ggtgggctgaggggacaccaaggacccgtgctgtttcctgtgacccttccagtctact

SEQ ID NO: 6855194 - DNA, 58 bp, Homo sapiens
tccagtgtggagactccaagcacagtcatcattgcctgctacggtcttcactggtgga

SEQ ID NO: 6855195 - DNA, 55 bp, Homo sapiens
ggctgtgctttgcccaaagggctgtggtttcttagcagtcttgtgacagccagcc

SEQ ID NO: 6855196 - DNA, 79 bp, Homo sapiens
agagccttctcggcgcggagcattcccagggacccttccaggccccgacccctgggacccgctgcagaggcagggcttt

SEQ ID NO: 6855197 - DNA, 59 bp, Homo sapiens
tgatttctgaggctctgcccagacagcagtgattgtgcctgggctttctctcaaagaca

SEQ ID NO: 6855198 - DNA, 56 bp, Homo sapiens
gtcagtgtaggttcatcagtggtaacaaatgtaccactttgatggtggatgctgac

SEQ ID NO: 6855199 - DNA, 61 bp, Homo sapiens
aagagcagagcagggggaatcacagtctgacaaagagagttctccagccctgttccctttt

SEQ ID NO: 6855200 - DNA, 57 bp, Homo sapiens
tctggttgtcgaccaccaatgctgaggttcctctttgaggggtaggttgaggccaga

SEQ ID NO: 6855201 - DNA, 81 bp, Homo sapiens
gcccttgtctcccgtttggaaaggatgcagcattttattgagggagcggcagcatccccaggcagcagggcaagacagggc

SEQ ID NO: 6855202 - DNA, 60 bp, Homo sapiens
tgctttggcccaacattgatgcctgtcccagaaatacaggatcaagtgtcttgccaggca

SEQ ID NO: 6855203 - DNA, 60 bp, Homo sapiens
ggctggagtgcggtggcgtgatcatggctcattgcagcctcgacctgctgggctcgggct

SEQ ID NO: 6855204 - DNA, 101 bp, Homo sapiens
ttgacagcggcagatatttttgaatatgattgcaaatttggcttgtcatggagtacctgccaagtaccatgaatgtatttgatgaataattctgctgtcaa

SEQ ID NO: 6855205 - DNA, 59 bp, Homo sapiens
aatgctaggcctttcagcccaccaccttaataaatagtggcttggaagccacctgtatt

SEQ ID NO: 6855206 - DNA, 58 bp, Homo sapiens
gatcaacttttagcatggtacctacggtaagtaaaacaggtactaatgaaaagtgatt

SEQ ID NO: 6855207 - DNA, 59 bp, Homo sapiens
tgggtagagtgctgacaatgcctgctcctggctggggtacatgtgtcagttctcaccca

SEQ ID NO: 6855208 - DNA, 86 bp, Homo sapiens
gggtggttcattataataaatgcagcctagctcagttttcccagtaaggtcatcagatctgagtggctgcatgtaaattgctaccc

SEQ ID NO: 6855209 - DNA, 78 bp, Homo sapiens
acattaatcattgtggcgtggcactgggcaggaagttcttacctaagcaagttccactctacaatatatctttagtgt

SEQ ID NO: 6855210 - DNA, 107 bp, Homo sapiens
gagagacagatataagatgtgggacagatttaatttatttcaactgccaagggaaaggtgattgtggcagattttataaattgctgtacatacttttgttagttctc

SEQ ID NO: 6855211 - DNA, 84 bp, Homo sapiens
gtgcgtgtgcgtgtgtgtgtgtgtgtgtgtgtgttggggcattctgcacatgtgggtaagcacatgggcattctgcacatgtac

SEQ ID NO: 6855212 - DNA, 80 bp, Homo sapiens
tatgtgtgtgcatgtatgtaaatgtgagcgtgtacatatgtacatccatacatacagatatgcattcagaaatatacata

SEQ ID NO: 6855213 - DNA, 63 bp, Homo sapiens
gaggtcccaatagagtgctgtaagaatttagagaagagtcattacttttgcctatggagcctc

SEQ ID NO: 6855214 - DNA, 67 bp, Homo sapiens
ggctgtgtcggtgccacctgctatgcctgggcttggtgccacgtggcagtgccagctccgacaagcc

SEQ ID NO: 6855215 - DNA, 99 bp, Homo sapiens
aatagtaatgattatcatttgcaaagtgcttgcagagtattaagcatttgctaagtgctttacatacagcaacctttggagctgatttctattattatt

SEQ ID NO: 6855216 - DNA, 56 bp, Homo sapiens
gcctcaggcctatagctgctgtggccacaccttccgccagccatgcttgcctaggc

SEQ ID NO: 6855217 - DNA, 55 bp, Homo sapiens
gtctggctttgaaacttgctgcagatgagccacctgcagataattgaaagctgac

SEQ ID NO: 6855218 - DNA, 98 bp, Homo sapiens
ttccaattacactgcattgtaacaacatttgatttttagaaactattgagctttggaattcctgttgtttcgtcagtgtttgtaagtagtttatggaa

SEQ ID NO: 6855219 - DNA, 82 bp, Homo sapiens
ggagaagggtaagagttgaaggagattttcagtatcacacaatgtctgtctctgagcctcctccaactcatgcctgagctct

SEQ ID NO: 6855220 - DNA, 65 bp, Homo sapiens
ccactggattttcttactgtaggaggatctcctgatgcagtccagcaaagaactttcacatgtgg

SEQ ID NO: 6855221 - DNA, 71 bp, Homo sapiens
cttcactttgaaatgtgtaagagagagtttctgcaagtgttttgtgcagtcttcttacaaatttcaggaag

SEQ ID NO: 6855222 - DNA, 87 bp, Homo sapiens
tctgccaatctgttagagcttttcaacctttccttgtttttcctaacattgagagttttgaagagtatgtgtctggtttttggtaga

SEQ ID NO: 6855223 - DNA, 60 bp, Homo sapiens
ctatagttacaactgtttgaatgtcagagcatttgatgagtcaagacattgtagctgtgg

SEQ ID NO: 6855224 - DNA, 59 bp, Homo sapiens
agagtctggaagcgcttctaaactgaggcaaatgcagtttgtgggcgtttcctgatttt

SEQ ID NO: 6855225 - DNA, 86 bp, Homo sapiens
atgagcatttcataaaggctggctgctgtgagcatactaatgtgctatcccagctcccactttgatgagtaccacgtaatgttcat

SEQ ID NO: 6855226 - DNA, 59 bp, Homo sapiens
ggcaagctgtgctgacaagatcagaaggttactatcagaaccgtcagctccagtttgct

SEQ ID NO: 6855227 - DNA, 76 bp, Homo sapiens
tggtcagaatcccagatctttcccatcaagcacagaatttcccctgggtttgctgggcatgtcttaattcttccta

SEQ ID NO: 6855228 - DNA, 74 bp, Homo sapiens
gcatgtctgcgtgcatgtctgcgtgcatgtcagggtgcatgtccgggtgcatgtcggggtgcatgtcaggatgc

SEQ ID NO: 6855229 - DNA, 60 bp, Homo sapiens
gggaaatgtgggagagccagtggacattcagtgagtagtaaacagctctgccacaatccc

SEQ ID NO: 6855230 - DNA, 59 bp, Homo sapiens
tggctgatcaataggcttgaggaaactgacaaatacaataagatctgtttgatgagtca

SEQ ID NO: 6855231 - DNA, 76 bp, Homo sapiens
gctgacttgcacatttcacacaataggccttgttatcaagggtctgatcgtggtcaatgcaatttgcagtgttagc

SEQ ID NO: 6855232 - DNA, 80 bp, Homo sapiens
ccctcccctggctgtgttttcctccctggcgtttgttctcagcagaagtaagtaaggaaggcttaaagcgcgggggaggg

SEQ ID NO: 6855233 - DNA, 60 bp, Homo sapiens
tttgtgcaatggtgtttaggttttatggctatatatttgaagttctacaccattggcaaa

SEQ ID NO: 6855234 - DNA, 65 bp, Homo sapiens
ccagatctccgggggcccacgcagccccgcacgccagggctctgctggaagttctctggaaatgg

SEQ ID NO: 6855235 - DNA, 66 bp, Homo sapiens
ggctatgcttcaggagtaagggtaacccagaagtaaactagccttctccctagctctagcctggcc

SEQ ID NO: 6855236 - DNA, 67 bp, Homo sapiens
gcatcctgagtgaaatgaatgattacatggctttaatttgaaatacattcagcagtgctcatgatgc

SEQ ID NO: 6855237 - DNA, 70 bp, Homo sapiens
ccgggcgttggcatttgcctgtagtcctagctattcgggaggctgagggaggagaattgcttgaacccgg

SEQ ID NO: 6855238 - DNA, 67 bp, Homo sapiens
gctaatatgattccactattgtatgggagaggcatcatgtgaattagtgggaatcacctttattagt

SEQ ID NO: 6855239 - DNA, 61 bp, Homo sapiens
gcaagggtgcaggctgccaccttctgagttttatatcaaaacttctcagcctgcacctggc

SEQ ID NO: 6855240 - DNA, 66 bp, Homo sapiens
gcagagaggcagggaaactgctttaagacaaagcagggaagttggggtagtattatgtctctctgt

SEQ ID NO: 6855241 - DNA, 63 bp, Homo sapiens
agagggccagggcagcagcagaaatgaatgggaacatggacccagctgtgccctgctcctact

SEQ ID NO: 6855242 - DNA, 56 bp, Homo sapiens
gagtggtgttcattttcagaatggtctcccagaagatcttctgtgatacatcagtc

SEQ ID NO: 6855243 - DNA, 125 bp, Homo sapiens
gtggaagtgtagctatcctcattcccttgggagaggtatgtgtcagtgcttatatatattcaaaatgcaagtgtctttccatctactcattctaattctatgaattcacacagctgtacttttac

SEQ ID NO: 6855244 - DNA, 71 bp, Homo sapiens
acagaggctcagagttaggacccatgtagcagagatcagctttactgggaaaaactgctttgaggctctgt

SEQ ID NO: 6855245 - DNA, 66 bp, Homo sapiens
aagctgatttcaggaactacgagggggttatgatggttctacctcagaatagtcctcagatcactt

SEQ ID NO: 6855246 - DNA, 67 bp, Homo sapiens
taaaactctaaattacacagtgttgtgccatgagtttggtattgtaacaacaatagtttaggtttta

SEQ ID NO: 6855247 - DNA, 57 bp, Homo sapiens
tgtacagactttgcagtgtgcagagtcaaatctctcatatcctgtaactttgctgca

SEQ ID NO: 6855248 - DNA, 69 bp, Homo sapiens
gtgtgcctctcagctgttcacaatgcagaatcttgaaaaggtcaacatagtagcagtatgacaggccat

SEQ ID NO: 6855249 - DNA, 77 bp, Homo sapiens
gaggcaggagcgctgtgggtgggagggctgcttcctgggctctgagtacagcacggtgcatttactactcttgtctc

SEQ ID NO: 6855250 - DNA, 129 bp, Homo sapiens
tctgccttcccacacctgatccatggactgtgtctttccaggccagacctttcaatctttctctctgggaagatgggctctatgtctaggagatgccaatggagccgtgtgagcgagtgtgaatggagg

SEQ ID NO: 6855251 - DNA, 64 bp, Homo sapiens
agcagctcatctagctttgaggtatagatcaagaaagtcatccagagaggttaggtgacatgct

SEQ ID NO: 6855252 - DNA, 117 bp, Homo sapiens
tttagaatcagtgaataaaaacagcgaatataaacttttataaagctgcagatatgggttgaatctggatcaattctgttttgtaaaagtttataactatttgtcactgactttaaa

SEQ ID NO: 6855253 - DNA, 68 bp, Homo sapiens
tatttccacaccttttgaatctgggctggccttgtgacttgcctggactcttgaaggtggtgggagtg

SEQ ID NO: 6855254 - DNA, 57 bp, Homo sapiens
gcctagcaaatgagaggagaaaataagatgatcggctcttcctgacatatgcaaggc

SEQ ID NO: 6855255 - DNA, 103 bp, Homo sapiens
ctcggggaaaaagtataatcagtactgcatcttgtttaccaatctcttaaattaagtagacatacagaatctgcagacttacattgaaaacattttccaagag

SEQ ID NO: 6855256 - DNA, 65 bp, Homo sapiens
tggaaaagctgactgtactaaataaaggtggtcagttgcctttatctgatattcagcgatttcta

SEQ ID NO: 6855257 - DNA, 74 bp, Homo sapiens
gcatgagcagctgtctgggccaggcctggccgaagagccattcatccctgcactccagccagtaaatgctcagc

SEQ ID NO: 6855258 - DNA, 80 bp, Homo sapiens
tgggcaggaagatgaaaaggattggagatgttttcaagaatggttgaatagattcattctatttctccgtctcctcccca

SEQ ID NO: 6855259 - DNA, 64 bp, Homo sapiens
acagacctgggttggacactttgggcaggttatttatcctctctgtgccagtttccatgtctgt

SEQ ID NO: 6855260 - DNA, 76 bp, Homo sapiens
caactgtttgtccgtttcttcctggcaaagcaatcagagccccatgtcgggcctccaggaggaaatggaacacttg

SEQ ID NO: 6855261 - DNA, 78 bp, Homo sapiens
aaaatgtagattcctgggtccacccaaaatccacagaatcatgatctctggggaatgggcccttggaatctctatttt

SEQ ID NO: 6855262 - DNA, 67 bp, Homo sapiens
gtggggcaggagcacctgggccatccctggatcctctaggctggcttggctctcctgtggaccccat

SEQ ID NO: 6855263 - DNA, 61 bp, Homo sapiens
ccttcttctgtgtggcccaagatgactcaccaatatgtctgtattctacccagtgagaagg

SEQ ID NO: 6855264 - DNA, 87 bp, Homo sapiens
tcgtgtttcccttcattgctatttcatgttcctatggccgggttctccttgctgtctaccacatgaaatctgcagaagggaagaaga

SEQ ID NO: 6855265 - DNA, 57 bp, Homo sapiens
tggaatctaaaaacgggcttggttttttacctaaaatcagtcttgattagattcaca

SEQ ID NO: 6855266 - DNA, 62 bp, Homo sapiens
actgaggttggcagattcatttaataaatatcattctttatttggactgccagttcctgagt

SEQ ID NO: 6855267 - DNA, 77 bp, Homo sapiens
gttgtgctacatttgcatctcttggagaagtggctcttatacttgttcatgaggtagtaaatacacttgagcatcac

SEQ ID NO: 6855268 - DNA, 67 bp, Homo sapiens
ttttgtttcagaagtcaactaggtaaagaactacagtggttctcctgggatgacttttgaaatgaaa

SEQ ID NO: 6855269 - DNA, 58 bp, Homo sapiens
gcacactggagcctggaagattagtaaggctgtacttatgagttccagtccagggtgt

SEQ ID NO: 6855270 - DNA, 63 bp, Homo sapiens
acagaaaaggacggggacgcaagtcagcaagccaccaggcatgtgacttcacctgtctactgt

SEQ ID NO: 6855271 - DNA, 69 bp, Homo sapiens
ggtgagggtgggacagagggtatggtcagggcagccagtccctgctgtccctcagtcctgcctctcgcc

SEQ ID NO: 6855272 - DNA, 76 bp, Homo sapiens
ggctgggtatttgaaggagaattaataggcattggaattgaacattgcccctatataattttctttagatctagcc

SEQ ID NO: 6855273 - DNA, 69 bp, Homo sapiens
tttattgctgagaaggattccattgtatggatattccacattttgtttatccattctccggttaatgag

SEQ ID NO: 6855274 - DNA, 69 bp, Homo sapiens
tgaaagcaggcgggctactttagcatctgatgccagggatatgagagagtagcccagtgtgttcattca

SEQ ID NO: 6855275 - DNA, 61 bp, Homo sapiens
tggcaggaaagtaacagagcacagcggatggtacaataaagtgctagttaacttttagcca

SEQ ID NO: 6855276 - DNA, 69 bp, Homo sapiens
gggccaggcaaagcccatgcaagagtgtgtggaagtgagctggagccctcttcagggcttgtgtggccc

SEQ ID NO: 6855277 - DNA, 76 bp, Homo sapiens
tctgaaatgcatcctattttccaaggctgtgtgcttcgcagcagagcacttcagcccagaggaagggatgtccaga

SEQ ID NO: 6855278 - DNA, 77 bp, Homo sapiens
cttggggatattggtatgcaggtgactagctgaattcatttcatgaaggaagctccctgtatagagaatccctttag

SEQ ID NO: 6855279 - DNA, 62 bp, Homo sapiens
ggcctggccatttactctgtaagagtggtcaacttcacttccttccagcaaatggcatcacc

SEQ ID NO: 6855280 - DNA, 75 bp, Homo sapiens
ctgctgtcatgtctgaggtcattccaaggacatgggagactgctgtccatggttggatcctcttaacatcagcag

SEQ ID NO: 6855281 - DNA, 73 bp, Homo sapiens
gggcaggcacttgggtctgaaaatggtgaccaccagcaggttgctggcttctggccattcagcctcctgaccc

SEQ ID NO: 6855282 - DNA, 67 bp, Homo sapiens
ctgatttggtaagtatgaatgcagtagacaaaaatctctgttcttaaagcattcttgctaatgtcag

SEQ ID NO: 6855283 - DNA, 64 bp, Homo sapiens
tacaggtttaggcacaactactcagctagaacaagctctctgagggagatggcctgccattgtg

SEQ ID NO: 6855284 - DNA, 62 bp, Homo sapiens
gccttgccttcagtccatcagtcagtcagtcaacaaacgcccctcattgtgctgagcaaggt

SEQ ID NO: 6855285 - DNA, 62 bp, Homo sapiens
cttgccctgaccccattccctgtgaaagtttcagaggaccagaggcactggggataggtaag

SEQ ID NO: 6855286 - DNA, 121 bp, Homo sapiens
gaagctgtgcttgctttgaaagagctgtgctaagtatctgcagaatagctgctccaaaaatggaatctttattccaggtacttggtttctaatttttttttctcttgcaggtgtaaccttc

SEQ ID NO: 6855287 - DNA, 103 bp, Homo sapiens
gaacaagtttaaactgaaactgtgatggttactatgcttaatgtttttgtaggcatttcataaatattaggcaaggagattatttagtactcctgatttgttc

SEQ ID NO: 6855288 - DNA, 96 bp, Homo sapiens
ggggtgggaggggaagctggagggactttctcacggatggggccaggctgggccagcagggtgaggtagcccctccctgatccaatctcccagtcc

SEQ ID NO: 6855289 - DNA, 65 bp, Homo sapiens
gaaggagggaagcccagctgttcccactgttctcaccacatgggagcagcctgcctcccaccttc

SEQ ID NO: 6855290 - DNA, 57 bp, Homo sapiens
tgtcagtttcctgtgccctgctgtcccacagctgaagcaacaacaggatggcagaca

SEQ ID NO: 6855291 - DNA, 63 bp, Homo sapiens
ggggcccacggcggcccgggcgtcgcgctccacggcgcaggcgaaggcacgcgcgggggcctc

SEQ ID NO: 6855292 - DNA, 71 bp, Homo sapiens
gctattaattaacagtttatgatgtgcctcacactctgcagaggaagcactctataaaactgtcaggtagt

SEQ ID NO: 6855293 - DNA, 67 bp, Homo sapiens
ctctgacaagacagaccataactgctccaaaagggctattatactctagtctgttggtgattcagag

SEQ ID NO: 6855294 - DNA, 60 bp, Homo sapiens
ttagaaggtttccagtcatgctctttcatttttctgagcatttgctctggttccttctgg

SEQ ID NO: 6855295 - DNA, 92 bp, Homo sapiens
tgtgtcatgccaaattatatttccctttttgtttgtgtctagggagactagactggtgaattagggggaagtcgtagacctgtgtgatgaca

SEQ ID NO: 6855296 - DNA, 76 bp, Homo sapiens
gaaggggaggaggccagtggaaggaagcactgattcctctgggagtcctggcttctatcactgcttctgctctttc

SEQ ID NO: 6855297 - DNA, 60 bp, Homo sapiens
gaacactgagaggggagtggcaccttcccaggctgcccagctcagtctcttgccctgttc

SEQ ID NO: 6855298 - DNA, 130 bp, Homo sapiens
actgaataatattccattgtgtggatgcaacacagtttatcgattcacctaccgagggaaatcttggtcgatttcaggtttgggtaattatgaataaagttgctataaacatacatgtgaaggtttttgt

SEQ ID NO: 6855299 - DNA, 69 bp, Homo sapiens
ctcttcactcagctctctttggtctcctttgcttggctctggtaccaaatagttgggattactgaagag

SEQ ID NO: 6855300 - DNA, 130 bp, Homo sapiens
catttagctggatagtgcctgatgtttagcgttagtaggatagtacaagtgtggcttttataagtagacatttgcttttgtgccagcagcgtgacttgaacatagtagggacaaaagtatctgttgaatg

SEQ ID NO: 6855301 - DNA, 70 bp, Homo sapiens
tctcatgtttttcaaaagaagaatgcttgcacacaaataacacaggcaactcatcatgaaagacttgaga

SEQ ID NO: 6855302 - DNA, 71 bp, Homo sapiens
gagtcacagaataaattggtatcagagtctaattcagaaataatgtctgttctgataccatactctgtctc

SEQ ID NO: 6855303 - DNA, 84 bp, Homo sapiens
ttcatctatggcaaactacatttttgaaatattaattgtgttcagtcccaaatgagctgttgcagaattagtttgcctgatgga

SEQ ID NO: 6855304 - DNA, 73 bp, Homo sapiens
gtcaagaactgtgaagagtctgagatcttgctccacttgcaagctaataagttagacttttacagtttcatgc

SEQ ID NO: 6855305 - DNA, 77 bp, Homo sapiens
gtgaataggtctgtatcagtgtgttatcagtgctaggtgagatgatacactggcctttgcagagccctacccttcat

SEQ ID NO: 6855306 - DNA, 76 bp, Homo sapiens
ggggaaattacagattcaagctctttgaagatatttattccttcaaagttcttaatttgtgtttattcatttcccc

SEQ ID NO: 6855307 - DNA, 59 bp, Homo sapiens
ccctgtgctgggccctgagaccaggggcctctgccaccttcagaatgctccaggcaggg

SEQ ID NO: 6855308 - DNA, 60 bp, Homo sapiens
tgagatgggtcatcaggtttggttggcatttaaaacttccttcctccatgtcccatttca

SEQ ID NO: 6855309 - DNA, 77 bp, Homo sapiens
ggtgtggatgtctcagagacatcaggttgtagcagtgtctgaaatttgtttcctaagtgtctctgaagtccagcgct

SEQ ID NO: 6855310 - DNA, 88 bp, Homo sapiens
gatactgctactgtcaaacagctgctggataatcatcccaaaggagaagggagagatgttcattcagcatgttcagcagtgtggcttc

SEQ ID NO: 6855311 - DNA, 62 bp, Homo sapiens
aaactgtttaccatacacagtgactcgaggaggcaggagtcactgttagaagtgaattgttt

SEQ ID NO: 6855312 - DNA, 63 bp, Homo sapiens
tcagactgttctcttccacggcgctcggaggttttcatcctttgggacaagagatagctctga

SEQ ID NO: 6855313 - DNA, 122 bp, Homo sapiens
cccagaggaacgctggacaaagggcaaggtcgtctgcagagggtttgagcatcctggcagaaaggggcactgtcaggctgtcttcctccctcttgggcatcgttcttaccagtttccttggg

SEQ ID NO: 6855314 - DNA, 73 bp, Homo sapiens
ggccagcagcgggcgggggttcccaggtctacagctcctgtgagggccccaagaacctcctcctgcggcggcc

SEQ ID NO: 6855315 - DNA, 129 bp, Homo sapiens
ttgaagatgttatattaaaatatgccattgtaagttgaaacatttttgcataaatttttaaaattctcatattcagagaaagaagtatgtgagaaattatccataaagtggctgatatggcattctgaa

SEQ ID NO: 6855316 - DNA, 87 bp, Homo sapiens
ttttgtatatattcatgtgtctgtagcacatatgtatttgagcagaatatatctatatgtgcaaggcatgtgtatatatgtataaaa

SEQ ID NO: 6855317 - DNA, 84 bp, Homo sapiens
tcagcccctaaaagaaatcaagtcactgttaaatggtggagtatacattctgttagtgagtgacttgacacttgtgagggttga

SEQ ID NO: 6855318 - DNA, 98 bp, Homo sapiens
ccctgtcccagcttgagtacagtgcccggccagtgggcttggccagaagctacccacaaggctttgggcaccatctgaccacagtaggggcaacaggg

SEQ ID NO: 6855319 - DNA, 59 bp, Homo sapiens
gagccggctggtgccctcggggaggggcgggactctccccgcagggtcccagatggctc

SEQ ID NO: 6855320 - DNA, 56 bp, Homo sapiens
cagaaataaacttctcacatcgttagttcctgagattgtgtgagtgtttgtttctg

SEQ ID NO: 6855321 - DNA, 63 bp, Homo sapiens
aaggcagaagacaggcaaatcatggcttataaggttggtgggaggctgcctgtcatttggctt

SEQ ID NO: 6855322 - DNA, 124 bp, Homo sapiens
tgcatgatttgtagatgtaaatttgactttattatcattaactgttgaattatcaagtgtatgatgcagtgcaatcaagtttaacagcatggtgggtaagagcatctagattagaatcattgca

SEQ ID NO: 6855323 - DNA, 84 bp, Homo sapiens
gaagctctgcctctgagttagagatctagattgtttctctgcatcaaaaagcgactaggttttccagccagaagtggaggtttc

SEQ ID NO: 6855324 - DNA, 55 bp, Homo sapiens
gaggcctgggagcctgtcctccactgctggctggaagggcaggttggagggcctc

SEQ ID NO: 6855325 - DNA, 61 bp, Homo sapiens
tcctagggcttccctgggaggtgggctgggcccagcatccacctttggaaagaccctggga

SEQ ID NO: 6855326 - DNA, 105 bp, Homo sapiens
aaagttctcccctgttgatgttttagaactaagagttatcatttagctatcttcttcagctatcatttagctcttagttctagagtatcaacagaagagaacttt

SEQ ID NO: 6855327 - DNA, 66 bp, Homo sapiens
gggttgttctgggtttgctgatgttcaggttgtctctgaattacatggtgtgctgagaatgacacc

SEQ ID NO: 6855328 - DNA, 74 bp, Homo sapiens
attgctcaggaagaccaaactttggttataatagcttgctaaatgtgacagttagtttggtgttatgagtcaat

SEQ ID NO: 6855329 - DNA, 111 bp, Homo sapiens
atgctcatgtgacaatgaagacttctagttttgccttatcaacatcatgctactaaaattcatctatgttgttgagtatagctgcagttcatttatttttcactactgtat

SEQ ID NO: 6855330 - DNA, 74 bp, Homo sapiens
gccatcagagactgccatctccttgcattcctattgttcctagggtcaggagacactggcaacactctcttggt

SEQ ID NO: 6855331 - DNA, 58 bp, Homo sapiens
tgagacagggtcttgctctgttgcccaggctggagtgcagtggcaggatcttggctca

SEQ ID NO: 6855332 - DNA, 81 bp, Homo sapiens
aagttgtgcagagttgcctttatttatttagctttgtattagctgcttaagaaatgttggtaaaactttgaacatttactt

SEQ ID NO: 6855333 - DNA, 76 bp, Homo sapiens
ctccctcaatgccaccctgaccccacggctggagaaccctgtgcttatgtggtgggcagggccactgttgatggag

SEQ ID NO: 6855334 - DNA, 79 bp, Homo sapiens
cttttcaattatctttgtatgacctactacactaaaggcatcttgaagctatgtatggtttatagggaaattgtagaag

SEQ ID NO: 6855335 - DNA, 79 bp, Homo sapiens
gagcttatttttaagtctcaaaggtctgtagtctctctcacttactccagcattttgatacttgaaaattttaagtctc

SEQ ID NO: 6855336 - DNA, 64 bp, Homo sapiens
cagccgcagagcctcccttgccatttgcctcaagcccagggcagtgccaggagggctctggctg

SEQ ID NO: 6855337 - DNA, 69 bp, Homo sapiens
ttcaagctgctggatttactgagttttatcatattgaacgtgagaaaatccagaggctagtttcttgag

SEQ ID NO: 6855338 - DNA, 71 bp, Homo sapiens
gctgatctgggtgtggtatcttagccatgtgtagttatctctatctggcagatgcctcatttccagttggt

SEQ ID NO: 6855339 - DNA, 56 bp, Homo sapiens
atgctccagtacttagccttgcaaacctcaacatggcttctccaggtactgagcat

SEQ ID NO: 6855340 - DNA, 90 bp, Homo sapiens
ttccaaggtgaattcagaggtgggctgagaggatgtggggagaggcatcaacaaagtctgctgcagtcgtggctctaaacacccttggga

SEQ ID NO: 6855341 - DNA, 57 bp, Homo sapiens
ggtgggatggaggatcttagaccctccactggcccctgagacgaccccatcccgacc

SEQ ID NO: 6855342 - DNA, 81 bp, Homo sapiens
tagaggatcacatttgtgtcataagcaaatcctttataaatcatcaagagactgcatagatggccacaaagagattttgta

SEQ ID NO: 6855343 - DNA, 60 bp, Homo sapiens
catgtcaaagcagactgagagcggtaccaattatgagaccccagctgattttttgacgtg

SEQ ID NO: 6855344 - DNA, 78 bp, Homo sapiens
gcaagtgattgtcacgtcccttatgcctcttttggtcaaaagcaattcataacacagggacttgaccaattgtcttgt

SEQ ID NO: 6855345 - DNA, 55 bp, Homo sapiens
tgtttgcttggtcagtaagtagtaaagttgagacttggacacagacaggcagaca

SEQ ID NO: 6855346 - DNA, 76 bp, Homo sapiens
ctgaaaggaaataggttcactgtcttgaggagcaaaacatccttagttacccaagagtgaactttgagactttcag

SEQ ID NO: 6855347 - DNA, 76 bp, Homo sapiens
gggatgaggttcgatacagcgtatttattgcttgtcatgtaaattaaaaaccttgtatttaactcttttcaatcct

SEQ ID NO: 6855348 - DNA, 67 bp, Homo sapiens
atatgtgtatgatcagtgtgctccagctgttcttaatgggcagctttgcaggctggtcagtgcctgt

SEQ ID NO: 6855349 - DNA, 61 bp, Homo sapiens
gactgggctacgggatacttgtgtgatggttgacaagttgctacctctctgtgctccagtc

SEQ ID NO: 6855350 - DNA, 115 bp, Homo sapiens
gcatccttgactttgcctttatgaaggtgtataattaaggtaggtgatggaccatactctatgtaatgattagttaccttgatttaatcttttaaacagagagctcacaggatgc

SEQ ID NO: 6855351 - DNA, 65 bp, Homo sapiens
gcagcgacgctggctggttccctgctccaggcatgttcctccgcaggggaacctgctagagctgc

SEQ ID NO: 6855352 - DNA, 57 bp, Homo sapiens
gcgcgtatcgccgctctggatttaaggacaatactttcccctggcagccatgcgcgc

SEQ ID NO: 6855353 - DNA, 69 bp, Homo sapiens
ttagtggcaattataatagctgtgggaaataaaagtatgaaaaaatcttacttcctacagttctactga

SEQ ID NO: 6855354 - DNA, 62 bp, Homo sapiens
taacacagttctctgttgcacagaatttctaatgggtgaatggctacagagcaatttggtta

SEQ ID NO: 6855355 - DNA, 56 bp, Homo sapiens
cctgccagctgggtaccttcatctctaaccttctgataaagctgccctcaggcagg

SEQ ID NO: 6855356 - DNA, 79 bp, Homo sapiens
ggtgtttgcagtttatgttcctgcagtactgtgtacacacaactgaaaatcaataggaagttaatggaaagcaaatacc

SEQ ID NO: 6855357 - DNA, 80 bp, Homo sapiens
aattctgccatgggttatatcatcagctgaactcatagtgggtttgaaaaaggcctttggtatgttctcaggcctgaatt

SEQ ID NO: 6855358 - DNA, 94 bp, Homo sapiens
ggccatagccatgattgcttctagattgacagagagcacagcaagctctgctgtcaccacgtggctcttgttaatctgtacccatctatctgcc

SEQ ID NO: 6855359 - DNA, 72 bp, Homo sapiens
ttatttagagtctaatggtgaagataatcttaggtcataagatttgatttttttccaatagattttggatga

SEQ ID NO: 6855360 - DNA, 74 bp, Homo sapiens
agtgaataaattgaattgatatttcatctgagattgctcaatcagatgtaaaggcagactttaatttttgtact

SEQ ID NO: 6855361 - DNA, 59 bp, Homo sapiens
gaattatgggcttgtttggagactgggccgctcctgttcccaatcagtgccagtaaatc

SEQ ID NO: 6855362 - DNA, 102 bp, Homo sapiens
cttaaagttactaaagggcgtctaagtatgcaaatcgtcttagaatgcagggtaatggtcatttgaagacatttgaatactttcatccactgtgactctgag

SEQ ID NO: 6855363 - DNA, 64 bp, Homo sapiens
gttgttaaggccttggtaaattggcatttgagtcactcagcagaggccctgccaggagcccaac

SEQ ID NO: 6855364 - DNA, 114 bp, Homo sapiens
catctgatattttgtagttggtatacagcaaaagttaactaacagagtaattacagtcttattctgtgaacatggttaatctatttttttgatgccaatacaattaatcacatg

SEQ ID NO: 6855365 - DNA, 58 bp, Homo sapiens
gccaagtgcagtagaaagacccagtgaggtaagaactaagtcattcattaaacttggc

SEQ ID NO: 6855366 - DNA, 90 bp, Homo sapiens
tagtttagcaaatgcaattttagttttagcatccatgcttcatagtaaaggaatggatactcaaaggtagatggtacagatgttgagcta

SEQ ID NO: 6855367 - DNA, 60 bp, Homo sapiens
accacctgcttctgattctctaggaagactgctgagagtcaacatcgagccactggtggt

SEQ ID NO: 6855368 - DNA, 57 bp, Homo sapiens
actgccattttgaataattactgccaaaaatatgggcttaatcttcaacttggtagt

SEQ ID NO: 6855369 - DNA, 96 bp, Homo sapiens
ccttcacctacattcatatacagatatgttccatgcatcgctaattgatggttaatgctaagtgggagatgtctactgtggagcttttggagatgg

SEQ ID NO: 6855370 - DNA, 57 bp, Homo sapiens
catggctgtataaagttaaaggctttctacatgaatttaactttggatacagctttg

SEQ ID NO: 6855371 - DNA, 56 bp, Homo sapiens
ttgtgactttttcttgtttttggccaaaggcttttgcaaaagcaatgaagttatga

SEQ ID NO: 6855372 - DNA, 83 bp, Homo sapiens
agccttcactttacatttgatctctctaaagtttttgaaggtttcgagatgttctttatttggggagaaatgaaatgaagtct

SEQ ID NO: 6855373 - DNA, 66 bp, Homo sapiens
tcccccagtctgggcgtggtcaactttgctgtatgttcagggagacccagccacagcattgaggga

SEQ ID NO: 6855374 - DNA, 72 bp, Homo sapiens
gcttggtttccagctgcctcctatcatttccttgcttgctgtcccaagttgagatgtcataggagaccaagc

SEQ ID NO: 6855375 - DNA, 84 bp, Homo sapiens
aggagaccctgaggccgttggtgggccttacctgctgccttctctccctgccagggtcaggccagtcctattgcctcttctcct

SEQ ID NO: 6855376 - DNA, 129 bp, Homo sapiens
tcagttatgaggactttttctctgcccttcatcaacatgcagcctgtgaacagtgtctgggaaagtagtggtcattggttgcgtaatttgattttaggcttatggagaaaaggacccaagtgactctga

SEQ ID NO: 6855377 - DNA, 88 bp, Homo sapiens
cccccaccattccgggtttctccaatctctccaggggcctcagagaccccagacagaagaggaacttggacagaggcttgggtggggg

SEQ ID NO: 6855378 - DNA, 114 bp, Homo sapiens
tgtatcatttagctaagcatgtctgaagatattttctttaaccagcatgaactatgcattgtatgaaaggaaatatatcatgaaattgtattatgtgttatgctataatataca

SEQ ID NO: 6855379 - DNA, 61 bp, Homo sapiens
tctggccctcagactcatgggcacattcagaagtcttgcctactgagactgggtggccagg

SEQ ID NO: 6855380 - DNA, 63 bp, Homo sapiens
acatctgactcagttttctgccacaatctagagagaaagtttggctaaacttgggtcagatgt

SEQ ID NO: 6855381 - DNA, 64 bp, Homo sapiens
caggagcttctttagtcttgtcctggcacacccagcacatcagccactttgaatggagctcctg

SEQ ID NO: 6855382 - DNA, 57 bp, Homo sapiens
ggaatttgggtaccatgtttccatttcctgtttttcagaaaatgctgctcaaattcc

SEQ ID NO: 6855383 - DNA, 71 bp, Homo sapiens
tatatgtgtgtgtatacatacatacacacgtatgttatatatgtgtgcatgtgtgtgtacacatacatgta

SEQ ID NO: 6855384 - DNA, 130 bp, Homo sapiens
ctttgctggtcagatggcagaggcgggaacgtgcaggaatcaggatgctgtcagttaccagaccgtgcaagagctggtggacatggccctgacaggtcctgggcaagtcagccctgtctggctcccaagg

SEQ ID NO: 6855385 - DNA, 58 bp, Homo sapiens
tttgtcttccccctttaatcagtcataagtcctgtcattatccagtgggggagagaga

SEQ ID NO: 6855386 - DNA, 55 bp, Homo sapiens
acattgatgatcccacttacagtgggactaactgtatcccttgggttatttgtgt

SEQ ID NO: 6855387 - DNA, 59 bp, Homo sapiens
actggtgtatgtgctcaataagcatttgaatagtaaatgaatgaaccacatataacagt

SEQ ID NO: 6855388 - DNA, 67 bp, Homo sapiens
agtaggtttcctaggcttatacagctgttgagtggagaaatgggatatgggctcaggaactcgaact

SEQ ID NO: 6855389 - DNA, 57 bp, Homo sapiens
agagggcaatgttgctgttcagaatttcctcattctgttccccaggacctgttctct

SEQ ID NO: 6855390 - DNA, 59 bp, Homo sapiens
gttccagtcagggcaaactgccaagtgtgggaagagcttggtggtttgagggctggagc

SEQ ID NO: 6855391 - DNA, 58 bp, Homo sapiens
gaggccctaaaagactgtgctggcagctccaggaaaagctcagtgctttcattgcctc

SEQ ID NO: 6855392 - DNA, 98 bp, Homo sapiens
ctcccacatacgctggtgaaagggtggttttatcctcaggcaaagcttcctggattcagtgaaaacccctttcgaacatcagatggcatgtcacagag

SEQ ID NO: 6855393 - DNA, 62 bp, Homo sapiens
aggaaagtatactttgtggatgcacatcagaacattccgtgcctttacaattttgcattcct

SEQ ID NO: 6855394 - DNA, 78 bp, Homo sapiens
gtaaatgctcaataaatgttgctgttatttttaaaagaatacataaaaaggaaaaggatatatttattgagtatctac

SEQ ID NO: 6855395 - DNA, 87 bp, Homo sapiens
atttgactggttttgtatacaattcacacttcccagtggatgcataatggagaggtggttgtattgccactaagggattagtcaaat

SEQ ID NO: 6855396 - DNA, 68 bp, Homo sapiens
tgtctgttcctgcagcctcctccagctacgtgcagctcagctgccaccgcgaggctgcagagcgggca

SEQ ID NO: 6855397 - DNA, 59 bp, Homo sapiens
gtgagacactgactccaaaaataaagaattctcagaatttgagtctgtggtgtctacac

SEQ ID NO: 6855398 - DNA, 71 bp, Homo sapiens
gtaatcagcaaacattgattggacttaggattgccaagaatatcctgccaatttagggtttattgatttac

SEQ ID NO: 6855399 - DNA, 87 bp, Homo sapiens
ctggcaagagtaaaagtacaatctttctgtaaaggcaatttggaatgtgaatcaaaagccttaaaattgtgcttctctttgatccag

SEQ ID NO: 6855400 - DNA, 72 bp, Homo sapiens
ttttgtacttgaaacccagggccctggtggtctaggcacccaagggaatctcctggtcttcaggttgcaaaa

SEQ ID NO: 6855401 - DNA, 76 bp, Homo sapiens
taaggatatgagatttgggaggggccagggatggaataatatggtttgactctgtccccacccaaatctcatcttg

SEQ ID NO: 6855402 - DNA, 76 bp, Homo sapiens
gaagaagaagaatgggtttggtgagagggttccaatattaacaacccaacttcaagctcattcctctaacctcttc

SEQ ID NO: 6855403 - DNA, 83 bp, Homo sapiens
tgcatactgtgcgatgatattgcatttaggtgaattactcataatttagtagtttagaatgttgcaatacagcatattacaca

SEQ ID NO: 6855404 - DNA, 130 bp, Homo sapiens
gttgggggagggatggggcctggctcaaggcggagaagggggttgcagtctagggtctgcgggacgcctgggagtgtgcggccggggccctctctctgcaaatgggtctcccaagcccttgccccccagc

SEQ ID NO: 6855405 - DNA, 129 bp, Homo sapiens
tcagaaagggccaggaacttgctcaaggtcacatagtcctaatgccttggaattcaaaagccctgatggaattcagacctctgactccagggcattaagctcttgatcctggttctgctctgtctcata

SEQ ID NO: 6855406 - DNA, 84 bp, Homo sapiens
cctggggcagggatcggggaaaagggaggctgtggcccccttcacacctggcatattcctccttcccccgacatcccctccagg

SEQ ID NO: 6855407 - DNA, 66 bp, Homo sapiens
cagttccccttgaagactagaatgaggaatcacaagcgtggttttcatttgctgccttctgaactg

SEQ ID NO: 6855408 - DNA, 73 bp, Homo sapiens
gtctccccagtcccgcatggtccagaatgagatcccctacttcatctggaccactcggcgggatgtgctcgac

SEQ ID NO: 6855409 - DNA, 98 bp, Homo sapiens
tgccagtccgtttttaattatccacctttgcatgatttggattatcctagctcagctacttacaggtggctccactgatggaaaaatggaccaaggta

SEQ ID NO: 6855410 - DNA, 64 bp, Homo sapiens
agctcaggtttaagcgactggaatcattccaacatgattcctggtggcagaaacatgacaagct

SEQ ID NO: 6855411 - DNA, 70 bp, Homo sapiens
tagaagggtttggggtgaaatagacttactcaatcagagtatgtcttgttaatctgaagcaagttttcta

SEQ ID NO: 6855412 - DNA, 80 bp, Homo sapiens
acttattcacatgaaaacaaatttttagatttttacgtttgaatctgtctggtcagagttctgttttcttgttggtaagt

SEQ ID NO: 6855413 - DNA, 66 bp, Homo sapiens
gagacaagtttttgatagactagaaaattgtctcttaaggttcttgtcaggtcaaaaaccttgctc

SEQ ID NO: 6855414 - DNA, 111 bp, Homo sapiens
tgtaatagtaatatttaattctcacagcaacactctgagtatagaccactgacctcattttattgacaaggtggctaatgttcagagatgttaagcaacttactaaagaca

SEQ ID NO: 6855415 - DNA, 65 bp, Homo sapiens
aggacacagcctgtgaactgggggagccctgctactcaccagccactctcccagcacagcttcct

SEQ ID NO: 6855416 - DNA, 64 bp, Homo sapiens
cctgctgtcagtggggcaggcacaggctttttccagtcccaggctgccccctactggcagcagg

SEQ ID NO: 6855417 - DNA, 76 bp, Homo sapiens
ctccaaatgtctttcttctgctacgtggcttgtttaaacagcctccaaaaatgtgtagaaagaaagaaaaagggag

SEQ ID NO: 6855418 - DNA, 57 bp, Homo sapiens
cattttttggaggcactttgcagaattagggttctttgttatgtgcttcaagaagtg

SEQ ID NO: 6855419 - DNA, 65 bp, Homo sapiens
gcctgacttttcctgggtagctcctgggtcaaaatttcaggcaggatcccagggaaggggcaggc

SEQ ID NO: 6855420 - DNA, 57 bp, Homo sapiens
cagggttggcccctgaggaagagagcatctccttgcctccctcagtttccagccctg

SEQ ID NO: 6855421 - DNA, 68 bp, Homo sapiens
tccttgaatctgagctagatggagaatgtttcactgaagagaatcctatgtattgccagagccaggga

SEQ ID NO: 6855422 - DNA, 112 bp, Homo sapiens
tggttttcgtgttagtagagacgttgttgagaagtgtaggactggtgttcatgcagttatgtgctgtcatctaataccctctttatttcttattccctttcacgtaaaatca

SEQ ID NO: 6855423 - DNA, 78 bp, Homo sapiens
gcctcacccagacctttcccccaggtgtgtggtgcttacctgtccacagactggagtgagagaaataagtttggaggc

SEQ ID NO: 6855424 - DNA, 92 bp, Homo sapiens
ggctagaatataagcaggcagaaaaatgtgaaatgagagactggcctagtctcccagcctacatctttctcctgtgctggatgcttcttgcc

SEQ ID NO: 6855425 - DNA, 68 bp, Homo sapiens
gccaatgttttaaaagagattgagaatctggaattttatataattttttttaacttttagacattggc

SEQ ID NO: 6855426 - DNA, 89 bp, Homo sapiens
agaagtatcaaaatgagcctttctagatctcactgaatctctgaaaaggggaagtggtgttttctaagaaagtgtgatgatctacttct

SEQ ID NO: 6855427 - DNA, 73 bp, Homo sapiens
cggggcccagcactggctgggatcctgtccctgggcttgcttggggccaccctgatccccgccgtgggtcctg

SEQ ID NO: 6855428 - DNA, 56 bp, Homo sapiens
tctgtgttacccgccagggcctctttgttgaaaggggaggttacaggtgtcacaga

SEQ ID NO: 6855429 - DNA, 79 bp, Homo sapiens
gtgtagaaagatcggtgtgaaggggctggtccccgcgcttgagcccaggccagctgccctctgctggtccctcctacat

SEQ ID NO: 6855430 - DNA, 116 bp, Homo sapiens
atggggtctcatcttctgttggcttttcttaggtgtatgtcattagggaacactttacaacaaggcctggaatcccctaatagatcatatacaacaagtagagcctttggccctat

SEQ ID NO: 6855431 - DNA, 61 bp, Homo sapiens
gggcaggaggctaattctgcatactggatgcatgggccaggttcaggtgggtctcctgccc

SEQ ID NO: 6855432 - DNA, 71 bp, Homo sapiens
gagtagttgttttctggatatctattcctcatactaccatgaatagaagtctctcaagaaacatactgctt

SEQ ID NO: 6855433 - DNA, 73 bp, Homo sapiens
ggtgacatgaatagtaaaagatacagctaatgagaagcattggccacaagttattatactaaggacagttacc

SEQ ID NO: 6855434 - DNA, 85 bp, Homo sapiens
cccagtctttgctattgtgaataatgccgcaataaacatacgtgtgcatgtgtctttatagtagcatgatttatagtcctttggg

SEQ ID NO: 6855435 - DNA, 82 bp, Homo sapiens
ctgctttctgccatgtctgaggagcagctggcccgctacgaagtgtgtcgccggtcagctttcccaaaagcacgcattgcag

SEQ ID NO: 6855436 - DNA, 119 bp, Homo sapiens
tgggatttagtctcagttgtgtaatttaggggctgagtgacctcaggccaaacatctcatgtctttttgccttagtttattcatttgccaactaaatggcttgttaagacttcttccca

SEQ ID NO: 6855437 - DNA, 77 bp, Homo sapiens
tcgcttgaacccttggggtggaggttgcagtgagccgagagtgcgccactgcactccagcctggggtgacagagtga

SEQ ID NO: 6855438 - DNA, 111 bp, Homo sapiens
ttcagatttagcagcaggcagttttcaatttattagcatttcatttcaagaggaaggataaaacctccatgagatatactaataatcaaactgtgcatgcaggttgatgaa

SEQ ID NO: 6855439 - DNA, 59 bp, Homo sapiens
ccaagtatttgtcttgttggtctccaatcacgtcctggaaccgtagaggcagaatatgg

SEQ ID NO: 6855440 - DNA, 68 bp, Homo sapiens
tttcactgccagagactcttagcggccttcagttctcttgagctggagccactgggtcttgtatgaaa

SEQ ID NO: 6855441 - DNA, 78 bp, Homo sapiens
cccaggtgcagctgcaggagtcaggtccaggacccatgaggccctcagacactgccctccacctgtgctgtgtctggg

SEQ ID NO: 6855442 - DNA, 59 bp, Homo sapiens
cctcgtctgagccatcagagaacgtttctggaggaagtgatgctggttgagatctgagg

SEQ ID NO: 6855443 - DNA, 90 bp, Homo sapiens
tctttgtacgaattagatttcctggctaaacctgtgaaaaatctcatggtattaggaaatctgaatgttgtttctttgtattattcagga

SEQ ID NO: 6855444 - DNA, 75 bp, Homo sapiens
gtgcccacttggtaaagcacaatttcaccttcttgtaaaccacagggcagagtgaaatgctatgaatgtgggcac

SEQ ID NO: 6855445 - DNA, 117 bp, Homo sapiens
ggctcggaggcattcagtctttattcacaggctggagtgatgttgcggtggacttaatgccccctgagaggtctgacttcaagcctgtgggtgacacggagctactgtttttgagtt

SEQ ID NO: 6855446 - DNA, 56 bp, Homo sapiens
ggtgactcatgtgtgttttcaggtaggccactttacctctctggacattagtcatc

SEQ ID NO: 6855447 - DNA, 65 bp, Homo sapiens
tacgggtcctggtcacatatgttcattttgagaaaaatacattgaactgtgccctatgacttgta

SEQ ID NO: 6855448 - DNA, 70 bp, Homo sapiens
gtttggaatgagtcctgccattattgatgtatcataaatggtccaaggggctcaaaaaaactttccaaat

SEQ ID NO: 6855449 - DNA, 72 bp, Homo sapiens
ggtgcccagctgctgtctttgaatggatggaaacccaaccccattgtgcagggataatgcagctgcgacact

SEQ ID NO: 6855450 - DNA, 58 bp, Homo sapiens
taggggctgagggagaacagccagcaagaaattgaggcccttagccttatagcctcta

SEQ ID NO: 6855451 - DNA, 59 bp, Homo sapiens
gccaggtggacttgatttgaatactggctccactgtttttaggttgtgtccccttaggc

SEQ ID NO: 6855452 - DNA, 84 bp, Homo sapiens
ggagcttgggtttcacatacagtgtatagtagattatagcataccattttctgttcagtgcatatgtattgatttccaagttcc

SEQ ID NO: 6855453 - DNA, 88 bp, Homo sapiens
atgtggcctgtggggcagatgtctggacacctcatgctttccttgccttagctgaaaggttatttaggtctgcttgttcaggccacat

SEQ ID NO: 6855454 - DNA, 120 bp, Homo sapiens
ggctcagcaggctggtggcggcaggttcaggctctgtctggttccagacctgagggaacacaaagaggacccttaggatggtacaaggcaggggtccccagctcacctgcctggggggcc

SEQ ID NO: 6855455 - DNA, 64 bp, Homo sapiens
agaacttgggtgtgggggtgtggcctggggtgttagacccctcccaggttccgacgcctcttct

SEQ ID NO: 6855456 - DNA, 68 bp, Homo sapiens
gggtaacagggaggttgaaggtattggagttgagagacccaggctgtgcaaacttcaaatgattaccc

SEQ ID NO: 6855457 - DNA, 98 bp, Homo sapiens
cattcccagagagtttgttcatttatttctcttctctatattctcagaaattctttctgtctcagagatgttagggaagaggttggggcatgctgatg

SEQ ID NO: 6855458 - DNA, 129 bp, Homo sapiens
tgatcagacagtatctgttacgttttactcttgggatacaaattttaagagacactttggtaaattagacagtgtctagaaaaacaaagtatctgaaagagaagacagaagaaatgactgactagatta

SEQ ID NO: 6855459 - DNA, 55 bp, Homo sapiens
agtcctgtctctcccagggccactgtcttcagagcctctgggttggtgacaggct

SEQ ID NO: 6855460 - DNA, 60 bp, Homo sapiens
gttctttaggggcccaatttcctgctccttcaaccagaaagagagggcctctctaagagc

SEQ ID NO: 6855461 - DNA, 104 bp, Homo sapiens
aggatgaattcagggtaccagagcttagaggatatcatcagcctacaaatgacccttagcttaactctgtgtaggcctgtgaatcagctccttcctgtcatcct

SEQ ID NO: 6855462 - DNA, 99 bp, Homo sapiens
tttgagagcgtttggaaattggaagacttggtggcgaacgagggtcaggacctgcatcctgcctcagagttatcgacgtatccggaatgtgggatcaga

SEQ ID NO: 6855463 - DNA, 59 bp, Homo sapiens
gccttctctgtgagctcctaggagatcttcccatgacaatctaggggatagtgaagagc

SEQ ID NO: 6855464 - DNA, 81 bp, Homo sapiens
tttcttagcattttagtggtgtaggtctggaaggatccttcaaggggcatctaatccagtccagcatcgtgcttatagaga

SEQ ID NO: 6855465 - DNA, 77 bp, Homo sapiens
gcccgcaccagcttctctggccgcagtgtggagttgtgctgtgccagccgcaagcccaccatggccgaagcacgggc

SEQ ID NO: 6855466 - DNA, 57 bp, Homo sapiens
cttggtccgagggcgcctaggcagcagcaggtagttctgggccacccttggggcgag

SEQ ID NO: 6855467 - DNA, 59 bp, Homo sapiens
gttcagggagggacagatgaagggcgtaaatcatgatctgggaagtctggtccctgaac

SEQ ID NO: 6855468 - DNA, 87 bp, Homo sapiens
gctgtggtcagtttgtgctaggcactatttctcaatttccttggctggtcctcagagatactgttctggtttacaagtgtctgtagt

SEQ ID NO: 6855469 - DNA, 57 bp, Homo sapiens
ctctgggcaagtatgatagaaaacttttctttgtaaggccaaatctacttcccagag

SEQ ID NO: 6855470 - DNA, 63 bp, Homo sapiens
gggaggctggggggctggggctctggctgggcggcgcagggctccgggccaccggcctgtccc

SEQ ID NO: 6855471 - DNA, 77 bp, Homo sapiens
ctctggaaaacctctgggttccgtggtttggttagattaggaatttccagcatcatacatgatctaggggaccagag

SEQ ID NO: 6855472 - DNA, 92 bp, Homo sapiens
tggtttcgactaagataggaggggtggaaatagcaaaatggtagtgcttgcatgttgatttttctctccactccattaaatctagggaacca

SEQ ID NO: 6855473 - DNA, 72 bp, Homo sapiens
caacagatgatttatatttttctaaactcttttcattaaatggtttaagggagaatattgatggtcatggtg

SEQ ID NO: 6855474 - DNA, 62 bp, Homo sapiens
tgactggagttagttttcagaggttttatcatattttagatgaaacagcaacttcctagtca

SEQ ID NO: 6855475 - DNA, 76 bp, Homo sapiens
cagagtctgattttgacaactgtgcagtttgtattgaagggtacaagcccaatgacgttgtccggatcctgccctg

SEQ ID NO: 6855476 - DNA, 123 bp, Homo sapiens
gtgcacatgaacgtgagttgaaaatagccttcgttattgttgttgtaagccacctaaacttgggggtcatttgttactgcaacataatgtagtctaagctagctgatacacacacacatgcac

SEQ ID NO: 6855477 - DNA, 61 bp, Homo sapiens
gagaggtcttggctcctgtgtgcagctcatgctgagctatggaggcaagacatacagtctc

SEQ ID NO: 6855478 - DNA, 105 bp, Homo sapiens
cagcaaatgcatttcctacgcgccaggattgatgcagccagcatacagggagtcattcttcctgctgagaaatgcatccagttatggggaggaaggtgacagctg

SEQ ID NO: 6855479 - DNA, 63 bp, Homo sapiens
gaaactggctggttactatttctggtgacactcaaaggaagttgtgacagccaactgtgtttc

SEQ ID NO: 6855480 - DNA, 60 bp, Homo sapiens
tgtctaggttgcggttttatgtgttgttattaagacttgatgaagctgtagctttaggca

SEQ ID NO: 6855481 - DNA, 59 bp, Homo sapiens
agtcattcaggaatgcaggcagatgcagattcagattctgtcttatttaacacatgact

SEQ ID NO: 6855482 - DNA, 128 bp, Homo sapiens
gtctcagccagaaaactgttgggtgggttggctgtgacagagcatgtagtgacagcccctgtgtgggcgaggctgggggcaactgtaactgccacagcccagagcccctcagctctctccctagagat

SEQ ID NO: 6855483 - DNA, 62 bp, Homo sapiens
gccttgcttgcaaatactctgctgtttatccaccaacttaaactcctgagggcaggcagggc

SEQ ID NO: 6855484 - DNA, 114 bp, Homo sapiens
ccaaggagtttggttttgtttgggtttgttctaggtatggtcccagggatcccagatcaaaccaggcccctgggcctatcctagaaccaacctaagctcgcgcatcattcctgg

SEQ ID NO: 6855485 - DNA, 74 bp, Homo sapiens
tggggataagtaccactactgccttcaggctgatatgaaccctgaggttcatgaaggttagggaacttgctgca

SEQ ID NO: 6855486 - DNA, 76 bp, Homo sapiens
atcccagcacatcatgttaattcattacagagacagaacttctcaagcatactctgtaagcatgtgagcttgggat

SEQ ID NO: 6855487 - DNA, 55 bp, Homo sapiens
aggcccagagagatgaagtgatgggccaagggctcgcagctggctctgtgggttt

SEQ ID NO: 6855488 - DNA, 72 bp, Homo sapiens
aacaagccagctctgagttgaagtactcactggggcgaggggtgcttcatatttttagaactgagcactgtt

SEQ ID NO: 6855489 - DNA, 55 bp, Homo sapiens
tgagattaaaccaatcctgattcatcttctatggtcagagaatggcctactctca

SEQ ID NO: 6855490 - DNA, 60 bp, Homo sapiens
gaggctgagagtggatcccagggatggtcacgaacctccagagagccactttatagtttc

SEQ ID NO: 6855491 - DNA, 56 bp, Homo sapiens
aacattgattgcatctgttcactataattctcagtgggagggatggaaatgatgtt

SEQ ID NO: 6855492 - DNA, 129 bp, Homo sapiens
gctgactttcttcttccttcttgttgaatatctgtctggttgaggaatcaggaatccttccctgcttccttcttcaattagatagctattgcctctcctgccagccaaaggaagtagggatgttttggt

SEQ ID NO: 6855493 - DNA, 63 bp, Homo sapiens
cctttcttgatgaatgctaagaactagagtggggttcaggttttaaccattcacaagtgaagg

SEQ ID NO: 6855494 - DNA, 77 bp, Homo sapiens
tacatctgtctcctcatcgcctgttcactcactgagacacccgtaagtgccactacagagaggaggagagagctgtg

SEQ ID NO: 6855495 - DNA, 100 bp, Homo sapiens
tttgcctatcctcacctggagtggaatttttacctatgaatgattttgtagcatcatgcattcattattttaaaaatattgcttcactgagttatgcaaa

SEQ ID NO: 6855496 - DNA, 89 bp, Homo sapiens
tgtagcttttgttggtggtgttattttttggctttgtcatatcatttgtgaaagttaggatgtagtaattgacaagattaaaaggtaca

SEQ ID NO: 6855497 - DNA, 61 bp, Homo sapiens
tggatgtagatgctcttgctgagtctgttccgcaagagggaaagaaagggtagctgctcca

SEQ ID NO: 6855498 - DNA, 97 bp, Homo sapiens
gcactccatcagattcttattcagcaccacttccagagaagtaatgaggacaattaagcataacgttctgatttgggcataaggttctgatttgtgc

SEQ ID NO: 6855499 - DNA, 84 bp, Homo sapiens
tttaaagattagaagtctctgtcgtagatcagcgttttatagatgaggatacgctatcaatctagacaaagaagcttatttaaa

SEQ ID NO: 6855500 - DNA, 57 bp, Homo sapiens
agatggggctgaaagttccaatcctctaatcacatgatcggcaaccagcccccatct

SEQ ID NO: 6855501 - DNA, 55 bp, Homo sapiens
gtacatacgtagatccatcatttgaataagagggggattaattctatgtgtgtgc

SEQ ID NO: 6855502 - DNA, 74 bp, Homo sapiens
gggcacatttcagaccagaactggatggactcacctggctgggtaatttagacatttgtggtttgcaatgttcc

SEQ ID NO: 6855503 - DNA, 59 bp, Homo sapiens
ttgtgcagtggatgctttcacctgtccaaacagcaaaagcaagtctctacaaagtacaa

SEQ ID NO: 6855504 - DNA, 66 bp, Homo sapiens
ctgtatgtattagtttgcttgggctgacatagcagaatatcgtagcctgggtagcctaaataacag

SEQ ID NO: 6855505 - DNA, 83 bp, Homo sapiens
ctgactccttgagttacagctctccaagagaaatcatattttattcccttttcatgagagcacataattattttaggagtcag

SEQ ID NO: 6855506 - DNA, 120 bp, Homo sapiens
tgtgtgcatgcgagctgtgcagctcatgtgcacgtcctgtgtgagtgcaccacctgtgacattaactgggtgtgcagagacacagcgcacatgagggcctgcacaggccatgaccacaca

SEQ ID NO: 6855507 - DNA, 62 bp, Homo sapiens
tccactagatatggtattcacagcacctggtacattccagatgtttaatacatatttgtgga

SEQ ID NO: 6855508 - DNA, 75 bp, Homo sapiens
acgaggaaacgtttgcaaatactgagcacgcaatcaatactcgataatcggtggctgccagtattacctccttgt

SEQ ID NO: 6855509 - DNA, 56 bp, Homo sapiens
gggcatcagagattggagattggttcatccaacttcttcctctagatctgaggccc

SEQ ID NO: 6855510 - DNA, 55 bp, Homo sapiens
tctgtgctgtgaggctcttccagttcagtcactggataaagctgtgctgcatagg

SEQ ID NO: 6855511 - DNA, 84 bp, Homo sapiens
tttttagattccttttcttaaacatatgtggctatgagaaataaggaagtcagtaatttaagataaggaatgcatttttaagag

SEQ ID NO: 6855512 - DNA, 58 bp, Homo sapiens
gctcaaaacagcacctagcttcctatagtaccttattatttgctgacagtgctggagc

SEQ ID NO: 6855513 - DNA, 59 bp, Homo sapiens
gcagtaattcaagacccattgcactttgtagaagagtcccagggattttgacttgctgt

SEQ ID NO: 6855514 - DNA, 78 bp, Homo sapiens
tgtctaacattagaaactgtaaacacagcagtacaactagtgtttggagctgtctttatagtgttacagtgtcagaca

SEQ ID NO: 6855515 - DNA, 71 bp, Homo sapiens
gagatggtggttttcaccaggggtaagtgagggctgctgagatctctctgtcctgctgggtcaaccgtttt

SEQ ID NO: 6855516 - DNA, 70 bp, Homo sapiens
tgtggcatctagggtgactctggtatagccctatgcccagcagatctcagtgtctccctggattgccata

SEQ ID NO: 6855517 - DNA, 82 bp, Homo sapiens
tgtttcttgggtagatatgatgtgctatgtcactaggttaaattatttagatgttggttagcccatcaattccaagaataca

SEQ ID NO: 6855518 - DNA, 95 bp, Homo sapiens
gctgggactgattgcagtctttgaggaggtcctgggtttactcttcttgctgagatcccaccagatgttcttcattggactccattacaccaagc

SEQ ID NO: 6855519 - DNA, 70 bp, Homo sapiens
atgacccacaaacctattggcaagaataataaatgtttgttgtggcaggtcaatgggatttgtgtgttgt

SEQ ID NO: 6855520 - DNA, 59 bp, Homo sapiens
ggctctgggttctgcaatgcgtactacaggaatcattgaactacgcatgagcccgtgcc

SEQ ID NO: 6855521 - DNA, 59 bp, Homo sapiens
tctttcccagtgattaaggcagtggtgttgggcattggatgctgggcattggaggagga

SEQ ID NO: 6855522 - DNA, 84 bp, Homo sapiens
tgctgcagttatccatcagtcacactatagagcaggtcacgcataataaacagctgctttattaggttgatggagtatgcagca

SEQ ID NO: 6855523 - DNA, 63 bp, Homo sapiens
taacaagttctgacagcattgttaactgattaaaaatacctaataaggctgctggatttgtta

SEQ ID NO: 6855524 - DNA, 129 bp, Homo sapiens
ctgtctgtccctcgcctacctggggctgcttcctagagccggcagtgaggcggagcctgcaggacctagttcagttcttacagccactctgtgaagcaggctccaaggcagagggctgagggacaccag

SEQ ID NO: 6855525 - DNA, 68 bp, Homo sapiens
ctttgggctttggccaactcttcgctaatacagtttgctggcctgagtgaatagggccagaaccaaag

SEQ ID NO: 6855526 - DNA, 85 bp, Homo sapiens
agctttgcatggggagcttccttagcacttgacatgtgtgccttcctatgtggtcctaaggagagttctgtacatgcgctgagct

SEQ ID NO: 6855527 - DNA, 66 bp, Homo sapiens
tctcatgtgttgttagtaccagcagtccttaggggctgtggggaccaacaggactaaatcatgaga

SEQ ID NO: 6855528 - DNA, 73 bp, Homo sapiens
gggagtagtttctcatgctgtttcagtgctatcagctcacaaggaatctgcaaacaccacagagacaattccc

SEQ ID NO: 6855529 - DNA, 83 bp, Homo sapiens
atattctatgaagtgagttatggttgcttaaagggccacatcctaggagtcagaggctataactcaggtttgttagtgaatgt

SEQ ID NO: 6855530 - DNA, 59 bp, Homo sapiens
ggagagaggcatctgagtttgcaagcttggcaactaggtgaatggagatgcttttaact

SEQ ID NO: 6855531 - DNA, 73 bp, Homo sapiens
tggaggccaggaagcccaagatcagggtgctggcctgttcatttcctggtaagggctctctttctggcttgca

SEQ ID NO: 6855532 - DNA, 130 bp, Homo sapiens
gttcaacataaagaatgctccatcttgtttatttcattaaagatccttacagttttgactcatgtcttccaagacatgagtgtaacagtctttacgtgatagtgtgtttgcttcagtgttcttttttttc

SEQ ID NO: 6855533 - DNA, 82 bp, Homo sapiens
gcaggggcagctgaggccacgagtgaagggcctgctcatgggtagcccacgccccctcctcagggccctcagcagcccttgc

SEQ ID NO: 6855534 - DNA, 55 bp, Homo sapiens
gttcagtagacaaaggacacgttttgccttgggagaggtcactgtgtttctgagc

SEQ ID NO: 6855535 - DNA, 111 bp, Homo sapiens
cagtgctttaaggtctatgaagtgtgtttacaatagttccttcttttgttttactctggggggaagcagagaggatattattgtccacctgctttatggataaagacactg

SEQ ID NO: 6855536 - DNA, 100 bp, Homo sapiens
taatagagtaatggtgttgcaaataaagtccaaggaagctaaaaatatgcaaagcagtgccattgtaatgactttatatgtaacactactaattctatta

SEQ ID NO: 6855537 - DNA, 80 bp, Homo sapiens
atttcaagggtgtctgttgcttcaggaaacagtaacggagcaggccttgctggtggttcgagcaacacccaccccgaaat

SEQ ID NO: 6855538 - DNA, 60 bp, Homo sapiens
gggaatgggaggtggcctgtctctgtctctgcgtggagagacactgccacttctgttccc

SEQ ID NO: 6855539 - DNA, 70 bp, Homo sapiens
gcagtggtccagttcacacccatgttggtccctggccacctgtgctgtgtgggtgttctggcccagctgc

SEQ ID NO: 6855540 - DNA, 63 bp, Homo sapiens
gttgcagatactgaagcacagggattaagcaaaatgcctaagatcatgctgccagtatgtagc

SEQ ID NO: 6855541 - DNA, 82 bp, Homo sapiens
ctgatagcataactaaaggccatgatggaggatcagtatccacgttgcttgttccttctggcttttacatctatgatagcag

SEQ ID NO: 6855542 - DNA, 66 bp, Homo sapiens
tgtgaatctgtactctagagtttttcaaggggcagcccaagcatcttaaaaagtatcagattctca

SEQ ID NO: 6855543 - DNA, 76 bp, Homo sapiens
ccacccagaaagccacagtcccaggcagagtcaggagggccagattttaaagaagttgcctgggctgtcctggggg

SEQ ID NO: 6855544 - DNA, 56 bp, Homo sapiens
agccacctcacctgctgccgttgtcatatggcccagaaaccacaggaaggtgggct

SEQ ID NO: 6855545 - DNA, 80 bp, Homo sapiens
catagttagtggttcagagcaaggaccctggagccagactaaccagcttgaatcttgattctgatcctttgctagctgtg

SEQ ID NO: 6855546 - DNA, 71 bp, Homo sapiens
agagtttcagacctagacatcaaggcatcaagaggccatgaggcttctgttttcatttgtcttgagactct

SEQ ID NO: 6855547 - DNA, 66 bp, Homo sapiens
cctccatcaccatctgccctcaccccaagcgcattccaaggtgacggtgcactcggtaatggcagg

SEQ ID NO: 6855548 - DNA, 59 bp, Homo sapiens
ctaagatttcagactctgtggttatggattataaacatgagtcacagtatcagtcttag

SEQ ID NO: 6855549 - DNA, 71 bp, Homo sapiens
gaaatctgatacccattccttgtgttcagtcagctggtgctgattctggggctggatgggtgtcaggggtc

SEQ ID NO: 6855550 - DNA, 70 bp, Homo sapiens
agcggtgccgggagccttggagaagcagtgctgcctggctgctgcagctcctctggctgcctgagctgct

SEQ ID NO: 6855551 - DNA, 76 bp, Homo sapiens
agtgctcaagttgttcatcttattctgtaggtttctctttccttggcttattgatatgcagaactgacttggtact

SEQ ID NO: 6855552 - DNA, 82 bp, Homo sapiens
aaactccaaattatgccatcatgtggactcacaaaagattgtgttcaggcttccactgtatgtctcatgtgttttggagttt

SEQ ID NO: 6855553 - DNA, 71 bp, Homo sapiens
tacattgtaacatttgtgttgaactgccccacacagcatactaatgtaggggtgtaacacacatacttgta

SEQ ID NO: 6855554 - DNA, 62 bp, Homo sapiens
tcatatttctgtgttgactgtgtgtcacagaggactgacccacagtcaatgtagaaatatga

SEQ ID NO: 6855555 - DNA, 79 bp, Homo sapiens
ttgggaactgctgttctggagacactgatgaagctggtggcaatagacagttcatgaggtctaagccagaatttgccaa

SEQ ID NO: 6855556 - DNA, 77 bp, Homo sapiens
cttcatttatcatttatctgatcatttgacaagtatttattgaatgcctgttaagggtgtagatatatgtggtgagg

SEQ ID NO: 6855557 - DNA, 59 bp, Homo sapiens
tcctggagcctcattcaaacacaataaacattcagttgacttgttatgagactctagga

SEQ ID NO: 6855558 - DNA, 115 bp, Homo sapiens
cttggtgaaaattttactgcttggaatccagtgattgtgaaaacattaagaagcaccaatgttttcataatgtcacagtcaaaacaattctcaggcgatgagttctaccaccaag

SEQ ID NO: 6855559 - DNA, 103 bp, Homo sapiens
gctatataaaaagaggaagcgcctagagccctgtggactgtcaagttttataaagagaactgggcatcccatggcagagccttggtgctcccagaaatgtggt

SEQ ID NO: 6855560 - DNA, 73 bp, Homo sapiens
gaatatagtcttaagtagtagactcttgttttaattaataaagctacgagttaaatagcttaggattcatttc

SEQ ID NO: 6855561 - DNA, 91 bp, Homo sapiens
gggaagatcagcaagaaaggtactccagattttgcattagattaagtcagagttctgaattctgatccagaacctgtcactcttgtttcct

SEQ ID NO: 6855562 - DNA, 83 bp, Homo sapiens
cagtgggcactaaaatactgtctttcacagatatttcgccttggaaatttcatggaaagttagtagagtgatgctaccaactg

SEQ ID NO: 6855563 - DNA, 129 bp, Homo sapiens
tcacttttggttccttggtttgcgattattttccccctttttgtgcggactgtgccctcgctgctctcactgccctcaccttgagggggaaaataatccggagttgggtaaaaaagaaaaagaaagaga

SEQ ID NO: 6855564 - DNA, 66 bp, Homo sapiens
taccatccaaactctcattatctgtaccgaaaagatatggacacatgttttgagttagggctggta

SEQ ID NO: 6855565 - DNA, 91 bp, Homo sapiens
gggcaagtggagtgagaagggaagtatttctgacagcttgccagcaggaatcttctggcaaactggaggaagccctgtgctgagcttgcct

SEQ ID NO: 6855566 - DNA, 69 bp, Homo sapiens
attgtgaatttaactgagagtacttttaaaactataactaagcagtgaaaggaaagttgaattgacagt

SEQ ID NO: 6855567 - DNA, 101 bp, Homo sapiens
gggcagcaaggagccaggggcactgcttttcagagtctgcctggccatcggggcaggcgagggccctgaggagccctgaggagccctgaggagccctgctc

SEQ ID NO: 6855568 - DNA, 71 bp, Homo sapiens
gagataatgtacacatcccagactcccaggaactggaaggaggccatcctgggagagtgggactgtatctc

SEQ ID NO: 6855569 - DNA, 59 bp, Homo sapiens
gcccccagcgctgggcctgtagggtgtgctcctgggatcaggccccaggcctggggtgc

SEQ ID NO: 6855570 - DNA, 57 bp, Homo sapiens
gaggaacagagggcaaggccagggctcatgtgctgacacctttttccttctttcctc

SEQ ID NO: 6855571 - DNA, 70 bp, Homo sapiens
gggaatctgttctccccatttccaaaccatgacatgaatgggtgctgacatgtggagagaacagatatct

SEQ ID NO: 6855572 - DNA, 60 bp, Homo sapiens
cagttaagacctggtgtgtcatatgtatcccaaccccttatgtgaacacttacttggctg

SEQ ID NO: 6855573 - DNA, 67 bp, Homo sapiens
tagaggcttcagttgtaccttcttgctgtgatacaaattgtctgaatgtatcgaattgaggctgctg

SEQ ID NO: 6855574 - DNA, 64 bp, Homo sapiens
gttgctatcagggttggatttagcaacttggcattcacttggtaggaccacccctgttggcagc

SEQ ID NO: 6855575 - DNA, 61 bp, Homo sapiens
tcttgggtcatgatcacagctagtgctaaaccactccatgctgcctgatcatacaccaggg

SEQ ID NO: 6855576 - DNA, 75 bp, Homo sapiens
gcccaatgccccaactcctccccagcatgccaagcctctggggttggtgcatggggcgggagtaggggaaagggc

SEQ ID NO: 6855577 - DNA, 87 bp, Homo sapiens
gctcttagttgtattaagtttggcatatactgtgtaaatactctgtgaccaactagtgtttacagagtagtggaaagcttaaagagc

SEQ ID NO: 6855578 - DNA, 61 bp, Homo sapiens
ttgctcagtgtcttttttggagggcgtgccatgcgatactgcctctccttcacttgagcaa

SEQ ID NO: 6855579 - DNA, 81 bp, Homo sapiens
catgagcacgttcatgtgtgcatctgtgtgtgtgtgtgtgtgtgtgtgcatgcacacctgtgcacatttgtatgtgtggtg

SEQ ID NO: 6855580 - DNA, 62 bp, Homo sapiens
tgctacacttaaatcagtcacccagtgttagagtctgggtagttggaaatgcaagtggagca

SEQ ID NO: 6855581 - DNA, 130 bp, Homo sapiens
gccttcaccttcattggctgccggtcctgccactccagaccctgctctggggctctgcctttcgccgcaggttctcccgcagagggggtcattggtctgggaaggagattgaagagtgggggttggaggc

SEQ ID NO: 6855582 - DNA, 72 bp, Homo sapiens
tgacagccttatgaggcaagtcaatttcttactacttccatcacttaagagattgtgttcataggcatgtta

SEQ ID NO: 6855583 - DNA, 69 bp, Homo sapiens
ctcatatttatctcatgcttagtaatttgtcttcccgaggaaatgtctgtctcatgaggaaaacatggg

SEQ ID NO: 6855584 - DNA, 80 bp, Homo sapiens
acattcaagttcatgtgtagtcagtgccgaaatggagacatgaggtcttaaactgggatgcatgaaatccttgaaattgt

SEQ ID NO: 6855585 - DNA, 57 bp, Homo sapiens
tctccctactgactccaggaccgtaaccaaagcaaaggttcttcagccaagaggaga

SEQ ID NO: 6855586 - DNA, 69 bp, Homo sapiens
gatcaatttggtgtgttccaggaactgaacgaagtccagtatggtgaggaacccaacgcaaagtagatt

SEQ ID NO: 6855587 - DNA, 68 bp, Homo sapiens
gccccggaaggcccagcccgtcctcgtgctgtctccggccggtgctcgtgctgaggctctcctcgggc

SEQ ID NO: 6855588 - DNA, 72 bp, Homo sapiens
tacctgttaaggatctgggagggaaacttgccctgtgttaaagtgttcaatccccaggtcctgaattctgtg

SEQ ID NO: 6855589 - DNA, 65 bp, Homo sapiens
tcttgcatcctcttagctgaaggttcctttaactggagtcttcacttagctgaggggactgaaga

SEQ ID NO: 6855590 - DNA, 61 bp, Homo sapiens
ttccctttccttcctcttgccagtatagaaactggctggatttttggaaggagagcaggaa

SEQ ID NO: 6855591 - DNA, 78 bp, Homo sapiens
ggcacgcaattcaaatttgttccacctgatattctgtgaccagaaactattatggtaaacaaaattttttggtgtgtc

SEQ ID NO: 6855592 - DNA, 115 bp, Homo sapiens
aaagccaatgacatttcacagaaatatagttctagaaatattttatttcccattaagttactagtgaaaatattcctgaggtatatgggtagctgttgaaatgtcatttggcttt

SEQ ID NO: 6855593 - DNA, 60 bp, Homo sapiens
tggttggtgtgaggtttcttagtgtgatgcatacaagattaaaacttataccatgcacca

SEQ ID NO: 6855594 - DNA, 119 bp, Homo sapiens
ttaacatagttattttgatgaattttttaagaagtgattttcctcattctgtactttcttccaaagagtgaaaaagaaatcgattttgctgagtttttggaataaatcaaatatgttag

SEQ ID NO: 6855595 - DNA, 64 bp, Homo sapiens
caaggttattatgtgcatctgttatttttccaatacatgtaaacagttgcagcatgatgctttg

SEQ ID NO: 6855596 - DNA, 69 bp, Homo sapiens
gcaagtcttgtcattttatcgataggatactttttagtatttgatcattagaatgattctttgaattgc

SEQ ID NO: 6855597 - DNA, 59 bp, Homo sapiens
ggctcacgcaattatcccggcctcagcctcccaagtggctgggattacaggtgtaagcc

SEQ ID NO: 6855598 - DNA, 63 bp, Homo sapiens
gggcagcatctcattcattcatgttcagcaccagcatgaacctggcacagaggagatgctcct

SEQ ID NO: 6855599 - DNA, 65 bp, Homo sapiens
ggaggtgaaactgtttagtttttgcaggtagaattctaagtctgtagaaaaacagtttaatttcc

SEQ ID NO: 6855600 - DNA, 80 bp, Homo sapiens
tcttctgcatctcacagccagtgctcattgtcagccaattccatgccaggcactgcacctggctctgagatctggaatga

SEQ ID NO: 6855601 - DNA, 59 bp, Homo sapiens
gtggccagtggtgggcgccctgggctgtatgtccccatctgtgtctgcctttgtgccac

SEQ ID NO: 6855602 - DNA, 66 bp, Homo sapiens
atgtggattatacttacagaagctgtttggaaaccttcttagcagtttgaaagtatgagtccatat

SEQ ID NO: 6855603 - DNA, 88 bp, Homo sapiens
ggccatacggttcctgtcacgatgactgcactctgccattgtagagtgaaggcagccatggacagtatataaatgaatgagtgtggct

SEQ ID NO: 6855604 - DNA, 64 bp, Homo sapiens
gatgctgagagattggagactagtttcattcttctgtatgtggatatccagttttcccagcatc

SEQ ID NO: 6855605 - DNA, 126 bp, Homo sapiens
gcacagcgctgtgtgacttttgtcacttttcatgatgtataagcacagctgccttttttaggaatcgtgagctggagtcgtgagcaaagtgttgcaggagtagcatttttcaggagagtgaggtgc

SEQ ID NO: 6855606 - DNA, 86 bp, Homo sapiens
ttttttggcacatagtagaaatatttatctctgagagtccacagatttcattactccttaggctagtttctgttgtagccacagaa

SEQ ID NO: 6855607 - DNA, 74 bp, Homo sapiens
ggatgtgggtggttttggaggccactgtttggcccactataggatataaataaaggtctttagtgcaaacatcc

SEQ ID NO: 6855608 - DNA, 76 bp, Homo sapiens
cagtttgtaattggatgatgtagacaaaaatatgctttaccctaggggtatatacattgtctgcttctacaatctg

SEQ ID NO: 6855609 - DNA, 58 bp, Homo sapiens
gtgtttgtgtgggagttcagttcaacaacttgttaagcacctactccataccaggcac

SEQ ID NO: 6855610 - DNA, 85 bp, Homo sapiens
ctctgcctactcagtcacagcccatctacagttggcttggtctttagtgacaaggctgctgtgattgggaacttgtatggcaggg

SEQ ID NO: 6855611 - DNA, 63 bp, Homo sapiens
catccatagcctcaataaatagctaaaatctgattctttgctgttattccaggctgatgggtg

SEQ ID NO: 6855612 - DNA, 76 bp, Homo sapiens
tccagagcataagagaaagctgggggccctggtctagggctctcctccagaatcagctcccagcttcctctctgga

SEQ ID NO: 6855613 - DNA, 75 bp, Homo sapiens
tgttatttcctttgattcagtgtgagtatattacatgaacattttattcacactgtatacacaggatgtcaaaca

SEQ ID NO: 6855614 - DNA, 75 bp, Homo sapiens
cacagtgtcaggcagctgaggactttgctaacatgtcctgtcctcgttcacagagtccttggctccgtcattgtg

SEQ ID NO: 6855615 - DNA, 86 bp, Homo sapiens
gggccattttcacttcttttgtcatttttcagttacttcaggccatctggatgtatacgtgcaggtcacaggagatatgatggctt

SEQ ID NO: 6855616 - DNA, 66 bp, Homo sapiens
gcctcctctgtcacttgtatgtctataattcatcaactaaatggctttggtggcggggatggaggt

SEQ ID NO: 6855617 - DNA, 85 bp, Homo sapiens
gtcttgctcacaaaactatttttggagctaactctcttatagaaaatcatcaaaaagggttttatccaaaatgtttcagtaggat

SEQ ID NO: 6855618 - DNA, 115 bp, Homo sapiens
gttacatataaatagcttaacctcttctcttacatgtgagttatatttgcgatattggagaactccagggtaggttgaatgtgatacacatggggtgagccttaaagatattaat

SEQ ID NO: 6855619 - DNA, 60 bp, Homo sapiens
ggggattgggaaatgtggaaaacagtcattgtggctgacatcattgtgttgccaattccc

SEQ ID NO: 6855620 - DNA, 62 bp, Homo sapiens
ttaccctgggcttggcctgctcagccggtctgggcttcctgggcaaacacaactcagggtga

SEQ ID NO: 6855621 - DNA, 60 bp, Homo sapiens
gcagagctcaaggtgttcagctttcttttcactctgagctatgttcactgagagttctgc

SEQ ID NO: 6855622 - DNA, 87 bp, Homo sapiens
ctctgggatttggcgcgcaccattggaattatttaacagcactaggaggtgatgttgggatcgaatggtggaacgttggacttgggg

SEQ ID NO: 6855623 - DNA, 61 bp, Homo sapiens
caggaaatggggtttagttattaagcttgcgtagattgcttgatatactgaatatttcttg

SEQ ID NO: 6855624 - DNA, 75 bp, Homo sapiens
gtgacatttttccttttaaataaatgtctttacatttttaaaagtgaattgatttaaggggaaaaaagagttcac

SEQ ID NO: 6855625 - DNA, 58 bp, Homo sapiens
agctggtgagggttgaggggtagcaagcgggggtctctaggcctcatcctctccagct

SEQ ID NO: 6855626 - DNA, 75 bp, Homo sapiens
tctggaggctgagagctctaagatcaaagccagcagatttggtgtctggtgagggctccatctttgcttccaaga

SEQ ID NO: 6855627 - DNA, 65 bp, Homo sapiens
ggccctgtggttttgcaaagtcccttgatgtttttgggttccattctcagtaaaagcacagggtc

SEQ ID NO: 6855628 - DNA, 56 bp, Homo sapiens
tctatgtctcgacccaagacaactatgtcacactatgtcttgggtcgagacataga

SEQ ID NO: 6855629 - DNA, 88 bp, Homo sapiens
aggagcagaagatgttaagaaggaattgaagtttaggccatacggggaggtgctcatctgttttaactgtatttgtcttctggcccct

SEQ ID NO: 6855630 - DNA, 67 bp, Homo sapiens
gcagctgcaggtggtcccatgccctgtgccagactgtgttgaggcatggggaggcctggaggcttgc

SEQ ID NO: 6855631 - DNA, 96 bp, Homo sapiens
ctgaatccagctggcaggtgaggcatgtgcctggagaactgtaagaacattggggcttcatgcctcactttacaaggcagcaaatggaggccacag

SEQ ID NO: 6855632 - DNA, 80 bp, Homo sapiens
agcttgacagaaatcactgtacccatttaaataaattcaaagcagagaatatgctaagtgtgcagtaacgactacaagct

SEQ ID NO: 6855633 - DNA, 58 bp, Homo sapiens
ccaaatacaattcctgagaatacttgttttggaagccttgtgtttcaggagttcttgg

SEQ ID NO: 6855634 - DNA, 81 bp, Homo sapiens
ttcttcatggcagtggaatgggatgagttgatactgtaatctcttaactcatacatgcctttccagccattgtctggagga

SEQ ID NO: 6855635 - DNA, 69 bp, Homo sapiens
gagccctgctggcggggaactgatgactcctcgttggtacggtcgtctgccctgtccaacgtggggttc

SEQ ID NO: 6855636 - DNA, 82 bp, Homo sapiens
cttgcatgaggtgggggcatggcttagctggggtcagactgcccaggttctaatctggctgtgtcccgggctctcaggcaag

SEQ ID NO: 6855637 - DNA, 59 bp, Homo sapiens
gtaaaaggattagcaggatgggctcagtgggaaaggaggcccctgtgggatcctgttac

SEQ ID NO: 6855638 - DNA, 65 bp, Homo sapiens
tcaagccttggtagggtctggagtcagactcagccaccactgacctagcccctactccaagttga

SEQ ID NO: 6855639 - DNA, 86 bp, Homo sapiens
gggctcaatgactgtcttttcactgcttgattgacatgcacgcttgcagggtgtcgcctggggacaagcagtgagcgaggcggccc

SEQ ID NO: 6855640 - DNA, 56 bp, Homo sapiens
gggctctgtttagaccagagatcagcaaactatggtccgtgggccaaatacagccc

SEQ ID NO: 6855641 - DNA, 68 bp, Homo sapiens
ggggagcgcgggctgatctgctccacgtgctggcaacagagcctgtgggagatgcagctcctgccccc

SEQ ID NO: 6855642 - DNA, 126 bp, Homo sapiens
ttcccataacaagatgttcatctctggaggctatcccggagagccaactgcacataaatccattctaattaaatatgccactctccaggggtagatgccttcgttacaggacttatttcaggggaa

SEQ ID NO: 6855643 - DNA, 61 bp, Homo sapiens
tagtggagagttgttttgtgcattgtggaatatttagcacatcactgagctctgttcacta

SEQ ID NO: 6855644 - DNA, 58 bp, Homo sapiens
tctcagaacgtagtatctgtggccatggaaactaatggacaaacaggtaccttctgga

SEQ ID NO: 6855645 - DNA, 90 bp, Homo sapiens
tgaggtcaattctgtaggtagaaaatgagcatattgatcctttgttagtaccttatgataagagggtcctctcaactatcacaaatctca

SEQ ID NO: 6855646 - DNA, 66 bp, Homo sapiens
tccaaagaatcttgctttcatggaagtcttgggaaatgccaatacttctttaagagtaagtctgga

SEQ ID NO: 6855647 - DNA, 64 bp, Homo sapiens
gacccggccataccctcccctgtgtcacgtgctgctcacagcagttgacggatggtgctgggtc

SEQ ID NO: 6855648 - DNA, 92 bp, Homo sapiens
cggcccctgaggggcgctactttgcggcgcggaggagcatcgtggcggcgatgcgtcccccgttggtcgttgagcctgcctctgattggctg

SEQ ID NO: 6855649 - DNA, 85 bp, Homo sapiens
tggaatgtgcctatgcctgttaatgtcttatgctatttatagcttgttcttgcataatacatgtaactgcattgtaatcatttta

SEQ ID NO: 6855650 - DNA, 65 bp, Homo sapiens
ttctagaagggcctaggcataaggtatggtttgggaaattgccttggccaaggacctttttggag

SEQ ID NO: 6855651 - DNA, 56 bp, Homo sapiens
gggatctgatgcactgctgaaaatgaggtcagatagctaagggtagcaaagatcct

SEQ ID NO: 6855652 - DNA, 89 bp, Homo sapiens
ggctgccagagggtcctgggcacagggcaggccgggcttcctcagggaccccgcccttggcctctttggcccggcggaagatgtcagcc

SEQ ID NO: 6855653 - DNA, 58 bp, Homo sapiens
tggttgtggtcctccacatcgctgctgttgtagcaggggtgtgggatggactgaacca

SEQ ID NO: 6855654 - DNA, 74 bp, Homo sapiens
attcatactagattatgagttatcaatctctgaattatcggatattgatggtgcttatagtcatgggaatggat

SEQ ID NO: 6855655 - DNA, 56 bp, Homo sapiens
ctttcctcccaactcaggccctactcatgcttagccgcctgaggtggggtggaagg

SEQ ID NO: 6855656 - DNA, 65 bp, Homo sapiens
gctgtatatctttcttctagtttggagaagccagtggggtcatctagaaaatgaaagaatgcagt

SEQ ID NO: 6855657 - DNA, 68 bp, Homo sapiens
agcagcgggtctgcaagccttccctggggcctgcagagctagaaagggaggcccagcagactggcgct

SEQ ID NO: 6855658 - DNA, 63 bp, Homo sapiens
ttactgaaaattcttcaggattcctacatgtgagctattggaatcagaagttttggtcagtag

SEQ ID NO: 6855659 - DNA, 74 bp, Homo sapiens
gggaatggagaccaggcccgagtccccaggtgacctaaagaggggtgaggtgccttgggcctgtcagcactccc

SEQ ID NO: 6855660 - DNA, 58 bp, Homo sapiens
gctgatgtgatgtcagaagaggccaattagacaatcaggactttcaacatcactcagc

SEQ ID NO: 6855661 - DNA, 65 bp, Homo sapiens
ctggaggacagaggccatgtctgattcatcttgtattctcatatttggcccagtctgccctccag

SEQ ID NO: 6855662 - DNA, 57 bp, Homo sapiens
gccttcagagatgaaaagtggagactgggagcctcacccttcactttcatttcaagc

SEQ ID NO: 6855663 - DNA, 103 bp, Homo sapiens
atctgatctagtgacttagttctgcatgtataattaattggcagcatgttcacagctcctactaagctgcctgatttacatagtgaagctagcagatgcagat

SEQ ID NO: 6855664 - DNA, 56 bp, Homo sapiens
ctgaaactacagtaaggagaacgtgggagaaatgttcctcctatcttgagtttcag

SEQ ID NO: 6855665 - DNA, 76 bp, Homo sapiens
ggaattggaagctggactctgccatttacttgccgtgtgaccctgagtgagtggagagctctaggttttgttttcc

SEQ ID NO: 6855666 - DNA, 78 bp, Homo sapiens
aggtgcttcagtggtctctgctagggctgaggtgttcagcttgctgcacaacattcctagcgggaattgaggctgcct

SEQ ID NO: 6855667 - DNA, 80 bp, Homo sapiens
ctgtccaacatgttatggctaaatttcaatattagtaatattattagtaaataattattagatatagtatgtctggagag

SEQ ID NO: 6855668 - DNA, 55 bp, Homo sapiens
aggttaactgggataacacattctaatgttttatgtgttgatgctcagatgactt

SEQ ID NO: 6855669 - DNA, 58 bp, Homo sapiens
agaaaagaggctttctaagcattccttcctctgcaggatatttgggatcctcttttct

SEQ ID NO: 6855670 - DNA, 78 bp, Homo sapiens
ttggcttgaagatctatcaacatataatatttgagttcttgtttgagatttagataaggtatgtcatgttcaggtcaa

SEQ ID NO: 6855671 - DNA, 69 bp, Homo sapiens
gcttcagtaacaggcctaggattacacagttggaaaagaaagccagaatatgaccctaggcctttgagc

SEQ ID NO: 6855672 - DNA, 68 bp, Homo sapiens
gctgaagttgtggggctccttctggctgtaagggagactccttgggccttgagaatgttctgcacagc

SEQ ID NO: 6855673 - DNA, 80 bp, Homo sapiens
gtaagggttcactggaactaagggggctccagctaaaaaacaagtttgaaaggcactgatcttatccagtatcatcttac

SEQ ID NO: 6855674 - DNA, 71 bp, Homo sapiens
gtttgcatgggttgattagtactgaatgtagttttctttaactaccatttgatgactcaactcataatgac

SEQ ID NO: 6855675 - DNA, 74 bp, Homo sapiens
cttgcagggttactgtgaggttctgctctgatattgtgtgtctagtatcttaacagcttccaggaaccctagag

SEQ ID NO: 6855676 - DNA, 82 bp, Homo sapiens
gacaaagctgcaagactgagccttgaagctagatagttctaggtgacaaaagagaatttctagttcctgggccagctgggtc

SEQ ID NO: 6855677 - DNA, 69 bp, Homo sapiens
caaatgaagcagtccatctgctctgagatattaagccctatattaagattgtagaaactgtagcatttg

SEQ ID NO: 6855678 - DNA, 60 bp, Homo sapiens
tgtgaccttttgttttcagggataaggatgttcctttcttcctggcatagagagggcaca

SEQ ID NO: 6855679 - DNA, 65 bp, Homo sapiens
gttagtgtgtgtgactcaataaccattctgtacaccaccaggaaagtgacttttataccactaac

SEQ ID NO: 6855680 - DNA, 130 bp, Homo sapiens
cctccgtttctttccttggttttctaatctctccaatgggaatgtttttatttgcttttctcttacatcgtggaagcagtagaatgcattgcttttctgaaggactggaagaaggaaagggaaagggagg

SEQ ID NO: 6855681 - DNA, 72 bp, Homo sapiens
tgttttttagagatggggtctctctatgttgctctagcctgtgcaacagggaaatctcagctctaaaattca

SEQ ID NO: 6855682 - DNA, 58 bp, Homo sapiens
agataccccagtgttgatgcctggttgttccattatgccaggactccatggggtctct

SEQ ID NO: 6855683 - DNA, 62 bp, Homo sapiens
taaaatcagccgaccatggtggcacgtgcttgtggttccagctacttggtaggctgaggtta

SEQ ID NO: 6855684 - DNA, 92 bp, Homo sapiens
ggggccttgtgcaataaagtggaggcccgggctgtgccacagccacagctcttctcatggggcctcagcttcctgattgtttaatgggtccc

SEQ ID NO: 6855685 - DNA, 85 bp, Homo sapiens
ttctgtgatctctagattggactaaaggcaacagcttctttaagtgagcttgagtctttgtctccaggatggaccctttatagga

SEQ ID NO: 6855686 - DNA, 126 bp, Homo sapiens
cattattagtcattagagaaatgcaaattaaaaccgtaataggcacaaccattaaaataacttaattctttaaattgacagtagtatgtgctggtgaggttttgaactccggtagacagaataatg

SEQ ID NO: 6855687 - DNA, 125 bp, Homo sapiens
cggaggtgggaaggggcctaacggtcagggctcagagaagcggtttcgccttcttttccgcggagggatccagacacgaccgcgtcctgaggcggttctgaaaagccgggccccttaaacctctg

SEQ ID NO: 6855688 - DNA, 66 bp, Homo sapiens
ggagcagcccaggcaaagataaaatttaaatgaaaagtaaattttcttgtaggaatgggctgtatc

SEQ ID NO: 6855689 - DNA, 60 bp, Homo sapiens
tagtcttcatgaggatgtttaccatttctgaagttttgcgtaaattagccttgaagatta

SEQ ID NO: 6855690 - DNA, 93 bp, Homo sapiens
ttagtttgtagaatggattaatgaatacattttgtagctctttgcatagattacacatatgtccattaatcagtagtgagaatctaaaactaa

SEQ ID NO: 6855691 - DNA, 87 bp, Homo sapiens
cctgacccatttgtataatgtcagtgctaagtagtattttttattaataaaaagtcttggtttcattggcaatgtcagacttttagg

SEQ ID NO: 6855692 - DNA, 64 bp, Homo sapiens
gattcctcatggctgtcgcagggccgtgcgtgagctgctgggccttggcgatccgtggggcatc

SEQ ID NO: 6855693 - DNA, 65 bp, Homo sapiens
agagatgcctttttatcatggatgatgttgacaaacatcgtgtgccccggatgaaaggcatttct

SEQ ID NO: 6855694 - DNA, 61 bp, Homo sapiens
cttgtggcctcctgttcctgggtacagatgaacctgtttgccatggggatggggccacggg

SEQ ID NO: 6855695 - DNA, 77 bp, Homo sapiens
gtggagagtaaggtaataaaagcaggttttgcaatggacatgaatgagcactgattttgttgcacttaaataaccac

SEQ ID NO: 6855696 - DNA, 59 bp, Homo sapiens
ctggccctgtaggatgtgagtttgctgccgggtaggacattcgaggtttgcagggtggg

SEQ ID NO: 6855697 - DNA, 122 bp, Homo sapiens
gcagtgccctggacgtggcctcgaaccgcgtgccctggctcttcttgttccacacgtggacagcataggtggcactgagcagccgcggcagctcctcggggttgatgtcctcaaagtacttc

SEQ ID NO: 6855698 - DNA, 56 bp, Homo sapiens
gagcaggctctgcctgtgtgtcacgtccacatggtgaacatggcagacgtctggtc

SEQ ID NO: 6855699 - DNA, 62 bp, Homo sapiens
gggatatttcacaggccagtggtggggcctttggcccttggcccttccctgctgtggaaccc

SEQ ID NO: 6855700 - DNA, 60 bp, Homo sapiens
ggggtcttccttttgttatctgactttgctgactagaacagttaatgaagaggaagcctc

SEQ ID NO: 6855701 - DNA, 64 bp, Homo sapiens
ttccctcgtgcagatgcggccaggaatatcttaatttattggtgtgctggcatgcaagagggaa

SEQ ID NO: 6855702 - DNA, 107 bp, Homo sapiens
gaagatgcctccgctgaattttttactttcttgagtcatgtgcaaatactgaatgttaattacatgcaattaagagggtgaatacatgattctctggttgtagattc

SEQ ID NO: 6855703 - DNA, 56 bp, Homo sapiens
gtctagagtgcttcctagtcatctggtactgggtggttgaggtgtcattctcagac

SEQ ID NO: 6855704 - DNA, 74 bp, Homo sapiens
gctgctctgaggtcgaagcaccttgtatgttatgtgaaaaatatttccaagcaaagtgctttgcctccagctgc

SEQ ID NO: 6855705 - DNA, 129 bp, Homo sapiens
gcattaaggtagtggccggactgtgtatccttggaggtgttcatctgccctgaaaagatgggattctgaacctcaaatcgtgctgggtagagtggatctaagatggtcagttatggtgctcctgggtgc

SEQ ID NO: 6855706 - DNA, 77 bp, Homo sapiens
cttctgggcctccaggtccttgtttgtaaagcagggtggcccacccctccctggagggcttgagaggcctgcagaag

SEQ ID NO: 6855707 - DNA, 74 bp, Homo sapiens
ggagcacagcagctgctcagttgctccttgaaggaccccaccctgagagcctgaaggcagctgctgtcagcccc

SEQ ID NO: 6855708 - DNA, 78 bp, Homo sapiens
tgaaaatgtaactcttagattcattctgttttagagctagaagcatctgaaagcaaatacatgaatcttgcgttttta

SEQ ID NO: 6855709 - DNA, 59 bp, Homo sapiens
aggatgctgaagcctgggaagtgaggtacttatttggaaatatggcttctggcaggtct

SEQ ID NO: 6855710 - DNA, 85 bp, Homo sapiens
atgaactccgaagagtcccaaaatgattcttagaggaccagcctcctgggactgtgactgcttttgagagctcttcagagatcat

SEQ ID NO: 6855711 - DNA, 61 bp, Homo sapiens
gaaatggatttcaaatgcggcagcaactccttaatgctgccctgctaatgagttccaattc

SEQ ID NO: 6855712 - DNA, 73 bp, Homo sapiens
gtcctaattctaacagggtaggagggcatgaatcatcagattctctcttccacaaaccactgaagattgggac

SEQ ID NO: 6855713 - DNA, 73 bp, Homo sapiens
caattgaaatgttgtcctgtctcttgaagtataggattttgtgtcaaatgaggctgatgaatgtggtcagttg

SEQ ID NO: 6855714 - DNA, 63 bp, Homo sapiens
ttgtggttgctccatgacaacctgtatcaccaagtggatgctgtcatgatgtgcacaccacag

SEQ ID NO: 6855715 - DNA, 80 bp, Homo sapiens
ggccagctcctgttcaggtccagagctgctaacgtgggttctactcagtcccagtgacttggccagaatagagctttgcc

SEQ ID NO: 6855716 - DNA, 70 bp, Homo sapiens
tgtactgataaatgtgtaacaaccagctctctggggggagaacgggaatgtatgcacatatataggtaca

SEQ ID NO: 6855717 - DNA, 56 bp, Homo sapiens
tttctacatgttttctattgaatgtccctcctaggccacaatagaaacagtaggaa

SEQ ID NO: 6855718 - DNA, 59 bp, Homo sapiens
tatgcagaagtagggattggagagaaccaagttccctttggtaatatacttactgtgta

SEQ ID NO: 6855719 - DNA, 66 bp, Homo sapiens
cagagccttcatcgcagccttgttcagttttacctgctcaacaggggctggttgaaagagcatctg

SEQ ID NO: 6855720 - DNA, 86 bp, Homo sapiens
tttataacatgcactactagatgcaaaagtttacatcaaagtttactttaaatatcatttggtagggactaaatgtgtgtgataga

SEQ ID NO: 6855721 - DNA, 86 bp, Homo sapiens
ttgcttttgctgcttcttttgtgggtttgcacttgtgacctaaagtaaataaaatagcataaaataggaagctggggtgggggcaa

SEQ ID NO: 6855722 - DNA, 70 bp, Homo sapiens
gcctgtcctcttccgcctgtctgtcctttgtgtccaggaattccccagacagtggggaaggaggagaggc

SEQ ID NO: 6855723 - DNA, 81 bp, Homo sapiens
gcagccacacctggttctagtgaaagtctatacatcacctgcagatctggggctttgagctagatatagtacctggcatgc

SEQ ID NO: 6855724 - DNA, 119 bp, Homo sapiens
agaaaccttagccagctaactcactactggggtggcatagggtgatggcttagggtgttctaacaggcattttcactgatgtcatcctacagagcagtatagaaaggactaatgtttct

SEQ ID NO: 6855725 - DNA, 109 bp, Homo sapiens
taggtaatatataaatgtaagattttgtacattatttcatcagtcatctgggcccaaggctagatatctggaaaaaatgtatggatggacttaattttattgatactta

SEQ ID NO: 6855726 - DNA, 70 bp, Homo sapiens
ggcatcttgggaactgccttgcctttggaaggccaaatgtaataaggagtttcccagtcagaagaatgcc

SEQ ID NO: 6855727 - DNA, 67 bp, Homo sapiens
ttaaagtattgttaagattcaactgtcatttaagtgcacagttctaaatcttggataatagatttga

SEQ ID NO: 6855728 - DNA, 56 bp, Homo sapiens
acaaacatcttgacctcagatttctagtctttagaactgaggcaatggatttttgt

SEQ ID NO: 6855729 - DNA, 88 bp, Homo sapiens
ttctgtcatcaaaaggaacactcagtaattcagatatagtgataaatgtctatatttaacttaatgaagtgttcagttaaagatagag

SEQ ID NO: 6855730 - DNA, 58 bp, Homo sapiens
ggagagaccctggagaaggtcctgtttacaaaagggttaatcttccccagggctctcc

SEQ ID NO: 6855731 - DNA, 109 bp, Homo sapiens
ggacagtgtgtggcttccagagtctagaaacaaggtagagctcccataaggtttcatgggagctcactttccctgctttgtgtctgtaactctgaggcatgggctgttc

SEQ ID NO: 6855732 - DNA, 70 bp, Homo sapiens
tagggcaagatcagcttaacatcctacactgttgtctttaagaggagcacaacattggggtgttacccta

SEQ ID NO: 6855733 - DNA, 90 bp, Homo sapiens
aaggattataagcataaattgatactgtagccagagcagacttaacacttcatgtcctggttcacatctgtttatctgttttcagttctt

SEQ ID NO: 6855734 - DNA, 77 bp, Homo sapiens
ttattatccaacacttgatatcttatatttaataatttgaaaatgttggatgcctgactttagggtgtggaaaatga

SEQ ID NO: 6855735 - DNA, 58 bp, Homo sapiens
cacacttgtgaccgatataatgagccactggatggcactgtgggtccatgcaaatgtg

SEQ ID NO: 6855736 - DNA, 68 bp, Homo sapiens
cagatttcatctctctaaaagacagtccaaagatagaataggaatcttgaagagagtagtgaagattg

SEQ ID NO: 6855737 - DNA, 109 bp, Homo sapiens
tgcaaaagtattttctttgtcaaaatgtttgtatatttactgagtgcattttcaaatgacccctgacacttccggtaaaaaatgcttctattttgagagggtttttgca

SEQ ID NO: 6855738 - DNA, 65 bp, Homo sapiens
catgtgtattattcttgtggaatattagttcaccagatgatagcccacaattctagttacatatg

SEQ ID NO: 6855739 - DNA, 122 bp, Homo sapiens
atttgaaaatatattagtgttttgagataaacagattatgaagcattgaccttgtgagaatcacacagtccaaggcaggtgcttatgacttgctcctctcaccactctgaagttattcaaat

SEQ ID NO: 6855740 - DNA, 125 bp, Homo sapiens
ttagggagtcctacttgtactcacagctctgccaaggaatgtcaaaccttgagcatgtcacatcatatcagttcactgggtttgatttccttatttattgagtgatggtttgtgcctctccctaa

SEQ ID NO: 6855741 - DNA, 81 bp, Homo sapiens
gcagtataaatgtcaagtagaactataatgatgtctaatagggcatttatcattttatattggaattatttatatgactgc

SEQ ID NO: 6855742 - DNA, 55 bp, Homo sapiens
gctgtgttttagatattttaacccttgtgacctggcagaatatctagcacatagt

SEQ ID NO: 6855743 - DNA, 56 bp, Homo sapiens
attcctaggtttgagggaaccaaaaggaaaatttatgggcaccaaaacctaggagt

SEQ ID NO: 6855744 - DNA, 66 bp, Homo sapiens
acctggctggccatgcagcgccagctgtgggtacatacctaggcgctgggcaaggccagtagaggt

SEQ ID NO: 6855745 - DNA, 76 bp, Homo sapiens
agactaggttatgctgtatttgtgtcagattgctttgtttaatgacacatgattaatgccaagcatagtctagttt

SEQ ID NO: 6855746 - DNA, 62 bp, Homo sapiens
gccctggttttggcatttatgatcattgagtatagtatttaagctaatgtcataattagggt

SEQ ID NO: 6855747 - DNA, 55 bp, Homo sapiens
tattatatgttgttgagtgtagttgtcaaagcaactagcacgattccaagtaata

SEQ ID NO: 6855748 - DNA, 75 bp, Homo sapiens
ggacagaagaggagtaactgtcacagcgagccccaagaccctggggtgccacagctacatcctagagcactgtcc

SEQ ID NO: 6855749 - DNA, 71 bp, Homo sapiens
cttaattcatcactttcaataaagtaaatgatagacatagagtttgttaaaatataggaagtgtggttaag

SEQ ID NO: 6855750 - DNA, 78 bp, Homo sapiens
tgtaaatccattttcctaaggtagtgataattttataacacaagcatgagaaatgaacacaaccttgggagacttgca

SEQ ID NO: 6855751 - DNA, 58 bp, Homo sapiens
tttctctgctgcctgtgtcgatgacatccagaccatccaagcaggaaaggtatagaaa

SEQ ID NO: 6855752 - DNA, 69 bp, Homo sapiens
gtctttgcagccttctggactgatgtgcatagaatctgtataacacgcagttgagagggagagtaagac

SEQ ID NO: 6855753 - DNA, 96 bp, Homo sapiens
gaaaatctgtctcatcgacagtcagtgatatggtaagggaagaaaaagcacagtatatttccattacagagaggtgattgtgaagatcaggtattc

SEQ ID NO: 6855754 - DNA, 74 bp, Homo sapiens
gtctacagtacacaggtaccaagctgccttttgtctttctaattcagaaaaagcctgatgcctgtgctgtaagc

SEQ ID NO: 6855755 - DNA, 56 bp, Homo sapiens
ttgggaagaggcccctggattccacagagactggtggccaaccgggcagctcccag

SEQ ID NO: 6855756 - DNA, 130 bp, Homo sapiens
caatgtttaataaatatttttaagtgtgcgtttttcctttctcaagagccggcaatccatcctgatattgccacatcaatgtgctgagcttcttcaaggagatcaatgtgcagactgtgtattaggcttg

SEQ ID NO: 6855757 - DNA, 104 bp, Homo sapiens
gccttcaagctctggcattccagtaagggctgacttggaactgtcacagagaaactgggggacagtaaatgcagtctagcacttgtttggaactagagcatggc

SEQ ID NO: 6855758 - DNA, 70 bp, Homo sapiens
gggtgtttggaaaaggactactttcctctcttgaaataggaggctacagagaccttttctcagataactt

SEQ ID NO: 6855759 - DNA, 93 bp, Homo sapiens
ccaagggctgttgccagggaaacatagttctcggtcttcagcctggtcttcctgagggctgggagtttgatttgactggtaggaaagtctgag

SEQ ID NO: 6855760 - DNA, 103 bp, Homo sapiens
ggaaaagtgcagtattagggtgggagtgtcccgattttccaggtaccatctgttatggcttccctttgccaggaaagggaattccctgaccccttgtgcttcc

SEQ ID NO: 6855761 - DNA, 98 bp, Homo sapiens
ctgggtgctggggacaggtgtgggctgggctctgagttaggacgagccactgtcccatttgagagtctccagccccatcatgttcaatcccagctcag

SEQ ID NO: 6855762 - DNA, 129 bp, Homo sapiens
ccactgatttctgtgtaatttgtgtccaatatttcaaagccatttaaaaaaggattttgactgcatgcctagtagctgtttcagatcattttttaagtacagaatggataattagtcttcagtgatttg

SEQ ID NO: 6855763 - DNA, 98 bp, Homo sapiens
attctagccagcatttaagggtggatacaggagatcaaagtatttgaatacttgcttcactttctatttgtgtctggtccctcaatgctgagtgggat

SEQ ID NO: 6855764 - DNA, 68 bp, Homo sapiens
gagcccagtggtggctgtgctttgctgtcaggactgacagtagaagatgctgttacagaactgagctc

SEQ ID NO: 6855765 - DNA, 77 bp, Homo sapiens
gtatattcaaggatgccaataaatgttaatatctaaaattggattgtgataattgttgcaaaactctgtgaatatat

SEQ ID NO: 6855766 - DNA, 62 bp, Homo sapiens
cagtaaaagttgaaaagtgaggaatgtccagtcggtgctcattcccatcgtcaacttcactg

SEQ ID NO: 6855767 - DNA, 77 bp, Homo sapiens
gggtgtccagccagcaggtgagtgcagcctgatccaggggaaccaggcagatgctcttttgtgggctagggactccc

SEQ ID NO: 6855768 - DNA, 76 bp, Homo sapiens
ttctcctaggtcttggggtaagggctagcctagcagttgctggaagctagagcttagtctcgatttccagagaggg

SEQ ID NO: 6855769 - DNA, 85 bp, Homo sapiens
tacctgagcccaaagtcctgcttccctgaccatccctgagcccaaagtcctgcttggggcagaagacagcagcacttgctgggta

SEQ ID NO: 6855770 - DNA, 64 bp, Homo sapiens
ccaggggaaacagggagcactccaccttcttaataccaaatggcctgcttccaacagctcctgg

SEQ ID NO: 6855771 - DNA, 103 bp, Homo sapiens
gtgattactttgggaacataatttttatgcagcaaaatatttgatatgatttgagaggtaccaagtagacttttgcatcaaggaaaaatgtcccaattgtcac

SEQ ID NO: 6855772 - DNA, 67 bp, Homo sapiens
ggccttaggggtgaggcagacctcaactgcgaaaagtccccagggggctgctcccacccctgaggcc

SEQ ID NO: 6855773 - DNA, 90 bp, Homo sapiens
tcagtggctcatttgattgtcacctaccttgcacaaaacctcccagccccgagcactgtctggtgggttgacaggcagtcagagtgctga

SEQ ID NO: 6855774 - DNA, 100 bp, Homo sapiens
tgaggctacagaaggagaacaaagttttcagcattttatagcctgtgagtgaccagtctatttaattccagtctgtactttgctctgttctcctgcctca

SEQ ID NO: 6855775 - DNA, 87 bp, Homo sapiens
gttctatgtacacttctagtgaattattgaaactgagtgtgtttgggggaactccccaaacttgcatttggtttcagaagtgagaat

SEQ ID NO: 6855776 - DNA, 86 bp, Homo sapiens
atctatgaaaacacaattgtcttgaaagcaacactttcctttataggaaccaggttttattttgtgataaaaatggatttatggat

SEQ ID NO: 6855777 - DNA, 71 bp, Homo sapiens
ttgctttataattttgtttctctcttcctgcctggctaagaggagaaagaagacgaacattgtagaagtaa

SEQ ID NO: 6855778 - DNA, 60 bp, Homo sapiens
cttagcttcactgggtctcagtttccctatctgtatattgggagcagttgtgaagctcag

SEQ ID NO: 6855779 - DNA, 130 bp, Homo sapiens
ttcacgcactatggaatccctgctcctttcagagcctccaggctcctgactttttgggactcctggttccatgaggcagggaggctggctcttccctctgaggacactgggtctgggatgcagtgctgag

SEQ ID NO: 6855780 - DNA, 58 bp, Homo sapiens
ggccggtctccagcttcagtgtctctgagtaggcattcagcaagctatgggacaggcc

SEQ ID NO: 6855781 - DNA, 58 bp, Homo sapiens
gtttgcagcattcatgtctcaatatgttcagtatttcaggcaattcgaagttgcagac

SEQ ID NO: 6855782 - DNA, 66 bp, Homo sapiens
ctaaacatctttacaacagacctagtgcaaatttagctatcactggtctgctagaaagatgcatgg

SEQ ID NO: 6855783 - DNA, 57 bp, Homo sapiens
ttctcagggtctggatggcctgactgagaaagttccaggccttaaggactcggagaa

SEQ ID NO: 6855784 - DNA, 57 bp, Homo sapiens
gcaggctccaggccggccccttgaatctcaccgcgaggaaggcaccctgctgcctgc

SEQ ID NO: 6855785 - DNA, 73 bp, Homo sapiens
gccaagcactggaggggtactttcacctaggccaacaaacttaataagcagagaaacccttcagtgttttggc

SEQ ID NO: 6855786 - DNA, 117 bp, Homo sapiens
ggagcccagcccaaaatcccattccctgcctcctggtcctgtgttcttcctgcctcccttaaagataggagctgcaagtctgtgtggggaggaggcgggaatgggtggctcttctcc

SEQ ID NO: 6855787 - DNA, 85 bp, Homo sapiens
agccccaaagttgcttctcaggaaaggagccacgtgcatttgcaccagggcctacccctgtttctaagaggcatgcaatgtggct

SEQ ID NO: 6855788 - DNA, 59 bp, Homo sapiens
cacatcatagagactcaatccatgctttttgaattgagttctgtatttctgtgactgtg

SEQ ID NO: 6855789 - DNA, 82 bp, Homo sapiens
cgcctgcccccgcagctccacagcctgcgtgcgccggacccactcctgcagctcctgtgctgagtgtgccttggtgcaggcg

SEQ ID NO: 6855790 - DNA, 62 bp, Homo sapiens
gctgttgcaatcaaggccatggcaaaataactggctcccaaggtggcagtggtggcagcagt

SEQ ID NO: 6855791 - DNA, 61 bp, Homo sapiens
ccagctgacagtaggtttacagtttataatctggcctttgtaaaagcatttgtcagcctgg

SEQ ID NO: 6855792 - DNA, 76 bp, Homo sapiens
aatactgcttccattctgtaattttctcttcccagcgcacccgtgggacctgttacattgagttagaggcagtatt

SEQ ID NO: 6855793 - DNA, 61 bp, Homo sapiens
gttgtagtggaatatacccatgctccattcacatggttcatgtctgctttcatgctacaac

SEQ ID NO: 6855794 - DNA, 88 bp, Homo sapiens
gcccatttgatggcagagaagtttctggtttgcataggccagaactggtttgcagtaactaggcaagcttgaagcaactctcttgggc

SEQ ID NO: 6855795 - DNA, 58 bp, Homo sapiens
ttgtaagaatagtccctagatgtgtgcaaaacacactctgcctaactattcttgacag

SEQ ID NO: 6855796 - DNA, 58 bp, Homo sapiens
tggaagctggctgatctgacttgcttgcagatgtctgtaacagcattagcagcttcca

SEQ ID NO: 6855797 - DNA, 55 bp, Homo sapiens
agaggcagaagtgttcaaacccacgttgtgagtctggtttgagagcctgcattct

SEQ ID NO: 6855798 - DNA, 60 bp, Homo sapiens
ggcgcgggagcagctcgctaggcactgccacatgcagctgactgtccgctgctcccggct

SEQ ID NO: 6855799 - DNA, 86 bp, Homo sapiens
catttccatgaggagctccttgaaatgagcatgagacccttaaagagcatgctaaagacacaataagtagcttctaaatggttttg

SEQ ID NO: 6855800 - DNA, 69 bp, Homo sapiens
gatgttcttgcaatagacttggttcttctgtatattctctgcacagggcaacaggtctgttagattttc

SEQ ID NO: 6855801 - DNA, 114 bp, Homo sapiens
gccgcagaaaggagatctatttaccctggcacatgcgctgtgtggtcagctgaaaacaaaacaggttttttattactcgtgtggtgtaggggggaagtttcccttctctgtggc

SEQ ID NO: 6855802 - DNA, 71 bp, Homo sapiens
gtaagatttaaaatagcaattggagattcagcaacaattctcacctctcatttgtctttagtaaatcttgc

SEQ ID NO: 6855803 - DNA, 67 bp, Homo sapiens
gttttagagtagagccatttctgttttagagctgcagaggcaaaatcaaatggctttcctttaggat

SEQ ID NO: 6855804 - DNA, 58 bp, Homo sapiens
cagtctctgcccgcgtctgccccagcacttggcacagcgggacagacgcagagatctg

SEQ ID NO: 6855805 - DNA, 79 bp, Homo sapiens
gcagcagacaagtgttatcctaatagacaagtgttatcttcactatttagcaatcatgtttacgtgacatgtctcctgc

SEQ ID NO: 6855806 - DNA, 65 bp, Homo sapiens
tgtgcctggcccctggtgtgttttaaagctcaagtttcatgccaccccataggtgttaggtgaca

SEQ ID NO: 6855807 - DNA, 76 bp, Homo sapiens
ttcaaatgtcaaaggctatacattcacactactcattcacatgtttgtatgaatgtatggtcctgtgaattatgaa

SEQ ID NO: 6855808 - DNA, 66 bp, Homo sapiens
gttctgctcttttattgaagaagattctgtcattcattgactggagtgagtatcgatgaacagaac

SEQ ID NO: 6855809 - DNA, 60 bp, Homo sapiens
atgcacaaggtagattattattctgatgtcatgcaaatgagtacctgtgtgcctgtgtgt

SEQ ID NO: 6855810 - DNA, 60 bp, Homo sapiens
gtgtgtgtgtgtttgcgtgtgtgttcctgtatctcatcatatctgcaaacaatcacatat

SEQ ID NO: 6855811 - DNA, 67 bp, Homo sapiens
gggactcctttaaggagggtgataactcagtgaattactaggcagtaccaactttgcaataagtccc

SEQ ID NO: 6855812 - DNA, 67 bp, Homo sapiens
gtgcggcctggccttcaagtggtcgtcccactaccagtaccacttaaggcagcacacaggcgagcgc

SEQ ID NO: 6855813 - DNA, 78 bp, Homo sapiens
ggtgacaggttccacaggcgctgaccctggggttctggcaagctgttggctcagtgtttgtggaacatagtcgaagcc

SEQ ID NO: 6855814 - DNA, 115 bp, Homo sapiens
tgagcagctggaagaggatggtggagcagaaggtttaatttcacatacagttggcttctgtttgtgataacttttacattttcgcagatagcttgtctttttccctgttgactca

SEQ ID NO: 6855815 - DNA, 76 bp, Homo sapiens
tcttttgaaatctttagtaggaaaatcccctagaggagtccaactggggcttgctctgcaaaagtgttcataaaga

SEQ ID NO: 6855816 - DNA, 77 bp, Homo sapiens
tatttgctttaaaatggctaagtctggagtttttacgtattgatctttctaaacttggatcacttttaaagctagta

SEQ ID NO: 6855817 - DNA, 80 bp, Homo sapiens
gctctttctctcagtctcttagaatcgcatattgtcaggcattgtcacacatgtgattctaagacagcgagagaaagagc

SEQ ID NO: 6855818 - DNA, 71 bp, Homo sapiens
ggcactgaggatatagtggtaaacagttcttacccttggggtattacataccaaactgtaccttgaatgtt

SEQ ID NO: 6855819 - DNA, 66 bp, Homo sapiens
ccgagttaaagaacagattgcccggggtcttgaacatctctgggtaattgaagcttttgcctttgg

SEQ ID NO: 6855820 - DNA, 55 bp, Homo sapiens
ctcattgcccagatccccacagaagatccggaagtcatctggggatggggaagag

SEQ ID NO: 6855821 - DNA, 80 bp, Homo sapiens
acaatatgagggacacatctcaggggacactctcgagtgaggcattagggtgtgggtgctgagatgtctcttttcattgt

SEQ ID NO: 6855822 - DNA, 74 bp, Homo sapiens
gccatgcctgaagcaagggtaggcaggtctcttatccccaatatcaccagccctgctcttcctctggtcccggc

SEQ ID NO: 6855823 - DNA, 59 bp, Homo sapiens
ctctgaggtcagtgctgcagttatccccattttaaagataagaaaactgagactcagag

SEQ ID NO: 6855824 - DNA, 119 bp, Homo sapiens
agtagttttcattgttcactgttattctccatccctgtatatcacaagggctatcttgtagtactttttgataatattgggtaggtgataactcaaagatgcacaaggttctaactact

SEQ ID NO: 6855825 - DNA, 73 bp, Homo sapiens
ctatcaatacatgttatcagtgttctctgggggtattaagttccagtcacccatagtgtaacttgattgatag

SEQ ID NO: 6855826 - DNA, 57 bp, Homo sapiens
ggacttaggagcaggcagatcagggcccacatcctggcttaacctcttcctatgtct

SEQ ID NO: 6855827 - DNA, 72 bp, Homo sapiens
tgcctagcatagtatttgtcacatagtaatcactcaataaatcacatgttgaataaataaatgtgcttggta

SEQ ID NO: 6855828 - DNA, 59 bp, Homo sapiens
tcctttggttcaattctcccagttccagagttcaggaatggcggaaagaacacagaggg

SEQ ID NO: 6855829 - DNA, 59 bp, Homo sapiens
gcagagattggtgcactgatgaataattatttatattctcattggtcattaagctctgt

SEQ ID NO: 6855830 - DNA, 122 bp, Homo sapiens
agtattttaaaagtgggaaaatggtcaaagaaacatttgaaatagttcattcttgtaattttttgtcccaagactgtgctattttaaaaagtatctgctgtcatcttcaccttttgaaaact

SEQ ID NO: 6855831 - DNA, 61 bp, Homo sapiens
aacatatggatgttgaattaactttgtctcattatggcatttaatttgatatctataagtt

SEQ ID NO: 6855832 - DNA, 58 bp, Homo sapiens
tggccagcccttcagccatgcctgatagaaggtcgcaggcaggctgaggcagtggcca

SEQ ID NO: 6855833 - DNA, 82 bp, Homo sapiens
tgtagccttcagcatggctctggcctcagtgtgagttaccagtattgtgagtacgctggagcagggctagcagtggggtata

SEQ ID NO: 6855834 - DNA, 88 bp, Homo sapiens
ctggccaaaaggaaagacaggacggaattcctgggaagtcctacagctgctgtctaccatagagttccattgtcttctcctctgctag

SEQ ID NO: 6855835 - DNA, 60 bp, Homo sapiens
actgaaatatttagaagtgaagagtcatgatttttgcaatttactcttaaatgattcagt

SEQ ID NO: 6855836 - DNA, 55 bp, Homo sapiens
ctgctggaatctttaagctggaaagaaatccagtcttgaaaggtagagtctacag

SEQ ID NO: 6855837 - DNA, 76 bp, Homo sapiens
gtaattctctaacctaatgtggagggagccgaggtctttacatactaattccctagagtcattggttgagggctgc

SEQ ID NO: 6855838 - DNA, 61 bp, Homo sapiens
ttccttccaaattgcccttcagttgaatgcttttctctgagctggtctatggacttgggaa

SEQ ID NO: 6855839 - DNA, 109 bp, Homo sapiens
cattcatataataatctttttctttcctcttggttacttcctgaatcttccatgtatatttctatgtgtgtgcattggcaggaataatgaaggacagcatgtgtggatg

SEQ ID NO: 6855840 - DNA, 66 bp, Homo sapiens
aaaggaagaagaaaggcaatacttgcaaccaatgataaagaggtattctgactttcatctgccttt

SEQ ID NO: 6855841 - DNA, 86 bp, Homo sapiens
gattttattttctgtattttcttctggaagcttatggggctttttctttatctgaactttcacaagaatatgctttgatatgggtc

SEQ ID NO: 6855842 - DNA, 89 bp, Homo sapiens
cagtgaccttggcaattcaaactgaggagaggatggccagttatcttattgggtacgattttcagtcttgaagaaaaggggtttcactg

SEQ ID NO: 6855843 - DNA, 75 bp, Homo sapiens
ggttgatttgggataggtttgtgtttgagaacatatttgtttatgttttattaccaacttgtacttaaatatact

SEQ ID NO: 6855844 - DNA, 58 bp, Homo sapiens
ggagactagagtttagacaagggcttgcttaaatcctgtgtgtgagtcctggctttcc

SEQ ID NO: 6855845 - DNA, 60 bp, Homo sapiens
gttgttatctattgctgcgttacaaaccaaaccactccaaatgtagcagtttaaaacaac

SEQ ID NO: 6855846 - DNA, 101 bp, Homo sapiens
tgcggagaatagtctctgtcccagactattttgcacaaaacaattggcaaacagtttaacattttgctagaatggctgataggtcagagttgttttttgca

SEQ ID NO: 6855847 - DNA, 80 bp, Homo sapiens
ccagaaatactcagattcactgcctcccttgcaagaatgagggtggggtgagggagagcagggtcctgagatacttctgg

SEQ ID NO: 6855848 - DNA, 126 bp, Homo sapiens
ggtgctaggctgggagctgccctgagagctgggatgcccaccaaggcccacagaactgtctccaggcccttgtagacagtgggatctctgggctgatttctggttggggtctgctcctaccccacc

SEQ ID NO: 6855849 - DNA, 77 bp, Homo sapiens
aggttcgtttgcaaaagcaattgcagtttttgcaattactttaatggcaaaaactgcaattacttttgcatcaacct

SEQ ID NO: 6855850 - DNA, 103 bp, Homo sapiens
gggtaatcaacgtaccacagaagcattccagcaaatagttgagaagtatgattattaatgccacaatgtttgctgaggattttgtgatcttaccttgtggccc

SEQ ID NO: 6855851 - DNA, 75 bp, Homo sapiens
ccaggcatgtggtcctttagaggatgtaatatggactgtagcttttattgagtcagagaggggaacgttgtaggg

SEQ ID NO: 6855852 - DNA, 56 bp, Homo sapiens
tgaaagtgctgggattacaggcgtgagccaccacgcccagactcccatactttgta

SEQ ID NO: 6855853 - DNA, 70 bp, Homo sapiens
aaaggagttgatcatctaagagtaatagttatctgtatggtagtttatcattagcaatgatcaaaacttt

SEQ ID NO: 6855854 - DNA, 56 bp, Homo sapiens
cttctgactgtcttggcttctggacttttccagggctagaaattctgcagtggaag

SEQ ID NO: 6855855 - DNA, 68 bp, Homo sapiens
tttgcttttggttgtgttagcaatataagatcccctttgcattgcatagcatgcaccaaaaatgcaaa

SEQ ID NO: 6855856 - DNA, 55 bp, Homo sapiens
tcacagacatggtgaggtaacaaacacatgttgttttaaacagccaagtctgtga

SEQ ID NO: 6855857 - DNA, 61 bp, Homo sapiens
agacccttgttccttgtacctggatgaacttggtttccggggacagttcccactggggtct

SEQ ID NO: 6855858 - DNA, 58 bp, Homo sapiens
ctaggccatcagcatttaacttgatgttccactgggaattgcagggctgtctgcctag

SEQ ID NO: 6855859 - DNA, 68 bp, Homo sapiens
tctgtcagatggcactgataattaatcctttggaaagatcccaagggctttcaggctctctggctaga

SEQ ID NO: 6855860 - DNA, 94 bp, Homo sapiens
ctgctctatttgcatatcactttgaatggggaaaatggcttatttaaaatgctcatctgtcatccagttcacatggtgagtcaaagtggagcag

SEQ ID NO: 6855861 - DNA, 95 bp, Homo sapiens
ctttagggattgtttttatgaaactctttccacgattactttaagagttctaaaagttgttagcgatgagatttttattggagcaatttctgggg

SEQ ID NO: 6855862 - DNA, 65 bp, Homo sapiens
aggactctttacggatcatccccaaagctacagattttgagacggggaagactgtcaggattcct

SEQ ID NO: 6855863 - DNA, 57 bp, Homo sapiens
tgctcagacagatatttcgagataaactcttttaatggagaatcatttgtttgagca

SEQ ID NO: 6855864 - DNA, 90 bp, Homo sapiens
gagcgagagttcagaacacactgggggaaacaagatggtccatttgctaagaaacttgtggaactcccaggtgagaaggggtctctgttt

SEQ ID NO: 6855865 - DNA, 73 bp, Homo sapiens
gtatggctaagacaattccagaatagcctttattgaaacattactttgtctgagattgttcttagtgggatac

SEQ ID NO: 6855866 - DNA, 126 bp, Homo sapiens
acccttccttctgggtctttgtttcgagtattattctctggaggaaagattctgagatagagataaccaggcaggatattttcgcagggagaattcttaggataagcatctgagaaagggaggtgt

SEQ ID NO: 6855867 - DNA, 110 bp, Homo sapiens
gttcatcagacttgaacagcgaacttgaaccacatggtggggctctaaagattccaggaagctccagcggatggtcttatatttgatgtctcagatcatgtctggaaaac

SEQ ID NO: 6855868 - DNA, 105 bp, Homo sapiens
gcaaaacaaaaataaaattccactggctctccactatggatgagaagttgcacaaaggcctagctgtttcgttggtggagagctacatggctgcccaagttttgc

SEQ ID NO: 6855869 - DNA, 58 bp, Homo sapiens
ctcccaagtccttgaagaaacagttctgtgtggtagatttgcttctcaaagggcagag

SEQ ID NO: 6855870 - DNA, 57 bp, Homo sapiens
ggctctggggggaagtctgttgcccctcttggcatttatacctgctctctctaggcc

SEQ ID NO: 6855871 - DNA, 94 bp, Homo sapiens
gcagacacggtggtgatcacattgcttggcatttgctgggagctgagccctcttctctctccatggttttgtcaagctggcaccataactttgc

SEQ ID NO: 6855872 - DNA, 56 bp, Homo sapiens
gccttgcctcagccatggaaacggctgctgcccacacccctgagctgtggtaaggc

SEQ ID NO: 6855873 - DNA, 61 bp, Homo sapiens
gaggagcgcggggtacacgcggtggccgcagacgccgagccctgcggagccccgaggcctc

SEQ ID NO: 6855874 - DNA, 92 bp, Homo sapiens
tatagatggatttaggcagatggggatgaatggggtggggctaggctgagagtccacgatttaaccccgatgtctccaaatctaactctgtg

SEQ ID NO: 6855875 - DNA, 63 bp, Homo sapiens
tagtccaggtttccatctccacattctgcaaccacttgcagatagactgaagccatgtgacta

SEQ ID NO: 6855876 - DNA, 76 bp, Homo sapiens
tcacatggacttcacagagggccacttgaatgttttcacaatgtgaaaagataaacaacagccttctccagggtga

SEQ ID NO: 6855877 - DNA, 68 bp, Homo sapiens
atattttgttctggctccttttaaatgtattcatttgtaattttggaacagagctcagaaaatagtat

SEQ ID NO: 6855878 - DNA, 64 bp, Homo sapiens
ggagccagcactattagatatgcctttgttgaatccccaaagaattgtctttggtctgagtttc

SEQ ID NO: 6855879 - DNA, 65 bp, Homo sapiens
ttgctctagggctcagctctagctcctgatgaaaaccagatctgggagcttggagcctttggtga

SEQ ID NO: 6855880 - DNA, 76 bp, Homo sapiens
gtgctacacatagattgctcaatgcccaacagaaaataccactgtcagaacatgaaggttaatttgtctggagcac

SEQ ID NO: 6855881 - DNA, 66 bp, Homo sapiens
aatcgtgcatttgcatgtagataaatcactgcagaactttaggaatcctgcatgtagagcatcgtt

SEQ ID NO: 6855882 - DNA, 68 bp, Homo sapiens
acaggagctctagggacagcacagtgaggggtctactccggagcagtgcgagctctatctgctcctgt

SEQ ID NO: 6855883 - DNA, 56 bp, Homo sapiens
tatgtgctaagtgtctggtatatgccccatgtatctaccagagctctcagtatgtg

SEQ ID NO: 6855884 - DNA, 63 bp, Homo sapiens
atttctctggactgcagtaagcctcatgactctttaaaagacatgggaaatgcaaagagaagt

SEQ ID NO: 6855885 - DNA, 63 bp, Homo sapiens
ccatcattccatccactcttgatgacttttgccatcattcagtcaaaaatgatggagagatgg

SEQ ID NO: 6855886 - DNA, 56 bp, Homo sapiens
ttctttgctgtgtctggctttctctttcctatgaataaagtctcaacagctgagaa

SEQ ID NO: 6855887 - DNA, 89 bp, Homo sapiens
gagactcaggagagatgcccactggaggagctagcatgaaaaaaagagaaaattgctgcctttagggggtgctcagccctgaagtgctc

SEQ ID NO: 6855888 - DNA, 76 bp, Homo sapiens
tgcataaaaaatgagaactgtgattctattgctttgcaatatttgctgattcacagtttcctcatattcttgtgca

SEQ ID NO: 6855889 - DNA, 80 bp, Homo sapiens
ccgcaggctccggggtgccctggctcagcgcagaaaggacgccgcgcacaggtacagcccaggccgcccgggagccgcgg

SEQ ID NO: 6855890 - DNA, 112 bp, Homo sapiens
taatgttcctcagccaagaaggctgtgatgagcctcatggagaaaatatacatgttagatgagcttcattcaggcttgagttacggtgctgttggccttgagttcaacatta

SEQ ID NO: 6855891 - DNA, 59 bp, Homo sapiens
agcgcctggggctggccagagtggtctgaaacccaacccagctggcctgtcctaggcct

SEQ ID NO: 6855892 - DNA, 82 bp, Homo sapiens
ctaacgctctaagagcatgacataagtgaaaaacatcaattaaatttgtgtaaatatatgttatgtatttggcttcagttag

SEQ ID NO: 6855893 - DNA, 67 bp, Homo sapiens
tcagagaaaggctgaaatgccagaatggccattgtagtgcattctagctgagtatcagcccctctgg

SEQ ID NO: 6855894 - DNA, 92 bp, Homo sapiens
ctgctccctaaagtcacagtctatggtggaggtgcaaacaagcgatcctgttggggcttcagggtacttcctcctgtgtgctttgcacgtag

SEQ ID NO: 6855895 - DNA, 85 bp, Homo sapiens
caggaggccagcaggtggatctctaaggactgatgtaaagaatgcttccaggttctgagaaattggcatcccaggcaggctcctg

SEQ ID NO: 6855896 - DNA, 112 bp, Homo sapiens
ccccgcaggtcctgtctcagcccttccagtccggggcgcggagccagggcgcttgcgcgtcctccgtgtgcgtcctgctcggcgcgcctcggaagcagcgggacctgcgggg

SEQ ID NO: 6855897 - DNA, 84 bp, Homo sapiens
cacctagtatagggcctgatgcgtaggagaccttccagatgtgggtcagtcttattcagtgggctctgccattttcagtaggtg

SEQ ID NO: 6855898 - DNA, 96 bp, Homo sapiens
attcaaaatgtgtctaataagtgagctggtgagactgaaggtttgcccctcaattatcctagtccattgattagctcatttaaacatgtgtggaat

SEQ ID NO: 6855899 - DNA, 60 bp, Homo sapiens
ccaagtcctctggtttcaaatagtgttttttcaatcaattgtatagtactagaggcttgg

SEQ ID NO: 6855900 - DNA, 129 bp, Homo sapiens
aaaagaaaactttccaaatctaaagtattcgttctcaaagtcgaccaagaggaatcagttacatactatgactgcattcatttggttggcattgtcatacttacttatgattgatgataaatctctttt

SEQ ID NO: 6855901 - DNA, 82 bp, Homo sapiens
gggctgagttaaagcacgtagaaaccaaatagcatcatgtttttgagacatttctgatgctagttcctgtgtcttaaggccc

SEQ ID NO: 6855902 - DNA, 59 bp, Homo sapiens
ccaagataatctgtgaaaaatcaagtattttaaaatagattttgtcaaaattgtcttgg

SEQ ID NO: 6855903 - DNA, 73 bp, Homo sapiens
ggggcctggtaggaggtgactggatcatgggcatggagttctcatgaatggtttagcaccatctcccctcccc

SEQ ID NO: 6855904 - DNA, 77 bp, Homo sapiens
tccaaatcattgattaattgttgctagctgagaatacaacctgaacaaagacagtaacaaatattcattggattgga

SEQ ID NO: 6855905 - DNA, 76 bp, Homo sapiens
ctcagactgtactcttatagccatctgaaatacgttttctaggtatagatagattgtgtaagggtacagttgtgag

SEQ ID NO: 6855906 - DNA, 65 bp, Homo sapiens
tttcacgctgggagcaagtcaggaaaggtgatgcctctcaccgccaagaaggctcccagcagaga

SEQ ID NO: 6855907 - DNA, 61 bp, Homo sapiens
tgatatttaagcaaaaatatgggacatccttcctcaccaaatatttttgtttggactgtca

SEQ ID NO: 6855908 - DNA, 100 bp, Homo sapiens
ttccatgtgtagtaacggggtctccatttctaagttggagaagttcatggtatcacttggaagactcctagggttggagacagtgacacctcatatggaa

SEQ ID NO: 6855909 - DNA, 114 bp, Homo sapiens
gggtgctgcggcgatccgggtcccggtcccagcgcggggggaggatccgtgttggatacacggggaagccgcacccgtagcagggggacggggaccccatctgtgcccagcccc

SEQ ID NO: 6855910 - DNA, 88 bp, Homo sapiens
tagggagtttacatccacccattattgatgcaacagcccttaatagcacctttgttgtcagagggtgttgtgttgcttaatatcccta

SEQ ID NO: 6855911 - DNA, 59 bp, Homo sapiens
ggtagcagctgtgagtaaaagccatcaccaggtagataggaggagaccgcagtgttacc

SEQ ID NO: 6855912 - DNA, 56 bp, Homo sapiens
gccaatcagtgttgacctactgtagctaaatattaggtatttgaaaactgattggc

SEQ ID NO: 6855913 - DNA, 89 bp, Homo sapiens
ccatccctttccttgagagccactgtcttggtgtaatgtgaccacactgcctagtctcaggagcaggggctaatctggggatggggtgg

SEQ ID NO: 6855914 - DNA, 130 bp, Homo sapiens
tttagtcaaagcacagcagaacaatgtggaacacaaggttgacactttttcaggtgtctataagaagctcacagataaggatgttaattttgatttcccatagtttccgttgtaaacaaaaatgactaaa

SEQ ID NO: 6855915 - DNA, 68 bp, Homo sapiens
tctaggaaagtgattcttcaatttgcattccagaccaaccagcagcgcaatttgagaacttttttaga

SEQ ID NO: 6855916 - DNA, 67 bp, Homo sapiens
agagaggaagccattgcttactgaacacagactgtgtcaggccccacactaagcacattttccctct

SEQ ID NO: 6855917 - DNA, 59 bp, Homo sapiens
gatgagaaagtggcattctaaaagaaaggagacttcatctttcagagtgtctttccatt

SEQ ID NO: 6855918 - DNA, 63 bp, Homo sapiens
tcaggttatatttgttcaggtttgatggtatcacaaattgaaccatttagtaagtatacctgg

SEQ ID NO: 6855919 - DNA, 81 bp, Homo sapiens
ggttgaggctcagcgaggtgttgttgctgtcctggggtcatcatgatccacagtgggcacagcaggactctggcttcagcc

SEQ ID NO: 6855920 - DNA, 56 bp, Homo sapiens
ttcatagggagcatctacctatttattattaccacataggtgatgtgactctagaa

SEQ ID NO: 6855921 - DNA, 71 bp, Homo sapiens
catgagaaatacaggagtttggacttctcgagttcactttagatgaaggccaggcttcagtgtgtaaaatg

SEQ ID NO: 6855922 - DNA, 61 bp, Homo sapiens
gcccatggccctggtggacagacagcctatgaattgggggccatgctccaggcccatgggc

SEQ ID NO: 6855923 - DNA, 56 bp, Homo sapiens
cctggattataggccctctgaatatacaggatcaggaagggcaataaaatctcagg

SEQ ID NO: 6855924 - DNA, 57 bp, Homo sapiens
tgtagatgacatgtaaatgaatgaacatagttctgttccaataaaatgttatttgca

SEQ ID NO: 6855925 - DNA, 60 bp, Homo sapiens
gtgactaagattctttgatatgaatttaggtcatcctgaaatataataaattttggttac

SEQ ID NO: 6855926 - DNA, 77 bp, Homo sapiens
cttgtttcaagtgtgtgggcaggcagtggtcggggagggcgctctggtatatcagtgcactccatacttgagttgag

SEQ ID NO: 6855927 - DNA, 62 bp, Homo sapiens
tttgaatgtacatgtgaatttaggcaatggaaaacacattttgcctgcactgtatatataaa

SEQ ID NO: 6855928 - DNA, 85 bp, Homo sapiens
gcatatactttgcgatgaattgtttgaaaagtggagatttattaaatgaggaaagattccttttgaagctttttgtgcagtatgc

SEQ ID NO: 6855929 - DNA, 64 bp, Homo sapiens
tgtagtgggtagaggccagggacgctgctcaacatcctttagtgcccgggacagctcctcaaca

SEQ ID NO: 6855930 - DNA, 55 bp, Homo sapiens
ggtgggggtggtttttcaggttaagtttgctctacagaaactggctactctctcc

SEQ ID NO: 6855931 - DNA, 104 bp, Homo sapiens
ttgagacagggtctcactctgtcgctcaggctggagtgcagtggtgtgatctcagctcactgcaacctccacctcccgggcttaagtgattctccttgcctcag

SEQ ID NO: 6855932 - DNA, 130 bp, Homo sapiens
aggccaatttggaggaaggagattcataaatccacgggattattctaactttgtcagttcaccagagttaaagaaagataattcgccttggggaaaagtctatgtaattacctacttttaaaaaggacct

SEQ ID NO: 6855933 - DNA, 57 bp, Homo sapiens
gctgtctgccgcaggctgccaccatcccgtaggccgggggaaacctgcggaggctgc

SEQ ID NO: 6855934 - DNA, 82 bp, Homo sapiens
gtactgtgagaaccaactttgtgtgtttaatatggctgtatgctcagctaaattaaaacacagaggtaaagctctacctgac

SEQ ID NO: 6855935 - DNA, 58 bp, Homo sapiens
tagtccctgcccttaaagggtgcagcccacattctgcaacctgagacccacgggacta

SEQ ID NO: 6855936 - DNA, 56 bp, Homo sapiens
gggggataagcggggagaggaaaaccactcactctcacatgccctgtcagtccccc

SEQ ID NO: 6855937 - DNA, 60 bp, Homo sapiens
gctgttttgaagatgtggtctcagatcctcagcccaccattcaaggtcttcacagtcagc

SEQ ID NO: 6855938 - DNA, 130 bp, Homo sapiens
gtccctgcagcaggaagaagcatttcctggccctggtctcctctcaggggtccccggccgagtatcctgtttctgctctgccagggcatcctgtggtggtccccggggctgctggagcctggcagggggc

SEQ ID NO: 6855939 - DNA, 85 bp, Homo sapiens
catctgtttctggtaatgtcacatctagtaaattctgtttataacatatatgctgggactgtgactcatggccacaggcagactg

SEQ ID NO: 6855940 - DNA, 55 bp, Homo sapiens
ctgagacccagacacctgaggaggaagtgctgcctggctagtgctggtgtctcag

SEQ ID NO: 6855941 - DNA, 55 bp, Homo sapiens
caggggtgttgggccagggccagggaagtccatctggcagcacccacaccctctg

SEQ ID NO: 6855942 - DNA, 69 bp, Homo sapiens
agatttaatgatggcttctaacaggcttctctcattcttgttgaactggttacaagccttgttaaatct

SEQ ID NO: 6855943 - DNA, 83 bp, Homo sapiens
taattctgcaggtttgctctgttcaaagttaataggtctgtatggtgacccatagatgagacaaagtagagactgctatgtta

SEQ ID NO: 6855944 - DNA, 57 bp, Homo sapiens
gtgcccttataaacaaggcttcagagagcttttgccccttctgccatgtgagggcac

SEQ ID NO: 6855945 - DNA, 79 bp, Homo sapiens
gacttcagttccacctgggaactctaggaggctatatacaacatatcttagagttatcctgtcctaggggaggggagtc

SEQ ID NO: 6855946 - DNA, 62 bp, Homo sapiens
gaggcccaagagtgctttcatgagattgcagttactgatgagactcagcacttgtgtgtctt

SEQ ID NO: 6855947 - DNA, 82 bp, Homo sapiens
tctgtacattcctcagcattagcacagacattcaaaaaaatgggtgcaatgtgtgataatggtggcaaacaggaaagacaga

SEQ ID NO: 6855948 - DNA, 82 bp, Homo sapiens
cttaaggatgagaagtgatgttgccaataggggcattggctctctgcaagatccttaaacaacacactttgtagtcctaggg

SEQ ID NO: 6855949 - DNA, 83 bp, Homo sapiens
ggagacctggcaggatgccttggacacccggtcgctacgcagcagaagccaagtgcataggcgtcctgcacagaagagtttcc

SEQ ID NO: 6855950 - DNA, 128 bp, Homo sapiens
tcattatccaggctacttttccttcttgatgctcctgttagtttatgcttaagaatgcaaagaatgcatcttaatgctagccaatagagaacataataaagatggtaaatgtcccataagaataatga

SEQ ID NO: 6855951 - DNA, 88 bp, Homo sapiens
gtctggctgtttcctcactggatttcgcttttgaaaaacatttttcatccacattttcagtcatggattcactgaggagatatttggc

SEQ ID NO: 6855952 - DNA, 61 bp, Homo sapiens
ggggggaaggggcaccttcaggtcacctagacaattggataaatggtgctatcacccaccc

SEQ ID NO: 6855953 - DNA, 77 bp, Homo sapiens
ggcaggtggttcagtggttagggccaaccatctacttcagttcctgtctggcccagatctctgaccttgaccatgcc

SEQ ID NO: 6855954 - DNA, 76 bp, Homo sapiens
gccgcgaccgctccctctgtccgaggccggctccgtcgcgtcgcggagcagctcgggctacagagggggccgcggc

SEQ ID NO: 6855955 - DNA, 57 bp, Homo sapiens
ggagggggaaactttggctgccaatttcagggcagccagccagaagattctctctct

SEQ ID NO: 6855956 - DNA, 70 bp, Homo sapiens
atatgcaactatatgatgtggcatagttttaggctttcctgaatatggcaactcttgtaactatgtatgt

SEQ ID NO: 6855957 - DNA, 61 bp, Homo sapiens
ggggagatgctcacggttccctcacttgctgctcctgtagaggagctggcagcgtctccgc

SEQ ID NO: 6855958 - DNA, 84 bp, Homo sapiens
tggggggccttgggcctgcacacttaagcttgctgctatcccacggagggcagctggaaggtggcttccctggggcccagccca

SEQ ID NO: 6855959 - DNA, 87 bp, Homo sapiens
accaggcaagaggtgtgaaaataggacctggagccaggaacgtccagtgtctcaagttccagccctgtggcttccacccttcctggt

SEQ ID NO: 6855960 - DNA, 85 bp, Homo sapiens
ttggctgctccatgtgttctcagggaaaataaaactgcaacctcagattgtagctgtgtgcccatggtggaggcatgcaggccaa

SEQ ID NO: 6855961 - DNA, 88 bp, Homo sapiens
gctcgatgctgtctcatcacctcatttagggtacaatatgctgaggaactgaccaaaggtccctgaacagtgagagatagggaagagc

SEQ ID NO: 6855962 - DNA, 55 bp, Homo sapiens
agaaattcaccctggagaagtagtattgagtcactagttcacaggccaaatttct

SEQ ID NO: 6855963 - DNA, 58 bp, Homo sapiens
aaggctcagctactcagcctgcacaaggcaaaggcccaggttcagtgggttgaggctt

SEQ ID NO: 6855964 - DNA, 55 bp, Homo sapiens
gactgtctctgtgaatggtagggtaactgtttccctgccactgtaggtgacagtt

SEQ ID NO: 6855965 - DNA, 71 bp, Homo sapiens
gctatgacgtcatcttgtggtctgctgaaaggctactggagccacagcagccagacaagatacatcaaagc

SEQ ID NO: 6855966 - DNA, 59 bp, Homo sapiens
gtgatagtctcctggttgtgttgccgagctctggcattctgcttaagggaggctgtcat

SEQ ID NO: 6855967 - DNA, 85 bp, Homo sapiens
cttttaggtatttctgagcagtctagccaggtgttcagtttatgggcacggagtttatgaggctgctttagattcatttacagag

SEQ ID NO: 6855968 - DNA, 61 bp, Homo sapiens
tgtgtgttatcttagttcatctcacaaaagccctaggaagagatgactacgatgatgccca

SEQ ID NO: 6855969 - DNA, 112 bp, Homo sapiens
caggaaagaaaggtctgttgggtccagagcatgcagatcatcaagatatagaccatgtgctgtggccttggtgatctggtgtactctgttcccaataggcctgtgcctcctg

SEQ ID NO: 6855970 - DNA, 82 bp, Homo sapiens
ataggcattgatatttttgggttctgtatttactgtttgttcagtcagtaatgtaatggagctctgatatatcaattattat

SEQ ID NO: 6855971 - DNA, 128 bp, Homo sapiens
acggattgtggctcacctaagcagggaagccgatttggaacttaaacaagctcccaagttgtgatcagtcgagcttggcaagcactgtttgagagagtaggtgtcctgcaagcaggagccggttttgt

SEQ ID NO: 6855972 - DNA, 72 bp, Homo sapiens
ctggctcctgggccctgggctaactcactggctcagccttggagcccagggggccagggcaccagggaccag

SEQ ID NO: 6855973 - DNA, 119 bp, Homo sapiens
tgctaggatggcttacagaacacaggaagacactcattatcactggtttattataaaggatttaaatgaatagccagatgaagaggtccttaagctgaagtccaggagggttcctagca

SEQ ID NO: 6855974 - DNA, 63 bp, Homo sapiens
ctctctgatgtggcagctgcatctaaatgctttttagttgtttcacatgccagcattcaggag

SEQ ID NO: 6855975 - DNA, 86 bp, Homo sapiens
ggaacttatactgtaacagccaggttagtgctaattgtagacttacagtaaagccttctggttgacagtcactacaccagagttcc

SEQ ID NO: 6855976 - DNA, 64 bp, Homo sapiens
actgagaagtcaggttctcttcttcccactagaaaaagggataagaggaaattgatttgtctgt

SEQ ID NO: 6855977 - DNA, 73 bp, Homo sapiens
agcagagcagggattttgccatagctatctgattttccttcttacagaatctgtgtattccttgctcatgtct

SEQ ID NO: 6855978 - DNA, 91 bp, Homo sapiens
tcattaattcctcaggtcattctggaagacattaatttggtttggactcacgacgaggggagattttccagacatacaccaggaattatga

SEQ ID NO: 6855979 - DNA, 84 bp, Homo sapiens
gcaggctgcacggcagctctcagcggttggagttaggttctgtagctcttccaggctagagttgttgcacacttgtggctctgc

SEQ ID NO: 6855980 - DNA, 58 bp, Homo sapiens
ggagatgaccaagccttggtctgctctctagcagcttccacagacttggctcgtggcc

SEQ ID NO: 6855981 - DNA, 63 bp, Homo sapiens
gataatggccgggggctgaatgctgctgaacagtaaagagcatagatgccaaaggtcataatc

SEQ ID NO: 6855982 - DNA, 130 bp, Homo sapiens
caactcccagttatgtgttgggtgaggctctagatgtattgatgttcttgggatgctttttcatggattccagggaagagcaaggcagtttatagacagcttattccaacactgggtttgaactaagttg

SEQ ID NO: 6855983 - DNA, 97 bp, Homo sapiens
agtctcctggcagcggagctcctgctgcccgccatgggtgtctgtgatgctgccgtgcccactgggggctgcaggcactccagcatcaggatggact

SEQ ID NO: 6855984 - DNA, 63 bp, Homo sapiens
atgagagtttaaaaccagacactgtttctgggacccctggggttcgggagtctggaactccat

SEQ ID NO: 6855985 - DNA, 117 bp, Homo sapiens
ttgagacaggagaaagggaaataatccaagggtgcatgttgaattggccatcactatggagggctgatgcaccatgtagccaggaatttctcaggaatctcatggaacatgtctcag

SEQ ID NO: 6855986 - DNA, 88 bp, Homo sapiens
tcttctgaggcaaagggtaatggaatggaacatcatagttgaggtattggcaagtggtggccaattcacagggctcattggcagagga

SEQ ID NO: 6855987 - DNA, 56 bp, Homo sapiens
ctgttagtgatcaaagggagaggtagtcatcaaaacagctccccttcactgaacag

SEQ ID NO: 6855988 - DNA, 72 bp, Homo sapiens
gaggtagggagggactgcctgattagcactgtgcccttgatatgccagcatcaggtccagctcctgtgcctc

SEQ ID NO: 6855989 - DNA, 73 bp, Homo sapiens
tgagtcattttgtaaaggtatacttagctgaattgagatgcctcattcagtggatatcttcacttttgagtca

SEQ ID NO: 6855990 - DNA, 87 bp, Homo sapiens
gtgcagaagacagatggatcttggagaatgacagtggattatgtaagcttaaccaggtggtgactccaattcctgctgctgctgtac

SEQ ID NO: 6855991 - DNA, 58 bp, Homo sapiens
gagcctgatacacaagtggaaggagacgggcaaaggcctgctcctctcgtgtaagctt

SEQ ID NO: 6855992 - DNA, 60 bp, Homo sapiens
gaggacactggactcctggcagcaggttctgtcgaccccacctgtgagtcttgtggcctc

SEQ ID NO: 6855993 - DNA, 73 bp, Homo sapiens
atctttacaagtaaagctatcatcaatgcaacttttctaaaaggaggttgagtagatagttctttgtttagat

SEQ ID NO: 6855994 - DNA, 83 bp, Homo sapiens
gtcccttctctccccacactccccaagccccgctctcagtgggtccttaacaaacggggaaaaggtggagagagaagcaggac

SEQ ID NO: 6855995 - DNA, 80 bp, Homo sapiens
aggccaagttatggcagttacccttgatgataccaacacatattcttgataccatcttttgaatttttatatattggcct

SEQ ID NO: 6855996 - DNA, 82 bp, Homo sapiens
tgggctccctgggcctgccacggagccagccctctgccgtggggttcagggcctctggcaggcaggccctccagggacccca

SEQ ID NO: 6855997 - DNA, 72 bp, Homo sapiens
gggcatgtaggaatccatggagagggtcatcattataataatccactcaagatgatttgatttctatagctc

SEQ ID NO: 6855998 - DNA, 80 bp, Homo sapiens
actttgggtctctgtcaaattcataacacttatttcttggtggaatacagttaatgagttggacagttcaggaaagaagt

SEQ ID NO: 6855999 - DNA, 59 bp, Homo sapiens
gggaaattcttagaaagcaatgctttgcaaccacaatgcatcaaagtctgaaatttctc

SEQ ID NO: 6856000 - DNA, 58 bp, Homo sapiens
ctcccacacagcccgctcaccggaccccaccccgtccgggccagatggctctggggag

SEQ ID NO: 6856001 - DNA, 94 bp, Homo sapiens
ggtcttcggggtgttatgagagactatgggtacaagtgatttattccgtgtaatttagaagtgggcctatagtcctcttgtgttttgggagact

SEQ ID NO: 6856002 - DNA, 60 bp, Homo sapiens
cctggccacctctgccctactgagtgggacccttcaccgggcaggaggggggtggcctgg

SEQ ID NO: 6856003 - DNA, 63 bp, Homo sapiens
agtgttcccaggcgttgccaaatgtcctctggaaggcaaaaatcacccctggttcagaacact

SEQ ID NO: 6856004 - DNA, 79 bp, Homo sapiens
tcttatgaaaatactgaacatgtttgcagtcaattccatgactccttggtgatttagatattttagttaaagcagaaga

SEQ ID NO: 6856005 - DNA, 98 bp, Homo sapiens
ggacagcaacatttcaactttgatttaacatgtgggagacacaaaaacaaggcatgtttctgacctgaatgaaacagatggtgtaatgctgactgtct

SEQ ID NO: 6856006 - DNA, 77 bp, Homo sapiens
gttgtagtctgcgttagtcttggctgatcttggttggatttactcgtgtttcagttagctgacaagtaggctagagc

SEQ ID NO: 6856007 - DNA, 106 bp, Homo sapiens
tataaatcacaggtcattttcttaagaagcaagtctcagcaaaatattttctcataaagaaagagaatttgaagagacaatttggaaagcaacctgttgacctata

SEQ ID NO: 6856008 - DNA, 78 bp, Homo sapiens
cagaaggtgtcaaggaggaagtgagagatgactattttaacaaagatgttctattttcacttttgcaatgagatactg

SEQ ID NO: 6856009 - DNA, 65 bp, Homo sapiens
gcctggcattaaagggtaaattaaaattacgactatatttggtgttcatcttttagtggcatggt

SEQ ID NO: 6856010 - DNA, 104 bp, Homo sapiens
tgaggcaggagaatcacttgaacccgggaggtggaggttgcagtgagctgccgagatcgcaccactgcactccagcctgggtcacagagtgagacccggtctca

SEQ ID NO: 6856011 - DNA, 76 bp, Homo sapiens
agttaataagctgaggctctggctgcagaacctgaactcttaacccctctgcagaattgtctcaagctagatagct

SEQ ID NO: 6856012 - DNA, 57 bp, Homo sapiens
ctgaccttgtgatctgcccaccttggcctcccaaagtgctgggattacaagtgtgag

SEQ ID NO: 6856013 - DNA, 58 bp, Homo sapiens
tgtggggaggctgcagtgctgctgtgtagcatttcttcctggtgtgagcctctccaca

SEQ ID NO: 6856014 - DNA, 94 bp, Homo sapiens
aggacagaactgtctctgttaacttccagggctaaggcaatgtatagccttcaggatttaggaagatgaacataccagagatagcttgaatctt

SEQ ID NO: 6856015 - DNA, 75 bp, Homo sapiens
agggttgcacaggcacctccaggggtatgttctggccactccgtgctgcaatcttggggctgcctgcccatccct

SEQ ID NO: 6856016 - DNA, 63 bp, Homo sapiens
tttttagagtagtaaccattagaagtaaaattaaattcttctaataaataaatgctctaggag

SEQ ID NO: 6856017 - DNA, 97 bp, Homo sapiens
cattgtgtatgtttatgtatttgtgtgtaggtgtgtatgtgtgtgtgtgatacatacatacatcaagtatcacaagacattgaccttatatattatg

SEQ ID NO: 6856018 - DNA, 60 bp, Homo sapiens
gggtggctgtgagcattatgtgaggtggctcatttgacagttgcgtttactgccgaaccc

SEQ ID NO: 6856019 - DNA, 66 bp, Homo sapiens
catattgtctatggctgctttcactctaaaacagcagagtagggtggttgtaacagagaccatatg

SEQ ID NO: 6856020 - DNA, 63 bp, Homo sapiens
ggagaaactcagtgaattttcatcaaattggatagagcccagcagtgattttactgaatctcc

SEQ ID NO: 6856021 - DNA, 69 bp, Homo sapiens
ttagaaaacataagtggtaaagcattacctctattaataatatttgtatgctgcttatgcattttctga

SEQ ID NO: 6856022 - DNA, 61 bp, Homo sapiens
tagatcaggagttggcaggctatagccccaaggccaaattctgcctgccagcctgaatctg

SEQ ID NO: 6856023 - DNA, 59 bp, Homo sapiens
caagattaccaaggaccagcgggtaatgtttgagtccgatggatgggatccttatcttg

SEQ ID NO: 6856024 - DNA, 59 bp, Homo sapiens
ctgtgtcatctaaaaagagagatattttccaaggaagttctaaattttggaagatgcag

SEQ ID NO: 6856025 - DNA, 59 bp, Homo sapiens
gaggtgtagagaaagagctctgtctcctccctgggagaatactcctttccctacacctc

SEQ ID NO: 6856026 - DNA, 59 bp, Homo sapiens
ggtcagcagtgcagggcagagctggatgcagctttgccagcttgaactgtgggctggcc

SEQ ID NO: 6856027 - DNA, 80 bp, Homo sapiens
gcagactatacattgctatagccctcattattttacagctgtcaagtaaaaccatgagcagctgggctgaactggtctgc

SEQ ID NO: 6856028 - DNA, 57 bp, Homo sapiens
ctggggctcactccagccctggcaagtagccagatatccttgggttgagaccctcag

SEQ ID NO: 6856029 - DNA, 62 bp, Homo sapiens
taccttctaggtgatggttacatgggcatacacatcatcgtgctgtacacttaagataggta

SEQ ID NO: 6856030 - DNA, 62 bp, Homo sapiens
tgcccaggacccttcaatggctcccactgctgtcagggacaatttatgggtcctggtgtgca

SEQ ID NO: 6856031 - DNA, 65 bp, Homo sapiens
ttatcatcactggatggaaatatacagcttactgctaagatcatatttccaggttagtgaggtaa

SEQ ID NO: 6856032 - DNA, 130 bp, Homo sapiens
gtattgcctattttaaaaattaattgaaattgtatcattgaggtatagaataaaatgttaagtaaacattttggtacctacagctgaattagatgacttgcattcaaacgtttccttttgaaagcaatac

SEQ ID NO: 6856033 - DNA, 91 bp, Homo sapiens
gagaagggttataaatctggatgtaacgaaggtttcaccccagtggtaatagagttagagggtgaaaggttgcatcttgttcaaccttctc

SEQ ID NO: 6856034 - DNA, 56 bp, Homo sapiens
gcctcagttgggccagttctaggggccatcccaacccctgtgtggccagctgaggc

SEQ ID NO: 6856035 - DNA, 83 bp, Homo sapiens
gataagaacaggaggggaaactcagacaggaaagaagccttatactaaactttcttgcagagtggttcccctctacgtttatc

SEQ ID NO: 6856036 - DNA, 102 bp, Homo sapiens
gcagcattattgtcattatgttagccccattttcctttgtaagggcatcaggattaaggttctctttggagatatggtctagtatagagattgcgatgttgc

SEQ ID NO: 6856037 - DNA, 71 bp, Homo sapiens
acagaggaccacagatgagcctgcagagaaatactctactagtttgccggctctatgtggttttggattgt

SEQ ID NO: 6856038 - DNA, 84 bp, Homo sapiens
ggcatttgctgaacttgaagggagcagtaagcagtgacagaataatgaatattatcactgacctgtatcagttgtgcaaatgcc

SEQ ID NO: 6856039 - DNA, 76 bp, Homo sapiens
agtaattctactaggaatttatgatgaggaaatagttgatcaaaatatagtcaaatgaattcatagtagaattatt

SEQ ID NO: 6856040 - DNA, 71 bp, Homo sapiens
agcaaggtaatgtctccagaagcctagacagccaatgtgagcatatttaaggcttctgagtcacatttgtt

SEQ ID NO: 6856041 - DNA, 63 bp, Homo sapiens
gcgttgaaagaagagatgctgtctatacaccctgtgtgactgccgattgtccttctctctagc

SEQ ID NO: 6856042 - DNA, 85 bp, Homo sapiens
gtagagaggtcaggatgatttttgttgattttgtacttgctaagtcactgtcttgcaaaggtcagctcctagtcctggcccctac

SEQ ID NO: 6856043 - DNA, 63 bp, Homo sapiens
ccggcctcaaccttcagggtccctgactgctgcatggaacacgcctttggaggatgaggctgg

SEQ ID NO: 6856044 - DNA, 67 bp, Homo sapiens
gcttgtgggtgtgccctgggagatcccttttccttggccactgggctctcctgggtccaacccatgc

SEQ ID NO: 6856045 - DNA, 72 bp, Homo sapiens
tcctacgtgggaaaaagcaggctactgaggacaaaaacctcccaaccctccccaccttgttttccactggga

SEQ ID NO: 6856046 - DNA, 56 bp, Homo sapiens
caggctgattgaagtttttgtgggtcataggaccttggcaattgtttgtgagcctg

SEQ ID NO: 6856047 - DNA, 100 bp, Homo sapiens
ctccttagatccccggagctcaggactggaggagcggggcttgttttcaccttgaccgaccctctcccgcctccggcttcttgtgcgagggacctgggag

SEQ ID NO: 6856048 - DNA, 67 bp, Homo sapiens
gatatcccaggccttgatgggagttggggttgcatagagcacaatttttcttaggtcctggcatatt

SEQ ID NO: 6856049 - DNA, 128 bp, Homo sapiens
gaagagatgaatcatgtgcataatttctacaagttaacaacatataagaagcagaattctacagatgataaagtagaatatgtttgacatctaagaattcttactttagaagtgcagtttagctcttc

SEQ ID NO: 6856050 - DNA, 65 bp, Homo sapiens
ttgtgggcttactatactaaaagggctatgaaaaatagcctgtattggaagcagtagggacataa

SEQ ID NO: 6856051 - DNA, 89 bp, Homo sapiens
tttttacagagcactgattggtgcattttacaaaactctagctagctacagagtgctgattggtgcattttacaatcctcttgtaagaa

SEQ ID NO: 6856052 - DNA, 101 bp, Homo sapiens
ctagtgggtgcagagccagacaggaggcacttcccgtctcagcctcagcctctatctccaccggcatggctaagtgctgctgtcagcttctcacccgctgg

SEQ ID NO: 6856053 - DNA, 61 bp, Homo sapiens
atagactgtggaagacacagaagctccaagacatggggcttctcagtagtacacacactat

SEQ ID NO: 6856054 - DNA, 67 bp, Homo sapiens
aggtgagcacctctccagctggaacatgaagttagttaaacatttccagtagggagtctgcttactt

SEQ ID NO: 6856055 - DNA, 82 bp, Homo sapiens
gacaggattccagtacaggtctctcatttccttcatgattaggaatactactttgaaatgagagacctgtactgtatctgtt

SEQ ID NO: 6856056 - DNA, 129 bp, Homo sapiens
ggaatgctctccctgccctttcccaaggtggaaactgaggcttggaggggtctggtctctggttaacagatacccagccaggcttccaggcttccaaccccagctgggctgggggagggggtggctgac

SEQ ID NO: 6856057 - DNA, 80 bp, Homo sapiens
catattctaacagccaggaattctggagaagaaaaattgggtaataaatcttatcagattatctgggctgtcctgatatg

SEQ ID NO: 6856058 - DNA, 110 bp, Homo sapiens
ttgccatcaaagcaaatgacagaggcagtcaagagctggggctctgggtttaagcagatgtgggtttgaatcctggttccagcattcttcaaccatttgactttgggcaa

SEQ ID NO: 6856059 - DNA, 80 bp, Homo sapiens
ttcagccctagtgtatcctggcctaaaaatacagaacaatcaagttgattgttggaaatgagaggctaggcagggttgga

SEQ ID NO: 6856060 - DNA, 88 bp, Homo sapiens
ataaaacacgtggacaggtaactgggaatacatctgtatcatataggtgacaggtgtccaacatttacctttaaaacatgtgttttgt

SEQ ID NO: 6856061 - DNA, 64 bp, Homo sapiens
gaactcgttgctgaagccaaagtcagcaatcttgatgttggcctcggcatccagcaagaggttc

SEQ ID NO: 6856062 - DNA, 55 bp, Homo sapiens
tagtgtaattccccttcatgtattttcatatgcttgaatgggatggaattcactg

SEQ ID NO: 6856063 - DNA, 56 bp, Homo sapiens
cctcctgcctgtttacctgtacttagtcacagtgctgtccaggacccagcaggagg

SEQ ID NO: 6856064 - DNA, 62 bp, Homo sapiens
tgcccaagccaggctgtttttattactgtggctttacaatatgttttgatagctggtgggca

SEQ ID NO: 6856065 - DNA, 57 bp, Homo sapiens
cagcatgttcttgtctcactgggtgaggagatgacagagagaggaggagagatgctg

SEQ ID NO: 6856066 - DNA, 77 bp, Homo sapiens
gagcccaccacctgtgcaaagactggtcaggacttgaaccctgaaaggccctctgcatgggaggctggtggacgttc

SEQ ID NO: 6856067 - DNA, 92 bp, Homo sapiens
agtgcagaggcataacagaagggtgggccctggcagccatctgggtctcttccttcctaaccatggtggcaggtgcatccttctttgacact

SEQ ID NO: 6856068 - DNA, 82 bp, Homo sapiens
gatcacaggaatcaaaacctcatggtgctgctttgtcgtgtgctagcaccagcctgagagttttcttggatgccctgatttc

SEQ ID NO: 6856069 - DNA, 64 bp, Homo sapiens
ttttccctaatgacaaatgattttgagcacttctttgtgtgcttattggccattaaagggaaaa

SEQ ID NO: 6856070 - DNA, 57 bp, Homo sapiens
aggtggctcacaccggtaatctcagcactttgggaggctgaggtgggtggatcacct

SEQ ID NO: 6856071 - DNA, 62 bp, Homo sapiens
ttaatgatgtatgtgtgcacgcatatgtgtgcatatgaatgcccaagcacatgcctctctaa

SEQ ID NO: 6856072 - DNA, 58 bp, Homo sapiens
cagtgtacttggaatgtaacagctgctcaaaatgtgtgtgttgaatctgagtctactg

SEQ ID NO: 6856073 - DNA, 78 bp, Homo sapiens
tcccctgagcaggcggtggagcggctcgccgccccaggccgcggccgagtctaggccccgccgctgttcaccctggga

SEQ ID NO: 6856074 - DNA, 108 bp, Homo sapiens
gcctgatgtttttcaagcatttatgacaattttccccataggttatcttgagtatcaatatgattttctaaatgggaaaattgctgagtcctagatacaatgtaaggt

SEQ ID NO: 6856075 - DNA, 74 bp, Homo sapiens
ggatgtgtcttggctactttgctgcccagcagtgcctgctctcaggcacatgtgagagtagaggcctagcatcc

SEQ ID NO: 6856076 - DNA, 58 bp, Homo sapiens
gagcagagtgccagtatttgttgtgaagccagacagaattaacatggtactcctgttc

SEQ ID NO: 6856077 - DNA, 73 bp, Homo sapiens
ttatagctggagtcatgtttctggaagttttaccatacaagcagtatatccatcaagatgacttttgctataa

SEQ ID NO: 6856078 - DNA, 67 bp, Homo sapiens
tctcaggccttaattaatttggcactattggttaattagctggaggtgtcatttagttaatcagaga

SEQ ID NO: 6856079 - DNA, 65 bp, Homo sapiens
acatctggttacagatttagaaagagaacactttcttctttcacagtgctctgtaagtatggtgt

SEQ ID NO: 6856080 - DNA, 56 bp, Homo sapiens
ccgatgtggactctgagatccggagaggaaaactgctctacttcaggccacatagg

SEQ ID NO: 6856081 - DNA, 58 bp, Homo sapiens
tcagacaggctggacagcttgcttacagaagcagagccaggatccggatctgacttga

SEQ ID NO: 6856082 - DNA, 71 bp, Homo sapiens
gcatgagagtgccttgtaaacctgccctgctgcagcaatgagggcatggcttctgccaggcacctgtaagc

SEQ ID NO: 6856083 - DNA, 65 bp, Homo sapiens
ggcacacagacactccaaaggtatttgttatgattattaaagcagtgggggagtgttagtttgct

SEQ ID NO: 6856084 - DNA, 83 bp, Homo sapiens
gaaataaattgggaagtatctctctgtctagctttggcagttttaccaggatgggcctgggatatgctttagtaatttgtttc

SEQ ID NO: 6856085 - DNA, 78 bp, Homo sapiens
agtttctttctgtctttgttcaggctgctatagcaaagtagcatacactaagtggcttacaaacaacagaaattaatt

SEQ ID NO: 6856086 - DNA, 82 bp, Homo sapiens
agattctagaccagtggtttccaaacttgttccacattagtatcacctggacatctttagaaactactgctgtctggcttct

SEQ ID NO: 6856087 - DNA, 78 bp, Homo sapiens
cagccgggtgaatggcagaaagaatagaggctatttgaatactgatgtggccctcactttcttctatttccattaatg

SEQ ID NO: 6856088 - DNA, 72 bp, Homo sapiens
acttaccccacatcacgtagctggtggaggagaaaaagaccctgtgaaggctgttggatggggaaggtaagt

SEQ ID NO: 6856089 - DNA, 99 bp, Homo sapiens
ttggaataaggggaagggtgtggtttgaagggagatggaggaaagaaaaagtaatttcactatctctccacaatgccagtgttcatacttgaattttga

SEQ ID NO: 6856090 - DNA, 89 bp, Homo sapiens
atgtccttaagtacctcttgaaagctccatattgtagagaagaccctatgacttctagatccgcaggttttcagtggggtagggtacgt

SEQ ID NO: 6856091 - DNA, 87 bp, Homo sapiens
gtgtggaaaatggcaagacagttctgtgagccatgtggttggaacaggtccatagaggcactgatctttctgggatgccacccgcac

SEQ ID NO: 6856092 - DNA, 74 bp, Homo sapiens
gcctgtacatgtgtgcgagcaggccaggtgcatgtatgtgtgtgcatgctgtgagtgtgccgcagagggcaggc

SEQ ID NO: 6856093 - DNA, 106 bp, Homo sapiens
tttcttacctcccttttattctgtcaaacttatacatgtgacattccatttcctcagggtcttgatgtttactggtttatagaataagcaggttcacaccaagaag

SEQ ID NO: 6856094 - DNA, 88 bp, Homo sapiens
atgagaattcaaagtatgtatgtgtgtggtagtgatggtgggggcacccattactttccaatatatcagtataactccttattcttat

SEQ ID NO: 6856095 - DNA, 81 bp, Homo sapiens
cccagttatacaagtgttaggtgtaggttccaggtattagaaactgagcaggtcacatggtagcacttcgctgtaattggg

SEQ ID NO: 6856096 - DNA, 63 bp, Homo sapiens
cacaacacacattaatatcaaaggctcattatagcagtgactgtgaacctgggtgtgtgtgtg

SEQ ID NO: 6856097 - DNA, 58 bp, Homo sapiens
ctggcagcgtgtttatgaacatctgcatgaaactgtgcttggcataaacacgttgcag

SEQ ID NO: 6856098 - DNA, 79 bp, Homo sapiens
gtggaacaagcaagcactgcatgtctttcattcagagttctctgaggaaccaccttgggtaggcttttgtttgtcacac

SEQ ID NO: 6856099 - DNA, 55 bp, Homo sapiens
ctggagagtgatgaatggttaaacagcaattggttgtctttggcctcattcccag

SEQ ID NO: 6856100 - DNA, 73 bp, Homo sapiens
aaagagatgcacatacgtcagtggctgtcatccaaatggaaatatgaacacatctgcgtgtgtctctctcttt

SEQ ID NO: 6856101 - DNA, 65 bp, Homo sapiens
ggcccctccccacagcccaggagacttcactaatagatgaagatcctggggtctggggaggagcc

SEQ ID NO: 6856102 - DNA, 62 bp, Homo sapiens
gctccttatggtcctgaccctacagttcctgtcccatgaccagggccagatcaccaaggagc

SEQ ID NO: 6856103 - DNA, 95 bp, Homo sapiens
agttcaaagcccaaaatgacgattcatagagcagctcactgaatacatgttacatggagatttatactgagcagctcatggtcagggaaagaatt

SEQ ID NO: 6856104 - DNA, 90 bp, Homo sapiens
ggagccagactcagagcagagcagcctgaggagcattctcactaaacaaacatgtctccagaactgcagtgctctgtatctccaggctcc

SEQ ID NO: 6856105 - DNA, 82 bp, Homo sapiens
gctgggtgtctttggcttgggtctctcatgcagttgctgtcagatagtggcaggagcagtcaggggcagctggacaccatgc

SEQ ID NO: 6856106 - DNA, 62 bp, Homo sapiens
tagaagagacaagactacatttatatacttatcagtgttttatgtagggtttgccttctcta

SEQ ID NO: 6856107 - DNA, 107 bp, Homo sapiens
tcactattggctcgtcctaggagctgcgcacgcggactggacagcctgaaaggcgctgttgctagggtgccaggattcgctgcagcagcttccggaaaaggcggtga

SEQ ID NO: 6856108 - DNA, 72 bp, Homo sapiens
gagtgggtgagagacttggcacagattggaagggatgtgaaagacttcctggaagagggtttctcattactc

SEQ ID NO: 6856109 - DNA, 73 bp, Homo sapiens
ggatttgggtggaaggcaggctgggcgacccttgaggagagttgctgtaagtatctttctacccccaaaatcc

SEQ ID NO: 6856110 - DNA, 60 bp, Homo sapiens
cctgaggacacacgctgcaggagagcagcctcgagtcttttctgccttcgaggtctcagg

SEQ ID NO: 6856111 - DNA, 102 bp, Homo sapiens
tgaggcaaagttttgcccttgttgcccaggctggagtgcagtggcacaatcttggctcactgcaacctccgcctcttgggttcaagcgattctcctgcctca

SEQ ID NO: 6856112 - DNA, 111 bp, Homo sapiens
atgttttaaaattccaaactcctgtgggaatgaaatgtgtttctttgtgaatgggtatctgttactgtcacatgccgcgcaaattctcatggaggtagggatagcagacat

SEQ ID NO: 6856113 - DNA, 65 bp, Homo sapiens
agaggagctgagccacgtcctggcggccatgaagaaagcagctgccaggaaggactgagctccct

SEQ ID NO: 6856114 - DNA, 87 bp, Homo sapiens
agttggagtttaaggaatgtcctaagttgatctgtactaatttccaggaattaatttgcaccttgggctgtgccttaaattctagct

SEQ ID NO: 6856115 - DNA, 127 bp, Homo sapiens
tctcctcttttttccttttttctacccttaagtttctgtggggccttaaattctgtgagctgcagaaggactctctccacagctgtaaatataggggacgtgggagagagaaagaaaaaaggagaga

SEQ ID NO: 6856116 - DNA, 73 bp, Homo sapiens
tccctggctgtgtgcccccggcaccgcggagcgcccaggtgaaccctcgactgggggcagccgcaccagtgga

SEQ ID NO: 6856117 - DNA, 64 bp, Homo sapiens
ctggattcagctgatcagaatcacttttgtaaattatttggttcttctcaattagttgattcag

SEQ ID NO: 6856118 - DNA, 75 bp, Homo sapiens
gtgggtgtgataagaccaagggcttcaaaagcatatgtacaatgggcttgtcccttgtgtttctattatggccac

SEQ ID NO: 6856119 - DNA, 70 bp, Homo sapiens
ggttaccaggacatgttgcaagtttatatgcatgttctcatatgaacaataatcatgtctatgattagcc

SEQ ID NO: 6856120 - DNA, 56 bp, Homo sapiens
atgaggtattagcagtaactgaacaaggggaaagtgagtgttggctaatgctacat

SEQ ID NO: 6856121 - DNA, 57 bp, Homo sapiens
gaatgattacagtcactgtacttttattctccagaagtgctaagtactgtaatcatc

SEQ ID NO: 6856122 - DNA, 108 bp, Homo sapiens
gtaaagaatactagttcctgtcttccagaattttctctatagtcaaatgaaagcttgatctttcacatttgttttaagaagttgggctgacactggttttctctttac

SEQ ID NO: 6856123 - DNA, 75 bp, Homo sapiens
tttttaatgtcttagtaccttaatttcctcatgtccaaagtgaggctaaaaacagggtgattgtgacaagaaaaa

SEQ ID NO: 6856124 - DNA, 73 bp, Homo sapiens
gtctgctctacctcccccattttcccattccttcactctccagagtaggaaagatggaaggaggataagcagc

SEQ ID NO: 6856125 - DNA, 93 bp, Homo sapiens
ggtacattggaaactataacgacttcatgacattcaggtcagacttttttggcaagaatccattataggtgatgttatatgtttcagattacc

SEQ ID NO: 6856126 - DNA, 61 bp, Homo sapiens
ggcggggtggcactctaaatagaaagcacatatcccccgctttccagccgccacttccgcc

SEQ ID NO: 6856127 - DNA, 124 bp, Homo sapiens
tggtgttgaacagtaaatctgcaatactgagcctctaccacaggtggaatttggtctgtaaaaaagattcctcacttgagatggggctaaagtgattagcagccactgcgtttatagaacacca

SEQ ID NO: 6856128 - DNA, 66 bp, Homo sapiens
tggaagagcccaggcagagggatgcttggttttctctgtatcgtaatcatgtctgggatgatttta

SEQ ID NO: 6856129 - DNA, 114 bp, Homo sapiens
ggtactgcctcgctctttccaattaataatatgccctgtggtgctatatgactttccttcaggtacctatcacaggtgtgatttacattatttggtggatatataatcaatacc

SEQ ID NO: 6856130 - DNA, 78 bp, Homo sapiens
ctccttaactatcagatggtgatacatatcagaaagtgatacataaactttggtgtgttaagccactgatacttggag

SEQ ID NO: 6856131 - DNA, 86 bp, Homo sapiens
tttgaccttctttatagccccatgaggcattggcatgtaatgtcaccatttcagagttggggaaaagcagatatgaaaaggtcaag

SEQ ID NO: 6856132 - DNA, 99 bp, Homo sapiens
aggagagaagggtgttgtttctttgctgatttatttttaacccgaggttgtacaagcccctgacagtttggataaattagccaggcctcgcagtctcct

SEQ ID NO: 6856133 - DNA, 73 bp, Homo sapiens
gtatctctgttatgcatggtcattgcctgggagcagcccaagggcaatgtggatcatgtgaataacgtggtgc

SEQ ID NO: 6856134 - DNA, 93 bp, Homo sapiens
gacaagccttggggtgagcaacgaggccctgagaaaatccctgcagcctctggctgcagcaccacgtggcttccttcgttcccaaggcttgtc

SEQ ID NO: 6856135 - DNA, 62 bp, Homo sapiens
ctgttctagcttcttgggctataactagatagatgttagctggcccaagtctgctagaagag

SEQ ID NO: 6856136 - DNA, 105 bp, Homo sapiens
caagtagaaaaattcatctccgtttctgagcatccaaagatgctttcaccattcttgctgaatgctttgatgccagataactgcaggagcatgaaactctccttg

SEQ ID NO: 6856137 - DNA, 78 bp, Homo sapiens
gtgggagaaggttatgggggttggattatgcaagaagaatctgattttgttttaaatcatttccatggcttctgttat

SEQ ID NO: 6856138 - DNA, 64 bp, Homo sapiens
actagtgtgacaccctgttaagatccctttaccagctaacacttaatataggttcacaactagt

SEQ ID NO: 6856139 - DNA, 81 bp, Homo sapiens
gccacttcatgctgctatgtcgaaagggccattattattattatattttaatggtaaaagagaaaaggagagaggttgagc

SEQ ID NO: 6856140 - DNA, 61 bp, Homo sapiens
ggaggcccaggggagccgcctgccagagtcatcagcagagccaggctctacctgggtttcc

SEQ ID NO: 6856141 - DNA, 57 bp, Homo sapiens
cacttcctttccagaaacgaaccagaaatattttgttcatttgtggtgaatgaagtg

SEQ ID NO: 6856142 - DNA, 71 bp, Homo sapiens
gctccagagtaactttcttgtgacatttggggttttaatggattccagaaacctgaaagtttctctgcagt

SEQ ID NO: 6856143 - DNA, 87 bp, Homo sapiens
gtgcctagcaccagctggatgctgggagttcagcatgcagagccttggcctctgtcctccggagctcccagtctagcaggcagacac

SEQ ID NO: 6856144 - DNA, 63 bp, Homo sapiens
ttaagaaacatttttatgacagtttagctttttcagctgctttcattatgttgtgttttttag

SEQ ID NO: 6856145 - DNA, 75 bp, Homo sapiens
gctctggataaggagtacagccggaggagggtcacagagccctcagctcaagcccctgtgccttagtctaaaagc

SEQ ID NO: 6856146 - DNA, 56 bp, Homo sapiens
gtaggaacaaaactggctgactgcagatggtgcaaccagtccactggagttcctac

SEQ ID NO: 6856147 - DNA, 69 bp, Homo sapiens
ggcaggaggttgcagttgggcgctcagcagctgtggcagccggttgaggtctggcagtagcgttgggct

SEQ ID NO: 6856148 - DNA, 129 bp, Homo sapiens
gagaagaataaaggggccagatgggtcgtgtagaggatgaagaggcactgacatattttaaatagtggggtggtaaatgtgggttggtccttttgttgaatattgcatgatggctctgagcagaagctt

SEQ ID NO: 6856149 - DNA, 114 bp, Homo sapiens
taagtcacaaaatattagttaaatatttttgctcaaggttcagttgcagagactggaatgctcttgaatgaatttgagcagagatagatttattacagcatatttaaagactta

SEQ ID NO: 6856150 - DNA, 88 bp, Homo sapiens
ccccaccccgcctccacgccccggctctgagacttcctgcctccccggctccgggcagctctggctgtgggaagctggcggggcgggg

SEQ ID NO: 6856151 - DNA, 55 bp, Homo sapiens
ggtggggaggagcagatgttttgcctctagtgagacaataatttacttccctatt

SEQ ID NO: 6856152 - DNA, 59 bp, Homo sapiens
gaaggaggcgttagccctaggaggtacctgaagttacctgggggcaacgcgttttcttc

SEQ ID NO: 6856153 - DNA, 75 bp, Homo sapiens
gggtgagtgaggtctgagcttgagcccatgctctggttgccaagtagggcacatggcacagagctgtgttgacct

SEQ ID NO: 6856154 - DNA, 87 bp, Homo sapiens
ggaggggtacagctgtctggatataccttggccaaatttcagtgtatatagaaaagtgggaggttatcgactatgttaaaccttttc

SEQ ID NO: 6856155 - DNA, 72 bp, Homo sapiens
accatcttttgtcttatccaatctctcaggtatccttgtttggttttggggaagacaattgcaaaaggtggt

SEQ ID NO: 6856156 - DNA, 80 bp, Homo sapiens
attttgtagttttctagcacatggaaaagtaaccaggcacaaaatacatttggtttccaaatgttggacaactgtattat

SEQ ID NO: 6856157 - DNA, 57 bp, Homo sapiens
agggcagcctgagtgctggcccacaaagggccctggaggaaaatctgaggctgctct

SEQ ID NO: 6856158 - DNA, 69 bp, Homo sapiens
catgatacgcatcgggtagaggagctggagaggagcttgtccagactcaaaaaccagatgggtaagatg

SEQ ID NO: 6856159 - DNA, 78 bp, Homo sapiens
tgacccagagatggaaaatatagacagagaatggggtacgtgatctctctcagagtttttttccaggacttctgggca

SEQ ID NO: 6856160 - DNA, 77 bp, Homo sapiens
cttctggaagagctgttcagaaatgtttattgatcaaataaataaatagaatctaaactgctcatcttaaaaagagg

SEQ ID NO: 6856161 - DNA, 89 bp, Homo sapiens
ttcaatacgtgagcctcaaagtcttctcattatgtcttccacatattaaagtggaagtaaccagaaggctttggaaattcaggtctgaa

SEQ ID NO: 6856162 - DNA, 106 bp, Homo sapiens
agtatctggaattctattgtgtgtgagtctgtgcaggaacacaatgagtctcaaagtgaaaaaaactttggattcctggttcctacagcacttttgttcagatact

SEQ ID NO: 6856163 - DNA, 72 bp, Homo sapiens
gtcaaaagaaatagcatggttcagagtgaaattttctggaacaggagagagctgagctttgctgtacttgac

SEQ ID NO: 6856164 - DNA, 70 bp, Homo sapiens
acttctacacagtgcgggttaacaatgatcttaatgcactttcatctgtaaactccttggtgtgtgaagt

SEQ ID NO: 6856165 - DNA, 86 bp, Homo sapiens
gaatgaccagcaattttactcttcctcttccatgacattgttattattttgaaccttaacagtattgaaagaggatgtggtcattc

SEQ ID NO: 6856166 - DNA, 65 bp, Homo sapiens
ccaggccctgcaggagtggggacagagggaacccggccggtggcccgaccctgcagggaagaagg

SEQ ID NO: 6856167 - DNA, 85 bp, Homo sapiens
ggagaggggcgggtgtcctgggcaggcagctgacgggcatccctgtcttctcccatcggccgcagggaagcagccgctcttgtcc

SEQ ID NO: 6856168 - DNA, 83 bp, Homo sapiens
gagcagggggttggcgcgggctccccgcagcccaggcagctcggccctgcctcggggacacccgcaccactgacccgctggtt

SEQ ID NO: 6856169 - DNA, 70 bp, Homo sapiens
ctggcagattcactccaagacaagtagttttagcccactggagatggggaacagtcttgagggtggccag

SEQ ID NO: 6856170 - DNA, 74 bp, Homo sapiens
tcacacatttttgggttgatgtctgatattttgcatcacaaatgtcaattggctacaaataatgtaatttgtga

SEQ ID NO: 6856171 - DNA, 55 bp, Homo sapiens
agggactgagctaggatctagtgactgcattgtctctgagatgccttccagccct

SEQ ID NO: 6856172 - DNA, 82 bp, Homo sapiens
ggacagaggaaaaatgctccaaatctgtggcaaacaggatttcactgaaatttacaggattctttggatatgcctttgattc

SEQ ID NO: 6856173 - DNA, 64 bp, Homo sapiens
cacgtggatggagcagtgacccaggaataaagccaatgggccctggggagctgtatccagagtg

SEQ ID NO: 6856174 - DNA, 130 bp, Homo sapiens
agctcagtaactggcttctcagaacttgtcaattattttccatattctgtgctgcacaagtatgacttcataaaggcaatttaacaaatagaaaatctggattggctagaacatttgtcaatactggatt

SEQ ID NO: 6856175 - DNA, 56 bp, Homo sapiens
tgtgagatgctatcttcaaagtgcccagcaaaatacactatgaagttagccctcca

SEQ ID NO: 6856176 - DNA, 60 bp, Homo sapiens
tttggaaataattccatctcattatgcatatttgcatttggtaatggagttatttttaaa

SEQ ID NO: 6856177 - DNA, 64 bp, Homo sapiens
aacaccaagctgctctggatagtccatgctgtgagttccaggactgcagagcatgcaaaatgtt

SEQ ID NO: 6856178 - DNA, 94 bp, Homo sapiens
tctttctgtgcactggtcaccaggtagcattgtaggccaaatgctgcttgcttgtcaccctgcctgagtggtgccatgtagcagtacagagaga

SEQ ID NO: 6856179 - DNA, 67 bp, Homo sapiens
ccagtacatatcctttacgttttgttcatcaactttgatagacagcatagaggaaatgtggaactgg

SEQ ID NO: 6856180 - DNA, 76 bp, Homo sapiens
gcagattcttgggccctccccttgtgaatcagacctactgaatcagaacttctcagggtggggttcactaacctgt

SEQ ID NO: 6856181 - DNA, 70 bp, Homo sapiens
gtgtcaggtggggttgttgaggaagagaaattcctaaatttctatgccatgttcagctactatctgaaac

SEQ ID NO: 6856182 - DNA, 58 bp, Homo sapiens
ggctgcctgctcctcctgcacggggcgaaaagcccacctgggatccgagcgggcggcc

SEQ ID NO: 6856183 - DNA, 65 bp, Homo sapiens
tagcagaaaaacaaatatgtgtgcgtgtgtgtgtgtgtgcgtgtgtgtatgttttgaggttgcta

SEQ ID NO: 6856184 - DNA, 65 bp, Homo sapiens
ggaggtcatggaaactgcagttcccggggatgacgggcatcccttgctggaggtttctagaccct

SEQ ID NO: 6856185 - DNA, 66 bp, Homo sapiens
taagtcaggaaatggacatctttgctgtttgaccgctgggcagagaaataatcatttccttcctta

SEQ ID NO: 6856186 - DNA, 76 bp, Homo sapiens
gctgccagatttatgtcttactacagcaattaacaaagttatttttggaagtaagcatttaatatcttcttgtagc

SEQ ID NO: 6856187 - DNA, 61 bp, Homo sapiens
ggggcttgtagctctctttcgttctaaaagattttaaaacagcagaaactgcaagctaccc

SEQ ID NO: 6856188 - DNA, 129 bp, Homo sapiens
gactaggtgaatttctcaaagtcacatagctactaaatgatcagatatgagattttagctcactaatttgggctccaaaatctatgtcttctatagtcaagtggtattggatgagatacacattaagtt

SEQ ID NO: 6856189 - DNA, 55 bp, Homo sapiens
ggtggctcacgcctgtaatcccagcactttgggaggccaaggcaggcggatcacc

SEQ ID NO: 6856190 - DNA, 79 bp, Homo sapiens
gaatataaacagtaggctaaagctatatcttaccctcaaatctgggtgaaatgatcagtttggttactgctttatattt

SEQ ID NO: 6856191 - DNA, 71 bp, Homo sapiens
gggaaattcaggtaatttgcagccacagtaatcttcactatactgaaatgttaaatacttggcttttctcc

SEQ ID NO: 6856192 - DNA, 63 bp, Homo sapiens
cttcccaagggctctgtgtgcctccccacggcccctgctgtgatgggaagagcccttgagtag

SEQ ID NO: 6856193 - DNA, 72 bp, Homo sapiens
ggtagagcacatttctctacctcacacaatcgtcctagggtaattgatcagggctgagatggtggctctgct

SEQ ID NO: 6856194 - DNA, 67 bp, Homo sapiens
tgtgaccagttttgtgtgatttttaaaaaggaaaactcagtagaaatcacagaaaatcaggggaaca

SEQ ID NO: 6856195 - DNA, 64 bp, Homo sapiens
agacaataacacaaaagaatatgtgtgtctaacttcaggaaacattgttctttgtgttaatgct

SEQ ID NO: 6856196 - DNA, 70 bp, Homo sapiens
ctgctatcatgtggactaatccatcctggccaccctactcctggctgtgggactggaactactggtgcag

SEQ ID NO: 6856197 - DNA, 76 bp, Homo sapiens
tgcaaacatctaatctcttctcaaaggtcattagtaaaagaggctcattgggatttgggaagggagagagtaagca

SEQ ID NO: 6856198 - DNA, 112 bp, Homo sapiens
atcctaaaagcaagctcgtgtgtgatgtttcataatatccagagattttgtagaaaaacaaattgtcagttatctgggataatgaccatgaagcatgtgcttatttaagggt

SEQ ID NO: 6856199 - DNA, 55 bp, Homo sapiens
agaaagtgtgtcatactaagtgctgttctaagccactaagtagactgccctttct

SEQ ID NO: 6856200 - DNA, 64 bp, Homo sapiens
ctcccaggcctgcatctgctgcgcacactccctccatgtgtctgtgtggccacagtcctggggg

SEQ ID NO: 6856201 - DNA, 60 bp, Homo sapiens
gactgccagagatttggtgaacaacagctgcggcagattttgtaagctaaatgtccagtc

SEQ ID NO: 6856202 - DNA, 93 bp, Homo sapiens
gggggtggggggaggagtgcaaaattcagaagcaattaattcatttctttcggagctaatttatgaatctttactctgaactctccaagtccc

SEQ ID NO: 6856203 - DNA, 70 bp, Homo sapiens
atttctgccattggagaatattctatttgatagcactattccagattgtaaattcctcaaggacagaaat

SEQ ID NO: 6856204 - DNA, 60 bp, Homo sapiens
aagcaattgtgaaccacctgcaatgcggtcctgtgtgtgcatgtgaattcatacttgttt

SEQ ID NO: 6856205 - DNA, 66 bp, Homo sapiens
tataatgaggttcgcagttgttttatgagatcggcctatttttaagagtaacacgggcctcttgtg

SEQ ID NO: 6856206 - DNA, 73 bp, Homo sapiens
gacgggcagggcacgcactggccccggcgcccacccgcacccctccccaggtcagtgcgtgcccgcgcgtgtc

SEQ ID NO: 6856207 - DNA, 69 bp, Homo sapiens
aggcttattaagtcacactagacaactgaggttgcctaagacgtcattgtcctggacttgcaagggcct

SEQ ID NO: 6856208 - DNA, 71 bp, Homo sapiens
gtttcgtgtttgcgtttagtttcaagacacgtcgacaaaacgactgtcattaatgaatgtaataacgaaat

SEQ ID NO: 6856209 - DNA, 59 bp, Homo sapiens
gctgacaattgaacagtctggaagggacaggagtttgtgccaggctggcaaatgggggc

SEQ ID NO: 6856210 - DNA, 67 bp, Homo sapiens
gcccacttaggtcgggcttcttctgacagtgtgtaagaccccactgtgagcagcgacctgaggaggc

SEQ ID NO: 6856211 - DNA, 68 bp, Homo sapiens
ggtttttcagcattctttacaaggatgaggatgtatggtcttctctttgtccaaatgtatcaagaatc

SEQ ID NO: 6856212 - DNA, 62 bp, Homo sapiens
agggagagagattcagtaaccaatatggtggccgttctatccaaattgggaactctcaccct

SEQ ID NO: 6856213 - DNA, 66 bp, Homo sapiens
tgctcctactcacttcttcccttgcacatatgggatgccatcctgatgaaagggaaaagtggagca

SEQ ID NO: 6856214 - DNA, 77 bp, Homo sapiens
ggggtgactttgttttcacagcagaatttctgaggctcagttatatggcatcagggtctgtgagtggctgtcacccc

SEQ ID NO: 6856215 - DNA, 94 bp, Homo sapiens
gccattcatagatggattcatagagaatgggaatgtcaatgtagttattaaaattgattagtccactataatcctacaaagaatttataaaggc

SEQ ID NO: 6856216 - DNA, 63 bp, Homo sapiens
tgtatagtcttccaggtcttctactttgaagagagatgacttagatggatagatttttatata

SEQ ID NO: 6856217 - DNA, 72 bp, Homo sapiens
tctgtgagttgatggcccagtttagactagaatcttggtcaccttgagccaaggcctcaagaatttcatgga

SEQ ID NO: 6856218 - DNA, 62 bp, Homo sapiens
gaagagaaggtgtaggccatcctgggtccagtaagactttatggcagactctcttctccgtc

SEQ ID NO: 6856219 - DNA, 83 bp, Homo sapiens
aagtgttgacggttagcctaaaacatgcctctatgagacacatcctctttcttgccaggttcttttggccaacctcatgactt

SEQ ID NO: 6856220 - DNA, 130 bp, Homo sapiens
accccgaactccttggcgaccactgagtccccatagcaacagcggtgacttcactctgggctcggcttacaaccccggtgaggtcaccggccgttgccaggggaacgggagggcgcaaggagtccggggt

SEQ ID NO: 6856221 - DNA, 55 bp, Homo sapiens
ggaggggatggtttgaccctggaatgctggaaccagggattccaccagcctctcc

SEQ ID NO: 6856222 - DNA, 129 bp, Homo sapiens
aggaagagaagggtttgtggaagtaaatctgtcctgtgacagtgggaggaccagccagctgacctggtcaccgtttcttctgttctagagacatgctgatctagattttatcaggtacccttctctcct

SEQ ID NO: 6856223 - DNA, 70 bp, Homo sapiens
atcttcctgagttcttatttccagtcagggaaacacattttctcctcatttaatttggaactcagaggat

SEQ ID NO: 6856224 - DNA, 69 bp, Homo sapiens
ggcttggcggaggaaactgaggcaagagggaagtgtcccagatatgcagccggtttcccctgaggggtc

SEQ ID NO: 6856225 - DNA, 62 bp, Homo sapiens
ctccaagatggcaggaatcataagctggagacatctagttattgttgctgctgttgatgaag

SEQ ID NO: 6856226 - DNA, 96 bp, Homo sapiens
gaaggcatggggtaatgaaaacatattggcttagctctgtgactaacaagaaaagtggtcactggttaagttaatgtctttgggctctgtgttctc

SEQ ID NO: 6856227 - DNA, 74 bp, Homo sapiens
taggttcacacatcttccagatctactgatccttaagaacaagggcaggccaagttgaaagatgtcagagccta

SEQ ID NO: 6856228 - DNA, 76 bp, Homo sapiens
tggtttgactttgggctctaactcaaacttgccttcaaattctggttttgtcatgagtgggcacattgtgaaatca

SEQ ID NO: 6856229 - DNA, 75 bp, Homo sapiens
agcgtcatgttggcactggttccccttgcccctcaagtcccacaggggtaacctggatgtgccaacgtgaatgct

SEQ ID NO: 6856230 - DNA, 128 bp, Homo sapiens
tcagcaccacctgggagagtctttggaaacacctgagcaacactccacattgctaggagtccctgggtgttgttctgggttatctggttttgttgttgttttgttttgtgtttaagctcttccattga

SEQ ID NO: 6856231 - DNA, 90 bp, Homo sapiens
acttattaaattacatattcctggtccctaccacagacctacttaataatgtccaggtgaggaatccaggaatttttagtttgatcaagt

SEQ ID NO: 6856232 - DNA, 57 bp, Homo sapiens
gagaggaaagaaccaatgacccaactcaaagcagtcaggcagcaggagtttcctctt

SEQ ID NO: 6856233 - DNA, 100 bp, Homo sapiens
tttccctttataattaggaggtgctgggtcctccactgcttcccagctttggaactaatttcaggggaagcaggaggaggaggacctcctagaagggaga

SEQ ID NO: 6856234 - DNA, 55 bp, Homo sapiens
ctttggtacgctttacatgtttcacactgggagatatgtgtgagttgaatcagag

SEQ ID NO: 6856235 - DNA, 55 bp, Homo sapiens
tggtttgccaattatctataaatacattggtaggtatttaaggataagcagacta

SEQ ID NO: 6856236 - DNA, 63 bp, Homo sapiens
gctctctgtcctgtgtgcgctggtatccttgatgggagcctgtggaaactgggtgcagagagc

SEQ ID NO: 6856237 - DNA, 71 bp, Homo sapiens
ggcattttaaagggtgaattaaactggcaccacttgagcaaagtatcaatcaccctttgaagttggcagcc

SEQ ID NO: 6856238 - DNA, 64 bp, Homo sapiens
ctggagctgatacagctggcttttagaaacttttgacaagtaaccagggccttgtgcagcacag

SEQ ID NO: 6856239 - DNA, 90 bp, Homo sapiens
cggctgagctgcctcctggctggtgggcctcagcctgcttctgagggaggagcagcccaggtgtccctcagcctgtttcagctccagccg

SEQ ID NO: 6856240 - DNA, 67 bp, Homo sapiens
gatcaggagatggcctcagacctcacaaggcactggaagaggtcaaaaagcaaggccctccctcatt

SEQ ID NO: 6856241 - DNA, 62 bp, Homo sapiens
gaaagagatgtcgtttgtcttcgtatagacggaaatagggggaaatcaaaagatatttcttc

SEQ ID NO: 6856242 - DNA, 91 bp, Homo sapiens
gcaggaaagccaggccctgaggagattgtggctggggagtgacggacaccaaagaccagcagcttctcaaatcaacctagggctaccttgt

SEQ ID NO: 6856243 - DNA, 90 bp, Homo sapiens
taaggatattcccttttagcatttggcaccagttattttacaccaacttgtgaagcacagtgccaagttctattgcctggaatctcctta

SEQ ID NO: 6856244 - DNA, 73 bp, Homo sapiens
tttgcctagaactttattctttatttccttacatagaataataaaggacataaaaaaaggaagttcaggcaga

SEQ ID NO: 6856245 - DNA, 119 bp, Homo sapiens
gaatcacctgcagcgtttgttaaaacccaaattccaggcctttctcccagactttctaattcagtgggcctagggttggcctgagaatctggatttctaataagttcccaggtgagatc

SEQ ID NO: 6856246 - DNA, 72 bp, Homo sapiens
tttagatgatggaggttggattcaggtgcatcccctggaatggggtttggcattagcttcacgtggtctaga

SEQ ID NO: 6856247 - DNA, 72 bp, Homo sapiens
tcccgagtagctagaactacaggcatgtgccaccacgcttggctaatttttgtatttctagtagagacgggg

SEQ ID NO: 6856248 - DNA, 81 bp, Homo sapiens
gctctcagtttctagttctctgccaaaaaagtgacatgatcttgattatatgcttttttagtagtaacttaggcagagagt

SEQ ID NO: 6856249 - DNA, 83 bp, Homo sapiens
gctatctcttaacttattggtattatctcaatcaatcatgggtcattccatggaattaataggggaatacttaagactttagc

SEQ ID NO: 6856250 - DNA, 129 bp, Homo sapiens
aaataaaccaaaaggaaactcttgagatttgcttctgggaagatggtgacagaatttccgatacttgaaaatataaatatttgcttttatcttcttatagaaatcctaagagtattccatttctagcct

SEQ ID NO: 6856251 - DNA, 105 bp, Homo sapiens
catgacaaatattcttcaaatcccgtgtcaaatctatctaattctgagtctatttctgtgttaaagattctgaggctgattagatccaggaatagtatagtcatg

SEQ ID NO: 6856252 - DNA, 75 bp, Homo sapiens
tggcttaatatttcatatttaactgcttaccccgtctggaatttgtggggctgtggggtgtgaagtgaggagtta

SEQ ID NO: 6856253 - DNA, 81 bp, Homo sapiens
cagcaacagcaacagcaagacaaataatccagaccccatattttagttctggtcccagttatcttctgttgccttgttctg

SEQ ID NO: 6856254 - DNA, 67 bp, Homo sapiens
cccgcctccagcccacgcaggcctgccctggcctcctgggagcgggcggcgatggctggggtgtggg

SEQ ID NO: 6856255 - DNA, 78 bp, Homo sapiens
cccacaagcctatgatggttagttatccctgtctgaaaatctggactgagggaaataatctattctgaggcttaaggg

SEQ ID NO: 6856256 - DNA, 66 bp, Homo sapiens
tgccagaaagtggactcgaactgaggtcttctgaccctagacacagtgtccttctacttgcctgca

SEQ ID NO: 6856257 - DNA, 59 bp, Homo sapiens
agaggcctccctcccagctggttgtgcacgccccattcagttggctgggatggccgtct

SEQ ID NO: 6856258 - DNA, 77 bp, Homo sapiens
ggaagaaatactggaaggatatgtgtggtagatttgaggttcaatgccattttaggcatgtccttctgtatcattct

SEQ ID NO: 6856259 - DNA, 64 bp, Homo sapiens
ggtagatccaggccttgaagtaccagtgcagcgtgccacttactatctaagacctggaattgct

SEQ ID NO: 6856260 - DNA, 76 bp, Homo sapiens
tcgcttgaacctggaaggtggaggctgcagtgaggtgagatcacaccactgcactccagcctgggtgacagagcga

SEQ ID NO: 6856261 - DNA, 59 bp, Homo sapiens
aggtgcagctacacctcagtgctgtgggtacagacccactgccttcagttgcttcacct

SEQ ID NO: 6856262 - DNA, 90 bp, Homo sapiens
gtggtcaataatgcaatatgggacgtgagaatgagattggaatgtataggaaggtgattttgaggtttcaggtcttgtgtttgtaaccac

SEQ ID NO: 6856263 - DNA, 68 bp, Homo sapiens
ggtgccatggcaagacagacagctcctcccaggctgggtttggggcaaagtggttgctattgggcacc

SEQ ID NO: 6856264 - DNA, 69 bp, Homo sapiens
gcctgagggctctactcaccaccctgcttgtccgcacatccaagctccttgtgggactggggctccagc

SEQ ID NO: 6856265 - DNA, 75 bp, Homo sapiens
atgctatctatttcattatggtcaatgtttacttacaataatatgtagcaatgctctatgatgaaaagccagcat

SEQ ID NO: 6856266 - DNA, 84 bp, Homo sapiens
tttgtctcaggctttgggtcaggctctgggggtgcaatgacgagtcacgccacagtgcttgcccttaaaaagcccacaggcaaa

SEQ ID NO: 6856267 - DNA, 99 bp, Homo sapiens
tgaggcgggagaatggcctgaacccaggaggtggagcttgcagtgagccaagatctcgccactgtactccagcctgggggacagagcaagactgtctca

SEQ ID NO: 6856268 - DNA, 58 bp, Homo sapiens
tgccttagctaccaggtcctccaggaaacgttcacactggggacctgactaattggca

SEQ ID NO: 6856269 - DNA, 130 bp, Homo sapiens
tcaccctttccccaggaaatccctcttaacttttccggattacagccaggctgagcacaatgtttcccgcaacccagcagggctggatttggcaagagtgactaatgggacctggccaggagtcaggtga

SEQ ID NO: 6856270 - DNA, 79 bp, Homo sapiens
ctttgactccatctctctttgttagtctcactctttccattaattctctgtgagaggtaaagagacagaggagtcaagg

SEQ ID NO: 6856271 - DNA, 68 bp, Homo sapiens
gccccctctggtcagcagggctccctggcagggcataccaagctcacaccaggcctctgacctcgggc

SEQ ID NO: 6856272 - DNA, 57 bp, Homo sapiens
gagctgcaggcatttattcatgcaagcttccagctcgcttatctatgtctgcagctc

SEQ ID NO: 6856273 - DNA, 106 bp, Homo sapiens
aggcagcgggtaggaaagaggtcatgagacaaggaaaggaagctgaaaaaccgaagtttcagatgccctttgttttagacacccctcatttccagaactgtcacct

SEQ ID NO: 6856274 - DNA, 65 bp, Homo sapiens
cacagctttgagaggctctcagatcagccacattccaatcggactggagtcagatcagagctgtg

SEQ ID NO: 6856275 - DNA, 74 bp, Homo sapiens
gggagatgttacctctagactcatagcaaccactcttggaagtggtcagctctttgggctggtggacatatcct

SEQ ID NO: 6856276 - DNA, 73 bp, Homo sapiens
tttcacttagatttccttactgggtggtcacaggtgtgggtgaactaccacaagtatgaagaactaaaggaaa

SEQ ID NO: 6856277 - DNA, 71 bp, Homo sapiens
cataaagctgctgtttgtatgtggactgatttaagccataggaagtctattttcagaagcagttttctatg

SEQ ID NO: 6856278 - DNA, 126 bp, Homo sapiens
agttaactataagccataaaagtatctaggagcagacctgagtgaagcacgtgttcagttagttattgaaacaaaagtatgtagcttgtctcaagttcctggtaactacttcagggctgattgact

SEQ ID NO: 6856279 - DNA, 70 bp, Homo sapiens
gttttgctttccatctgatttttgtgtctgaatttctcagttggttctgaccacagactggaaagagggc

SEQ ID NO: 6856280 - DNA, 78 bp, Homo sapiens
gggcgtgtgtgggagcaggagagggattctctggggtccccatttggaacctggagacccacttctgccaacaagtcc

SEQ ID NO: 6856281 - DNA, 55 bp, Homo sapiens
ctcaggctccagacttccgtccgtcgggagtgtggagggaggtgctgggcctgag

SEQ ID NO: 6856282 - DNA, 93 bp, Homo sapiens
tgatattctttgatgacattttcatgttgacaggtagttttggtaatcccaaacaaagtagttagtcatgtgaaaatgtcatatagccagtca

SEQ ID NO: 6856283 - DNA, 76 bp, Homo sapiens
cattgcttttaatataaatgctttatagtgtattatgcaagtgaaatatgagaaagactttaggttagaggcattg

SEQ ID NO: 6856284 - DNA, 58 bp, Homo sapiens
tatcttcttgccaggctggtgtgttggctatacatagttggacctgggtaagaaaatg

SEQ ID NO: 6856285 - DNA, 61 bp, Homo sapiens
cttggctgttgggcattgagaaaatgttgaactgaatgaatcaatgacttaggcagccagg

SEQ ID NO: 6856286 - DNA, 88 bp, Homo sapiens
ttggattagattggatcatataaaattgccaatatttgcttatttgtggcctaaaaaatggcaatttcatatggttcatatagttcag

SEQ ID NO: 6856287 - DNA, 130 bp, Homo sapiens
atcaatagcaggtccctactgtattgactgatctttaaatttggccgccttattattctaggagctctattctaaactcaaggagttcagaaaggctgtgccagccagtaagtaaagttggacctttggt

SEQ ID NO: 6856288 - DNA, 55 bp, Homo sapiens
gtctatccctctgtagtttctatccactccaggggctcaccagttgggaatagac

SEQ ID NO: 6856289 - DNA, 72 bp, Homo sapiens
ggtgaagagaagaaactcactttgggaggcagcaaggtagttcttcccctctggagagtttccctcgctccc

SEQ ID NO: 6856290 - DNA, 68 bp, Homo sapiens
atggctgctgctcctgcctggctcccagggactgcgctctggcaggcagagagcggcctttagctcat

SEQ ID NO: 6856291 - DNA, 61 bp, Homo sapiens
cctcttgccccgaagtctgagaaggttaaccttctgtgtatacagagtttgcaggcagagg

SEQ ID NO: 6856292 - DNA, 77 bp, Homo sapiens
tagcatgagtcgtgtggtttgcagaaatctctggcaggtttggaccaccagaagatggctcaaaccatgctctgctg

SEQ ID NO: 6856293 - DNA, 103 bp, Homo sapiens
gtgtaggacagactctttcctcaatctgtgtggcgttgcgtggctaggagttagattcctttgccatgacatggcacaagactaggagcacggttttcagcac

SEQ ID NO: 6856294 - DNA, 55 bp, Homo sapiens
ttgtgtctggtttgaagtccatgattttttgatctgccatccggtccagacataa

SEQ ID NO: 6856295 - DNA, 60 bp, Homo sapiens
ccagctgttcattgttgccacccctcgccactgtcaggaggtggcaatgagggcagttgg

SEQ ID NO: 6856296 - DNA, 55 bp, Homo sapiens
gttaaggatcttgagatgaggagaacctcttgacttatctcagtttgtcctaaac

SEQ ID NO: 6856297 - DNA, 60 bp, Homo sapiens
tcacagcagtaaagaaaacactgactgattctacagtttttgtttctgtaattgttatga

SEQ ID NO: 6856298 - DNA, 84 bp, Homo sapiens
cttaacttttgtaaacatttgctaccttttttattaaatgacatttgttggaatgaagaaaaaggtaataatacactagttggg

SEQ ID NO: 6856299 - DNA, 76 bp, Homo sapiens
atagggatctattgttttattaaatgagccctggggaacatttttaaagggttcaaaagtgagaggggattcctgt

SEQ ID NO: 6856300 - DNA, 65 bp, Homo sapiens
gaccttccatgccttcttccaaaaggagcaactcaaatggcagatacccaggcaaatggagggtt

SEQ ID NO: 6856301 - DNA, 56 bp, Homo sapiens
ttttctttgtaagatgagtctgggccggcgaactgggaagcctctggcagagagaa

SEQ ID NO: 6856302 - DNA, 63 bp, Homo sapiens
tcctcacctcccagaaccctgcctctctcaggaagggaaactgaggcagctgggaaatgaggg

SEQ ID NO: 6856303 - DNA, 71 bp, Homo sapiens
ggggccagtggcaggcggagatgtaggactcaggctcagcccccgtgtcctgccctctcctccttggccct

SEQ ID NO: 6856304 - DNA, 90 bp, Homo sapiens
agtgtttcttggactttctagggtagaggaaaaatgggacaatgaaataactcttttattcttttatgtctgttggagtcttgaaactct

SEQ ID NO: 6856305 - DNA, 73 bp, Homo sapiens
attatggctcagtaaaagatggaaatagaataagaaataccgttttctcattctctcttctgctgcccgtgat

SEQ ID NO: 6856306 - DNA, 91 bp, Homo sapiens
gttagatatgtacatttctgggctcttcccagatccagagatgtctgaagttctgggtttgaagtagagcccaagaatctttgtgtttaat

SEQ ID NO: 6856307 - DNA, 67 bp, Homo sapiens
tcctgtctgtctgtgccctgctggcccggtgacccttcctcctccagctccaggtagatgggcaggg

SEQ ID NO: 6856308 - DNA, 66 bp, Homo sapiens
gaagaaaacctgagtactgctgggaatgccacgtccgggtctctctctgtgtgcctcagtttcttc

SEQ ID NO: 6856309 - DNA, 66 bp, Homo sapiens
gacagttataacccacatgatagcaatgcgcaggggctgcaatgcagggcaacatggggtgctgtc

SEQ ID NO: 6856310 - DNA, 117 bp, Homo sapiens
gtgagtttgtttatcctgtacatgtcatataaatggaaacatacattttgtgtctgacttctttcacttagcagaatgtttccaaggtttgtgttgcagaatgtatcggtgactcat

SEQ ID NO: 6856311 - DNA, 56 bp, Homo sapiens
caggagggaggcctgtgggactttctgctgtggctgtttacaaggctttgctcctg

SEQ ID NO: 6856312 - DNA, 79 bp, Homo sapiens
ctctttggtttctgtctctgtaaaaaaaagtgtctaattgcatttgggcaaaaaacttgcagtgaagagagaaaaagag

SEQ ID NO: 6856313 - DNA, 79 bp, Homo sapiens
gcacattttaaaggcatgggtgcctgcatgtgcaatgtaaagtcacatcatcttgtatcctgtctttaaaaaattgtgt

SEQ ID NO: 6856314 - DNA, 127 bp, Homo sapiens
tgggaattttcctgtgatagggattttactccttcttgaggtagcacattcttcctttacacagccaggggaccactggaatatgccccttaagttgaggagaagccctcagtccttattccaccca

SEQ ID NO: 6856315 - DNA, 61 bp, Homo sapiens
aaaattgctactgtaccatctccatattggtagaagtcaattagaggcagctagcaatttt

SEQ ID NO: 6856316 - DNA, 76 bp, Homo sapiens
gagctactccttgttttcaggcctgtaatttgctaaaggattgagcacaacagagaaactaaggagtttggagctt

SEQ ID NO: 6856317 - DNA, 59 bp, Homo sapiens
tctgtccctctgaaatgctccagtagcataatgaagttgtactgaggttaggggatgga

SEQ ID NO: 6856318 - DNA, 61 bp, Homo sapiens
agccacatggctaatacgccactggacacagatgtgtgcagttttgtgtttgctgtgggct

SEQ ID NO: 6856319 - DNA, 65 bp, Homo sapiens
atgatggccctgtacaaggagtggcagccctgcatagggacctatggccctgcacagggagtcgt

SEQ ID NO: 6856320 - DNA, 81 bp, Homo sapiens
gtggggaggtgaaactggcatttagtggatggaggccagggtgctgctaaacatcttgcaatgcacaggacaacctcccac

SEQ ID NO: 6856321 - DNA, 68 bp, Homo sapiens
ctgcctgagttttaagatgcgcttctgttggtcgtccaacaaggctggtatcttaaagatgaatgcag

SEQ ID NO: 6856322 - DNA, 82 bp, Homo sapiens
agctgtggttgaggtccccagtacccactgtggcagcgttctcccttgtccagaaaccaaatgggatggggactctccagtt

SEQ ID NO: 6856323 - DNA, 86 bp, Homo sapiens
gtccatccatttgtatcaacatgcatgttatttatcagtatggagtattataaagaacatgtgtgtgggaatcagatcaatgtgac

SEQ ID NO: 6856324 - DNA, 71 bp, Homo sapiens
ttcctggaagaattatctgaaagctgtgtgtggggcctacacacaactggtggtatttttccctcaaggaa

SEQ ID NO: 6856325 - DNA, 95 bp, Homo sapiens
ttgagacagagtcttgctctgtcacccagagtgcagtggcacaatctcggctcacggcaacctctgactcctgggttcaagtgattctgtctcag

SEQ ID NO: 6856326 - DNA, 105 bp, Homo sapiens
gttgagatggagtctcgctctgtcatccaggctggagtgcagtggtgtgatctcggctcactgcaacctccacctcccgggttcaagtgattctcctgcctcagc

SEQ ID NO: 6856327 - DNA, 63 bp, Homo sapiens
cttctgagtagccacagagcgaaaggagcacattacaccttcctcatggggttccttcagaag

SEQ ID NO: 6856328 - DNA, 130 bp, Homo sapiens
tccatttacagaggccagctctgggtgaagggtaccattgaaagatgtcgaagaacccagtaccattgacagtaagcctggtggtaacccttcacctgtaagggcatggagaggaaccagtgttagtgga

SEQ ID NO: 6856329 - DNA, 58 bp, Homo sapiens
ggaaaatgggaacctgaagccaggaggtcaagccaagccaacaggtgttctgtttttc

SEQ ID NO: 6856330 - DNA, 128 bp, Homo sapiens
tataactctagttttggccattgtatgggattttatgttattatttactacatgatcaaatgaaaatgtgaaagtgtcatagaaacccatgtctggaactgagcacgcaccccttcttaagagttata

SEQ ID NO: 6856331 - DNA, 85 bp, Homo sapiens
gaatggctttggttcctttctggaggcccaagggcagaatccactttcttccctctcccagtttctagaggctcacagccccttc

SEQ ID NO: 6856332 - DNA, 67 bp, Homo sapiens
tcttctgactgatcgcctaacactctagctggggacaaggtgttattggaggcatcagctctggaga

SEQ ID NO: 6856333 - DNA, 86 bp, Homo sapiens
tgtgctgtattcataaatttgcttagagccaatcttgattgtttcttcatttcaattaagagagagttgaagcaagaaatagcaga

SEQ ID NO: 6856334 - DNA, 56 bp, Homo sapiens
gcccccgtagtagatgaggcgcagcagctcctgctcctcgtaactctgtggtgggt

SEQ ID NO: 6856335 - DNA, 75 bp, Homo sapiens
cttaggaaaatttaattctcttctgtggtaagcattgtctgccttctataggccaaaggattagagatttctcag

SEQ ID NO: 6856336 - DNA, 59 bp, Homo sapiens
gtattagaatgcagccatgctcattataaaaaatgtattgtctatggctgtgtttgtgc

SEQ ID NO: 6856337 - DNA, 102 bp, Homo sapiens
gcatgagaggtctggggctgcagactggggcctgagagttctctgcttctcatagctgctgtcacacatggccccagctttcacttcccaggctcctcatgc

SEQ ID NO: 6856338 - DNA, 56 bp, Homo sapiens
ccagccagaagtccgggcttctgagatagaggaatatccttgacctttggaaatgg

SEQ ID NO: 6856339 - DNA, 85 bp, Homo sapiens
gagattatggcctgggttcttggcacagcaggattctagggtgtttgtttttcattcctgtcccaagaatgcacctgataacctc

SEQ ID NO: 6856340 - DNA, 78 bp, Homo sapiens
gtttcggctttgtttgatagaagtgttctagggagtcaaaccctgtagaaaattggagcattcatacattgctgaaac

SEQ ID NO: 6856341 - DNA, 64 bp, Homo sapiens
acaagaaatggaagatccatggtgagactcgggagaactctccatggagacttcctcttcttgt

SEQ ID NO: 6856342 - DNA, 58 bp, Homo sapiens
acccaggtggcagaagctgcagtgagctgagatcacaccactgtactccagcctgggt

SEQ ID NO: 6856343 - DNA, 110 bp, Homo sapiens
ggacaaggggaaggctaatggtgtcttttgttcacctgatatatgtagctccttctgcttcttatgggtaatgtgtataggttgtgctaatagtgccatgcttcccttcc

SEQ ID NO: 6856344 - DNA, 72 bp, Homo sapiens
tgtggcataagctcggtttgacactgagggtagtgggagacaggtcagtgtgaggggctgggtcctgccaca

SEQ ID NO: 6856345 - DNA, 60 bp, Homo sapiens
gggctgcttatactgatgataaccccccaaaaatagttctctcaatatcagttgcagcct

SEQ ID NO: 6856346 - DNA, 57 bp, Homo sapiens
gaaacagattaacagcatattttagtgaaaccaaagcaagtgtgttttatctgtttc

SEQ ID NO: 6856347 - DNA, 99 bp, Homo sapiens
gtgccctgtttctggttccagatacccttacacttcctgcactttccaaggcacacacacagtgggctgcaggggggtctggacttggagcaggagcac

SEQ ID NO: 6856348 - DNA, 82 bp, Homo sapiens
cctaggggtgttctctgccctgagcctgctctgcctgagtgagggctgggccacagactcaaggcaggccacgccctccagg

SEQ ID NO: 6856349 - DNA, 60 bp, Homo sapiens
ctgtacaggccaccactgaatttttgccttaaaaaaaatttagcatcgtggcttgtctgg

SEQ ID NO: 6856350 - DNA, 66 bp, Homo sapiens
aacgatattgacaagtgagctgggctgcttggcaccaggtagtctgaatttgacttgtcagttgtt

SEQ ID NO: 6856351 - DNA, 64 bp, Homo sapiens
gcccgaggtcccagttgcccaggtcaggcagaaagtgtgtctggaggggaaactgaggcctggc

SEQ ID NO: 6856352 - DNA, 95 bp, Homo sapiens
ctattggccagtcaagcatttatagcccctatcatccatttgctacacaagacttccctggattggttatggagtgacttaactctggttattgg

SEQ ID NO: 6856353 - DNA, 73 bp, Homo sapiens
gggtagggattcaaaaataagctcctattttctgctggaaaatctacttgagatatttttgaatttctctccc

SEQ ID NO: 6856354 - DNA, 69 bp, Homo sapiens
ggtgctgacttcacagtcttactatgtcagacataacgatggcattgggcgttgtagagggttagcacc

SEQ ID NO: 6856355 - DNA, 86 bp, Homo sapiens
agtcagtttgccaacatgtactattaagaggcctaaatgcacacattactgacacaatgggctataattgtgcttttgaaactgct

SEQ ID NO: 6856356 - DNA, 56 bp, Homo sapiens
cttccagctgattacaggctatggcaggctccataacctccccaattagccggagg

SEQ ID NO: 6856357 - DNA, 60 bp, Homo sapiens
ctggccctgcagaactagcctgggcatcagagcccaccagaggtgactgccagcggccag

SEQ ID NO: 6856358 - DNA, 97 bp, Homo sapiens
tctcataattgggttgcactttgctgttagtaaaggagctgtttcgtagtcaaaaggaacatgcattctctaaaagcaaattttaagctactggaga

SEQ ID NO: 6856359 - DNA, 62 bp, Homo sapiens
agccaggccttttctcaaggttgtgtctgtagtaagtaaccttgagggatgaggtagtggct

SEQ ID NO: 6856360 - DNA, 87 bp, Homo sapiens
aggtaatgagtttgtatgacagggttctagcgcttcatgggggaagaaagctacaagtcttgtcattcatttcataagtttttacct

SEQ ID NO: 6856361 - DNA, 67 bp, Homo sapiens
gtttgctggaaaatttttttctgaataaacagtaataatactgtgtctggaacaaatactagcaaac

SEQ ID NO: 6856362 - DNA, 64 bp, Homo sapiens
tgcctgggtgccctctgctcctccgggaacttctccgagcccgcaggccggtgcgcaccaggta

SEQ ID NO: 6856363 - DNA, 84 bp, Homo sapiens
gagacaacagatgtatacagggttgactcatagatttagaaagttattagtgcatgttaatggtgtacaaatgttaattgtttc

SEQ ID NO: 6856364 - DNA, 57 bp, Homo sapiens
aaacatattcccttttagtttagctgatttctacaatgaaactaaggggaaatgttt

SEQ ID NO: 6856365 - DNA, 89 bp, Homo sapiens
gagatgtaagaggaagttattgttgggggggcttcaggaaatctttttaaaagggtctgactcctctggcaagctcttcctttcttttc

SEQ ID NO: 6856366 - DNA, 72 bp, Homo sapiens
agtgatctgctcaggttacctagctagtaagtggcacagctgaacaggtccaaggttcctgaatagaggatt

SEQ ID NO: 6856367 - DNA, 62 bp, Homo sapiens
tcaggaggtaaggtaaaacagaatcctctttgaaagcaggagtttgtcttccatatccctgg

SEQ ID NO: 6856368 - DNA, 80 bp, Homo sapiens
gggccggaagatggcaccagaggaaactacgttagcaagctttgcaaaccagcctttctctgccagttattttccttccc

SEQ ID NO: 6856369 - DNA, 77 bp, Homo sapiens
gtccctggtagcccttcaagagctctgtcctatgaacaagagagggcagaaaccaccttgatggagcaagtggggat

SEQ ID NO: 6856370 - DNA, 64 bp, Homo sapiens
ctgagcccgggacccgccgtcaatggcgtgggtgctcccaccctgttcccggtggccgggccag

SEQ ID NO: 6856371 - DNA, 78 bp, Homo sapiens
gggagacagcatgtatgtctgatgcacatgcatgtgcgaatgtgtgtgtgtgttagaggtgcaggtggtgtacagccc

SEQ ID NO: 6856372 - DNA, 72 bp, Homo sapiens
aacgtgttctttttctgtgtcaggcactgttctaggcactagagatccagtggtgaacaaaagaggcatgtt

SEQ ID NO: 6856373 - DNA, 64 bp, Homo sapiens
tagttcttgtcctctctagcagggcttgccttgaaagaaggagctgactagagagaaagagcta

SEQ ID NO: 6856374 - DNA, 129 bp, Homo sapiens
ggtagtggccagtgatgcttctcaacataccacaatgcacaggaccacacataatgcacagctgcccacaacaaagtattatgtggcccaaagtgtcagtggtgatgttgagaaaccctggcttaaacc

SEQ ID NO: 6856375 - DNA, 69 bp, Homo sapiens
tagtaactgggagagtcagaattggcacccagattgatctgaccccaaaccctgtattcttcaatattg

SEQ ID NO: 6856376 - DNA, 79 bp, Homo sapiens
ggcagctgtagcttctgcgggacctccactgctcgggcgtcaggctcaggtagctgctggccatgtacttgctgttgct

SEQ ID NO: 6856377 - DNA, 98 bp, Homo sapiens
ggtaaattctttttcacatgcttacctgccaaagcacttagtttgaaaatgatgttttgccaagagcaggtgttcagccagtgcaaaatcactttact

SEQ ID NO: 6856378 - DNA, 130 bp, Homo sapiens
ctagatcagtttgaaagtcatttcagtagcctgggccagggaggtgtctgtagcatctgaaccaaatgaaactcagaagatatggacacattcttgggtcagacaaggagaaatgagcgaactggttgtg

SEQ ID NO: 6856379 - DNA, 90 bp, Homo sapiens
ggacatttagattgccatatccagagttatatccaagcagcaaatgattgcactgcttataaattctaggcagatgataatttaaagtcc

SEQ ID NO: 6856380 - DNA, 59 bp, Homo sapiens
ccgtccattgcccaacagcatgggcagcattgcttggtgccagtgagggcagaggatgg

SEQ ID NO: 6856381 - DNA, 88 bp, Homo sapiens
ctcaagatgtcagctgggagcaaagccatgcatagaaggcaggtcttctgtgtgtgattcctgtgctcttttagccatgttgcttgag

SEQ ID NO: 6856382 - DNA, 92 bp, Homo sapiens
gtcggccggggccccgctgttctttgggagctaaaatctgccatttcgcttagcagagaccccagttcacaatagaagaggtggccgccgac

SEQ ID NO: 6856383 - DNA, 63 bp, Homo sapiens
aatataaaggggtgtatgtgtgtgtgttagctactatgaatcaacacaagcacttctggtatt

SEQ ID NO: 6856384 - DNA, 71 bp, Homo sapiens
ctccttctcttccccttagtttcctttaagagtgataaaaatggaaaagggggctgaggtggaggaaggag

SEQ ID NO: 6856385 - DNA, 84 bp, Homo sapiens
tcttctctggaggccgttggcccttactggtcctatgtatgttggaaagatctgaggttctgccgacctggtttccagccctga

SEQ ID NO: 6856386 - DNA, 130 bp, Homo sapiens
gatcattattactgcagaaagtaatagccttctgtttttgagtcttcagtaaaagggtaagaaaagtagttttcattttaaatattctgctctgataccaagaacagaaagtaatgcagttttaagtgtc

SEQ ID NO: 6856387 - DNA, 73 bp, Homo sapiens
ctcctatatgtctagtaattgacctgtagaaaataattacattcactacaaattaatgggcatgtttagagag

SEQ ID NO: 6856388 - DNA, 64 bp, Homo sapiens
ggagttctggattagcatgatccctagggttttatttctggatttaagaaattcagactattct

SEQ ID NO: 6856389 - DNA, 65 bp, Homo sapiens
tgtcgcccaggctggagtgcagtggtgcaatctcggctcactgcaacctctgcctcccgggttca

SEQ ID NO: 6856390 - DNA, 58 bp, Homo sapiens
gctggagaacccaggaggaagaggaaaaaagttttttcctcctctacactccccatgc

SEQ ID NO: 6856391 - DNA, 62 bp, Homo sapiens
tgccaataaatggaaaagatggatgtatccatttattacttcattcacccatatattgagca

SEQ ID NO: 6856392 - DNA, 69 bp, Homo sapiens
tagcacatttaggctggtgccaggaaatctgtatttttgaacaagaaccttggtgagtctaacctgcta

SEQ ID NO: 6856393 - DNA, 77 bp, Homo sapiens
ggaggatctggcaggcgggagccatagaggccacgtgtccacatgtctctccccagccccggctgccggcagccccc

SEQ ID NO: 6856394 - DNA, 55 bp, Homo sapiens
gccagctagctagttgctgggttgagtggttaatccaatgatttgtatagctggc

SEQ ID NO: 6856395 - DNA, 93 bp, Homo sapiens
tccagttgtacattttccttcattctccttatgaaatggtgagttcaatactcttctattttgaagggaattgaagttcatggaacaaaaggg

SEQ ID NO: 6856396 - DNA, 88 bp, Homo sapiens
gtgtcatatagctaatgaatgatagagctgccttcggatcctaggttgcctggctccagagcctatatgttcaactttcatatgatac

SEQ ID NO: 6856397 - DNA, 79 bp, Homo sapiens
acagaaaagaattctcttccattgaaacagagactggataatcacattttggggggttgtttggagggaattttactgt

SEQ ID NO: 6856398 - DNA, 71 bp, Homo sapiens
ttggataccatggcagtttattcacggtacagccgcaggttaatctgtgagactaagatgcaagtatttaa

SEQ ID NO: 6856399 - DNA, 77 bp, Homo sapiens
aaaaattttcatctctgttctatgtaaaatctggagcactactctggacaaactagatcagagttcaggaagttttt

SEQ ID NO: 6856400 - DNA, 64 bp, Homo sapiens
gcaatgttatacttatgtgcaaaaatatacttaaggtatattatggttgtaggttaacaattgc

SEQ ID NO: 6856401 - DNA, 88 bp, Homo sapiens
ccaacttaaaggagactacagtttgtcaaactcatcgttctatataaaccttcagacatttggcaaaactgtgtctatctgattgtgg

SEQ ID NO: 6856402 - DNA, 79 bp, Homo sapiens
caagaaagtggtgattatatccccatttccaggttaatgaaggagaacctggaggtaatgttatttttgttgattcttg

SEQ ID NO: 6856403 - DNA, 69 bp, Homo sapiens
tagctgtcaccagaaatggccattggtagactccttgacttgctcctgggcctttctgagtgacagctg

SEQ ID NO: 6856404 - DNA, 66 bp, Homo sapiens
tcccatgggtcatggccagtctgtttccaagttttactgaaagaaaacttgtggctttgactggga

SEQ ID NO: 6856405 - DNA, 88 bp, Homo sapiens
ggcaagtctgtatgctgaggaaggtttcttatcaatcgtaatttatttgctataggaagtaaactttcttcagctaatcataattgtc

SEQ ID NO: 6856406 - DNA, 73 bp, Homo sapiens
ttctttgtatttctttacatatgctcattggaatataagttcgatggaagcagaccggaggaatattttggag

SEQ ID NO: 6856407 - DNA, 59 bp, Homo sapiens
atagtattgtgtcaaggatttttctgtgtaccttacacagatcatctcgaaacaactat

SEQ ID NO: 6856408 - DNA, 64 bp, Homo sapiens
gtaataggagggagtctgctttgagtaatccagtgccttctgaaagtttctccctaattgttgc

SEQ ID NO: 6856409 - DNA, 56 bp, Homo sapiens
gggtgtggtggtcatggcccagtgagaggatgccaggctgtggccgtgccagactc

SEQ ID NO: 6856410 - DNA, 62 bp, Homo sapiens
aaacatatgccaggttacaaaagtgaggctggtaggaatcacattttccttggtatctgttt

SEQ ID NO: 6856411 - DNA, 56 bp, Homo sapiens
tagaggcgggtctttggaggtgatgcggagggacggccccaggggacccagcccta

SEQ ID NO: 6856412 - DNA, 62 bp, Homo sapiens
gctcccttctggggaggagctgaccaaaatgtcgtccagctcctgcttgacagaagaggtgc

SEQ ID NO: 6856413 - DNA, 74 bp, Homo sapiens
tttggctattgatagcagcaaagacatttttccttcccttttgggaaacagtcatggttgctgttcaagctaag

SEQ ID NO: 6856414 - DNA, 57 bp, Homo sapiens
gggcgaatgctctttctgaacattctcagctttagctaagcaaggaaagggcagccc

SEQ ID NO: 6856415 - DNA, 64 bp, Homo sapiens
gtcagagaaccatcttattcctaaaatactaggctaagagggaattagagatcagttctttgac

SEQ ID NO: 6856416 - DNA, 82 bp, Homo sapiens
tgcagtgttactgggcctgggtgtaatgtaaatggaattatttgccgtgaaaatacccagtccaatctcttagcaaattgca

SEQ ID NO: 6856417 - DNA, 64 bp, Homo sapiens
agtgaaatacttaattgaatattagattgctgtggcaactggtagaaagcagtaagtggttact

SEQ ID NO: 6856418 - DNA, 59 bp, Homo sapiens
cagacccttgtaatgactgtgagtgtcaaacactcaaaggttgacccaaggcaagtctg

SEQ ID NO: 6856419 - DNA, 77 bp, Homo sapiens
tagctttgtttttgttgtctttttctgtagggatcccattaattatgtctatgagaagaaaacaagattaaaagctg

SEQ ID NO: 6856420 - DNA, 64 bp, Homo sapiens
tcagggccggggctgtggcgagcagagggatgtgccaggtggtcgtcgtggcctcatgtcctgg

SEQ ID NO: 6856421 - DNA, 68 bp, Homo sapiens
tttgggccttgctggacaaggagctgaggaagaactctggagtcctggaatcagctactgggcctaga

SEQ ID NO: 6856422 - DNA, 109 bp, Homo sapiens
aactggtccaagaacttgaggtaggcctgacgctggggtgcagctgctggaatgaagtggccaccagagtgggtgagggtgatggctccgggaaattggctggccagtt

SEQ ID NO: 6856423 - DNA, 55 bp, Homo sapiens
gctggggctgtaggaggacttatgttgtggtttaagagcttcctacagcccttgt

SEQ ID NO: 6856424 - DNA, 71 bp, Homo sapiens
ctctgcattaagctccaagttgctctgagacctgatttaggggggtcagaggaactggactaaagccaggg

SEQ ID NO: 6856425 - DNA, 107 bp, Homo sapiens
gtcccacaaggcattggtcctttcccattgggaagtcatgaataagagactatgaagcttgcacgtcagatcttcctcaattaatccaccattagcatgtttgggat

SEQ ID NO: 6856426 - DNA, 120 bp, Homo sapiens
agctgaacagggaaggagaagtagcctagcaagattataacttcaggcacagtttcagaacatgtagcttcagtctgatctcataggagatttctggattttgcctcatcccagtctgct

SEQ ID NO: 6856427 - DNA, 60 bp, Homo sapiens
atgcttggcgtttcacttcctgtccactgagacagtcctaagtcatgcatgccatagcat

SEQ ID NO: 6856428 - DNA, 58 bp, Homo sapiens
gggacaaactgactcctgctgttgacttaatttctgcactgctttcacagtttgttcc

SEQ ID NO: 6856429 - DNA, 87 bp, Homo sapiens
cgggatcgtaaatgttatgacagtgaaaaaaatcagactgagatctcttgtctgactcagcactgttgaacatatatttagatcttg

SEQ ID NO: 6856430 - DNA, 62 bp, Homo sapiens
gtgaattagctttacctaggattgttttgggaaaattcttgcaggaacctggtaagcttcac

SEQ ID NO: 6856431 - DNA, 64 bp, Homo sapiens
tcatttcctgtcttttgtgaaggattccgtaatattagaatcactcagcacagatggggcctga

SEQ ID NO: 6856432 - DNA, 78 bp, Homo sapiens
tacagggacaaaactcagtgcagaagagccctcttgagcactctccttaactcttctacactgagttttttccctgta

SEQ ID NO: 6856433 - DNA, 60 bp, Homo sapiens
attgtgctgatctgggagtgcacggggccacatgcccttgcaatttgacgtcagcacagt

SEQ ID NO: 6856434 - DNA, 84 bp, Homo sapiens
tcagggctcatatagtagtatcacaaagtaaaatgaagtttcatttataagttttgttatgctaatttgtggattttatcctga

SEQ ID NO: 6856435 - DNA, 82 bp, Homo sapiens
gggtggcataggaagctgagtgcgtagcctctgctggtaaagtgaatggccagcagctagctgggtttcactgtggacatcc

SEQ ID NO: 6856436 - DNA, 68 bp, Homo sapiens
tgggacagacaactggactaagatcacccagggcctgagtgaccttgggcagttatctaaccttccca

SEQ ID NO: 6856437 - DNA, 60 bp, Homo sapiens
gagcttgtgatagaaggagcggtagtcctttggctttagttccaggtggtcacagagctc

SEQ ID NO: 6856438 - DNA, 68 bp, Homo sapiens
ttgtggtgtgtgctgaggtggaaagtgatagtgttccctctttgcattctcagcacagagcactgcag

SEQ ID NO: 6856439 - DNA, 65 bp, Homo sapiens
ctctcctcccaaggtcagggtctttttctccttaattgtctactctgacatgtggaaaaggagag

SEQ ID NO: 6856440 - DNA, 72 bp, Homo sapiens
agaaagcagcagccgacatggattgcactcttgctctgtgccttgcatgcgttagttggcgtgttgcttgct

SEQ ID NO: 6856441 - DNA, 61 bp, Homo sapiens
ctctcagactgaagggcctgtgggtctgtgggaaggctgctcaggagccctggattggggg

SEQ ID NO: 6856442 - DNA, 89 bp, Homo sapiens
cagcccctaagggagtaattacagatagactttgaagctgcttaataactggcagcatcatagattttttgtaatcacctgagaagctg

SEQ ID NO: 6856443 - DNA, 63 bp, Homo sapiens
tcataaagttctaagaattgtagaaaccataaagttgaggtttatagtttttagaattataga

SEQ ID NO: 6856444 - DNA, 69 bp, Homo sapiens
tggccaaaggtacttgttcctgcatcttccatacagcaggtatatggtcagggttccaggtatcttcca

SEQ ID NO: 6856445 - DNA, 116 bp, Homo sapiens
tggggctctgccactctgctttattggaacggctccgcgtctgagagcacagcaggctcaaccctgcttcagagtggaggccggaccaggctggtgggtgaccagcaggactcacg

SEQ ID NO: 6856446 - DNA, 73 bp, Homo sapiens
tacttacaaaggagaggagataggtaccaaagactaacgctataagaaatctctccatctccttttgtatgtg

SEQ ID NO: 6856447 - DNA, 80 bp, Homo sapiens
gaaagggccaagagtctcacgggcttcttacgtgttgctggatgctcaggaggaggctgtgaggacgaaggcatcctttc

SEQ ID NO: 6856448 - DNA, 64 bp, Homo sapiens
gaaggaaggaaaaatatatttactccaaaattcatttactgggagttttaagtgccctttcttc

SEQ ID NO: 6856449 - DNA, 64 bp, Homo sapiens
gcgctgccctctgtgacccggcccaggagagcccctcggggggaagggaagagagaggcagcgt

SEQ ID NO: 6856450 - DNA, 63 bp, Homo sapiens
gcaacagaaactgtagtgcttcgatctgacctggcggtctgaaagcattacagtttattaggc

SEQ ID NO: 6856451 - DNA, 84 bp, Homo sapiens
tcttgtaaattctcatttgtttaaaagaaatcatagaaaacacatgtcttctggagatgacttttagaaatggagttgttaaga

SEQ ID NO: 6856452 - DNA, 96 bp, Homo sapiens
gagggctggaaaggaaaggtagcgtgccagcaggcaagcagggaaaatatatgctgcagtcactgttaacattctgcatgtttccttccggtcttc

SEQ ID NO: 6856453 - DNA, 67 bp, Homo sapiens
gtggctcctttataaagtaataagaacacaaactaaatttgtgttcctaaatatgaatggagaaagc

SEQ ID NO: 6856454 - DNA, 118 bp, Homo sapiens
tgggagtctattactgagcaagtctatagatcactgggcaataaattcagagaacgttccttagcattcatctaatttggccatagttttaattaagtgtttcagctaatgatttcca

SEQ ID NO: 6856455 - DNA, 100 bp, Homo sapiens
ggaggtgagcgacgcttccttcttgggaccctcctgctctctggtcttggcaaacctgccaggcacaggtgggcctcagaaccagcccgtttatagctcc

SEQ ID NO: 6856456 - DNA, 90 bp, Homo sapiens
aagtgccgagggcacagaccttagggagacactcactgtcacggttgtgcaagtgcagcatctccttaaatcttgtcccctgtgtgtctt

SEQ ID NO: 6856457 - DNA, 87 bp, Homo sapiens
gagcatttaactcatttacatttaaggttaatattgttatgtgtgaatttgatcctgtcattatgatgttagctggttattttgctc

SEQ ID NO: 6856458 - DNA, 60 bp, Homo sapiens
tgagagccagaagggcctgaggttgaagcagccgtgcctcttcatcttgtgagctactca

SEQ ID NO: 6856459 - DNA, 62 bp, Homo sapiens
ttgcatgcaaatcttaagtatgtgtgtataaatatacatatactgagtgatttgctttgcaa

SEQ ID NO: 6856460 - DNA, 76 bp, Homo sapiens
ccagcacattcacaactgagcattgttgcctgacaattcatttattcaacaatgaatgtttgagtgccatgcatgg

SEQ ID NO: 6856461 - DNA, 55 bp, Homo sapiens
cagttcatgagtgaccatgaaaaatgttttcatcaggcatcatgctcaagagctg

SEQ ID NO: 6856462 - DNA, 76 bp, Homo sapiens
ccagttcttcttgacacgaaagacagtaaaattttacacctaactgccttttgatggagttcaagaagcagactgg

SEQ ID NO: 6856463 - DNA, 97 bp, Homo sapiens
agcatctggaaaatacctagattttggtgggactgggtggggccctaggtgggctcccagcccccgagtgtctggaaatgatggtatgagggaagct

SEQ ID NO: 6856464 - DNA, 60 bp, Homo sapiens
ttaggcaaaggaggccacttagccagcttagattctaggcctgggtctccttctgcttaa

SEQ ID NO: 6856465 - DNA, 76 bp, Homo sapiens
cccactttcatcagaagaaagacaaatgatgcaaaagtcaaggaggcagataatcgttttctttcttcctggtggg

SEQ ID NO: 6856466 - DNA, 64 bp, Homo sapiens
ggctgcatagtgtaagaatgtatcatgcctacaatggtcttcatcttcagtacacttgcacgcc

SEQ ID NO: 6856467 - DNA, 85 bp, Homo sapiens
gccctgagccgctcacttatatttcaggagatatgggagctcagtctatgaatttcgtactataagaggagctcagactcagggc

SEQ ID NO: 6856468 - DNA, 89 bp, Homo sapiens
ccctcagattctcaaagaagagcctcatctatcagggctactgaaaggtaaggtactcagcccaggtgaggggttcgaaatctagaggg

SEQ ID NO: 6856469 - DNA, 127 bp, Homo sapiens
ttcagaagtgggcaaaaatatcaaatatttagcagttatgtgaatcatgtgacaggtgtctcagtgtagctggagcatgggccatggatgcagggatattgacagataaagcacagcccaaactgga

SEQ ID NO: 6856470 - DNA, 86 bp, Homo sapiens
agatgaaatgactttccttgaggccaaaaaatgatatcaaagacattatcacctactatgacattttttgtggccttcgtttttct

SEQ ID NO: 6856471 - DNA, 92 bp, Homo sapiens
cccatcctgacttggcagggagcctgaatgttccagggaaagcatttccctgtcccatgcctcaggttccacaactgtcaaatgggggtggg

SEQ ID NO: 6856472 - DNA, 91 bp, Homo sapiens
gggggccccatatttacatttcatactaaggctcaaaaatcatgtagctggttttgctcttggtaatgaaagactccttgaggtggttccc

SEQ ID NO: 6856473 - DNA, 64 bp, Homo sapiens
tggcagtggctcctttcatgggtccatgaaatcttaagcagggccaggaagtgcagccctgcca

SEQ ID NO: 6856474 - DNA, 61 bp, Homo sapiens
tgagtctgtcagtctgactttcttgtgaatgagaatggtcaggtagctctgacaggcctca

SEQ ID NO: 6856475 - DNA, 71 bp, Homo sapiens
agattcattgtggatattttctgacccaggctattgaattgcaggatttcaaagtatcacacaacgagtct

SEQ ID NO: 6856476 - DNA, 66 bp, Homo sapiens
tgctgacctgctctcagcagagaggaaatggcctccctcccatcttggctgcagagccggcaagca

SEQ ID NO: 6856477 - DNA, 77 bp, Homo sapiens
cccttgaacctagatggatctctgtgactattttgactaatgaagtgtggcagacaagattctatgtgacttctggg

SEQ ID NO: 6856478 - DNA, 62 bp, Homo sapiens
atggtctggaccagagtagatcagaaatcctgcagtcttgtggtcggctctacccagactgt

SEQ ID NO: 6856479 - DNA, 76 bp, Homo sapiens
tctcagtagtttacactgtgaaacaggtatcttgaacacacccattggatcccttgtccacggtgtatatgctgga

SEQ ID NO: 6856480 - DNA, 79 bp, Homo sapiens
tggattggagtgtgttttatctattgtatctttaaatatataaccagaagaagaataaatcatagaatacctctaggca

SEQ ID NO: 6856481 - DNA, 79 bp, Homo sapiens
tccaattgctccttgtgcttccagtgtcatactttcctggagtgattcctgattccagcacaaccctggagtagtaggg

SEQ ID NO: 6856482 - DNA, 78 bp, Homo sapiens
ggatttagcttgcagaatacttattctgtattttgcattataaaaatacaattgtaatattcctgagggctgatatcc

SEQ ID NO: 6856483 - DNA, 69 bp, Homo sapiens
gtctggcatcagcctgtagaatacagtaaatcatatttataatttgcatgggtctgcagcaggccaggc

SEQ ID NO: 6856484 - DNA, 60 bp, Homo sapiens
tgctatgcttgactctggaataaaatgttgcattcttgcaggtgcatgagtcagtaagca

SEQ ID NO: 6856485 - DNA, 56 bp, Homo sapiens
gattcagcctctgcttccctgaccaagctgtgagctctgggagggagggctgggtc

SEQ ID NO: 6856486 - DNA, 55 bp, Homo sapiens
cgcctttctgtgttgccctatttggtttcgctagttctgccacagggagaaggtg

SEQ ID NO: 6856487 - DNA, 65 bp, Homo sapiens
ccagtgcagcctgtcgccagtggatccgtggaaattatatgttctctggcaagggctgtccatgg

SEQ ID NO: 6856488 - DNA, 129 bp, Homo sapiens
gggagcccagaccctgtagggagttttgttttcctttcttctcttgggtgtggtgtcttgtgtttctgaatgtgaacccaaagaccctacccctggagaggaagcaccttcctctttgtgttggtctcc

SEQ ID NO: 6856489 - DNA, 62 bp, Homo sapiens
tttccttttgtccctatatcctggaaggtttgtttttccaggaagtaaggataatctggaag

SEQ ID NO: 6856490 - DNA, 63 bp, Homo sapiens
tgagcggcaaggtcagctgggtacccggatacatcagaatctaccgtgcttatctcctgctca

SEQ ID NO: 6856491 - DNA, 63 bp, Homo sapiens
ttagagaaatgggtactgcatatacttctggtgttgagtaactgaagaaccctatttctctaa

SEQ ID NO: 6856492 - DNA, 70 bp, Homo sapiens
ggggttaggcaatttcaccattcactgaacattttgtgtgttttctgaaaactgaagtagtgctgacttc

SEQ ID NO: 6856493 - DNA, 61 bp, Homo sapiens
ggccctcttttatccatcataaatcatcatcagatttatactttgttagcaaaagggggct

SEQ ID NO: 6856494 - DNA, 61 bp, Homo sapiens
aagctcatgggtgctgtactttctgagttcctgagaatatttgcctgttgcctttgggctt

SEQ ID NO: 6856495 - DNA, 76 bp, Homo sapiens
taacagctccagagggagagtttcaacatggccctgcagggctaagtgaagattgctccattttctttatttgtta

SEQ ID NO: 6856496 - DNA, 84 bp, Homo sapiens
gttgcagttattcagaaggcccgccctgagcaagggctccaaaccaggatttccttcagggttgaggccgactctagtggcagc

SEQ ID NO: 6856497 - DNA, 95 bp, Homo sapiens
atgaaagagatgttacccaaaacaagaataaaaactgtttacctagatgcttggtaaacatttgttattcttgttttgggaaccatttctttcat

SEQ ID NO: 6856498 - DNA, 102 bp, Homo sapiens
cataaataatcaaggtctgactattttattttcggtggctgtgtttgttctaaattaagaatgccattgagattgaagtaagcatgctgactgtaatttatg

SEQ ID NO: 6856499 - DNA, 66 bp, Homo sapiens
ttaaggaccagtttcaaactgtaccaaatcctcactcactggctgatgcagtaaattggtctctaa

SEQ ID NO: 6856500 - DNA, 58 bp, Homo sapiens
tgactctacactgtagaattataaggacctcaagccttggcaagacagtggagggtca

SEQ ID NO: 6856501 - DNA, 90 bp, Homo sapiens
agccctgccctgacttccccagagaacttctcctaaatctcagtgaggcaagcactggcattcaggagagcttcctgagaagggtctgtt

SEQ ID NO: 6856502 - DNA, 85 bp, Homo sapiens
ttccttatgtttttctattagaatgttctttttcatcgtgtgaacaatgaggcttttaaaatatttttgtagttaggcaatggaa

SEQ ID NO: 6856503 - DNA, 83 bp, Homo sapiens
gtgcaaggagaccacagagacagagcccagggtgcctcttgtacaagaacccaggctgcttctcagtggcgctccctccccac

SEQ ID NO: 6856504 - DNA, 95 bp, Homo sapiens
gtgtaagtcttgaatgaattcagtctagagattctgaagggaatttgataatattttcctttcctttttggtttgcttatgatgggacttggcac

SEQ ID NO: 6856505 - DNA, 55 bp, Homo sapiens
cggaaacttgagaaccagccagaacatgtagcctggctcttggtgctagtttctg

SEQ ID NO: 6856506 - DNA, 67 bp, Homo sapiens
gccatttaggggaagacctggcactacagcccggaggtcctgggttcttttgtggttttccccgtgc

SEQ ID NO: 6856507 - DNA, 57 bp, Homo sapiens
tcagatatctgatgtctcttactcacccaagtgagttgcgtgggctcagatctttga

SEQ ID NO: 6856508 - DNA, 57 bp, Homo sapiens
ctgctgcaatctggcttccatgtgaatcagcctctgagaagaagattagattgccag

SEQ ID NO: 6856509 - DNA, 76 bp, Homo sapiens
atttgatttagaatgacattgagccataacatcaagtagtgaaaatttaagatgctggttcaatttcccatcagat

SEQ ID NO: 6856510 - DNA, 79 bp, Homo sapiens
gcaccaggcctggctgggcagccacaggcccaggaagaaagcagggccgcagcgtggggtccggcactggggcctgggc

SEQ ID NO: 6856511 - DNA, 87 bp, Homo sapiens
ggcatgccccgctgcacttgtggatttgatatacagacacagaatagaagagtgtgtgtgtccatgtgtggtgcagagatgcgtgtc

SEQ ID NO: 6856512 - DNA, 63 bp, Homo sapiens
ccttcctctagcctagtaatgcctgttcatccttcagctcaggtatcacttccttagggaagg

SEQ ID NO: 6856513 - DNA, 76 bp, Homo sapiens
ctcaaagcgcctgcctctgtgcttatgctccatgggcacccatgtgtccaggctagaagtcacaggccaggaagag

SEQ ID NO: 6856514 - DNA, 86 bp, Homo sapiens
tcaagcttagcaacttttctttctctgtgctgccaaaggacaggaggagatacagagatgtgaaaagctctaattctttagcatga

SEQ ID NO: 6856515 - DNA, 58 bp, Homo sapiens
ggactgtggtgctaaaaggagactgacacagactagtcttggaagtagaacacagtct

SEQ ID NO: 6856516 - DNA, 83 bp, Homo sapiens
ctggtagaacactcttgcacatgttttactctccaacattatcgttgagtagactcagaatgcagaaggatgagctctgccag

SEQ ID NO: 6856517 - DNA, 77 bp, Homo sapiens
tggtcaaagtgtaagagggactagaaatgagtttctggaacatctacagtaattcctctatctttcttcaagagcca

SEQ ID NO: 6856518 - DNA, 57 bp, Homo sapiens
ctattcaccccctatttgcaatgctggtaagagcaatattggttgggaggtggagag

SEQ ID NO: 6856519 - DNA, 85 bp, Homo sapiens
cacataacacttttctcttagcttagctgccaggaaaataatttaataccactgttgctactaagtcatggaaagtgtgtgtgtg

SEQ ID NO: 6856520 - DNA, 66 bp, Homo sapiens
cgggacactagagagcaggcattcccgtggccgcgggagagccgcgttcctggctggccattcccg

SEQ ID NO: 6856521 - DNA, 89 bp, Homo sapiens
gaactcccagtcttgggcgggtggtgtccctgctcctccacagctgtcgaagcctggggaaaccagttcccctcactgggcctcagttt

SEQ ID NO: 6856522 - DNA, 77 bp, Homo sapiens
gagagtccgtggcaggagttcaattgcccatgatttgcagtagaggtcattggactcaaaagaactccttggctgtc

SEQ ID NO: 6856523 - DNA, 74 bp, Homo sapiens
tgattttgtctgaacgaagtaggtccactggcactatttggcctgtggccctttgttttgatacctctaaatta

SEQ ID NO: 6856524 - DNA, 70 bp, Homo sapiens
gccattttgcttcagtagctctttaaagctacttaaagttgttttaaaggggctttgagtgtctagtggc

SEQ ID NO: 6856525 - DNA, 65 bp, Homo sapiens
ctcagctctccaacttggctctctggctatccacaggacgtggacatgagcccagtggggctggg

SEQ ID NO: 6856526 - DNA, 66 bp, Homo sapiens
cacagagacatgatgtcattgctctgcccggatttccttggggactcaatttcatcatttcctgtg

SEQ ID NO: 6856527 - DNA, 77 bp, Homo sapiens
ctaccccaacgctgaggaggctgagagagctaaggctgagactccccagttctcttccacagcctcctcacatgtag

SEQ ID NO: 6856528 - DNA, 55 bp, Homo sapiens
gagcccagctgcggccctcagccctgcccggtgggcgcaggagcagactgggctc

SEQ ID NO: 6856529 - DNA, 87 bp, Homo sapiens
gcatgagatacaggggacctagggctgctggaaggatgggctgctggggcgtatctctgttccaagccttatccctgctcttcatgc

SEQ ID NO: 6856530 - DNA, 75 bp, Homo sapiens
atgttcccatggcagtatttctgaaaggctggtaccatctctccaagctgacattggatattgctatttaaacat

SEQ ID NO: 6856531 - DNA, 61 bp, Homo sapiens
agattcctagtgttatttctgtcctttggaatattatccagcagagggaattttaggatct

SEQ ID NO: 6856532 - DNA, 86 bp, Homo sapiens
gactggcttctattgtttatttcttgcgtttttgttgcatttcgttgcagatttaagagataaacagtggaaggcgctttcaagtc

SEQ ID NO: 6856533 - DNA, 75 bp, Homo sapiens
ctaccttccaagcaccttgtaagaattaaattagttaatataagtaaagttcttagaacaaggcctggaacatag

SEQ ID NO: 6856534 - DNA, 58 bp, Homo sapiens
gaaacaatgggaaagcaatattggaagataactgtctccaaatactcccaattgtttt

SEQ ID NO: 6856535 - DNA, 59 bp, Homo sapiens
ggaatagccagtgttgtgttggatagcgggagcatttggctagcttatggttatagtcc

SEQ ID NO: 6856536 - DNA, 129 bp, Homo sapiens
gtgtcgggggcctgaacacgaagtcggtagaggagcaggtctccaggcacggctccggcaacaccaacaggaagcgggccaccttggagagcgctcttccactgctggagttcctggtcaatacggcat

SEQ ID NO: 6856537 - DNA, 73 bp, Homo sapiens
aggtggggagtgggtaaaggagtccagcaggctgaatgccttcaacaatcattttaccacatggtcctcattt

SEQ ID NO: 6856538 - DNA, 59 bp, Homo sapiens
cagactgaaaatccctggtagtacctgtagtttccttccaggacacgatttttagtctg

SEQ ID NO: 6856539 - DNA, 71 bp, Homo sapiens
ccaagcatttactaccattctgatcagtgtgaactttttccgccagaaccttgctgatagtaatctcttgg

SEQ ID NO: 6856540 - DNA, 71 bp, Homo sapiens
atggaaggaatgtggcatgcagctgacctctggtacaggacagcaagaggaagctgagatgcctctttcat

SEQ ID NO: 6856541 - DNA, 83 bp, Homo sapiens
cacgcaggaggcagtgcagtgcagtggttaggagccaggcagcttgggtttgcatcctggctctgccacttactgcctgtgtg

SEQ ID NO: 6856542 - DNA, 109 bp, Homo sapiens
tttctgtttatttacctattcccttggagctaccaggaagggctgtggcctgtggccgcttttcttctgagtggcaccagcagttggaagcagtgggagtgaggaggga

SEQ ID NO: 6856543 - DNA, 117 bp, Homo sapiens
catgaagattttgttccatgaaacataaaagcctgcatctttttccaagtttattttatactgccataaggaaagtgagtggaatgagttgtaggcttgactcaacagtagctcatg

SEQ ID NO: 6856544 - DNA, 86 bp, Homo sapiens
ggggcgtgcctgtggcccgtcttgcaggttccgcggctgtgcagtgagtgcgcttctgggctgcaggagtggggcaaggacgcccc

SEQ ID NO: 6856545 - DNA, 130 bp, Homo sapiens
ggagttggaacagttctaggtgatgttatagggtatttacaacagacctagatgaatgagatattataaatttcaatatcttgtgtctttgagaataaccctggaacatttttaaagttgtttttatttc

SEQ ID NO: 6856546 - DNA, 78 bp, Homo sapiens
cacagtatgcagaagtagaagcttgcttctgagtagtgtcatttctactcataggctcctctgcttctgcattctttg

SEQ ID NO: 6856547 - DNA, 76 bp, Homo sapiens
agctccgtccatgcggctctttccaaaccggggccgtttttgcctggcttctctggtgtggactccgcgcggagct

SEQ ID NO: 6856548 - DNA, 55 bp, Homo sapiens
cccccgggaagctctcgtggctgggcctcttctccagcagagccttccaggaggg

SEQ ID NO: 6856549 - DNA, 87 bp, Homo sapiens
gcaggaatttcattgctctgctgtgtgccccagtgggacctgatgcccaacaaatggaactgaatatagaagagcaatgatttttgt

SEQ ID NO: 6856550 - DNA, 67 bp, Homo sapiens
ctttgtgcactagttcacaaaataggaaattactcaaatgtccaaatacgtttgctggtgtataaag

SEQ ID NO: 6856551 - DNA, 55 bp, Homo sapiens
tgggcctcctgccctggcctaggaaagtgctctaggcagccatccaggaggctca

SEQ ID NO: 6856552 - DNA, 85 bp, Homo sapiens
ccctttgtctccatcactgcacacctgaggtatatatctctctctctgagtagtgtacctcagtgcagatgttacaatcagaggg

SEQ ID NO: 6856553 - DNA, 75 bp, Homo sapiens
attctcttccttcctttcagggctatgcctaggcagaaaagaagcaggcagaagccgagggggaggtttcaggat

SEQ ID NO: 6856554 - DNA, 57 bp, Homo sapiens
ggtaccagttatttctgaatgcatgggaaaatccattttgtagcaatgactgttgct

SEQ ID NO: 6856555 - DNA, 62 bp, Homo sapiens
gatctagacctgcagtttgaaccttacttttgaggcgaggaggctgaactagggtctggttc

SEQ ID NO: 6856556 - DNA, 63 bp, Homo sapiens
ggttatcagtacgtttgtagatgctgccaaaatcttttggctccaaatcaactgctgttaact

SEQ ID NO: 6856557 - DNA, 66 bp, Homo sapiens
agggagccagagatccaggatggctcattcgtctcacttttgaccgccctgcttctctagttttct

SEQ ID NO: 6856558 - DNA, 95 bp, Homo sapiens
agttaaggccattttcacttcttttgtgattcttcagttacttccgaccatctggatgtatacgtgcaggtcacaggggatatgatggtttagct

SEQ ID NO: 6856559 - DNA, 69 bp, Homo sapiens
tctttttatgtatgcttttaaggaattccattcctgggattcaacatagctgaggcatatatggacaga

SEQ ID NO: 6856560 - DNA, 72 bp, Homo sapiens
agcaaggaaaaaggcctttagagcttaaattacaaccacatctaatgaactcagaggtgtttttcacttact

SEQ ID NO: 6856561 - DNA, 90 bp, Homo sapiens
attttttatttttgatactttgtgcaatttctctagaatatgaggattaagaaccttagggattgtattagtgtcacagcagtagaaaat

SEQ ID NO: 6856562 - DNA, 101 bp, Homo sapiens
ccggaagtagaatggggtctgagaggaggcagcctcggataatggggacaagcagccttgaggcaatgtttcttctatcttacagccctattatcctttgg

SEQ ID NO: 6856563 - DNA, 79 bp, Homo sapiens
gcattagctgtcttctagtaggccaagaagctccccaagcaacacaaggagctttgtccctgttggaaatgcagagtgc

SEQ ID NO: 6856564 - DNA, 77 bp, Homo sapiens
tggacctcccaggcattgccattttcccagtctgagtccatgaaccaggaaaatggcattgcctaggggactttcca

SEQ ID NO: 6856565 - DNA, 86 bp, Homo sapiens
ggacatctattacatctgcttagaattcattgtccagaactacaagaattctgggcaatatgaagggagcacatatatatttgttc

SEQ ID NO: 6856566 - DNA, 103 bp, Homo sapiens
acagtgtcatttgtttaggagaatctacaatgaaaaaatgtttaaattaaatgtttaggcatttaaagatgtaagactcgcttatctggcacatagacattgt

SEQ ID NO: 6856567 - DNA, 83 bp, Homo sapiens
tggagactccaggaaagtgggatgtgtgttttgtgttcttctggccgtccttcaatatacttccaatttcctgtgggtttcca

SEQ ID NO: 6856568 - DNA, 61 bp, Homo sapiens
gagcggccgccgggccacgtgaccggtttgtttacaaacactgccgggcccgcggccgctc

SEQ ID NO: 6856569 - DNA, 88 bp, Homo sapiens
atctgtaatatccatacttttagtgatgttaaggttatgttcatatgtaagaataatgatttctaagaaccagtgaggatatttaggt

SEQ ID NO: 6856570 - DNA, 63 bp, Homo sapiens
gtcctcccattggccaggacttgccgtctgaaaggggcctctatcctggtcatgtggctgggc

SEQ ID NO: 6856571 - DNA, 56 bp, Homo sapiens
cccaggctggagtgcagtggcgcgatctcggcttattgcaagctctgcctcccggg

SEQ ID NO: 6856572 - DNA, 116 bp, Homo sapiens
ttagccggttgaactatttattacgtgtctccgttcctggttattatgccagtaaattgctcaggcagatgcagggatggatgatgggcatataattcactctttttcacggctag

SEQ ID NO: 6856573 - DNA, 58 bp, Homo sapiens
ggagtgaggatgtcatggacctcacagaaggtgacagtgaggcctcagcctcagctcc

SEQ ID NO: 6856574 - DNA, 59 bp, Homo sapiens
gacatcatggagaggacaaacagattggcaagcctttttatgtcttttccaatgctgtc

SEQ ID NO: 6856575 - DNA, 63 bp, Homo sapiens
ccagggcctcctaaggcatctaaaatatgcaaatctttggtgagcccccagtgaggctcctgg

SEQ ID NO: 6856576 - DNA, 130 bp, Homo sapiens
acctgcaagctggagacccaggacagccagtggtgtaatgccgtctaagaccttaggcctgagagccaaggggcagatggtgtgcatcctggtgcaagggcaggagaaggatgtcccagctcaggcaggt

SEQ ID NO: 6856577 - DNA, 78 bp, Homo sapiens
cagctggtctgcattgctggtactggttgcatcatcctcatcctcagagctggcttcacaggcagtgtggaagagctg

SEQ ID NO: 6856578 - DNA, 65 bp, Homo sapiens
ttcatgcgttcacaagacgtttactgagtgcccttttttcggcaggtcccattgtgaggcttgaa

SEQ ID NO: 6856579 - DNA, 74 bp, Homo sapiens
gaactgcttagtttatggtctttagtaggagatgcttattaactactaattgatgataatgtggcaaatagttc

SEQ ID NO: 6856580 - DNA, 56 bp, Homo sapiens
cccatctgcactgggagcatgtctggcccacaccagctcaagcactgtgtgaaggg

SEQ ID NO: 6856581 - DNA, 61 bp, Homo sapiens
aggtcagatggcttattgggggttccagaatccattttatatcttccaagccagcttgcct

SEQ ID NO: 6856582 - DNA, 57 bp, Homo sapiens
atttgcgttaaagacctctttggcaatgcattgttgaaagaggttaatattgtaagt

SEQ ID NO: 6856583 - DNA, 58 bp, Homo sapiens
catatacacttccacctctgtgctatcttcctggaaaacacagagtagaagtgccatg

SEQ ID NO: 6856584 - DNA, 68 bp, Homo sapiens
acttttgaacaaactcctctgtcttggatacatttttcttaaaaccaagcagttgtaaattcagaagt

SEQ ID NO: 6856585 - DNA, 62 bp, Homo sapiens
gggtggagagtggctctatgtgggaaagcagaagatatccacctagcattcacctcctacct

SEQ ID NO: 6856586 - DNA, 58 bp, Homo sapiens
ccaggtgtagcactgctcacaggtcagattgcctgctctgacgtagtgactcagttgg

SEQ ID NO: 6856587 - DNA, 91 bp, Homo sapiens
tattttctctgttttggagtatttaactggaaacacaatgatgtaattacatgattaatttttccagtaggtaaataataacaaggaaata

SEQ ID NO: 6856588 - DNA, 64 bp, Homo sapiens
gtaagaggaggcggacacaggtagtgttgaacactctcaatctctgccacatgcctctatttgc

SEQ ID NO: 6856589 - DNA, 106 bp, Homo sapiens
gtttcttgtttatgagaacaagacattttacattcttccattgtaggtttcataacctcagggatacacaggaatctaaaatgtcagtggctcggctggaagagac

SEQ ID NO: 6856590 - DNA, 76 bp, Homo sapiens
ggtttgactgtcctacccatttgtctgctggtcatttagggtgacaggcaggacagaggtgtgtggagtcgatacc

SEQ ID NO: 6856591 - DNA, 55 bp, Homo sapiens
taaggagagaatttagaggttttagactggcatctgcttctaaattctgttttta

SEQ ID NO: 6856592 - DNA, 79 bp, Homo sapiens
gctctgccaggatacagtgagaatgcagctaataacttccaggaggtttcctctgctggttttcattgtaacttagagt

SEQ ID NO: 6856593 - DNA, 65 bp, Homo sapiens
caggctagctagtgacagcaggtctctaatgcaaagtttaggatctcgcctcctgagctatcctg

SEQ ID NO: 6856594 - DNA, 73 bp, Homo sapiens
gaggcattctagaagtagaagtagaagtagaagtagaatatttgtgaataatgctctacattagcagtgtttc

SEQ ID NO: 6856595 - DNA, 56 bp, Homo sapiens
cccagtggcaaagcagcttagaccacatggagacatgaagcatctttgaaactggg

SEQ ID NO: 6856596 - DNA, 88 bp, Homo sapiens
atatttagtgagaaaaaggctggtagtatttagtcacagcatgtagacactgctggtgactgactacttcagtccagaacacaaatat

SEQ ID NO: 6856597 - DNA, 60 bp, Homo sapiens
gttccagaacctgagagcacaatcctgtgtgatctcactgcagggccaggattctggaac

SEQ ID NO: 6856598 - DNA, 62 bp, Homo sapiens
ttcatccagatacatgaggcacagttctacatgctggtgctggccaaagtgtacctggagag

SEQ ID NO: 6856599 - DNA, 77 bp, Homo sapiens
gtggctcctgtaggctgaagagaaaagacagctcctacaaagtacatctttcagctcttcaggacccaggagactgt

SEQ ID NO: 6856600 - DNA, 71 bp, Homo sapiens
gctagtcaagggctgggctgcttgttgtcactgggtctccttttctggctttgcatgcccacccttgatgc

SEQ ID NO: 6856601 - DNA, 74 bp, Homo sapiens
ggtataagaatgcttgtttggggtgggcaagagatgtagtaaagtagcagaccccactgttcaggcattcaacc

SEQ ID NO: 6856602 - DNA, 92 bp, Homo sapiens
ggtgacaagccattcaaggtatttaaaacataagcactaaaattttatccatgcatttatgtgtgtgcttttgaaaaaaaaggcctgtcact

SEQ ID NO: 6856603 - DNA, 100 bp, Homo sapiens
gcatgcaaatgaagaggaatgaaactatgttcattgtgtacccactatgtggcaagcactgtgctaaacatgtatcataaggtatctcattttagtatgt

SEQ ID NO: 6856604 - DNA, 61 bp, Homo sapiens
cacatggcttggttttgtttgctgtggtttttttaaacgaacaatctccaagaccaatgtg

SEQ ID NO: 6856605 - DNA, 75 bp, Homo sapiens
gctgagaagttgggtgggtgtttcaaggtgaccttctggataccagccagaggtgacatgcacctatcccttggc

SEQ ID NO: 6856606 - DNA, 96 bp, Homo sapiens
gaaatttattcatatatggcccagtgaggtgtgcatgaaagaaagaatctggttctacattcatgtattacctcaagccattcatatgaaaaattc

SEQ ID NO: 6856607 - DNA, 96 bp, Homo sapiens
gcacagacatctggggaggtcaggcctgctcctaccacctattgctctcagaaaaagcggaggggcctggttggcctctgttgatgacaattgtgt

SEQ ID NO: 6856608 - DNA, 76 bp, Homo sapiens
gtgttgagtgcagaccaggtacattcaataattagtacctactacagttattaagtcctgttttgagctgaattac

SEQ ID NO: 6856609 - DNA, 55 bp, Homo sapiens
gtgtcctctaattggcctcttgcacaggagtgtgtagggaatcttttgggggcac

SEQ ID NO: 6856610 - DNA, 59 bp, Homo sapiens
ggctgctgctgtgtaggcctgtttcctgtcaccagggttcagagccaagagcagcatct

SEQ ID NO: 6856611 - DNA, 77 bp, Homo sapiens
gggaaggggcgtctgtaggcagtgggtgaggaggctgtctctgtcccagctggaccctgacagatctctcttttccc

SEQ ID NO: 6856612 - DNA, 73 bp, Homo sapiens
gaatgagggtcttgaggatctgaactgtatttttgaatatgggataccaaaggaccctatacaaaacttattc

SEQ ID NO: 6856613 - DNA, 130 bp, Homo sapiens
attagaatcacttgtggagatttataaaaattgctgcctgaatgaaccttgttcttggagattcagatggaattggcctgggtggggtctagacagcagtagtttttaaaactctccaggtgaatctaat

SEQ ID NO: 6856614 - DNA, 64 bp, Homo sapiens
gtggtagagtcaggcttgggatgcaggtctatgtagttccaaagcctgtattcttatccatcac

SEQ ID NO: 6856615 - DNA, 71 bp, Homo sapiens
tacctctgtcaattagcctccgtgaagtgagatgaacctctgagcacaaggattaaatgatatacagtgta

SEQ ID NO: 6856616 - DNA, 65 bp, Homo sapiens
tcctcaactttctagcagcaggtataaattgcctgaataatacagactagcttcaaggatgaggg

SEQ ID NO: 6856617 - DNA, 98 bp, Homo sapiens
gccattagggatctgtgggcctcttgagggtggctatgagaatcaggccagggtgagggtctgtgggcatctatggggcaccgcgggtctgcatgggc

SEQ ID NO: 6856618 - DNA, 125 bp, Homo sapiens
ccttgttgattataatatttggagatcttattgtggagaagggaagaatactggaaaatatagaatattctgtctttttatacatctaagtgaaagagtttttaaaagatattataattcagagg

SEQ ID NO: 6856619 - DNA, 74 bp, Homo sapiens
gacaattgaatcttgagcctcaatgccataggcttgatagtcagtgaatctgaaggctaaagatctgatctgtc

SEQ ID NO: 6856620 - DNA, 80 bp, Homo sapiens
ggaatgaacagtggagacaagagagttaaatagggtttgactcattaaagtctccgtatgctgggtttcaattttattct

SEQ ID NO: 6856621 - DNA, 79 bp, Homo sapiens
tagtgtgtgggcttcagggactagcctgaccagtgcatttcaaactatgcgacggaaagactctgaggacccacacctg

SEQ ID NO: 6856622 - DNA, 97 bp, Homo sapiens
gtctttcaaattattgaattaaagtagaggagaacacaaattataggttgtcttggtgtgtgagttttctcttgttattcattaatctgattatgac

SEQ ID NO: 6856623 - DNA, 81 bp, Homo sapiens
gtgatgagaggatgccttattgtaatctttccattgggtagtctaacatggcacaaagagtatagtgaggttcttcctcac

SEQ ID NO: 6856624 - DNA, 64 bp, Homo sapiens
gatatgtaatctaaggagcctgcatctcattgtggctttactgtcattcttatggttatatatc

SEQ ID NO: 6856625 - DNA, 70 bp, Homo sapiens
ttggttccctggggtgtacacctcactgtgcaaactactggtacaatgagctgtacatctccaaagccag

SEQ ID NO: 6856626 - DNA, 76 bp, Homo sapiens
gctgatgtaatggaagttaaatatggtatgggggaactacattacatagtaattttttacttttaattacagtagc

SEQ ID NO: 6856627 - DNA, 58 bp, Homo sapiens
gcccaggaattggaggctgcagtgagctgtgttcacgccactgtactccagcctgggc

SEQ ID NO: 6856628 - DNA, 85 bp, Homo sapiens
gcagctccacagaccacttcagccagctggggatgcggaggagaacagagtggcctcctcccccgagctgtgtttgtggggctgt

SEQ ID NO: 6856629 - DNA, 77 bp, Homo sapiens
gataaagttaagtcatttctgattatagagattctaattatagatatttgtggtatagagatgattattataatgtc

SEQ ID NO: 6856630 - DNA, 82 bp, Homo sapiens
agagctgaaaagttacccagagtcatgtttattcccttttctactaagcagggaacttgaactctgggtgcacatgagttct

SEQ ID NO: 6856631 - DNA, 75 bp, Homo sapiens
tgtggagccagcagggtctgagctcagcagcttctcaaaaaagcccccctgagctgctttgcttttggggccaca

SEQ ID NO: 6856632 - DNA, 70 bp, Homo sapiens
ggctgagtccacattcctgggtagatccgtgatacacagaatgtaaggcccatggagtctggatctggcc

SEQ ID NO: 6856633 - DNA, 67 bp, Homo sapiens
tgttcagcatcaggaaagctttttttgccttacttaactaaagtctgcctttcatggtgcatgatca

SEQ ID NO: 6856634 - DNA, 55 bp, Homo sapiens
gttaaggcaaccagggccaggctggatttttcagagggcacatggtttcctcagc

SEQ ID NO: 6856635 - DNA, 58 bp, Homo sapiens
tttcctactttctggggaggtataggaagaatgggccttctcagatcgagtagtgaga

SEQ ID NO: 6856636 - DNA, 74 bp, Homo sapiens
gattgtgctttgcatcttgttccagtaaagtctcttgtcagtttgcttgtcaggagccaagaaaagcagcaatt

SEQ ID NO: 6856637 - DNA, 103 bp, Homo sapiens
tctgatagtaactgatttaggaacataggcttaaaccatcagtagctggtattcccagggctggtctagggatgggcgtatgatccaatttggcctaatcaga

SEQ ID NO: 6856638 - DNA, 55 bp, Homo sapiens
gttgaggaggttcagggtggttactatgttcttggttcactcccatctcctctgc

SEQ ID NO: 6856639 - DNA, 72 bp, Homo sapiens
ccttgtgcttacttgctatatttctttagggaaaaagttcttagacaggaaacagttggtaatgcatattgg

SEQ ID NO: 6856640 - DNA, 58 bp, Homo sapiens
acctcatagttttcgtgggtcagaactttgagttctggctcagggtctcttatgaagt

SEQ ID NO: 6856641 - DNA, 72 bp, Homo sapiens
tctgctggcagccaagtgggatactctggggtcagcaacttgctgaagtgagtaaccccctctgccagcagg

SEQ ID NO: 6856642 - DNA, 77 bp, Homo sapiens
ggtaggaggttgagtgttgtgcatgcaccagatgctgccttgattgtttggctgtgtcacaatatcaattaattgcc

SEQ ID NO: 6856643 - DNA, 60 bp, Homo sapiens
tgaggcttttggcattccttagactcacttatcaaaggtgggccagggccagaagcatca

SEQ ID NO: 6856644 - DNA, 74 bp, Homo sapiens
ggccagggagctcgttgggttaaccaggatgtcaatgattttgtacttgccatagaacaacatctctttgagcc

SEQ ID NO: 6856645 - DNA, 62 bp, Homo sapiens
ggaatgcactggttctttcccatagtttgcatttaaactgtgtgaaacatcaatgtgtgccc

SEQ ID NO: 6856646 - DNA, 88 bp, Homo sapiens
tttaggtatctgagtatacaatggcactgccaatagaaagcaactatagagtttatttgcatgccactgtattctagaaagaactgaa

SEQ ID NO: 6856647 - DNA, 70 bp, Homo sapiens
agtgtccactgcgttcctgggaagggctgcgaggcctgccctccaaacctgactggggatgggcggcact

SEQ ID NO: 6856648 - DNA, 60 bp, Homo sapiens
aggcttcttttagaggggatggtttgataaaactgaagacctcatgttagaagaaggcct

SEQ ID NO: 6856649 - DNA, 71 bp, Homo sapiens
ggagttgttatagaatgtaagaatgcaaagattgaatggtcaatgtggtattttggcattcttccaaatcc

SEQ ID NO: 6856650 - DNA, 112 bp, Homo sapiens
tttaaatttactatgatctttgagacagctttatcttcacctgggaattgctgttagacaattaaggttagtaaagctcattgaatttctcagagggaaggtgttatttgaa

SEQ ID NO: 6856651 - DNA, 60 bp, Homo sapiens
tttacctttgtgggtctccctccagaactgaaggcttgggaggagtttccaatgggtaaa

SEQ ID NO: 6856652 - DNA, 58 bp, Homo sapiens
gttcttaagcttgaggtttgcagaggagcagtaatagtagcttcaggctcaagagaac

SEQ ID NO: 6856653 - DNA, 94 bp, Homo sapiens
gtaagaaaggttattagcttttggttataaggtgccccaaactagtctgttttcatacaagttttcttcattttgtggccatgatccatcttgc

SEQ ID NO: 6856654 - DNA, 63 bp, Homo sapiens
ggaccaacgctgcccatatttgtactcctaaagaagagagtatgtatgactcagtgcaaatcc

SEQ ID NO: 6856655 - DNA, 59 bp, Homo sapiens
ggaacttatttggataatacagcacagatgtaccttgttgtactcaacagatgaattcc

SEQ ID NO: 6856656 - DNA, 115 bp, Homo sapiens
ggatgaagacatagtaaaaccaaatgcaacataaatttgaagtggcaaacttggtagtttctcagtttctcacccaagagttattttgttttgttttgttttgttttaaccatcc

SEQ ID NO: 6856657 - DNA, 56 bp, Homo sapiens
tttgcctaatgaagggcatttttctctgtgaaaatctggctagttcattaggtagg

SEQ ID NO: 6856658 - DNA, 85 bp, Homo sapiens
gccattaagtttcaacatgcaaactttgggagacatattcagaccatagctgtcctcaaagttcattcatgttgttgcatatggt

SEQ ID NO: 6856659 - DNA, 88 bp, Homo sapiens
ggctcagatgttcaagaacattgtgatcacttcagataatgtttatcttatttatgatgttgcacagatgttcaagaacattgtgatc

SEQ ID NO: 6856660 - DNA, 100 bp, Homo sapiens
gcatggactgtattaggttgaaccatgtgaaattgttattccatagtcaaaatggtaagcattggcaatttcacatggcttaaccctgtgtgtatctatc

SEQ ID NO: 6856661 - DNA, 62 bp, Homo sapiens
tgtggttggaatgcagccatgcccatttgttcctatgctacctatagctgctttcagctgca

SEQ ID NO: 6856662 - DNA, 57 bp, Homo sapiens
tgtcttgaggcgcagtgtagattacatgggtcagaatttgtaaatgtgcttaggaca

SEQ ID NO: 6856663 - DNA, 61 bp, Homo sapiens
ggttctcaaataccatgtatcatcagtcattgttttgtctgcatgtttgtgtctgagaact

SEQ ID NO: 6856664 - DNA, 68 bp, Homo sapiens
ctgcctctttagctagtggtttactgggcagaaaatattcagctgcagttcaatgcttgcttaggcag

SEQ ID NO: 6856665 - DNA, 59 bp, Homo sapiens
gcaaaagtgatgctgtttaacttctgaatcattaagaaagatgcagcttccacttttgc

SEQ ID NO: 6856666 - DNA, 59 bp, Homo sapiens
aaagggcttatggaaaaaagatgctcatgggtgcttcttggctcccttgtaggcccttt

SEQ ID NO: 6856667 - DNA, 68 bp, Homo sapiens
ggtctcacagtgctctgggtggcagactggcagggggcagcttgtctaccaccccgggcctggagact

SEQ ID NO: 6856668 - DNA, 61 bp, Homo sapiens
tgcctgtgggtgccaccaccctttgagaactgaaaaatgcgtgtgcccccacctccaggca

SEQ ID NO: 6856669 - DNA, 59 bp, Homo sapiens
tggtcttggagtctgaagacctgggtttgtggcccagtaacacaaccactccgtgacca

SEQ ID NO: 6856670 - DNA, 91 bp, Homo sapiens
ggtgcagcttctatagcaggactgaagggcacagggaatgtctctaaacaaccgtcccattcatatgtttctgagtcctctggcagccacc

SEQ ID NO: 6856671 - DNA, 64 bp, Homo sapiens
cttcaaatccccctgagtttgatactgtgttacataatggtctcagaacattaaggatttgaag

SEQ ID NO: 6856672 - DNA, 55 bp, Homo sapiens
gggggccttattcatctgccagagccctgctgtggtaagcagaataatgccaccc

SEQ ID NO: 6856673 - DNA, 87 bp, Homo sapiens
tctcatcgtgttgagactcgagtctctcagaccttggattcattccctggtgtctttgagcctcagtttcctcattggtaaaagaga

SEQ ID NO: 6856674 - DNA, 72 bp, Homo sapiens
ttcaatgttaagaagaatatgttatgataagaggttcctaaagaaagcatttcatagttctctggcattgaa

SEQ ID NO: 6856675 - DNA, 66 bp, Homo sapiens
tttatgggtcatgcactctgttgcaactattcaattctgctgctgtaactagaaagcacccatgga

SEQ ID NO: 6856676 - DNA, 56 bp, Homo sapiens
gtgtgtatctcttgttggcatgaatatgtctgtttgtacaacaagtagagacatac

SEQ ID NO: 6856677 - DNA, 56 bp, Homo sapiens
gcagctgtaaagcagaaatagtaataactatttcacagctttattagcaaaagtgc

SEQ ID NO: 6856678 - DNA, 129 bp, Homo sapiens
ggacacatggggcactaaaatgccaagctagcagagaacagcattgcagctttggatttgtctaatctcacagtggctttgctggtctcgtgtttttcttgccagtccttttatgcccttggtgattct

SEQ ID NO: 6856679 - DNA, 103 bp, Homo sapiens
tctttaaataacatcactgcagttccagttccagtttcagttactttcatttctggaggtaactggctaactgaacgaggaaatgttattgttaccctacaga

SEQ ID NO: 6856680 - DNA, 101 bp, Homo sapiens
acaggacagaaagataattctcttatgaaaagacagttaatttgcattttatgtgaatattttaagtgttgttttcaagagataggtttcttctgtcttgt

SEQ ID NO: 6856681 - DNA, 87 bp, Homo sapiens
tggaaatgaacacaaaataccatctaatgcttactttggggaacgggaagagagcctcaaacagagagatgtatgtggaggtttcta

SEQ ID NO: 6856682 - DNA, 84 bp, Homo sapiens
cataactgcagtttcttttcaggatgacaccatgtccagcttaaaatgtgtagctggatgttttaagtctcctttgcagctatg

SEQ ID NO: 6856683 - DNA, 61 bp, Homo sapiens
gagagatccagactgtgggtgacacatgcaaatgcccagttgccacatacgctggactctt

SEQ ID NO: 6856684 - DNA, 65 bp, Homo sapiens
ggcttcttgattagtgtagtcttctctcctgctactcctgaggacactaacatttgcaaggggct

SEQ ID NO: 6856685 - DNA, 86 bp, Homo sapiens
tacctgagagaggactacaaatactgttttattccatgatcaatcagctgagtgtagaaagaaatatattacctcttcctcaggta

SEQ ID NO: 6856686 - DNA, 77 bp, Homo sapiens
gctgtcagtcacatgctgtgggatctgtattgtgtattctggtcacaacacattcctgcagacatgatgcttgcagc

SEQ ID NO: 6856687 - DNA, 63 bp, Homo sapiens
gaggcagcatctatggtgggaaaacacacatgatcagccagtctcaccagttgattctgcctt

SEQ ID NO: 6856688 - DNA, 75 bp, Homo sapiens
aagggagatgctgtttaagtggaatttgtttttagaaaacaggtcagaaacaagagcttacatggctgctctctt

SEQ ID NO: 6856689 - DNA, 57 bp, Homo sapiens
agagatcccaggaggccttccagtgaaactctatcatcatgcaatcttgggatttct

SEQ ID NO: 6856690 - DNA, 65 bp, Homo sapiens
cccaggtggtcaggcaaggacacgcggtcattctgcctcctgcgtcttgtcctcgggcgcctggg

SEQ ID NO: 6856691 - DNA, 57 bp, Homo sapiens
cctcccttcccggcatggctctctggacccaggcaggaagctgctgattggtggagg

SEQ ID NO: 6856692 - DNA, 74 bp, Homo sapiens
gcattaatttttgctcagctaggctgaagaagacaaaatttgtgtccctcaagccttaagtgagtcatcaatgc

SEQ ID NO: 6856693 - DNA, 63 bp, Homo sapiens
attttcctggtagtaagatgaccctattgttatgtacattcaggtcttctattcccagaaagt

SEQ ID NO: 6856694 - DNA, 75 bp, Homo sapiens
gtatgcagacttgtacttcatgggacagagagctgcttctgggtttgtactctgctcagaaggtgtatgctttat

SEQ ID NO: 6856695 - DNA, 59 bp, Homo sapiens
aacacataggcagagcatgacaacacagagtaacctgagtagagtgctacctgggtgtt

SEQ ID NO: 6856696 - DNA, 82 bp, Homo sapiens
gtttatctgcagatctgcaggtgagggccctggaagcatgaactgtggccaggggagttcccctccactgcactcagaatac

SEQ ID NO: 6856697 - DNA, 62 bp, Homo sapiens
agagggctcattcatctgggcttggctttgccttggctgagccagagggagtcgggtcacct

SEQ ID NO: 6856698 - DNA, 70 bp, Homo sapiens
tatgtattgcttcataattgttgccaaagcttctcctaggagtttggtgcaaggcaatgaagaataaata

SEQ ID NO: 6856699 - DNA, 80 bp, Homo sapiens
gtccttgcagttaaaaatcattagtttcagttgcaatacaaatttaggcaagggctgatgatatttgcactgtaatggat

SEQ ID NO: 6856700 - DNA, 77 bp, Homo sapiens
atttccctttagctaaattagcctatattggaaactgagacactataaacctataggttcacttagctgtgggaaat

SEQ ID NO: 6856701 - DNA, 70 bp, Homo sapiens
tgtctgcacctctcgggtcatgatttccatcatcttcttccggatttggcggacccgttggtgctgggca

SEQ ID NO: 6856702 - DNA, 62 bp, Homo sapiens
ttgggggtgggaattatcatgctccagtacagagtggatggatgaatgatttctactcttaa

SEQ ID NO: 6856703 - DNA, 70 bp, Homo sapiens
attgatatctaccgccattgatatctatctttcattggatatacatcctcagtgttggtcaagaatcagt

SEQ ID NO: 6856704 - DNA, 101 bp, Homo sapiens
tgcagacgtggcctctgctcttagagagttgttgatcaggaggtagcagataggtaggtaatctgaggacatttttttcagcagcataggcaaaaattgta

SEQ ID NO: 6856705 - DNA, 83 bp, Homo sapiens
ctaaggccttgaagaaaaattgcatgtctgcttctcctcctctccgcaagaagaaagcattagacaggcattcaagtccttag

SEQ ID NO: 6856706 - DNA, 78 bp, Homo sapiens
tgaaactcactgcagccttttcctctgtatgcgtgagatttattatcagctcattttgatggaaatgcagtgacttca

SEQ ID NO: 6856707 - DNA, 62 bp, Homo sapiens
cccgtgttcctgctcagagctggcacaaccgaccaaggcagaagctctgagaggggcatggg

SEQ ID NO: 6856708 - DNA, 76 bp, Homo sapiens
agcttagttctgtgtttctgcagcagaaatactgcctggtaagtgagtattctgtatggggaaactagaggaggct

SEQ ID NO: 6856709 - DNA, 69 bp, Homo sapiens
ttgagataattcagcacagaggaaccagtacaggtctctgatagctgtaccaagtgctgattaactcaa

SEQ ID NO: 6856710 - DNA, 93 bp, Homo sapiens
gttaacaaaaatgcactttgagtagagtagatgagaaagcatctgtaatgcttcttgctcaatgtctgtttaaggtgttcagtaaatgtttgc

SEQ ID NO: 6856711 - DNA, 77 bp, Homo sapiens
gcaagtgagccagggccatgaggcacagggtcacaactaaaccagtggaccaaggccagcatggctcgggccacagc

SEQ ID NO: 6856712 - DNA, 56 bp, Homo sapiens
gcaattgtatttatccccaggcagggactccattgccagggccctgtgtgcaatgc

SEQ ID NO: 6856713 - DNA, 60 bp, Homo sapiens
ttatcagttccaattccaaattccaaggagaatccgattggctcaaattggaatagatga

SEQ ID NO: 6856714 - DNA, 59 bp, Homo sapiens
ttttaatgtgctctgcaatgattgaactgttctcaggagatcatttttgcacatcaaaa

SEQ ID NO: 6856715 - DNA, 80 bp, Homo sapiens
tcagttaaagttcttacagaaaatagataacatttaaaaatattaagtgatgtttggatttgctgagatctttgacctga

SEQ ID NO: 6856716 - DNA, 87 bp, Homo sapiens
ctaagaaactgatcagacattattttcaagataatcgtgggcagcaccttgctcttgaaaattgatgctggctcacaagttttctag

SEQ ID NO: 6856717 - DNA, 62 bp, Homo sapiens
cagcagctttggagtgtgagtgctgtctctttggagagattgtgggctccttgagggctctg

SEQ ID NO: 6856718 - DNA, 65 bp, Homo sapiens
tgccaaaacaggagttgaccaagtacagtccataagccagactctgccctctgcctgtttttgta

SEQ ID NO: 6856719 - DNA, 120 bp, Homo sapiens
actgaggcctatttttgacttctgatctccagaactgtacgataataaatttgtgttgatgtaagccactaagtttatgacagtttatagtagcaataggaaatcaatataggtaatagt

SEQ ID NO: 6856720 - DNA, 106 bp, Homo sapiens
ttaagcagtgcattgtgaataactttctatgttaatacacatatttcctgaatatcatttttaatagttaacataggagtttgttgtatggttgtacattgtttaa

SEQ ID NO: 6856721 - DNA, 68 bp, Homo sapiens
tgcagactgtacctggaagagggcctgatctcgggaaagacagttttcttcagccaaggtaatctgca

SEQ ID NO: 6856722 - DNA, 60 bp, Homo sapiens
gaaacaggccaggttccaggcccacacttcaaagagacaaggtctgctttggactgtttt

SEQ ID NO: 6856723 - DNA, 72 bp, Homo sapiens
cctgctggccaggcccagcccttagccaggtgctttttcagggaccaagtagagctggggcctgaccacagg

SEQ ID NO: 6856724 - DNA, 93 bp, Homo sapiens
gtaaaagcaacagtacctaacctgtaagttgataattaagtggcatgacacgttaaacatttagcatagtacctgtaacatgttagcttttat

SEQ ID NO: 6856725 - DNA, 60 bp, Homo sapiens
gctgggctcagctgggcgtgctggtgtatggagcataaggtatggacagccgagcatggc

SEQ ID NO: 6856726 - DNA, 62 bp, Homo sapiens
aaagtcccttgtgccatgtaagatgatttatgcacaggttctggcatttgtacagggacttt

SEQ ID NO: 6856727 - DNA, 76 bp, Homo sapiens
gtgtttgcaggggctggctctgtttctggctttgcctattggcttcatcctaaacaggctatttctttacaaacac

SEQ ID NO: 6856728 - DNA, 81 bp, Homo sapiens
ctgggtctccggttctgccgcctcctgtccctccttccggctgccccggccagaggggctcgaaggcgcgttggggcccgg

SEQ ID NO: 6856729 - DNA, 60 bp, Homo sapiens
gaggccaaagctctgctcctgctccttagggtgggagacatattccagagctggggcttc

SEQ ID NO: 6856730 - DNA, 61 bp, Homo sapiens
ctgtctccggccgccctggtgctgcctgtgtccatgagcggtgctggggggtcgggggcag

SEQ ID NO: 6856731 - DNA, 84 bp, Homo sapiens
tgtcttaaatgaaaacatgagcatatgggaggagtacttgtttcaagtttctgctctggttgttttattcaaattcatttgaca

SEQ ID NO: 6856732 - DNA, 68 bp, Homo sapiens
tgcggctgtggcatttggaaagagcactagagtaactgggtctggccaaaggttattctctggccgta

SEQ ID NO: 6856733 - DNA, 73 bp, Homo sapiens
tagatattcttatccttttctctgtagaccagatgggctagctgggtaaatagtaagagtgatggattatctg

SEQ ID NO: 6856734 - DNA, 82 bp, Homo sapiens
gggttttgatattgtaggcatattaaggctagccagcttaattggctcctgcatttgtgctaacaactattagtctttaccc

SEQ ID NO: 6856735 - DNA, 56 bp, Homo sapiens
ttggctcccactaactccagcagttgcactttgcctggaacacagtaggcagtcaa

SEQ ID NO: 6856736 - DNA, 62 bp, Homo sapiens
ggtcattccagtcagtgtgagtttattgcaattcagtaataatttccagccaactggaaacc

SEQ ID NO: 6856737 - DNA, 73 bp, Homo sapiens
cattgaaactggctagggaaaatgattggatagaaactattattctattcatttatccccagcctacaaaatg

SEQ ID NO: 6856738 - DNA, 86 bp, Homo sapiens
ctgatcttgaactcctgacctcaagtgatccactcaccttggcctcccaaggtagttggatatttgagatcggagttctgagatag

SEQ ID NO: 6856739 - DNA, 60 bp, Homo sapiens
ggccttctgaagcatctaggagaaaatccatctccttgatttttccagcttctagaggcc

SEQ ID NO: 6856740 - DNA, 64 bp, Homo sapiens
aaaccaatgttttaggaagttgaggagcttgctcaaagctacaattgtataaagcaaatggttt

SEQ ID NO: 6856741 - DNA, 129 bp, Homo sapiens
gatgagaatctcctgagggtgtttgttaaatattacaagtttctggcttcatcccagacccattgaataagaagctctaggaggaccaggaacctgtgtttttaataagaggccctgataattcctatc

SEQ ID NO: 6856742 - DNA, 60 bp, Homo sapiens
atttgaggtatggtaaggtaaaatcttttaaaatgaggatgcctttataatgctacaaat

SEQ ID NO: 6856743 - DNA, 91 bp, Homo sapiens
cacatgccagaggggctgacacccttggccacactgaagaatgatcagcagcgccaacagctgggtgcatgtccctctgcacccagatgtg

SEQ ID NO: 6856744 - DNA, 69 bp, Homo sapiens
ggcctccaggttccgcgagaagggtcggtattaaaggattccttggagcggtcagcactggtccgggcc

SEQ ID NO: 6856745 - DNA, 117 bp, Homo sapiens
tccctgacgtgagccccttgaacttccagttgtctccacaggtgtcagctcactaagtgtctggcattttctgagcagctactgtgttcagggactgggacaaggcacgtgtaggga

SEQ ID NO: 6856746 - DNA, 63 bp, Homo sapiens
aaacatggagagttctcaggtgaatcctttgtatagccaccttgggcccagctctgtctgttt

SEQ ID NO: 6856747 - DNA, 67 bp, Homo sapiens
aaatgacagagtaagctgtttaaagtcaaactcacgtcccagctatgcagcttgctttgggacattt

SEQ ID NO: 6856748 - DNA, 67 bp, Homo sapiens
cttttaatgaggtaaaggacaatgttttgataagtattaatgcacatttattttacctttctgagag

SEQ ID NO: 6856749 - DNA, 61 bp, Homo sapiens
ggcctgaggccctgccctttctggccacttgcagggctcagcacagggcccagcctaggcc

SEQ ID NO: 6856750 - DNA, 57 bp, Homo sapiens
caggtctgcagacagggccatggggtttggtctctgccctgccctggggccggcctg

SEQ ID NO: 6856751 - DNA, 83 bp, Homo sapiens
tgagatgcatcctcctctgaatgctgttgaagaaggatcccacctcataccctgttcagcaagttcaggggcccaacatccca

SEQ ID NO: 6856752 - DNA, 63 bp, Homo sapiens
agagaccattatgtataatcacagagtgtcacaggcatgacatgaatgattatgcaaaactct

SEQ ID NO: 6856753 - DNA, 61 bp, Homo sapiens
gggggaaaaacacctgggactctgggacacaggacctaggcaaatccagatttttccaccc

SEQ ID NO: 6856754 - DNA, 68 bp, Homo sapiens
ttgttttgagatggagtcttgctctgtcatccacgctggagtagtggcgagatctccactcactgcaa

SEQ ID NO: 6856755 - DNA, 63 bp, Homo sapiens
gcaggggagaggcggcccagagctttgtctggcctggaccagcctccgccttcactcccctgc

SEQ ID NO: 6856756 - DNA, 65 bp, Homo sapiens
actctgccctaggcctctggggctccactgagaaactgagatttcactgaggtcaggggtagggt

SEQ ID NO: 6856757 - DNA, 59 bp, Homo sapiens
tgctgcagtgggattagcctgaagaatccttctatgtccccgttattctctctgcagta

SEQ ID NO: 6856758 - DNA, 110 bp, Homo sapiens
cttggctgggttattaatagaatttgaagtttatttcaatctattcatctgaaaaaaggtgagaggatggaaattaattagaattctcagtttataaaaccagttccaag

SEQ ID NO: 6856759 - DNA, 90 bp, Homo sapiens
cctccaaatgtttagcaataggagggaaggaggtgggtggtgtcaggctgatttacatattgtctattgttcaagtgctacatgaggagg

SEQ ID NO: 6856760 - DNA, 59 bp, Homo sapiens
gggcctgtgctgaacgggtctttccgatctctttctagaaacgcctttagcacaacccc

SEQ ID NO: 6856761 - DNA, 55 bp, Homo sapiens
atatatgcatatttataagatacatgatatacgtattatatagatgtgtgtgtat

SEQ ID NO: 6856762 - DNA, 62 bp, Homo sapiens
gcacccggaagcacaggcttgaggacgatgagcagcagagcatctccagcgtgctccagggc

SEQ ID NO: 6856763 - DNA, 93 bp, Homo sapiens
ggccaggatggtctcgatcccccgaccttgtgatccatccaccttggcctcccaaagtgttgggattacaggtgtgagccaccgtgcctggcc

SEQ ID NO: 6856764 - DNA, 75 bp, Homo sapiens
gaagggtaacagaaatagaaatgagagtccgacaagagaaaaggactctgttactgggatctggggccacccttc

SEQ ID NO: 6856765 - DNA, 123 bp, Homo sapiens
ttctccaaaatcttcagaaactctcatttttgtatcagaaatcaacacacagtggtgagtgagcaccaactatgcaatcgttctaggtgcaggagatgggaaaatattcttgaagtgagagaa

SEQ ID NO: 6856766 - DNA, 121 bp, Homo sapiens
gcaaaaactggaaaaagatttttaacagaaagtcagagatgccaaagattaccttcctttttattcaggtaaactggtaggcatcatttgattaatggagaatattaaattcattttgagc

SEQ ID NO: 6856767 - DNA, 69 bp, Homo sapiens
gggaaatgaactgtaagtggtgaaattagttttggtatttaatttaaaactacatttatagtttttctc

SEQ ID NO: 6856768 - DNA, 130 bp, Homo sapiens
gaggggcgtccggggcgcggacctcggccgcggggagtcttggctgccgccgtctccatcgcgccgcgcgcgtaaaggaaatggcgcgtctagccgcgagcggtcggcccggtgccccagcgcgtccctc

SEQ ID NO: 6856769 - DNA, 56 bp, Homo sapiens
ggagggagggctagaccaaagacagcagccaaagtctgggctcctgccctctgtcc

SEQ ID NO: 6856770 - DNA, 86 bp, Homo sapiens
ggctatgctgtcagaaacataaggaacctgggcttaagagaatggctctgcctctcccatgtcaaggttgcttttggctgcacgct

SEQ ID NO: 6856771 - DNA, 84 bp, Homo sapiens
cacgagcctcctgtaaatgaggtgctactgttttcccatgtccatttccaagacaaggacatagaggccctgcatggctcagtg

SEQ ID NO: 6856772 - DNA, 58 bp, Homo sapiens
ggcagggacgcagcactctccgtcacatgctgtgtgacgtgcagtggagtgtcccgcc

SEQ ID NO: 6856773 - DNA, 62 bp, Homo sapiens
cttgtttcctcaaagttgtataaatatttgatcacaaattatactgtattttggggcacaag

SEQ ID NO: 6856774 - DNA, 76 bp, Homo sapiens
ttcttactgtatatagtttaggttcgaatgggatcaccataggtgtgcttatgaccttaactgtaacagcgatgaa

SEQ ID NO: 6856775 - DNA, 71 bp, Homo sapiens
tggaggcagggctgagggtgggcgggcagatttattgcagccattcctctcccctgcagcgcctgcttcta

SEQ ID NO: 6856776 - DNA, 58 bp, Homo sapiens
gagccagggtctctcgctctgttgcgcaggctggagtgcaatggcatgatcgtggctc

SEQ ID NO: 6856777 - DNA, 55 bp, Homo sapiens
tctcattcaatcttgatagcttaaagttgccattaagctaagaggaaaagtgaga

SEQ ID NO: 6856778 - DNA, 72 bp, Homo sapiens
agtgcctgcctcataggcttatcgtgggcttaaatgagtcaacatgtataagcgctaggagtgcctggcact

SEQ ID NO: 6856779 - DNA, 56 bp, Homo sapiens
gcctgtatctatgcaaaactgttattattcagagactagtttatgcagatactggt

SEQ ID NO: 6856780 - DNA, 61 bp, Homo sapiens
ttccttagggaaagggataaggcatagccagatatgggagtgagatcccttctctgatgag

SEQ ID NO: 6856781 - DNA, 79 bp, Homo sapiens
gcccctgagtcaagtccagtgaggctgaatggccactcatcctgcattaatctcagccagggctctggcctcagtgggt

SEQ ID NO: 6856782 - DNA, 56 bp, Homo sapiens
cgtggtaagtagcctatggcgtcctctcacccagggctttggcaggccttgccacg

SEQ ID NO: 6856783 - DNA, 113 bp, Homo sapiens
tcccacttgtactgacctgttttctggcccatctgtggtcttggcagtatcccctgctttactgtctcaggtctgccagcaccataaattagggagcttagtgctcaagggga

SEQ ID NO: 6856784 - DNA, 75 bp, Homo sapiens
gtcctgaatgcaaagtgaggtgagtggcctttgcaaatgccagctggaaatgctgctctgctgtgtaagcaggac

SEQ ID NO: 6856785 - DNA, 79 bp, Homo sapiens
tgattgtcattccttgatgaattaaagctagagttgcccacctgtgtttcttgctagaatcatttggagagatttatca

SEQ ID NO: 6856786 - DNA, 71 bp, Homo sapiens
ttgcctcttatgtccatgctcttaattagacacattagtaggttattaacatgagttggagataggggtag

SEQ ID NO: 6856787 - DNA, 79 bp, Homo sapiens
accacaggcaccagagggagtttctgaggttgcagaggtgactgagcaatatcttccaagctccctggtgtattctggt

SEQ ID NO: 6856788 - DNA, 97 bp, Homo sapiens
ccagtctctatgtgagggtctctccagcctttagcccacgcgtctctccctcccggtggcctcagcaaggctggcagggtctctcagtgggaactgg

SEQ ID NO: 6856789 - DNA, 68 bp, Homo sapiens
ttgtgtctttggcgtccctggggcttgcctgcaaggaggcaggtgttgggagacaccatggggcagag

SEQ ID NO: 6856790 - DNA, 68 bp, Homo sapiens
tcagctccacttgagtggggcctggaagatatacagaactctgacagccatattaaggatggggctga

SEQ ID NO: 6856791 - DNA, 83 bp, Homo sapiens
atctgtgtcagaccccggcagtaaaactttatgggttcttccccgtgaaatattttgtttatgtcacgtgggtctcatcggat

SEQ ID NO: 6856792 - DNA, 58 bp, Homo sapiens
caaatacgtgcacatacatacatgcatacgtgtgtatgtatgtgtgtgtatgtgtatg

SEQ ID NO: 6856793 - DNA, 60 bp, Homo sapiens
tgttggctattcctatatgagatgatgaaacttattattatatagggaaagtcccagacg

SEQ ID NO: 6856794 - DNA, 63 bp, Homo sapiens
tcttttgtgactcttgggtctgtgaccattgctggctacacaatgttgccccaggacaaagga

SEQ ID NO: 6856795 - DNA, 72 bp, Homo sapiens
tcgtttctccataccagcttcagacacaccttgggtttaaaaaggtggttgtaggctggtctgagagcccga

SEQ ID NO: 6856796 - DNA, 57 bp, Homo sapiens
ggcaggcaggagcgtgcttgggaccactgctggctccagacactgccttgctgtgct

SEQ ID NO: 6856797 - DNA, 86 bp, Homo sapiens
gacagggagatgagacaggtgtataatcgggcctcaagaatgctctttggatctggagtcctgcatttgctcttagatcatttgtc

SEQ ID NO: 6856798 - DNA, 85 bp, Homo sapiens
ctgggagtggttgtggctacagactggaggcccctcatctgcgaggtgagaggctagatcagctctgtgctggagccccgtccag

SEQ ID NO: 6856799 - DNA, 65 bp, Homo sapiens
catgggtgggatggggtcaacatgtacctggagagactagaagcatagtccccttcccaaaggtg

SEQ ID NO: 6856800 - DNA, 129 bp, Homo sapiens
tcaaccaccaccctcttaagctgagctagtagaacaagtgaggatctgcctgtaattactgcttaattcatttgcatgtggatgttctcattataatgtcattagcatggggagggagtctggttgcca

SEQ ID NO: 6856801 - DNA, 102 bp, Homo sapiens
atcataaagcaaagttgcagggcagtgctaagtagctggcccagtaggccctgtcctacttgagccagctccttgcctgtcagtaatgaccagcttagtgat

SEQ ID NO: 6856802 - DNA, 58 bp, Homo sapiens
tgtccagagtcacagagctcaaagaaattacagaatctttctcctgtgaattctggca

SEQ ID NO: 6856803 - DNA, 65 bp, Homo sapiens
ttctactcacatttcatcaggccaagaaaatcatgtggtcaagcctgatatcagtgtgacaggag

SEQ ID NO: 6856804 - DNA, 128 bp, Homo sapiens
acagtgtatatcaatttcaaggcacagggaggaaacatccattttgttcaaaagcatcagactttgtggattctgtttggatgcagcagaagtgttcttctctttcaaaagtattagaaacgcattgt

SEQ ID NO: 6856805 - DNA, 57 bp, Homo sapiens
gtgaggctggctgacttctgaagcatcgaattgtgcattggaaactcagcagcacac

SEQ ID NO: 6856806 - DNA, 102 bp, Homo sapiens
ttctggggtaatgagttccataagtttatctttgctgggtactgtaaattcctgtttaccaagggacccacagaaataaacagaatactcggatgaccagaa

SEQ ID NO: 6856807 - DNA, 83 bp, Homo sapiens
gtctgaagaggccacaaaggcttttgttcctatttagtctcttcgaaactaggtgccacaaaggcttttgttcctatttagtc

SEQ ID NO: 6856808 - DNA, 57 bp, Homo sapiens
gtttatacacaagactatatgtgtgtgcatgtgtgtatacagtgtctgtatataaat

SEQ ID NO: 6856809 - DNA, 70 bp, Homo sapiens
ggagccgggacgagccccaggctggaggcgggaccagccgctgccgtctccgtctcggtgtcccggcccc

SEQ ID NO: 6856810 - DNA, 71 bp, Homo sapiens
tataattccatttatataaaatgtccagaacaggcaagcctgtagagacagaaagtagaatggtagtagta

SEQ ID NO: 6856811 - DNA, 64 bp, Homo sapiens
cctgcaataaagaggatgtatttacagcatgagagcagagctggtgcctgtttcttttcgcagg

SEQ ID NO: 6856812 - DNA, 99 bp, Homo sapiens
gagaaaaattaagttggtacccacattgtctgagatgtgtttcagaggacaattactttccagagcagttttcagatcaaaatggtatcatgttttctc

SEQ ID NO: 6856813 - DNA, 56 bp, Homo sapiens
agaggtgaatgtggcttgtgtggaacctcacacacatttggccaaaaattatttct

SEQ ID NO: 6856814 - DNA, 69 bp, Homo sapiens
atgtgttcatgtttttccctttgaagactgcctgggaaaggctaacagtcatggaagtaacaaacatat

SEQ ID NO: 6856815 - DNA, 64 bp, Homo sapiens
atggttgttacttggtgtctctggctgcattttgtttgtcgctgctggttccgtgactgtccat

SEQ ID NO: 6856816 - DNA, 59 bp, Homo sapiens
cacgtgcaggtcttaggagacaaaggaagggaagtgactgtttcctggcctggtgtgtg

SEQ ID NO: 6856817 - DNA, 63 bp, Homo sapiens
gatcagagtggctagagccttgtgacttttctcttactttctgctcttgagcttctctgtgtc

SEQ ID NO: 6856818 - DNA, 59 bp, Homo sapiens
tatggcttttaactgtcgtatgcaaggaattcccttatctgacagtaggcagagccatg

SEQ ID NO: 6856819 - DNA, 62 bp, Homo sapiens
atgtatcaactgcaggcaagttcaggtaaagttctccatttgctttttcagttgacttacat

SEQ ID NO: 6856820 - DNA, 75 bp, Homo sapiens
ggtctcttttgaatgctagtgtgatatgtaagggcctgatttctgccttaatttcactggtgtttctttggggct

SEQ ID NO: 6856821 - DNA, 70 bp, Homo sapiens
cttctatttcagggagaataaatttgctgcaatctatgggcagctagttaattgaaacctgaggaagggg

SEQ ID NO: 6856822 - DNA, 86 bp, Homo sapiens
gatgctatttttgaggtgcagcttaaaggctgccttgtggcccctacataatctgctgccactctgagcttgcttcaaaatagatc

SEQ ID NO: 6856823 - DNA, 86 bp, Homo sapiens
tttgtgccatgctgagtggttatagcttatccaggaaactaaagtttccaagaatacagatttgtgaacacacaggtatgcataaa

SEQ ID NO: 6856824 - DNA, 64 bp, Homo sapiens
gggtcatgaacagtttccctgtagaaaatggacctgaacactctgcagtaaggaattgtttccc

SEQ ID NO: 6856825 - DNA, 120 bp, Homo sapiens
gggataggtgtaggaggtaggcccttccttgatgattttcccaggatagaccatcatccctctgggtgaaggtgaatgtctatggggaaggcctccaggaaccaccctctacatgttccc

SEQ ID NO: 6856826 - DNA, 123 bp, Homo sapiens
ctgtacagtgtagtatgctcctttaggcaggttgttacagtgcatgtggcttctgtagcacccagttccagcagtgcccagtggccaacagtgtgtagcaccttccacggacaacttctccag

SEQ ID NO: 6856827 - DNA, 68 bp, Homo sapiens
attatgttttcccctgcagtggaataattttaaaattccaattgcttttccaagggcagaatattaat

SEQ ID NO: 6856828 - DNA, 58 bp, Homo sapiens
gccgggtacatatcaaggctttattaacatttaattaagcatttattatgtgccaggc

SEQ ID NO: 6856829 - DNA, 56 bp, Homo sapiens
gttgcggtggctggctggcactgtccccaggggcagtgccagctccacacagcagc

SEQ ID NO: 6856830 - DNA, 65 bp, Homo sapiens
ctagactgtaaattacataagaacaggaacaatgtgtttgctcactatgaatttgcagtgcctag

SEQ ID NO: 6856831 - DNA, 81 bp, Homo sapiens
ggcaggccctgtgctataggttagggctaaccatgttatcatcattctaaccaagcagtccctgacctcacagagcttacc

SEQ ID NO: 6856832 - DNA, 79 bp, Homo sapiens
tcagagtaatttgagaaagatggaatcttacaggctgtactgtctgttcatgaaatatctttttgaagttgaactctga

SEQ ID NO: 6856833 - DNA, 72 bp, Homo sapiens
cagacctgggcatgtgtcctgctgtgtcacacaggtgctctgtgaccttgagcaagacactggtcctctctg

SEQ ID NO: 6856834 - DNA, 58 bp, Homo sapiens
ttactgagtgtccactatgagccaaacattgtgctggctacggggaacacattagtga

SEQ ID NO: 6856835 - DNA, 64 bp, Homo sapiens
cttccagctgcagtgctgcctcctgaaagtgatcacaatttagaagcatcacctgttctgggag

SEQ ID NO: 6856836 - DNA, 57 bp, Homo sapiens
gcagggggctctccaggttctctccttgggttctgggcctgatgtgggatcctctgc

SEQ ID NO: 6856837 - DNA, 93 bp, Homo sapiens
tgcccacaccaatgcatataataggtactattatatctaaatcactgtttttagagagcagtgtagtgtacctataatggtagtaactgggca

SEQ ID NO: 6856838 - DNA, 67 bp, Homo sapiens
gacttatctttgatgccagatgttacttatgaagcaatgagtgatctgtcttaatcatagattagtc

SEQ ID NO: 6856839 - DNA, 73 bp, Homo sapiens
gtagcttattgtataaggtgatttatgatacataaaacatcactgtgcatttgttaccttattgcagacttac

SEQ ID NO: 6856840 - DNA, 64 bp, Homo sapiens
ttggggtagaaatgaaagagctatagaaatgtagcacactcataatctttcatttctgccctgg

SEQ ID NO: 6856841 - DNA, 67 bp, Homo sapiens
cagtaggcagaagtggcattcggagtgggaatagtagacatgactggtggccttttcatgtttcctg

SEQ ID NO: 6856842 - DNA, 61 bp, Homo sapiens
gggctgtgcctcaggtggggtccacatagtctggtgtggtcatctctcctgggccagcgcc

SEQ ID NO: 6856843 - DNA, 76 bp, Homo sapiens
caggtcagcgtgtggagaactaagcagacctgttcttcattaactgcggctctctggggatgtcacacactacctg

SEQ ID NO: 6856844 - DNA, 83 bp, Homo sapiens
agtaagttaaaattagcagggactttggcaacaggtgtttgtttagatgcgtgtttatgaaaatccttgctgatcttcttgct

SEQ ID NO: 6856845 - DNA, 55 bp, Homo sapiens
aatatttatcaaaagtgaactgcatttctgtatgtgttcactgagcttaaatgtt

SEQ ID NO: 6856846 - DNA, 77 bp, Homo sapiens
agcttatattctagtgatgccatgaagattaatgtgccatccagctataattacaaaggtatcatgtgaatgaggct

SEQ ID NO: 6856847 - DNA, 55 bp, Homo sapiens
gcaggtgggagccgctgcctgattctagctacaacagacataggttcctccttgt

SEQ ID NO: 6856848 - DNA, 55 bp, Homo sapiens
cttcgattgtctatggcccatagggctctgccaaatgggtccctgcagtttgaag

SEQ ID NO: 6856849 - DNA, 92 bp, Homo sapiens
caaatgaatgagtcagacttgactttgtaagtttttacatgcttatataatgtgaaaattatctccttaaggactagacttataaatatttg

SEQ ID NO: 6856850 - DNA, 78 bp, Homo sapiens
ctgccacttcaggaagtgacccaatgatggccaaagctttactgaggcccccagctgcatacttgccaagaggggcag

SEQ ID NO: 6856851 - DNA, 85 bp, Homo sapiens
gaattagtgacaggaatgtgtggatgcggaagtagagggcaaaaccattaaagtctactttcactcatacttattcattatattt

SEQ ID NO: 6856852 - DNA, 129 bp, Homo sapiens
aagagatatggccaggagacacattccacctgaagactgagagggaggctgtccggtaccatgtaacagttgcgtcagactgggacacttcctttttacagaggactataaaacccctgccctgtcctt

SEQ ID NO: 6856853 - DNA, 78 bp, Homo sapiens
ggggttaagaaacttgcctgaagtcaaccagctattaatgagcagagctgggatttcaagctaagtgaatttgatttc

SEQ ID NO: 6856854 - DNA, 81 bp, Homo sapiens
ggtatagaacaaaagaatgtgtgattgaagctcttgaagagatttatttcaggagagaggcaaacattttgctctgatacc

SEQ ID NO: 6856855 - DNA, 69 bp, Homo sapiens
gtcatcctcccagtatttacattgtgagcctggatggttagtcattgtcttacatactgtggaggatgc

SEQ ID NO: 6856856 - DNA, 80 bp, Homo sapiens
gggctgcctttccaggagagcctgtgcagccgggttctgccctcgttcggggaactctgccaggtttcaggagccagctc

SEQ ID NO: 6856857 - DNA, 74 bp, Homo sapiens
gtgcagttacacagctggtgtcaggcactgcagtgtaggtacacggctggtgtcgggcacagcaatgcaggtac

SEQ ID NO: 6856858 - DNA, 64 bp, Homo sapiens
tataagtagaaagagttgggaggaattttagttgggtttcattcttctaaactctatactggta

SEQ ID NO: 6856859 - DNA, 76 bp, Homo sapiens
aaattaagccgtatttcttgagtggtcagtttctaaaatagtagaagagaagcatcaataggtaatgggttaattt

SEQ ID NO: 6856860 - DNA, 56 bp, Homo sapiens
tgtctttgtgtacaggatcgccatgggagtggtaaacataggtcttgaacaaagca

SEQ ID NO: 6856861 - DNA, 59 bp, Homo sapiens
cctggtattcatctttacctcaccctctaagtaaaattgaggtaaaagtgagcttcagg

SEQ ID NO: 6856862 - DNA, 68 bp, Homo sapiens
tttaattagcaagccagagagctaacaattatctcacctgtcagctctcttgacagcttgctgttgaa

SEQ ID NO: 6856863 - DNA, 106 bp, Homo sapiens
gaatccgaaacccggggtgggacacagccatctgtgttttaacaaccccctttaaggctcgttaaagcacagatggctgcgtcccacccaaggtttcatgtgattc

SEQ ID NO: 6856864 - DNA, 89 bp, Homo sapiens
gggacatggtgtgtgcgcttcttcctgagccaggttgaggttgggaccactgatccattggaagcctggtgaggggtacagccagttct

SEQ ID NO: 6856865 - DNA, 60 bp, Homo sapiens
gttgccaatgtctttagcaaatggtgagatatattccaagaaactgaagataatggcaac

SEQ ID NO: 6856866 - DNA, 74 bp, Homo sapiens
tggttgatggccgtggccagggtcagggatgagcgttccacagacccatgactctcattcacagtcttcagcca

SEQ ID NO: 6856867 - DNA, 73 bp, Homo sapiens
ggcttctttttcatgtaggtctttacacgagatgtagagaagtctccaggactataggaaagacacacaagcc

SEQ ID NO: 6856868 - DNA, 76 bp, Homo sapiens
gttttagttattgcattatcatttcaggtgtgcatcacaaatttaacattttaatgagatggcaatgacttaaaat

SEQ ID NO: 6856869 - DNA, 72 bp, Homo sapiens
tcccagatctttgtttctcctgtcatttctgatcactcgagattaaaaacagcaatggagaagccaggagga

SEQ ID NO: 6856870 - DNA, 61 bp, Homo sapiens
gctttgggaaattcatcttcataaagcttgatttttaattgaagcaaatttttctcagagt

SEQ ID NO: 6856871 - DNA, 110 bp, Homo sapiens
gatagcttttgcaaaatttacatacccagcagcctccccatcagctgaataagaattgcaatgtggatgtggcagaggcaatcaggtatgtggggttagaagaagctgtc

SEQ ID NO: 6856872 - DNA, 65 bp, Homo sapiens
ctttttttcccacattcatatttgactgcgcattatgtgaaaaattgaatttgggaaacattgag

SEQ ID NO: 6856873 - DNA, 55 bp, Homo sapiens
accctttgggttccccaagcctgcctgcctggtccttgggcctgcccagagtggt

SEQ ID NO: 6856874 - DNA, 128 bp, Homo sapiens
gtttgttctaaaagtgataagatctataatagttttgaatcaactttgccttcagtgctttccaaggagagagattactgaaaaagtatgattcactgtaatgatccattgtcatgagtggaattaac

SEQ ID NO: 6856875 - DNA, 77 bp, Homo sapiens
tctaggaagttctttagttttcatcaaatctattcctcctttatacaagtgagaaaactgaagatcagcaagctaga

SEQ ID NO: 6856876 - DNA, 55 bp, Homo sapiens
gtgtgggctatgtgcgtgggcatgtatgaatgcatgtgtatgtccaatgccctac

SEQ ID NO: 6856877 - DNA, 92 bp, Homo sapiens
tcctgggtagctgcggtgatttcgtactgtgaagtgcacatgtgtactccatacagccctcacaatgaaaaacactacatattatccagtga

SEQ ID NO: 6856878 - DNA, 91 bp, Homo sapiens
tctgctgctgcagctgtagaggacagtggccacttgtctcctggaaccaccattgtgcttcaatagctaccacagaatgagcatcagcaga

SEQ ID NO: 6856879 - DNA, 60 bp, Homo sapiens
ctctctctggtacatagagtttggtccagggaccaagctctataccagagaaaccctgag

SEQ ID NO: 6856880 - DNA, 65 bp, Homo sapiens
cacgggattcttttgcctagggctgaaaagatgtgtctgctagccaagtagggggaaagcccgtg

SEQ ID NO: 6856881 - DNA, 68 bp, Homo sapiens
tatcttctgggcagtgaaaattggattgagaacagtgaatatcaacatgattgaactctcagaaggtg

SEQ ID NO: 6856882 - DNA, 56 bp, Homo sapiens
tcctggggccccaggggctaagtctgccttagcatactgcatctgaagtcccagga

SEQ ID NO: 6856883 - DNA, 92 bp, Homo sapiens
ctaaactagtaggattaggattagagcaaggagagttagtgaggaagtgtaactttcactgaatacttgtctcatccagaattctgctgtag

SEQ ID NO: 6856884 - DNA, 63 bp, Homo sapiens
cccagaggtggaagctctgagcagagccactgtggcttctgcatctcaggattcccttcaggg

SEQ ID NO: 6856885 - DNA, 79 bp, Homo sapiens
ctatgtcatcagagagtgaaaaggatatgtcttgtgttagatggaaaaaatgggcatgtcacaattcttaatgggatgg

SEQ ID NO: 6856886 - DNA, 62 bp, Homo sapiens
tcctataatatgaaaagaagtcaccattggggaactagagaccccagaccttttcatatgga

SEQ ID NO: 6856887 - DNA, 69 bp, Homo sapiens
cttcctttcagaggaaggcctgtcctgctggaactggagccaaggggaggctgcctatgaaggcagaag

SEQ ID NO: 6856888 - DNA, 79 bp, Homo sapiens
ctggggacacagagctcacagtctcctggagggggtgagagatgactgacaggtggtctgtggtgcagtgtgacctggg

SEQ ID NO: 6856889 - DNA, 73 bp, Homo sapiens
gaggtagttccttcctctactatgtgaggactcagtgagaaggtgccatccatgaacgaggaagtgggccctc

SEQ ID NO: 6856890 - DNA, 115 bp, Homo sapiens
gtacttctatgcattaagtgctggcagcttctttaaatgtaacccagactactttatgacaggcagtaaaaatatgtgaaggggctgctgtatgcaggtagtccatagtaagtat

SEQ ID NO: 6856891 - DNA, 75 bp, Homo sapiens
gccaagaaaagaaagaggagtgctgcatgttggcagatctcagcttcaaatgcagctgctcattctctcagtctc

SEQ ID NO: 6856892 - DNA, 81 bp, Homo sapiens
ggcacagagaggctgtggcactggtctagtgtcacacagcatgttggcagaggggccacctgcccagcccttcctgaggcc

SEQ ID NO: 6856893 - DNA, 55 bp, Homo sapiens
tccccaggtgtggcattgggaggagcactggcctctccagtgccggcgctgggga

SEQ ID NO: 6856894 - DNA, 60 bp, Homo sapiens
caactgtagggattgagttttccttggccttgaaagcagtagatcgaatccctacagttg

SEQ ID NO: 6856895 - DNA, 110 bp, Homo sapiens
accaggaaaaattctgcatctttaggcagtcattgaacaagtagctttgtgttatttcctttgaattgtccatgaagcctgatgtattattaatgaattaatttcttggt

SEQ ID NO: 6856896 - DNA, 77 bp, Homo sapiens
agggcttttgacatttgttccatgatgtaatagaggatttaaccatcaaattatgtgtcaaagcatattcaggccct

SEQ ID NO: 6856897 - DNA, 74 bp, Homo sapiens
ctcctctggctcagctgtcacttctaagttttgctaagatagcttactttagtactgatagttactagtgtgag

SEQ ID NO: 6856898 - DNA, 91 bp, Homo sapiens
gtgatggggacaagctggcgtggagcggggggcaggcagccttgagcagatcagggctcagttctgcttcatgctgattgaatttatccac

SEQ ID NO: 6856899 - DNA, 59 bp, Homo sapiens
tagattctggagagacagcagtgaattagacataaaaatgtgtgttcttccagaattta

SEQ ID NO: 6856900 - DNA, 76 bp, Homo sapiens
aggttacatagctggtagtggttcagccagatttggaacccaaacagtctgatgccatctgccatgtgcttaacct

SEQ ID NO: 6856901 - DNA, 89 bp, Homo sapiens
agagaaattatacctaagccactagtctgttatgaaggtgctaccttattcatatttgacatgacttatggctgatttaagatttctct

SEQ ID NO: 6856902 - DNA, 65 bp, Homo sapiens
ggcacataagaaatgaatatgagaacagtatgaaagtgaagcagttctctttattcctttgtgcc

SEQ ID NO: 6856903 - DNA, 55 bp, Homo sapiens
tgatggtcatctcctatttggtttggtgtgtgctcagcctcttgggatgacatta

SEQ ID NO: 6856904 - DNA, 63 bp, Homo sapiens
agccagggtggacatttccacaagcttggacaccctccagctcacagtgtccttcctcaagct

SEQ ID NO: 6856905 - DNA, 64 bp, Homo sapiens
ctatccattaaagccttggaaattgctggtaaatatgtaaaaaatcaagtgcttaaatggatag

SEQ ID NO: 6856906 - DNA, 59 bp, Homo sapiens
tctcagttttgtatgttgtaagtctggtaggctcagcttagcatcttacaatgctgagg

SEQ ID NO: 6856907 - DNA, 79 bp, Homo sapiens
gccggtcgtagcggaggtgaggaagtggggcagtcccatcgcagaccccccgtgcccctctgctcacttccctacaggc

SEQ ID NO: 6856908 - DNA, 76 bp, Homo sapiens
ttgtgtctatcttctcagtatatgggatgtggggtgtgtttgtgtatctgtgtctgggaggagtgtgttggtgcgg

SEQ ID NO: 6856909 - DNA, 80 bp, Homo sapiens
gcctcctgctagctcctcgcagttgtgctgaggcccacagcccagctccactgtcagatgagaaacagaagcacggaggc

SEQ ID NO: 6856910 - DNA, 59 bp, Homo sapiens
ttccagttggtagaatgtaagggggaaatctgtctctctctctctctcataagctggag

SEQ ID NO: 6856911 - DNA, 67 bp, Homo sapiens
gcggatgctcagtctggccacctgctcaagtcaagtagcaggcaggtcacatgcttggcgactccgt

SEQ ID NO: 6856912 - DNA, 67 bp, Homo sapiens
ggcctcaccaccctcggtgcggggtcctgatgcccgctgggccctcccctctgggtggtgagcagcc

SEQ ID NO: 6856913 - DNA, 56 bp, Homo sapiens
gaaaattatgtggcatattctgggaaagtggcaacagcagcaaccacatagttttt

SEQ ID NO: 6856914 - DNA, 71 bp, Homo sapiens
ttgctggctctggacgtcgatctatgtctacctacaaacacaagtggaccaggctagttcagagcttcaga

SEQ ID NO: 6856915 - DNA, 84 bp, Homo sapiens
agtgtgaacctcctaaggcaccagcttcctgtcttcaaaccttcatctcctcaaggataaagtttactgccttaggacagcact

SEQ ID NO: 6856916 - DNA, 87 bp, Homo sapiens
aggaagaagcctcctcatcttaggtgatgagacagttgatagggttttccctactgccttccacctatggatgaatatggtcttcct

SEQ ID NO: 6856917 - DNA, 80 bp, Homo sapiens
agaaggaagcaggggtagagattgctggtgtaagggactttttcttcccttctgtcttctctcccactgttttgtcttct

SEQ ID NO: 6856918 - DNA, 63 bp, Homo sapiens
cctctttttaaccccccaatggctgttatcatcccttcagagtaactgggtggtagggagagg

SEQ ID NO: 6856919 - DNA, 61 bp, Homo sapiens
ccttaatttactcatctataaaacaggggaaatacctacttatggggttgctgaattaggg

SEQ ID NO: 6856920 - DNA, 92 bp, Homo sapiens
gccaggtcagggtaaatgtggtttcagacagactcgaactctctttgccagtctgagtatctctgagccagattctttgcggagggcttggt

SEQ ID NO: 6856921 - DNA, 74 bp, Homo sapiens
atagatacacatgtacatacatagatatacacacatgtatgtgtgtatatgtgtgtgtgtgtgtgtgtatatat

SEQ ID NO: 6856922 - DNA, 61 bp, Homo sapiens
gcctggagctcggctgagggcgcaaacacggacgtggggcgccacctgcgggtgcccgggc

SEQ ID NO: 6856923 - DNA, 75 bp, Homo sapiens
agcagatgtctttgctttttaaaaacctctcagacatttgtagtgagggtgcaaaagcaaggacagtaaactgct

SEQ ID NO: 6856924 - DNA, 57 bp, Homo sapiens
acagtctactcaggaagtccccgagatcaaagcaaggggctttttatttagcactgt

SEQ ID NO: 6856925 - DNA, 56 bp, Homo sapiens
ggctgagttctcttgctgaatctaagactacggttctattgtgagaacctcagacc

SEQ ID NO: 6856926 - DNA, 97 bp, Homo sapiens
gcctcctctatttgtttattttactgtatatatttaaggcacgtaacatgaggctttgatataagtatacatagtgaaatggttactagagtcaggt

SEQ ID NO: 6856927 - DNA, 66 bp, Homo sapiens
attctctgatctgaaggaggaatggtgctcaattaagacatttgtcttctttcagattagcagggt

SEQ ID NO: 6856928 - DNA, 56 bp, Homo sapiens
ttccctgacaagagcacaccccaggaaactccatctcagggtctgtgtctagggaa

SEQ ID NO: 6856929 - DNA, 75 bp, Homo sapiens
gtggctgcacatgtgcagagatcttgtaacgtaactatggcttttctctgcaccatgtgtgaaataagctgccgc

SEQ ID NO: 6856930 - DNA, 80 bp, Homo sapiens
gcaggggttgaaacagagtggatacagtgagtatattttatatcacgtttgttcatcgattttattttgactttccctgt

SEQ ID NO: 6856931 - DNA, 56 bp, Homo sapiens
gcccaagtacgtcatcagaagagcttagattggatgcccttccttgggtgctgggt

SEQ ID NO: 6856932 - DNA, 62 bp, Homo sapiens
ggtaaggccctttgctcagcctgtaactatgtatctgcaaggctggcttcaggagcctctcc

SEQ ID NO: 6856933 - DNA, 90 bp, Homo sapiens
ggccaaaatgggcagaggtttctgcagcatagtggcaggtctgcttaccttgcattgtgaagcggagatcttgttttgaaccatagggct

SEQ ID NO: 6856934 - DNA, 56 bp, Homo sapiens
gactgagcttgaatcctggttgctcctctctgtgtgaccttgggtgagtgacggtc

SEQ ID NO: 6856935 - DNA, 57 bp, Homo sapiens
ggtgatgtgacccagaccctcatgtctgagagggctgagctcctggtcacaattatc

SEQ ID NO: 6856936 - DNA, 80 bp, Homo sapiens
tctagacatcaaaggggtaggaaatccagaggtggctcctctatttggagaactggatattttgctgccaggagtctgga

SEQ ID NO: 6856937 - DNA, 55 bp, Homo sapiens
ggagctgatgacgtcaccatggcactcatgcctgagatgttcttccatcagtttc

SEQ ID NO: 6856938 - DNA, 58 bp, Homo sapiens
catgtgcaataatacctcaattactgaaactcatcggaaatgagttattttgtatatg

SEQ ID NO: 6856939 - DNA, 72 bp, Homo sapiens
gaagccactcatgaaaactctccctcctcgacatgctcagaggggctttaggggccagtgaccagtggcttc

SEQ ID NO: 6856940 - DNA, 60 bp, Homo sapiens
gatgctttgtacagggcctggcacattgtaagcacttgtcagttcctgttgcacagcatc

SEQ ID NO: 6856941 - DNA, 66 bp, Homo sapiens
aggtgaggagagggtgatttaagtgggatacattacagaaaatctataaagtcacccctgctccct

SEQ ID NO: 6856942 - DNA, 61 bp, Homo sapiens
ggttatcagttcacttatgtaaagcacttagagcatgtgtctaagtgggctgggacagacc

SEQ ID NO: 6856943 - DNA, 84 bp, Homo sapiens
gcttagtggttaaatttctgcgtttgtgagtcaatcaagtttaaatttaaatcctgtccatttaccagatgcttgaccttaagc

SEQ ID NO: 6856944 - DNA, 61 bp, Homo sapiens
gcagtcattttcaaaacatgtaatccatttcttaattatgcatggaggtggatgtgactgc

SEQ ID NO: 6856945 - DNA, 58 bp, Homo sapiens
gagtccagagattaagcacctctgacagctctttgtcttgcttatccattttggtctc

SEQ ID NO: 6856946 - DNA, 86 bp, Homo sapiens
cggcgcgggcggaggcagcaggcggcccgcgggcccggctcccccagtcccggccccggcagccccgccagctccgctcgccgccg

SEQ ID NO: 6856947 - DNA, 55 bp, Homo sapiens
ttctcttggttagcctggcaaaaggcttatcacttttgttgagctcttcaaagaa

SEQ ID NO: 6856948 - DNA, 102 bp, Homo sapiens
ggggcaggagcagaggaggtctggagggtgggtagagaccttggaagctccaactggtttctcattcatccatcttcaccggtatctccagggctaagcctc

SEQ ID NO: 6856949 - DNA, 57 bp, Homo sapiens
gtcttgcttatggctaaagatatgaatttatgggatatctgtagtctgtggcaagac

SEQ ID NO: 6856950 - DNA, 59 bp, Homo sapiens
gtgaaaatttatgggagtttttcattctactcaatgagagattgctgtatgttttgcac

SEQ ID NO: 6856951 - DNA, 64 bp, Homo sapiens
tccctatcctcatacatatctcagtcttgttgcaacagagaaaagcatatggtgaaacaaggga

SEQ ID NO: 6856952 - DNA, 97 bp, Homo sapiens
gtggggtgttgttttttttttttttttgagatggagtcttgctctgccactgaggctggactgcagcggcaccatctcggctcactgcaacctccgc

SEQ ID NO: 6856953 - DNA, 94 bp, Homo sapiens
gggagcagaagacagagtagaagaagagtttacaaatataatcaactgagaaaggatttgcacagcctttctggctgctcttgtttcttctccc

SEQ ID NO: 6856954 - DNA, 103 bp, Homo sapiens
gtgtttgtattactgtcttaagaacagcagagggcactccaagctaaactttggaatgtgctactgttgatttttaaagaagttttaaattgagaacaagcac

SEQ ID NO: 6856955 - DNA, 106 bp, Homo sapiens
acacctccttcatctgtgcttagccgcagcgtctgccctcgcttcttcctaggggtctgaggacctctgaggtgaggaggagctttttgaggaacatgggaggtgt

SEQ ID NO: 6856956 - DNA, 70 bp, Homo sapiens
ggttgttaaaagcagagactctggagctagactacctgaatctaaatctcagcctttctgcttatcagcc

SEQ ID NO: 6856957 - DNA, 58 bp, Homo sapiens
aggtctggtatttttctatactgagaagctcttacagctgtaaaaatataccagatct

SEQ ID NO: 6856958 - DNA, 58 bp, Homo sapiens
ggtacagtggcttgcactagctgaattcattactattccctttgtgcagccttgtgct

SEQ ID NO: 6856959 - DNA, 68 bp, Homo sapiens
gggcagaatgtgtgtctttatgtgaattggtctcctttaatgtaattccgtaaagtcttacaatgtct

SEQ ID NO: 6856960 - DNA, 64 bp, Homo sapiens
cagaaagctcaggaaagggatatgttacatcgtgactcagtgatacactccctgctgggcactg

SEQ ID NO: 6856961 - DNA, 60 bp, Homo sapiens
ttctgcttctgcaggagctcctgatgccgggcgagcatctccactcgggcaggggcagga

SEQ ID NO: 6856962 - DNA, 86 bp, Homo sapiens
tagttccctcatctgcatgattggggtcatgatagcatctgtgaagagttgttataaagactaaatatgttgagatatgggaattg

SEQ ID NO: 6856963 - DNA, 62 bp, Homo sapiens
ggagacccatccggaccccatcactgcctgtctaagcagagccaggtgtagtctcggaggcc

SEQ ID NO: 6856964 - DNA, 91 bp, Homo sapiens
tggctgggtaaaatggtatttctaggtctagacccctgaggaatccccacactgacttccacaatggttaagctcgtttacagtcccacca

SEQ ID NO: 6856965 - DNA, 74 bp, Homo sapiens
tgtgttgggtgctgagtttcaggaagaatatgggcccacccagtatttggaatctgccttaggacctgtccaca

SEQ ID NO: 6856966 - DNA, 64 bp, Homo sapiens
ctaacataacctggtggccaagcctccataatactctggggccaggctcttggttatgttttag

SEQ ID NO: 6856967 - DNA, 108 bp, Homo sapiens
gatgggcgtgatgagtcagtgatgtctgccagggtcctgggaacagagagttgggcccatggaccaggtaggttccatccctgctttcttttgtagttaaagctcatt

SEQ ID NO: 6856968 - DNA, 55 bp, Homo sapiens
cttccaaatgtaaataagtttcatccaattaggtgcacttgttgagatttggaag

SEQ ID NO: 6856969 - DNA, 75 bp, Homo sapiens
gcagagcagatggtggggcaggaaaatctgtggccatctcgcaataagttatttttctctctcactctgccctgt

SEQ ID NO: 6856970 - DNA, 84 bp, Homo sapiens
gcctgtgggaagatgctggcaaggtgctggagggccctggaggcaaagggcctgcctcgaccttgccccccataacccacaagc

SEQ ID NO: 6856971 - DNA, 60 bp, Homo sapiens
ttggggctaggagtgcaagccacccaggggctcctgacgggctgctcacctaggtcccaa

SEQ ID NO: 6856972 - DNA, 56 bp, Homo sapiens
ttcttgcatcaagacagcctgtccagctagcaaggcaggttgttaaactgtaagag

SEQ ID NO: 6856973 - DNA, 70 bp, Homo sapiens
taggttcagagaactgaaaatattttagtaaattggctataaaaatgtatgttttccagtcttgaacttg

SEQ ID NO: 6856974 - DNA, 90 bp, Homo sapiens
tctgcaggcatgccctaagatgatctttcttccacatggctggtggaacattcaaagtggagagatcagtctcaggttgccctgatgtga

SEQ ID NO: 6856975 - DNA, 82 bp, Homo sapiens
tgaatgtcagcagtgtgcccagaggctggatccatggaatgggaaccaacagctgaactgtgcatgcttacagctgacatca

SEQ ID NO: 6856976 - DNA, 55 bp, Homo sapiens
tagtgatttcagtgggttttgccattatccccaaggggcaacccctgatttccta

SEQ ID NO: 6856977 - DNA, 79 bp, Homo sapiens
gggctgctttggaaagcatggaaacctgaacttgaatccgccagttaagtgctgtttcccagcctcagctcagcagctc

SEQ ID NO: 6856978 - DNA, 129 bp, Homo sapiens
gtgcataaaacaagtaccttattcacatttagcactgggaatgtcgtcagcttcatactctccaacacaatggatcctaaacttcggcatgcctcaggattagctatttcatcagcttgttaaaatgct

SEQ ID NO: 6856979 - DNA, 82 bp, Homo sapiens
ctctccccacgaaagaacagtgtcctgggactcggggtgcggggcagccgggttcgctggagctgttcagtgcggggaagag

SEQ ID NO: 6856980 - DNA, 90 bp, Homo sapiens
acataacttgagtgatagcagagccaactcgattcatccagaattgatttcatcccaggctctggaagaaatctaatgctcaggctatgt

SEQ ID NO: 6856981 - DNA, 65 bp, Homo sapiens
gacccataggaatctgttgtccttgtgaatcgaatgactgaaacagctattcactactatgggtt

SEQ ID NO: 6856982 - DNA, 79 bp, Homo sapiens
cccccagaggaatctggtaaagaagacaaacagggccaggcgcggtggctcacttctttaatcccagcactttgggagg

SEQ ID NO: 6856983 - DNA, 85 bp, Homo sapiens
gttcttccaggccctacagaggagaccaaggctcagctggcagctagctgtggggccaaattctcctctctgcctaggggagagc

SEQ ID NO: 6856984 - DNA, 100 bp, Homo sapiens
aagggaaataactaagtaggtgagttttaagcacatggtgtattttataggtgttgtaacacttttctattaataggcatatataactactttttccctt

SEQ ID NO: 6856985 - DNA, 129 bp, Homo sapiens
ttttaaagtattaatcattttgatgtgacttaaaggctgatcttaatattatcaaaggatttggtacatttgtgtgcttgatattaatacagtggcttaaagttgtacagttgaaatatagtttaatag

SEQ ID NO: 6856986 - DNA, 101 bp, Homo sapiens
gaatgatttaagcagtttctgatgcatatttccctttacatgtattttgtaaaatttctgcatgctgaaggtgaattgacaatagaaagctaatatttgtc

SEQ ID NO: 6856987 - DNA, 69 bp, Homo sapiens
tccctggcagataacctgctgtgccctgcttgggggtagagaggagggtgcccaggtatctgccactga

SEQ ID NO: 6856988 - DNA, 75 bp, Homo sapiens
gtcacacataactgtagttataaagctatcccttaagaattgggtagatttaaaacattacagcgttgtcatgac

SEQ ID NO: 6856989 - DNA, 59 bp, Homo sapiens
tatatcctcgttgagataagacagctggccctgactgctgtattcaaagtgaggatgta

SEQ ID NO: 6856990 - DNA, 85 bp, Homo sapiens
gctggcttgtgatgttattagatacaaaccattttatataaatttaaaaatactattgaagttgttctcataacgtatagccagt

SEQ ID NO: 6856991 - DNA, 110 bp, Homo sapiens
ggatgtatgatttcaagctattaaggtgagctgtataacagggaaggtcaaaaccgtgaactgagtcctaaattatgtagcctaccccagtgacttacattgtactttcc

SEQ ID NO: 6856992 - DNA, 71 bp, Homo sapiens
tttctaacttaacactcctgtgattaatctgtggctggatagttgtagatcagggatctgttagttggaaa

SEQ ID NO: 6856993 - DNA, 58 bp, Homo sapiens
tcctggttagagctctctggggtatgaggattccagtaaagagttgtctgagatggga

SEQ ID NO: 6856994 - DNA, 56 bp, Homo sapiens
gggggcaggaataaaggacagctgtattgatggcccagttttctgatcttgccccc

SEQ ID NO: 6856995 - DNA, 84 bp, Homo sapiens
acttaatacaagaaactacatgaatgcataattaagatattcattagtctgtcttgtatctgatgtggattttttgcattaagt

SEQ ID NO: 6856996 - DNA, 58 bp, Homo sapiens
gactatttaaaaagaactactgcagtggggagtttgcagtagtggagagagatcagtc

SEQ ID NO: 6856997 - DNA, 74 bp, Homo sapiens
agctcaattgactacgtccatgcaaagactaaagaaatttagtttaactttgtaaacgtgaggcttggttagct

SEQ ID NO: 6856998 - DNA, 61 bp, Homo sapiens
ccattcctttcccactccacaggggtggcatacaatacaccaagagctgggagaaggaagg

SEQ ID NO: 6856999 - DNA, 55 bp, Homo sapiens
gcagaaggtctggcacttcagggtaggcagtgctctgcagggcttccctctctgc

SEQ ID NO: 6857000 - DNA, 69 bp, Homo sapiens
ggtctggtcagagcccctttcatagaaatggaaacacttacttgaattggtttctgcagaagccagacc

SEQ ID NO: 6857001 - DNA, 95 bp, Homo sapiens
gccgggtcccggctcccctttgttcccccgctgggctcggcgctccggcgccgccccctctcgcggggcagcggaggtttgggcccgggccgggc

SEQ ID NO: 6857002 - DNA, 55 bp, Homo sapiens
agagttccaagcccatggcattcctgagagtgaggaagcagggacatggaacttt

SEQ ID NO: 6857003 - DNA, 110 bp, Homo sapiens
tcctaattttgcaaatagcttgattccatcatgttttaattagcaaactgattatattcaagagattggtgaatgaaaagtagattaagatcagtgcagcagaattggga

SEQ ID NO: 6857004 - DNA, 61 bp, Homo sapiens
gttcaaggctgaggtgtgctgtgatcgcacctgtgaatagctactgcacttcaacctgggc

SEQ ID NO: 6857005 - DNA, 81 bp, Homo sapiens
ccactgtttgaggcccagaggaggggggtctttctgccatttgcggcagcagcctggcccctcctcgggtagcactggtgg

SEQ ID NO: 6857006 - DNA, 67 bp, Homo sapiens
attccctatggggatttttagcattcatcttcttttgctcggatttagtgctgaaatccctgggaat

SEQ ID NO: 6857007 - DNA, 81 bp, Homo sapiens
aggtattagagagcaaagttctgacaggagcactactaattaactgataattgtcttcctttggcaagctctgctcttcct

SEQ ID NO: 6857008 - DNA, 91 bp, Homo sapiens
tgtacaatctctggaaggaaaggtagcagagaagtcatatttgacccattcatttatttcctttcctcctctagattttcgtagttgtgca

SEQ ID NO: 6857009 - DNA, 61 bp, Homo sapiens
ggcatgagccactgcccttggctcataatttccatatagccatttccagtggcatcatgct

SEQ ID NO: 6857010 - DNA, 69 bp, Homo sapiens
ttcagcactgactgagtggttaagttgattaaaagctgatagagccagtgccctcatgtacaggctgga

SEQ ID NO: 6857011 - DNA, 66 bp, Homo sapiens
tcgggcctggttgtgtgtggttgtatgtggacttggacatgtctgcaccgaacccacagctcccga

SEQ ID NO: 6857012 - DNA, 68 bp, Homo sapiens
tctggttgtcttcacctaagtcacaggatgcagagccatcactggtcaggaaggtggggacagacaga

SEQ ID NO: 6857013 - DNA, 84 bp, Homo sapiens
ctcccgccccgttcccaggaagcctctccaagcgacccctgcccagagcgctgaggctcctcgggaggacaaacggcgcggggg

SEQ ID NO: 6857014 - DNA, 91 bp, Homo sapiens
tggccagaaaaggggccttaaaagcccacctaacctgctcaccttatagataaggccagagagggagggtggggatgcccaggttcagtca

SEQ ID NO: 6857015 - DNA, 69 bp, Homo sapiens
tcacatggtaatgtgttgaatatttgtacaagtcagaggaatgtatgagtagtggcacaagcaatgtga

SEQ ID NO: 6857016 - DNA, 81 bp, Homo sapiens
tcttacttgaatatgtgtatttggttagcctacttgttataagatagagttgacatttaagtatacaattaaaagttagga

SEQ ID NO: 6857017 - DNA, 73 bp, Homo sapiens
ggtacagtttttattcatgacaagattctccatgtccacctttgatttgcctcttgttttgaaaggactggcc

SEQ ID NO: 6857018 - DNA, 109 bp, Homo sapiens
aagggagctggaaaatggcaaagatgaacgttcatagttatttgtttcatactctttatataacaggctccttgtgaatggatatttccaatttccacacaaggccctt

SEQ ID NO: 6857019 - DNA, 74 bp, Homo sapiens
agaagccatgtctcaggtggccacaagaggagatggtgaatcccaggccattaccgctgagacccagggcttct

SEQ ID NO: 6857020 - DNA, 89 bp, Homo sapiens
tttctgccactgaagcaattgagagatgtttctgctttttaaaatataaagcatatatgtaaaacaacttaattgctaggttccagaga

SEQ ID NO: 6857021 - DNA, 76 bp, Homo sapiens
cagtgttcccatggcacccagggctggcgccgggcacataacaggcaccctctgggtatctgtggaagtaacgatg

SEQ ID NO: 6857022 - DNA, 69 bp, Homo sapiens
cactgagggactcccacctggcagcagtcacctccgcaccttcaccgaccactgcagggagccccggtg

SEQ ID NO: 6857023 - DNA, 72 bp, Homo sapiens
ccgtggttactggctgggcctgagggctgtgcgccatctgggcaaggttcagggctaccagtgggtggacgg

SEQ ID NO: 6857024 - DNA, 71 bp, Homo sapiens
taatatattgttagagcaggagcagtcatgttcatataacatgattctctgctactctaaatgatagatta

SEQ ID NO: 6857025 - DNA, 57 bp, Homo sapiens
cctccccacagcccaggagacttcactaatagatgaagatcctggggtctggggagg

SEQ ID NO: 6857026 - DNA, 75 bp, Homo sapiens
acatgacccacccttttccattaaggcctttagaatcctgatctacagctggccttggaaaactgggagttatgt

SEQ ID NO: 6857027 - DNA, 57 bp, Homo sapiens
tcagtaaggattggaactggagtttcaactcagatctgattcctgatcctctgctga

SEQ ID NO: 6857028 - DNA, 67 bp, Homo sapiens
gaaccaaagtctgggggctgagtaagatgagatcagggagctcatttatccagccccttcactgttc

SEQ ID NO: 6857029 - DNA, 84 bp, Homo sapiens
acaatgcctagcacatagtaggctctcaatgaatatttgcttaatgccgaatgaattaagagcctactatgtgccgggcgctgt

SEQ ID NO: 6857030 - DNA, 70 bp, Homo sapiens
cagggacacagctgctgtggaggttttcactgcattttcagtaaggcattatagagacagcctgttcctg

SEQ ID NO: 6857031 - DNA, 55 bp, Homo sapiens
gcatcccttctctgtcggtttcctgggtggggcttggtcactggagtggggatgc

SEQ ID NO: 6857032 - DNA, 68 bp, Homo sapiens
ggggcccatttggtcattgggctgggggggcagagtcctctcaggctcaaagggccggatgaggtccc

SEQ ID NO: 6857033 - DNA, 68 bp, Homo sapiens
gctaggtgtcctcgtccaaagattctgtttaattgatgattgattctaatgggccaggaaacactggc

SEQ ID NO: 6857034 - DNA, 76 bp, Homo sapiens
ctagggttctatttcttaatcttggctggaaccaaagaagttgttatctgccgtctgatcaagagagaacccatag

SEQ ID NO: 6857035 - DNA, 65 bp, Homo sapiens
ttgtttccttttataaggcttgaggtgtttttgactttatttctgcttccttgagaaggagatag

SEQ ID NO: 6857036 - DNA, 56 bp, Homo sapiens
tgaagagagctgtcagttagaagttcccttggtcttctcactgtctgctttgttta

SEQ ID NO: 6857037 - DNA, 60 bp, Homo sapiens
ctggttgaatccttgagggcaagaactctatcctttcatgccacagggtcctcaggccag

SEQ ID NO: 6857038 - DNA, 57 bp, Homo sapiens
gctgtggctgaccaccagggggcagctgtgagccccatggccaggcacgcgcatagc

SEQ ID NO: 6857039 - DNA, 63 bp, Homo sapiens
gtaattacaggtccaaaacaatctcatagttttatttgggggttatttgcatcctgtaattat

SEQ ID NO: 6857040 - DNA, 64 bp, Homo sapiens
gtcctgtgtaagtacttgctcagcatgctcagagattcccatgccagcttatttactgcaggac

SEQ ID NO: 6857041 - DNA, 68 bp, Homo sapiens
ggcttaagaggttttaggatgctgtttattcaactgaattgcattacagaaactttcaaattttggcc

SEQ ID NO: 6857042 - DNA, 56 bp, Homo sapiens
gggaaaagtctgcaagaaagcttatcctccagatgggctgccttttaattcttccc

SEQ ID NO: 6857043 - DNA, 76 bp, Homo sapiens
gtggcttgctcagtgaggccagggctgcactttgagaggggatggcaaactcctctcctggctgcactgtggccac

SEQ ID NO: 6857044 - DNA, 78 bp, Homo sapiens
gcaaaatttagctatgtataaccaaagtacaatgtcctgggaccacttgtgctctgtgttatttaaggctcaagctgc

SEQ ID NO: 6857045 - DNA, 55 bp, Homo sapiens
gagcccaattatttttaaggatgacgacagtgcatgctgttaagataatgggttc

SEQ ID NO: 6857046 - DNA, 77 bp, Homo sapiens
ctgtagaagcagctgtactggcagcattgtgtcttccttcatcctgacagagtctgtgaagtcagttactacaacag

SEQ ID NO: 6857047 - DNA, 77 bp, Homo sapiens
ttagaaataccttgattttgaatccatgatttatacacagtgatatattcttagatgcagaaatgagggatttctag

SEQ ID NO: 6857048 - DNA, 81 bp, Homo sapiens
tgtccttctgagactgagggtaacctggagctgctgcaggcgctgttgcaatcacgggtacccatttgtctgagattgaca

SEQ ID NO: 6857049 - DNA, 59 bp, Homo sapiens
gcttttgttttcttagaaacctggccgctcttggaatttaggcttgagagaacagaagt

SEQ ID NO: 6857050 - DNA, 103 bp, Homo sapiens
tggcctgaactttctgtagttttagcagcaatgggatgctttgaaacctagatctctcaccaactacatcttccattgactggtgaaacactagtttaagcca

SEQ ID NO: 6857051 - DNA, 56 bp, Homo sapiens
gggcgtgtacacgcacacgtgtcctctgtcccgtgtggaggggcgtgtacatgctc

SEQ ID NO: 6857052 - DNA, 84 bp, Homo sapiens
ggcatgtagggaagtatataaatcctttcagactaccagggaaccacttagggtttgaaagaatttatgtactttccaactgcc

SEQ ID NO: 6857053 - DNA, 96 bp, Homo sapiens
gctatgagtatgttttataaagtggattctgtgtgagatgtacagctcaaaactattgttatactttacacttagaatgcttttatgtgcttatgc

SEQ ID NO: 6857054 - DNA, 56 bp, Homo sapiens
aagctgtacttagcattgactcctctgctacagcaggagtctgggggatgcagctt

SEQ ID NO: 6857055 - DNA, 58 bp, Homo sapiens
tcaggaagctgctctgggtggtagctttaggatctacaccctcagcaaggcttcctga

SEQ ID NO: 6857056 - DNA, 63 bp, Homo sapiens
gactttcttctctggcggtgtgttttcctctgtttccaggggagctcccaagagaaggttgtc

SEQ ID NO: 6857057 - DNA, 83 bp, Homo sapiens
atttccataccttatttacttcttctcaagagggtagacaatttttacactgagtgagaaaaggaaatactaaaaatgggaat

SEQ ID NO: 6857058 - DNA, 63 bp, Homo sapiens
ctggtgcctcctctcccaggtcaaatattaactatctggccttggaaagaggggaggaatcag

SEQ ID NO: 6857059 - DNA, 99 bp, Homo sapiens
agagaagggatcatagtgcagctccctttcacagttcccagaaacagagtatttatggaatcagatgaggggcagagctaaagctaaggtctcttttct

SEQ ID NO: 6857060 - DNA, 73 bp, Homo sapiens
ttctgctgcacttgagcctgggagaagttggctccagaaattttgccatctatcttgccatcaatcggtagaa

SEQ ID NO: 6857061 - DNA, 84 bp, Homo sapiens
ttaaaataccattgcctggattctaccacagaacaattaaattgggatttctgtggttaggattcaggcatggacatattttaa

SEQ ID NO: 6857062 - DNA, 68 bp, Homo sapiens
gctcaggccacccagagctggctctgcatgtacagcctatgtgcttacagaccagtgtctcctgaagc

SEQ ID NO: 6857063 - DNA, 65 bp, Homo sapiens
ttggaagccctgtgataggccagatctcatttatagatatgtttcatgatgctcacagggtccaa

SEQ ID NO: 6857064 - DNA, 57 bp, Homo sapiens
ttggtgccatcttccttcctctgcacctggaaaggatagggaaggaagaggctttga

SEQ ID NO: 6857065 - DNA, 72 bp, Homo sapiens
ggaggtgaagcatgctctgcaaaggcttttgtgcagcagcttccgagagtctacagcaggcagcccaccccc

SEQ ID NO: 6857066 - DNA, 65 bp, Homo sapiens
caggtgttaaatgatggatttagacaagctggacaccaagtttgtgttctatcattctacagctg

SEQ ID NO: 6857067 - DNA, 90 bp, Homo sapiens
attggtagtggtggttggctttagacctgagactgtccttgactcagacatttcagattcatgaagtgacaacataaaactacttctaat

SEQ ID NO: 6857068 - DNA, 75 bp, Homo sapiens
gattcttcctctgcctcccgtgctcactctctccccaaccatggtgggcttaggggtgctgaggccgatttggtc

SEQ ID NO: 6857069 - DNA, 84 bp, Homo sapiens
gtttcgggtgagtcttttgtggatggaaaatagcaggaactagttgtgttatgtctttatcccaatatgagactcgccacttac

SEQ ID NO: 6857070 - DNA, 103 bp, Homo sapiens
ccctgtgtttagggacccatggctaggtctggccacttccatggcagagcgaaagccactacgctggtgaaggctaggctagccttgttccccagacacatgg

SEQ ID NO: 6857071 - DNA, 63 bp, Homo sapiens
ttttcagtggagtgacatgatcttacttgtattgtaaaaggattatgctcatttcggtgtgga

SEQ ID NO: 6857072 - DNA, 103 bp, Homo sapiens
ggtggctttaattttcctgcctaacgttggtctctggtctctgtacaaggataagcacctggtgaagtcagcggagcccggggagcagcaggtaagtgccacc

SEQ ID NO: 6857073 - DNA, 105 bp, Homo sapiens
gggcagtgggtggtcaggagccacacctgatggagggtgtcagagagcgaaggtgtctttttgccatctccttggtcttcaccagagtgggcggccccgctgccc

SEQ ID NO: 6857074 - DNA, 72 bp, Homo sapiens
gaagcaaataccttccacagtgaccttgaagcagctttccccctgcagcaatggttaggaaagtatcgtttc

SEQ ID NO: 6857075 - DNA, 74 bp, Homo sapiens
gtcgagatagggtctcactatgttgcccacgctggtcttgaattcctggtgtcaagtgatcctcccatcttggc

SEQ ID NO: 6857076 - DNA, 77 bp, Homo sapiens
ttctctgcacaaactggctggcttgttcactgactgggcaaccttccccagcttcagaagaagccgtgaggcaggaa

SEQ ID NO: 6857077 - DNA, 78 bp, Homo sapiens
atactatctttatacatttgtagctatttactgtatgtacatttgtccgtcgtgcggcctaagcatagatgtaagtat

SEQ ID NO: 6857078 - DNA, 70 bp, Homo sapiens
gcagttcgtgcctaagcgcaagtgcccgtctattccgtgggggctgcctgtgcccaggcacacacgctgc

SEQ ID NO: 6857079 - DNA, 99 bp, Homo sapiens
gaggtaggagaatcgcttgaacttgggaggcagaggttgcagtgagctgagatcatgccactgcgctctagcctgggagacagagagagactccatctc

SEQ ID NO: 6857080 - DNA, 80 bp, Homo sapiens
gaaggtttcttacatttgtaactctccctttgtatatttcgaatgtttgagagggggagttatattaaaataaaactttc

SEQ ID NO: 6857081 - DNA, 100 bp, Homo sapiens
ggctgaaggatactgagggaatcatatgcctacagagcagcaggaccagagtttgtatccagatctgtccagctctggggctcacctcttcctgttagcc

SEQ ID NO: 6857082 - DNA, 92 bp, Homo sapiens
gccttacttgcctcactactgggtcaacacattttatgtgtataacatatgtgtacagaaatgtgatgacgcaagaggcaagagttgacggc

SEQ ID NO: 6857083 - DNA, 85 bp, Homo sapiens
cccagctggcagatgcacagggctgtggtagctgtgggcagcccggttgccaaatgccaccacagctgcgtcactgagagctggg

SEQ ID NO: 6857084 - DNA, 112 bp, Homo sapiens
caccatgcatgtgaatcacctggggggctgcttaaaatgcagattctgtctcaggaggtctggggtaggaacaagagtctgcatttctaacaggctctgtgtagtgctggtg

SEQ ID NO: 6857085 - DNA, 58 bp, Homo sapiens
atctagatttaacagagtataagttactataggtcatcttgtattccttgaatcaggt

SEQ ID NO: 6857086 - DNA, 99 bp, Homo sapiens
ctaggctggtgccttccccttggggccagggctgtgcgtgggggacaaggccgctgctctccctagggccgctggctaagaaggaaatacctgacctgg

SEQ ID NO: 6857087 - DNA, 121 bp, Homo sapiens
ttctggctgcacatgagaatcacatgggagcttaaaacatagccagactgagccccacttcagactgtgaaactgatgtatttttaaaatgcttcccaggtgttttcatgtgcagtcagga

SEQ ID NO: 6857088 - DNA, 56 bp, Homo sapiens
tctaccagcaacagaaggcaggggacctgagactcctttcactgtggtgctggaga

SEQ ID NO: 6857089 - DNA, 82 bp, Homo sapiens
ggtgcttggctatggcagggactgtggcccttgggaccactgctctcaccaggtggccacctctatgctgccaagactcacc

SEQ ID NO: 6857090 - DNA, 84 bp, Homo sapiens
gtggggccatgctggggcctctgtgaggttaacctgactcctcactttgaccctgagaggtgcctgcaatgatccttgcctcac

SEQ ID NO: 6857091 - DNA, 85 bp, Homo sapiens
ctccagctccttaatccggatctccagctcgcagagctcctccgggtgggaggcagaggcgagcctgggggtcgaggggcagggg

SEQ ID NO: 6857092 - DNA, 58 bp, Homo sapiens
ggactgttttgaggattcaatcaattaatatagatataaggtccttagaacagtgtcc

SEQ ID NO: 6857093 - DNA, 56 bp, Homo sapiens
ctgagatggagtttcgctcttcttgcccaggctggaatgcagtggcaccatctcag

SEQ ID NO: 6857094 - DNA, 67 bp, Homo sapiens
ccagtggaggctgcagcacagcaaatattgcagaacagcaaatattgctgcctgagccttcctctgg

SEQ ID NO: 6857095 - DNA, 73 bp, Homo sapiens
gcaggtgccaggggatgcacgaaggcgcctcggagagacccctttctccgggtgcccacgtgcccctacttgc

SEQ ID NO: 6857096 - DNA, 59 bp, Homo sapiens
cctggcacctccagctcatggccctgagcgggcagagttggccagctggaggcgccggg

SEQ ID NO: 6857097 - DNA, 60 bp, Homo sapiens
gatacaggtaataataacagaaaaacaaatctgtttttcagccatgaattacactgtgtc

SEQ ID NO: 6857098 - DNA, 75 bp, Homo sapiens
gatggtagcccagaaagtgtgtgcagttgtttttccaggagcataagcaaatccacacactctgagtcttctatt

SEQ ID NO: 6857099 - DNA, 67 bp, Homo sapiens
ctccctgtgtcggacgtgggcagcagaacgcccctttgatgccccgtcctgtacactaagaagggag

SEQ ID NO: 6857100 - DNA, 75 bp, Homo sapiens
tgctgctgtgtgggagacaggcgctgtcccagggcaggctctcctgggcctatgcttttctccaggccagcttca

SEQ ID NO: 6857101 - DNA, 77 bp, Homo sapiens
gagcagcctgaggagcgtgggccggtcacttgctatagcagccatcccgggaagtcactgttcatcacggcatgctc

SEQ ID NO: 6857102 - DNA, 127 bp, Homo sapiens
ggtctgtggcctgttaggcactgggctgcacagcaggaggtgagcagggagcaagctagcactagggcccaagctccgcctcctgtcggatcagtggcagcattagatactcataggagcacagacc

SEQ ID NO: 6857103 - DNA, 96 bp, Homo sapiens
gaaatctgaagtaatgtattaaaaagcagtgacaaaaatgaagaacatgttgcagtcactctgttttactcactgttgatgctgcttcactctttc

SEQ ID NO: 6857104 - DNA, 65 bp, Homo sapiens
tcccggtccatcacagggctgttgggcacagacacacttgcccactcagccctgtggagcaggga

SEQ ID NO: 6857105 - DNA, 84 bp, Homo sapiens
tcttgtgtgtatgtaagtttgtgtagtttagcatccttgtattatattgcatgggttactgcttcaaaaaattatgcgccaagg

SEQ ID NO: 6857106 - DNA, 103 bp, Homo sapiens
ttgagaaggagtctcactccgtggcccaggttggagtgcagtgacacgatctcggctcactgcaacctccacctcccgggttcaagcgattttcctgcctcag

SEQ ID NO: 6857107 - DNA, 57 bp, Homo sapiens
gcagaatatgccccagtgggggaaccggctcacggctttcctgattgtcatttctgc

SEQ ID NO: 6857108 - DNA, 64 bp, Homo sapiens
gctttccctacagactttcctgttcaattaacacctgtcactgccaggctctgtaggagagggc

SEQ ID NO: 6857109 - DNA, 62 bp, Homo sapiens
gagatagaagtaaagacttgagatactgggattatccattatcacatggactttgctttctt

SEQ ID NO: 6857110 - DNA, 62 bp, Homo sapiens
ggggcttgcttaaggtcacccggttcttaagtggcagggctggggccggacagcaaagcctt

SEQ ID NO: 6857111 - DNA, 100 bp, Homo sapiens
ggtatctgccaaaagagcaaacatgtaatagtgaaacacggggagcacattaattaaaatcaagagctctattattactcctgattgtactgcagatacc

SEQ ID NO: 6857112 - DNA, 58 bp, Homo sapiens
ggggtaggaagagaaaatagtgcttgtctccagaattacttttttcacttctagcccc

SEQ ID NO: 6857113 - DNA, 80 bp, Homo sapiens
atttttgtggcctttcaaggatggaatctttttctgacctgatccacaaattctggaaaggcccctctgttgacagaaat

SEQ ID NO: 6857114 - DNA, 55 bp, Homo sapiens
gcacatttaactgagctcaggacgctgcaatgtgatccttcaccgtgaaatgtgc

SEQ ID NO: 6857115 - DNA, 83 bp, Homo sapiens
caccaccatagcctgtaggtccctaacttccagaccctgctcagggttaaacaagctggacactgaacagcctctggggggtg

SEQ ID NO: 6857116 - DNA, 56 bp, Homo sapiens
gccaccatgtattgacttggccattgtcattaacaggcagttttaagcatagtggc

SEQ ID NO: 6857117 - DNA, 71 bp, Homo sapiens
tactaaccacaacactaaatgctggtgggggtggagcaacataaactctcatttattgttgtgggaatgta

SEQ ID NO: 6857118 - DNA, 66 bp, Homo sapiens
ttcagaaacagtatggaagccattaggaagggtgcccttgccacttattggcccaactctcctgaa

SEQ ID NO: 6857119 - DNA, 75 bp, Homo sapiens
attaattctgctctgaagccaggattctggggagtctttactccagatagtaacctttctagagcgagaagggat

SEQ ID NO: 6857120 - DNA, 76 bp, Homo sapiens
ctggacaatgagggagctgacctttctgtgctcaataaaccaattgccactagagagtaggttccctggtgaccag

SEQ ID NO: 6857121 - DNA, 84 bp, Homo sapiens
catttggaattggagagttagagtggtatgttggaaagaatgcaaatttggaaatatcatttataacttttaaaagaaagaatg

SEQ ID NO: 6857122 - DNA, 63 bp, Homo sapiens
cttccttggaataccatgttgacagaggtgcaaagtgactgtacctgctgggtgctgagggag

SEQ ID NO: 6857123 - DNA, 55 bp, Homo sapiens
tgcatccgcacgcttgtgagaatctgtctaccaaagagtctgaggtgaggatgca

SEQ ID NO: 6857124 - DNA, 75 bp, Homo sapiens
tcgttttagctgtgaagagctaaaaaatggaaaatgcatatttcatgtaaagttcagtacagttttttaagatga

SEQ ID NO: 6857125 - DNA, 94 bp, Homo sapiens
ggcttaccatgtttgtggagacttttattggtaatgataaaagttgggctgacaacatttctatcatcctgtaatgtaatgcacacacagagct

SEQ ID NO: 6857126 - DNA, 62 bp, Homo sapiens
gatttgctctccaggtccaagaatccagcaatgctgtgatcatttggtccttgagaaaggtc

SEQ ID NO: 6857127 - DNA, 77 bp, Homo sapiens
gcatgtgggacagtagtcactaaactagatcaagaagagaaagtctttgctcttggtgaactactgaatcccattgc

SEQ ID NO: 6857128 - DNA, 129 bp, Homo sapiens
agttaggaagccagtgtggtataaatggactagttcactatagaagacagtgtttaaggaactgaattgattggcattgtgaaactgtaggtgagttccttagtctttctagcctgtggtttctttact

SEQ ID NO: 6857129 - DNA, 69 bp, Homo sapiens
tcaggcagggtttacaatagcaataatgtaattcaaataagcaattattgtaattgaccttggcgatga

SEQ ID NO: 6857130 - DNA, 58 bp, Homo sapiens
gtccttgtggggtgcgaggagacgtccagacacaagtgtttacttcaactcccagggc

SEQ ID NO: 6857131 - DNA, 58 bp, Homo sapiens
taaatatatgctaaacacttttggagggaaactgggagaaagtgtaagcatataatta

SEQ ID NO: 6857132 - DNA, 63 bp, Homo sapiens
ctgtgccacaaactcgcgaaaaccggctacctagagccagcgtctttgcgagcttgcggccag

SEQ ID NO: 6857133 - DNA, 93 bp, Homo sapiens
tcatgtcagatctttggtgcttgtcctgacacagctgtcagccttccagctctgtgcagttcagggacacacaacaaagaggcagtgacatga

SEQ ID NO: 6857134 - DNA, 69 bp, Homo sapiens
gaatccttagcagggccgggcctgggtcactgggctccgtgctcccggcgcccaccctgctggggtctc

SEQ ID NO: 6857135 - DNA, 84 bp, Homo sapiens
gagaacagggcagcaactttgtgccttcactcacttccctccaacccccgatgtgcacctaggtcaaagttctctctctgtctc

SEQ ID NO: 6857136 - DNA, 65 bp, Homo sapiens
gggcaggtgattttggctccatgtcccctgacttcaggttgtaagtgtgctagaatcactcaccc

SEQ ID NO: 6857137 - DNA, 57 bp, Homo sapiens
gcacctcttggagccttgttggccagcaaaacacttactggaggctccaagagctgt

SEQ ID NO: 6857138 - DNA, 87 bp, Homo sapiens
aagagtttgtaggctgagggccaggaatgtcccatccccttcagggtagtcctgcagatggaccttccccctaggctcatgtgtctt

SEQ ID NO: 6857139 - DNA, 87 bp, Homo sapiens
tcaggatgtggctccttaagttctccaaggccagattgagatttgtttttctgaaccttgagggacattcgggagaaacgagcctga

SEQ ID NO: 6857140 - DNA, 72 bp, Homo sapiens
gtatggtagaatacaaaatatatactggagacttgtaaagtctcttagaaccttgttttggaactgccatgc

SEQ ID NO: 6857141 - DNA, 61 bp, Homo sapiens
tacaaagaggcagctccattttattttattagcctcccttagatgtggcagtctttttgtg

SEQ ID NO: 6857142 - DNA, 64 bp, Homo sapiens
atgatgaagagtaacaggctgaagctcaggcaaacgcccccgccaccatgtgtacatttatcat

SEQ ID NO: 6857143 - DNA, 60 bp, Homo sapiens
gagatgactggtagtctcacaccaagatacacacctctgaagtgctgccagatctatttc

SEQ ID NO: 6857144 - DNA, 64 bp, Homo sapiens
cccgaggtcagaggcctggtgtgagcttggtatgccctgccagggagccctgctgaccagaggg

SEQ ID NO: 6857145 - DNA, 57 bp, Homo sapiens
gagtggcagaggctctgggaccagactacctgggtttgaatcccagctctgccactc

SEQ ID NO: 6857146 - DNA, 65 bp, Homo sapiens
tcatttataaggatgcaattaaagcattgccaagttaaaaatgtcatgttgctctttgtcaatga

SEQ ID NO: 6857147 - DNA, 62 bp, Homo sapiens
atgtggctagtgcaactgagaaactaaatcttttattttagcttaaatgtaaatagccacat

SEQ ID NO: 6857148 - DNA, 129 bp, Homo sapiens
agtaaattatcttgtttgggataatacgttagtcaaatcttatctggttacaagggataaaatcatatgattttatccgttgttaccagataagatttgactaacgtattatcctcaagaagtttatat

SEQ ID NO: 6857149 - DNA, 60 bp, Homo sapiens
ggatcagaatctttgggtgtaaaaaaagagtgaaaaaattccctaaatgattctgatgcc

SEQ ID NO: 6857150 - DNA, 62 bp, Homo sapiens
gtctagttccacgtaaagccccagaagtgaccttctgggtctttacccatggaattccagac

SEQ ID NO: 6857151 - DNA, 80 bp, Homo sapiens
gagcccagcctcagctgccacctctgcctttggggaacccaagtcctcaggctgccctgacagcccccgatgctgggctc

SEQ ID NO: 6857152 - DNA, 76 bp, Homo sapiens
ttcaagggcgtcatggggggaaacattactgcttttgatcaaaagatactgttttaatctcccattgctctctgag

SEQ ID NO: 6857153 - DNA, 62 bp, Homo sapiens
agcgctttaactccttctagttctgtttttcctttgatggtattagaaggtatttagggcct

SEQ ID NO: 6857154 - DNA, 99 bp, Homo sapiens
tgtcttaacatgtttgaacctcacagagcccagatgtctaattgtatgttctttttgtctttatatggacaactggtttttgacaaatgtgttaaagca

SEQ ID NO: 6857155 - DNA, 56 bp, Homo sapiens
tggaagatgcttgagaactgtttgaattgaatttcattcaaggctggtatctttca

SEQ ID NO: 6857156 - DNA, 101 bp, Homo sapiens
tggtctttagtttgagtcccagctgtgtggctgacaggaaagttacttaatttccatatcatcaaaagtcatcggcaaaatggggctaataatttctacca

SEQ ID NO: 6857157 - DNA, 90 bp, Homo sapiens
ctgtctgccttgcctgtgaatacaagccaggcacaaggcatcgaatcccgtggtgcgagcttctggtttggtattcaccatgacagacag

SEQ ID NO: 6857158 - DNA, 62 bp, Homo sapiens
tttaattcaacattgttcacagtggtagaaaactagaaagccatagtgagtagtgaattaga

SEQ ID NO: 6857159 - DNA, 103 bp, Homo sapiens
aagttacagacttcaactgcagaattgcttatctatctttaagtcctttcttccaaggatttctaagcattcgatgggcaccataatagtttgttattgactt

SEQ ID NO: 6857160 - DNA, 76 bp, Homo sapiens
ttgctttgttgcctaggctggagtgcagtgatgcgatttctgctcactgcagcctccaccttccaggttcaagcaa

SEQ ID NO: 6857161 - DNA, 99 bp, Homo sapiens
tgtattttctgaaaatgtttaaagtattttatcatttgtttgattctatccctggtgatgtctcatatgatataaatgcagactggattaggaaataca

SEQ ID NO: 6857162 - DNA, 72 bp, Homo sapiens
ccatcattttacaaacatttcagaattttaccttttagaaggaaacagttctgcctgtttgagaagtgctgg

SEQ ID NO: 6857163 - DNA, 79 bp, Homo sapiens
aatcatcttagcgctaatcaccgagcttcattgagtactttgtaatgtgccaagctgggagctgaaggctgatttgatt

SEQ ID NO: 6857164 - DNA, 110 bp, Homo sapiens
gcgcccgcggggagcctcggcctctgcctgcccgcgggcccctgcgctccgggcggccgcgtggtcgggcacggggggccgttgcgcaggggccgcggcccgaggggcgc

SEQ ID NO: 6857165 - DNA, 81 bp, Homo sapiens
ggcgatgttcaagctcttctttccatccctagccactagctcagtatcaggtgtttaggagatgcagaatgaatgtttgcc

SEQ ID NO: 6857166 - DNA, 129 bp, Homo sapiens
tacacctatctgctcattttgttgtgttagcttttctggtttatttcatagtttgttcttgctatttattaagaacagaatatcaaaagattatgaatagcctcagctctagaatgcttaccactgtta

SEQ ID NO: 6857167 - DNA, 92 bp, Homo sapiens
tgggagctctgaagccagggtgacccttcagcattgtccccaaatggagggaagtaggctgggcttggtttccctgcttcagccagtcacca

SEQ ID NO: 6857168 - DNA, 61 bp, Homo sapiens
gattattcagtttgtcctgtacacctggagtttattagagtgtaatacaaactaaacggtc

SEQ ID NO: 6857169 - DNA, 81 bp, Homo sapiens
ccctgtgttgaaactctcagggatctcaaatagacggtctaggcagttggctcagagccttgagagctgatcggggcaggg

SEQ ID NO: 6857170 - DNA, 62 bp, Homo sapiens
gatatgtgatttgacttctggcatggggacagtcttgatctctggaaggttaattataagtc

SEQ ID NO: 6857171 - DNA, 77 bp, Homo sapiens
tgttgccaggtgccactgagagagcgcctgggatcattcatcgaataatcctgcccgtctctccgcacttttaaaca

SEQ ID NO: 6857172 - DNA, 66 bp, Homo sapiens
tactgtaatgagattagcttccccatataaactattttggtatcctgagctatagcttatacagta

SEQ ID NO: 6857173 - DNA, 74 bp, Homo sapiens
tggagctcgtggctggctagggggttctccatgtgctcatggccaggagagtctgccgagccagcccagcccca

SEQ ID NO: 6857174 - DNA, 96 bp, Homo sapiens
gttcagttgcttagcttgatatttaagtaacttggaactattgtgtctatagatcaatatggcttgttactatgtttatagagcttgcgatttaac

SEQ ID NO: 6857175 - DNA, 62 bp, Homo sapiens
ggctcttgatgttcattgacttggccaagactagctttctaagtaaatgcaatatgaggacc

SEQ ID NO: 6857176 - DNA, 130 bp, Homo sapiens
tgtggagattcagcattacctaggaatgtataagaagaactctgggcttcaagtcagatttgctaagtcacaaactctgggggtggagcccagcaaactgaaccttaacaagcctccgggaaattccata

SEQ ID NO: 6857177 - DNA, 72 bp, Homo sapiens
gaatatatagaaacccaggatttgtatttgtatttaaatgtaaatacaaaaggtctgggtctctgtatcttt

SEQ ID NO: 6857178 - DNA, 73 bp, Homo sapiens
tatctgaacctcagtgtcctcatctgtaaaatgaggagaacacctcctacatctgaggatgactgtaaagatg

SEQ ID NO: 6857179 - DNA, 64 bp, Homo sapiens
ggcagtaaacactacctacaaatgcagcagtggaagagaccagtgtgtaaggtactttgctgct

SEQ ID NO: 6857180 - DNA, 71 bp, Homo sapiens
ggaaggagggaagggggaagagagctggccgtagacccgtctccggcccccgcctccccctttcctcctcc

SEQ ID NO: 6857181 - DNA, 63 bp, Homo sapiens
ctggcactggtagtttcagcaaccagcaatcattgcttctgcttatcactaactctgtgccag

SEQ ID NO: 6857182 - DNA, 58 bp, Homo sapiens
tctcatgtgaagaaagaatttctgtcactttggtgatgaatctttgatttacatggga

SEQ ID NO: 6857183 - DNA, 70 bp, Homo sapiens
agttttgccacggtgccgagcgcaggacgatgacccggcccaatgccctggatcgatgccgagggaaact

SEQ ID NO: 6857184 - DNA, 59 bp, Homo sapiens
ggcagaagaaaggctaagtctccctctctcttctggagctgagacaaacttcttctgcc

SEQ ID NO: 6857185 - DNA, 55 bp, Homo sapiens
aggtggagacccagagaaggcggccaattgctcaaagctgctctgggtctcatct

SEQ ID NO: 6857186 - DNA, 80 bp, Homo sapiens
gaggtttagacaggatgttcaagggacctatgacttcatgtccgtgtgtccctctggacatataatctgcctgtgacctc

SEQ ID NO: 6857187 - DNA, 62 bp, Homo sapiens
aactttaattatttttcacttagagatcatacagttctagagtagtgtgagtaattggagtt

SEQ ID NO: 6857188 - DNA, 67 bp, Homo sapiens
gtttctgtctgctatgcttgttgtcactgcaccttagttcatctgatagcacaagtagatagcaaac

SEQ ID NO: 6857189 - DNA, 60 bp, Homo sapiens
cataggaagccatctcagtcacctacttgtaaaggcaactatggtccttgcttccctatg

SEQ ID NO: 6857190 - DNA, 77 bp, Homo sapiens
agggaaggtgggtaactagcccaggtttctgatgctgctggtgtctgaaggctgaggctgtgttgttttcaatccct

SEQ ID NO: 6857191 - DNA, 84 bp, Homo sapiens
ttgaaggtagggaactctgtcttcactcatgagtaccttccaacacgagctctcaggagtaaagacagagttccctaccttcaa

SEQ ID NO: 6857192 - DNA, 71 bp, Homo sapiens
ggcatttttattggaatttcactgactctactgattaatataaggagaactgacatttccaatataaagcc

SEQ ID NO: 6857193 - DNA, 76 bp, Homo sapiens
tgaacttacaaaggagataaattggaggctgatgattagcatcacaaaatgattattccctttgtaaaaggcttca

SEQ ID NO: 6857194 - DNA, 79 bp, Homo sapiens
caggctcccaagcatattttacaaataccccagatgcatgttcaatgtgtatttctgcaaagtgtgtgactgtggcctg

SEQ ID NO: 6857195 - DNA, 72 bp, Homo sapiens
gggaaggacttagaccctgtctttattcagaggactgcctggttaagacagtattttaagattatctgctcc

SEQ ID NO: 6857196 - DNA, 67 bp, Homo sapiens
gtgtgagaggagcagaggatctgggggagggaagggcccaacaccccaagcctgtgccctctgactc

SEQ ID NO: 6857197 - DNA, 61 bp, Homo sapiens
ttgtttattccacctccattttcctagggaaggaattctagtaaaccgagggaataaagaa

SEQ ID NO: 6857198 - DNA, 89 bp, Homo sapiens
gattgcaatttcacaggcaaatgtcaatgggtaatttttgaagttttacttacaagtttactctggtgacaatttatgtgattgttatc

SEQ ID NO: 6857199 - DNA, 70 bp, Homo sapiens
cgttctggccgcgccacccttgccccagccgccgagcggctgcctgggcaggaggcgctgagccggcctg

SEQ ID NO: 6857200 - DNA, 116 bp, Homo sapiens
ggttagatgggatgggacactcaatacattttgtttctttttcattgctcagaggtaaactcagtgtccaaaaagaggcaagagaatgcattaagaatttccttgcctaaatagcc

SEQ ID NO: 6857201 - DNA, 65 bp, Homo sapiens
actttgtgcccaacagaaagaagaaataacatctattggctctttcacattgtggggggcatggt

SEQ ID NO: 6857202 - DNA, 71 bp, Homo sapiens
ccttgtagtactcagcattaaaggaaatcctgtggaaaacgaggtcctgatgatctctgagagccccaggg

SEQ ID NO: 6857203 - DNA, 89 bp, Homo sapiens
cactcttattttccataaagagttgttccatatgtgctgcttgctgagaaaaacacacatatgtggcaactgtagatgaaatatacgtg

SEQ ID NO: 6857204 - DNA, 74 bp, Homo sapiens
gcccaggcaatcacatttacattgctaattgaagaagaaagctacagtaagcaatagagtgagaattattaggc

SEQ ID NO: 6857205 - DNA, 56 bp, Homo sapiens
gcttggcccattgatcagctggaaaaaaatgctcattaatgaaactttggttaagc

SEQ ID NO: 6857206 - DNA, 72 bp, Homo sapiens
tctgtgaagataaggatgctgcagtcttggtcttaaatgctctgagaactgcgtgccttgttttcttataga

SEQ ID NO: 6857207 - DNA, 60 bp, Homo sapiens
ctgtgtgacaagtgaggacgcccaactgagatgattgagtgacttgctaaggtcacagag

SEQ ID NO: 6857208 - DNA, 60 bp, Homo sapiens
gtgtgtgtttgcgtgcatgtgtgtgtgcccgtacatgcacaaagcattctagacgcaaac

SEQ ID NO: 6857209 - DNA, 66 bp, Homo sapiens
acattgttgacattttgtcatattgacattttgtgtgtgtgtgtgaggagatgtcctgtgcattgt

SEQ ID NO: 6857210 - DNA, 95 bp, Homo sapiens
aggtctgggaggatagtgaggtgaggctgttgagccccagcaagtctcttttagggactctgcttgcccaatggaaacctactgcccccaaactt

SEQ ID NO: 6857211 - DNA, 72 bp, Homo sapiens
gctgccaggccaggccctcaggcaagggctctgaagtcagggtcacctgcttgccagggccgatcttggtgc

SEQ ID NO: 6857212 - DNA, 103 bp, Homo sapiens
gcggaggtgggaggtgttgggtccatggcagagcccttctgctgggttcctatctgagagcaggcagagggtcctgtgccagcagacgctcttcctcctctgc

SEQ ID NO: 6857213 - DNA, 68 bp, Homo sapiens
tatgttaatcatgaacatcagtaaggaagtgatttattccatcttcttgccttatgccatgaagcata

SEQ ID NO: 6857214 - DNA, 58 bp, Homo sapiens
tctcagtgactgctgggtccccaccctgttcaggactggatttcagcagacacagaga

SEQ ID NO: 6857215 - DNA, 66 bp, Homo sapiens
agtgccctggcttcagctttggctggatcagtaaagagccaagtcaaagatcaagtcagggaaact

SEQ ID NO: 6857216 - DNA, 60 bp, Homo sapiens
ccatttattgatgctacttctatagatacattttactgaggtacagcaccagtgaatagg

SEQ ID NO: 6857217 - DNA, 79 bp, Homo sapiens
gcggtgatgcctccagctaggaagtccttggcgaaggagatggcttgttccgtcatggtggcctggcgggcagcggagc

SEQ ID NO: 6857218 - DNA, 71 bp, Homo sapiens
tgcctcttctcccatctccaggcaggtgtatgcctcacactgcctaggaaaagaatggaaacagaaatgca

SEQ ID NO: 6857219 - DNA, 86 bp, Homo sapiens
tcagtggccttgtgcagctagccatgtggctcctgtgggtgtatgtgcggcttggcaggggctgtggcatgggagcaggggcctgg

SEQ ID NO: 6857220 - DNA, 101 bp, Homo sapiens
taggtcctggcaggccccatggtcactcctgagccctggggtcagtgtgggaggccacacagtaccccaaggctgggctcctgggagtcagccccgaccta

SEQ ID NO: 6857221 - DNA, 75 bp, Homo sapiens
ggccaagcatgtcttcttaagcaattttccactcaaccagttggggtcactgttgtcaggtaaaacagtatggcc

SEQ ID NO: 6857222 - DNA, 59 bp, Homo sapiens
aggatttgaacctaggcaatcatgagaatggaagtccatgaagccaggatcacgattct

SEQ ID NO: 6857223 - DNA, 59 bp, Homo sapiens
cccttctctcctccactgcgtttggggccatttgttttaaaagtggagagagaagctgg

SEQ ID NO: 6857224 - DNA, 84 bp, Homo sapiens
gattatataaatactgttggttatctgaattggctttacactgaatatacattaactcagagaactggcatgtttagaatggtc

SEQ ID NO: 6857225 - DNA, 65 bp, Homo sapiens
cagattactgggcctcatccccagagtttcatattgaataggtctgaagtgggcccacaaatctg

SEQ ID NO: 6857226 - DNA, 98 bp, Homo sapiens
ggctccttcctcctcgtgactcacctgggcctcacccagctcttgcctgcctgcgggatcatgggtgaggcccatgggtttcgggggcttccccagcc

SEQ ID NO: 6857227 - DNA, 97 bp, Homo sapiens
gagccagcagcccacagttaattctcacttggatatcactcagaaagatactctgaataactttctggtatgtctagcaactgggggctaataactc

SEQ ID NO: 6857228 - DNA, 64 bp, Homo sapiens
tgtgtctcctttccctgtctaaggctctaaaatatttatgaaggcacagagggagggagacaca

SEQ ID NO: 6857229 - DNA, 57 bp, Homo sapiens
gctgcaggttgggcaacagagtgtgtgtggagaggctttgaaggaccggcctggggc

SEQ ID NO: 6857230 - DNA, 61 bp, Homo sapiens
aagcataaaatggtaaacgaagctgaagatcgttttcagttgaaaaggcaattttatgctt

SEQ ID NO: 6857231 - DNA, 84 bp, Homo sapiens
tcctgagggaggctttcatttgctcatctcccactagtgaggccatgccttattgggatgagaggatgcagtttcatttcaaga

SEQ ID NO: 6857232 - DNA, 63 bp, Homo sapiens
acagcttcttggcttgggctcttgaaatctagaagtctttgggactgaaagcgaagaatttgt

SEQ ID NO: 6857233 - DNA, 65 bp, Homo sapiens
gctgaaagagtggtggccgtggtgtcacgagaagacttggaatcgcagctgtgccacttagtagc

SEQ ID NO: 6857234 - DNA, 59 bp, Homo sapiens
tcagtgtgcttattgatatagcttaaaacacttaatacaagctggtcttaagtaactga

SEQ ID NO: 6857235 - DNA, 72 bp, Homo sapiens
cttctgtgaggtacctgggatcgtcaaactcagagacagagtagaaaggaggtttccaggtgctgtggggag

SEQ ID NO: 6857236 - DNA, 92 bp, Homo sapiens
gcttgttgagcaggtacaatgcactagggactgtgtgagggacttgatgtatattagctcttttaatccttaggacagccctgtgaacaggc

SEQ ID NO: 6857237 - DNA, 85 bp, Homo sapiens
cttagtgtctcctgcctggggacaaaggagggcatatctaatgatccttctacttgtttgtcctgtcccatgccagagcactgag

SEQ ID NO: 6857238 - DNA, 69 bp, Homo sapiens
gaggctctttcccaaggaaatgaagctgatgttggtgatagcctggagcatttctttcattccagcctc

SEQ ID NO: 6857239 - DNA, 75 bp, Homo sapiens
ggattctatgtttatctgtatttctgtaccttcagttttatatctgatagagaattacagaagaatgtcaaatcc

SEQ ID NO: 6857240 - DNA, 85 bp, Homo sapiens
aaagcaacatagtgtgaatcagcctgtcagttccattccaaagcgacagcttgggaagaacaggtttattttcctatgttgtttt

SEQ ID NO: 6857241 - DNA, 79 bp, Homo sapiens
gtggtctcttatgggcaggagcacagacttcagccaaaataaaactatgaataccattgtgtctctgtcccaagatcat

SEQ ID NO: 6857242 - DNA, 73 bp, Homo sapiens
cagcacagggcagggccacaccccctgcttccccctccaggagagtcaggacatgctggccgctgctccgctg

SEQ ID NO: 6857243 - DNA, 58 bp, Homo sapiens
ttaccagctgctgcctgtgggtcgggcctttaattagctcacatctggcagctgatga

SEQ ID NO: 6857244 - DNA, 57 bp, Homo sapiens
agatcagaaatgtaatggcagtgccttcaaagaacatagtgccgtatattctgttct

SEQ ID NO: 6857245 - DNA, 63 bp, Homo sapiens
agacttcattgggttttatactggctttctttttggtagtccactgaagaatccagggagttt

SEQ ID NO: 6857246 - DNA, 66 bp, Homo sapiens
gtgtctgtcttttgtctttgaaatgctgctactgaagtggcactttcaaaagagaagtcatgacac

SEQ ID NO: 6857247 - DNA, 88 bp, Homo sapiens
ttcctcactactcaggatgtcggtgactattgatttttatttcataaagaatttacggtagtaataccaatataaatgacttcgggaa

SEQ ID NO: 6857248 - DNA, 78 bp, Homo sapiens
aaactctagtccttgcagctctgtatgctgattatttgacctcagaggatctaggaaacagggctgaaactcaggttt

SEQ ID NO: 6857249 - DNA, 81 bp, Homo sapiens
ggcatttattagcatgaaagcataggacagtcatacatcccagtgccaggcttccatccttttaagtgctccaagagtgcc

SEQ ID NO: 6857250 - DNA, 86 bp, Homo sapiens
tgggaaatatgcccaagattcttacatcatgccaagacccttgaaaagggtggtaccatgggtgaaataaggggtaaaattatcca

SEQ ID NO: 6857251 - DNA, 71 bp, Homo sapiens
tcagtgcaggtgaagatttaagcatctcaattgtagattagcacgtattgagaaattaatctgcccactga

SEQ ID NO: 6857252 - DNA, 56 bp, Homo sapiens
gaggcatgaatgcagtgtccttttccaggaaatgtgtggtgctgacatcatgcttt

SEQ ID NO: 6857253 - DNA, 61 bp, Homo sapiens
ttttgctagttgttgagtatacccatttcagtttacactctgatactgagcaacaggagaa

SEQ ID NO: 6857254 - DNA, 78 bp, Homo sapiens
gtcctaattgagttctgtgtaaaggggttaccatatgcttttttcaggtggcaagcagttacccaggattcgttggat

SEQ ID NO: 6857255 - DNA, 78 bp, Homo sapiens
tgcttttttcttatttacttatttctcagaaattatagaagctttaaaaatgcagatctttgagaaatgggaaaagca

SEQ ID NO: 6857256 - DNA, 63 bp, Homo sapiens
gtaggaattgtgggggaaaaaatgcaatcaacaaaagcctcttcttccctcaggatgtcctgc

SEQ ID NO: 6857257 - DNA, 70 bp, Homo sapiens
agagaagttcagtggaggctcaagtgtgcttttataggagagtacagagcaaattccacctatcttctct

SEQ ID NO: 6857258 - DNA, 67 bp, Homo sapiens
gtcaggaatgctctggaaaaacatcctgcatttggaaggaaattggaccacatgagctctttctgac

SEQ ID NO: 6857259 - DNA, 81 bp, Homo sapiens
cctttccgataaattctggagaaaattctgtcattcttccatgagatttgatgagtatttctccagtcatttcaaatgagg

SEQ ID NO: 6857260 - DNA, 65 bp, Homo sapiens
agtcacacaagataggcttttgggctttcagggaggtgtgggggcttcttgcctgtcttggtgct

SEQ ID NO: 6857261 - DNA, 59 bp, Homo sapiens
cttccttggcttctggggtgtgcacacaagcactggaccaaggatgaggctcaaggagg

SEQ ID NO: 6857262 - DNA, 57 bp, Homo sapiens
ggacatctcttgccagggctgcaatcctttattaggctaattatggaaagagagtcc

SEQ ID NO: 6857263 - DNA, 56 bp, Homo sapiens
agctagtgttttctaatatgtttattaatttgtttgtatcagatcaaatactggct

SEQ ID NO: 6857264 - DNA, 68 bp, Homo sapiens
ggcatgagaaggcctggcctcaaccaaaaacagtgcaaattctgggtagaactctggtcttctcatcc

SEQ ID NO: 6857265 - DNA, 57 bp, Homo sapiens
tcatccatctttgatttcatagtaagacttgcttaatgtgtgagtcatcatgggtga

SEQ ID NO: 6857266 - DNA, 63 bp, Homo sapiens
ccttctagcctgcgccagggcagaccccttgctcaccccgtccttggtgctctgctgggatgg

SEQ ID NO: 6857267 - DNA, 68 bp, Homo sapiens
ctgtgtggcttctcatcttccacccacagcttcagaattgggcaaaggttctaagggaagccatgcag

SEQ ID NO: 6857268 - DNA, 62 bp, Homo sapiens
tggtgcttcacagcatgagctttggagttaagccaacttcagttgtaatcctggatccacca

SEQ ID NO: 6857269 - DNA, 66 bp, Homo sapiens
ggtgacctcccgtggcctgaggtgttcatacgtggagtggtggacaccgcagccatgaaagggact

SEQ ID NO: 6857270 - DNA, 129 bp, Homo sapiens
aatattatttttactgattgagatgcacacaatttatctgcattctgaccatctgttactatagacagaatttgtcagataaatttgtgttgaaaattaagcaaattatcagtactttaaggttatgtt

SEQ ID NO: 6857271 - DNA, 65 bp, Homo sapiens
ggccaggaggggacagggctgtgtcgccccatgtgggtggggctgggctgtgcccttccgtggcc

SEQ ID NO: 6857272 - DNA, 58 bp, Homo sapiens
ctatagaccaggagaaatggtgagtttctgtttcattctcattgtttcttctctgtgg

SEQ ID NO: 6857273 - DNA, 55 bp, Homo sapiens
gggcattgcagacccttactgctagagcgtctcaggcacctggtctgcaaagcct

SEQ ID NO: 6857274 - DNA, 94 bp, Homo sapiens
actgaggaggcactgcaagtttagctaactggcccaaggtcacacagctggtagatggtggggctgagacttgaacccagtctgcctccacagt

SEQ ID NO: 6857275 - DNA, 66 bp, Homo sapiens
ggagaggctcaggtctcaggtctggctactgaaactggaggtttttcctgctgacttgggtctcct

SEQ ID NO: 6857276 - DNA, 78 bp, Homo sapiens
acctatagagagatctctaagctctgggttatgcagcccacactgcccagaggtgcttcagaggtgcttcctatttgt

SEQ ID NO: 6857277 - DNA, 56 bp, Homo sapiens
ggagaatggcaggcagtatctaggacctcattaaagggtctgtccttccattcttc

SEQ ID NO: 6857278 - DNA, 58 bp, Homo sapiens
aaaatgacattccagtgatatttccatatctctaaacatcacttggaatgtgcgtttt

SEQ ID NO: 6857279 - DNA, 57 bp, Homo sapiens
gttgggcgtggttttctgtgtctgcgcttactattcgtcggctcaggctatcctaac

SEQ ID NO: 6857280 - DNA, 68 bp, Homo sapiens
tccattgcctggaaagcactgacaatgtggtagctttcatcactgctgcagttttgccaggcaatgga

SEQ ID NO: 6857281 - DNA, 62 bp, Homo sapiens
tatgcagagcatgactgtaccagctttgtacaggcctggtgactttcttatgtctctgcatg

SEQ ID NO: 6857282 - DNA, 55 bp, Homo sapiens
gggtctgaggagtaccattgtcctatagatgttagacagctgtggccttgcaccc

SEQ ID NO: 6857283 - DNA, 78 bp, Homo sapiens
acaggtctggttggcctctcccaaatggctttgggtgaccctatccccctggctgcaggcagaggctgtctggcctgt

SEQ ID NO: 6857284 - DNA, 101 bp, Homo sapiens
ttggtgcttgagccagatgaggcagcctatggggagctcagggccatggtgctggacctgagggccttctatgctgagctttatcatatcatcagcagcaa

SEQ ID NO: 6857285 - DNA, 68 bp, Homo sapiens
gtctccttttcctactcatactataccttcctgtacctgggtggatggagcgggaggatggaggagac

SEQ ID NO: 6857286 - DNA, 55 bp, Homo sapiens
gtttcctctcgcccctgggtttttggagcacccgggttgaggggccaggggagat

SEQ ID NO: 6857287 - DNA, 64 bp, Homo sapiens
caggccaataaatgtgatggcctttttttacaatgctctttatgaagtccttacccctggcctg

SEQ ID NO: 6857288 - DNA, 73 bp, Homo sapiens
acagttgcagaggcctcaaaccagacctgatgattcagaatctcagatgctagggctgagctatttgcatagt

SEQ ID NO: 6857289 - DNA, 62 bp, Homo sapiens
ccgttattttcttcttaaaaaaacctttttaaaggaaggtgtgaagagatgggaagagatgg

SEQ ID NO: 6857290 - DNA, 77 bp, Homo sapiens
ctgaaattcaccatcctttctagaaattagagataaagctctataatggaaagtggatgtgatttgtgcttttgtag

SEQ ID NO: 6857291 - DNA, 67 bp, Homo sapiens
acaatatacacatcctaatgggaggtaaacgtggtataatatccgatattacgatgtgttatattgt

SEQ ID NO: 6857292 - DNA, 85 bp, Homo sapiens
cccaggctgggatggagccactgtctgcacccgaggaggcctccagagcaggaggcgggagcagcagctctgagcccggcttggg

SEQ ID NO: 6857293 - DNA, 94 bp, Homo sapiens
aatcttttcattttctgaataactctatgatatagactgttattatccccattttgcagatattaaaactatggttttcagagagtttaagatt

SEQ ID NO: 6857294 - DNA, 55 bp, Homo sapiens
ttctcagggtttgtgcaggcttgcgtattagtaaaagtttgaaaattcttgagag

SEQ ID NO: 6857295 - DNA, 67 bp, Homo sapiens
ctaattatgttgttataatcaagatttttgcacaatttgtgttttattgatgatgacgccaaattag

SEQ ID NO: 6857296 - DNA, 75 bp, Homo sapiens
tcagctcgagcggcgtgaacctgcagagcatggattcgtccacgtctccttgctgcagttcaccctgccgtctga

SEQ ID NO: 6857297 - DNA, 81 bp, Homo sapiens
gaaaatcagatttgcttcagcctcagagcacatttatgtaaaattaaatgagagctgacagtaagctgcacatttgttttc

SEQ ID NO: 6857298 - DNA, 130 bp, Homo sapiens
ctctagctcttgaccttgggcaagtcactgtccctgtctgaactgtttcctcaactgtcaaatgggggagtaaatgccttccccacagcttgtggagagaatgcagtgggctcatggttggtggcaagag

SEQ ID NO: 6857299 - DNA, 55 bp, Homo sapiens
tgcagatgagagggagtttttaggacccagttccagcaatttttcctcctctgca

SEQ ID NO: 6857300 - DNA, 57 bp, Homo sapiens
acagcgtgagcttcatgaaggtagaggaggattctatctgtatttgttcactgctgt

SEQ ID NO: 6857301 - DNA, 65 bp, Homo sapiens
gctcaggtgttatacatgaaatttacttgggtgggttgctgagtgacacctcaaagacaacgggc

SEQ ID NO: 6857302 - DNA, 81 bp, Homo sapiens
cgcagtgccacctcgcggccgccttcagaagtgcatgctgcgatctggcgctctgagaagccctgtggggaggtacctgcg

SEQ ID NO: 6857303 - DNA, 129 bp, Homo sapiens
gcacatttagtggtttgctgatagcaggtatttaggaggctgatctgggccatgctggaaccacctggcctggcagatggctgcagtatattttagagaagtccctaagtgtgcctcagtacacactgc

SEQ ID NO: 6857304 - DNA, 100 bp, Homo sapiens
gaggcaggagaattgcttgaaccctggaggcggagggttgcggtgagccgagattgcatcactgcactccagcctgggtgacagagcgagactccgtctc

SEQ ID NO: 6857305 - DNA, 78 bp, Homo sapiens
gtcatggccagtatgaagaagacaaatgacactcctcacgtgtctgtggagaggtcctgtctatcaccctcgccagat

SEQ ID NO: 6857306 - DNA, 55 bp, Homo sapiens
tcccagcacctgatgaagtaggactgcaactatccccacttcccagatgagggga

SEQ ID NO: 6857307 - DNA, 72 bp, Homo sapiens
tttttaacatgcagtatgtttattggaataaattcaattttattgaaagataggctactgtggtgttagagg

SEQ ID NO: 6857308 - DNA, 88 bp, Homo sapiens
ttctgtaaatgccctcatgccagggtgcggcccggctgtcagcacgagagggacgttggtctgtcccctggcaccgagtcagtcagaa

SEQ ID NO: 6857309 - DNA, 77 bp, Homo sapiens
tatgtagcaatagcatcatactgggccccacaggagcagcctgacagtatgatttggctattattcctggctgcatg

SEQ ID NO: 6857310 - DNA, 60 bp, Homo sapiens
cactcctctggtgagcagacagttatcgaatccatctctgtgaatgcttgttatggagtg

SEQ ID NO: 6857311 - DNA, 72 bp, Homo sapiens
tcagaaatggtttgctagtctgatctatgatcctactgttagaaaaggcattttgtcaaccataatttttga

SEQ ID NO: 6857312 - DNA, 59 bp, Homo sapiens
ggctagtaagaaagaccaagctctgagctcaaaagctcataaggtcttgatttactgcc

SEQ ID NO: 6857313 - DNA, 98 bp, Homo sapiens
ggtggaaactttggaggcttagtgtatagaaggtccagattggaaggagtcatcagattccgggaaatttacctctaaacaggagcccaccctccacc

SEQ ID NO: 6857314 - DNA, 66 bp, Homo sapiens
attgttaaactctcaacagagaaccacgtgtaggacagcgtggtcttgcaggtgagagtagatggt

SEQ ID NO: 6857315 - DNA, 130 bp, Homo sapiens
gattaactatggtccactaactatctgaatgaacatacaagaagctgtttgcagtggatggagactgagtagttccatcacatcactgaagacagaagattttattctgattaattttccattgtaaatt

SEQ ID NO: 6857316 - DNA, 56 bp, Homo sapiens
gttccagtggaataacttggggtcacgatttggccagtggtgagattccctgggac

SEQ ID NO: 6857317 - DNA, 56 bp, Homo sapiens
cctgctggcgtggctggcgcccacgttggcgtcctctgaaagccccgccaggtagg

SEQ ID NO: 6857318 - DNA, 103 bp, Homo sapiens
ttgtcagagtttatcaattatagaacagcctcctctagaggaatataaagcactgccaaatcctctgagatttaggctgttgctggtagtagtactctggcaa

SEQ ID NO: 6857319 - DNA, 88 bp, Homo sapiens
aagtattcgtaggcaaaaggtggctttcatttcaggatgtgttacatgggctttcttgaaatgcaagcccattggcctgatgaatctt

SEQ ID NO: 6857320 - DNA, 93 bp, Homo sapiens
cttcctcatgtcacttcctggattcccaagggctgaggggaccccacagagagaagagaaccccgagtctgggggtcaaggagcctgagggag

SEQ ID NO: 6857321 - DNA, 79 bp, Homo sapiens
gaagaagttgctggcaggtttggtgtctggtgagggccactttccaggttcacagacgccgacttgttgttttgtcttc

SEQ ID NO: 6857322 - DNA, 72 bp, Homo sapiens
ttcttaattctctctagaagctgagatggggcaagggattgcactatgtacatggagagcaattgaatagaa

SEQ ID NO: 6857323 - DNA, 69 bp, Homo sapiens
gaaattgtaaaggattgcgccaattcttaacatcattggttattctgcgatgcaatcctggtatatttc

SEQ ID NO: 6857324 - DNA, 63 bp, Homo sapiens
ttcctttcctcttattttcccagtgatgtcttctgagatatgacaggcccaggagaaaaggga

SEQ ID NO: 6857325 - DNA, 57 bp, Homo sapiens
ctgcctgtttcctcttgctccccaggctggctgagcacctgcggaggatcagagcgg

SEQ ID NO: 6857326 - DNA, 112 bp, Homo sapiens
cagaatgtttactagattctcatggctcattattggacacttcttctgcacacattctacagcatcttgtgtggaagattcttcaatctgtagaaattaggaaacagcactg

SEQ ID NO: 6857327 - DNA, 82 bp, Homo sapiens
ggttaggtttgagtcccttttaaaactgtcagtaggagacaccctacggagtatttacaagaggaaaataagatttatcgcc

SEQ ID NO: 6857328 - DNA, 87 bp, Homo sapiens
cagctttcagagcaacttgtgggtgtccatgattaagtactggttagtgattcatcctggcattcatttatgggcttatgatggctg

SEQ ID NO: 6857329 - DNA, 56 bp, Homo sapiens
tctggtgattttctgtcagtctttggcattccttggcttatagaaacatcaccaga

SEQ ID NO: 6857330 - DNA, 93 bp, Homo sapiens
ggacctgtgctgtctgtttgctctggggtctgggcagtcctgttgtttgggtagaggcctcagagggccctagggacagactgacccaggtct

SEQ ID NO: 6857331 - DNA, 56 bp, Homo sapiens
ggtggctctccctggactcagctcaggatcagctttttagaatggggagggccgct

SEQ ID NO: 6857332 - DNA, 65 bp, Homo sapiens
agctggggaagatggccctccatgtgtccaccattactgtgatacctgtttctgtcatccccact

SEQ ID NO: 6857333 - DNA, 60 bp, Homo sapiens
tccgtttgcctgtttcgctgatgtgcattcaactcattctcagcaaaataagcaaatgga

SEQ ID NO: 6857334 - DNA, 57 bp, Homo sapiens
agagcagggtgttacaggactgaactcagctttatttcagctgagcatccgtgctct

SEQ ID NO: 6857335 - DNA, 64 bp, Homo sapiens
gaatgaaagtgccatatgttattgctattgtcagtagtagcaacagcaatagtggtattggttc

SEQ ID NO: 6857336 - DNA, 76 bp, Homo sapiens
atggtgaagtacttctctcctgatggctgaactgtggctcggggctgcatgtagaccaggagggacatttcagcat

SEQ ID NO: 6857337 - DNA, 66 bp, Homo sapiens
gtcgtgtgggtcatattataaatgttctgttcttaatgaatctgtatgttagtatgacattatgat

SEQ ID NO: 6857338 - DNA, 60 bp, Homo sapiens
agaggaatagggctattcaggagcctgaaggtctccttaaattacgaacccactttcttt

SEQ ID NO: 6857339 - DNA, 97 bp, Homo sapiens
aggtcagtgatactatgctcccttcacccagttatgcccagttacactgacctggtatcctggataactggtgtgagtaagctggtccaatgctcct

SEQ ID NO: 6857340 - DNA, 70 bp, Homo sapiens
tccccagggcagcgcccctccacgccactgttccgagaacctgcgcaggaggtggtggctgctccaggga

SEQ ID NO: 6857341 - DNA, 119 bp, Homo sapiens
tgaagaaacagttcaaagaaactattgcttagactatagctcacagtgcttcaggtgaatgcaactagtaattggaagtagtgagactatggactaacgctttcattgtaagcccttcg

SEQ ID NO: 6857342 - DNA, 72 bp, Homo sapiens
tgtaccctaacacccttcagctttcttagctcagaggcattttgaggtatggatatctggagaggaagtaca

SEQ ID NO: 6857343 - DNA, 58 bp, Homo sapiens
cagatacgcagacccgggtgtgagttcaggctctgctgctccctggctgtgtgacctg

SEQ ID NO: 6857344 - DNA, 55 bp, Homo sapiens
tgcatgtgtcgggcctgtgctagatcctggggttgcagcacagacaagaccagca

SEQ ID NO: 6857345 - DNA, 81 bp, Homo sapiens
atataatggcactcctcagaaacagtccacggaaatccagattttcgcagtggcttgtgtgggaagtgcagactattgtgt

SEQ ID NO: 6857346 - DNA, 96 bp, Homo sapiens
gccagcttgtctcctctgctctgtggctatcatactgaaggctttgcaagccttgggtgcaccatagctggagagttgggaataaaagcctttggc

SEQ ID NO: 6857347 - DNA, 99 bp, Homo sapiens
gaggcaggaggctcgcttgaactcgggaggcggaggttgcagtgagccgagatcgcatcactgcactccagcctgggcgacagagcgagactcagtttc

SEQ ID NO: 6857348 - DNA, 59 bp, Homo sapiens
gcaataatttttacatgaaataatgactgtttcagttattcagcagtgggatttgttgt

SEQ ID NO: 6857349 - DNA, 129 bp, Homo sapiens
ccccagcctttatctttgtgtgcaattgatttgtgctaatcctggaatgagtttgctgattggaagccttgtcctcagtagtctaggatttcaccttcaaccctgtcaccatctggctggactgtgtgg

SEQ ID NO: 6857350 - DNA, 77 bp, Homo sapiens
agaggaaagaggagagaagagaaatattcacattctgggtttaatgagaatgaatcttttgctttcccagcaactct

SEQ ID NO: 6857351 - DNA, 63 bp, Homo sapiens
cagagacagcacagttggtaaaattgttatagttgacaagttggaaagcagtgcatgtctctg

SEQ ID NO: 6857352 - DNA, 64 bp, Homo sapiens
tggtgttaattcagatcatatttatagctttctttggtaagctgcatttgagtctgaataccca

SEQ ID NO: 6857353 - DNA, 83 bp, Homo sapiens
gccgtatgccagctctggtccagggagggcaccacctgctggctagactgagttccttcccaccccagggcggggcctacggc

SEQ ID NO: 6857354 - DNA, 84 bp, Homo sapiens
agaaactgagcggtggggaggcttttggagctcctgctaatgttagcagactgtagggctgaggctaccactggtctgatttct

SEQ ID NO: 6857355 - DNA, 80 bp, Homo sapiens
gtgagtccctagtggaaagacatgatctaaatggcaaacatctttcttcaaaatgactgtgctttctctggaggcatcat

SEQ ID NO: 6857356 - DNA, 57 bp, Homo sapiens
atgtcagcccaagccctgtgcccaattcaaaaatggtcacagggcttggcctgacat

SEQ ID NO: 6857357 - DNA, 85 bp, Homo sapiens
tgggcagagaggatggaaccctgatttctccattgctgcttgccactggggaaaagcgttaggagttcagtgccctttgtgttca

SEQ ID NO: 6857358 - DNA, 82 bp, Homo sapiens
cacaaaccaggctttcaggaaggagtttggcacatgtatgcactggtaggaggtgtaatgtgcagaaatccggccttttgtg

SEQ ID NO: 6857359 - DNA, 81 bp, Homo sapiens
cctgccattgcctttttctccagtcctttaagcatctctagaatctggaggtttatgccttggagctggggcaatggcggg

SEQ ID NO: 6857360 - DNA, 60 bp, Homo sapiens
gaggcagccagaggttctcatttggaaagctgaatggtgattgcttctgagcagagcctc

SEQ ID NO: 6857361 - DNA, 73 bp, Homo sapiens
ggctgtgccctcacatggggcaggagcagaacacaacagggccatgagctcagcggtgccaggaggcgcagcc

SEQ ID NO: 6857362 - DNA, 71 bp, Homo sapiens
ggtgaatggtcaagttaactgcctctcagcccttctgtctcagaggctgtgaaggttaaagacgatgcatc

SEQ ID NO: 6857363 - DNA, 90 bp, Homo sapiens
gactctgcagagtggaaagagcctggggttagagttgggagccataaatatttcttagcaatttaactgactctaggttccatatgagtc

SEQ ID NO: 6857364 - DNA, 83 bp, Homo sapiens
ctgatgcctttgccacagattaggatctctcctaaggtccacccccgtttcagagcttctcatttgactggttgaggtctcag

SEQ ID NO: 6857365 - DNA, 97 bp, Homo sapiens
ccaagttgccccgagactcattggaattcagcttgcttataaacacctggaggttttgagattaggctgaggtctggggctcggggattttgcttgg

SEQ ID NO: 6857366 - DNA, 66 bp, Homo sapiens
ctagtggtaattctgtgagatggtgcagatgtaggatatttccaccggctcaggaagttctattgg

SEQ ID NO: 6857367 - DNA, 74 bp, Homo sapiens
agttgttaaaattacaaatttacaagtaagctacaaaaagtatgcttgtcttcaggattatggttttaataatt

SEQ ID NO: 6857368 - DNA, 66 bp, Homo sapiens
ttgcccctccaaggcactgagatttccttgtggaattctagcagatattggaaattttggtggcaa

SEQ ID NO: 6857369 - DNA, 66 bp, Homo sapiens
gcctggcagggcccggacggcagatgcgcttcggtgctgctgtgagtcttgtgctctgccttaggc

SEQ ID NO: 6857370 - DNA, 94 bp, Homo sapiens
tgaatacgattgagtggtatttgttgaatgaatcattatgctaattttaagtcaggatagatcacaatggttcactttcactattcagtattca

SEQ ID NO: 6857371 - DNA, 75 bp, Homo sapiens
ggacaatgaatccaggcagtgatccaccaatgataactaacatcataaaaagatacatggccggatatgatgttc

SEQ ID NO: 6857372 - DNA, 78 bp, Homo sapiens
catcagtgtggtcagtgtgacattttttaagttatttgcatttaatcttagaacatttcataatgttaccacttgatg

SEQ ID NO: 6857373 - DNA, 80 bp, Homo sapiens
gtattccacaacattcttaaatacactgaatttgcagtatgtctgtctcttcagtaagtataagaagtgttggtccatgc

SEQ ID NO: 6857374 - DNA, 129 bp, Homo sapiens
ttaagaattgatttagtgtaaagataatatagcaagattttgtttaggttatggatgctctctaaaaatgcataatacttgtttgcctaaaattttgattatgttttatcttattttgtcacagttaaa

SEQ ID NO: 6857375 - DNA, 59 bp, Homo sapiens
ccatctgtaggtgacacatgagtgatcaagcaggtgctcatttacagatttacagaagg

SEQ ID NO: 6857376 - DNA, 78 bp, Homo sapiens
gttgagattctggaggagaaagggtgggcgagtacaaaacgtatgccttctctttcccctctacccttctgttttaat

SEQ ID NO: 6857377 - DNA, 60 bp, Homo sapiens
gtattgtagttgcagtcagctgtcggctagagctgcagtcatctgagctaactactttac

SEQ ID NO: 6857378 - DNA, 58 bp, Homo sapiens
gacttacacactctgccctgctgttgtcaataacaataaaggggtggagggtgtggtt

SEQ ID NO: 6857379 - DNA, 66 bp, Homo sapiens
ataaatggcttctcagtttcataatgaaaggaatatttcattttgcagagctgaggaactgtttat

SEQ ID NO: 6857380 - DNA, 77 bp, Homo sapiens
cttcttctagtatgtgtcatattatgttaggttatgccatcagagataacaataagacacgctattactagaacagg

SEQ ID NO: 6857381 - DNA, 66 bp, Homo sapiens
tgtctttctataacactggctgtaataatttgaaactgtgtggccattttgtgttttggagaaaca

SEQ ID NO: 6857382 - DNA, 64 bp, Homo sapiens
ggaaggttttcctagggaagctgacaagccagatcttcctcccagcctcccacggattccttcc

SEQ ID NO: 6857383 - DNA, 58 bp, Homo sapiens
cttgatacattctgtgttctcagatcctcctggggtctgttttgcaacatgtgacaag

SEQ ID NO: 6857384 - DNA, 122 bp, Homo sapiens
aggtgaactgtggtatttctctggctccttaattagcactctgatgggtgacaggaggcccaactggatgtgttccatcagggctgcaggggagtcaagccaaaggattatgatgttcatct

SEQ ID NO: 6857385 - DNA, 95 bp, Homo sapiens
taccacagcataatctagtccatcacgactgatacaatgtctttctcttccaacagactgccagtgccgtgagggtagaagctatgtctgttgtg

SEQ ID NO: 6857386 - DNA, 61 bp, Homo sapiens
gcccagtaatagagtgccagggatggggacctcttccctccgaggtaagcctgtgccaggt

SEQ ID NO: 6857387 - DNA, 62 bp, Homo sapiens
attagtggcatagctcaaactggaattgaaatctgtttgagtcctaaagctgtgcccttaat

SEQ ID NO: 6857388 - DNA, 59 bp, Homo sapiens
gtagttgcttagcactgaagctttagaaaaatttaatcctttagtgaaaaggggctaac

SEQ ID NO: 6857389 - DNA, 89 bp, Homo sapiens
ttaccatttaggtcttcttaagagtcaatccagcaaataatgctctagggcaatttgatacttaaaatgatgagacctttccctggtga

SEQ ID NO: 6857390 - DNA, 84 bp, Homo sapiens
atggaggggaggagagaaagtgatggatatggatacatttaggagaatgtgtacaaccaagcactaaactctccttttctgcat

SEQ ID NO: 6857391 - DNA, 70 bp, Homo sapiens
gctgggttcctctggaggctctaggagagaattccctcctgaagcttttccagctgctagaggagcctgc

SEQ ID NO: 6857392 - DNA, 97 bp, Homo sapiens
gtgggtcacacagcatcatgggggatgagctggggctggagtcggctgtatctgacaccagaccctccattcaagctcccttgatgacaacgcccac

SEQ ID NO: 6857393 - DNA, 101 bp, Homo sapiens
gcgtggtgtttaggagcatgtaattctagctacttgggaggctaagacatgacagtagcttgaatgcaggaggcagaggttgcagcgaactgagatcatgc

SEQ ID NO: 6857394 - DNA, 70 bp, Homo sapiens
aacctgattctaatgtgctactaagataatgagaattcattaagagttatttgcacataatagaagggtt

SEQ ID NO: 6857395 - DNA, 65 bp, Homo sapiens
ggcatattataagttatttcaagttgcatcttattttaaatgaacttggatcagctttaaatgcc

SEQ ID NO: 6857396 - DNA, 70 bp, Homo sapiens
ctgaaagcccattaagtctgttaactggagaacctacacgtaacatctccaggtggcttgggcttctcag

SEQ ID NO: 6857397 - DNA, 69 bp, Homo sapiens
cttggggagctgtgcagtgactacagatagaaagatggggttcatcagagcaccacacagttccctggg

SEQ ID NO: 6857398 - DNA, 78 bp, Homo sapiens
ttaaattttattgtgtggctggctcctccctgggaaaaaagcctgttcacatgagttagccattccactgacatttga

SEQ ID NO: 6857399 - DNA, 91 bp, Homo sapiens
cagatgtcccctgacatttcatggccagaactgtatcacatgggttgcccccagttaaacgggccatgtgagtgtgtagtggggcacactg

SEQ ID NO: 6857400 - DNA, 130 bp, Homo sapiens
ggtacatgttatacaccacatagctttgctttttgtcacctctcttctaatcatctgtgagagttgataatatgaggcactgtcccaaaggctagtgcatgatgtagaaacaatgagagatccatgtagc

SEQ ID NO: 6857401 - DNA, 114 bp, Homo sapiens
gaagcattagaggaaggctgtctgagggctctgaactggaagtaaatgcatgcggttctgctaagctaattccatttccggtctcagtctctcaacaccaattctttcagcttc

SEQ ID NO: 6857402 - DNA, 75 bp, Homo sapiens
cgtggttttgttagaatgtagtgcttcaagatttatttccactaaaatcttaaagaatattctaccagagtcttg

SEQ ID NO: 6857403 - DNA, 59 bp, Homo sapiens
gggcagctggccaggtattctgggctgtccccaagggagccaggggccagctatttccc

SEQ ID NO: 6857404 - DNA, 100 bp, Homo sapiens
gtcaaaagtaaaggccctaatgatgctcataggcagaaatgctccctattcaataaaatagagctagtttctgcttacatttaagttcctaacttaagac

SEQ ID NO: 6857405 - DNA, 72 bp, Homo sapiens
gtgaggcttgcaccatgagcaccacattcattcagcatgcgctggctggtcccctccatggtgcaggctcac

SEQ ID NO: 6857406 - DNA, 64 bp, Homo sapiens
tcaaagtaccattatcagtggacacccactccacgtggcactactgtgagaatggaaaccttga

SEQ ID NO: 6857407 - DNA, 87 bp, Homo sapiens
gcacctctgccgtgggagttgcggccaggttctggcaggcaggggctctgcctgcactgcctggctccaggttccattctcaggtgc

SEQ ID NO: 6857408 - DNA, 56 bp, Homo sapiens
cctggatctttgttgtaaatatcaacctcaatggcaatttggagcagtggttcagg

SEQ ID NO: 6857409 - DNA, 75 bp, Homo sapiens
tgctgctttcagtgatgtcacattggcagcttgacatcagctgtgatggaaatattgacaccacagaaattggca

SEQ ID NO: 6857410 - DNA, 96 bp, Homo sapiens
ggggctgtcagtgctaacctcagagctctatgttcatggagggatgactcagttacatccccagatagctgggttctcggttggtcaataggcccc

SEQ ID NO: 6857411 - DNA, 81 bp, Homo sapiens
gcatttctgggataaatcttgtttagataaaaatatattttattatgctgaatttggtttgctattttttatctgaaatgc

SEQ ID NO: 6857412 - DNA, 84 bp, Homo sapiens
tgtttagctcatgctgaagagagaactactcagctcttggaaaatgctgagctgggtattcctgcctcttggctgagctaaata

SEQ ID NO: 6857413 - DNA, 59 bp, Homo sapiens
aaccacatgaaaagagtaatatgtgtttatagagtatatatatatgtatgcgtgtggtt

SEQ ID NO: 6857414 - DNA, 112 bp, Homo sapiens
gctcctgctgccctcctgctcagcagaggccccctccacccattctggggagtcagaatcctcatctgggtcctcagggggctgcaacagtcggggggcaggctctagaggc

SEQ ID NO: 6857415 - DNA, 68 bp, Homo sapiens
gccttctttcttaatagccaggaagtgttttagagtcatactctctggtgtagaaagaccttcaaggc

SEQ ID NO: 6857416 - DNA, 65 bp, Homo sapiens
ggctcacaatgtctaagatgtttctatctctgtgggcctagaaatctacttagactttctgagcc

SEQ ID NO: 6857417 - DNA, 79 bp, Homo sapiens
aggctggagtgcaatggcgtgatctcagctcactgcaagctccgcctcctgagttcatgccattctcctacctcagcct

SEQ ID NO: 6857418 - DNA, 57 bp, Homo sapiens
gtttcctttctattgccttgattttctctttaagtatgtcataaggagagaggaaat

SEQ ID NO: 6857419 - DNA, 71 bp, Homo sapiens
gcagctggcttcactgctcaagtgattatcctgaaccatccaggccaaatccctgttggcagtgcccctgt

SEQ ID NO: 6857420 - DNA, 82 bp, Homo sapiens
tcctattttatagacaaactgatacttggcgagttaatgtgatttgtccaaggtcccacagttagtaattataaaagcaggg

SEQ ID NO: 6857421 - DNA, 110 bp, Homo sapiens
gtgtgtagaaagttttgtcagtgcagatcaggacagtctcagcttgctgtctaattacaagttcatggtgctttcctgtctctgtgaagctgtcataccttcttacatat

SEQ ID NO: 6857422 - DNA, 58 bp, Homo sapiens
ggctgaaactcttttgcatattagaggcagaagtctctcttggcttaggagtgtagct

SEQ ID NO: 6857423 - DNA, 57 bp, Homo sapiens
tcagatccacacagcgtctcaggccccaactccgggtttctgggagagtgaatctga

SEQ ID NO: 6857424 - DNA, 85 bp, Homo sapiens
ctgacatcccctcaccaggtctgtacagcctggctctgagaggctctgtctgggtccgggactgtggatgtgtgtggggagtcag

SEQ ID NO: 6857425 - DNA, 61 bp, Homo sapiens
ctggtgtttggagttaccgctcttggggtccttcagagctgcgtctattcacaatcatcag

SEQ ID NO: 6857426 - DNA, 87 bp, Homo sapiens
gagcagttattgttgtacccattttgtcagtagggaatctaaggttcagagagaccaagtggcgtgtccaaaataatgattctgctt

SEQ ID NO: 6857427 - DNA, 70 bp, Homo sapiens
aaagctatcatgagtttttaagagtaaggacagtgtactatgtcttcttcatgtatactcatggtacttt

SEQ ID NO: 6857428 - DNA, 69 bp, Homo sapiens
cagagcactcttcctaggaagtcagacttcccaggaatcccttggtgctgagagcctaggagggctctg

SEQ ID NO: 6857429 - DNA, 62 bp, Homo sapiens
acattttgcccttatttgctgagccccaattcccacagggcaacatgatgagggtcaagtgt

SEQ ID NO: 6857430 - DNA, 79 bp, Homo sapiens
aattgttaccaaagcaggtaatgaatggaaagatactgtgttttcttaatgcccttctctatctgctctagtagcagtt

SEQ ID NO: 6857431 - DNA, 56 bp, Homo sapiens
ggccgggcaggtctcagccagcctgtccctcccacattcctgaaacctgcccagcc

SEQ ID NO: 6857432 - DNA, 97 bp, Homo sapiens
aggtgctatgaagaatgtgaattggtagctttctgtctctagattgaacagtggtgaccattcattcatttgttcaacaaacatctatttagcatct

SEQ ID NO: 6857433 - DNA, 66 bp, Homo sapiens
tcctgcctgcttctgagccagaggaaagaggaagatgacactcttctctgctccagagcagaggga

SEQ ID NO: 6857434 - DNA, 61 bp, Homo sapiens
ttattatggtatttctttgcagttgatgggtcctcagcaggcagaggaatggtatacataa

SEQ ID NO: 6857435 - DNA, 68 bp, Homo sapiens
ccatgcttggcactcaactgtcgttgttggatgaaacaattcagaaattgccagaatgtcaggcttgg

SEQ ID NO: 6857436 - DNA, 72 bp, Homo sapiens
tgtgttggcttattttgctgatgacccaggcattgtcatgtgcctctcatcctagtgaaaatgagtggcata

SEQ ID NO: 6857437 - DNA, 55 bp, Homo sapiens
tatggagattcaaaagcatcttgaatgatggcatttattatgcttcatctgcatg

SEQ ID NO: 6857438 - DNA, 70 bp, Homo sapiens
agaaatggttgctagctatgtctactttcactcttcctatatctgtggatcataaaattgcaccatttct

SEQ ID NO: 6857439 - DNA, 60 bp, Homo sapiens
cagttaactgagctctgtgagagtcccagggctgaattgtcgccagtggtttagtttctg

SEQ ID NO: 6857440 - DNA, 87 bp, Homo sapiens
aggctgtgagtttctttggaaggcaggcttctgattaggtgttgccaaaggctctgcctaaacgtttgttttctgttgatggagtct

SEQ ID NO: 6857441 - DNA, 83 bp, Homo sapiens
ggaacaggtaaaggttaactattagaatccacccagcacataataggatacagtgggatttgtggttcactttggccggttct

SEQ ID NO: 6857442 - DNA, 56 bp, Homo sapiens
ccgtctgccccagaccctgacccaggacccgcctggaggaagctggggtaagaagg

SEQ ID NO: 6857443 - DNA, 58 bp, Homo sapiens
cccagagctgagggggcacgttagtttatcatcgccttgtcaatccttctagcctggg

SEQ ID NO: 6857444 - DNA, 70 bp, Homo sapiens
tatcaatgtccgggccccattccagtcaaacagggtgagaatttcttggaaggaggcccaggcatccata

SEQ ID NO: 6857445 - DNA, 60 bp, Homo sapiens
tagagcctggagttgtaacttaggccacatctttctctccagtcccaacattcagctctg

SEQ ID NO: 6857446 - DNA, 62 bp, Homo sapiens
gccatccagaccgtgccatgctgccatttggcgtaaggcctctggtctcggaattccctggc

SEQ ID NO: 6857447 - DNA, 74 bp, Homo sapiens
ggcctcaaaacttcacacagcaaatttatctagcagtggcatgcagggtaggttgagggttgagcaaggaggtc

SEQ ID NO: 6857448 - DNA, 60 bp, Homo sapiens
gtctctgaagtcagtttttctagtcatttcttgagaggcagtgagtgtgacttcacagac

SEQ ID NO: 6857449 - DNA, 108 bp, Homo sapiens
ggtcgccgccgcagcctccgccgccgccgcagccgctgccgccaccgccgccgccactgtcgctgctgtcgccacggtcgccgctgccgccgggccgctgccgcgacc

SEQ ID NO: 6857450 - DNA, 124 bp, Homo sapiens
tcccgacctcaggtgatttgccctcctcaacctcccaaagtgctaggattacaggcgtgagccaccacgcctggcaattttttgtatttttagtagagacggggttctgccatgttggccggga

SEQ ID NO: 6857451 - DNA, 61 bp, Homo sapiens
acagggaggctgaatgatgggcagggagttctgctccccctcggggcctcagtttccctgt

SEQ ID NO: 6857452 - DNA, 72 bp, Homo sapiens
ggctagtagtagccaggaataggtcagctaccgaggtgagcggtacctagttggtcttcttggatctcagcc

SEQ ID NO: 6857453 - DNA, 98 bp, Homo sapiens
gccaattccaaataagagactctaagtggtcagggttgttactgtgtgaggcagcctggcagtaatacccctggctcaggttggggcctcatggtggc

SEQ ID NO: 6857454 - DNA, 122 bp, Homo sapiens
tggtggggagtatttgggattcgggcatttggaatgggagcctggcattgttgggaggagcagcagcgttaggttactttccaaacacccctagagtttaattgccttgatttcttccccta

SEQ ID NO: 6857455 - DNA, 62 bp, Homo sapiens
ctacaacataacgggcattcagtaaatattcatttgtatctagtgagcttgcatgtgtgtgg

SEQ ID NO: 6857456 - DNA, 56 bp, Homo sapiens
aattccagggggtaccattcatattgtagtctacaggaatggcttcctctgaagtt

SEQ ID NO: 6857457 - DNA, 67 bp, Homo sapiens
catatgatgtatgactgtgttcaaactacagtggtagagtttgaatagttgcaacataaatcatatg

SEQ ID NO: 6857458 - DNA, 127 bp, Homo sapiens
tcttatatataactataaactttcctgaggaatgggtgataaattcaaacatagagtttcaagatccaattcaaatgtaaattcttttgaagccccctcagggaaagctattagtttgatcttggga

SEQ ID NO: 6857459 - DNA, 71 bp, Homo sapiens
gtggaggctttcaaagaccttggcatgggggcccaccttcttgctttacaatttttgaaaccaaactccat

SEQ ID NO: 6857460 - DNA, 66 bp, Homo sapiens
acaaatgtctacattgagaataatgcagtaaagaaaaggatgcacttcttaatatgagatatgtgt

SEQ ID NO: 6857461 - DNA, 87 bp, Homo sapiens
agctttggtcctaggtgaagggcaggcttattccttcttttgggaatagggaataacctgtgcccttcaaataagggtccctaagct

SEQ ID NO: 6857462 - DNA, 76 bp, Homo sapiens
agaggttgctctgtgcactgtagcatgtttagcagcatccctggtgtctaccttctatatgccagtggcaccctct

SEQ ID NO: 6857463 - DNA, 74 bp, Homo sapiens
gcttaaaggagacatatctacagacagggtttgagcctagtaatggtgagaactttcttggatgtctcaacagc

SEQ ID NO: 6857464 - DNA, 59 bp, Homo sapiens
tctaagccagaactagtgattggcctaggctcggtcaagtgcctccttctaggttaaga

SEQ ID NO: 6857465 - DNA, 65 bp, Homo sapiens
gtgcctctcattggctgagcccggctgaaagccagagagcaggggcacagctgatgcagacacac

SEQ ID NO: 6857466 - DNA, 63 bp, Homo sapiens
caagagcatccctgcatccagccatcacagtgtgaagtgagtttcagatgaggagatgccttg

SEQ ID NO: 6857467 - DNA, 57 bp, Homo sapiens
ctgaggccatgaatggatgttccttcaacccaaggagcaagctttcctggtcatcag

SEQ ID NO: 6857468 - DNA, 77 bp, Homo sapiens
ggccctggttgtgagttgagttgagcttccagccctgtcctggaggagctggcctcagtcatgctacagccaatgcc

SEQ ID NO: 6857469 - DNA, 56 bp, Homo sapiens
tccaaagtctcagatttctccagacttcctggatgagaaactctggtgactgtgga

SEQ ID NO: 6857470 - DNA, 70 bp, Homo sapiens
gagggacttgtttacaagcagttctgaccaccttagtggtgtactgttttctaggcaaaaaatatctgtc

SEQ ID NO: 6857471 - DNA, 108 bp, Homo sapiens
ctacttgcatgctgacctttctctctgtaatctaagccaccagtagtttcctgccatttctcggggcattgggctgggatggagcatcaaggacaaggcgtgttttag

SEQ ID NO: 6857472 - DNA, 68 bp, Homo sapiens
gacagcagaaaacttttgtgctctgaatactggagagaaaggatttggttacaagggttgctgctttc

SEQ ID NO: 6857473 - DNA, 71 bp, Homo sapiens
tcatattatttatggcactgttggtggtagccagatatcataaatgcagtgtcataaatacttttgtatga

SEQ ID NO: 6857474 - DNA, 72 bp, Homo sapiens
tgttagctgcatcatttgaaaactgcagacatcgtgacatttcacttctgtacacttcagcatgcatcttca

SEQ ID NO: 6857475 - DNA, 63 bp, Homo sapiens
agaggcatgggtctgtcccttcggattaagaatctttaacctggggcctgaagaccatcttct

SEQ ID NO: 6857476 - DNA, 69 bp, Homo sapiens
agggttattgtgagcattgaatgataccaagttataagtgcataggtattcaatcagtgttcattccct

SEQ ID NO: 6857477 - DNA, 61 bp, Homo sapiens
ctgtgtctcctcaactcatgctcgaggtcagaaatggtctcggtacttgagagagacacag

SEQ ID NO: 6857478 - DNA, 57 bp, Homo sapiens
agaattagcagagaaggtgtcttcgaattcccagaggagcttcttctgtctaatttt

SEQ ID NO: 6857479 - DNA, 64 bp, Homo sapiens
gtctggagtgtcctagcaagccggtcctttgcacagaaggctggatttatggggacttcatggc

SEQ ID NO: 6857480 - DNA, 57 bp, Homo sapiens
gttgagcagattcagatcagcccaagaaatctgggctgataatgcattctgtttaat

SEQ ID NO: 6857481 - DNA, 56 bp, Homo sapiens
ccaaatggtgacatgcttatgtgcaattcttgctcaagagctctccactaggttgg

SEQ ID NO: 6857482 - DNA, 61 bp, Homo sapiens
ggttgcttgcagaacagacagacaaccccatggtgagtttctcagttctctgcaaggagtc

SEQ ID NO: 6857483 - DNA, 130 bp, Homo sapiens
attatctttacttttgtgactatgtccactctatctgtaggttgggaacatgacctaatggtgtgctaccatgcagctctttccagctccatgttcagtgacttcatattggtaagttgaaatctactat

SEQ ID NO: 6857484 - DNA, 76 bp, Homo sapiens
gatccaagtcctgtgcaaatgcatctgactggcgaacagaaatcccatcaagaacagctgcagggagactggggtc

SEQ ID NO: 6857485 - DNA, 99 bp, Homo sapiens
cagttatgtattataatcatgaaattgtattggcctcaaacccaaattttctttgtagtctaggatagatttttcatgaaagctatatagttataactg

SEQ ID NO: 6857486 - DNA, 74 bp, Homo sapiens
tctgttatttggaggatgcttggtggtctgtaatctaaaatctgagacgataaaggatttttcaaaataatcga

SEQ ID NO: 6857487 - DNA, 87 bp, Homo sapiens
attctagtacatctaacagcaacaccagaataagatttgacctactaagtgctctgttacattggagttgtttagattcaccagagt

SEQ ID NO: 6857488 - DNA, 66 bp, Homo sapiens
aagctctgtccagcctatgatttcccaccctgcggaagcacatgaagctcaggctggacctggctt

SEQ ID NO: 6857489 - DNA, 57 bp, Homo sapiens
ccaggtatgtcctaagcttcagggatccagtttcttgtccttctgaaatatatctgg

SEQ ID NO: 6857490 - DNA, 105 bp, Homo sapiens
tctgacgaaaaactttttaggatgtatttgttgctttggctttgatcttaatgtttgcaaactaatacattaatacatgtgaagccttaaggagtttttctaaga

SEQ ID NO: 6857491 - DNA, 69 bp, Homo sapiens
aatgcatttttgagtatgaatgagtcatctgtttctctgggtgcttcatttttagttataaagtgcgtt

SEQ ID NO: 6857492 - DNA, 72 bp, Homo sapiens
agatttgaaaatagtacaatctacagacatagtgttagctgttttttctagttttgtgtcttttgcaaatct

SEQ ID NO: 6857493 - DNA, 62 bp, Homo sapiens
cctgcttgaggggatatttgtgtctgtccctcataccggccacacaaacctcctcagcctgg

SEQ ID NO: 6857494 - DNA, 96 bp, Homo sapiens
agatgtgagtgttgtacatggaaatcttccaggagggcatttcttttgttctcatagaggcttgtctccttctggggccatacaactctgacattt

SEQ ID NO: 6857495 - DNA, 72 bp, Homo sapiens
tcttcccttactttcttgtcctttagctgctgtttcttgttcctccttagtcagctgcagaggtgaagaaga

SEQ ID NO: 6857496 - DNA, 80 bp, Homo sapiens
tgcttggaaaacattgcttctcgtttgtaagtgtaggtgcatacatgacaaatcagaggggcttggaatgaaataaagca

SEQ ID NO: 6857497 - DNA, 57 bp, Homo sapiens
gctcgtggtttagcacgtgcttcttcctccaggcgaagccaagtgctggccatgggc

SEQ ID NO: 6857498 - DNA, 101 bp, Homo sapiens
gtaggaagaatgagggggaaaaagacaggaacatagcaaatccatgtcttgtctaacaggatgctgagccttctgttctatttccaactctcatttcttgc

SEQ ID NO: 6857499 - DNA, 60 bp, Homo sapiens
gcagccccgcgatctccttgtggccgtgctcacaggcgcacatgagggccgtggagccgt

SEQ ID NO: 6857500 - DNA, 58 bp, Homo sapiens
ggtgagaggagaggaatagatggggagacccataggctgggctctctccacattcatc

SEQ ID NO: 6857501 - DNA, 101 bp, Homo sapiens
gtatattctggttaggatgtgttcatagctgacgcatctccaaaaattttttcatgaaggcggccagctcctgaacatcttcaattgtgacagaattatac

SEQ ID NO: 6857502 - DNA, 65 bp, Homo sapiens
gtggcggactcgacctggcctgcagccaggctactgcacgaaagcccaaggtcgtgtccggccac

SEQ ID NO: 6857503 - DNA, 77 bp, Homo sapiens
atgcatgaattgtttatatacagtaggcaacacatataattggaatatgtgagtctaattgtgtagtatatatgtat

SEQ ID NO: 6857504 - DNA, 82 bp, Homo sapiens
taacagagtctcactatttatggcagttttgtctcataaagtcactgtgaacactgaagtagtgaatactgaaacattgtta

SEQ ID NO: 6857505 - DNA, 58 bp, Homo sapiens
ggcgtttttttggggggatcagggatgggtgagagctctactgcttacaaaaataccc

SEQ ID NO: 6857506 - DNA, 84 bp, Homo sapiens
tgaagtgtgcagggtgaagtaatgaaacagggagttgaagaaactctattctcctgtcgatttggttcctctgcggggtcttca

SEQ ID NO: 6857507 - DNA, 63 bp, Homo sapiens
tttggcaggggttaggtttctgtcatttgcaactaaaaggatcctgaccaatacttgatcaaa

SEQ ID NO: 6857508 - DNA, 59 bp, Homo sapiens
ctgcactgctgtgttcggctccccgtggaccttccacgtcagctcagcactgcagccag

SEQ ID NO: 6857509 - DNA, 65 bp, Homo sapiens
tgggctccacactgaaatattaatatcttattgttttgatgatgatgatgatgttcattggccca

SEQ ID NO: 6857510 - DNA, 129 bp, Homo sapiens
aagttggggcagaatgtccaaacacagtttagtggaggtgattctgtgaggggctgaccttaatatggtccaacatgtagtctccctgtattagttatctactgctgtgtaacaaatgactcccaactt

SEQ ID NO: 6857511 - DNA, 96 bp, Homo sapiens
tcaagaagtatattatgtcctccagtgtgttctcaatgaaaagaaaattatttctttcttggggaacacactcttatggcattttaacttttatga

SEQ ID NO: 6857512 - DNA, 81 bp, Homo sapiens
atgtattttaatacaggatttcacctcatattttggtattattgtgttaaaagatgaaatggtgtcttggaagaaatgcat

SEQ ID NO: 6857513 - DNA, 61 bp, Homo sapiens
ggccagccccagacatcctatcgccacaatgccatgtcgcaataggaagcaggggccggcc

SEQ ID NO: 6857514 - DNA, 57 bp, Homo sapiens
ggggtcttagaacactattttgcacactgaggtgttatagaattgttttgagacccc

SEQ ID NO: 6857515 - DNA, 58 bp, Homo sapiens
gcacgttcacttacttgagatgacttagttgagtcatctcaagtaagtgaacaaatgc

SEQ ID NO: 6857516 - DNA, 83 bp, Homo sapiens
atccttctccttatattgtaaggtaagcatgggtgtactggaaacaccacactcagaaccatttactctgaggaaaaaaggat

SEQ ID NO: 6857517 - DNA, 59 bp, Homo sapiens
ctgccttggtttctagcagggctgctcactgaactgggctgcctgccaggggccagcag

SEQ ID NO: 6857518 - DNA, 56 bp, Homo sapiens
ttgtctgaaagatcattacattttgtcatcctgagagatgtgttaaattcagacaa

SEQ ID NO: 6857519 - DNA, 129 bp, Homo sapiens
tctactattggctccatactaatgttccttgtgatttaatgcgtctctgagttttgcatgtctaaggttatttacagcttaaaagatgcatttatattatgattagtcaccggtgagctatgaagtaga

SEQ ID NO: 6857520 - DNA, 67 bp, Homo sapiens
tgtgcttatttttgtggctctggaggatctttctaatgagattttcctcctggatacaaagggaaca

SEQ ID NO: 6857521 - DNA, 100 bp, Homo sapiens
agacatgcacacgacagggggtctccctgtattttcaggaagacgatggcttctccatattcctgaaaatacagggagagaccctggcgtgtgcatgtct

SEQ ID NO: 6857522 - DNA, 72 bp, Homo sapiens
ggggcttgagctggctaagatccaagaaaggcatccatgtaaggtgggctgtttttcttcttttcaggctcc

SEQ ID NO: 6857523 - DNA, 62 bp, Homo sapiens
aggacacaggtaagccagtggatgcgggaccttgccccagccattctgaagctctgtgtcct

SEQ ID NO: 6857524 - DNA, 55 bp, Homo sapiens
ttggccagtgaaccaggcctggcttcatcccacccaaggcttggattgtggccaa

SEQ ID NO: 6857525 - DNA, 84 bp, Homo sapiens
gtagccgtggaaaattctcagtcagtttggactgtgtacattctggccctttcatatacacagactaattggtgacatggctat

SEQ ID NO: 6857526 - DNA, 121 bp, Homo sapiens
acccgcggtcttggccataggcgatgccacttccgacagcccagcagggtctggccctgggtcccagaggcgcagcccctgcggggtttggatgggttcctgcggcctccgatccgctggt

SEQ ID NO: 6857527 - DNA, 62 bp, Homo sapiens
tctgtatctcacttctttgtggctcccaaccccaccactccacccagagagctaggtacaga

SEQ ID NO: 6857528 - DNA, 59 bp, Homo sapiens
gcctcagccttccctgaaggactgctagatggacttcattattgggagaggccagaggt

SEQ ID NO: 6857529 - DNA, 67 bp, Homo sapiens
gagccctggcaggttacaaccagttagcaccagagtctgccttgaagagtttccagcctgcttgctc

SEQ ID NO: 6857530 - DNA, 64 bp, Homo sapiens
ggaagtgaaatatgcccattgctgtcttcacccagagaaaatagattgctcatatattacttct

SEQ ID NO: 6857531 - DNA, 89 bp, Homo sapiens
tcttttcatggcctcgtagccttagcacatgcaaatatcaaccaaccatcattgtctgagcacctgtgctgaacctgggcctgagaagg

SEQ ID NO: 6857532 - DNA, 68 bp, Homo sapiens
ttgtaggccacagagaggagatttcgatcttcattggagagaggttcattcagctctgtcacctgcaa

SEQ ID NO: 6857533 - DNA, 79 bp, Homo sapiens
gctctgaattaatcacttttcattagtacctgttttacttaccgtaggtaccatgctaaaagttgatctcaatttgggc

SEQ ID NO: 6857534 - DNA, 93 bp, Homo sapiens
aaacatttacagagatgttgtgattggaattatgggctagtttcttcatcatttatgatttcaggaatgtcttagcatccttttgtagtgttt

SEQ ID NO: 6857535 - DNA, 58 bp, Homo sapiens
gtaagacacagcgaaatgttcctgcgtcagtggattcagggaatcctgtgtgttttgc

SEQ ID NO: 6857536 - DNA, 91 bp, Homo sapiens
gcctctctgtgacaggatgcaagctgccaccagaagagcatgacctagtgcaaggcagctctttgagcaaggcagctctttgcagggaggc

SEQ ID NO: 6857537 - DNA, 98 bp, Homo sapiens
gatgtctctcagtcttagtttccttatctgtaaaatggatacaatgtcaagtagcaatgacttggatctgcagtgggaattaagtctgattatgcgtc

SEQ ID NO: 6857538 - DNA, 72 bp, Homo sapiens
gcaagagttagcagtcttgtgtgttaatagtttgcctttgaatttagaactagaaaacaagatgctgattgc

SEQ ID NO: 6857539 - DNA, 62 bp, Homo sapiens
caccttgcattcttttaatttacttgaattcaagtggaaaaactgaggagagagctgaggtg

SEQ ID NO: 6857540 - DNA, 122 bp, Homo sapiens
actccatccaaaaatgctgatttcactgacataaatgttgagtctagatgatcctaggaatatatcaatatattccctccagggtatctatgctcatttaggggtgacagtgtatatggagt

SEQ ID NO: 6857541 - DNA, 129 bp, Homo sapiens
tgccacaactgcctatcatacttcgactactcttgaaaatagatccacatctcttcggttttattgcctgattcatgggcatatattttgcattggcgatagtgtagtgtgatgaaggaaacattaaaa

SEQ ID NO: 6857542 - DNA, 75 bp, Homo sapiens
gtctcttcccctcaggatagattgtcctctcatgcatatgctgaagagtcgtctttcttgacataggccagaggc

SEQ ID NO: 6857543 - DNA, 68 bp, Homo sapiens
tggaaattaaaattcctcttaaaatagatccttagttttttgagttccttaggaggttttaatttgta

SEQ ID NO: 6857544 - DNA, 88 bp, Homo sapiens
accaaatatttatatttctcttccctactagacacccagtaggattatacttcttgtgttggggaggagccatgtaactagttctggt

SEQ ID NO: 6857545 - DNA, 68 bp, Homo sapiens
aaatcagactctttcaaacagaaagccagtctgagttggcaggctggtttgacaatgaggactggttt

SEQ ID NO: 6857546 - DNA, 65 bp, Homo sapiens
gtcacgcagccctgttgcgcttccggcgcctgctggtggctgagctgcagcgtggcttctttgac

SEQ ID NO: 6857547 - DNA, 74 bp, Homo sapiens
cctaattaccttatgaagaccctacctccagataccatcatactgggattagggttttaatgtatgaatttggg

SEQ ID NO: 6857548 - DNA, 61 bp, Homo sapiens
agttgctttggatataacttctcctgaggagaaacctgaagttagtttcaataaagcaatt

SEQ ID NO: 6857549 - DNA, 64 bp, Homo sapiens
ctggtatgtttttgtcctccagggatctggttttaatctggagcccttgataataaagcaccag

SEQ ID NO: 6857550 - DNA, 81 bp, Homo sapiens
cccagcaatctacagcttccccccgggcttgagagggaggcggcactgagtccatgtggaggggaggtggggagagctggg

SEQ ID NO: 6857551 - DNA, 87 bp, Homo sapiens
gtagtcaagagatcatatgcagtaatgaactctatggaagaggattaaatatgacattcatttggtaaatgatttctgtatgattat

SEQ ID NO: 6857552 - DNA, 61 bp, Homo sapiens
aacactttgggcatggccttccctctcagataaacaggagggggaggcagcaccagaggtt

SEQ ID NO: 6857553 - DNA, 107 bp, Homo sapiens
ggggtgcagctggggctgggggaaggtgggcggtgtcttggatcgtggcagctattttagggcctgagctggctgacctcccccagcgtgatctccgtctgctcttc

SEQ ID NO: 6857554 - DNA, 63 bp, Homo sapiens
tcagccctagcctcagtccagggcaccacacccaagggccccacactgatgctggtggtgtga

SEQ ID NO: 6857555 - DNA, 70 bp, Homo sapiens
ggagtagtggctgtgaaatacatgggaaagagtttgaaaagtatgtatcccacatttcacagcactttcc

SEQ ID NO: 6857556 - DNA, 62 bp, Homo sapiens
tgctgaatagaagtcttcaaagggagcttaattgctttcacctttccgtgattctatttgca

SEQ ID NO: 6857557 - DNA, 77 bp, Homo sapiens
tattttttatgctttaattgttagaatctagtttatcagggctgataccagggctgacagtaaaagtatgagagata

SEQ ID NO: 6857558 - DNA, 97 bp, Homo sapiens
tcctgtgtcaaaaccattacatatgttggcaacatttatcatcaggaaaagcgtcccaggaagttgaattctaatgtatgtgtggtgttacaatgga

SEQ ID NO: 6857559 - DNA, 55 bp, Homo sapiens
gtttgtcagagaactccagcaaatgagaaaagtttgtcagagatctccagcaaat

SEQ ID NO: 6857560 - DNA, 69 bp, Homo sapiens
aagacagggcctattattcctctagaaagtattcacctctttcatagacaggataacaggattctcctt

SEQ ID NO: 6857561 - DNA, 74 bp, Homo sapiens
tgtttgtttattggatttgactagacttagcagaatgggtatgctctggtctgcttatatctatatgataagca

SEQ ID NO: 6857562 - DNA, 62 bp, Homo sapiens
ctaatgctttggggttggtactgtcaactctatttgacatattggcaaactggaggcatgag

SEQ ID NO: 6857563 - DNA, 65 bp, Homo sapiens
tggcctgcaaacctgaagatttaagatgcacagtgtcgctatttgaccttcatttttggaggcta

SEQ ID NO: 6857564 - DNA, 97 bp, Homo sapiens
tgtttctagctgtttcttaagtcatctgaatgaatgttccttggcagttgttgagaagattaaacatatttagtgtatgacttgagtacaagaaata

SEQ ID NO: 6857565 - DNA, 59 bp, Homo sapiens
cttcccaatctcttctcctgcagggataatatcacatgatttctgaggagaacagaaag

SEQ ID NO: 6857566 - DNA, 56 bp, Homo sapiens
gggcctggtgcttctgactcctgacttaacagaaacaggatggaggtaccgggtcc

SEQ ID NO: 6857567 - DNA, 72 bp, Homo sapiens
ggttccaggcctctccttagtctggcagtgggtgtctcaacccgatgccctgagcagaggtggggcctggcc

SEQ ID NO: 6857568 - DNA, 69 bp, Homo sapiens
tctgctactttaattcccctttgccatgtaacatgatttgttcacaggctctagggattaagatgtaga

SEQ ID NO: 6857569 - DNA, 86 bp, Homo sapiens
tggtatttgctagtaggagagtcctaatctaaggaatatatttagaagaatgtctctggtttaggatcgcttatggtcaacaaaca

SEQ ID NO: 6857570 - DNA, 55 bp, Homo sapiens
ggatgagtgtttagaaaacactggcatacagtaggtgctcaataaatgctcattt

SEQ ID NO: 6857571 - DNA, 89 bp, Homo sapiens
ccaatgagaaaaacagtttgaagtgtataacgacctacaggaaaaaattcctgatcccatttaatactgagaacatgattttcttttgg

SEQ ID NO: 6857572 - DNA, 108 bp, Homo sapiens
tgttcaaagtctggcatttagaaggtgctcagcatacatctgttaaatgaatcaggttgagaatgaagctgggtggtgctgagccttgctgttattgctgcgggaaca

SEQ ID NO: 6857573 - DNA, 62 bp, Homo sapiens
ccagagctgagaatgtggcttccttggagttatgagagatagggagggattttgagctgtgg

SEQ ID NO: 6857574 - DNA, 69 bp, Homo sapiens
tgtctgcttatgagaattgtagtcagatcttcattagaatgaatgacatctgattccataaggcagaca

SEQ ID NO: 6857575 - DNA, 62 bp, Homo sapiens
aaaacccttctgcagactctgagaaatgacaaggggaagctgagaagctgagactgggtttt

SEQ ID NO: 6857576 - DNA, 73 bp, Homo sapiens
ttagtattattttccttccggtaggtggacctatgttgtgttggtaaggcttattgcaaggtaaaattgctga

SEQ ID NO: 6857577 - DNA, 58 bp, Homo sapiens
tcttgcaggcatgaaaggactcggggctgaaattgccaagaatctcatcctggcagga

SEQ ID NO: 6857578 - DNA, 81 bp, Homo sapiens
tgctggggtgttttggcctgggtttttgttgtgcttctttggctgcaaactgggctgatctttagccaagacacaccagca

SEQ ID NO: 6857579 - DNA, 80 bp, Homo sapiens
gaaaggatgggtgagggaagaaagaattgatgcgttttgatatatccaacatattttttcttcccttttattctcttttc

SEQ ID NO: 6857580 - DNA, 62 bp, Homo sapiens
gagaggggacctgtgtgtctaggtgatgtcactcagcagcatgatgacagagtctctgggtc

SEQ ID NO: 6857581 - DNA, 72 bp, Homo sapiens
gcacacaccacagagggacctggggacgcccgttggtcagggctttcctggccagctgtggtgagtttgtgc

SEQ ID NO: 6857582 - DNA, 108 bp, Homo sapiens
ctgactcatctctgagctaggagatgctcgtatggactgcagaagtttggctcttgtatttagagtggaatggtgtcctgagctcttgctggtcattgatgagtacag

SEQ ID NO: 6857583 - DNA, 66 bp, Homo sapiens
gtaaaatctagctgcatgcttctatttgcatattatatacagacaaagagcatgcggtaatattgc

SEQ ID NO: 6857584 - DNA, 61 bp, Homo sapiens
ctgtttctataacctctgaagcacatctctccacatatgcttgagaaagtaaagagacaag

SEQ ID NO: 6857585 - DNA, 74 bp, Homo sapiens
aggttgtaggtgagctcatagtctgaattcacaaacagaatattttcaggcttgaggtctgtatgtgtcagctt

SEQ ID NO: 6857586 - DNA, 72 bp, Homo sapiens
aagccccaagaactttataactgtaaatgtcaagaaaggtccctggcaatagttgtgggttctttagggctt

SEQ ID NO: 6857587 - DNA, 55 bp, Homo sapiens
ctggttcaatggggctgagcccaggtgagggttcagggcagttcccattgaccag

SEQ ID NO: 6857588 - DNA, 113 bp, Homo sapiens
gtcattggtactcaccatcattcaattttcagtcacttctattctattaagtgccagggtcttgtcctcagctgaatcttagaatgctgatgattgtggtagattcagtagac

SEQ ID NO: 6857589 - DNA, 94 bp, Homo sapiens
gcgccttctatgtaccagaccctggactggggctgaggctccaggatctgccctggagttgtctcgagtctagaggagaggacaaatcagacgc

SEQ ID NO: 6857590 - DNA, 69 bp, Homo sapiens
atgtctggaggaaaaggttaaatgaaatggccttactttgccatcccaggaaatcaattcttccagcat

SEQ ID NO: 6857591 - DNA, 85 bp, Homo sapiens
caggatgtgcagggcccaagggtgcccagcagaggagcaaggcctcttctcttctcactttgccctgtaccttgggttgcacctg

SEQ ID NO: 6857592 - DNA, 73 bp, Homo sapiens
gcagcaaatgtcaaagagaaacagtcatgcctaagagtcattaaatgatttgtttttcattcacatgggctgt

SEQ ID NO: 6857593 - DNA, 65 bp, Homo sapiens
gcacacagcatctcacttcccagaaggatcttcaccttttcatctggaaactgagtgctaactgc

SEQ ID NO: 6857594 - DNA, 74 bp, Homo sapiens
acttcagttttctaatgcttctgatttgggaacactgggaacttgttttcaagttacattagaaatcatgcagt

SEQ ID NO: 6857595 - DNA, 95 bp, Homo sapiens
agtttttattaggttgatgcaaaagtaattgcagtttctgccattacttttagtggcaaaaaacagcaattacttttgcaccaacttaaatagct

SEQ ID NO: 6857596 - DNA, 80 bp, Homo sapiens
agctgctaattaagaccaagccacttgtgtttttcaaaaatctgaaaaccacaaaagtggcttggttttaagtagtggct

SEQ ID NO: 6857597 - DNA, 87 bp, Homo sapiens
tgaccaaggaccattctccagtcctgcccctactccagaccaaagaccctgaaggagcagggcaggacaggggaatgtttggggtca

SEQ ID NO: 6857598 - DNA, 129 bp, Homo sapiens
tggtcagctacagtccatctgttatcaagaggcctggctgtgtgtcttcattcagtttattaggcatttactgagcacagcctacatgccaggttcttcattttttgacacagggtcttgtgttgccca

SEQ ID NO: 6857599 - DNA, 55 bp, Homo sapiens
gatgatgggcattctttggcttgcagctatgtctttcaaagcactgcctgtcatc

SEQ ID NO: 6857600 - DNA, 86 bp, Homo sapiens
cagtttcttgaatcactttagagatacctgttggctaaatccaagagaaaggagttattgctgaaatgctgagttcaagatggctg

SEQ ID NO: 6857601 - DNA, 78 bp, Homo sapiens
caaccttaaaagttccctttcatattttataaatggagtaaaatgttcttcagtggttttgaaaggggaagagggttg

SEQ ID NO: 6857602 - DNA, 64 bp, Homo sapiens
aacttggctttgccatttatcgtttttgtatctccagttactcatataaaagcagagctgggtt

SEQ ID NO: 6857603 - DNA, 57 bp, Homo sapiens
ctgtgacttccactactgatcagcacattaaaacaactgtcagtgcctgaggcacag

SEQ ID NO: 6857604 - DNA, 79 bp, Homo sapiens
gagatcttgagctggacacacactggaggtaaatggggtgtgcaggaaacactgatgccccggccccaccctgagactc

SEQ ID NO: 6857605 - DNA, 66 bp, Homo sapiens
ctggagtccagggccatctccatgaggccgtccacggccaggctgaggctctggaagaccctccgg

SEQ ID NO: 6857606 - DNA, 84 bp, Homo sapiens
gtgaaggcttcatgttcatgcttaggaaaataattattgtaaccataattttcctttaaaatgaaacatgatgttaacattcac

SEQ ID NO: 6857607 - DNA, 57 bp, Homo sapiens
gcttgatggcttcaaatgatagaaatgtattctctctcagttccagaggctacaagt

SEQ ID NO: 6857608 - DNA, 57 bp, Homo sapiens
tgatgggttgctcattagagagtgaaaacctgctctctaaactctgattaatccaca

SEQ ID NO: 6857609 - DNA, 55 bp, Homo sapiens
cagccatcactggggcccaccatggcttttcagagccagactcagtatgtggctg

SEQ ID NO: 6857610 - DNA, 106 bp, Homo sapiens
gcagtcatgttggccaactctcattttaggtgtaaggtatatcagcctccttcagtctcaggtgcagtccttatacctaaaattgagggctggccaagatgactgc

SEQ ID NO: 6857611 - DNA, 59 bp, Homo sapiens
agggttctgggccttacaggtgagaaaagaatgtcacttcctggcaggcccaggaccct

SEQ ID NO: 6857612 - DNA, 95 bp, Homo sapiens
tagagataaaaggatttagcagaaaaatatagtaaatgtattagccaaggggaattcttcaagaatatattgctgtctcggatcagtttactcta

SEQ ID NO: 6857613 - DNA, 85 bp, Homo sapiens
tgtacccttggcagccttctctgagaaggtgacacagatgacactgtggcccctccaggaggtgtcaagacaaatttgggtgaca

SEQ ID NO: 6857614 - DNA, 86 bp, Homo sapiens
ggacaaggcagaaaggcaatgtcatggctcttgccctcacactctagggcctagactggtgtgacaatgtccatgcttacatgtcc

SEQ ID NO: 6857615 - DNA, 77 bp, Homo sapiens
ggtccatgagtaagtgggtaagcatggggtatattggttctattcctaatttgctctgctttcctcttacacactcc

SEQ ID NO: 6857616 - DNA, 64 bp, Homo sapiens
tctggagaggtaagaagatagggtgtgtgtatttcaggctctgtgttttgtgcctactgctaga

SEQ ID NO: 6857617 - DNA, 59 bp, Homo sapiens
gctggaagccgtttcaccctgaagcctgaaggggcaaaggcagaaagcggtgttctagc

SEQ ID NO: 6857618 - DNA, 64 bp, Homo sapiens
agaagcttctcctcctaacaggcaagcatgacacactctgccaaaccaggaagggcaagtttct

SEQ ID NO: 6857619 - DNA, 66 bp, Homo sapiens
ttggaaagcaagctggacatacagagttctcaattttatgccattgtgccctgacttgcttcccag

SEQ ID NO: 6857620 - DNA, 72 bp, Homo sapiens
gaactttctctggctggaaacaggagattcagcagaagttgaagtcagagttttcaagcatgagaaggattc

SEQ ID NO: 6857621 - DNA, 63 bp, Homo sapiens
gagctatttctgcctaatgacctgtatgtaaaagcaacagaaatatagaaggtaggaataatc

SEQ ID NO: 6857622 - DNA, 100 bp, Homo sapiens
aggcaggagactcacttgaaccctggaggcagaggttgttgcagtgagctgagatagtgtcactgcactccagcctgggtgacagagtgagactccgtct

SEQ ID NO: 6857623 - DNA, 81 bp, Homo sapiens
gaagtttgagtttgaggtgactgcaggatatatctaagtgaaaatattctataagcagttggaagttcaaatccaaatttc

SEQ ID NO: 6857624 - DNA, 67 bp, Homo sapiens
gttaagttccacagtgagataaaagcaagtatgactaagcttgagtcttttatcctgggaatgtaat

SEQ ID NO: 6857625 - DNA, 68 bp, Homo sapiens
gagtgtttaggggagctcgggtgcaatcggagagttagctctttgaggccggctgcccttaaatcctc

SEQ ID NO: 6857626 - DNA, 67 bp, Homo sapiens
gtctgcttcatgtgttttctaggttcacacttgaccgtggtttggcataggaagaatatttctagac

SEQ ID NO: 6857627 - DNA, 57 bp, Homo sapiens
cgccttccttctaaaaatagccaaccccccaatgcgggaaaggtgggaggtgaggtg

SEQ ID NO: 6857628 - DNA, 66 bp, Homo sapiens
ctgcaaggctggctgcacaggggctcacttttatgaaagctggattccagtgcagtcacctttcag

SEQ ID NO: 6857629 - DNA, 80 bp, Homo sapiens
agaactttatatcaggatagtctgtaaattgtcttggaaagctttcatttcaataagttgcagacatcctgagaagtact

SEQ ID NO: 6857630 - DNA, 94 bp, Homo sapiens
cagacgggaaggagagcaagtgggcggtttatgattctgccctgtgctggggcgagtgagctgagctctttgatttctcccaagtaaccgtgtg

SEQ ID NO: 6857631 - DNA, 122 bp, Homo sapiens
gatctgaacaggcagggagaccccaggtgacacctgggttataggtactctagataagtaatctgagccacctgagcccatggtgggtggttctggcctgttttcctgccaggtttctggtc

SEQ ID NO: 6857632 - DNA, 65 bp, Homo sapiens
ggagatccactgtgtttgtgttgaggattcattacacatgactcagtagaaaatacatggacttt

SEQ ID NO: 6857633 - DNA, 56 bp, Homo sapiens
cgcttatgtgtatagggccagtaacattttcagagttgtcttgtaacacataagtg

SEQ ID NO: 6857634 - DNA, 57 bp, Homo sapiens
gttgggtaattaagcacagaaatgttctgggacatgctctgtgtgccatcacctaac

SEQ ID NO: 6857635 - DNA, 87 bp, Homo sapiens
ctagggttagatgtacaaagagaggatttcaatctgcttctgcatttggcctaatgaaatccctgtctttgaagcgtttggttctgg

SEQ ID NO: 6857636 - DNA, 57 bp, Homo sapiens
ccctgatttttaaagcaaaatcaaaacgtgtgcttgattctgctttgagaatcatgg

SEQ ID NO: 6857637 - DNA, 111 bp, Homo sapiens
ggtggtgcacgcctgtaatcccagttactcaggaggccgaggttgcagtgagctgagatcacgccactgcactccagcactccagcctgggtgacagggcgagactccacc

SEQ ID NO: 6857638 - DNA, 84 bp, Homo sapiens
atttgagggttgtgagggttaagtaagaagaatatgaaaatactttgtggtctctaaagcactttaaccacagaacttttaagt

SEQ ID NO: 6857639 - DNA, 62 bp, Homo sapiens
caggcaacgtccttagagatgctgccctaatgaggtttatttcttcctgggtatgttgcctg

SEQ ID NO: 6857640 - DNA, 55 bp, Homo sapiens
catgcagcaggatctcattcccattgagggacacaaagtgggttgctgctccatg

SEQ ID NO: 6857641 - DNA, 64 bp, Homo sapiens
tggcaatgtggcatcaacgaagtcactgtacttctcagtcatttgtgtagagtgatattgtcca

SEQ ID NO: 6857642 - DNA, 83 bp, Homo sapiens
ataccaaggctttgacagtgtctatcttattggttatggtatccatggctcctaggatggtgcctggcactgagtgttggtgt

SEQ ID NO: 6857643 - DNA, 59 bp, Homo sapiens
ctctttaaggcaatatagaattcatgctaaatagatgaaaatgtgttgttcttaaagag

SEQ ID NO: 6857644 - DNA, 101 bp, Homo sapiens
cacataatggcatgataacaagcacaaagttctaacatctacgtggaatgtcaattttaaataagagtgaggacatgggtgtgtttgtgcatgtgtatgtg

SEQ ID NO: 6857645 - DNA, 56 bp, Homo sapiens
ggcggcccctccctgctccgctgtccgccttgggtacagaagcggcgagtggcccc

SEQ ID NO: 6857646 - DNA, 64 bp, Homo sapiens
atagttacctaacttaaaacatgtggtggggtatttattaaccaatataagtataggtaagtat

SEQ ID NO: 6857647 - DNA, 106 bp, Homo sapiens
gcattggcatcacctgggagattgctagagatgcagatcccaggccctcgcagatccatggagtcatcacctgcattttagcaagagttccaggtgattcgtgtgc

SEQ ID NO: 6857648 - DNA, 68 bp, Homo sapiens
ttcacctgtctgcagcacccagcacaaagcctgagcaaggcagatgcagggaatgcttgcagcatgaa

SEQ ID NO: 6857649 - DNA, 75 bp, Homo sapiens
gttgtccagtttgcagatggcaggtagtagaacttctcagcctccataatcatgtaagtaaattctctggagaac

SEQ ID NO: 6857650 - DNA, 99 bp, Homo sapiens
tgggacctactaactcccccaccaacctcagtggttcagtggtgtctgcaaaatgcatccatcctgccatctgagtagcaggtgagagttatgggccca

SEQ ID NO: 6857651 - DNA, 79 bp, Homo sapiens
ggtcttagaacaggaggttttcagatccaaataatagttaaaattataatggtatttcaagacttgcctgctctctacc

SEQ ID NO: 6857652 - DNA, 57 bp, Homo sapiens
ggctcccaaataattgcaccaagtagatacaaatttggttactggatttgaggggcc

SEQ ID NO: 6857653 - DNA, 125 bp, Homo sapiens
tcaccatgctggccaggctggttgcaagctcctgacctcgtgatctgcccaccttggcctcccaaagtgctgtgattacaggcatgagccactgtgtccggcctggtgcagaatgttaatagtgg

SEQ ID NO: 6857654 - DNA, 66 bp, Homo sapiens
ggtcgtacttcctcagccagcacttaggggccgtgaggtccatagccatgagctgagggagtgacc

SEQ ID NO: 6857655 - DNA, 129 bp, Homo sapiens
tcacttttcaagcccatggactatctcccagtgctgttcattttaatattctgcagagtacttaagcattacagaatatagaagctggaagatacttggcagtcatttagtccctcatgttctagatga

SEQ ID NO: 6857656 - DNA, 72 bp, Homo sapiens
tccctccctctgaggctttgagcctggggttgtcattaacagaagagggagcgaggacttcaggggaacgga

SEQ ID NO: 6857657 - DNA, 74 bp, Homo sapiens
tgggaagcagcctgaagccaagggctggctgacttggaatataaaagctgggccccttgcaaagtgctttccca

SEQ ID NO: 6857658 - DNA, 70 bp, Homo sapiens
ggcaggcaggccggccggccccagctctgctggtgaatgcagaggggctcaagcagtggtcttccctgcc

SEQ ID NO: 6857659 - DNA, 57 bp, Homo sapiens
gccgacaagcaaagaatcttaggctgcattaatggagtcaggatatgccttgtgggc

SEQ ID NO: 6857660 - DNA, 68 bp, Homo sapiens
ccctgtctgcacggggaggatgggcttgccaggggtcgggagcaccagtttcgtcgtgacaaccaggg

SEQ ID NO: 6857661 - DNA, 57 bp, Homo sapiens
gcaagagtggaacaaaggcagccagtgtctgtttgccatccaacagttccatcttgc

SEQ ID NO: 6857662 - DNA, 58 bp, Homo sapiens
ggggtgtgtatgtatgactgtctgatggtctctttccactctgacacttacacacccc

SEQ ID NO: 6857663 - DNA, 74 bp, Homo sapiens
ctccttcccgtctttgctatgcctgccctctgctggaggaactcatgaacggcagctggttagaagggaaggag

SEQ ID NO: 6857664 - DNA, 81 bp, Homo sapiens
tcagtttctgcctttacttctttagcctctaacagtgaaatctatactgtctggaggcagagagggaaagaggaaaaagga

SEQ ID NO: 6857665 - DNA, 66 bp, Homo sapiens
tcctgggtgaaagaacaggcagtcgaagattccatggcctaaattaattctatttcatccccagga

SEQ ID NO: 6857666 - DNA, 67 bp, Homo sapiens
gcctcagtttcctcctctgtaaaacgggcatgagaggaacactcatctccgaggattaactgagcgc

SEQ ID NO: 6857667 - DNA, 82 bp, Homo sapiens
atgattgctctgcctttgaggttagctagcagatcagcccagttctggttgatctaggttggcttcaactgggacagctcat

SEQ ID NO: 6857668 - DNA, 70 bp, Homo sapiens
ctcatttacacacagaggtgtgctggagagctatgggccagctcatgagcatgaggatgtggtaggtgag

SEQ ID NO: 6857669 - DNA, 70 bp, Homo sapiens
gtgatggggctggtattcagatgcatacagaaaattttctcatgcctggaattatcattattcttgtcac

SEQ ID NO: 6857670 - DNA, 94 bp, Homo sapiens
tttctcccttagcctgatgatgtattatattaatatatcattaaagagacagctttcagaaatgatgtattagtacaacacatcactggagaaa

SEQ ID NO: 6857671 - DNA, 82 bp, Homo sapiens
ttctttctttcccatgccagttttgagatgcacctcttacttggcaggtgttcctctgtactgggtactgggacagagagaa

SEQ ID NO: 6857672 - DNA, 77 bp, Homo sapiens
ctgcctcggagagctgtcactcagaccatgcagacttcagtggagaacctgcaggacttcaggactctgagaggcag

SEQ ID NO: 6857673 - DNA, 74 bp, Homo sapiens
tggcatctgaggcagtttaatttttgaagcggagacacagaagctttagcaaattagcacctctaaggatggca

SEQ ID NO: 6857674 - DNA, 76 bp, Homo sapiens
tgtaggcaactgtaacacaatggtatctgtgtaatctaaacatagaacagataatacattgtgctacaatgtaaca

SEQ ID NO: 6857675 - DNA, 56 bp, Homo sapiens
tgattgtggcatagttgcacaaatctgaatatttgtgcaactaaaaccattgatca

SEQ ID NO: 6857676 - DNA, 83 bp, Homo sapiens
ggagtttcttgtcatccaggctggagtgcattggtgcgatcttgactcactgcaactccacctcccggttcaagtgattctcc

SEQ ID NO: 6857677 - DNA, 65 bp, Homo sapiens
gatcagcaggaggtgagcagcaggtgagcaagcattaccatctgagctccgcctcctgtcagatc

SEQ ID NO: 6857678 - DNA, 65 bp, Homo sapiens
actagactcccctggagaggatttaaaaaatattgatgcctgggcttcatcccggagattctggt

SEQ ID NO: 6857679 - DNA, 60 bp, Homo sapiens
gcttcctagagtggaggaggtttcactgcacttacacatacattttctgttttaggaagt

SEQ ID NO: 6857680 - DNA, 61 bp, Homo sapiens
cctgtggccacactgcatacagacagttcctgaccctcatggagcaggcaggtggcccagg

SEQ ID NO: 6857681 - DNA, 109 bp, Homo sapiens
gggctcctgttgggagagggaaggtaggttccctctaggatgtggctggaggacacagaactggtccccactcattcctgagaccaccacctgtctggggacagggtcc

SEQ ID NO: 6857682 - DNA, 91 bp, Homo sapiens
tctgagatctcgctgtggaccaggtgctgagacaacaggaaacaaggccccatgcagccctcaaattgctcagcgtctagtgggtttcaga

SEQ ID NO: 6857683 - DNA, 67 bp, Homo sapiens
tttaaaatgtggtggaaggatgttcttttttaaagacactcccctctctcttttcacgcattttgaa

SEQ ID NO: 6857684 - DNA, 123 bp, Homo sapiens
gggcgcgcgcgcggggggtgcgcgtgtcccgggagcgcgtccgcgcggcggcctcccgcgtgctcgtgtgcgcgcgcgtcccgggtgccgcgcgcccttcttatgcacagctgcggtgcgccc

SEQ ID NO: 6857685 - DNA, 129 bp, Homo sapiens
ctctcctgtcactgtagaaattgatttcctatgtggatttgtggaagccctatgagagacagttttcttatgactgtgctgtcaattgctttcagtaagtatctgtaatgataggctataatgggagag

SEQ ID NO: 6857686 - DNA, 129 bp, Homo sapiens
taggttttcaagaaattaagtgtggtattacgtattattatgaaattttaagctattgctgtttatcaggttaatggcattgattacatgaaagtaacacgttcgattctacatactatttgttgaccg

SEQ ID NO: 6857687 - DNA, 75 bp, Homo sapiens
tgcattagggacccagcagagaccaccatgttgatttgacaaggttcttagagctgggatgaataaattaatgca

SEQ ID NO: 6857688 - DNA, 91 bp, Homo sapiens
tctttgttttgggaaatatcttgcacatgctatttatgtttttgaaaaaaatcaatgcaacaaattgtgtgcaatatgctccttagctaga

SEQ ID NO: 6857689 - DNA, 77 bp, Homo sapiens
aagaaaattaatcactgtttttatgtaatcagtgcttcaaaagtacttgagggtacttgaaagcagttgattttctt

SEQ ID NO: 6857690 - DNA, 70 bp, Homo sapiens
ggtcccactgctcacaaagccaaggtcaataccctagaacagcccctggcccttttgtgaagtggccacc

SEQ ID NO: 6857691 - DNA, 104 bp, Homo sapiens
gctggggactgtcccgcgtgggccagtggcaggaccaggcacgagggccagcaggagcagggctggtcacgtctcctcctccttcccccatgcaggttcccagc

SEQ ID NO: 6857692 - DNA, 55 bp, Homo sapiens
gtccagtgcagtcaaggaagaaccagccctgctggggctccagtactgcctggat

SEQ ID NO: 6857693 - DNA, 77 bp, Homo sapiens
gcattcctactttcttcaggaggccacacaaattttctggaccttaatgttgctgtagaaagtcaacacaggagtgc

SEQ ID NO: 6857694 - DNA, 62 bp, Homo sapiens
caaggattttcagtggcccgcacccagatagaaatttggctggtggctggttctggaccttg

SEQ ID NO: 6857695 - DNA, 62 bp, Homo sapiens
tgtaaagaaatagcatttgtaggaaaatcaccttgggtgtgtatagatcctggttctttgca

SEQ ID NO: 6857696 - DNA, 71 bp, Homo sapiens
acttagaaattaccttgcactgagtctgaaaaatacaaatttttctataaaaagtgctaggataactgggt

SEQ ID NO: 6857697 - DNA, 108 bp, Homo sapiens
ctcaaatcctccaaaagttaccttgctacacagtttctccccggcaagctcaaccaagaatttggtggagctggaagaatgtagacgttggagctggacagatctgag

SEQ ID NO: 6857698 - DNA, 81 bp, Homo sapiens
ctgggttccccacttggagaccatggagcacctcacagaggcctgagggacctctgggtgatgcccaggcttggaacccag

SEQ ID NO: 6857699 - DNA, 57 bp, Homo sapiens
agggcctgagctctcctccagtgcgggcgtcttattctggatgatgcctcaggctct

SEQ ID NO: 6857700 - DNA, 66 bp, Homo sapiens
gctattaagggtgttgatcagagaggatgaagatggttatctgtctttagcaccaccccaaacagc

SEQ ID NO: 6857701 - DNA, 59 bp, Homo sapiens
tatggcttcatcttttagtccttatggagtcaggtcaggggacacaaagatgagtaata

SEQ ID NO: 6857702 - DNA, 75 bp, Homo sapiens
ccaaccaacaatcctttctgtatttaaaagatctgggagtttgtcaagagaaatatagaagggtttgaagcttgg

SEQ ID NO: 6857703 - DNA, 80 bp, Homo sapiens
gaccgaagacactggtggttaagaactgactctaggctttgatctcagtccaaccacttaccatctgtgtgactttggtc

SEQ ID NO: 6857704 - DNA, 55 bp, Homo sapiens
agtggctcatgcctgtaatcccagcatgctgggaggccgaagcaggcagatcact

SEQ ID NO: 6857705 - DNA, 59 bp, Homo sapiens
gtgccaggcatggtgctgggctatgacctacagtatctcattctcccgtgccatggggc

SEQ ID NO: 6857706 - DNA, 58 bp, Homo sapiens
catgtgtacctgaatgcctcctccaggcagcctggagaactcagacgcaggtcatgtg

SEQ ID NO: 6857707 - DNA, 55 bp, Homo sapiens
ttgttttgcatgattcagtggtaatgtaataattgctcttgaataagcataataa

SEQ ID NO: 6857708 - DNA, 63 bp, Homo sapiens
tgtgctgctagactgctaatggatgtttattattatttaaatgttttatgtctctagctgcca

SEQ ID NO: 6857709 - DNA, 69 bp, Homo sapiens
ttgctgattgtagccactgtgatgaattaatctattagagcttttcaatttatgtggctattcattcaa

SEQ ID NO: 6857710 - DNA, 58 bp, Homo sapiens
gtctgtgcctgattttcagtactgtatgccttatagttacagaagataagggtattac

SEQ ID NO: 6857711 - DNA, 66 bp, Homo sapiens
tgatgaggactgggacaggtacgtgcaccctgtgcttcacctaactgcctgtgccgatctctctca

SEQ ID NO: 6857712 - DNA, 63 bp, Homo sapiens
tttctgcagaagctcactaaatccaggagtcccctgggtgcaagtaatgaatttctgcagaga

SEQ ID NO: 6857713 - DNA, 82 bp, Homo sapiens
aatgaccccactgcaaacatagtacttgagcccagaccagccacaagatcctgggattaggctttgtttatagcaagttatt

SEQ ID NO: 6857714 - DNA, 83 bp, Homo sapiens
tcaagctctaaagtgaatgttccctttttctgaggctgtcctagagcgtcagacagccttggactgaatactttagagcttga

SEQ ID NO: 6857715 - DNA, 103 bp, Homo sapiens
gcctacaaggacacatcattgtcacccaaatttcatagttgatgttcggtttcactgttggtgctgtacattctgtgggtttggacatgtgtcctcctatagc

SEQ ID NO: 6857716 - DNA, 55 bp, Homo sapiens
ctttggctggcaccccagcggggcggaggcctcgctgcatgaagccaggccaggg

SEQ ID NO: 6857717 - DNA, 83 bp, Homo sapiens
gatatgtttgaaccagggtgatgcgtttgagaaggtttctaagagatgcaaccttatccacatcttgggaagtgaatattatc

SEQ ID NO: 6857718 - DNA, 80 bp, Homo sapiens
ttttcagctcccggtttctttgcagtgctgtcatctctggagacaggcgctggcagagagaaaagtgcccatgtagaaaa

SEQ ID NO: 6857719 - DNA, 65 bp, Homo sapiens
ctgggacctcctcactgttctatatgcaaatggccttgcacctgggcagccgagcgggctcgcag

SEQ ID NO: 6857720 - DNA, 93 bp, Homo sapiens
gcagatgaaataagaggacagatgtttggtgtggttttcagggccttataaaacttcctctccccctcagatgtctctccattatttacttgc

SEQ ID NO: 6857721 - DNA, 83 bp, Homo sapiens
ggcgggggccgggctggggcgcgggcagggggcgtcgggcgaccgtgcaccccggggccctgctcctcgccccttcccccacc

SEQ ID NO: 6857722 - DNA, 63 bp, Homo sapiens
gctttttccttcacctcttgagcctcttccccaataagagactggaagggatgaagaagaggt

SEQ ID NO: 6857723 - DNA, 91 bp, Homo sapiens
cagagtgtggagtgaagtggagaagtaaatatctgtttatagcactagaagagtgatacacagatttacatcaatcaagctacatagtctg

SEQ ID NO: 6857724 - DNA, 66 bp, Homo sapiens
aggagtccatgttaaatctagttatgtttaaattgtaatggaaaagagctgtttacatggatttct

SEQ ID NO: 6857725 - DNA, 63 bp, Homo sapiens
gtgggctaaagtggggcagggcagacactggccagctgtccacccaacccatttccagttcat

SEQ ID NO: 6857726 - DNA, 63 bp, Homo sapiens
ccacatgattgtctggcttggccacgttccacacaaagctggcttccccggagtgacatgtgg

SEQ ID NO: 6857727 - DNA, 62 bp, Homo sapiens
tgcgtgacctggcaactgtagcttctgtgggacttccactgctcaggcgtcaggctcaggta

SEQ ID NO: 6857728 - DNA, 61 bp, Homo sapiens
cctcagatgcgcgggtgcctatctgtatattcattatacagaactgcacgtgcacgcgagg

SEQ ID NO: 6857729 - DNA, 62 bp, Homo sapiens
cctctccctgacctggattccaggcctctcggaaaagggggccaggagggggcagggagagg

SEQ ID NO: 6857730 - DNA, 75 bp, Homo sapiens
tcctgttttctcagggattgagtgggagaagttgtaaggagaaagacccagaacagtcttctgagaaggcaaggg

SEQ ID NO: 6857731 - DNA, 72 bp, Homo sapiens
agctcaaactgtaccttgtcaataaagttgatttctactttaggaaccaattaatagataggaaacagggct

SEQ ID NO: 6857732 - DNA, 74 bp, Homo sapiens
gtgaccctaaggaatgaagggattctttgcaggactgtaatcctggaaatcttccttcactctttccatttcac

SEQ ID NO: 6857733 - DNA, 82 bp, Homo sapiens
ttagtctcatctgtataagcatgcttcatatggatacacaatgctgtgcatctcctgactgatgttcatttagggagattga

SEQ ID NO: 6857734 - DNA, 74 bp, Homo sapiens
tctcagcagtatccaatgagtgaagaacacttgactgactcttgggtcacctctattacttattgtactctgga

SEQ ID NO: 6857735 - DNA, 72 bp, Homo sapiens
gtaggggaggcagtgttgaaaaggagagccagccagggctttgttctcccatcagccacttccgtctgctac

SEQ ID NO: 6857736 - DNA, 58 bp, Homo sapiens
tcttcaaaccctggttttgtgataggcccgcaaaggattcatgatccagggttgagga

SEQ ID NO: 6857737 - DNA, 58 bp, Homo sapiens
tttattttcctctgcattcagctcatgtggcaagtttgaatgcaagaaggaacatgaa

SEQ ID NO: 6857738 - DNA, 57 bp, Homo sapiens
tgagtgaggtgcttagggcacagaatttaatgttgtctcggattgtaccttacctca

SEQ ID NO: 6857739 - DNA, 77 bp, Homo sapiens
caagacagcaatccttgaggtctttgagcaaacgcaagaaccgtccttctcctgctgctggtgacctctgctgcttg

SEQ ID NO: 6857740 - DNA, 128 bp, Homo sapiens
aacatgcaggaggcaatgggaacaaactacggggaaatagagctggaaccttgatcaggctgcacctgaagactgattttccactaggcttttccatatacagttgttccttattattcctttttgtt

SEQ ID NO: 6857741 - DNA, 83 bp, Homo sapiens
acaggtaagattaacatcaaccagttagttatgaggactgcccaacctcatgttaatctctaattgtttgtgttgtcacctgt

SEQ ID NO: 6857742 - DNA, 58 bp, Homo sapiens
tagcttggtcatcgtggctgttggacaagatgctaaagcagccacagccaccaagcta

SEQ ID NO: 6857743 - DNA, 57 bp, Homo sapiens
gctggacagggccaaaccggctgatctctctggggatgggaggaaggccctgccagc

SEQ ID NO: 6857744 - DNA, 71 bp, Homo sapiens
ttataatttctcttgtcagcttctctgtggatttggtgtctacaaagaaagctgaggggaaaaaattataa

SEQ ID NO: 6857745 - DNA, 67 bp, Homo sapiens
gtccagtgacaagtagctggccatgtgaaaacagaagtgcaggcataatctgctgtgtcgtctgggc

SEQ ID NO: 6857746 - DNA, 76 bp, Homo sapiens
tcgcttgaacccaggagatggagattgcagtaggccaagatgatgccactgcactccagcctgggctacagagcga

SEQ ID NO: 6857747 - DNA, 75 bp, Homo sapiens
ctgcttctcagctgtgagggctgctctgggtggtatgacccagcaatgtgacccctgacagcaggtgtgaagcag

SEQ ID NO: 6857748 - DNA, 62 bp, Homo sapiens
attagatatttgctgttggatttggtatatttaggcaaatccttcttctgctagtgtctaat

SEQ ID NO: 6857749 - DNA, 55 bp, Homo sapiens
gtgaaggccagtagggtcctggcctcacccaggcctgcctctacttacctctcat

SEQ ID NO: 6857750 - DNA, 59 bp, Homo sapiens
ctctgaatactttaagaattgtggaaaggttgcactccagaaaagtagagttttcagag

SEQ ID NO: 6857751 - DNA, 58 bp, Homo sapiens
tatcccgtcataatgatgctattaggaatttcttcatggtggctcacctgattggata

SEQ ID NO: 6857752 - DNA, 58 bp, Homo sapiens
cagggtcactctgtctgctgtgtggagaacagtccgcaggaagacaagggtggaaatg

SEQ ID NO: 6857753 - DNA, 81 bp, Homo sapiens
gtagattgtgctgcagtttgtaaacattttaagttgcataaactgctccttgattttcaaatgtagtataatactgtctac

SEQ ID NO: 6857754 - DNA, 56 bp, Homo sapiens
ccgcgcccgcgcgctctcggctgggcacggtccggctccaggcctgacgggcgcgg

SEQ ID NO: 6857755 - DNA, 64 bp, Homo sapiens
tctctaggaatagcaaagtaggacagaaataaggctttctgtctcccaggcaattcctaggaga

SEQ ID NO: 6857756 - DNA, 68 bp, Homo sapiens
ggagacggccgtggcccgggcgcggcggccgcccctctggctgctctgcctggtcgcgtgctggctcc

SEQ ID NO: 6857757 - DNA, 74 bp, Homo sapiens
tgagaggggatgggtatgtttgtggccttgatggtggtaatgatttcacaggtacatccttatccccaaactca

SEQ ID NO: 6857758 - DNA, 56 bp, Homo sapiens
gagccatgagatagttggttcgtcgaaaacaataacaaccaacagaatcatgtctc

SEQ ID NO: 6857759 - DNA, 92 bp, Homo sapiens
actttttattgataaatttttacatgtttatgtggtacatggagtagttgttacattacacattacagaatatgtaatgatcaactgagagt

SEQ ID NO: 6857760 - DNA, 57 bp, Homo sapiens
cattcaaagcaggaaaggcctttgtcatggtcaaatggctttaatgtgttttgaatg

SEQ ID NO: 6857761 - DNA, 87 bp, Homo sapiens
ggcttggaggtccctcctgaatggggttgtggtgtcttccactggacatcatggtaacacagctgtatccaggagatcctctgggtt

SEQ ID NO: 6857762 - DNA, 62 bp, Homo sapiens
gctaattcacagtaggaaattttaaaaaaggtttgaggaagatttcctactgggagattagc

SEQ ID NO: 6857763 - DNA, 69 bp, Homo sapiens
aaggatttgatctttataatagttttgatctttatttagggttaggattaggttaaggttttgatcttt

SEQ ID NO: 6857764 - DNA, 56 bp, Homo sapiens
ggcagaagataggacagggaattacaattttcagagcccccgtcccattttctccc

SEQ ID NO: 6857765 - DNA, 57 bp, Homo sapiens
aaagcatgtgaatagaatatggctacattaagtggattctgtgagagtcacagcttt

SEQ ID NO: 6857766 - DNA, 75 bp, Homo sapiens
aggtcagccaggaagcggtgagggctgccctggtccctgcgcgtcacggctgtcttctctcttctctctctatct

SEQ ID NO: 6857767 - DNA, 73 bp, Homo sapiens
aggtcgtggacaaccaggctgggacccagggccagctgaaggtgctgggtgccaacctctggtggccatacct

SEQ ID NO: 6857768 - DNA, 84 bp, Homo sapiens
gaaagtgttttattaaaagaaggtgctacactaacaacacttaattgtctgtgtaagacatatcttagtgatgcagcaactttc

SEQ ID NO: 6857769 - DNA, 69 bp, Homo sapiens
ggaaaagtgaggcagcccaagggaattcatcttgtgtcgtcttaccttgggtgccggtcgcattgttcc

SEQ ID NO: 6857770 - DNA, 63 bp, Homo sapiens
gttgcggctgcagcagagaataggggatttctggcattccttctctgaggggccggctgcagc

SEQ ID NO: 6857771 - DNA, 70 bp, Homo sapiens
tcttggaccatcagagcagggaggaactaggcagatcatttggttcaaccccttgatggtacagttaaga

SEQ ID NO: 6857772 - DNA, 101 bp, Homo sapiens
ttgttttaagttatatttgaaaggaatttgcaggtgtgctgtgtaagggaaatattatgcacagcatgtttggagatagagttcagtgtggcttagagcaa

SEQ ID NO: 6857773 - DNA, 58 bp, Homo sapiens
catcgctcattcctctgatgctgggtttctttttcaagccacagaggacagggctgtg

SEQ ID NO: 6857774 - DNA, 80 bp, Homo sapiens
tcaagccgttgaaatgtgttcagttaaagccagtggccataaacgtgacccatgagcttcaactgacacagaaactttga

SEQ ID NO: 6857775 - DNA, 67 bp, Homo sapiens
gcattacacatagacattcgttcaatatccttttcctgtgtgtgtgtgtgtgtgtgtgtgtgtgtgt

SEQ ID NO: 6857776 - DNA, 71 bp, Homo sapiens
ctgaacataggcattgctggtattggaagtgctcactggggggcgtctctgggttaagcagtgcatgtcag

SEQ ID NO: 6857777 - DNA, 71 bp, Homo sapiens
atgtttcaatgcactttagccttagggatttttgtcaaacatggcaggaaggccaaatgtgtataaaacat

SEQ ID NO: 6857778 - DNA, 61 bp, Homo sapiens
ggtacaaatgtctcctcttttgttagggctcttatataccctcccaagtgggcattggtcc

SEQ ID NO: 6857779 - DNA, 81 bp, Homo sapiens
ttgcagattagaaaaaaacacctactagacaactgaaattgggtttcagactggcatctaagggctgttgttctcctgcaa

SEQ ID NO: 6857780 - DNA, 56 bp, Homo sapiens
gcggtggaggaggagatagagaggatctcatctgttctcttggctttgtctactgt

SEQ ID NO: 6857781 - DNA, 81 bp, Homo sapiens
ttactcttatgaagaatgttgcagtgagcatcctaggcaattcgccttatgcacatgtatgtcaatatttccctagagtaa

SEQ ID NO: 6857782 - DNA, 59 bp, Homo sapiens
ggctatgtctcataaatcgctgtaactccagcatatagcaaagttcctgacacatggcc

SEQ ID NO: 6857783 - DNA, 75 bp, Homo sapiens
cctgaaattatgttttctccttttcatctgtattttccttgtcttcaagatactaaaaggggaagctccttcagg

SEQ ID NO: 6857784 - DNA, 77 bp, Homo sapiens
ctttgtcatatacatcaagataaaaactgtcagactacactagattcacagacaattgttttggtgttaagagaaag

SEQ ID NO: 6857785 - DNA, 90 bp, Homo sapiens
tttgtgttctgtaattgctttagggcaaatatttcaatgtttaatttatattacgaaattgtcttaagagtttgagtattagaaaacaaa

SEQ ID NO: 6857786 - DNA, 97 bp, Homo sapiens
ggccgtgtccctagtgacgcggtgcggcaagttcatggggatgatgtctgcaaagcgctgcacctcgtggatcaccgcgtctgtgtaaggcatggcc

SEQ ID NO: 6857787 - DNA, 56 bp, Homo sapiens
ggaggctggccttcagacgggtgtcctcctccccagcctcctgaagcccagcttcc

SEQ ID NO: 6857788 - DNA, 93 bp, Homo sapiens
tttaatctgtggagccttagtctttggattttaaaaatactttgaaacaccctagtatttataatctgccaaagagagagttcacttgttgaa

SEQ ID NO: 6857789 - DNA, 88 bp, Homo sapiens
tgggggaccggattgtgcggcctccagagctgcctggcagagggcacaccttctcggcgccctggtgccgcaccgcgccgcgctccca

SEQ ID NO: 6857790 - DNA, 80 bp, Homo sapiens
tggctcatttgtcctcagccctgcattctggttgttgagggagatcattcacagagccagggctaggaactggtgaggca

SEQ ID NO: 6857791 - DNA, 71 bp, Homo sapiens
cagctaggaagtggcagagagcaagtgtctgactccaaagtccacgctctttctacttttcataatggttg

SEQ ID NO: 6857792 - DNA, 57 bp, Homo sapiens
gtacattagctgcatagaagaaaatgtcctttcttgagggaatatgcactgaagtat

SEQ ID NO: 6857793 - DNA, 70 bp, Homo sapiens
gctatgagggcgtaaaacaatgtatcttgctatacaatataaaacaggatttattatatgccctcatagc

SEQ ID NO: 6857794 - DNA, 74 bp, Homo sapiens
cattccagaaagatttcacatcccaagcctaaggtccaggggcagcaggcattgaggcggatgtggctggagtg

SEQ ID NO: 6857795 - DNA, 85 bp, Homo sapiens
gaattttctccttacactggggaaggtgtaggaatcatgtaattgccgcctactccggcatttgtcagtagtggggagaagtctc

SEQ ID NO: 6857796 - DNA, 61 bp, Homo sapiens
gggcactggcggggcagctctggcttctcaggagctgaggagatcagcctccctgcaaccc

SEQ ID NO: 6857797 - DNA, 58 bp, Homo sapiens
tctcccctggtctcgcgcgctgtctgaaccccgggcggcagcgtccggctacgggagg

SEQ ID NO: 6857798 - DNA, 81 bp, Homo sapiens
cccactcctcctctcctactttcagatggatttattccttttttaaacaatgaacatcggaaatgagactgtggggtgtgg

SEQ ID NO: 6857799 - DNA, 68 bp, Homo sapiens
cagagcaattaagccgaccccagcgtcctggctccagtaagccgctcagctctccgttttattgcctg

SEQ ID NO: 6857800 - DNA, 57 bp, Homo sapiens
atggcattatagcaatggtttgtgttatgattaaagcaaattattcttatatgccat

SEQ ID NO: 6857801 - DNA, 111 bp, Homo sapiens
gccaaatgcaattaagtcgccttttactgcagggcattgtaactctttgttcattttggaagtgttgaattaaagagaggacttgttttgcagacttaatattaataaggt

SEQ ID NO: 6857802 - DNA, 62 bp, Homo sapiens
gattctcagtgtgattttgagtaggcgacagagagttctcaattctagacaacactgaaatc

SEQ ID NO: 6857803 - DNA, 130 bp, Homo sapiens
gtaagaatgtttcccttggaagaagccctggggttccagtctgaaactacagttgaaagaaggagaggaccagctgaacctacctggggccccatggatgcttcttcagcccaaggaaacaatttcatgc

SEQ ID NO: 6857804 - DNA, 74 bp, Homo sapiens
ttagaggactttccttggagtgctattggatgttttttgcacttcaaactcacactagggagacgggcctttga

SEQ ID NO: 6857805 - DNA, 78 bp, Homo sapiens
gatcttacttaatcctcaccgcaagcccatgagctgagcactgtgcatgcatgctactgggaggtagtgggtgggatc

SEQ ID NO: 6857806 - DNA, 71 bp, Homo sapiens
ggcacagagcccagcttcctagttcaccaccaatgagccaggtgttttgctgggttgcttgtttttgtgcc

SEQ ID NO: 6857807 - DNA, 70 bp, Homo sapiens
ccctgtgccttggcgctgtgccacggagggccgaaggaaggcgggcacttactgccaaggcgagccaggg

SEQ ID NO: 6857808 - DNA, 85 bp, Homo sapiens
ggtggaccagcagagctctcctagaccgcagagctctcctagaccgggcctggggtccgcaggaggccactgtgctccagccacc

SEQ ID NO: 6857809 - DNA, 81 bp, Homo sapiens
gtgaatctaactattttgcataattactgatatgctgattatcactggtttttattatgtagttgtgatggttaatttcat

SEQ ID NO: 6857810 - DNA, 57 bp, Homo sapiens
gtcaatcagcaagcatttattgagtgtgtatgtacatacaggcatgctggagttgac

SEQ ID NO: 6857811 - DNA, 63 bp, Homo sapiens
gagaaccccacatccctggccagcagagccgatgagtaatgaaggaatgagggagtgggtctc

SEQ ID NO: 6857812 - DNA, 100 bp, Homo sapiens
gtgtcaaacaaatcaataatgcaggcagccttctcgtctcacagttcagctccatcttcaccaggtgggtatggagaccaagaatgtgctgctttgacac

SEQ ID NO: 6857813 - DNA, 107 bp, Homo sapiens
gccgagaacgtgtgactccctgggccagtttctcattgaaatcagatgacgcaggaagtatcatccacatttcagtgataggctgccccctagtgacaattttcagc

SEQ ID NO: 6857814 - DNA, 127 bp, Homo sapiens
cccaggtcacacagctggtaagtgccagagctgggatttaagcccaggccacatagtccttccctgtgctgtgtggcctctcaggcttgatcaattatctctgctgggtattgagctaggacctggg

SEQ ID NO: 6857815 - DNA, 57 bp, Homo sapiens
tggtccctttgactgcccgccacaagggaagatccaaagtgtggcagagagtgacca

SEQ ID NO: 6857816 - DNA, 62 bp, Homo sapiens
tgtgcagctatctctctacagttgtacataaaatgtttttactgtaaaatgagatatgtata

SEQ ID NO: 6857817 - DNA, 77 bp, Homo sapiens
aagttattaagtattagaatgaagtataggatttgggtcttttgaagttctatagtctttctactaactgctaactt

SEQ ID NO: 6857818 - DNA, 87 bp, Homo sapiens
taggagataccttgcaaagccacaacattagttagccagactggttcagtcatctgggagacgtgtgttgtcagtggtaggatcctg

SEQ ID NO: 6857819 - DNA, 65 bp, Homo sapiens
cggggcgagcgggctgtggctgggtgctggtgggcagacaccatcagagcacagtccgtgccctg

SEQ ID NO: 6857820 - DNA, 82 bp, Homo sapiens
ttgagaggatataagaaagtaattttgtctgagttttaggttttggccatgattgaaacaagttgctttctattccttacag

SEQ ID NO: 6857821 - DNA, 90 bp, Homo sapiens
cttgaccttggcccagtagacctctgaggctgggaattcagctttctctggaaagctttctcagtcattaggtacttggcttaatcctag

SEQ ID NO: 6857822 - DNA, 56 bp, Homo sapiens
agctgtattctctttgtattaatatccttaccgtgtttcacagggcagaaacagct

SEQ ID NO: 6857823 - DNA, 112 bp, Homo sapiens
tccctagcaggcctagggggggtctggggcaggggtctcccttggggagtggcgtctgccagctgctgtgcagggaggctctcctgctcataccctcttctgggcacaggga

SEQ ID NO: 6857824 - DNA, 60 bp, Homo sapiens
atacacgtgtgtgtacatgcacgtgtgtgtacgtacacgtgtgtgtacgtacacgtgtgt

SEQ ID NO: 6857825 - DNA, 75 bp, Homo sapiens
ttgttaagtcatttggtaggcatgagttgataaaactattgtttgtgcaatttatgtactatataaaggcagcaa

SEQ ID NO: 6857826 - DNA, 86 bp, Homo sapiens
gtggaagtgtgggggtgggaggaggacactctgcttcagcccctaggcctgttccatgtgtccttgttcccattccagacacccac

SEQ ID NO: 6857827 - DNA, 79 bp, Homo sapiens
ggattggggcctggttgttgctttcgagggtgtgggaagaggacacatcacagtgataactaagtcctgcatgcagtcc

SEQ ID NO: 6857828 - DNA, 121 bp, Homo sapiens
aggcaagaaggagatgagggccagcaccccagagccaggttttagtttaaattgggcttctgaatccaatactaaattgcaaccaggtctctgtctttgttgttgtttattttctctgcct

SEQ ID NO: 6857829 - DNA, 81 bp, Homo sapiens
aggttatgataagtatcaaatggtagcatatgtataaagcagtacataaatgtaagatactattttgatattttataagct

SEQ ID NO: 6857830 - DNA, 66 bp, Homo sapiens
agcacgatgctggtatacagtggtgttaaccatatgggggctgctgttatatgggtgttatgtgct

SEQ ID NO: 6857831 - DNA, 58 bp, Homo sapiens
ccatcagctgcagctggtagtccattcaaggcaaagtgtttactagtctcagttatgg

SEQ ID NO: 6857832 - DNA, 58 bp, Homo sapiens
cagtggctcatgcctataatcccagcactttgggaggccaaggaaggtgggtcacctg

SEQ ID NO: 6857833 - DNA, 73 bp, Homo sapiens
cagagtaaaactgtaatttgctgtctcatttgtgttctatgggcactggtgtgaaacagtagattttattctg

SEQ ID NO: 6857834 - DNA, 97 bp, Homo sapiens
gctcagaaggctcttctctttgacattattcaggtggtgtcccagcgaatcagtaccgtggatctctcgtgttacagcctcgaggaggttcctgagc

SEQ ID NO: 6857835 - DNA, 76 bp, Homo sapiens
atagacagatgatagataaatcgatagctattataaacacttgggacatgtagctggcaatctatcatctatctat

SEQ ID NO: 6857836 - DNA, 63 bp, Homo sapiens
cggcgcagtcagacgccatctgctgtacacctctgcgcagccattggctgcctggtgcgtccg

SEQ ID NO: 6857837 - DNA, 55 bp, Homo sapiens
gcaaccctgggacacgctcatggctccagccactttcctggcgctcccagggtgc

SEQ ID NO: 6857838 - DNA, 66 bp, Homo sapiens
gccaagtcacagctgctttcttgcaagaggcttcatggtgtctgagaaatcagtggtgaatatggt

SEQ ID NO: 6857839 - DNA, 85 bp, Homo sapiens
gcagtagatgggaggtagatagcttcttgtcttatctacatgaagagataattttaaccaagtttctacatctccatcataaagc

SEQ ID NO: 6857840 - DNA, 55 bp, Homo sapiens
gcaatggggagctcaccacctgttttgaagccaggcaggtttgggctcttcttgt

SEQ ID NO: 6857841 - DNA, 60 bp, Homo sapiens
ctttccagccagatttgctgggtttctgaacagtttaacacagttttcttggctggaggg

SEQ ID NO: 6857842 - DNA, 77 bp, Homo sapiens
ggtcccggaaggatttgaggatctgcacggagtcaggaccagcccctggccccctgattgtcacctttctcaggatc

SEQ ID NO: 6857843 - DNA, 76 bp, Homo sapiens
agtgcagccgggccccacggtgacctcaggagagaaggtgaccctgctgtgtcagtcatgggacccgatgttcact

SEQ ID NO: 6857844 - DNA, 68 bp, Homo sapiens
tatggtcaaagatatgaagccctcaagtccagataaacatgaaggccatggctaatgtctttgaaata

SEQ ID NO: 6857845 - DNA, 80 bp, Homo sapiens
cctatatatatcgggacataaatgaagtttgactatggtgttccatggggaaaatattggtgtctggaagtcagagtggg

SEQ ID NO: 6857846 - DNA, 62 bp, Homo sapiens
ccgtggcgagcatgagtcactctgggcctcatctgaaccctatcttggcatcttgcttgtgg

SEQ ID NO: 6857847 - DNA, 80 bp, Homo sapiens
ccacaccttggggcttgctgttgtagcctgtgtggtcactaggcatgtctgggctaaggacgggcaagtcccacaagtgg

SEQ ID NO: 6857848 - DNA, 58 bp, Homo sapiens
atattgggatgtttggaaatgcccctgaaagtctttctattgctaaatttcccaatat

SEQ ID NO: 6857849 - DNA, 70 bp, Homo sapiens
ggctgtgctaaggactgggaggcaggggaatgagcccacctgctgctcctggcctttggaggctgcagcc

SEQ ID NO: 6857850 - DNA, 66 bp, Homo sapiens
cagtgtcagtttggctctaaagtttcaagggatactgaaagggaatattggaaccaaatgaatctg

SEQ ID NO: 6857851 - DNA, 68 bp, Homo sapiens
gaaagctcttactagctacaaatatcactaatagtgatgagagtgatgttgactagctataagctttc

SEQ ID NO: 6857852 - DNA, 71 bp, Homo sapiens
tgggaagtagtggggtagagtggaaaaagcaaggctgatctgaggacaaattctagctcatctactttcca

SEQ ID NO: 6857853 - DNA, 60 bp, Homo sapiens
tgggggaaagccttcttgtatcgagccagcctctttggctggtcacttggggtgccccca

SEQ ID NO: 6857854 - DNA, 123 bp, Homo sapiens
tgagagattgaagggaaggatgaaaggagtgaaattttcactgacgggtgaaaagtaaccaatattgggtatagctcagcaccccgacaggacattctttgtcatatgctaatcaattttttg

SEQ ID NO: 6857855 - DNA, 77 bp, Homo sapiens
agtattctttgaagtgccctgttcacttcatggttctgtagagaattagaaaacttccaggagtttccaagaatgct

SEQ ID NO: 6857856 - DNA, 55 bp, Homo sapiens
ccctctcttagaagaaacacagccttcagcacttggtaccggcttctggaggggg

SEQ ID NO: 6857857 - DNA, 74 bp, Homo sapiens
aacccacctaatatatgatggtggattagattaataaattagtgcaatttcaatgcactcatggttggtgggtt

SEQ ID NO: 6857858 - DNA, 79 bp, Homo sapiens
tgagtagtaacacttcccgaccatatggctgtctctaaaccttcatccttagcaggtgtgtgtgggagtgtgatacaca

SEQ ID NO: 6857859 - DNA, 63 bp, Homo sapiens
aatcagcagtcttcccttcctttttctctagtactagggaaaaaacctaggaaggtgctggtt

SEQ ID NO: 6857860 - DNA, 59 bp, Homo sapiens
gaaagcctgtatttattgagagtgtaccattgcaggtggctcttgagatgcaggtagtc

SEQ ID NO: 6857861 - DNA, 75 bp, Homo sapiens
cgccaggcatctcgcccacgaagtaggtggcattggcagtgacgatctcaaagcagtgtgggttggtgcccggcg

SEQ ID NO: 6857862 - DNA, 71 bp, Homo sapiens
gtcagctcggctccgtcttgccagggctggggggaccctcatcctcacccgcttccggagctgcagtggat

SEQ ID NO: 6857863 - DNA, 79 bp, Homo sapiens
gcaaggcagatatttcagttcacattgaaggcctaaattattggattttaaagaatgttgatctgatatatttgattgc

SEQ ID NO: 6857864 - DNA, 71 bp, Homo sapiens
tttggcaaagtcttagcaactatcgctttatcctgtggaaaaagctcaagggtgttgcagagacctccaaa

SEQ ID NO: 6857865 - DNA, 91 bp, Homo sapiens
actgcaaggttaagtactattagtctctttcatttgtaaggacaaaggaagattaaagagattaaagtaacttgccttttatccagctagt

SEQ ID NO: 6857866 - DNA, 55 bp, Homo sapiens
ggctgcagtttgcacatccaaggccccagatgggccttggctggcatctagcacc

SEQ ID NO: 6857867 - DNA, 55 bp, Homo sapiens
cccagggcttggggctgggagagacctctctcatcctgcactggctcctcctggg

SEQ ID NO: 6857868 - DNA, 61 bp, Homo sapiens
tcagcaggtctgaggcggggcctgacattctgcacggctggcctgctccgggcgctgctga

SEQ ID NO: 6857869 - DNA, 75 bp, Homo sapiens
gggacggggctgcgctcttcctgccgcttcggccggaggcttcattgtgcagtgggaagaatgcagcctcctccc

SEQ ID NO: 6857870 - DNA, 77 bp, Homo sapiens
gggttgtgggagcctggaagacattgatgttgtcaccaaatacgaattcaatttcttggtctttgaaaccgcctccc

SEQ ID NO: 6857871 - DNA, 73 bp, Homo sapiens
ggctcttggtctgcctgaaggggcctggggctatttgtactccaccccaggtcctggcagctgactcagggct

SEQ ID NO: 6857872 - DNA, 60 bp, Homo sapiens
gttcaaactggcagacttctacttcttactgagggaagaggagagagccaagttttaaac

SEQ ID NO: 6857873 - DNA, 90 bp, Homo sapiens
aaaacagaacaagtttgcttattagccttaggtcatttctacccaatactgttaccatatggcttctataaggaagcttacttctgtttt

SEQ ID NO: 6857874 - DNA, 58 bp, Homo sapiens
ctgtatgtttctatgaatgtgactattttagatacctcatgtaagtggaagcatgcag

SEQ ID NO: 6857875 - DNA, 82 bp, Homo sapiens
ttttataggtggcagtcaactcttttgtgctcctgtatctgggacagttacagagatgccgaagagtgaaataactgtagag

SEQ ID NO: 6857876 - DNA, 57 bp, Homo sapiens
ttccacatctctcagcttccagtgcccagcactgtgacccagagcaggtgccaggaa

SEQ ID NO: 6857877 - DNA, 91 bp, Homo sapiens
tgtctttggtgaacacatacacattttttgcgttatatacttaggattcgaattgctgggtattagaatgtgtgtgtcttcagctttagca

SEQ ID NO: 6857878 - DNA, 62 bp, Homo sapiens
agttaccgagaacatgactggaattcaggaaatgctaaaggtcctgtcttatctctgtaact

SEQ ID NO: 6857879 - DNA, 123 bp, Homo sapiens
tgggatagaagtgagggaagaggtggctaggcctgaccggaatgtagaggccggatagcctattaacagtgtctagttttagcttttggagccagctgcctagcttcaaaccacaacttccta

SEQ ID NO: 6857880 - DNA, 83 bp, Homo sapiens
cagcagggtcctgtcttccttctgctctgtgggacagtgccagggcactgccaggcagcagagggagaagcggggagccgttg

SEQ ID NO: 6857881 - DNA, 55 bp, Homo sapiens
cgtgggctgcgcccagttcttcaccaaggctgactacccgcagtgccagtccatg

SEQ ID NO: 6857882 - DNA, 62 bp, Homo sapiens
tccaagatggttggtgtggtggtgcactgtgaagcagttccatgaacagctaacattttggg

SEQ ID NO: 6857883 - DNA, 58 bp, Homo sapiens
gcattttgtttggaaatctttattgttacaaagcagtggctgattacaaactgagtgt

SEQ ID NO: 6857884 - DNA, 66 bp, Homo sapiens
tttgtccaataccacagagttagtaaccagtagacttgtgattagcaatggtggtattaggaaaga

SEQ ID NO: 6857885 - DNA, 80 bp, Homo sapiens
cacagacaaagccacccctgagatgtgtaacagatggtggtgacagtactgtctatatgctctcatggcctggtcctgtg

SEQ ID NO: 6857886 - DNA, 78 bp, Homo sapiens
caatcagtcaccttgactatagctgtagttggagaaaaacaagctctagactagttctactcaaagtgtgatccattg

SEQ ID NO: 6857887 - DNA, 88 bp, Homo sapiens
gcatatacacagagagtcccttcctgataatgagattttccctgcttagactggaggaaaatattcagggaggtttctgttatatagc

SEQ ID NO: 6857888 - DNA, 78 bp, Homo sapiens
tcttatgttattataaaactatgatttgcaaatgtgtctgttgaaacagtcttgctgtatggtcaggtggcaataaga

SEQ ID NO: 6857889 - DNA, 68 bp, Homo sapiens
gggaaaaagcaggtactcagcttgggggatgtctgaatcctacctcagtgttcacttagtttttctcc

SEQ ID NO: 6857890 - DNA, 59 bp, Homo sapiens
cacctgggctttctctgggactcacctaggagttccccagtgtggtaggtccacaggtg

SEQ ID NO: 6857891 - DNA, 58 bp, Homo sapiens
tccttgattgaatattcccttgggcctgccagtccaggctcctgttatttaatgagga

SEQ ID NO: 6857892 - DNA, 84 bp, Homo sapiens
ctcccaggaggccctgggccctctgagcctcagttttcttgtctggtgatggctgagggccagggctagtctcatgcagtggag

SEQ ID NO: 6857893 - DNA, 58 bp, Homo sapiens
ggcaactgggtatggtgtatgtggcctgagttcctgggccagaatctgcccagatgct

SEQ ID NO: 6857894 - DNA, 89 bp, Homo sapiens
acgtgtgagccctcagtgactggtccttcacagccacactctgtgggatgcagagtctgtgctggggccagctcgggagagctgaccgt

SEQ ID NO: 6857895 - DNA, 61 bp, Homo sapiens
ggccttcggggtgggactcaggggcaggcagaacctgtccaggaattgaccctgcaaggtc

SEQ ID NO: 6857896 - DNA, 59 bp, Homo sapiens
ctggtgactccctctcccgcttctcccaactctgaggcccagggactgggaatcagtgg

SEQ ID NO: 6857897 - DNA, 81 bp, Homo sapiens
ggcagcatacatacaaagtgacatgaagcaggagatcaagacaagccatactcctaaaaatgtcctttgtgtgtagctctc

SEQ ID NO: 6857898 - DNA, 124 bp, Homo sapiens
caacagctctgcaagcttggggttgtggttcacaatttttactgattgggcgactgagatgcagaaaggccacagttactcagtttgtatgtgagcagtccaaggttcaaacccatgtctgttg

SEQ ID NO: 6857899 - DNA, 114 bp, Homo sapiens
ctatatacccagtcttgttgcagtttgctgagcgggtggagcgttaccttgggaggccctgatccctccctgggcggacattctcccacagccaaactctcaagaaatgtatgg

SEQ ID NO: 6857900 - DNA, 98 bp, Homo sapiens
ctgaggaatagaaagtttgtctctctgtattcttcgtaatgcctgatgcaggcataagaacacagacacaaagtaaaattggttctatgaattctcag

SEQ ID NO: 6857901 - DNA, 64 bp, Homo sapiens
gctgggtggatcggaggctctgccaggcccaagacacctgcagcacgcatcccaccacctcagc

SEQ ID NO: 6857902 - DNA, 127 bp, Homo sapiens
cttagcacagcatttggccttcagtatgtggtcaatgaagatacactattcttatttttcttattaggctcagagcagtacctgttttttcaaccatcgtgctagagactgctaactgctccctagg

SEQ ID NO: 6857903 - DNA, 78 bp, Homo sapiens
attttccaatgtagatgtctctgggattgccagcagcttatcgaatctggaccagtgaaactttctatgttgtgaaat

SEQ ID NO: 6857904 - DNA, 65 bp, Homo sapiens
ggtggaagtgaggagaggccagttgtgactattcagtggcagggttttatagatctcttcccacc

SEQ ID NO: 6857905 - DNA, 64 bp, Homo sapiens
gctttaggcttttgtagctttccattcctcatgttcagttgatagctgcagtcaagccagaggt

SEQ ID NO: 6857906 - DNA, 79 bp, Homo sapiens
gagctcagccactacaattggttccattctacagtaattattctcatgtggtttgtggaactcaattgtgaggtccctc

SEQ ID NO: 6857907 - DNA, 67 bp, Homo sapiens
tctgtttattcactttgggagagccattctgagaattgatgaatgtgttttatgagagaatataaga

SEQ ID NO: 6857908 - DNA, 89 bp, Homo sapiens
ggcatggtgatcacggctgtacactggtttcaaggacaccaactgctgctctagtccttctgtgaccaccagcagccccacactgtgcc

SEQ ID NO: 6857909 - DNA, 63 bp, Homo sapiens
tgcatcaggacttgcaggaccagagaaagaaggagaataaatatatcctgcagcttctatgta

SEQ ID NO: 6857910 - DNA, 56 bp, Homo sapiens
ccccttcctgtacacttcttgccagagcagaactgggaggtgagtgtgggaaaggg

SEQ ID NO: 6857911 - DNA, 71 bp, Homo sapiens
catgttatggttgatatcagtaatattatggaaatgtccattgctttattactctgtctgcctctgacctg

SEQ ID NO: 6857912 - DNA, 106 bp, Homo sapiens
ccagcctggaggtggcagagccaggtctccagctcagggtccagagtgcactcagtcatgccacccctgagctggggacttcccccttttaacatctcctggaagg

SEQ ID NO: 6857913 - DNA, 87 bp, Homo sapiens
ctgagatcagcatcctcactgaggtcagcccttcctatgatcctgcacaaggaacaaggtggggctgtttcagagagttcctctcag

SEQ ID NO: 6857914 - DNA, 57 bp, Homo sapiens
tacatgtgggttaaaaacactcttgtcttccctaggggtgcgaatactcataatgta

SEQ ID NO: 6857915 - DNA, 60 bp, Homo sapiens
gcaatgagagagtgctttttacaatgatatagtagtttactgtagccagcctctcaatgc

SEQ ID NO: 6857916 - DNA, 83 bp, Homo sapiens
gcacagtgcctggtatgcagtaggcattaataattgtaaagaaattaattaattgagcacatactgtgggccaagcactgtgc

SEQ ID NO: 6857917 - DNA, 74 bp, Homo sapiens
ggagctgcctttcatgcttggagggccacacaatgactcaaggctcatggccccccagagctggaggacagccc

SEQ ID NO: 6857918 - DNA, 91 bp, Homo sapiens
acagtaaagtcttggcggtattctcagagtgaccaagtctttctatctttggaaagagttacacagtttcagaaactgctaagatagctgt

SEQ ID NO: 6857919 - DNA, 63 bp, Homo sapiens
tctcctccaggaagccttccttgtctgctcctttctcaactggagccctgtttcctggagaga

SEQ ID NO: 6857920 - DNA, 126 bp, Homo sapiens
gctgtagttcaagcacagaccctctcaccccagccagcccttctccaccttccgggcgcacagtcttaggggtggagcagaggctgaggttgggggcctcacagtcaaaggtgctgagacaacagc

SEQ ID NO: 6857921 - DNA, 59 bp, Homo sapiens
gggcagagtggagtgcggcctcctgcaatgtccaggagtaggtgctcctcactctgccc

SEQ ID NO: 6857922 - DNA, 74 bp, Homo sapiens
ggttcttcagtgtagcaactgtattttcaaatataaatctgatttatgcagttagcactacagaagaaaacgcc

SEQ ID NO: 6857923 - DNA, 108 bp, Homo sapiens
tcctatattttaacatctttttggtatatttgttagctgtttatagggaataatttttcttaatagaatagcagctggtgcaactctaagaacatgtcaaatctagga

SEQ ID NO: 6857924 - DNA, 59 bp, Homo sapiens
tcctgctggactctgagtacaaagctgccctttgaatgggctgcctcagggctgctgga

SEQ ID NO: 6857925 - DNA, 68 bp, Homo sapiens
ttgtttcattagtactgacaataaaaatacctaaggtagaaggttgttgtgagtattaaatgagataa

SEQ ID NO: 6857926 - DNA, 64 bp, Homo sapiens
ctgggagttgacgaggcttgtaacaatctactgggatgatgtgagcctttattaacctcatcag

SEQ ID NO: 6857927 - DNA, 67 bp, Homo sapiens
agtgtgggctgtgcagatgggcctgggccactcccaggcagaggctctgatgcaagcccagggcact

SEQ ID NO: 6857928 - DNA, 81 bp, Homo sapiens
aagcctagttttggaaatcatttcttgccaagtgaaaaggtgctaagcttctcagcaagaagtcatttgtagcacaggctt

SEQ ID NO: 6857929 - DNA, 61 bp, Homo sapiens
agcagctggtgagcaagctcagtgtcaccccctagtgtgaactgtgccgttcacctctgct

SEQ ID NO: 6857930 - DNA, 109 bp, Homo sapiens
cctcagtgctggtggctggaggttggaccatgttgggggtttcaccaggatttactatagtcttgcagacagcttccagcctgctcttagtcagccctcccggttcagg

SEQ ID NO: 6857931 - DNA, 130 bp, Homo sapiens
tggtttttttgaggtcatgtgagtaagtttgttacatattctatttatttcatgtccgtacataaaggggatgttagaaattattagtaatatcaatgaggtttgaaaaccactgactccaagaagagca

SEQ ID NO: 6857932 - DNA, 88 bp, Homo sapiens
aaggagtaggtggcaacaaggcagtggatgtattttcctttattcttgtaaagataagacatcaactgagcattgccagactgccctt

SEQ ID NO: 6857933 - DNA, 58 bp, Homo sapiens
gtgcggagacctaattagtatccagggaacactaggcttgatcacataggtctcccat

SEQ ID NO: 6857934 - DNA, 59 bp, Homo sapiens
ctgaattgctttacaagccgtttaagaacaatttaatattcctgtgtgcagcagttcag

SEQ ID NO: 6857935 - DNA, 72 bp, Homo sapiens
ctgacttagatgccatcttttattcttctagaaactgagaaattctgcaagattggaagatgcaatattcag

SEQ ID NO: 6857936 - DNA, 69 bp, Homo sapiens
gcatccttagtgttttctcttgaatcctgtcttctccttcatggtctctggaggggacactgcagatgc

SEQ ID NO: 6857937 - DNA, 56 bp, Homo sapiens
gtgtgcttcagattcattattgtttagttcttcctaagggatgaaatgatgcacac

SEQ ID NO: 6857938 - DNA, 64 bp, Homo sapiens
gcactttctgagacaacttagccctcgagaattccacatttcttgttttgttgtccagagtagc

SEQ ID NO: 6857939 - DNA, 66 bp, Homo sapiens
aaatatagtaaatgcatagttcagccaagaatcaaagatgcagaagtactatgcatttatttgttt

SEQ ID NO: 6857940 - DNA, 56 bp, Homo sapiens
acagccttcgttacgttctcaattggtctgtgaccaatcaaaatgtatggagctgt

SEQ ID NO: 6857941 - DNA, 73 bp, Homo sapiens
gaaagtgggtgcaagcttggctgatgttgatccaatgaacattgataaatcagtaagttttgtaaatgttttt

SEQ ID NO: 6857942 - DNA, 78 bp, Homo sapiens
ttcagtgggaaggggagctggaaaggagatgtggctggtaagtaatcctcctctgaagttcacccatctccagctgga

SEQ ID NO: 6857943 - DNA, 66 bp, Homo sapiens
gatgtaaactgggacttcctagggcaaacaaaaatgtatagtcaccctatcactcaagtttacgtc

SEQ ID NO: 6857944 - DNA, 63 bp, Homo sapiens
ttgacatccttagggcagcagccagactggtgtgcacccctggtaatggctcaagcatgtgga

SEQ ID NO: 6857945 - DNA, 94 bp, Homo sapiens
gcataactgtattaggtgaaatgagccttgtgtgtgtaaagtgtagcctaccatattccagcagaccatcaaggctcagcttaaacgaaaatgc

SEQ ID NO: 6857946 - DNA, 116 bp, Homo sapiens
ctgggaaatctcactgtcttcattgttgacataccaagagcaaagctgggaggtttgagcacagagctctatggtgagtgtctgtgaagaagacatgatggagaagtttctaccag

SEQ ID NO: 6857947 - DNA, 61 bp, Homo sapiens
caggttagttaatctttgtttccttctcttctttggaaattatgtagattggtctaacctg

SEQ ID NO: 6857948 - DNA, 98 bp, Homo sapiens
gcgtttgatgcgggacgttcctgtgggagggagcggctggatcacagttcggtgtgcggctggctctgctcacatcctcgtccttggcattacagcgt

SEQ ID NO: 6857949 - DNA, 79 bp, Homo sapiens
cagaggaaacacagaggtggccactcttttttgccaaccaccctggatgaagaaagtggaatctctgtttttatagctg

SEQ ID NO: 6857950 - DNA, 82 bp, Homo sapiens
ggacagatggacctgtcttcaggggaggaatctggctgcctctgctcgctgaattctgccttgaggccttcctttcatgttc

SEQ ID NO: 6857951 - DNA, 82 bp, Homo sapiens
cagagttacagaagctatacaatgcacaaatgatgaaatcatgagtggattaatatggctcaaggaagcattgttgattctg

SEQ ID NO: 6857952 - DNA, 95 bp, Homo sapiens
ctgtggaggtgcagcttcataaacagtgtactcctttaccggaggctgagttgtttcacctctgcgggggtagattgtgaggttcactctaacag

SEQ ID NO: 6857953 - DNA, 61 bp, Homo sapiens
gctgctctgcttctgagaggtgctctgttactgcgtccttacttggcagaacgcagaaggc

SEQ ID NO: 6857954 - DNA, 105 bp, Homo sapiens
gccagccagccccgctgggaagggcagtgggtagcagctgaagttttcctcgcttccagctcccactctcactgctgactaaggtgtgcggaggctgatgttggc

SEQ ID NO: 6857955 - DNA, 91 bp, Homo sapiens
cataaagctcttccaaatgcaagttcatattttgttctcacttcttgtgtgtgagaacaaaatatgaacttacatttggaagagctttatg

SEQ ID NO: 6857956 - DNA, 61 bp, Homo sapiens
gtgtgtttaatgcacattgtttcctggttaaaccagttttcagtgttgatatttaatacat

SEQ ID NO: 6857957 - DNA, 75 bp, Homo sapiens
tccatgggccagtaatgctggaggtttgttagaaacgcaacttccaggccttccttcccagcctactggtttgga

SEQ ID NO: 6857958 - DNA, 83 bp, Homo sapiens
tctgcagagcccgcatcccaaccctgacccaggggccggggcgcaggctcctggagggaggcggtgctacgggactctgcgga

SEQ ID NO: 6857959 - DNA, 75 bp, Homo sapiens
acctccttcaatcttcctgacaaccctatgggtaaatattattgttgtaattcccatttagcggatgagggaagt

SEQ ID NO: 6857960 - DNA, 61 bp, Homo sapiens
ggcagctccctatggtgaggcgacagtagtttggttccttctttttcagggatagcgtgcc

SEQ ID NO: 6857961 - DNA, 60 bp, Homo sapiens
gctgccagctttccttggctgatgtagatgcattcattccaggccagggagagctgctgc

SEQ ID NO: 6857962 - DNA, 88 bp, Homo sapiens
cctccccagcttggctattcgatcactgccgaggacctagacttagagaagaaggcttcattacagtggttcaaccaggccttggagg

SEQ ID NO: 6857963 - DNA, 68 bp, Homo sapiens
ggaagagctggttttaggctatgtctctgggattgacttccagaatgtcaaccaagaaccagctcacc

SEQ ID NO: 6857964 - DNA, 88 bp, Homo sapiens
acatttacataattatgaacacatgccttaagaataagtggtacgccatatatttgtgtgtgcatgtgtgatatatgtatgtgtatgt

SEQ ID NO: 6857965 - DNA, 104 bp, Homo sapiens
aggaacaaataagatagatagtactccaaaacttgtcatgcagaatctttatgttccttcttgagactctctggtattggcaagttttatactattaatttcct

SEQ ID NO: 6857966 - DNA, 60 bp, Homo sapiens
aggggaagcgcagtgcagcctttgaggacctgacagctggcagtgcccggtgcctcctct

SEQ ID NO: 6857967 - DNA, 67 bp, Homo sapiens
gttagagccccagaaaacagtggtgagcatttggtcgtccactgtgtcatcttgggatgtctctagc

SEQ ID NO: 6857968 - DNA, 65 bp, Homo sapiens
gatataggcagatctgagaatattagctatttaatatcctggctgggtaatctttctgatatatc

SEQ ID NO: 6857969 - DNA, 67 bp, Homo sapiens
tctggtcccttttcctgcagtctgagtgtgctctgtactcagcagatgccacggtgggggacataga

SEQ ID NO: 6857970 - DNA, 62 bp, Homo sapiens
agcaaattctcacagaggcttgggctcatgaaacaaccaagagtaagaaccttgagattgct

SEQ ID NO: 6857971 - DNA, 65 bp, Homo sapiens
ttccttggccccatgcccagggctctgctaagggtctgaacatgggcatggggctaaatgtggag

SEQ ID NO: 6857972 - DNA, 63 bp, Homo sapiens
tgccagctacagggttgaaatcctggctgtttctggacagctcttcttcaagcctggctggca

SEQ ID NO: 6857973 - DNA, 58 bp, Homo sapiens
agtaatatccagtccttctgaaattaaatggatatcaggataactataggataatgct

SEQ ID NO: 6857974 - DNA, 103 bp, Homo sapiens
gaagaccttggagatctggggctgagcctcaaggtacagatgaaagtctagtttcccaaaactgggccgtgtgtgttccctcaccccactccaggcttgtctc

SEQ ID NO: 6857975 - DNA, 115 bp, Homo sapiens
gggttggggtgaccagtgggcggcaggacattcagagtggagacctgggtaccatgggacctttgacatgggctggcctttcccgctctcctctcctggcccctcccccttcccc

SEQ ID NO: 6857976 - DNA, 55 bp, Homo sapiens
cagctgcttccacacaagcaaagctcaagaccagggcctgcatgctggaagtctg

SEQ ID NO: 6857977 - DNA, 68 bp, Homo sapiens
aaagcaaatttggaattgaggatttacatagagtcatttgtggggaacttcattttcatcaatgcttt

SEQ ID NO: 6857978 - DNA, 55 bp, Homo sapiens
ctgtggcctgtgccagaactggcagataccccagcccctttgagacaagccatag

SEQ ID NO: 6857979 - DNA, 108 bp, Homo sapiens
ccccagcactctcccagtgcacccctcctccaccttcccaagctgcctgatgggaccagccaatgaaagggtgcagggacaggtgtgcagaactgggaggctctgggg

SEQ ID NO: 6857980 - DNA, 71 bp, Homo sapiens
cagtagtgactgtgagtcgctgtgacactggcttctcgccgtctgctgtcttttgatttactgtcgcactg

SEQ ID NO: 6857981 - DNA, 120 bp, Homo sapiens
gcctctcccggcaagatgcaaagtcaggctgaggatctcgggcctggactcaagctcacatcccttccttggccctctgctcagctcctcagcaccactgctctctgccactgggaaggt

SEQ ID NO: 6857982 - DNA, 58 bp, Homo sapiens
cacactgcttacacaaaatgattcgatagcctgattcattatgtatttagtaagtgtg

SEQ ID NO: 6857983 - DNA, 119 bp, Homo sapiens
tgttacctggattatctcatttcttccctcttcaagtatgagaaaggggactgaggagaaaggaacaatctgcagtcaggctgacaggctaggagggaggaaagatagacttgggaaca

SEQ ID NO: 6857984 - DNA, 66 bp, Homo sapiens
tgtagccaagattggagatcgtggcagcttttcaattaaaacattttctcactgattttgggtgca

SEQ ID NO: 6857985 - DNA, 55 bp, Homo sapiens
acttttgccttaaacagatggggtctgtcggatcccataattttgtttcagaagt

SEQ ID NO: 6857986 - DNA, 68 bp, Homo sapiens
ctggcatgtccacttcaacagtttcaatcttttctttcatgtgagctttttttgagtgaatatgccag

SEQ ID NO: 6857987 - DNA, 112 bp, Homo sapiens
gagacatggccccagcaatgatggattctaaatgtgactcaccatctcataagcaagcagtctattagagggtcaaggtcccataggagcatattatgcaggccctgtcctc

SEQ ID NO: 6857988 - DNA, 56 bp, Homo sapiens
acctctgcagtagggctgtgccatgtggccacagctccagattaattgtaggaggt

SEQ ID NO: 6857989 - DNA, 56 bp, Homo sapiens
tatgagttttaaaaaggccttctgcacctcaagggaggcttggatagatattcata

SEQ ID NO: 6857990 - DNA, 55 bp, Homo sapiens
gctacagtgataggaaacacatttctaactaagtcttcgtgttccctcactgggc

SEQ ID NO: 6857991 - DNA, 95 bp, Homo sapiens
atgttctgaagtactgagggttagggcttcaacttacgaatttggtgagttcacagttcagcctgtaacacatttcttcaggatttccagagcgt

SEQ ID NO: 6857992 - DNA, 74 bp, Homo sapiens
gcggggactgggaacaaggtgctcagcggacactcagcaaacggcctgaacgccgacgcctctcccgtctctgt

SEQ ID NO: 6857993 - DNA, 57 bp, Homo sapiens
ttatccaggaaaatagtctggaactatgagtttgtgtttgttttaaatcctggatga

SEQ ID NO: 6857994 - DNA, 97 bp, Homo sapiens
cttcttgggccctttcttgggtgactcagctggaagggggatgccagaatcttcatataccttgcgtttcacagtggcctttatctgggccctgaag

SEQ ID NO: 6857995 - DNA, 66 bp, Homo sapiens
gagggagggggagtccggggcgtgcctcccggcgatcctggcaagtgggctcccagatcttctctc

SEQ ID NO: 6857996 - DNA, 64 bp, Homo sapiens
tctcctgaagtttatgaaaactggttgtctttgaggagtggaatggtttttgaggcacagggga

SEQ ID NO: 6857997 - DNA, 69 bp, Homo sapiens
gccctggttggctgagcagagtcactcttggtcacagagagtggccctgtggggtcagatgagaggggc

SEQ ID NO: 6857998 - DNA, 65 bp, Homo sapiens
gggaccttggtgctcccagatgcagcgcagaatcactattgcctgtgtggggtctgccgcctccc

SEQ ID NO: 6857999 - DNA, 63 bp, Homo sapiens
gtgtgtgactgattgttctgagcaccagatccttctgagtggcagggagttcgttcacaacac

SEQ ID NO: 6858000 - DNA, 79 bp, Homo sapiens
tgttaagggtattataaagttgtttagctttatctgtttgataagataaatgggcatttgtttgtggtactgtgaaaca

SEQ ID NO: 6858001 - DNA, 64 bp, Homo sapiens
tgtagagttgttgtaggaattaaatgagctaattcatttgaaattcttagaacaaaaactcaca

SEQ ID NO: 6858002 - DNA, 78 bp, Homo sapiens
cctgctctggctttctcagcatggcattcactttccttcccttgcctatgaaatctgtgatttgaaatgttagacagg

SEQ ID NO: 6858003 - DNA, 105 bp, Homo sapiens
ccaggagatgttaaatgttactctgccgggtcagtctcttattttttaaactgaagatgaaatgctattttggctagaagaattattccgcatcttagccactgg

SEQ ID NO: 6858004 - DNA, 100 bp, Homo sapiens
tggttatgattctagtccatacatagctttagaagacactctgtttttaggatcgcttgagcccaggagtttgaggctgcagtgagctatgatcatgcca

SEQ ID NO: 6858005 - DNA, 60 bp, Homo sapiens
agtgtaatgccagaaccactttcttctggatgtgccccaagtgtgttcttggcattacct

SEQ ID NO: 6858006 - DNA, 66 bp, Homo sapiens
gtcaacaagtagttttcttccacagtgttcctagctgggtgtgcagaaagaaagagacttggggac

SEQ ID NO: 6858007 - DNA, 58 bp, Homo sapiens
agggcagtgttaggactgtctggctctgaagtccaaattccttctaaaacgctgccct

SEQ ID NO: 6858008 - DNA, 90 bp, Homo sapiens
tgaagcttcagtttcccacaataggattgttttgcagaaatttttttctaggctcctctcacattctattgttgagatactggggtttta

SEQ ID NO: 6858009 - DNA, 101 bp, Homo sapiens
tggggcaggagaattgcttgaacccgggaggcggaggttgcggtgagctgagatcatgccactgcactccagcctaggtgacagagcaagactctgtctca

SEQ ID NO: 6858010 - DNA, 74 bp, Homo sapiens
gccaggaaatgcaggctgtgtcatttagtgattccaatgagtgaaatgatctgatacttgcatttaaatctggc

SEQ ID NO: 6858011 - DNA, 59 bp, Homo sapiens
aatttgataggctataatttaaagtatgactttaagttcaaattggggcctgtgaaatt

SEQ ID NO: 6858012 - DNA, 86 bp, Homo sapiens
tgccagtatccttctgagacccattcttaactttatggctttttttctcttctcttgtctcacaatctttgaaggaatctcaggca

SEQ ID NO: 6858013 - DNA, 63 bp, Homo sapiens
gccttttctgatgtcacgaggtctaactctacttagcagaagactggggcataagaagatggc

SEQ ID NO: 6858014 - DNA, 71 bp, Homo sapiens
tgttttggttgtgatacaagattttgttcaggtttatggaactgggtaagttgtgtgcataagaagaagca

SEQ ID NO: 6858015 - DNA, 89 bp, Homo sapiens
tcagggctagtaagtgagaaagccatattttgaacccagatcttgctgactcaaaacctaggctctctgcttcctcacaaagcctttga

SEQ ID NO: 6858016 - DNA, 84 bp, Homo sapiens
tttcaattgggtagaattcacattcagttcttttctgttaagtttcacagggtagatctggaactgaggtttattggattgaga

SEQ ID NO: 6858017 - DNA, 56 bp, Homo sapiens
agccatggtgggagtgtttacatgacagaaatcagtaaacactacaaatcaaggct

SEQ ID NO: 6858018 - DNA, 64 bp, Homo sapiens
cagaactgtgagggcggcccatgctgcaggctgtggctgtcagcaggctgcttctccacagctg

SEQ ID NO: 6858019 - DNA, 60 bp, Homo sapiens
actgtgagaaataaatggctgttgcttatcagtcccccagcccatggcattttttacagt

SEQ ID NO: 6858020 - DNA, 78 bp, Homo sapiens
agggaaggttaaatggttacttttggttgttttgaagtatttctttgagaaaactgcagagtagcctcagacctccct

SEQ ID NO: 6858021 - DNA, 76 bp, Homo sapiens
ttgacaaacacggtggctcacagcaatgtttcctggtaataagttcgttgtttgtgagtcacgatggatttggaaa

SEQ ID NO: 6858022 - DNA, 66 bp, Homo sapiens
gtggtcaggaggtaggacatactggttagtttcatccaccagtatccactcaagccccaggactat

SEQ ID NO: 6858023 - DNA, 78 bp, Homo sapiens
cctgggtgcttaatctgtttgtctctctcctgacccacggtggcccaggtgggaccagagggagaggaacagcctggg

SEQ ID NO: 6858024 - DNA, 106 bp, Homo sapiens
gagtgctactgggtggcagcctagggggcccagctgcctgccttgggccaccctgcagaagagaccaggcaggcttgggactgcttaggagcacccagtgtgtctc

SEQ ID NO: 6858025 - DNA, 80 bp, Homo sapiens
tagataattttttcctacatttgtacaataagattattctcatttatagtcttcatgttgctgtagggagagatcattta

SEQ ID NO: 6858026 - DNA, 86 bp, Homo sapiens
gggtgaaggactgaggcctgggttccgagtggggcggctaggaaaggaaaaggctaggtgctccctgacccaggtcttctctaccc

SEQ ID NO: 6858027 - DNA, 60 bp, Homo sapiens
gtaatgctgtacaccattaacaatggcatactgattgggagtggatattgatagcattat

SEQ ID NO: 6858028 - DNA, 85 bp, Homo sapiens
cttgtacccgggagactgttcctagtggctgttctgggacattctcagagcggttcgccaggtggcgctcttcccccgggatagg

SEQ ID NO: 6858029 - DNA, 75 bp, Homo sapiens
taaagttatttgcctctgctttcaaggatatctgctggcatcatgagaatcagagcaaatccagaccaagcttta

SEQ ID NO: 6858030 - DNA, 101 bp, Homo sapiens
gggagaagctggccccagcccagtccaggcctgcctctgaggagccctcccaggtgggctgcacaggcctcaggcttggtgggggcagggctgagtcttcc

SEQ ID NO: 6858031 - DNA, 115 bp, Homo sapiens
agggtcagggggaggccagagcaattagcctggctgaggcctctgctaactcagaaacgtaagtgggggattggtccaggcctcactccagggctctggcctcgagcctgaccct

SEQ ID NO: 6858032 - DNA, 86 bp, Homo sapiens
ttcttgaaagccccagggcatgggaagaactgaatagacctggccctcacttacggattctacctatacccacagcagatcaagga

SEQ ID NO: 6858033 - DNA, 92 bp, Homo sapiens
ggacgggggtgtgggcagggcacagagctgctcatggtggccaggtcccctgtgctacaagtaaggcagctcctgccattgccacctcgtcc

SEQ ID NO: 6858034 - DNA, 71 bp, Homo sapiens
ataagttctgaagaggcgaggtaagtgtgctgaaagatggttgagatgcacttgtgttttcagaatcttat

SEQ ID NO: 6858035 - DNA, 83 bp, Homo sapiens
gtgattaaatatttactgttcaaagaagattcacagaactttttaaaattaatggcttcgagtctttgtttggatagtatcac

SEQ ID NO: 6858036 - DNA, 92 bp, Homo sapiens
cccactttgtcagttctgcctggcctgatctccacgcctcatgttcctttttggggtgatcctgtgagaagcctggtgctggcaggtctggg

SEQ ID NO: 6858037 - DNA, 86 bp, Homo sapiens
gcctccttcaaagtatttctctttgattcttaagtagcaaggacaaagaacttgagaaaccaagtagaaagtgacttctaggaggc

SEQ ID NO: 6858038 - DNA, 69 bp, Homo sapiens
agtcatttcccattcttcatatggcacatggcgctttctttaatgacacatgtgggctgggaaatgtct

SEQ ID NO: 6858039 - DNA, 78 bp, Homo sapiens
gagatgggctgctcttccagcaggatagcacttatgctttggtcaagtttactgtccctggaaactgctgccattctc

SEQ ID NO: 6858040 - DNA, 80 bp, Homo sapiens
ctgctaaaaagaggtcagagcaggaaaggcagccaaattcaatagcaaagcctgctggtttctgttctgctttggagcag

SEQ ID NO: 6858041 - DNA, 56 bp, Homo sapiens
cacatggcagctgatgattggaaaccatgctggttcactgttacggctgtcatttg

SEQ ID NO: 6858042 - DNA, 59 bp, Homo sapiens
gcagatgcagaactcagtgggttttcattcaatatgcatttactgagtatctgccttgt

SEQ ID NO: 6858043 - DNA, 85 bp, Homo sapiens
gaggagaaacccatatacttccctgcagagtaaagagaatgcgcaattgcttttgctaaagggggaaatagatttgggtctcttc

SEQ ID NO: 6858044 - DNA, 62 bp, Homo sapiens
ttcagtcccatccacattctctgagtgcctaatatgtgccaggcgctgtgcttggggctgga

SEQ ID NO: 6858045 - DNA, 55 bp, Homo sapiens
gctgggcagcggcagcaggggcagtgccttctgctctggcaggcacgggcccagc

SEQ ID NO: 6858046 - DNA, 60 bp, Homo sapiens
gcaacatcggtattggaggagttaaaggataattccttgttttttctcgtgcttgtctgc

SEQ ID NO: 6858047 - DNA, 62 bp, Homo sapiens
aaatattgtcctgcattattacgtgacaatgtttgtgttcaatataaggcaggaggaaattt

SEQ ID NO: 6858048 - DNA, 64 bp, Homo sapiens
ctagaaagatgccccagtgttaaagcactcaaaatctctttgacctggctgttctcatttctag

SEQ ID NO: 6858049 - DNA, 69 bp, Homo sapiens
tcatttccctggttccaagaatcttgataggaaaacaacgctccttttatttggattttagtggaaaga

SEQ ID NO: 6858050 - DNA, 58 bp, Homo sapiens
aaccagactctccaaaggcaaaaaatgggcttttgttgtcctctggatcggtttggtt

SEQ ID NO: 6858051 - DNA, 77 bp, Homo sapiens
gaggtctgggcttgggcctggttttgttttccacggcttgcggtgttcagacacaggctcagcaggagcctgacctc

SEQ ID NO: 6858052 - DNA, 109 bp, Homo sapiens
cgtggcctttccccttccagagggcagggcggtctcagcaccctcttggtccacagctgatcttttttagctgctgaagggtctggggctgtgccctggggaagccatg

SEQ ID NO: 6858053 - DNA, 60 bp, Homo sapiens
ctcattgggtatagtctgtgggcaggaccccctctattcagtgtttctgtgcccagtggg

SEQ ID NO: 6858054 - DNA, 63 bp, Homo sapiens
taagttctttcttaaaaggaaactcgttctaattcatatttttcttctcgaagagggagctta

SEQ ID NO: 6858055 - DNA, 66 bp, Homo sapiens
atgttctagacatagctctgccttcaaaacttctaaaactggcatcaaatctatggctagaaacat

SEQ ID NO: 6858056 - DNA, 62 bp, Homo sapiens
cttactagaaattaccttctcactgccatctaaaagtggtagacttcagattttctggtaag

SEQ ID NO: 6858057 - DNA, 84 bp, Homo sapiens
gcttgtgagcttgaaacgtaccaacattgctctttcaaatatgcatcaattgaatatgcagtttggtacttttctagcaaaagt

SEQ ID NO: 6858058 - DNA, 79 bp, Homo sapiens
tatgcacattgatgcaataattatgaaaggaaaacaaatctttcctttcaccaaaaagtgttgtgttaaagcgtgcata

SEQ ID NO: 6858059 - DNA, 56 bp, Homo sapiens
gctgagcaggggtgtgattaaagccccagatctggatgccatgccccaggcttagc

SEQ ID NO: 6858060 - DNA, 69 bp, Homo sapiens
tgatgagtttggagtctgagctttaaagcccacattcagaaagagaagccaggctcctgaggctggtca

SEQ ID NO: 6858061 - DNA, 84 bp, Homo sapiens
ggttgtatgaacttgaaaaatcccttgctctctcagaccctcagtatggggtctggaaaaataagggggacatactcaatagcc

SEQ ID NO: 6858062 - DNA, 99 bp, Homo sapiens
gtggtgaccagcttcagagtgggaagctactcatgcaggcagagggacttcctttattttcatatgtgtttctctctttggagttttgtgggtcaaaac

SEQ ID NO: 6858063 - DNA, 62 bp, Homo sapiens
ttgtgaatagtgctgcaataaacatacgtgtgcatgtgtctttgtagcagcatgatttataa

SEQ ID NO: 6858064 - DNA, 128 bp, Homo sapiens
gggggttgggaggtggtgagccctagaggtagagtgctaggagaggtggttgtagggtcagtcagggacaaatgatgcagggccttctagaccatgggccttcctggggatcttctctttcagccctc

SEQ ID NO: 6858065 - DNA, 72 bp, Homo sapiens
ccaggcctggagcggccatctcatttgcatgccgcaaggttgtggctcaggcggcttctcctgggggcctgg

SEQ ID NO: 6858066 - DNA, 73 bp, Homo sapiens
aaggggggtaggagggacttcaagtctacttaatacagactcctggggatccattcctttataagacccactt

SEQ ID NO: 6858067 - DNA, 74 bp, Homo sapiens
gtgaaaggtctgcttatatcttacattaaagaaacaatctaagtgtcatgttaggtgttaagcagccctgatac

SEQ ID NO: 6858068 - DNA, 108 bp, Homo sapiens
ggatcaagtagtgcacgttctcagggaggtgcccaggagtggacttttaagcaaacaccttctcaggtctgatcatgggcccactttgggaaccactgctttgcattc

SEQ ID NO: 6858069 - DNA, 65 bp, Homo sapiens
tggttgcctaattcattgggattgctagttttaacttcaatacaccataggaatagtgggcacca

SEQ ID NO: 6858070 - DNA, 69 bp, Homo sapiens
agaatgctacagagctctgtgaagagaccactttgtgtgtctgttttaaaatcaggctctgttttgtct

SEQ ID NO: 6858071 - DNA, 93 bp, Homo sapiens
cattctgagagccttctgagttgtatcatacatggataatttgcattatgagttttatccacgtatgataaaactctgaaggctttcaaaatg

SEQ ID NO: 6858072 - DNA, 66 bp, Homo sapiens
gcccagtgggggcacaccgttagtaatgagacatcttagcaccaatatgtgcttttcacattgggc

SEQ ID NO: 6858073 - DNA, 69 bp, Homo sapiens
gcatcttatttagagaggactagagaaattgtctaacactgctttccagacctttttaaatcaagaagc

SEQ ID NO: 6858074 - DNA, 126 bp, Homo sapiens
taaattccttaattggatctatgttttattgatagattggacatctcttttattcaacagaaattatctattgaatgctgactgtagtccaggtattatatcaaatgtgatacagttgggaatttg

SEQ ID NO: 6858075 - DNA, 59 bp, Homo sapiens
ttgaatgcataaatgtactctgaaacggaaaccaaaatggagtgcattttatgtttcaa

SEQ ID NO: 6858076 - DNA, 83 bp, Homo sapiens
cggtgaggagctgggtataggcatagctgagctgaaattatagaacctttgttcagaaataaaatatcccaacttcatcattg

SEQ ID NO: 6858077 - DNA, 85 bp, Homo sapiens
caaactctagagatctgaaaagagtatgtagtttacaaatgaaagtaaaggcgtcttttagattttacatctttcactgagtttg

SEQ ID NO: 6858078 - DNA, 108 bp, Homo sapiens
ggttccatggctttgtgggtacagttactcatagaagcactttatctgatgactgcacttccccaaagaaaagctttctgttaactgtacaaattttgaaatagaacc

SEQ ID NO: 6858079 - DNA, 57 bp, Homo sapiens
tgatcactgtatgctgcaggatttgaaaagagactgtgccacagcctgcagtggtca

SEQ ID NO: 6858080 - DNA, 65 bp, Homo sapiens
ctgccttgccctggcccctcactccgaggccagcgccatgctgcgcctggggctgtgcgcggcgg

SEQ ID NO: 6858081 - DNA, 80 bp, Homo sapiens
atccacgtccctttgctggggctggtgaggcaggctccagaggggccttgccctacaaccagtagccctcggatttggat

SEQ ID NO: 6858082 - DNA, 59 bp, Homo sapiens
gtctgaggggtttcccaggacacaggacattcaatgctaaaaccagagatgcctcaggc

SEQ ID NO: 6858083 - DNA, 85 bp, Homo sapiens
gacttacttgtctcacttaatcctcatgtaaatatgctgaagtagacactgctcctcacatgccacagatgaggcaaatatggtc

SEQ ID NO: 6858084 - DNA, 75 bp, Homo sapiens
tgcttttaataatctaagagctacgtgtctttaatattttagtggaccaagggagactctgggattttgaaagca

SEQ ID NO: 6858085 - DNA, 129 bp, Homo sapiens
attcttaactggccacctgtgtcacaggtcacctatgtggcatgcagggctaggtggactgcaggcctgtctgccctctgcctcctctgcagatgggtgggtggcctgtgactgtagtccttccctcgt

SEQ ID NO: 6858086 - DNA, 61 bp, Homo sapiens
aggttccagccgttccgtgactcacccaggtcactgaggagcacctggagggctgggacct

SEQ ID NO: 6858087 - DNA, 55 bp, Homo sapiens
catctgtcacctgtgaatgttgtttccttaacacttctaacttggtggcatgatg

SEQ ID NO: 6858088 - DNA, 90 bp, Homo sapiens
gaggctagaagttgaagactaaggtgttggcaggattggtttcatctcgaggcatctctccttggcatgccgtcttctcccttttacttc

SEQ ID NO: 6858089 - DNA, 61 bp, Homo sapiens
ggtataatccttgcagccattgcacagacccacaggcgtctgccagtgtgtgccaggagcc

SEQ ID NO: 6858090 - DNA, 79 bp, Homo sapiens
ctggaggaccaggcaagctgaggcgggggccaagtgggtagttcggggccaacccccatcagcggccaatggcctctag

SEQ ID NO: 6858091 - DNA, 74 bp, Homo sapiens
gaagatgcattaagggcctggagatacactggtcaacaagacaagtatggtgtctcctgccttcatgcagcttc

SEQ ID NO: 6858092 - DNA, 68 bp, Homo sapiens
ctgcagtacaagaagcatctctcgggcgatgatgcgcatagacagagggattttttagtcaattgcag

SEQ ID NO: 6858093 - DNA, 117 bp, Homo sapiens
ttccgttcctttcccctgccggactccgcgctctgatatatacaggagaggccctggaggggagaaggcgtcctcactgcagtgctccgagcagcggccgcaggaagaggcgtggaa

SEQ ID NO: 6858094 - DNA, 56 bp, Homo sapiens
ggagagagctgtcctggattgttcatggagcagaaacagtctccccagatctctcc

SEQ ID NO: 6858095 - DNA, 79 bp, Homo sapiens
tggaacagataaggctcagggtttaagtttcttgctcaaagacagactgtgtttgaatcctaagtttcattttgttcta

SEQ ID NO: 6858096 - DNA, 63 bp, Homo sapiens
ttcctgtttctgaataaaggggtttgttttattgacaagagtcctgagcacagagacaaggaa

SEQ ID NO: 6858097 - DNA, 74 bp, Homo sapiens
ctttgaggttttttgatttggttgaaactaataccaaaattggaaatcttttattacaccaggttaactcaaag

SEQ ID NO: 6858098 - DNA, 55 bp, Homo sapiens
tgttttgggtcactttccttggggcatttgtttccttttggtgaattccagaata

SEQ ID NO: 6858099 - DNA, 68 bp, Homo sapiens
gggaaccagggtgtgaggaggacggggtgccggtctggcacagatgtaatctattcacattatttcct

SEQ ID NO: 6858100 - DNA, 79 bp, Homo sapiens
gcatccacatttgttcttcactgttgttagcagaggcggtccttccagcttcagcgtgacaccagtggcgggtgtgtgc

SEQ ID NO: 6858101 - DNA, 55 bp, Homo sapiens
tttagcattaagcttttcaaattttagcttttagtgaggaaagcttaatgctaga

SEQ ID NO: 6858102 - DNA, 73 bp, Homo sapiens
ggggaaggactggggccaacacctcccttggccttcatagtacaccagagggaggtggttccccagtggaccc

SEQ ID NO: 6858103 - DNA, 72 bp, Homo sapiens
gctctgtagcccaggctggagtgcaggggtgtgatctcagcttactgcaacctccacctcctgggttcaagc

SEQ ID NO: 6858104 - DNA, 94 bp, Homo sapiens
tatcttgatctcagtgtgtagtaaattgtaggtttttgataagttagataatcctgagtcaattcttctctatctactgtgattaaatgagata

SEQ ID NO: 6858105 - DNA, 130 bp, Homo sapiens
ttaggaagagaatgctttattggtgtttttcctaagtgaagccatgcaggaaaagaagggaccaagtgaaccactttggagatgtttgcaagttttacttacctggagagataccagccccttctttcaa

SEQ ID NO: 6858106 - DNA, 57 bp, Homo sapiens
acatcacagagcccagataaagtcgagagagtctttgtaaaccttggttcctgatgt

SEQ ID NO: 6858107 - DNA, 56 bp, Homo sapiens
tctggctgggctgacattgaacttttattatattgagttcagttccccaattcaga

SEQ ID NO: 6858108 - DNA, 62 bp, Homo sapiens
gctggaaaaggaggcaaaatatacttcctacaaaatggcaaattttgtcttcttttctacgc

SEQ ID NO: 6858109 - DNA, 65 bp, Homo sapiens
ggcacaaaggaataaagagaactgcttcactttcatactgttctcatattcatttcttatgtgcc

SEQ ID NO: 6858110 - DNA, 64 bp, Homo sapiens
gtgtgagcaagattcagagattccagctctcagactttaagctggaagtcagactttctcacac

SEQ ID NO: 6858111 - DNA, 69 bp, Homo sapiens
gtccctgcacctctctctgcctcagtttctccaatgggtcatgaggagggagaaggtttagtgggtgac

SEQ ID NO: 6858112 - DNA, 68 bp, Homo sapiens
gaccttgggcacagcacagctttgtcagcctgttttcttctatgcgaggtgagctgtctgagctggtc

SEQ ID NO: 6858113 - DNA, 98 bp, Homo sapiens
gaggcaggagaatcacttgaacccaggaggctgaggttgcagtgagctgagatcatgccactgcacttcagcctggtgacagagtgagactccatctc

SEQ ID NO: 6858114 - DNA, 77 bp, Homo sapiens
tcctgggtgattaggatttcaacagagggattttagagtgatagaaacattcagttgcagtccatcacacctagaga

SEQ ID NO: 6858115 - DNA, 63 bp, Homo sapiens
aggctatgacagactcagcctgaaagaatgtcaagattgattagtgatgtctgtcactggctt

SEQ ID NO: 6858116 - DNA, 87 bp, Homo sapiens
acgtgtccttattttggaaataaatgcttctgaagttaaaataaatgtatttaattagtagaggcatttagttctgaggtggaaagt

SEQ ID NO: 6858117 - DNA, 112 bp, Homo sapiens
cctcacccagcctactggggggcactcctgatcgggacttgctgatgtggccctgggacatgggcaggctggagcaggacagccaccttcgtgtctggggtgtgtggtgagg

SEQ ID NO: 6858118 - DNA, 79 bp, Homo sapiens
tgatgtagcagatacatggtggtggcacttgactttcaaaagcaaagtcagtggatttaccatgcgtgcttctaagtca

SEQ ID NO: 6858119 - DNA, 80 bp, Homo sapiens
acataaagccacagtttcacagtcaatttggagtcaggcacagagcatgagctttgaaattggaaatgatgtatttatgt

SEQ ID NO: 6858120 - DNA, 61 bp, Homo sapiens
agaggcactgtggcttaccaaagctaaagatgttttagtcagaaagaagccatatgccttt

SEQ ID NO: 6858121 - DNA, 58 bp, Homo sapiens
ttgtctgagagatggcagaggtgggtgaggcaccacagctctgtctttctcttagtaa

SEQ ID NO: 6858122 - DNA, 57 bp, Homo sapiens
gggcagatgggctgccagaacttgtcatagttccagcacagaatttcctagctgccc

SEQ ID NO: 6858123 - DNA, 73 bp, Homo sapiens
tccacagcctgatttatggagcagtgccgtctcctggatgatatggagacactgtgaatgaaagagctgtgga

SEQ ID NO: 6858124 - DNA, 130 bp, Homo sapiens
ccagccgctgagcatcacccccggagcctcggtcagggccccattgtctccagtgaatcacaggacacgctgctggggagcaagagtagtgagggtttctgggttcctcgggtggagccgcaactcctgg

SEQ ID NO: 6858125 - DNA, 130 bp, Homo sapiens
attctataatttgtatctttatctttaatgtctatcatagtagctgaaatgtggaatggtttaaatactccacatgctttaacttattttgatttggagactttaaggcatggagattttttctctgaat

SEQ ID NO: 6858126 - DNA, 62 bp, Homo sapiens
gttcttcagaggtcggaggctaatggtatcaaacatcaggctgcctggtttcttgtaagggt

SEQ ID NO: 6858127 - DNA, 70 bp, Homo sapiens
caaaagttactttgttctcaagatatgtcattcttttgggaataaatacttctggtgacaaagtcttttg

SEQ ID NO: 6858128 - DNA, 67 bp, Homo sapiens
ggttaggctggggcaaaatagggtttcctttcttggacgtgctttatctgtgtcctcttgcctggcc

SEQ ID NO: 6858129 - DNA, 61 bp, Homo sapiens
ttctattagaatctttagagtctcactggaaatgacagtgataataagagttctaacagaa

SEQ ID NO: 6858130 - DNA, 75 bp, Homo sapiens
gagctaaactgcaaacagaaaagctactttgtctgcttcttgcggccagagagcgaacctgtgtgctagttggtc

SEQ ID NO: 6858131 - DNA, 64 bp, Homo sapiens
caggcgctgtggctcccacctgtaatcccagcactctgggaggctgaggcaggcacagcgcttg

SEQ ID NO: 6858132 - DNA, 111 bp, Homo sapiens
acattggttgtgatcctgtaaaaagccgcaagcagtggctctttcagtacaaggaaacccttgggacagaaaagtttacttttgctcaggctttatggtgacagccagcgt

SEQ ID NO: 6858133 - DNA, 57 bp, Homo sapiens
ctgtttatggaggtaaggcatctagcaaatacctgagtggcttgtttctatgggcag

SEQ ID NO: 6858134 - DNA, 55 bp, Homo sapiens
acacatgctcataaataaatagtctaaaaagccttttttatgtgtgtgtgtgtgt

SEQ ID NO: 6858135 - DNA, 76 bp, Homo sapiens
gacatgtaaagggtgttaaattactccgcggagatgtgttcgaggcaatgggtggttaaactggcctgtgtttgtc

SEQ ID NO: 6858136 - DNA, 99 bp, Homo sapiens
ggtgggtcatctgaggacaacatgattctaggtagtgtccaaatgcctcatttcttaacatttacattgtccagaaattattgtccatccactcccact

SEQ ID NO: 6858137 - DNA, 130 bp, Homo sapiens
gtttcattgttttcttgtcatctcattcagtgcaggaggaagccccattgaagccaggccatggcttgggcaggtgcaggttttcaagtactgagaggggatggttagctcaacaggtcagcagtgggac

SEQ ID NO: 6858138 - DNA, 128 bp, Homo sapiens
tgtagacaaaagcaatcagtagagccacaggagaagacactgggttaggcacgtggactcattgtctggagtctacttgccatcagagtttattacctccttcagcagttactttggaaaggtttaca

SEQ ID NO: 6858139 - DNA, 83 bp, Homo sapiens
aggtgtcagatagtgactgtggggaatttttgagggagctaactggagatgaatcattccatggtcatgatttctgcatatct

SEQ ID NO: 6858140 - DNA, 83 bp, Homo sapiens
ccgcgcgcccacggggctagagaaggtttctttcgagtttgagaaggaattggcacggccttctcagtctcccgaaagcgcgg

SEQ ID NO: 6858141 - DNA, 79 bp, Homo sapiens
ggcaaccctggcagaaaaagcttacgtatctttatcaaagttaaaaagtaagtaagtctcttttctgtgagaccttgcc

SEQ ID NO: 6858142 - DNA, 76 bp, Homo sapiens
gtgagtgcatgtatgtgtgcatatgtgtggctggattcatgcagctacattcatatgtgtgcatacatgtgtccat

SEQ ID NO: 6858143 - DNA, 56 bp, Homo sapiens
gcctgaagctggaataattgtaaaggtatccccatttataataatgttgcttcagc

SEQ ID NO: 6858144 - DNA, 60 bp, Homo sapiens
cgccaccgccttggcgtgttccccatacagttccatgggctcgaagcgctggtggttgag

SEQ ID NO: 6858145 - DNA, 94 bp, Homo sapiens
agcattatctggaaaaggggaatgggtagactgttgaattcaggcacctgacctcatgttcacttcgtaaacccctcccatttccaatgttgct

SEQ ID NO: 6858146 - DNA, 98 bp, Homo sapiens
aagttgcaacctagtgatgcatcttcagccctcagccaggtttctactcagatgtggaccctgagctggtggaagcatgcagattaattgtgaaactt

SEQ ID NO: 6858147 - DNA, 81 bp, Homo sapiens
attgtcaaactgccaacagagaagcattattcagggttcttggttttctgagtgtcaaggctctctttggcatttggtaat

SEQ ID NO: 6858148 - DNA, 57 bp, Homo sapiens
acttgtggccaggtttatcggctgtcatcctcaaagttaagcaatctggcggcaagt

SEQ ID NO: 6858149 - DNA, 65 bp, Homo sapiens
gtgaggggtctggacgcacagtcactgaacgcaaaggatggcacccatgcgtctgcaccctacac

SEQ ID NO: 6858150 - DNA, 57 bp, Homo sapiens
agaggtctgtgggccggcctttctcctctctggggacaccgctctgccccagcctct

SEQ ID NO: 6858151 - DNA, 74 bp, Homo sapiens
tcctgctggctagagctctccttcctctgtggatcctgtggagctgaagagaaagggagctcttccctctaggg

SEQ ID NO: 6858152 - DNA, 58 bp, Homo sapiens
tggtaaggacttagttatcaattgacagcataactggtaacatgtaagtcctggatca

SEQ ID NO: 6858153 - DNA, 74 bp, Homo sapiens
tagttaggtactagtatagaatataccagtgcataagttagttgactggttcattaggtattagtggctttctg

SEQ ID NO: 6858154 - DNA, 60 bp, Homo sapiens
agtagggtgcttaatactagatttcacagggcatgtaaggttctaataagcgctgctact

SEQ ID NO: 6858155 - DNA, 73 bp, Homo sapiens
gagcccaggaaatgccccgtggtgggagggcaggctcatcaggagctcctggcacagcagggttcctgggctc

SEQ ID NO: 6858156 - DNA, 76 bp, Homo sapiens
gccgggaggctggatgccttgggggaggaggaaacccacttggatttctcctcagcaaggcagctttggctccggt

SEQ ID NO: 6858157 - DNA, 55 bp, Homo sapiens
gcagaaggtcattcagtgtccagttaaatgtcctggacactgataatcttgttgc

SEQ ID NO: 6858158 - DNA, 58 bp, Homo sapiens
gagctgctcaggactccgcttaccaaaatctgctgggttgtggtaggttgggcagttc

SEQ ID NO: 6858159 - DNA, 70 bp, Homo sapiens
ctggctttttagcctgaagttttctgagcaggggaatgtcatgatcagagctgtgcttcaggaaagtcag

SEQ ID NO: 6858160 - DNA, 59 bp, Homo sapiens
tattaggtatgaactggcaaccatgtgttggtacaggctcaagttcatatggactgata

SEQ ID NO: 6858161 - DNA, 130 bp, Homo sapiens
taatttttttgttgttgttactttcttgttaacccgattataaactcccatgggagcaagagtgccttttttgccctcaggtttttatgtggttaagcaatggcaggtccatataatgacagactatata

SEQ ID NO: 6858162 - DNA, 64 bp, Homo sapiens
gttactctcatcccaagtaactgccatcatatttgttaaaatagcaatgttggggttagaggac

SEQ ID NO: 6858163 - DNA, 63 bp, Homo sapiens
gccactgtctctgataagctcgagggtagcaacctgctcttgtgtcaccatggataaagtggc

SEQ ID NO: 6858164 - DNA, 61 bp, Homo sapiens
tctgcggtccccttctcgccctccacacacttctctcggggctgagttgggggatcgcgga

SEQ ID NO: 6858165 - DNA, 86 bp, Homo sapiens
ccctggactgcttacttctagaactcttgtcaaaatgggtaaaggtgtcagttgggaaagttccaggacatagcatgcttccaggg

SEQ ID NO: 6858166 - DNA, 80 bp, Homo sapiens
atcacctgcagcctgcagcttaaatcagggtttctggcagggcctcgggagccacagtttatagtgattgcccaggtgat

SEQ ID NO: 6858167 - DNA, 104 bp, Homo sapiens
cagctgctcatcataggcttcatggacaaaagcctcactacttattagagtatcttcttctgggtctttttatttatggcaggtctaatttcttgatgctgctg

SEQ ID NO: 6858168 - DNA, 60 bp, Homo sapiens
cacgagccctgtaggaatctctcaactgttgctgtcattgactcctgcctgcaggccgtg

SEQ ID NO: 6858169 - DNA, 71 bp, Homo sapiens
tcttttcctatctagaaacagagttttactaaaataacatttggaaaattctttggtttggtcagaaaaga

SEQ ID NO: 6858170 - DNA, 83 bp, Homo sapiens
gtgtaccgacagattttgcatttcactttcagtaggcatttggaagcagaacggcctctttggactgaaaaaatctaggttac

SEQ ID NO: 6858171 - DNA, 65 bp, Homo sapiens
agtttgctgaaatgtctttagcagtgtttgttcaataaatgctttctaaatcatctcagcttatt

SEQ ID NO: 6858172 - DNA, 128 bp, Homo sapiens
catgttattttcattttcgttacttgagcagcattgacaagcctcagtcttttgcggtccgcagatcatgattcttggctatgcaaacctgaggctgatgcatcctccagcagctgaccacggacatg

SEQ ID NO: 6858173 - DNA, 72 bp, Homo sapiens
tgtctgggtaagagggaagtgaaagagaaccttagcttcgagtgttcagtttgacaacctttatattttaca

SEQ ID NO: 6858174 - DNA, 66 bp, Homo sapiens
gacataccagaccagctgcgttgctttccattgacaggaagcaaatcagctgctcaggaaaaggtc

SEQ ID NO: 6858175 - DNA, 70 bp, Homo sapiens
ctggctgccacttcagggtcttggcacctcgagctccaagctccacttccagacacttgatggcttccag

SEQ ID NO: 6858176 - DNA, 64 bp, Homo sapiens
gaaaccaactctcaaaactccagcagaaggcaatgaagctgttaatattttggtgagttgtttc

SEQ ID NO: 6858177 - DNA, 57 bp, Homo sapiens
tgtgctacaggattataggaacccagaagggtgtggtgaaataccttgtggctagca

SEQ ID NO: 6858178 - DNA, 64 bp, Homo sapiens
gttaacgtttatggagtgcctatcatttgcctggcatgatgataactgctctatgagcattaat

SEQ ID NO: 6858179 - DNA, 66 bp, Homo sapiens
ggtttaatgagctcagcccaaagagcagtgttcctaaacggggcatggcagcaagagctcatggcc

SEQ ID NO: 6858180 - DNA, 82 bp, Homo sapiens
cccagtctgagatgctttgtaatagcagcaggaatggactaagacacccaggtttcctgcagagacagaggcctcaactggg

SEQ ID NO: 6858181 - DNA, 81 bp, Homo sapiens
ggtactgtggcattgagtggagaagaggatggtctcctgaataggttaggggtcattcctcccctccagtccccacatgcc

SEQ ID NO: 6858182 - DNA, 74 bp, Homo sapiens
cagtcctcagcaccagaactagggcacactgggccaggtattaggccttaagttgtgggttgaggagaattctg

SEQ ID NO: 6858183 - DNA, 58 bp, Homo sapiens
ttgggaggtaatggagccaagtgaatgacacttttgtagctattcatctgctttccaa

SEQ ID NO: 6858184 - DNA, 91 bp, Homo sapiens
tgtgaagtgctgcccattaggagtataagaggctgctcacctttgggccagtcttcatattcatggtgtcaggtagctctacctcatcaca

SEQ ID NO: 6858185 - DNA, 65 bp, Homo sapiens
ttgttaaaaatagatttccaggacatccccatgggtctggactcgggatcctctattttcagcag

SEQ ID NO: 6858186 - DNA, 100 bp, Homo sapiens
tttaggtaatttataacgtgcagccagggttgaaagccagtgctccaatttcctggtctttattattaaaacccatggtttatgaatacattacgctaaa

SEQ ID NO: 6858187 - DNA, 55 bp, Homo sapiens
tctgaagaggctcttgataagatctgggggatgaggtctgaggagtggtttcagg

SEQ ID NO: 6858188 - DNA, 65 bp, Homo sapiens
caccattggagataacagatgcaaacctgttgtaaacaggaaatctcagtatgctcagaacggtg

SEQ ID NO: 6858189 - DNA, 74 bp, Homo sapiens
tacttcttttgtgtgtcattactgaaagattgaagcaagcttcacctaagtgtagtgatgcaaaaataatagta

SEQ ID NO: 6858190 - DNA, 120 bp, Homo sapiens
gaacaaagagaccataaataccaggctattttctagtttcagattgctttcatatcctgaagaagcagcatgataaagtgaatttgaatcttgcctccgctatttactggctatttgttt

SEQ ID NO: 6858191 - DNA, 78 bp, Homo sapiens
acattacttaccttgggttctatgccaacgtcctcaagcattttaagaaaatggcttagagcttaagtcgtacaatgt

SEQ ID NO: 6858192 - DNA, 122 bp, Homo sapiens
gaggctggcttggggaagtggcagagccagaggacagctgggtgtcccacttctgacccctcaaggcagcaatggcagctttcggctctcacctggactcctcgtcttctcgagacagcctc

SEQ ID NO: 6858193 - DNA, 61 bp, Homo sapiens
agccagccagactttaaaatagatgagaccattcttagtcttggtgagtcttggttcagct

SEQ ID NO: 6858194 - DNA, 108 bp, Homo sapiens
cagttgatctgaaataggattttacctaatgaagcagaatttcccactcttttgtttatgagaggtgtgggttttgttttgtttcttaatcttattttgtttttactg

SEQ ID NO: 6858195 - DNA, 58 bp, Homo sapiens
tgtacttactatctacctcatccaattattgcaaggatggaatgcggtagtatgtgca

SEQ ID NO: 6858196 - DNA, 105 bp, Homo sapiens
gtgtgtgtgtgtgtgtttaatatagagacactctatcaccctcctgtctccaccacatctcagatgggaagggagagtgtcctggattagccgcaggccaagcat

SEQ ID NO: 6858197 - DNA, 65 bp, Homo sapiens
ctctgtttgttgggctgtcttgcctggaggctctttccttctacaagccagctcctgccacagag

SEQ ID NO: 6858198 - DNA, 58 bp, Homo sapiens
ggtccaggatcaaggcatcaccacatttgatgtctggtgagggcctgccttctggttc

SEQ ID NO: 6858199 - DNA, 63 bp, Homo sapiens
gggactgttgggtaggagaactgaaaacaccaagcatgttggcatcacattactcaaagtcct

SEQ ID NO: 6858200 - DNA, 84 bp, Homo sapiens
gatttgcctgagacatcatggctgaaagtagtaataggaaaaaaattatttcatatttatgcatccactgaattcaggctattc

SEQ ID NO: 6858201 - DNA, 114 bp, Homo sapiens
ccacagggtgccagtccctacaacctctcacagcattatccagggcaacaggaagaacagttgcctggggattgctctgggccatgtgcttctggccataattccttcttgtgg

SEQ ID NO: 6858202 - DNA, 87 bp, Homo sapiens
gtccttttcaggaagtgaccagattcaggtcactcaggtcaagcctagtggcctgagtgacctgaggtctagtcactactacatggc

SEQ ID NO: 6858203 - DNA, 62 bp, Homo sapiens
cttgccccaggtgctgaggttggaagagggttccctaagctcctcctgagcacctgtgccag

SEQ ID NO: 6858204 - DNA, 130 bp, Homo sapiens
gcctatgacatctgggttggttccaagtctttgctattgtgaatggtgccgcaataaacatacatgtgcatgtgtctttatagcagcatgatttataatcctttgggtatatacccagtagtgggatggc

SEQ ID NO: 6858205 - DNA, 91 bp, Homo sapiens
atgtgtcaggaaagttcgctctggggtggcagagaagttgtctttcttgtttgtaactgagtgctcagagcctgaaagacttctggcacat

SEQ ID NO: 6858206 - DNA, 75 bp, Homo sapiens
cctaaacagatactgcccagagctgcccgtggaccttgtgagggcaccagggctgcctggccgtgtgtgtgaagg

SEQ ID NO: 6858207 - DNA, 97 bp, Homo sapiens
gagcttggaaagattaatcaacattccaatgtggtagagtcacaagtattatgtcctgattcaactgcaagtttgcttagtttatgttcttttgctc

SEQ ID NO: 6858208 - DNA, 58 bp, Homo sapiens
ccaaagcatgcctcatggatggctgtttggcccttgtagtcctgggcgttgactttgg

SEQ ID NO: 6858209 - DNA, 126 bp, Homo sapiens
gtagagggagaggttaaaacgtgtgtttacatttacacttgccatgctgcacactgaggaacatttgtttccagttcccatgacaggtgttacctgttcagataaagctttagccttttcttctgc

SEQ ID NO: 6858210 - DNA, 114 bp, Homo sapiens
tgtgcaaacacactctttcagagtttggaaactctgtatcatctttggccacttgaaataaaagtggttattttgatctagaattctgaaatctaaaggttgatgctttgaaca

SEQ ID NO: 6858211 - DNA, 81 bp, Homo sapiens
acaatcgaaacctgctaagtgtctgtgtttctgcaatcctgcaggggttgttgaaagacattatttatatatttcctttgt

SEQ ID NO: 6858212 - DNA, 127 bp, Homo sapiens
ctttttaggaaaatgatgtctggcttgttggatgaattaacttgcaccctagctgtgaagcaaaggagcttcagagcattcgggtgacaaattgcacagataagatggcatttcttttctgtctgag

SEQ ID NO: 6858213 - DNA, 55 bp, Homo sapiens
cctcttcccatccatgttagtgccttccctcctgggcagtggagattggaggagg

SEQ ID NO: 6858214 - DNA, 69 bp, Homo sapiens
aggaagctgctggaaggtacacatcttgggagtttgccctttgaagctcacctgtggaccttttttcct

SEQ ID NO: 6858215 - DNA, 56 bp, Homo sapiens
tgaggccctatgatttcctggaatattacccatctgggaaattgtgtaggagtcca

SEQ ID NO: 6858216 - DNA, 82 bp, Homo sapiens
gtacacctcagggacttttgagaatgtaatttacaacatttaatatagatgaaatgtgaatgcttttcatacccagttgtgc

SEQ ID NO: 6858217 - DNA, 56 bp, Homo sapiens
ggtactgccagggcaagccaaagcctcagcggctggaggagcctggagcacgtgcc

SEQ ID NO: 6858218 - DNA, 79 bp, Homo sapiens
gagtggcactgggctgcacctttgtaaatctcttaaacatggcttaatagaagacagctgcatcccatcactgcctctc

SEQ ID NO: 6858219 - DNA, 57 bp, Homo sapiens
ggctggtgctcaggaagtgtttttgaggtgatcttgagagttcttgctgagcaagcc

SEQ ID NO: 6858220 - DNA, 59 bp, Homo sapiens
gaaaatagcagatagaccaatgagatcctgagtttcttgttgaaataggtgctgttttc

SEQ ID NO: 6858221 - DNA, 99 bp, Homo sapiens
cacagtgtccagcgatgtgtttttggtctttcccatgtctttttgcagtctgctaagatgaatggtgaagtctgataaggaaaatgcaggtgtggagtg

SEQ ID NO: 6858222 - DNA, 62 bp, Homo sapiens
tgggaaagcaatttgtgtaatctgtgctcgtgtgcagaggacagaaccagatggctttcgca

SEQ ID NO: 6858223 - DNA, 60 bp, Homo sapiens
tctacagagagcaaacattctatgggatcatccttctaaccttagagtgtcttttgtgga

SEQ ID NO: 6858224 - DNA, 62 bp, Homo sapiens
agatgagggcaagctatagaatataaggggagtccatagcatcccaggagtttgctcttact

SEQ ID NO: 6858225 - DNA, 63 bp, Homo sapiens
cagaataaaagtcccaaggcatcatatcctgaccctggggttaccatattgggacttttactg

SEQ ID NO: 6858226 - DNA, 63 bp, Homo sapiens
aggcttccgagtagctgggactacaggtgtgcaccaccatgcccagctaatttttgaatgttt

SEQ ID NO: 6858227 - DNA, 67 bp, Homo sapiens
agtgctataaaggtagaccacagagcatttgtaagatatcttttggtcgttcttaatacaaagcact

SEQ ID NO: 6858228 - DNA, 71 bp, Homo sapiens
tgaataagtatggcagagtcctaagcctttatgggacagttcttgtggcttcattctcctgtgaataatca

SEQ ID NO: 6858229 - DNA, 69 bp, Homo sapiens
gtgacatttaaagctggcgttacagtttgtaggttttacaaatcatggctctagcttacaaatgtacac

SEQ ID NO: 6858230 - DNA, 86 bp, Homo sapiens
tgaaaacagacatcacactcagattgcatcattcaaggaagtttaataaaatgattgtaaaggtttgggtgtggtgttggagacca

SEQ ID NO: 6858231 - DNA, 60 bp, Homo sapiens
catccttcatacgactgaccctggagctgaaggccaggttttgcagtggtctgaggtatg

SEQ ID NO: 6858232 - DNA, 56 bp, Homo sapiens
gctgtctgggtgcccaaaagaaggctgcacgttggcctcttaacacccagggcagt

SEQ ID NO: 6858233 - DNA, 86 bp, Homo sapiens
gaaaaaaagcagattctggaactccatctccctgagattgtcactcatggggtctgcaggaagtttcaggaatctgcattttcttc

SEQ ID NO: 6858234 - DNA, 82 bp, Homo sapiens
tagcagtagctagtttgtaggcttttgtgagaattacataatatccatataatgttcttagcaaagtacttgctacatgcta

SEQ ID NO: 6858235 - DNA, 88 bp, Homo sapiens
agtgatattgatgatgaagaaggtgagtaaaggagttttgtttggaagtccctttaatcagtgcctttgtagaattaagcaaatcatt

SEQ ID NO: 6858236 - DNA, 60 bp, Homo sapiens
gatagccttaggaagattgtagttgaccaggaagcccaatttgtatcttccaaagttatt

SEQ ID NO: 6858237 - DNA, 73 bp, Homo sapiens
tccctaggagcaatagcaccaattaactctcacccgtggaggaagaattggttattggagagaccctaaggga

SEQ ID NO: 6858238 - DNA, 76 bp, Homo sapiens
tgcagcctcccagagattcccctaggcagggtgataaacacgctccaggagtcctgggagtgattgtcaagttgca

SEQ ID NO: 6858239 - DNA, 56 bp, Homo sapiens
gagtagctgttttcagtttgggttttttccaccaaagcgactttaaaacactgctc

SEQ ID NO: 6858240 - DNA, 70 bp, Homo sapiens
gtgtgggtggtctctgtgctcgggcatgggggtcaagttggctgctggtgccccagaggcagccacgtgc

SEQ ID NO: 6858241 - DNA, 98 bp, Homo sapiens
caaagcaatgaatcaggaatctgaggctttgaaattcaatctgcttctgatttaccatgcagaaaggtcacttagcctcagcttccttatctgctatg

SEQ ID NO: 6858242 - DNA, 80 bp, Homo sapiens
aggtggagatatttgcaggtcttatgctgtcctaaaacaaagctagtgccacaagacaaaggtcctggaaattttccctt

SEQ ID NO: 6858243 - DNA, 57 bp, Homo sapiens
tccagtttctctcaatcaattattcacactcctgtttgcttgctttgagagagagga

SEQ ID NO: 6858244 - DNA, 79 bp, Homo sapiens
ccagacatgtgcccttgaggaaggcatttaacatctcaaagactatgcttctctgtcaaatgggcacagtttccattgg

SEQ ID NO: 6858245 - DNA, 55 bp, Homo sapiens
cgggagtcaagacctaggatccctgaggaaaccagggcatcaaagctgactcctg

SEQ ID NO: 6858246 - DNA, 97 bp, Homo sapiens
ggctctgcaggtggcttcctggagctggtgctgtgcctgttctgttccagcactgctcattcagaggcaggcatgggctccatcaccattgccagcc

SEQ ID NO: 6858247 - DNA, 57 bp, Homo sapiens
agtcactgaataccttaatgttcaagaaaacttaagtcattaagaagttcaggaact

SEQ ID NO: 6858248 - DNA, 76 bp, Homo sapiens
tctcatttatttctcccaaaacaattctctgaggtataagttatattacacatgttttgggatggggaaattgagg

SEQ ID NO: 6858249 - DNA, 65 bp, Homo sapiens
actggatgttagggattttattgtatcacttccaaaatgtatatgttgaagtcctaacctccagt

SEQ ID NO: 6858250 - DNA, 85 bp, Homo sapiens
atacttagtttctaagactctgcaaatcagcttataagctctatgtcaaggtgaaaagaacagagtttgccaaactccagagtat

SEQ ID NO: 6858251 - DNA, 70 bp, Homo sapiens
gtgtctgtgcaacggttagatgaagatgctttgcgaggtgagatatggacatctgaagttgcagagagac

SEQ ID NO: 6858252 - DNA, 94 bp, Homo sapiens
gtacattcctgtgtgtgtgtgcatgtggcaggtgtgtgtgcatgggtgagcatgtaagcacatgtgtgtgcatggataggtgtgtgggggttgc

SEQ ID NO: 6858253 - DNA, 80 bp, Homo sapiens
gccagggcagagattcagccgtctgcagtcagcaggacctactgtgaggcctagacagcctgggagcactctgctctggc

SEQ ID NO: 6858254 - DNA, 72 bp, Homo sapiens
aacagagtacacttaataagcttaatctgaaactgatagtttggtagatacagtgttaagtgtggaagtgtt

SEQ ID NO: 6858255 - DNA, 64 bp, Homo sapiens
gtgtcccctcaaaattcatatgttgaagcctaaaccccaacatgatagtattttgaggtgaggc

SEQ ID NO: 6858256 - DNA, 62 bp, Homo sapiens
agctcagccacttccctctggtcagaggcttggctactgaccagaccccaggaggctgagct

SEQ ID NO: 6858257 - DNA, 73 bp, Homo sapiens
tgggggtgtttatagtgcccaagtgttgtgtgtatggtggcatttgagggcctggcatctataaacacatcca

SEQ ID NO: 6858258 - DNA, 86 bp, Homo sapiens
gtctttggactttctcttttgtgtaattctttgtatatacaagatccttggccaagatcccattatacaaaagaaaaggtggggat

SEQ ID NO: 6858259 - DNA, 79 bp, Homo sapiens
ttggagtatgtgagggtgaggtgcgctgcaggtgattaaactactgtctctcagctcaaaattcacctttgctacccag

SEQ ID NO: 6858260 - DNA, 55 bp, Homo sapiens
gataaattttgacttttttgtgaacttcaaattcccagaaatctcgagatttgtt

SEQ ID NO: 6858261 - DNA, 124 bp, Homo sapiens
gtttctaaagcaagatattttcaaactacttatcttggtgttttagtaattctagtgtcttaatatcgattgcttatacacaagatgaaagaggttattttcagggtgtcattgttttagtggc

SEQ ID NO: 6858262 - DNA, 63 bp, Homo sapiens
ttgcaatgcctcaattaaagccactgtacttttctatgtgcagggccttagggagggctgtaa

SEQ ID NO: 6858263 - DNA, 71 bp, Homo sapiens
gaattctctgtaggtgcctctgtctacaattgataatgttattgattggttcagatgggatctgcgaactc

SEQ ID NO: 6858264 - DNA, 94 bp, Homo sapiens
acctaaatgtgaaacataagattatctaaaagtcctagaagataacataggagaaaatctagatgaccttgtgttaggcaatgactttttaggt

SEQ ID NO: 6858265 - DNA, 58 bp, Homo sapiens
caccttgctaggtatttgggatgcaaagacagatgtctatccctggccttaaggagtg

SEQ ID NO: 6858266 - DNA, 76 bp, Homo sapiens
ttcatgctctgtgagtgatgaaactgaggttccaagagattacttatcttgctcagaatcatttcactagtatgga

SEQ ID NO: 6858267 - DNA, 75 bp, Homo sapiens
gcttcagaagtcatgctcagtctgttcctggaaaacagcagcacctaggaaaccagctgagaatgcttctgcagc

SEQ ID NO: 6858268 - DNA, 68 bp, Homo sapiens
ccagcctcctgggatgactctttcttttagtactgtaattcaaggcccttatcccaggagactgctgg

SEQ ID NO: 6858269 - DNA, 77 bp, Homo sapiens
gaatttatattttattctcaagacaatgggaagccatgagggttttacagattgctctggggatggacagatagatc

SEQ ID NO: 6858270 - DNA, 67 bp, Homo sapiens
tggattgcagatagctatgtacctgtcaatggccattgctgtcaggacacagctttctgtgatacca

SEQ ID NO: 6858271 - DNA, 85 bp, Homo sapiens
ggggtcactgacatttgctggacatgaatcagatatgctagataccctgcagtatgtgatacggtcctgcacattgagtaatccc

SEQ ID NO: 6858272 - DNA, 57 bp, Homo sapiens
aggctagtcaagtcaagcagtgggagtaaagaaacaccactgcacttgtgccagcct

SEQ ID NO: 6858273 - DNA, 122 bp, Homo sapiens
gttaaggcaggaaccggccattttcacttcttttgtgattcttcacttgcttcaggccatctgaatgtatacgtgcaggtcacaggggatatgatggcttagcttgggctcagaggcctgac

SEQ ID NO: 6858274 - DNA, 74 bp, Homo sapiens
tcccgcagctcttcagagtgagcaatgccagtttcttgaatgctattgctgatgctgaagggaagtcacaggga

SEQ ID NO: 6858275 - DNA, 80 bp, Homo sapiens
taacactgactctgggaggtggactgaggttccttatgggtccttctagcatcccctctccccttcagagatgagtgttg

SEQ ID NO: 6858276 - DNA, 93 bp, Homo sapiens
gtggatgagagtatgaaagattgatcatgaattgacaattgttgaaattgtgcgatgggtacatgagagtttattatatagtgttctatctat

SEQ ID NO: 6858277 - DNA, 60 bp, Homo sapiens
tggctcaggccacttcttttatggcacaagtttttataatggaacatggttttgatgcca

SEQ ID NO: 6858278 - DNA, 77 bp, Homo sapiens
aggtgtttacagtaggattttcagggtcttcaatctgtcatattgctagacatagactttctactgtgtcatcactt

SEQ ID NO: 6858279 - DNA, 66 bp, Homo sapiens
tcgttgttcttcttcttgttcaaggctacagctttaactttgtcacagcaagagtaaggacagcga

SEQ ID NO: 6858280 - DNA, 75 bp, Homo sapiens
gctgttcagcaatagagggtgaattcagggcccatttttctgtgcctgactgcagggcctgacacccttgccagc

SEQ ID NO: 6858281 - DNA, 60 bp, Homo sapiens
gcctcgggtacagataccctgattcttaggagaatttccaaatttctgtcacactgaggc

SEQ ID NO: 6858282 - DNA, 65 bp, Homo sapiens
gccatccgcatagtacaggagtccccagcctccctggggacgagatcttggcagtgtgggaaggc

SEQ ID NO: 6858283 - DNA, 56 bp, Homo sapiens
cccaggctgatgggatgggccatcccactgctggtggtcctggtggtcaggctggg

SEQ ID NO: 6858284 - DNA, 63 bp, Homo sapiens
gagcttagcaggaggctggagtggatccatccatctctggcccatgatcctgctaacaagctt

SEQ ID NO: 6858285 - DNA, 55 bp, Homo sapiens
gctgcaagatcttaaaagggagggctgtgaccacttgaaatgaagatcttccagt

SEQ ID NO: 6858286 - DNA, 55 bp, Homo sapiens
ttctctgacagccacatagaggctttgccaacctgaagcagggctgtcagcagaa

SEQ ID NO: 6858287 - DNA, 130 bp, Homo sapiens
atgatagtagtgtctacttgatagtgttgttttaaggattatatgatataatgaatgtaaaatgattcccaccatatctatcacatagtgtttagtaaatgttacctattcatagtagaagcactttaat

SEQ ID NO: 6858288 - DNA, 78 bp, Homo sapiens
gaatggagtagacccatgcctctcttgagtgtctctttgtttataattctctttgagagtaatgtttttactgtattc

SEQ ID NO: 6858289 - DNA, 89 bp, Homo sapiens
taggaatcgttttaaggccaatctgagttgggaatgtatttagtttggatagagtacaattatatttagatggtttggtgccattccta

SEQ ID NO: 6858290 - DNA, 83 bp, Homo sapiens
ggctgaaaggataaatgcatacatggttttgatggatatttctgaattttccttcactgtatcatgttgcacttaacactgcc

SEQ ID NO: 6858291 - DNA, 81 bp, Homo sapiens
gtggttgtccaggtgcagccagtctgccacacggtggcagtgctgttccacactaggcaggcttggtggcaccggttccac

SEQ ID NO: 6858292 - DNA, 56 bp, Homo sapiens
ttttatcattacccagctgaaatgtctcaggcagtcatattagggtaatgataaga

SEQ ID NO: 6858293 - DNA, 63 bp, Homo sapiens
gattacatgggcttgtgagtcctttcaacatggataggaaaggaacctctaagcctctgtttc

SEQ ID NO: 6858294 - DNA, 77 bp, Homo sapiens
tctcttacaaactaaggatatttaagggttttggagggggttcttatcataggttctgaatgtttctgtgtgaggga

SEQ ID NO: 6858295 - DNA, 60 bp, Homo sapiens
gtgaacaactgcaaaaatctccatgccccagtttggcatagagggagtagagttgttcac

SEQ ID NO: 6858296 - DNA, 64 bp, Homo sapiens
ctgtcccttgttgagtacactgctagccttgaacgtaggccctgcccagtgccacaaggagcag

SEQ ID NO: 6858297 - DNA, 81 bp, Homo sapiens
catgatatatgaaaggaaaccattctttatcattgacctattgaagatcctgggtaagttccttttaatttttgtgccatg

SEQ ID NO: 6858298 - DNA, 65 bp, Homo sapiens
ggtgacttcagtctctgccagctggagccctgtctcccagtagccagtggcaggggcagtacgcc

SEQ ID NO: 6858299 - DNA, 88 bp, Homo sapiens
gcatgagtaagtcagggttgtcagtgtttcaggtggcttgggagtcattctttccagacactgattgcccagcttgaagctactctgc

SEQ ID NO: 6858300 - DNA, 76 bp, Homo sapiens
gccaagtgcggatcatgggacttctcagccttcagatacatatggggctgagacagtcccatgatctgcagttggc

SEQ ID NO: 6858301 - DNA, 94 bp, Homo sapiens
ttatggttattgactctgccatcagtaattctctcacgttgtgattccacagtgttcctttgttgtgactggcaaagccacataatagctataa

SEQ ID NO: 6858302 - DNA, 74 bp, Homo sapiens
gccatgtgcccagcactgtgccagtcaccagggatctgatgcactggggtggacatgatgtggggacagagggc

SEQ ID NO: 6858303 - DNA, 76 bp, Homo sapiens
ctgagtctcctcccaggctcttccaggacccagcttcaataacctgggctttattgaaacctggggggaatttgag

SEQ ID NO: 6858304 - DNA, 68 bp, Homo sapiens
tactgaagtgcagtacaggctgccttgtccaaggctgcagttttggtagcccctgtactgcatcagtg

SEQ ID NO: 6858305 - DNA, 98 bp, Homo sapiens
gagacaggagaattgcttgaaccctaggtggcagaggttgcagtaagccaagattgcgcaacttcactccagcctgggtgacagtaagactctgtctc

SEQ ID NO: 6858306 - DNA, 72 bp, Homo sapiens
acacagaggatgtgtctggtctgggcacctaggctgtggagggtgccaggaggggacacctcctctttgtgt

SEQ ID NO: 6858307 - DNA, 65 bp, Homo sapiens
gatgtcctatgaggtgggactgttggcagaaagttttcccacattcaccacacttatagggcttc

SEQ ID NO: 6858308 - DNA, 70 bp, Homo sapiens
gtgaatggcaaaaattaacagatcaaccaacctacacttggttatattagaatgtatttttgccatttgc

SEQ ID NO: 6858309 - DNA, 80 bp, Homo sapiens
cccctagcgaatctcagctggtgctgcgcagagacagcagtcagcgtctgccggtggcgcggcccaggaggagcagaggg

SEQ ID NO: 6858310 - DNA, 123 bp, Homo sapiens
ggtggccaacaagtcatgcaaaggaagctatgagaccctgataggagtagaagaatatagctcctgttgccttcttgtaccttacagaggagcatcccaagctgaatggctatggcagccatc

SEQ ID NO: 6858311 - DNA, 69 bp, Homo sapiens
ttccagcagagggccctggctgcggtcttcccactgctttgacagtacccagttagagccctttaggaa

SEQ ID NO: 6858312 - DNA, 69 bp, Homo sapiens
cacctttaaaagctagaaaaaggctgggcacggtggctcagacctgtaatcttagcacttttggaggtg

SEQ ID NO: 6858313 - DNA, 95 bp, Homo sapiens
gcatgactcaagcagctttcagactcaagagctggctggttcctcactgggagggtttgcacctagccttgagggtggttgtgaagagtcagtgc

SEQ ID NO: 6858314 - DNA, 74 bp, Homo sapiens
gttgagcaattggagaaatactaagtgaaataacaatgataagtcactgttttagttttctcttgctgcataac

SEQ ID NO: 6858315 - DNA, 56 bp, Homo sapiens
gcctttctagtcttagaagcagtttgattcagtattttgcttcagaaatagaaagc

SEQ ID NO: 6858316 - DNA, 86 bp, Homo sapiens
caggcagttgttttaaatcgcggataatgtgagattgaaaagcagccttcaaattctgttactaatgtgatgtgaataacattctg

SEQ ID NO: 6858317 - DNA, 78 bp, Homo sapiens
atggcttgagagaattaactggcagttagtgctgtgttctatagcattcagtttttcctgttaaaccttaaaagccat

SEQ ID NO: 6858318 - DNA, 68 bp, Homo sapiens
gacaaggaaggatctcagaatttctcattccttctcagggtgacaattgttgtgaattcttccttgtc

SEQ ID NO: 6858319 - DNA, 60 bp, Homo sapiens
tgtttcctggaggttatttttgagacttcttgcttctggtctcagccaccagaagagata

SEQ ID NO: 6858320 - DNA, 113 bp, Homo sapiens
cctaaggtgattccagcagatgagccagatttgacaactctgtgttgtagaattgaatcttctctataacatctttgccaaattgctatttggctgtgattgattaccttggg

SEQ ID NO: 6858321 - DNA, 56 bp, Homo sapiens
ccaggcattagagaattgtgataggtttttgagcctgtgataaaagctgtgtttgg

SEQ ID NO: 6858322 - DNA, 63 bp, Homo sapiens
tttgagaaaggggatttaattccacggtaatacagaaatggcattaagtaatcttttcttaga

SEQ ID NO: 6858323 - DNA, 87 bp, Homo sapiens
ggtgggctctgagagcaagggttccaacgagaagggcagatcagcatctgccttttatggctagcctcagaagtcacagagcctccc

SEQ ID NO: 6858324 - DNA, 77 bp, Homo sapiens
ggagggataaataaaggaggagtggggtcctggaacctagaacagccggttccaatgggatctcctcccttccctcc

SEQ ID NO: 6858325 - DNA, 62 bp, Homo sapiens
ggcaaggccagattctctctaggggccaagactttctggcctcttctagctctggcgtttcc

SEQ ID NO: 6858326 - DNA, 75 bp, Homo sapiens
gttttcatgtagtttctgtataaaaattagcttctctgtaaactacgttagtttctatgtaagctacgtgaaaac

SEQ ID NO: 6858327 - DNA, 64 bp, Homo sapiens
gaagatggtacctgtaatattagtcctgactgtgattggtcaatacagtgttagttatcatctc

SEQ ID NO: 6858328 - DNA, 63 bp, Homo sapiens
gagcaggcaggaaggcagcactgacataaaatcaaaggcaccagagctgagcatctcctgctc

SEQ ID NO: 6858329 - DNA, 63 bp, Homo sapiens
ctcaagagaaattcatgtggcagcttaagcatcttcagtatgtggcacagaatttcttaggag

SEQ ID NO: 6858330 - DNA, 83 bp, Homo sapiens
gcgttgctctgccatgacccagtcaaagggaatgggtgcagctctggctctgttcccctttctgggttctggagagtccctgt

SEQ ID NO: 6858331 - DNA, 62 bp, Homo sapiens
gcctgaggggcgctggcaggttccttggggacagtggaggttgcaggcagccccttctgggc

SEQ ID NO: 6858332 - DNA, 85 bp, Homo sapiens
ggcagggggtattcagcattagagacatcagagcagagaatagctctgtatcctgactctggtgtcctctacccatcccctcgcc

SEQ ID NO: 6858333 - DNA, 79 bp, Homo sapiens
ctacttcatggggttgtcataaagatccaatgcgatgacccatgaaaagcttggcctgtggcacgtgctccatcagtgg

SEQ ID NO: 6858334 - DNA, 57 bp, Homo sapiens
gcagggttggtgtcctctgcggcctctctccttggcctgtggacggccaccctctgc

SEQ ID NO: 6858335 - DNA, 59 bp, Homo sapiens
tggcacatggtaagtgcttaacaagtgttagcacatgttatagcaaatagtgtgtgcca

SEQ ID NO: 6858336 - DNA, 68 bp, Homo sapiens
tgacagcccttccaggcagaattctagcacatgcttatgggttaggatcctgtatggagaagctgtca

SEQ ID NO: 6858337 - DNA, 75 bp, Homo sapiens
gggaggttagaaggatgagaacactcattgcagactgtgaggagatagacaactgttcattattcttcatctgcc

SEQ ID NO: 6858338 - DNA, 87 bp, Homo sapiens
ctctctactaaaagattcaaggctaaattctgtactgcatgtaccaagtaaaatatgcaagcagatgtggtcatcttggtgtgaaag

SEQ ID NO: 6858339 - DNA, 95 bp, Homo sapiens
gtaccaaggttacgtgagtccagctcattgtctgggatgcactgagagctttattctagagaagacctggatcttcacagtgaaatctgcagtgc

SEQ ID NO: 6858340 - DNA, 98 bp, Homo sapiens
ctttgcaattttcatcattttattaaccaagaaaccaaggctcagagaggctaagtgatttccttggtatccaagaactagtaagtgatggagcaaag

SEQ ID NO: 6858341 - DNA, 71 bp, Homo sapiens
aggtaatcatcctgtctcaaacttcatccatgccattggtaaaaatgttgaatgagacagaagatgagcct

SEQ ID NO: 6858342 - DNA, 55 bp, Homo sapiens
ggcctccaccgtctggccctgtcggctgagtggtgcccagcaaggtgagaaggcc

SEQ ID NO: 6858343 - DNA, 95 bp, Homo sapiens
gatcctaaatgcctttgattcttttttgagaggtaagtgggtgttaaattatacatgaaattacttcttacaaaagaaatattttattaaaaatc

SEQ ID NO: 6858344 - DNA, 64 bp, Homo sapiens
gagatttaagttggctataggtgctcattgacaggtctggcttcgagagttagctggctatctc

SEQ ID NO: 6858345 - DNA, 61 bp, Homo sapiens
aatccacaggtctggtctgggtgggacagggtgctcgctgagaatcaggcccgtagggatt

SEQ ID NO: 6858346 - DNA, 69 bp, Homo sapiens
gggcacagtggctcatgcctgtcatcccaacactttggaaaggctgaggcaggcagatcacttgaaccc

SEQ ID NO: 6858347 - DNA, 62 bp, Homo sapiens
tctagatgcggctgtgggggaatgggagcggccggacctcccagcctgacagtgcatcaaga

SEQ ID NO: 6858348 - DNA, 89 bp, Homo sapiens
tgtttgccattacattcttggaatcttgtttatagggctacaatggattagctagaaacagggccttcaggatgggaatgaactagaca

SEQ ID NO: 6858349 - DNA, 62 bp, Homo sapiens
gtgtccatctagaatttatttctagcagcatgtagctaatagcaatggagcttagaggacat

SEQ ID NO: 6858350 - DNA, 55 bp, Homo sapiens
aaggatttgtccaaagtcacacagctagtaagtgtagaagtgggaacaaatcttt

SEQ ID NO: 6858351 - DNA, 56 bp, Homo sapiens
tctggctgattatcagaatctgagacccaaccctgagaaattttgattcagtagga

SEQ ID NO: 6858352 - DNA, 80 bp, Homo sapiens
tggtactaacccaattatccaacaaataaatataaaattacagttataattattgctatggtgagagggatgtggtacca

SEQ ID NO: 6858353 - DNA, 77 bp, Homo sapiens
ttcactgtgctcagctctatggacacaaagatgatttagaagcagctgttgtccctgggagctcagccagcagtgaa

SEQ ID NO: 6858354 - DNA, 78 bp, Homo sapiens
tgggcttccagtggtggctcccggacctgccttgggggcagcaggagaggttgggagaggtcaccctgatgaagaaca

SEQ ID NO: 6858355 - DNA, 63 bp, Homo sapiens
gccttttaggttgtcaacctcttgggagtagccctactcctggcagacagcactgaagctggc

SEQ ID NO: 6858356 - DNA, 78 bp, Homo sapiens
ctgacagttctatatagcagagtcttcaagggcaggccagatatggctttgctttagtggctctatttgactgtacag

SEQ ID NO: 6858357 - DNA, 102 bp, Homo sapiens
gaagcaagaatgcagatggattacttcacatttgcaatgaaaaagagtagcaaagaaggctgttgcaaatgtgtggtgaggcatttcaaactcacaggcttc

SEQ ID NO: 6858358 - DNA, 72 bp, Homo sapiens
cactctggtctttctgaaagcaatccatctgttagtttccttccagtagtttgatttctgacaggccaggtg

SEQ ID NO: 6858359 - DNA, 70 bp, Homo sapiens
ttagaaaagtatatttacttactgtgaatttgcagtgatggaaatcacagtgaggagttacagtttctaa

SEQ ID NO: 6858360 - DNA, 64 bp, Homo sapiens
ccccctgggaactgaatgtctcggtataaaacacgattgtacatttgttcaattctgaggtggg

SEQ ID NO: 6858361 - DNA, 77 bp, Homo sapiens
gccacttgggagagctgggaaagccgtggagagcaggacccctgaggtctccattgtccctaggtctccattgtcgt

SEQ ID NO: 6858362 - DNA, 90 bp, Homo sapiens
gaaaattcctggatggacaaattagctgtcaatgaggatctgggaagatcacgagaatcctcttcagtaaattctttctggtgagttttt

SEQ ID NO: 6858363 - DNA, 85 bp, Homo sapiens
gggaccaggggccagagatatgaagaactatggctttgggggtgcctgcctaactcacaagagccctcttcactgccccttgccc

SEQ ID NO: 6858364 - DNA, 63 bp, Homo sapiens
ctgactagagtcagattcttagttggcacatccaggtgctccaactttgtgtgacctagatag

SEQ ID NO: 6858365 - DNA, 79 bp, Homo sapiens
cagaaaaagatttgcttgtgctatgaaagttggagaactcactgttttgaatattcatttgcagaagaagtattttttg

SEQ ID NO: 6858366 - DNA, 60 bp, Homo sapiens
agacagctcctactgaagccatgtttaaacagacacttggaggagaggagggagttggct

SEQ ID NO: 6858367 - DNA, 93 bp, Homo sapiens
ctttgggggtgatgcagatgtctcggggtgcatgcagatgttacaggtgatgcattctgcacatccaagaacaggaatgcaagtcctctgagg

SEQ ID NO: 6858368 - DNA, 89 bp, Homo sapiens
agcctcagcctaaagccctcctggggccacgctggttcccttccctgatggctggacccgggtcgtctcaggggcttcccagctgggct

SEQ ID NO: 6858369 - DNA, 67 bp, Homo sapiens
ctgtaggcctggcatgagacctgagagtctgtgtcgtaacaagttctcaggtgatgtcagaccacag

SEQ ID NO: 6858370 - DNA, 59 bp, Homo sapiens
cagcttatggtatagacagagtactttacccacttctatattctgctgttcctaggctg

SEQ ID NO: 6858371 - DNA, 83 bp, Homo sapiens
gagaatttgatgacctgagaatttgtggttcaggactggagcagtacctgtaccattagatactcaatgagcatcatcaactc

SEQ ID NO: 6858372 - DNA, 79 bp, Homo sapiens
ttgggaacatcttgaaaacacactgaggaaatcagcctgggctgtggcctggtcattcaggtgttttaaatcttcccaa

SEQ ID NO: 6858373 - DNA, 57 bp, Homo sapiens
atgcattttacctgtgataaatcaccttgactaggtcacagaagaagtagattgcat

SEQ ID NO: 6858374 - DNA, 70 bp, Homo sapiens
gggcaggggtcagtggccccaaccaggtcctaaatcaaacgtcctagctaggtgcccttcccccctgccc

SEQ ID NO: 6858375 - DNA, 57 bp, Homo sapiens
aagctagaaggagtgcgtgattccttggctctaggctttaggcatttggattggctt

SEQ ID NO: 6858376 - DNA, 73 bp, Homo sapiens
tgtaagaaatagagacaatgtttggtctacacttgccatatagtaggtgtttaggacatgttatcttcttata

SEQ ID NO: 6858377 - DNA, 59 bp, Homo sapiens
cccctaaggtcctttccaattatgaaaatctgtggttggctactggagacctatggggg

SEQ ID NO: 6858378 - DNA, 77 bp, Homo sapiens
ctctgcaggctctggcggctctttcaatatctcaggatctggagacatgtttctggggatgcctgggctcaacggag

SEQ ID NO: 6858379 - DNA, 60 bp, Homo sapiens
ctcctgacctcgtgatccacccgcttcggcctcccaaagtgcttggattgcaggtatgag

SEQ ID NO: 6858380 - DNA, 86 bp, Homo sapiens
gattaatatgttactaggaaattcattttggtgtgcacatctgtcactttaagctactaattgaaatgtcctggccacaaaaagtc

SEQ ID NO: 6858381 - DNA, 85 bp, Homo sapiens
gggagcattaagcctctaagtttgtggtaatttgctacacagtgtagaaaactaatacatgcttgatgatgaagtttctgtttcc

SEQ ID NO: 6858382 - DNA, 73 bp, Homo sapiens
actaaaaggaggttgaagctgtcagggttttatgtgactttgatgacaggtatttttaaggcttcctttctgt

SEQ ID NO: 6858383 - DNA, 129 bp, Homo sapiens
ctaaatcgtctcttaaatcctcttcagctgtcattttctagaattatttgatttatggtaaattagaagggtgtcagaaaaatgatatgtgagtacttgaagtggattttagtaggttaggagttgtag

SEQ ID NO: 6858384 - DNA, 62 bp, Homo sapiens
gtcttcccttggtgaacagagcatgactcatgtctatgcagtctaagcatgtaagggttgat

SEQ ID NO: 6858385 - DNA, 82 bp, Homo sapiens
tccttgggaaaagatgttttacatagcacctttgggtttgcaatcttgaattgctcatctgtaaagcacttttgttgatgga

SEQ ID NO: 6858386 - DNA, 114 bp, Homo sapiens
ggcttctaatgtagtctcaggatcaccccagctggcccgtggcagtactgaggctttcagattgctttcagtgtctgtgggcaggatggggaatcctagtcttcttcagaggtc

SEQ ID NO: 6858387 - DNA, 74 bp, Homo sapiens
cagtggtgcgggggccaaggtgaactgctgcatcttaactagcatcggtgtccttgtcctttggtacccagctg

SEQ ID NO: 6858388 - DNA, 78 bp, Homo sapiens
tccctctaaaagcacctctaaaagttttctgtggctgctgacagaagaggaagtcagagttttgaggtgtgacaggga

SEQ ID NO: 6858389 - DNA, 118 bp, Homo sapiens
ttcttgacaatgctttcagcagcctttcagaaattctaaggtcacaatgttggattagctgtttaagctgcaagcaacatggtagattttgggaagggatgtaagcttgaaccaagaa

SEQ ID NO: 6858390 - DNA, 64 bp, Homo sapiens
tcatcatgtaccctaaaaatggaaaagaataatttcttagtattttccacttggagtcagatga

SEQ ID NO: 6858391 - DNA, 55 bp, Homo sapiens
ggacctctctgcttgctggatagccaactttgatggtaagcaggctgcagaggcc

SEQ ID NO: 6858392 - DNA, 59 bp, Homo sapiens
tgtgatccaagatcaaattatgccatagctttgcatgcactgagagatgttggatcata

SEQ ID NO: 6858393 - DNA, 68 bp, Homo sapiens
ggaaggtggatggctctgacctaggctcaccgcaactgctgtgtgaagccacagagccacgccgtgcc

SEQ ID NO: 6858394 - DNA, 129 bp, Homo sapiens
tgcattgactaaaggcacagtaactaagtattaagggtttttaaaccgccttttaggaagatgctgctgccttccagtatgttaagatggtggttctgcccatgcagtactgtaccacaatgcagtgca

SEQ ID NO: 6858395 - DNA, 68 bp, Homo sapiens
ggatggggctgaaacatggaagagaggtacaagatccagcccttctggctccactcagccccacaacc

SEQ ID NO: 6858396 - DNA, 74 bp, Homo sapiens
ccaagggcatatgtcagaagtgatgttgagctagtcctctagaggctatttagcttccactctcatgcccttgg

SEQ ID NO: 6858397 - DNA, 55 bp, Homo sapiens
tgagggtctggaatctgggcttggcttaactccatcctctgactcagatctctca

SEQ ID NO: 6858398 - DNA, 56 bp, Homo sapiens
ctgatgaggtcatggaagagtgatactatttattcattccacaaatacttatctag

SEQ ID NO: 6858399 - DNA, 63 bp, Homo sapiens
aaggactaaaagaagggtttcttaagtggttagttacatgctggaatctttgttgtggttttt

SEQ ID NO: 6858400 - DNA, 56 bp, Homo sapiens
ctcctgggttctgggccgcagcgcctctgcgaggtctgcaggcttcgctctaggag

SEQ ID NO: 6858401 - DNA, 59 bp, Homo sapiens
ttggactgttctatcttggaatgaatcatcttgacctctttgttccaaggagcatttga

SEQ ID NO: 6858402 - DNA, 62 bp, Homo sapiens
gttaactctgcaacttttgaggctggggacctagctgtcagtgagttagttgcaagtataac

SEQ ID NO: 6858403 - DNA, 60 bp, Homo sapiens
ggagtctgagttgccctgcactgagaaccttattccagtgagggaagatctcagcacccc

SEQ ID NO: 6858404 - DNA, 105 bp, Homo sapiens
tgtactttgtgttctctgattgctgaagcatactttctatactgctatagtcctttagtatatgcttctgtatgtctcacagctgttcatgaattcaaagtaaca

SEQ ID NO: 6858405 - DNA, 84 bp, Homo sapiens
ttaaattcctgtgcctgactaggtgaatcaatatggaaaagatattataaaaatattgtttcctcctttgtcaggtaggtttaa

SEQ ID NO: 6858406 - DNA, 71 bp, Homo sapiens
attgttttaaacccataactcaagaagtaatgaattatttcactgtgccttcagttttggggtctagcagt

SEQ ID NO: 6858407 - DNA, 74 bp, Homo sapiens
gggcaagagatgagtaggagacagggtcctcacagatccctttgttcctggccttatccccaaactgcttgcct

SEQ ID NO: 6858408 - DNA, 79 bp, Homo sapiens
gggaggtgactgggatgtggagcaggtgggatgtcgtgaccgattggtacaagcataaggcttgcttcagtcttctctc

SEQ ID NO: 6858409 - DNA, 56 bp, Homo sapiens
gtgcctctagcttaaaataatccttatgccacagtggcatatttttgggctggcat

SEQ ID NO: 6858410 - DNA, 59 bp, Homo sapiens
ctcattggattatacttttttgatgttcaaatctaggcatctttgaagcatgcagtgag

SEQ ID NO: 6858411 - DNA, 74 bp, Homo sapiens
gagttggcaaatgctatttgggaacaacatgaaaaaaagtaaatgtatcagaaatagcattggctctgaagctc

SEQ ID NO: 6858412 - DNA, 90 bp, Homo sapiens
actttgttaagggctttggagccggcaataggaaaggagagctgaagaatctattttcccttgtttcccgctgataaggctcattaaagt

SEQ ID NO: 6858413 - DNA, 87 bp, Homo sapiens
tcatttgaagcttccattccaaggccaagtctaagatgttctttaaagaaatcttaagctattgcatttggagggcacacagattga

SEQ ID NO: 6858414 - DNA, 100 bp, Homo sapiens
ttgttctttttgttcaactcttatatgctagctgctcagagttaacctaaactatccatgtattctgacctgtaactgtaagagacaaagaaaagagtag

SEQ ID NO: 6858415 - DNA, 71 bp, Homo sapiens
gcattgagtgtcacaaggcatttatctgtaggattgggtcaccaaactcacagcacttgtgtcattggagt

SEQ ID NO: 6858416 - DNA, 68 bp, Homo sapiens
gagtaagggtggtagatccagttttggcaacctcagacgatggatgattagactctgccactcttctc

SEQ ID NO: 6858417 - DNA, 98 bp, Homo sapiens
gtggcagcttggagactgtaggtgggaggaaaaggaattgccagttcagtaaactttgtcaatgcattattctcccacttcagacttccgagggccac

SEQ ID NO: 6858418 - DNA, 92 bp, Homo sapiens
ggtggtgaccctcaggtgagactagggtgcctgtgtttcagcaaagcctgggcaattggaatgcagggctcctaagattccatgacaccccc

SEQ ID NO: 6858419 - DNA, 77 bp, Homo sapiens
aaaaactgtaggacatgtacttgtaacagcaattcatctttcaattctagtcagcaatgttcatgttctgggttttt

SEQ ID NO: 6858420 - DNA, 67 bp, Homo sapiens
ttgagaaaagctgtgtaaggatcatgttacatacattgtgctttctcttacagagttaccttcttaa

SEQ ID NO: 6858421 - DNA, 87 bp, Homo sapiens
ggaagatgctgtcatcttatcattgttgctgttgacttgaatccaaggttattgtggacagtagatggctcagagacaggcatttcc

SEQ ID NO: 6858422 - DNA, 66 bp, Homo sapiens
gggaggagggttctctggacagaggtgtgaattgtgtctctagttcccaggggaccacatctttcc

SEQ ID NO: 6858423 - DNA, 58 bp, Homo sapiens
tgcggggagggcaaagggagcgcaccaagaccaccaggctgctccaggccttgccgca

SEQ ID NO: 6858424 - DNA, 60 bp, Homo sapiens
ctcagatcttctgctgtggggagcataactgatcaatgactccagctgttgagatctgag

SEQ ID NO: 6858425 - DNA, 109 bp, Homo sapiens
gctgaaccccagcaaacagaggaagaggactgccccctcccgcggaggcccactcacgctgggcactagtgacaaggggacatcagcctttgttctcctggggcttggc

SEQ ID NO: 6858426 - DNA, 71 bp, Homo sapiens
cccaaagggcttcctgttctcaaatccactgctccttccattacgtggtgtctagaaggaggctcttttgg

SEQ ID NO: 6858427 - DNA, 56 bp, Homo sapiens
gggctggagttgggaagacaaactgtttctgctgcgtttgtgttctgacccagccc

SEQ ID NO: 6858428 - DNA, 59 bp, Homo sapiens
gcatatctgtttctgaggatacatgatttccgattatctttgtctctggagcagaatgc

SEQ ID NO: 6858429 - DNA, 91 bp, Homo sapiens
gcttgtaggagatataagactctcctgaggaaaagcttggtcaggtgtacctggagaaagctcccaggaggttctaataccttcccactgc

SEQ ID NO: 6858430 - DNA, 55 bp, Homo sapiens
actgaggcttaaagagattaggtaacgtctgggctactctgggagcctaaccagt

SEQ ID NO: 6858431 - DNA, 74 bp, Homo sapiens
gaagcacaattgattgtgatacctagagcagcatcatcattgatatgtatatcaccttcagacttttgtgtttt

SEQ ID NO: 6858432 - DNA, 57 bp, Homo sapiens
gttgtatatgtagagaatggtctttttaaagattatattttaaaatgcatatgcagc

SEQ ID NO: 6858433 - DNA, 80 bp, Homo sapiens
gagctgatccctgcaatttgctctcatggggtgtcagaacattaaatatcccagggtgaaatgcagtaggcttcagattc

SEQ ID NO: 6858434 - DNA, 59 bp, Homo sapiens
aaggaagaagactctttactcctcaatccactagagagagttaaaagctctttttcttt

SEQ ID NO: 6858435 - DNA, 95 bp, Homo sapiens
tgtctttagttctgagataagccgctgcactgattctgttgtctgggtccagacaagggaattgtgtgtgagaggcagcacttagagttcagaca

SEQ ID NO: 6858436 - DNA, 67 bp, Homo sapiens
gctgtaagcagactcccggccagctcaagtttcctcacctgggaagaggcgggaggctgtttaccgt

SEQ ID NO: 6858437 - DNA, 85 bp, Homo sapiens
tgacctgggggaggcagtgatcatgccgtcttacctcatcacagctgcccacgagcagatgcatgtttatgtctttcctaattca

SEQ ID NO: 6858438 - DNA, 95 bp, Homo sapiens
aggtcactgtcagctgggagaccctcagagtaggcactgctgggcagatctcccagtgcctatctcctctgggaacttcccggactgatcgacct

SEQ ID NO: 6858439 - DNA, 80 bp, Homo sapiens
gagttttagctcttacatttaggtctatgataaatttcaagttgatttttgcatatagtgtgaggtaagggtccaagctc

SEQ ID NO: 6858440 - DNA, 79 bp, Homo sapiens
agatactgtttcaggtactgggaatgcagaagtgaacagaacagtcaaacatccctgccctcatgcctataatatatct

SEQ ID NO: 6858441 - DNA, 130 bp, Homo sapiens
ccctggagatttcagagataaacccgacctggatctgcatttacattgcttgtaattgtcaaatggaagacagctgcaaacagttaagatgcaggcgtgggaaacaaatattgggagtagaaaggaaggg

SEQ ID NO: 6858442 - DNA, 62 bp, Homo sapiens
ctcagccatctccgtgtagtctgacagcgacagtggcagaacctgaacgtgaggtggagggg

SEQ ID NO: 6858443 - DNA, 60 bp, Homo sapiens
gggttgataaaatgtggcctatgaggcaaatctggcctggcatccatttttgtacaacct

SEQ ID NO: 6858444 - DNA, 61 bp, Homo sapiens
ccctgggattcaatttcactcttatagtgatgcctaatatacttcaatttgtgtctcaggg

SEQ ID NO: 6858445 - DNA, 72 bp, Homo sapiens
gtgtgtgtgtgcatatgtgtggctctcctctgtgaagtcacttggttcctcacagtatgctaatatattcac

SEQ ID NO: 6858446 - DNA, 98 bp, Homo sapiens
gggagataaggatatatcatgtttagaggaacaacagacttttaaaattctattttgaattaggtcggtttttcttagactgagttcctcattctcct

SEQ ID NO: 6858447 - DNA, 55 bp, Homo sapiens
attcctgactgctagtcattcagcctcactgtgaatgaccccagtagaaaggagt

SEQ ID NO: 6858448 - DNA, 101 bp, Homo sapiens
gtgagagctacctttaagctattcctgggctgtcctttggaaggatacatttgaggatgactccagaaggcaagttgcagggaggcaaatttggctcacac

SEQ ID NO: 6858449 - DNA, 97 bp, Homo sapiens
gtgggtggagcagtctaggaagggctcacaggagggagagacacccaggactgagagccctactctccctccttcccctggaagctgggccacctgc

SEQ ID NO: 6858450 - DNA, 73 bp, Homo sapiens
ggctgggaagcgcagaaggggccctaccagctcgcaggcgagttcagggctcagcatctggcatttgccagcc

SEQ ID NO: 6858451 - DNA, 59 bp, Homo sapiens
agttttgattgccctaagctatctactacgctgagattgagacttaggcaatttaggct

SEQ ID NO: 6858452 - DNA, 60 bp, Homo sapiens
cccaggcaggcgatggtgcagtggcaccatctcagctcactgcaatctctgcctcctggg

SEQ ID NO: 6858453 - DNA, 60 bp, Homo sapiens
caggccctcatactattttgcatgctccaagtggtactgcaaagcacttaagaggccctg

SEQ ID NO: 6858454 - DNA, 57 bp, Homo sapiens
aaggcacattcctgaaaacaatgtgggttagaccaggcagttcataggatgagtctt

SEQ ID NO: 6858455 - DNA, 78 bp, Homo sapiens
gggccctacgggtgcgcgcttcggtcctggaggccttatccaagcctcctctccatcagcgccacccgtctggggtcc

SEQ ID NO: 6858456 - DNA, 77 bp, Homo sapiens
gcaaccagccttctcctgcacctaacacaacgctctccacatatctggagggctggtgcttggagaatcagttgtgc

SEQ ID NO: 6858457 - DNA, 74 bp, Homo sapiens
tctcactggttcatccccttccaggaagaacagagtggcctgtaaggtttcaggaaggaggtgaacaaggaaga

SEQ ID NO: 6858458 - DNA, 65 bp, Homo sapiens
ctcatgtccagacattttatagcagtctcacttttggtgggggtgatatagtgtgctgggaagag

SEQ ID NO: 6858459 - DNA, 77 bp, Homo sapiens
gtgagggtgtctgcgtaactggcatcggaatcgaaaggccccgcctcccccatgcacgggtgcgcgcacacactcac

SEQ ID NO: 6858460 - DNA, 63 bp, Homo sapiens
agctcagacttaaaagaattgtttaaggcaaaaagctactgttcattttattgtctgattgct

SEQ ID NO: 6858461 - DNA, 67 bp, Homo sapiens
cctatgcttgtccatgctgtggttatttgattaacttaatgtaataccactgttggacattaatagg

SEQ ID NO: 6858462 - DNA, 84 bp, Homo sapiens
tccctgcggtctaggacctcagtgtgtcaggaagaaaatacacagacctgcaatgccctgggagtgctgtaccacagatatgga

SEQ ID NO: 6858463 - DNA, 116 bp, Homo sapiens
agaaatgccgatgtgcttctaagtaactagcttgtacaaatgtttaaacactttaaatttcacaagagcttacactttggcaagctattaaaaggggaaatatctgtagtgtttct

SEQ ID NO: 6858464 - DNA, 64 bp, Homo sapiens
tagatacctgctggacctcatttgcaactggtaaaatcagaagctgtcttccagcaggtgttta

SEQ ID NO: 6858465 - DNA, 70 bp, Homo sapiens
atggttctgtagatattaattattcctttgaggctccctcagagtgtaccaaatatcctacaggaatcat

SEQ ID NO: 6858466 - DNA, 73 bp, Homo sapiens
ttgcctgagctgaactaagcagttttatttgcatacatttagaagaccaaactgcagccttgagttcaggtag

SEQ ID NO: 6858467 - DNA, 63 bp, Homo sapiens
acaatcttattagtagtatagatccaggtgccttctggggactgtcatctctaaaaagattgt

SEQ ID NO: 6858468 - DNA, 55 bp, Homo sapiens
gagcttcctgatgccgaccagtaaatagataattgtacctccattcaggaagttc

SEQ ID NO: 6858469 - DNA, 62 bp, Homo sapiens
agtcttaccgcacctcatgaactggctgaaggctttgtagttggtgagcgtgtggtaatcct

SEQ ID NO: 6858470 - DNA, 87 bp, Homo sapiens
ggcaatcgcaacattttctggtatgcttctattgaatggttgacaccggccattgaagacttggtatccgtggaaatttgaattgcc

SEQ ID NO: 6858471 - DNA, 75 bp, Homo sapiens
gcttgctcccttgcgaaatcgctcttttcctcttgtagctggaggaacagagacgggatcgctttggggccgggc

SEQ ID NO: 6858472 - DNA, 98 bp, Homo sapiens
caggatggccatgttggtgcagatgggatgccccttgggcctgcttccaaggccttctgtggtctggcatctgtccatctctccagcattatctcctg

SEQ ID NO: 6858473 - DNA, 123 bp, Homo sapiens
gaaaaacctagttaattgaggattatatttagtagggggtttcaactgaaagtttcacctgaggtgtaggagaacttggggttgaatgtttagtactttccgcttgtcctttaattaggattc

SEQ ID NO: 6858474 - DNA, 70 bp, Homo sapiens
tccaatgaactgccttttgttatgacacaaaagccataaaagtagtgatgtgtataaaagcagtgcagga

SEQ ID NO: 6858475 - DNA, 78 bp, Homo sapiens
agttcacgtgaccactcccataattccatgcacctggccctcaggatgcaggaggtcggggagcactcaccctgagct

SEQ ID NO: 6858476 - DNA, 83 bp, Homo sapiens
gatggtgatggggttttggcagcaatatccatgtcttcacttcctgtgaaagaaggaatgttgctgagaactgcatcttcgtc

SEQ ID NO: 6858477 - DNA, 73 bp, Homo sapiens
ggtccgtggtgttttcattttcacatttgcccttttgtctagacagtggcaatgtagagagtgatcccgttcc

SEQ ID NO: 6858478 - DNA, 70 bp, Homo sapiens
tttaattatttcaggaacatttaaccacagggccagcaggctggatcttgatatgtgtttcttagttgga

SEQ ID NO: 6858479 - DNA, 67 bp, Homo sapiens
tctataagaaagtgttaacactggctacttttgcaaagaaggcctaggagttgacatggggggtaga

SEQ ID NO: 6858480 - DNA, 74 bp, Homo sapiens
gtgagcaacagtgggcaggccctaggcgatttgggaagagcgggtgtcagaaagcctggggtttggccagccac

SEQ ID NO: 6858481 - DNA, 90 bp, Homo sapiens
acatggctgccagaagtctgggacttacaatcaaccaccttggagatccagcatcctggggaggaatgtgaggtcaggtctgggccatgt

SEQ ID NO: 6858482 - DNA, 102 bp, Homo sapiens
tgaggcaggagaatcgcttgaatccgggaggcagaggttgcagtgagccaagatcaggccactgcactccagcctcggggtcaagagcgaaactctgtctca

SEQ ID NO: 6858483 - DNA, 58 bp, Homo sapiens
cttcaaaccacatgctgaaaatgagaaacgtcttaattttcgatggtgtggtttgagg

SEQ ID NO: 6858484 - DNA, 129 bp, Homo sapiens
tgcaaccaggaaagctgatttttaaaattcgatattaactacattttacagaagatgaaaccagagctcaaggtcatgttttagtaaagtgaaggttgtggaattcagaaccagatttatctgactcca

SEQ ID NO: 6858485 - DNA, 61 bp, Homo sapiens
ttgaggaattaggtttttcaaatgtgcataagtgcactgttgaaatatggattgaccttga

SEQ ID NO: 6858486 - DNA, 96 bp, Homo sapiens
cctcattcttgggggactgcctctgtcaccccagcatggggggaccctggaaagcttggcagggacaggggccggcgtctccgggggcaggtgagg

SEQ ID NO: 6858487 - DNA, 75 bp, Homo sapiens
gggctcgggctctggtgctgggaggacctcgctggcaggctcgtgcagggccctcctaacatctctgcccagccc

SEQ ID NO: 6858488 - DNA, 68 bp, Homo sapiens
ctgtcttaaatgttaggttgtactgagtccagtaggtcgctgacctagctcagcttgttatttgacag

SEQ ID NO: 6858489 - DNA, 102 bp, Homo sapiens
ctattctgcctgcaccatagggcatgggttggtggagatggagacgttctgggtgtcatctgtctgttcaacagcctggagcctccttgagcagcagaatag

SEQ ID NO: 6858490 - DNA, 70 bp, Homo sapiens
attccgcatcacactagcaaaagtgaggcactgattcacagtgccttaatacagatgggtggtgtggaat

SEQ ID NO: 6858491 - DNA, 110 bp, Homo sapiens
tagtaagttgttcctgcagcctcaacatcttagagaattccaaatgactacaccaaatgagttacatggacattctctccctgagttacaggaaaatatttaaattacta

SEQ ID NO: 6858492 - DNA, 71 bp, Homo sapiens
tctccctttgttttctgcagtctctcagaagcccctgctagtggtaaaattctgaactgtagttagggagg

SEQ ID NO: 6858493 - DNA, 72 bp, Homo sapiens
gtgcacttttatgagatactacagattgtgaataataaattagttactcgtatgtgttttagaatagtgtac

SEQ ID NO: 6858494 - DNA, 79 bp, Homo sapiens
ctggaaagggtgttgctggtgctttgccagaggaggagtccctgccctccctcctggccgtcaccgctgccctccccag

SEQ ID NO: 6858495 - DNA, 60 bp, Homo sapiens
acaaatgaatcatacataatgtgtgtgaaagcatatgtgtatgtatgtattcaattttgt

SEQ ID NO: 6858496 - DNA, 61 bp, Homo sapiens
gcggctgaggcggtggccaaggagcgggagcgcgctcaccgccggggcctcgcacaggcgc

SEQ ID NO: 6858497 - DNA, 67 bp, Homo sapiens
gcccttatttgaatgtatgagttttagtaagcactgtgataggaggattcatatacttaaatcaggc

SEQ ID NO: 6858498 - DNA, 88 bp, Homo sapiens
tggaatgtttaagagaacttgagagtcctcagtaagttttatttgtgagatttactagggctgtttaagtacttgcaagagctttcca

SEQ ID NO: 6858499 - DNA, 78 bp, Homo sapiens
tgagtgtacctattatattagtcagggatctacagaaaaacagaaccaacaagatgtttgtatagataggtacattca

SEQ ID NO: 6858500 - DNA, 55 bp, Homo sapiens
gttttgaatactactagaacttgggcaggtcctacaaacttggtggtgttgagac

SEQ ID NO: 6858501 - DNA, 57 bp, Homo sapiens
cttgatgtgcctaagtctgtctatatgcagcgtagactttactaaggctcattttag

SEQ ID NO: 6858502 - DNA, 59 bp, Homo sapiens
ggacacatagttgatgagcgtgtacgtgtcgcccacgagcatgatgacggctgtggccc

SEQ ID NO: 6858503 - DNA, 77 bp, Homo sapiens
cttcagtatagtataatacataggtacagccttttttagtagttttcagatggcttctttatgtttttatattgaag

SEQ ID NO: 6858504 - DNA, 58 bp, Homo sapiens
actgttttctaaagaacagatgcttcatatgaatctgtgacaagctggggaaaacagt

SEQ ID NO: 6858505 - DNA, 65 bp, Homo sapiens
tgctttctttccatcatgaagacgattaggtcgtgctaagacccagtcatcctggtgtgagagta

SEQ ID NO: 6858506 - DNA, 78 bp, Homo sapiens
gcttaatctctacacacagaatcggccgatggtgctctgaaaagtggtaggtctgaagtctggttaaatggagaaggc

SEQ ID NO: 6858507 - DNA, 68 bp, Homo sapiens
gagacagggtgatcgcttgagcccagaagttcaagaccagcctgggcaacacagggagaccctgtctc

SEQ ID NO: 6858508 - DNA, 88 bp, Homo sapiens
gtaaaaagttatacatagatctttgactgcgtgtggggtcagcacccctaacccctgtgttgttcaagggtcaactgtgctcttttgc

SEQ ID NO: 6858509 - DNA, 71 bp, Homo sapiens
gggccacatgctgagttgatgatatagcaagaaccaccctctagctggtcctcagctccagccttgagcct

SEQ ID NO: 6858510 - DNA, 58 bp, Homo sapiens
gtctggcttttgccctgtgtttctttaaagttgactctatgcagaggctgagccatac

SEQ ID NO: 6858511 - DNA, 73 bp, Homo sapiens
caagcttaagacagaagaggcagagcagcaggaaaggagctgtcaaaggtgagagtcttttgtctccagtttg

SEQ ID NO: 6858512 - DNA, 87 bp, Homo sapiens
tattgctaactgtataattttattaggcttttatagggatgataatgtctctcattggaaaagagtttaatcaaacagaatgtaatg

SEQ ID NO: 6858513 - DNA, 55 bp, Homo sapiens
tttcctgctccatttgctgagctccccaaagaagggatcagggagggagaggaga

SEQ ID NO: 6858514 - DNA, 81 bp, Homo sapiens
ctctttctttgcatctacctttttgtggtttagggagggctatttgcctttgacatggaaagggaagcaaggaacataggg

SEQ ID NO: 6858515 - DNA, 78 bp, Homo sapiens
cggattattaggcaaagatattacgtagtaaagtttacttaaactaaggtaagattttggactgtgcctaatgatttg

SEQ ID NO: 6858516 - DNA, 96 bp, Homo sapiens
ccccaggccggggtggggtaggagtcagcgagagagtccagcgctccaaaggggactttctggccctccgtgccccctaacccagcacttctgggg

SEQ ID NO: 6858517 - DNA, 59 bp, Homo sapiens
gacaaagtgcttcgggtgcagagagatgcctctgacactagacttgaggcactgctgtc

SEQ ID NO: 6858518 - DNA, 64 bp, Homo sapiens
cctaggaaaagcagtacagcgtggtagttagaccagcacagcttctgggatcaggctgcctagg

SEQ ID NO: 6858519 - DNA, 60 bp, Homo sapiens
tccaagaagtttatgttgtttcagctaatcaagtgagatgacattattttcttttgtgga

SEQ ID NO: 6858520 - DNA, 87 bp, Homo sapiens
tcccgggagtgggaagaggtggcaggaaggggatctgaggaggagaacaggggtcctggtggtctgtgcttcttcccagacacggga

SEQ ID NO: 6858521 - DNA, 110 bp, Homo sapiens
tctataacagagcccaaaaaatataaaggatgtgggttttgcatcttaaactgatcatgttcatgagaaagccatatctattctattctgtggcctttgtacattgtaga

SEQ ID NO: 6858522 - DNA, 78 bp, Homo sapiens
caaccttagccaataggtttctaattgggccatttatctggaaataagtgtgacataagagccctggagggtgggttg

SEQ ID NO: 6858523 - DNA, 120 bp, Homo sapiens
catttactggttgtttgctatgagccaggcactggactagatgctttgtatacatttgtgcaacacaatgtggcattgtcattattgggccagctttacatagattaagtcactaaactg

SEQ ID NO: 6858524 - DNA, 59 bp, Homo sapiens
ctttagcattctgcctgatctttatgccctaagactgcttagcagagcagaagctcaag

SEQ ID NO: 6858525 - DNA, 71 bp, Homo sapiens
tcttgtgccttggggatgaattatgaggaaccatgtaactataaacccaaccaatctcccattggccaagg

SEQ ID NO: 6858526 - DNA, 62 bp, Homo sapiens
gaatgggaaactctaaacttgagtaaggcatttcaccttgctctgttcagtgtatcttgttt

SEQ ID NO: 6858527 - DNA, 62 bp, Homo sapiens
tggtgtgaggaacccggaatgtggggtgtctgcgggtgctgcaagttccagtgttcctccca

SEQ ID NO: 6858528 - DNA, 73 bp, Homo sapiens
gatttgccatctctccatagcatagattagcctttggggtattctatggcctcctgtggagagatttaaaatc

SEQ ID NO: 6858529 - DNA, 121 bp, Homo sapiens
attgccaaaactgcttgtctaagtatcttgtttatgaatgttactatagagtggtggccctttacactgtagtatgaattagtggccagcatgcttgacagagagcgcagaacagggcagt

SEQ ID NO: 6858530 - DNA, 62 bp, Homo sapiens
cagggctagtgacaccccagtcaaggtggtccagagcatcaggagtcgtgtcacaggccctg

SEQ ID NO: 6858531 - DNA, 129 bp, Homo sapiens
ttaaacagagcagaccaaactctgaagaagctcttttctgcctcacccagaggttgttcccatagagaccactggaaggcaacggagtgagctgacacagatggttgtgcgcctatcctgtctggttaa

SEQ ID NO: 6858532 - DNA, 121 bp, Homo sapiens
agttgcatcctgtccttaaagcaggaactcttattctggagtttgaggacaagcttctgcaaatctgtgaagctcctgaattttgaatgtagagcacattttggagagaggatgcatagct

SEQ ID NO: 6858533 - DNA, 55 bp, Homo sapiens
gaactttattgattctcaggggttgcagcataaactcctgagatttaaggggttc

SEQ ID NO: 6858534 - DNA, 64 bp, Homo sapiens
gctggggtatccgttagtaagatgggcacggtccctcgctgcctgctctgatttttgccccagc

SEQ ID NO: 6858535 - DNA, 74 bp, Homo sapiens
gggcctggcacgtgtgagctgtgagctgcatcttgtggagaggtgtctgctgcaccctcacacccacaggacct

SEQ ID NO: 6858536 - DNA, 58 bp, Homo sapiens
tgagccaagatcgcaccactgcactccagcctgggtgacagagcaagacttggtctca

SEQ ID NO: 6858537 - DNA, 56 bp, Homo sapiens
cccaggaggctgaggttgcagtgagctgagatcgtgccactcccctccagcctggg

SEQ ID NO: 6858538 - DNA, 106 bp, Homo sapiens
atatctccaagagccctattccctgctcttatagctgtttccaagaagactctggcttaatgtggtagctgcataggggtaaggatctaggctgctttggtgatgt

SEQ ID NO: 6858539 - DNA, 62 bp, Homo sapiens
tgcagtgatgctgtacagggcagccaggcccctcctaggccagctgctctccacggtctgca

SEQ ID NO: 6858540 - DNA, 56 bp, Homo sapiens
aatttatcttggagaaatcagtgtgtttcatacactggctttgatccagatagatt

SEQ ID NO: 6858541 - DNA, 61 bp, Homo sapiens
gtggatgtgagggctcaggctgactgatctttcctcatcaaacaaatgcttttagatccat

SEQ ID NO: 6858542 - DNA, 64 bp, Homo sapiens
aggtgataaaatatgttgtgtgacatgggaaatgcctatgatacattgcaaaattttaaaatct

SEQ ID NO: 6858543 - DNA, 77 bp, Homo sapiens
cctggtggtgcaccggcgcagccacacgggcgagaagccctacaagtgcaacctgtgcgaccacgcgtgcacccagg

SEQ ID NO: 6858544 - DNA, 101 bp, Homo sapiens
tctcaaaaacttgttcactaaacaccacatgcatagccagcattgtatgtgttacacacgtgtgttctgtgtgtgtgcagtgtgaacaggctcacatgaga

SEQ ID NO: 6858545 - DNA, 58 bp, Homo sapiens
ctcctctgtctggccctgagccagccctgggtgggagtgttgggagtcagatgaggag

SEQ ID NO: 6858546 - DNA, 64 bp, Homo sapiens
cagatgctcagagaagttaaggaatttactcaaggacccaagtaaatgcagtctctgagatctg

SEQ ID NO: 6858547 - DNA, 62 bp, Homo sapiens
catctgtgcccacacatgttcttacatatatctatgcagaggtgtgtgtaggcacactagtg

SEQ ID NO: 6858548 - DNA, 82 bp, Homo sapiens
tttccttcctctttctggaaggaccccaggactccagaacacctaagcacctggctgagcctccaggaagagcctgaggaag

SEQ ID NO: 6858549 - DNA, 64 bp, Homo sapiens
ttgaatggctgtagttacctgatgaaataataagttattaattccagaactttgcagccctcaa

SEQ ID NO: 6858550 - DNA, 78 bp, Homo sapiens
tctcagcgtctcttaggactgactgttcaaaggctcctcagcaaatgagcccttgaacagtcctaagagaccctgagg

SEQ ID NO: 6858551 - DNA, 63 bp, Homo sapiens
tcataagggacttggctggcaatcagttgaagatactattcctttggcagcagttccaagtga

SEQ ID NO: 6858552 - DNA, 55 bp, Homo sapiens
tgaacttcagtgatttgctgcagctctgcattaacagaaaatcactgtcagttca

SEQ ID NO: 6858553 - DNA, 116 bp, Homo sapiens
ggttttcattttattcttcatgtgactttagtataaaatgtataactttattatttaacataaaatgtgcagtttttaagctgctaggttaaatgagtttccaaaatatgaattcc

SEQ ID NO: 6858554 - DNA, 78 bp, Homo sapiens
acacctctcagagcctcagcttccccatgtgagaaatgggtttaatgtttcatgttggggagttgagtgagtcaatgt

SEQ ID NO: 6858555 - DNA, 62 bp, Homo sapiens
cctgcagacggctggcagtgagcggctccatgacccgccgcacgtccaggctgagctgccgg

SEQ ID NO: 6858556 - DNA, 80 bp, Homo sapiens
actctaagcatcacccctacatttcccttgctctcttaccaagtaagctagggtgggctgggggagttgctttttggagt

SEQ ID NO: 6858557 - DNA, 55 bp, Homo sapiens
tgccacctgtacatgctatctgaaggacagcctccagggcacacagaggatggta

SEQ ID NO: 6858558 - DNA, 66 bp, Homo sapiens
gactaaaatgtacgaatgcaaaaatcagctgaagtaattcagctgacatggtatttgtgccaagtc

SEQ ID NO: 6858559 - DNA, 55 bp, Homo sapiens
ctggaatcagtttcttggcaagtttaaatgttaggctggagagattagatttcag

SEQ ID NO: 6858560 - DNA, 81 bp, Homo sapiens
tcaatccttaacctcttagtgcatctcattagtttggtaatttattcatcaaaaatgcactccaagatgtggtgggattga

SEQ ID NO: 6858561 - DNA, 77 bp, Homo sapiens
tttctccctttctacagtactgatttcataacttatctttaggtagagtggaaattagattttaaaaagtgagtaaa

SEQ ID NO: 6858562 - DNA, 56 bp, Homo sapiens
tatttaccctggcagctgtagcattttagccttccattagctgacagaggtgaata

SEQ ID NO: 6858563 - DNA, 84 bp, Homo sapiens
gttagaatggcgacacagataatttagttaaaacgtatctttaaccttttttttgcatgcgtgattaatctgtgagtctctgat

SEQ ID NO: 6858564 - DNA, 55 bp, Homo sapiens
ataatcaaagtcctatgacatcccagagacagggtgatctttaggttgtggttgt

SEQ ID NO: 6858565 - DNA, 56 bp, Homo sapiens
tcaataaatccctctgaccctggatgtcatccccagggtttttccagtttgtgtga

SEQ ID NO: 6858566 - DNA, 56 bp, Homo sapiens
ctccttccaccccactgaagtggacacctgcctctggagcccagggtgagaaggag

SEQ ID NO: 6858567 - DNA, 56 bp, Homo sapiens
atgcgtttaggacataaggagaactataaaacggtgcttctccaacttaaatgcat

SEQ ID NO: 6858568 - DNA, 87 bp, Homo sapiens
tatcaagtgttctgaggtctctttccatagtgacagacttttagtgttgtttcattgggaatgggaggttctcaaaattatttgata

SEQ ID NO: 6858569 - DNA, 83 bp, Homo sapiens
tgtatttttgtgcttgcaactttccagatgtatcactctaaaatgccgtctgctgttcagagatgttgctagtatttagagca

SEQ ID NO: 6858570 - DNA, 78 bp, Homo sapiens
cacagggtctgatgcattttaggaattgccttactttgggtttccccagaagcagattctaaagcaaggactcaagtg

SEQ ID NO: 6858571 - DNA, 77 bp, Homo sapiens
tgcacaggttagaacagtagaagaaagggtgaggccttgctataagccatctttcttcactgtccttccctaaggca

SEQ ID NO: 6858572 - DNA, 97 bp, Homo sapiens
ggcactggtggctgcacttctgggctgaaattagacagcatgctttttaaattgcagctgcttctgactaagctgcatgagggtaagtcatcttgcc

SEQ ID NO: 6858573 - DNA, 79 bp, Homo sapiens
gcctgcgcctttctccctgcctgcctgcgcctcccatgcagggccgacagcgccagccagggaagggagagacacaggc

SEQ ID NO: 6858574 - DNA, 64 bp, Homo sapiens
ggacagtttcttgagaaggctaacagctgaggacagctcttctagcatctggagaaacaagtcc

SEQ ID NO: 6858575 - DNA, 60 bp, Homo sapiens
catggaaccgtttgcagtttgggttaggccataggcgtttgatacaggaatggttctatg

SEQ ID NO: 6858576 - DNA, 55 bp, Homo sapiens
gcccgtggttgggaaaggcagtatcatatatgcagtctttctacctctatgtggc

SEQ ID NO: 6858577 - DNA, 76 bp, Homo sapiens
tgggacttttggttagaattgtattacatttccaaataccggaagaattattgcaatactagatatcctcagccca

SEQ ID NO: 6858578 - DNA, 75 bp, Homo sapiens
catcacatccctcccagagcaagccattgaaatagatattttaaagaagctgtggctctgggaggtggagtaatg

SEQ ID NO: 6858579 - DNA, 67 bp, Homo sapiens
atttcagagtgagagtgctcaaggctgcaggtgcaagacagcactggtaaggactcttagctgaggt

SEQ ID NO: 6858580 - DNA, 71 bp, Homo sapiens
gccagagaatccggagagtccattggatttgcaaaagcagtggcccatggctcttggggtcttctctgagc

SEQ ID NO: 6858581 - DNA, 59 bp, Homo sapiens
gcagtctaaattggagccgcaggacccagtgttctgagtcctggcgtccaatttcctgc

SEQ ID NO: 6858582 - DNA, 63 bp, Homo sapiens
tgggcttccagggggccacagcgtggtcctgtgcaggacaggctggcaatgccctgctgccca

SEQ ID NO: 6858583 - DNA, 60 bp, Homo sapiens
ggattgacaggttgtgtaggtggccagtaaacagacttttggtttctaagctgtcagtct

SEQ ID NO: 6858584 - DNA, 71 bp, Homo sapiens
ccactgaggcaggcagtatctagcttgggacatgcccatttgaagtcttttaaggatcttcctgcctgtgg

SEQ ID NO: 6858585 - DNA, 58 bp, Homo sapiens
gcagacacatccactcctacaggtgtctgacgaccttgggggtgtagctgtgatttgc

SEQ ID NO: 6858586 - DNA, 80 bp, Homo sapiens
catgtatagtatgagctcatacacttgtgttaactcatataattaactcaactcaaacgcatgagttcatactgcatatg

SEQ ID NO: 6858587 - DNA, 70 bp, Homo sapiens
tgaattttttatccatattaagatgcctctggggaatccagtagacacattaatatggaactgaatctca

SEQ ID NO: 6858588 - DNA, 56 bp, Homo sapiens
cccggcccagactctgggagcccccaaaggatggctctgaggaagttgggcacggg

SEQ ID NO: 6858589 - DNA, 79 bp, Homo sapiens
aactggtttcttctcttgtaatttaaaaaatctacccactaggggaagattgatagcttaggagaatagaagggcagtt

SEQ ID NO: 6858590 - DNA, 58 bp, Homo sapiens
aaagcatcagatctgacacttcgttgtagcatttgcagtgtgacagtcctgctgcttt

SEQ ID NO: 6858591 - DNA, 105 bp, Homo sapiens
tcttggctcagccccctgaagtcagaagggcccttccttcccatcctttcagaaggaagagagaagaggaaggcaaggtcccagtgacaggggaagggcccaaga

SEQ ID NO: 6858592 - DNA, 129 bp, Homo sapiens
gagctctccagatgatgctaatctgcagccagggctgagaaccactggatgagatgagctctcaggaccctgacatctcaggtctgtggttcactacccctggtgcacaataacatcttctgggagctt

SEQ ID NO: 6858593 - DNA, 78 bp, Homo sapiens
tagacagcttgggatagtgaaacttgggttgtgttttagaagaaactggatctgaacatcggtatcataaactgttta

SEQ ID NO: 6858594 - DNA, 91 bp, Homo sapiens
aaaatggagcatcacatctcctaggttattgatgcagaggtatgtcacaaggccctctgtagaaagagcccaggtggtagtctcccatttt

SEQ ID NO: 6858595 - DNA, 58 bp, Homo sapiens
tgaggaggaaggcttcattaggttgtgctgattcaattgcttgacattttccttttca

SEQ ID NO: 6858596 - DNA, 81 bp, Homo sapiens
gagacgaggaggttggggctgcagtgagctgtgatcatgccactgcgctccagcctgagtaacaaagtgagaccctgtctc

SEQ ID NO: 6858597 - DNA, 71 bp, Homo sapiens
agttatagaaccaggtcctcactctgcacaaaaaaattacctcccagaggtggaactgactttctaaagct

SEQ ID NO: 6858598 - DNA, 90 bp, Homo sapiens
caggggtggggtgggtcgtgggccctgctccattcagtggtgcctctgcctgcctcggaactcggggtccctgcccacccataccctctg

SEQ ID NO: 6858599 - DNA, 62 bp, Homo sapiens
ccatcagaatgaatgttctggagccctagctgggttgtttgagagcactcattgctcctagg

SEQ ID NO: 6858600 - DNA, 61 bp, Homo sapiens
tttcctgattttgatagcggggctggtcaggtaagagagtccttgtagaaaaatcaggaaa

SEQ ID NO: 6858601 - DNA, 60 bp, Homo sapiens
cagagccaggtggtgttggggcgaagcccagctcttccacccaacagccccatggtcctg

SEQ ID NO: 6858602 - DNA, 78 bp, Homo sapiens
gtataatctggccttcccatcagcctcgcctttctgcctacaggagataagaggctggtgtggaggaaactgatatac

SEQ ID NO: 6858603 - DNA, 68 bp, Homo sapiens
cctggtgtgccttccccggtggtctgtttctttaggacaggaacgcagctgtctggaaggcacccagg

SEQ ID NO: 6858604 - DNA, 61 bp, Homo sapiens
tcctctgtaaaacattgctaaataatgctgcagcttctctggcagccagtggtacggtgga

SEQ ID NO: 6858605 - DNA, 81 bp, Homo sapiens
gccacatgacttgggggcctgagaagcagagcctgcaggagccaggcctgctgtcttgaggccaagaggggaagggtgtgc

SEQ ID NO: 6858606 - DNA, 68 bp, Homo sapiens
ctgtgatacagtatttaaagagcaacgataaaagtctacacatgatgctctggttgtgcatgtagcag

SEQ ID NO: 6858607 - DNA, 77 bp, Homo sapiens
atgcagcctgtccagctgaccagagcagcagagatggctcagttttcagctgcctctcctgagttgacaggaggcat

SEQ ID NO: 6858608 - DNA, 77 bp, Homo sapiens
aattatttgtgtccacagaatacccttgtttttgatcttgaagctctaagtaatgtattgctgctggacatgtaatt

SEQ ID NO: 6858609 - DNA, 68 bp, Homo sapiens
agctcaccataggaacacagtcagaaggtgagatttgaccatagtttgcctgctcctgtgttagagct

SEQ ID NO: 6858610 - DNA, 65 bp, Homo sapiens
agtacatggttataaaagtcctctcattacagagttaagtaatggtgggaaatgtgacctctact

SEQ ID NO: 6858611 - DNA, 78 bp, Homo sapiens
aagtgccagtgtttaatcattgtgaatttataagtgtgtgcgttaatttgtaaggggattaaaaatacatgggtattt

SEQ ID NO: 6858612 - DNA, 58 bp, Homo sapiens
aaggcactgtactagttagttattgctatataacaactgccgctaaacatagtgcctt

SEQ ID NO: 6858613 - DNA, 102 bp, Homo sapiens
actggttgctttgaggaggagctgctttgatatgcaaggaactgtcttgtttagcaagttgttaatgcctacatattaagcatctttctttttttttccagt

SEQ ID NO: 6858614 - DNA, 59 bp, Homo sapiens
cggtatttaccaatcttctgtaacgaggtagactccatttagaatctggtgatgtatcg

SEQ ID NO: 6858615 - DNA, 91 bp, Homo sapiens
accctttacctgctccctcactttttcttcctatggagacccctctttttcctccacaggccttaggagagatgggggaaggggtaggggt

SEQ ID NO: 6858616 - DNA, 74 bp, Homo sapiens
ccagttgggcaccttattcctttctccctttccacttaagctgagtggcggggattagcagtgtttgcccctgg

SEQ ID NO: 6858617 - DNA, 87 bp, Homo sapiens
gaggatattttatttaagctgttttgcaaagtttgattagcctactgaatagtacagtttaaatattaatataaggaaaggagcctc

SEQ ID NO: 6858618 - DNA, 80 bp, Homo sapiens
atgaatcatgacccattttctagatgttctactggggaaagcagaattgttttaaggtggacatctaagtcatgaattat

SEQ ID NO: 6858619 - DNA, 62 bp, Homo sapiens
gacaccattacctttctatattgcaggtccccatggtcatgcagttagcaggtgctggtgtc

SEQ ID NO: 6858620 - DNA, 78 bp, Homo sapiens
cttgaagaagtctttcccagagtagttgatgctttaagagaggtataggactcacctgggtgaagaagattttgaaag

SEQ ID NO: 6858621 - DNA, 57 bp, Homo sapiens
tatggtctgatgtcccatggcttctggcttcagttgggggtaggggtatagacggtg

SEQ ID NO: 6858622 - DNA, 73 bp, Homo sapiens
cacttatctgcccatatttaactatgaagcactaaaagttgattaggagctctgtgtatgtggcaggtgcttg

SEQ ID NO: 6858623 - DNA, 94 bp, Homo sapiens
tggtgggaagtgccggctgggttggggttacatgactgctatcctcaatgcagtcctggccagcctcctgcccatcatcagctggccccacaca

SEQ ID NO: 6858624 - DNA, 72 bp, Homo sapiens
catttcagatagctgactactcttcttccaggcttagcctaccaaaggcagaggtggttactctctgttgtg

SEQ ID NO: 6858625 - DNA, 62 bp, Homo sapiens
tcctgaagcagttagcatgagcaaaaaaggagtgtggatgcttttccactgcttttcttgga

SEQ ID NO: 6858626 - DNA, 76 bp, Homo sapiens
taggttggtgcaaaagtaattgcggtttgggcattaaaggtaatggccaaaccgcaattatttttgcaccaaccta

SEQ ID NO: 6858627 - DNA, 65 bp, Homo sapiens
ccacctctcagggtttcctaatgcaaatcctcgaaccctgcagaagtgagcatccagagaggtgg

SEQ ID NO: 6858628 - DNA, 69 bp, Homo sapiens
ggtgtgcgccaccttgtgatccacccgccttggcctcccagagtgttgggattacaggcataagccacc

SEQ ID NO: 6858629 - DNA, 109 bp, Homo sapiens
gacagctctggtgtctggtgatggggcggtaagggagcttaggagatcaggcagcccatttatgtcttctttctttctgactcccaaccccacaaagacagagggaatc

SEQ ID NO: 6858630 - DNA, 63 bp, Homo sapiens
gcaaacaggaattgatgggagtcctctgacattttgaggatatccctacacatcactgcaggc

SEQ ID NO: 6858631 - DNA, 71 bp, Homo sapiens
cattgaaacagggacagttacatcatcagacttttatgtataagctgcagatttttgtccctacctcagtg

SEQ ID NO: 6858632 - DNA, 77 bp, Homo sapiens
ggcacactcacaacccctcatgccagacagcatgcaatcacgggatgctctgtggggctgagggaagaaagtgtgcc

SEQ ID NO: 6858633 - DNA, 89 bp, Homo sapiens
tgagatatcacttcacacccactatcatggctgaaatcaaaagacagtaaatacatgttggtgaggatgtggagaaactgaaaccctca

SEQ ID NO: 6858634 - DNA, 65 bp, Homo sapiens
ttctgctgcctactcctggggacttgaaggttgagttagagtccaccctacctagacagtaagaa

SEQ ID NO: 6858635 - DNA, 63 bp, Homo sapiens
cttcagggtgtgttcagcaagaggtaaggggtctagttctgctggaaatgagcgcacatgaag

SEQ ID NO: 6858636 - DNA, 60 bp, Homo sapiens
cctgttctctctttttggaccgaccgaaccagtgtgtcgctgttcacggaggaggatggg

SEQ ID NO: 6858637 - DNA, 56 bp, Homo sapiens
tgagcaggcaaacaatggttataatttactttcaatcaaagagtttgcctggctta

SEQ ID NO: 6858638 - DNA, 79 bp, Homo sapiens
ttactagctgtcaggcgaaaattaaatgagcttgctccgagcttcagatttatctttctgtctacaaaaggctatgtga

SEQ ID NO: 6858639 - DNA, 87 bp, Homo sapiens
agctgacttctgttcagatctaattggattattattgtttctcctcataatgtggctgatcgcagagctcttactagaaagtcagtt

SEQ ID NO: 6858640 - DNA, 78 bp, Homo sapiens
atccagctgttttcatttgatgtaacaaagaacaagcagaaactttgttttatccaaatggataatagtgtcctggat

SEQ ID NO: 6858641 - DNA, 88 bp, Homo sapiens
agagacatttttataaggtttctactgtgttaagaaaagttttaaaataatttctctagagaacagtacaaactttctgtgtgtttct

SEQ ID NO: 6858642 - DNA, 106 bp, Homo sapiens
taatgtttcaaatactggtatattctcttggctgtcacacagttgacatttcagatttctgagagattgatgtgtcacaagagatttgagggtgaatgaaaagttg

SEQ ID NO: 6858643 - DNA, 66 bp, Homo sapiens
gtcacatagtctggagtgtccagttctactctgaaaagatggctctccccacctaagaaatgtgac

SEQ ID NO: 6858644 - DNA, 68 bp, Homo sapiens
ttggctttctggaggccagctgccacctggggcaaagtatccaggtccaagatcattctgaaggccaa

SEQ ID NO: 6858645 - DNA, 63 bp, Homo sapiens
agccaggggctttgctcccctcagaggagaagcacatcctcagggtgaaattgggtcctggtt

SEQ ID NO: 6858646 - DNA, 92 bp, Homo sapiens
agagggtgacaccgctccagctgcgggctgtggggaggagatttgcaccctgacacccactgccagccgcccggaggcagttctcaccccct

SEQ ID NO: 6858647 - DNA, 55 bp, Homo sapiens
cttggcagctacacaggtaagatcaagttgatgtctcactagtgagcaagctagg

SEQ ID NO: 6858648 - DNA, 65 bp, Homo sapiens
agccatccagtccatgacattctgttatagaatcctggactgactgatatgggctggaacatgct

SEQ ID NO: 6858649 - DNA, 74 bp, Homo sapiens
gcaaatctctgactaccagaattttggatcaactcccaggtttaggagttggatgaaactggtgtgatgtttgc

SEQ ID NO: 6858650 - DNA, 64 bp, Homo sapiens
attattgccttaggagtgcatatcattgaatatcttctcgatggatctaccttcaggctctggt

SEQ ID NO: 6858651 - DNA, 80 bp, Homo sapiens
cccaaactgaactttcttgctgcagactcttggtttgcttatgaaccaagtgagtacttggcagaaaccaagtatatggg

SEQ ID NO: 6858652 - DNA, 57 bp, Homo sapiens
gctggtcccaatgtgtttccttctattcttttgacaggaagctcctggagagccagt

SEQ ID NO: 6858653 - DNA, 117 bp, Homo sapiens
tttgatatttgttagccttgatgtttgaagtactcatcggtgaccaataagctgttatacagccttgaacactgactgaagggggtctgaaataccatggggattaaaaatagcaaa

SEQ ID NO: 6858654 - DNA, 77 bp, Homo sapiens
tgggcttttctctgtgcactaacattcctggtccaaatttcctctttgtataagggcaccagtcacattaaagtcca

SEQ ID NO: 6858655 - DNA, 59 bp, Homo sapiens
cgcctctcacctccaggagctgctggcctccacggaaagcatccgcctggaggtgggcg

SEQ ID NO: 6858656 - DNA, 113 bp, Homo sapiens
ggcacagtccctggaggccaacccacagcacatccacaggctccagccaccgcggcactcaaacaccatgggcctgggagtgcacagtgaggtcctgcctgcaggagcgtgcc

SEQ ID NO: 6858657 - DNA, 66 bp, Homo sapiens
gtaatgtccattagggataaaggtggtgctagcaaaagacaaatctggaatccttgtggacaatat

SEQ ID NO: 6858658 - DNA, 69 bp, Homo sapiens
attttacctacttcaaacttttacctggttatagtaatgaattgtggaggaaaagaagttgggtgaaat

SEQ ID NO: 6858659 - DNA, 121 bp, Homo sapiens
gctcgaagaatcacaaaacatgtatgcatttaatgtcgaatgttttgcacagaaagggattccaaagtcacctgtgctgaacaattctgcattgatgatggcactgtaagattctaagagc

SEQ ID NO: 6858660 - DNA, 60 bp, Homo sapiens
ctgcctgcgctcgctctcgcagggctgggaagccttggcagggtggaggatgcagggaag

SEQ ID NO: 6858661 - DNA, 66 bp, Homo sapiens
tcattgtctgagcccctagaactgagcgtgggcagccctgctacagagcgggggctcagtagatga

SEQ ID NO: 6858662 - DNA, 60 bp, Homo sapiens
gtgcatcgctctaataggatgaggagccccttactcaccatgcctatgcctagggtgccc

SEQ ID NO: 6858663 - DNA, 55 bp, Homo sapiens
atgaggcattccactcaaactcatttttccttgacagtgggtgggtcagtctcat

SEQ ID NO: 6858664 - DNA, 57 bp, Homo sapiens
ggatttgcgcctgatcccacatgacttagtatagcatgggccatcgtgccaggtacc

SEQ ID NO: 6858665 - DNA, 64 bp, Homo sapiens
ggggaggcttgtgccaaggggaaagtcgaatctaaagagtgtttcctcctggccaggcggcccc

SEQ ID NO: 6858666 - DNA, 63 bp, Homo sapiens
gtccctggtctaccgtggcttcatctacccaatgctgcctggagggccaggtggaccaggggc

SEQ ID NO: 6858667 - DNA, 92 bp, Homo sapiens
gggttggctacatggcggggcggaggtatctttagtgggggaacagcgttgtgccaccaggaggggtctctgtctcccaggtagaggaattc

SEQ ID NO: 6858668 - DNA, 64 bp, Homo sapiens
tgcaacagtggggcatgctgaagccttacagaggagcccctctctagcctgcccacacagttca

SEQ ID NO: 6858669 - DNA, 57 bp, Homo sapiens
gatgcctttactcttgggtctattgctataaagcaaaagagcctggaaaaagacatc

SEQ ID NO: 6858670 - DNA, 108 bp, Homo sapiens
gggcaaatgtcttactataatttatgattttgatagaggttttagagtgtttatttataaaaatctttaagtttaccactttcagaattaagagcaggatatttatct

SEQ ID NO: 6858671 - DNA, 83 bp, Homo sapiens
gtccctctcaaaatagtagtggtccctcattgacaaacactggatgctatcaattagggtctatttctagtgtgagagagggc

SEQ ID NO: 6858672 - DNA, 82 bp, Homo sapiens
ctttgcacatctggatgaagacccagaggctggggtgacactaaaactccacagcctgagccccatccagctgatggcaaag

SEQ ID NO: 6858673 - DNA, 56 bp, Homo sapiens
acaaaggtgagcagaagacacatttcctttggtgtcagaagtggcttcatctttgt

SEQ ID NO: 6858674 - DNA, 58 bp, Homo sapiens
gaggaggcctgtctgggaggcctccaagggaggaggtacacctcagcagggctcactt

SEQ ID NO: 6858675 - DNA, 92 bp, Homo sapiens
ctagataggcatttctactcctacctgcagccaactttcttccaaaatgaaagcaaggccactattgcagaagcagagagttgccaatttag

SEQ ID NO: 6858676 - DNA, 65 bp, Homo sapiens
gttcagcagttgggacttgagcttgtgtctgccgactccctagcccccagtctaaactgttggac

SEQ ID NO: 6858677 - DNA, 107 bp, Homo sapiens
aagggaggtttgtaggagtcctcggacgtgggatattgggggtatctagggcttggatggtttgtggaatgtcctcagcatcctcccgtcccaacccaaccttcctt

SEQ ID NO: 6858678 - DNA, 75 bp, Homo sapiens
cctattccttacacttccatttattcttgtccagatgactaattaggagaaaaatgaggaagatagaggagtggg

SEQ ID NO: 6858679 - DNA, 59 bp, Homo sapiens
ttgttctatggggtgaagtctataaataaataaataagatatttcacatccgagaacaa

SEQ ID NO: 6858680 - DNA, 72 bp, Homo sapiens
catctgctcagtgcttatctctaaagttggaaggaaactaattggtttttagattgatggcattaatagatg

SEQ ID NO: 6858681 - DNA, 81 bp, Homo sapiens
cagcctacctaacactggcttttgctgaggctctagcagccagccaggggctctgcatgtgagtgggtggtggtagagttg

SEQ ID NO: 6858682 - DNA, 89 bp, Homo sapiens
tttgtttgcattcattcagcatttatttattgtgtacctactgtgtgccacacacagttccagacacaggagataaagctgtaaacaaa

SEQ ID NO: 6858683 - DNA, 81 bp, Homo sapiens
gctgacagcgcaggtgctgctggagcagcaggcactacagagccagtgttctccagtaagccctctgccactgttctttgc

SEQ ID NO: 6858684 - DNA, 55 bp, Homo sapiens
ccttatgttccttggtctcaggcaactagacagcctgaaggccagcagcataggg

SEQ ID NO: 6858685 - DNA, 66 bp, Homo sapiens
taacaattctctcttcatgtaggaaaaaagtgagtgtgataaactattcctcaggagaggatgtta

SEQ ID NO: 6858686 - DNA, 78 bp, Homo sapiens
cagtgctggtttcacccaaccgatgtgcagaagccaaaattttgatttatatcctttgggtgagatttttgagtgttg

SEQ ID NO: 6858687 - DNA, 57 bp, Homo sapiens
ggatgatgagctgtggtagcacgatgatcaataacattagcttcaaagccatcaacc

SEQ ID NO: 6858688 - DNA, 68 bp, Homo sapiens
tcctcctttctgccgttccctgctctgtggcggatgcgcagggatcagtagggacggcagcagtaggg

SEQ ID NO: 6858689 - DNA, 85 bp, Homo sapiens
cagccatccctgactcatctcctcaactcagagcttgagcccatcaccctcagctcagagctcgggaggatggggctggaggctg

SEQ ID NO: 6858690 - DNA, 110 bp, Homo sapiens
ctgccgctgcagggcgcacggcttcccggcggtcggcgacttctgctctggcaacttacgccagggttgtgtgctggccgctgggagcccaggtgacgccatgggggcag

SEQ ID NO: 6858691 - DNA, 128 bp, Homo sapiens
tgtgggtttctggcattgtaagtgttttgtctgcttgcaagcgagcagctgatggatggggaaaatgttcattgatttgtagtgcctgcactgcagccaaccagcactagaatgaggaggcaccatca

SEQ ID NO: 6858692 - DNA, 69 bp, Homo sapiens
gggctgggaaggagggttgcgaaggaaagtaaagttaaactgcatgccccttcccttcccttcctgccc

SEQ ID NO: 6858693 - DNA, 57 bp, Homo sapiens
aaatgctgcagctagtgtgttttttaaaaatagacattttattacactgcagcgttt

SEQ ID NO: 6858694 - DNA, 72 bp, Homo sapiens
gtggatagggaataggagatttgaattgggacaaaagtttccccatactgaggatcctgttctccagtaagc

SEQ ID NO: 6858695 - DNA, 70 bp, Homo sapiens
gctaccttgacagattggagaattggattgagggttaatgactcagtgagctcctgtctgtccctggagc

SEQ ID NO: 6858696 - DNA, 62 bp, Homo sapiens
atctttgtagttataaacgacttttgttttaataacaaagttgttgattttctactaagggt

SEQ ID NO: 6858697 - DNA, 55 bp, Homo sapiens
cagttcatggaagattcaatggacatgtacatgatcccctgagcacccagaactg

SEQ ID NO: 6858698 - DNA, 57 bp, Homo sapiens
ttctgtccccacactctaaggtcctggtttccactgcagggctgagaaggggaagag

SEQ ID NO: 6858699 - DNA, 86 bp, Homo sapiens
gttgaagtgaatgtcctgaaatgtgcacatgacattgggtatacatcaaagtttgttgtacatgttagtatcatttatgttgcagc

SEQ ID NO: 6858700 - DNA, 81 bp, Homo sapiens
tccttggtgaacagttgtaaattcatagcttataaaattattgcaattattaggtatgtatatacagaacaatgctaagga

SEQ ID NO: 6858701 - DNA, 61 bp, Homo sapiens
gggcgaaggccagggtcccacactcgcagcgctgcgacggcgctcgggacctccctcgtcc

SEQ ID NO: 6858702 - DNA, 108 bp, Homo sapiens
gtgacacataggaggtgtttagaaaacatataatgaataaactatgatgttattttcactgtttgttcaatatgtgtttgtcctttaaatatttaaaagttttgtcat

SEQ ID NO: 6858703 - DNA, 75 bp, Homo sapiens
tacatgatttagagcacaggctctggagtctaattagctgagttagaatccagattctatgctaacaaacgtgtg

SEQ ID NO: 6858704 - DNA, 55 bp, Homo sapiens
gtcactgtgaggaggggccagggggccacgtcccttagctccagacccacatgac

SEQ ID NO: 6858705 - DNA, 58 bp, Homo sapiens
aggcctcattttcactttatgcctggatctatggcagccatttgggatcatgaggttt

SEQ ID NO: 6858706 - DNA, 67 bp, Homo sapiens
gacttctgaactttttgtttgaattttcatcatatttgattctgaagcacagaatggtttaggagtt

SEQ ID NO: 6858707 - DNA, 57 bp, Homo sapiens
gagtgcttggtaattgcactgagccaaagacactcacttcgcaattattgggcattt

SEQ ID NO: 6858708 - DNA, 87 bp, Homo sapiens
ggggtgcccccacgctggccagcatgagggtctccatgcagcgtgcacatgcccgcaccctgtgtccccctcagccaggtgcaccct

SEQ ID NO: 6858709 - DNA, 70 bp, Homo sapiens
cctgctccgtgggtggatggctcacctccaggcaccctgaggccagccacagccaccctctggaaaaagg

SEQ ID NO: 6858710 - DNA, 129 bp, Homo sapiens
tttgttgatattccgaatggtgatgattttgccttgggtgctgtcatggggcacggagtatatgttttcttcttcattccttggcttcaccacagcatccatgggttcagcatagtcagaaggatcaaa

SEQ ID NO: 6858711 - DNA, 65 bp, Homo sapiens
tctattttgggatttgacatgttggtcccctgcaataactgtgagatgcaaatcccaaaatcagg

SEQ ID NO: 6858712 - DNA, 56 bp, Homo sapiens
tttgttccttgtgaccaggagggagctctccacctctctccaccacagagagcaga

SEQ ID NO: 6858713 - DNA, 62 bp, Homo sapiens
cttaggcagactgctgatgcaggagtacaaaactgcagagatatcaagcagtctgatttagg

SEQ ID NO: 6858714 - DNA, 60 bp, Homo sapiens
cctgaagctttgtagcaatctagtgattctctttgcaaggcatgtaacaatggctttggg

SEQ ID NO: 6858715 - DNA, 83 bp, Homo sapiens
gcacaggagtatgcgcccagcagctgggaaggaggctgacctcagacggtggcctgtggatcccagctctgtcatttcctggc

SEQ ID NO: 6858716 - DNA, 71 bp, Homo sapiens
gtactgtacatatgtctccagagtgtgggagcttcataaacaacacattttgatctgagcagatgtactgc

SEQ ID NO: 6858717 - DNA, 58 bp, Homo sapiens
cccatggccttgcaggcttaacaggaagagctctgagccagacaagacagccagtggg

SEQ ID NO: 6858718 - DNA, 65 bp, Homo sapiens
atgtgcaaaatgatatcctgaagcaccataggaaatataaatggtacgctctcatgcttgcacat

SEQ ID NO: 6858719 - DNA, 85 bp, Homo sapiens
gcaggaatgagtgctggaggcagtggaggtgcctgacgaaggtccagcaggacggacagccccagtgtctgtagatcaggcctgc

SEQ ID NO: 6858720 - DNA, 76 bp, Homo sapiens
tagcatttgtgggttgttgctgagtactgttgaatataacatgtagcagaaacgactaaatggttacaaatgatta

SEQ ID NO: 6858721 - DNA, 56 bp, Homo sapiens
gtttattttggtcaatacagtaagcaggtgtggcttgaagataggccaggatgagc

SEQ ID NO: 6858722 - DNA, 63 bp, Homo sapiens
ctgcgcagtggattaaggagggcagctcctttgggggctggccagagcctgtccattgagtag

SEQ ID NO: 6858723 - DNA, 69 bp, Homo sapiens
gcagtgtgtcagaggctcagggtctcagggacaatatccaggctctaggtcacctttgactttacctgc

SEQ ID NO: 6858724 - DNA, 76 bp, Homo sapiens
gcgctcctggcagggtggcagcgggtgacatggaatcaggcttgtctagcttgcttgccgctctccaagtgagcgc

SEQ ID NO: 6858725 - DNA, 69 bp, Homo sapiens
tctgggctttgcctcctgtgtttggcctttgtcaataccagtggaacaaacagaagaggcggaaccagg

SEQ ID NO: 6858726 - DNA, 61 bp, Homo sapiens
cagcttctccagatgaccctcagggcagaggtgacctggcagtgtcttgctggggcagctg

SEQ ID NO: 6858727 - DNA, 101 bp, Homo sapiens
ggagaggaagcaggcaggtggtattgacaaggtggagtcttggaacttggttttctatctcatatgtgttctaggtaccattgctgcataacaacctttcc

SEQ ID NO: 6858728 - DNA, 82 bp, Homo sapiens
gcactgaaaagagatccaccagggagagggcaatgtttaacttcaaagaatgccttcctaatggtggggtttcaggcagtgt

SEQ ID NO: 6858729 - DNA, 63 bp, Homo sapiens
ctatgtcctgagattggaaccataaagatgcttgatcttattatgggtacactcgggaattag

SEQ ID NO: 6858730 - DNA, 72 bp, Homo sapiens
ggtgctccgggcccacctgactgggcgtcctctgagtcagggaggtgccagtgctgtggtccccgcgagccc

SEQ ID NO: 6858731 - DNA, 67 bp, Homo sapiens
gcctgaaaactctctgtagaggtgggcgttgggggcctcaaccctcactctgcaccctgcagcaggc

SEQ ID NO: 6858732 - DNA, 85 bp, Homo sapiens
tccttttagcatattttgatgtatgtaatccttttttcccccaaatttgatgggtaacactttggattaaaattctgtttgagga

SEQ ID NO: 6858733 - DNA, 60 bp, Homo sapiens
cactagtcccatcagatgatatgagagaaaaggtttcatatattatatttgggaaatgtg

SEQ ID NO: 6858734 - DNA, 67 bp, Homo sapiens
tttcttcttgtgcactctctatgtactaggctgtacttgaggtgctagggatgtagcagtgaagaaa

SEQ ID NO: 6858735 - DNA, 74 bp, Homo sapiens
tggggactaagtggaccttagcattgggcacttggactacagaaaggcccaggactcagggtgtcgcgtcccca

SEQ ID NO: 6858736 - DNA, 61 bp, Homo sapiens
ctgttgaaattgtggagctcaaatatttaacttgtgtaatgcagtggaacaatttcaacag

SEQ ID NO: 6858737 - DNA, 57 bp, Homo sapiens
aatctgtagtaaacctgctgtcttagttcaagctgctgtaacaaaatactgcagatt

SEQ ID NO: 6858738 - DNA, 104 bp, Homo sapiens
gaggagaaagccaggaaatgacccattggtccctagatccagaggccacaagaaaggacaggaaatcaggtgaccatggggaaaagatttctttgctgctcctt

SEQ ID NO: 6858739 - DNA, 84 bp, Homo sapiens
tagctctttaagccacatttggacaatagtagacaaacattattgtatgtgttgtctgtatcatccaaaagtctttttgcgctg

SEQ ID NO: 6858740 - DNA, 55 bp, Homo sapiens
tgtctatcaacaggtaaatggataaacaaattgtggtgtatctgtatgatggata

SEQ ID NO: 6858741 - DNA, 60 bp, Homo sapiens
atccacaccgtcaagagctccctgctgacaaacagcatggcagtgaggatggtgctgggt

SEQ ID NO: 6858742 - DNA, 74 bp, Homo sapiens
gacagaatgcaagactggaggacccctgcctggaagaccccatcttcccactgcacctcccagcttcttctatc

SEQ ID NO: 6858743 - DNA, 82 bp, Homo sapiens
acatttttggtaagggtgcttcataggtgatgctgtgtatttcatactgcatcacagcaggaggcacataatattagtttgt

SEQ ID NO: 6858744 - DNA, 62 bp, Homo sapiens
attggctgctttactctgacggggcgatattaacctttctgcttttctctaaaggagccagt

SEQ ID NO: 6858745 - DNA, 92 bp, Homo sapiens
cctaaattctccaaagtctcagtttctttatgtgcataaagatagtaatacctatctccaaagcacttgaagaattgaactggaaaatgtgg

SEQ ID NO: 6858746 - DNA, 81 bp, Homo sapiens
gaaatgtcacatctgtctgcaattggctacctctccataggagaaacactgctggaagcctggagaccagatgttgctttc

SEQ ID NO: 6858747 - DNA, 106 bp, Homo sapiens
cgaagggcgtgcgccgcagcgtcttccgcagcttgaagctcggaggagctgcggcgcagcttcgggagcttagagctggggaagacgctgcggcgcgcgccactcg

SEQ ID NO: 6858748 - DNA, 99 bp, Homo sapiens
gaggcaggagaatcgcttgaacccaggaggcggaggttgcagtgagccgagatcacgccattgcactccagccctgctgacagtgtgagactctgtctc

SEQ ID NO: 6858749 - DNA, 73 bp, Homo sapiens
caggtcctcaggaggaagaactctgcaacaccactacaggtgtgcattctcagtccttcctccgtgggatttg

SEQ ID NO: 6858750 - DNA, 68 bp, Homo sapiens
gcagcttcctagatctgtggtactcagcctcagcccaagctgtgtattagaattgtctggggaactgt

SEQ ID NO: 6858751 - DNA, 82 bp, Homo sapiens
gaaggaggaatgatggtgcctagattatggttgctgttgccagtgatgttacatctatagtagagcaatacattccggcttc

SEQ ID NO: 6858752 - DNA, 81 bp, Homo sapiens
ccaaaggtgtccatgtcctaattcccacaacctgtgaatatgttagtttatatggcaaaggggaattaaggccaccagtgg

SEQ ID NO: 6858753 - DNA, 81 bp, Homo sapiens
ggtaataaattaagaatgttccaaaaaatatccatttgttctcagcaatatggagctgtgtgaatattcataactgttact

SEQ ID NO: 6858754 - DNA, 68 bp, Homo sapiens
ggacagacaggggttctcctggagtaccagaaagtgtagttgtactgcaggggatgctctgcctgtcc

SEQ ID NO: 6858755 - DNA, 58 bp, Homo sapiens
aattctgaggccatttatttcctctcttaaagagaatctgcaaatggtcctagggatt

SEQ ID NO: 6858756 - DNA, 94 bp, Homo sapiens
ggctgctccagggcccttattcttgccagatcctggaggccatttcttcttcaccaggaaatgaacaggaatgaaccccaagagcttctaagcc

SEQ ID NO: 6858757 - DNA, 65 bp, Homo sapiens
aatgatacagtgattattagttggtggtgtggaaatactaaatgctgcataaatgcttgattatt

SEQ ID NO: 6858758 - DNA, 85 bp, Homo sapiens
tttttagtttcatttatgttgttgcatgtatttgtagttcatttgttttctattgcagagacacatcatataagtatactgaaaa

SEQ ID NO: 6858759 - DNA, 55 bp, Homo sapiens
tgactggctgtggctattatgctttatacgaaggctctatgtcgaaagccagtta

SEQ ID NO: 6858760 - DNA, 56 bp, Homo sapiens
gggtttcctgggacatgagactttcattacgaaaactgggacagtcccagggaccc

SEQ ID NO: 6858761 - DNA, 79 bp, Homo sapiens
gttcctgctgggcaaaaccaggcgtttcctattattcttgaatacagcatgaaggatggctggctgccctgccaggaac

SEQ ID NO: 6858762 - DNA, 82 bp, Homo sapiens
caatgcaagcccttctattcagatttctcagctctagggggcaatggtaagagctggtgagatgtatggagggttgactttg

SEQ ID NO: 6858763 - DNA, 122 bp, Homo sapiens
aagtaaaggagactatacagtaagtgtttttccattccaaaaggatgttagaatgagacatctccatcctagaaaaccctatggaacggaaacctcattttcttactaatctcctgctgctt

SEQ ID NO: 6858764 - DNA, 66 bp, Homo sapiens
tctatcaggtttccattattttatgggtgggcttagcattattgggaagataaaggaaacaataga

SEQ ID NO: 6858765 - DNA, 64 bp, Homo sapiens
ccagatttcgtggctcctgcagaccatctggacatatgtgtgcaggtcacaggggttataatgg

SEQ ID NO: 6858766 - DNA, 129 bp, Homo sapiens
atcaaaattgtctgtagagctttttaaaaataactatgcccggtccccatcccagatctgtggatttacagtctccagaaatggggctggggagtgtgcactttataaagctccatagaatattttgat

SEQ ID NO: 6858767 - DNA, 56 bp, Homo sapiens
gcatgtgtgtcactttcctgcctgtgagcttctaaagaaggagaacatatgcatgc

SEQ ID NO: 6858768 - DNA, 109 bp, Homo sapiens
gaatctttttcctcttttcttattcttttctgtcaaaacttagctaagtgactgcattcttttagacacttttgaagaagatgggaatttagaggaagctagttgattc

SEQ ID NO: 6858769 - DNA, 70 bp, Homo sapiens
gcagagggaaggaagccaggggctggggagccggccacacaactgcccagtgcctatccttctcctgtgc

SEQ ID NO: 6858770 - DNA, 63 bp, Homo sapiens
tttggctgaagaccagattaaagcaattcatttttatatacagttttaattccttgagccaga

SEQ ID NO: 6858771 - DNA, 74 bp, Homo sapiens
tggtggaatgttcagtctcaagagtgatatatgaaatgcaagaatagatatgctatagtctgaatgtgtcccca

SEQ ID NO: 6858772 - DNA, 78 bp, Homo sapiens
ctgctaggcaggctgtccaggctcctttgggaatgtgtacatggggactaaaatgtttggggcagaacctcctagggg

SEQ ID NO: 6858773 - DNA, 65 bp, Homo sapiens
tgctggggcctgaggtggagctgcagactctgactgaggtgcaggaggctttattcaggatagca

SEQ ID NO: 6858774 - DNA, 64 bp, Homo sapiens
ctcactgccctgaagttgggtttctaatttactcaaggggctccagtgtctcagagcagatggg

SEQ ID NO: 6858775 - DNA, 62 bp, Homo sapiens
ccacctgtctgtaatcaactgagtttctaggtagtttctagctcaattgtctgcagtggcgg

SEQ ID NO: 6858776 - DNA, 102 bp, Homo sapiens
ggctgagtttgatcttaattctttttagtagattctcattgatctggttatgaagcaattacttgacaaggacataggaaactacaaaagagaagctcagct

SEQ ID NO: 6858777 - DNA, 129 bp, Homo sapiens
tgttgatatgaacaaaggaaaccaagtctcagagaaaaagctttgtccaaggccatgcaggtctccattggccatgcaggtctccattggcagactccacactggatttggttctgtgtttctccggca

SEQ ID NO: 6858778 - DNA, 55 bp, Homo sapiens
gttcaggaaggtcctatagcagagcttactaactttgttatccatctttctgtgc

SEQ ID NO: 6858779 - DNA, 59 bp, Homo sapiens
ttaggcattagagaaatgcaattttaaaccacagtgagatacatctctcagatgtctaa

SEQ ID NO: 6858780 - DNA, 63 bp, Homo sapiens
gacgggaggacctgagaacgccttggctttgcttgaggtggtgggagtcgcgggtagcttgtt

SEQ ID NO: 6858781 - DNA, 60 bp, Homo sapiens
ctggggtgcatccacgtggagttctcaaacatggagactggcctggagatgcagctgcag

SEQ ID NO: 6858782 - DNA, 77 bp, Homo sapiens
ggtggatgggttttcatgcctgtggtgcagtgttggtgaccagtgcttatcttcttggacatatacatttatctacc

SEQ ID NO: 6858783 - DNA, 65 bp, Homo sapiens
aacagaacctggagaagtttcttcctaggtttgaaatctttaatctagaaacttcttgttctgtt

SEQ ID NO: 6858784 - DNA, 58 bp, Homo sapiens
cagtgtatctttttttaacctttaaaaaaatctttaaaggtagttttaaaggtgcttg

SEQ ID NO: 6858785 - DNA, 58 bp, Homo sapiens
gaaggttttcaggagcctagtcttagaatcatagaggttcttggctcctggttccttc

SEQ ID NO: 6858786 - DNA, 61 bp, Homo sapiens
gagaatgtgtatgattaatgcctcagggctcttttcttcgcaaattcaacagcacattctc

SEQ ID NO: 6858787 - DNA, 65 bp, Homo sapiens
acaggtggtagagtggaaagaggctagccagagtgggtctgaattctgtctcctctactttctgt

SEQ ID NO: 6858788 - DNA, 56 bp, Homo sapiens
acctgtgccggggtctccaggacaaatgcctggaagttggaggccaggacacaggt

SEQ ID NO: 6858789 - DNA, 71 bp, Homo sapiens
gcgagcatgtgcatgtgtgcactgataatatgtacccctgcaagtcagagagggcacgtgcacacctacgc

SEQ ID NO: 6858790 - DNA, 62 bp, Homo sapiens
tggggtagcaatgacacccagcataacagttgatcgctgtgagctgaggtcattatgcctca

SEQ ID NO: 6858791 - DNA, 58 bp, Homo sapiens
gctctgtggctgagttccttatgttttaattaagcagggctcctgaaagccgcgtggc

SEQ ID NO: 6858792 - DNA, 59 bp, Homo sapiens
aggggcctggtgagagggtcacaccagaagggcctggtggagccacatcacaggctcct

SEQ ID NO: 6858793 - DNA, 77 bp, Homo sapiens
acaagtttgctgtcatccactaagctatcagaattaacatgctttctacattagcaccggatggcaagcaacattgt

SEQ ID NO: 6858794 - DNA, 77 bp, Homo sapiens
tttggattgcttggatgcttcgaacagccatgaaaagtagcctgcctgtggcatttagaggccaagcaattgacaga

SEQ ID NO: 6858795 - DNA, 80 bp, Homo sapiens
gggaggcaaactgaggcaggacttgcataaagtcctctgaaatgtgactagacttgctggctccttgcttctagccttcc

SEQ ID NO: 6858796 - DNA, 77 bp, Homo sapiens
gatcctgcagctgcaggcttcaggaagtctcctggggctatcagatggctccttcttgtagcagcagctgtggggtc

SEQ ID NO: 6858797 - DNA, 57 bp, Homo sapiens
tccagagcaaagtttgctaacagagtccactgctgttcaccaagtctttgtgttgga

SEQ ID NO: 6858798 - DNA, 68 bp, Homo sapiens
gtgggttcgtggtctcgctggctgcaggagtgaagctgtagaccttcccagtgagtgctacagctcat

SEQ ID NO: 6858799 - DNA, 60 bp, Homo sapiens
tcttcaaaattgattggagaagaaaattgccttttctctcctgccttttcattttgagga

SEQ ID NO: 6858800 - DNA, 62 bp, Homo sapiens
gagtaatcatagctaagctccagagtgcctgggtcacctggcagtctggcgagctatcactc

SEQ ID NO: 6858801 - DNA, 59 bp, Homo sapiens
cctgaggagagaattgctcctgtcctttcctatatcacagggcattgctggcctcgagg

SEQ ID NO: 6858802 - DNA, 95 bp, Homo sapiens
gaatgttggagctgggaatgattttggagaggaaaaaaatgcatctcaaattttgcagcaatttctccccaaaggactcactctcaccacctttc

SEQ ID NO: 6858803 - DNA, 55 bp, Homo sapiens
cttcttacttgtcttgcatatagggaaatcttgaatgtaggtcttggtgagctag

SEQ ID NO: 6858804 - DNA, 75 bp, Homo sapiens
ccagaccctccactcactgctgtgtttgaaccagggcaaagaaacactcagcacctgactggagcttcggtttgg

SEQ ID NO: 6858805 - DNA, 73 bp, Homo sapiens
ggggagaggggaggtccaggcatttgggttgggcaggcagcccacgcagctgtctggagttagcggtctcctc

SEQ ID NO: 6858806 - DNA, 66 bp, Homo sapiens
ttgctattctgtttttccaggttgtaattacagcaaacgattgattggaaaacatttaaatagcaa

SEQ ID NO: 6858807 - DNA, 65 bp, Homo sapiens
ggaagagagagtggttggtgtatggggtatttaaccccagtgcaccatttccctctgttccttcc

SEQ ID NO: 6858808 - DNA, 57 bp, Homo sapiens
gagccatcttttcccccggcagcccagcagctcaccactggggaggaggatgtgttc

SEQ ID NO: 6858809 - DNA, 77 bp, Homo sapiens
aggcccagcagcctctggtcctccctcagctcccctctgcccttgtggctgggagtgggagcaggggctctgggcct

SEQ ID NO: 6858810 - DNA, 72 bp, Homo sapiens
tttattttcctagaaccatgctcaggaaggaaatgttgcctcctgtttaggctgtggtctgggatctgtgaa

SEQ ID NO: 6858811 - DNA, 79 bp, Homo sapiens
ccctaggaattacaggttgtgtattcagtgatcacagagtatagtgattcactgaaggaagacactgtcatacctgagg

SEQ ID NO: 6858812 - DNA, 80 bp, Homo sapiens
gtcctcatccggcagccacatagaggccaagtgttcccgggcacctggcatccaacggctcgctttcctaggatgggaac

SEQ ID NO: 6858813 - DNA, 65 bp, Homo sapiens
gcctggcagatggagaagcagcaggtgctgtggtgtgacgggaccttgcttcccatcatgtacgc

SEQ ID NO: 6858814 - DNA, 97 bp, Homo sapiens
catatttggagtgtctgataaaagatatttggaaatcaaagagctgatgtaattcaatctttgatttgacaatatcttgtcagaaatgctaagtatg

SEQ ID NO: 6858815 - DNA, 75 bp, Homo sapiens
gatggcctgggtccccttccggcccaggaatggaactgaagccagataatgggaagggagggggtgcctggcttc

SEQ ID NO: 6858816 - DNA, 84 bp, Homo sapiens
tcaaagaggaaggatttagtttgagggtaaattctcctgtgcctcattacagtcctcaccaaggctgcgatccttccctgttga

SEQ ID NO: 6858817 - DNA, 95 bp, Homo sapiens
gctgcccaggatcctgtccctctaggaggccctcacaatcttcccacttgcacaggaccggggctgcctcctcgagacaggatcttatgggcagt

SEQ ID NO: 6858818 - DNA, 82 bp, Homo sapiens
acacatttgggtctgctattgttgttgttttaattgaatttttccagccttattgagacaaaattgacagacaaaattgtgt

SEQ ID NO: 6858819 - DNA, 55 bp, Homo sapiens
gcctggcccagggctcttgttggcacactctgcaggggcaaggctcaggccaggc

SEQ ID NO: 6858820 - DNA, 57 bp, Homo sapiens
tctgccttgttgcaggcgctatgtaggcacaaaggtcacagctctgaacacagcaga

SEQ ID NO: 6858821 - DNA, 104 bp, Homo sapiens
aagttgctataaagtattgactattagaatgtcttgaactttggttactgtgagccaagtcggtgctcaaagtatatttcatagtctcaattatatagtaattt

SEQ ID NO: 6858822 - DNA, 66 bp, Homo sapiens
gcccgcccactgttttccttggtgcgtttctctttaaatgcaaataagtgcaggcgtggtgttggc

SEQ ID NO: 6858823 - DNA, 58 bp, Homo sapiens
gcctaaaggttttactagatggttctatttgcagccatcacttgagaatctattaggt

SEQ ID NO: 6858824 - DNA, 96 bp, Homo sapiens
caggtaagtaactttattaaggccatatagcttgaatgggggacattcacaaaaccacatgccatgtggctttaaatagttcaatgaatttatctg

SEQ ID NO: 6858825 - DNA, 57 bp, Homo sapiens
ggtaccatgattcccacttttgtgcacatttacaagagggagaatattcatgttgct

SEQ ID NO: 6858826 - DNA, 61 bp, Homo sapiens
gggcaccatgggtaggtggccctaaggctccatgtcctgcttgccactcctgatgctgccc

SEQ ID NO: 6858827 - DNA, 100 bp, Homo sapiens
ggagcacagaagagttaagcaacttttctagacatggtcgtaagtttgaaaaatgtagatcaggcctgtggtttctagtaggttgcctaactctttcttc

SEQ ID NO: 6858828 - DNA, 67 bp, Homo sapiens
aaatgttgacctcctgaatgttttcataccagtttggattggaaaacagaagggtaggtaaacattt

SEQ ID NO: 6858829 - DNA, 84 bp, Homo sapiens
ggcagaaaaatggttgagaggctgtggtgtagttttccttatgtcactgccttgcaaaaacagccttgaggccttccctctgcc

SEQ ID NO: 6858830 - DNA, 63 bp, Homo sapiens
ctgctgggatagaagtatctcagtgtaccagcattcactaagctataaaatctgtgacagcag

SEQ ID NO: 6858831 - DNA, 73 bp, Homo sapiens
gacatcgccgtgtccgagatctttgtcagccagaaggacctggtgggcatcgttcccttggctatggtgagtc

SEQ ID NO: 6858832 - DNA, 59 bp, Homo sapiens
ggtgatcggtgatctggcttatttgttcctttgtgggggtaagggctgggcacctcact

SEQ ID NO: 6858833 - DNA, 75 bp, Homo sapiens
gacctgcaataacccagtatctgtgataagttaaggggagactaacccatcacagacactgggttattgcaagtt

SEQ ID NO: 6858834 - DNA, 62 bp, Homo sapiens
tcctgccttctgatcttctcttggcacctttactgaaaccatttagaagttggagggcaaga

SEQ ID NO: 6858835 - DNA, 64 bp, Homo sapiens
ctgcccagggataagcctagagaaagcagtccctcagtgatctaatagtttggctttggagcag

SEQ ID NO: 6858836 - DNA, 80 bp, Homo sapiens
gcagtttgacagcctcaaaagatacttgcatctaactgggagcatcttagtaagaatgctttcttcagtctacaaactgt

SEQ ID NO: 6858837 - DNA, 70 bp, Homo sapiens
agacacacagggagaaagaaagcctgcttggaggggatgaggtttaggagctattagtctttgtgtgtct

SEQ ID NO: 6858838 - DNA, 62 bp, Homo sapiens
tgtgattgtgccagaatggcttggttggctcagcgtcagaacggcttggttggcattgtaca

SEQ ID NO: 6858839 - DNA, 55 bp, Homo sapiens
tttagagagtagaggacagacaagggtgtgccctggtggcctctcacattctgag

SEQ ID NO: 6858840 - DNA, 70 bp, Homo sapiens
cctcagccagccacttcccaggagccatggaggtggagacttggggggtcctgggccaagggctgtgagg

SEQ ID NO: 6858841 - DNA, 61 bp, Homo sapiens
agggtcagttctgtgaggtgttggtcatcacttaggtagatctaatttccagagtggccct

SEQ ID NO: 6858842 - DNA, 57 bp, Homo sapiens
tgaagtaggcagcatgctgagatcaaggagctttactcagaatcactgtctgtttca

SEQ ID NO: 6858843 - DNA, 70 bp, Homo sapiens
agttccctatgttgaaggcaaagcataatctccatgaatactttgctttggctatcatagcatttgaatt

SEQ ID NO: 6858844 - DNA, 75 bp, Homo sapiens
gttctcaaataggatctgtgtaatctggcctggtaaggccatgctgggtaatttgcactgatcaatttgataagc

SEQ ID NO: 6858845 - DNA, 66 bp, Homo sapiens
gtttttctcacactatttattctgcttctttgaagatggtaggaggtcaggagagtgtgagtgaac

SEQ ID NO: 6858846 - DNA, 62 bp, Homo sapiens
gctgctctccctgctgtcctcagcctctcccaccaccggctgtggaccaggtcctgggcagc

SEQ ID NO: 6858847 - DNA, 66 bp, Homo sapiens
gtattttgcagagcctgtgattgagggaaaccaatgctccctcttaaaattacctttgcaaaatat

SEQ ID NO: 6858848 - DNA, 84 bp, Homo sapiens
gaccaggtttgagaagatgtaatgttaagcctcaggccatccaatacctgaattaacttaccatatgtacttttcaatctgttc

SEQ ID NO: 6858849 - DNA, 60 bp, Homo sapiens
ctcttggctggccgacctgttattatagggtttccctatgcaggccaggtccgcccggag

SEQ ID NO: 6858850 - DNA, 55 bp, Homo sapiens
atcagacctttatttcatgataggatacttcatgtcctgtgattcagggtttgat

SEQ ID NO: 6858851 - DNA, 77 bp, Homo sapiens
tctgcttctttttcctagtgctttctggtaagttatctcagcctattattatagttattgggaagattttgatcgga

SEQ ID NO: 6858852 - DNA, 71 bp, Homo sapiens
gcccatggtcagggaggcagggaccagcctctaccctctcagcctgtgacacctgtctcctcttacctggc

SEQ ID NO: 6858853 - DNA, 62 bp, Homo sapiens
atcaaagagtgagatttttactggttatttaggatctaggcatccagtaatctcctgttgat

SEQ ID NO: 6858854 - DNA, 62 bp, Homo sapiens
gcttgggccacagctcacacatccaatctacctgctcagcctggacggcatgtggcttaggc

SEQ ID NO: 6858855 - DNA, 86 bp, Homo sapiens
ctgaggtcatgttgacaagactttgtttgagactccaggcagatgtatttgcaaactctcagagaagtgatgagcaattgcctcag

SEQ ID NO: 6858856 - DNA, 63 bp, Homo sapiens
tcagaagggaaacacaagtgaccttaatgaaatgaagccgtggtcatgctttctccttcctga

SEQ ID NO: 6858857 - DNA, 91 bp, Homo sapiens
ttaatatgtactacatacatattacatcgttatgtaatatgtactacgtacgtagtacatcgttatgtaatatgtacgtagtacgtattaa

SEQ ID NO: 6858858 - DNA, 71 bp, Homo sapiens
aattgctgggaatatttagcccatgtccagaccaagtactgttttctctgggttaaatacttccagttctt

SEQ ID NO: 6858859 - DNA, 82 bp, Homo sapiens
ggctttggcttaagagaatgttgtggctaggttgatcttttattcagactactcaaactttctctatagcaacactagggct

SEQ ID NO: 6858860 - DNA, 76 bp, Homo sapiens
gcacctggagttgcctgggactgaataaacacttagccaacccagtgtgtctaccagcaccagcatattccagggc

SEQ ID NO: 6858861 - DNA, 70 bp, Homo sapiens
aggagtctggaggtacataatgagagggtctgggactggttcagaagctcagtgatgcctccaggggcct

SEQ ID NO: 6858862 - DNA, 57 bp, Homo sapiens
ccatgttgcatctcccctgctcctcattatccctctgtgaaaatgcaggcgacatgg

SEQ ID NO: 6858863 - DNA, 77 bp, Homo sapiens
gggtgtggtcagcctgggctccagagtccctttcagcttcctggctaggggtcaggaagccccggctcccgcagccc

SEQ ID NO: 6858864 - DNA, 67 bp, Homo sapiens
gagtgagagctggttcatggactgcctggcaggcacacctatgctcagtccagggaccggcctcctt

SEQ ID NO: 6858865 - DNA, 126 bp, Homo sapiens
agagagtgaaaaattcagaattccaagataattacccagaagattgtcagcaaaggcctctcattttctgtcactttgccattagacagcttctggctgatttccacaccaatgtctgaaccctct

SEQ ID NO: 6858866 - DNA, 59 bp, Homo sapiens
tggtgtactctgttgactaacacatgtgagtgtgcttgtgttctcacacagatgcagta

SEQ ID NO: 6858867 - DNA, 130 bp, Homo sapiens
aacacaattgtaatcagctacaatcaatatgcaggagctggttttcattttccactttgcactgagaggcagttcttaaagtgctgaagacctagctgtacttgaaaatggctgagatttagttgtgctt

SEQ ID NO: 6858868 - DNA, 97 bp, Homo sapiens
ctctatgttgtgaatgctcattctcttgtctgtattttgaaggttcactctggtgaacccaggaggtgacacagggcttggcacaatcactatagag

SEQ ID NO: 6858869 - DNA, 61 bp, Homo sapiens
aataagtcacagcagaaggagcaatttaggagattgtttttaaacatgtgactgaattatt

SEQ ID NO: 6858870 - DNA, 56 bp, Homo sapiens
gaagcctgctggatcaagcttatgctgttttcagtgaaagtgaatccagaggcttt

SEQ ID NO: 6858871 - DNA, 71 bp, Homo sapiens
tagtttagtgtggaatttgtctgccctcactgaaaactccagttaggcaatgaattattccaagtaaatta

SEQ ID NO: 6858872 - DNA, 62 bp, Homo sapiens
cattagcactgtctggttatcttgcttcagttgagggattcgggacaatagcagtgctgatg

SEQ ID NO: 6858873 - DNA, 61 bp, Homo sapiens
attgcaggccagtgtcctgggcgattccgtgtggaatagaccacagcaaaggttatgcaat

SEQ ID NO: 6858874 - DNA, 130 bp, Homo sapiens
agccagctgcttctgcacgcttttcgggtgggtagttgtttacccctggagcctgggctgcttgctgcctggcatggggctccctggccctggggacacaacccaccccttgagaggagtcggcatggct

SEQ ID NO: 6858875 - DNA, 67 bp, Homo sapiens
gagggattattgtgtccatttgagtcatgtggttatacctacattttctaggggaccaagatctttt

SEQ ID NO: 6858876 - DNA, 90 bp, Homo sapiens
gaggacctcagattgtagtttgaattttaatctcggtgttgcaaaagcactggaaaggtttaaagcaccaagctgtaggatcgcattctc

SEQ ID NO: 6858877 - DNA, 60 bp, Homo sapiens
gcttgattgaactcctgaatgtttgaatctcttcatgattttaggaagtttaaggcaggt

SEQ ID NO: 6858878 - DNA, 67 bp, Homo sapiens
ctggagtcaggagccccttctgcgtctcttccctccccttcaagggcagtgggctgctgcgctccag

SEQ ID NO: 6858879 - DNA, 58 bp, Homo sapiens
gagagagctaacagaagagcaaatgtttattgagtgctctatgtgttatagctgtttt

SEQ ID NO: 6858880 - DNA, 59 bp, Homo sapiens
ctgggacagttcaggtagggcaggtgagggacccccgaggccctggagccttgtcctgg

SEQ ID NO: 6858881 - DNA, 77 bp, Homo sapiens
cttctaaatgtcatgcttacctgtgtcattaaagaatggtgacacaaaggaaagcataatccactctgcataggaag

SEQ ID NO: 6858882 - DNA, 98 bp, Homo sapiens
ggagggctctgggaagcccctgacctgctgccccgctgaccctgaggcccgatgtgggcggctttgcaggcagcatcaaggctggccgccgctcctcc

SEQ ID NO: 6858883 - DNA, 115 bp, Homo sapiens
actgatttttaaaacaagaaaatacatctgaattttgatgtgcattgatatcttcaagcattgtatccaaatgttattttaaaatttgaatgtaggctctttttaaaaattcagt

SEQ ID NO: 6858884 - DNA, 66 bp, Homo sapiens
tgcattcaggatcctatgcttcagggagagttcttttgtataccattgctgaaggatccaggtgta

SEQ ID NO: 6858885 - DNA, 95 bp, Homo sapiens
gctgtcgcagacagaaaggggtctcagtgggtggagaagtggacctgctcacagaagaagaccacctctccaacctggacttcctccacgatggc

SEQ ID NO: 6858886 - DNA, 56 bp, Homo sapiens
ctgactccaggttttctctcaagtttgtagaattttacaaatgaacctggttttag

SEQ ID NO: 6858887 - DNA, 69 bp, Homo sapiens
ctgtttagtcaggatcaaattgaagttatcagagaaagctcttataacccaaatgattcactgttacag

SEQ ID NO: 6858888 - DNA, 88 bp, Homo sapiens
cgctccacctcccggagaggggcggggccaggcgagcctcacccacggcctctcgtagctcacgccccctctcccggagcctggagcg

SEQ ID NO: 6858889 - DNA, 61 bp, Homo sapiens
aagcccggttgggaacgtggtgtccgagaccgtctgggatccccgcgcgcacggccggctt

SEQ ID NO: 6858890 - DNA, 88 bp, Homo sapiens
tttaacacataactaggtttttcagggctcttaaaaggtaccttgcttaaactaagagttactggtttagaacctctgaatgtttaaa

SEQ ID NO: 6858891 - DNA, 84 bp, Homo sapiens
tcatggcatgttgtcatttgatctttctttgttgataaattaatatttaatacagatacaaaggaggacagtgaaattgcctgg

SEQ ID NO: 6858892 - DNA, 81 bp, Homo sapiens
cttatattcttactacagtaactggaattcttcttcagctcctatgagccagggagacaacattactggtttagatgtaag

SEQ ID NO: 6858893 - DNA, 93 bp, Homo sapiens
agagagtggcctggagaagcaggaaggtgtctggcccagagtctcatgcattgcaggaccagctagcaccttggctttcacaggtttcttttt

SEQ ID NO: 6858894 - DNA, 95 bp, Homo sapiens
aaaaaaaagattattttagacatgatatagagagtagattaaagggtagaattctttaggatctctcttgttacatttaaaatataagtttattt

SEQ ID NO: 6858895 - DNA, 107 bp, Homo sapiens
acagggtatatttagataatggaaatttgatattaattttggggagaaatagctgaaatcctgcaatatgtggaatcaagaactttggttatttgtcgggtccctgt

SEQ ID NO: 6858896 - DNA, 93 bp, Homo sapiens
tgctcttgtggtccttccaatattacaggtgtcaagagtagtaattatatgtttgcctgtttgtacagtgatgttgtatgccattcaggggca

SEQ ID NO: 6858897 - DNA, 79 bp, Homo sapiens
gcaattaatatatgctgttaagaattgtgtcccatgctgtaaaagcatgttcattttcttaatgtgccatatccaaagc

SEQ ID NO: 6858898 - DNA, 104 bp, Homo sapiens
gcctcttgtctccacagtaggaaattttctgcccattcttagagtctagggaaatacttggatgttatgaggtggtagactaagatggtgaggggcagagaggc

SEQ ID NO: 6858899 - DNA, 81 bp, Homo sapiens
cggagtttgcaggtcttgggagagtccatgaaacactgatacatacatttatgttcttccaaatctgtaacaaagcacacg

SEQ ID NO: 6858900 - DNA, 74 bp, Homo sapiens
ttgggtttagttggtgctcattgcagccacccatacatgtgtgttcagatgctgagaaccacgactgtgcttaa

SEQ ID NO: 6858901 - DNA, 75 bp, Homo sapiens
acccatgcacattctgggcgcctatggctgcagcatgtccctcaccctgttgccaggtagtcccagggcatgagt

SEQ ID NO: 6858902 - DNA, 63 bp, Homo sapiens
cggggttgagtcgcttgaggatctgggccaacacgttcactgtctgctcgctgctcagccctg

SEQ ID NO: 6858903 - DNA, 80 bp, Homo sapiens
gagtgtgagcctttcggagtaggagagaggctggggaagtccagcccctatcctcgctccaccccaccagatggccactc

SEQ ID NO: 6858904 - DNA, 100 bp, Homo sapiens
acatgcatacttagagttgttgtataatgatggaactttagcaattcactcacaatttgaagtacccgtttttattgcatttaattatatatacgcatgt

SEQ ID NO: 6858905 - DNA, 81 bp, Homo sapiens
tcagtttgtctctgaacaaactgcattcttcacttttactccagtagacagtcgaggtcagcagtttttcagccgtgttga

SEQ ID NO: 6858906 - DNA, 103 bp, Homo sapiens
gcccaaatacaaaagcaactgtgatgttagctctgtgttacaaggaatttctatatagtccctgtcttctgcctgacacagagcaaacaccattggtatgggc

SEQ ID NO: 6858907 - DNA, 74 bp, Homo sapiens
gacagctacctcatgctgtacagcacgtgtccatctgggaacaccctcagcatgatgttgtcagtggtggtgtc

SEQ ID NO: 6858908 - DNA, 94 bp, Homo sapiens
gagggcagcaggggaggacagagatctgggccagccccaagagaccccccaggcctctctggcatctggccaggctggcttcctagcagccctc

SEQ ID NO: 6858909 - DNA, 82 bp, Homo sapiens
gggggaatgcgcgttgtgcgtgtgtgcaagtgtatgtccatgtgtgcatgtgtgtgtgcgcgcgcaggaagtgcgtgaaatc

SEQ ID NO: 6858910 - DNA, 94 bp, Homo sapiens
aagtgtctttgtcacagcttgtatcccaatggagctattaatttcatttgaaatcatgttctctttgtgatataagcagattataaagaaattt

SEQ ID NO: 6858911 - DNA, 79 bp, Homo sapiens
tatgatatttttttctacttttctgtaggtgcattgcgaaaagaaaatgctgcctttctgaatggtggagaagtacata

SEQ ID NO: 6858912 - DNA, 61 bp, Homo sapiens
gctcgccccggcacagtgtccgtctgcacagacgcccgtggacgcacacgcgggggcgtgc

SEQ ID NO: 6858913 - DNA, 88 bp, Homo sapiens
gggattcacattgctggggctaagtacaaattgacatcaccttttaggaatgaaatgcttctctttgaccctttagctccagtgtccc

SEQ ID NO: 6858914 - DNA, 95 bp, Homo sapiens
caggaggcttccaagttcactttcttgtgctgtttcatgatgatcttcccaacattgcagaattaagcagagagccaacaatgtgaagaatcctg

SEQ ID NO: 6858915 - DNA, 59 bp, Homo sapiens
ctctgtcacttctccagctgagtgaccttggcaagtcgctcaggctgtctgtgctagag

SEQ ID NO: 6858916 - DNA, 61 bp, Homo sapiens
aaggcacctggtaagtgctcagtaaagggtcatggttgctgttgttattaccaggtgtgtt

SEQ ID NO: 6858917 - DNA, 96 bp, Homo sapiens
gggagatgtagggtccaggataggccagtaggggtgctgagatctggaatgtggctgcctgagttccatagtcacctcttcctggatttgtctcct

SEQ ID NO: 6858918 - DNA, 60 bp, Homo sapiens
catgaagcttgaagcagtccacgcagctactgaggagctacttggactggtttcaaggtg

SEQ ID NO: 6858919 - DNA, 65 bp, Homo sapiens
gctggtcaccgtgatgtctaatcaagtttctcaccccacccttgatgtctaagtcattggcctgc

SEQ ID NO: 6858920 - DNA, 84 bp, Homo sapiens
gtctatcattccagaactcaagaaatgcccttcgtttggtggagcacaggggctctgagctctgggaattataactgattagat

SEQ ID NO: 6858921 - DNA, 65 bp, Homo sapiens
gcagatgacacttctccatcaagtcaaatggaattactttgatatgaagagaggcgtgtttatgt

SEQ ID NO: 6858922 - DNA, 84 bp, Homo sapiens
gccagtgagaccagtggaggccttgggaccttttctttctggtaagcaataggtccaaggagaggtcttttttgtccctttggc

SEQ ID NO: 6858923 - DNA, 130 bp, Homo sapiens
aagaagtcaagttttttgaagattggagttagttatattagggaatgctgaatttagtatttatgtgaaattctatgtaagttttcttgtatttttaatgtgttttctcttgttaccagtttttgtgtgt

SEQ ID NO: 6858924 - DNA, 67 bp, Homo sapiens
gcatgctgtacaactggctgggctttcttatatttcttgtaactaattagtctcagtgtacagaggc

SEQ ID NO: 6858925 - DNA, 130 bp, Homo sapiens
ctgcttgccccttaagtctctagccccaggtacaatgtgaccacaggttctgctcaacagacttcaggaatttgaagaacaggttctagaaccattagtgttatgtgtgtgctgacgtatatgcaggcag

SEQ ID NO: 6858926 - DNA, 62 bp, Homo sapiens
gatgcacagagggcctggaactaacattcattcacttgattgcattcaggtttctgttcatt

SEQ ID NO: 6858927 - DNA, 83 bp, Homo sapiens
gtgcccaaaggacaaagcagagctggatgcatctgtggctaggagacagggatttgttttgttttgttttgttttataagcac

SEQ ID NO: 6858928 - DNA, 59 bp, Homo sapiens
gcgagtagatgatgaaagtgagctttacattctgacttcaagttcaatggtctacttgc

SEQ ID NO: 6858929 - DNA, 70 bp, Homo sapiens
ctcttttatgtgacgtgtgtgacctggtatctagtcaccctggggttgcatactctcattctaaaaggag

SEQ ID NO: 6858930 - DNA, 66 bp, Homo sapiens
agggtagcaggcagagaggggtttccagaaccatcatttgaaccctcactctgtgccggccaccct

SEQ ID NO: 6858931 - DNA, 66 bp, Homo sapiens
ctgctagatgatggggtggctgtccagtgtgacaagcagcaagggaggctcaagtatcacgggcag

SEQ ID NO: 6858932 - DNA, 78 bp, Homo sapiens
gtctgcttttgagtctctgccaaaacacaagtgacagtggctaacttccttgcgttggtaagctcagaataaatagac

SEQ ID NO: 6858933 - DNA, 72 bp, Homo sapiens
tgtggcctttcagcagttattcccctacagatgacaaactccaggtttgagggaacagattgcttggctacg

SEQ ID NO: 6858934 - DNA, 62 bp, Homo sapiens
gcccctggagatcctggcgcgcggggggcggcgactgctcctgccgtggtcgggactggggc

SEQ ID NO: 6858935 - DNA, 93 bp, Homo sapiens
gccatgcaggcaggggcagctagtttaagaaagaggatggctttcttccagttgtatttatcctttcaggcaagctccctgctagtatttggc

SEQ ID NO: 6858936 - DNA, 68 bp, Homo sapiens
cagaaatgtactgacatgcagttcacaaactggcactggtttaaaataagcactgttgtatgtttctg

SEQ ID NO: 6858937 - DNA, 95 bp, Homo sapiens
ggatgacagggaacagtggggactggagagcacatgttttgtccagtgagggcattcccagtgtctccagatgctccaatttttcctgggaagcc

SEQ ID NO: 6858938 - DNA, 55 bp, Homo sapiens
gaaagaccagcatgaggctttagcaggtgtgtaagctctcagaacactggtcttc

SEQ ID NO: 6858939 - DNA, 65 bp, Homo sapiens
acaggttggctgtgaggggttgcacaggcctcagttggccctgtggtaatgcgcacagtcactgt

SEQ ID NO: 6858940 - DNA, 64 bp, Homo sapiens
ttttagttaataggtcttcagcttaagcagaatggatgaataagttgaggtatattcattaaaa

SEQ ID NO: 6858941 - DNA, 73 bp, Homo sapiens
cttaatagctcatgtcagcagcaacacaaaaggtacagtgattttttaaatgcttggacaagactctattaag

SEQ ID NO: 6858942 - DNA, 63 bp, Homo sapiens
ggctgggacgatgaggattagtttaacgaggtttgtttgcacagagttccgttggccccagct

SEQ ID NO: 6858943 - DNA, 100 bp, Homo sapiens
gaatacaactggcctttggtgatagtgcagagaaatggggaaagggaggggtatttttgtgcagtgttatcaaaataagttacacagaataaaagtattt

SEQ ID NO: 6858944 - DNA, 61 bp, Homo sapiens
gtgtgtctgttatttgtcgctgcatccccaccacgcggcacagtacctgtcacagaggcac

SEQ ID NO: 6858945 - DNA, 78 bp, Homo sapiens
cattttcaagtgcatgatctcatttaatccgcatgacctccctgtgggttcattgttaacgtgtccacttgagagatg

SEQ ID NO: 6858946 - DNA, 59 bp, Homo sapiens
gaaactagagacttccctttccccgtatagttagtaatggtgaaagtgttgctggtttt

SEQ ID NO: 6858947 - DNA, 72 bp, Homo sapiens
tgttttctgtcacttttttggaatctgtggtttattattataataagattaacgaaaaagtgacacctaaca

SEQ ID NO: 6858948 - DNA, 55 bp, Homo sapiens
tggaggcatttctttttggtcgggacagaagactatcaatcagaaagtgcctgca

SEQ ID NO: 6858949 - DNA, 129 bp, Homo sapiens
gagggccagaccctggcaccttacagcatcctacatacttgggctttacctccagagagatgacgtgactggaaggtttgagtcgaggagtgaggtggcctgaccaaggtttgatgggactgccctgtc

SEQ ID NO: 6858950 - DNA, 129 bp, Homo sapiens
ctcattaccctgccctctcatggactgggctaactgaaggccaagctcccagagaagctggactcactgtgcgggattactgagggtgtggctgccaggctacagtcacaggaaggccagactgttgag

SEQ ID NO: 6858951 - DNA, 55 bp, Homo sapiens
atagagaatcgctcttgtcagttactacttttgtgactcttgagaaattctctgt

SEQ ID NO: 6858952 - DNA, 55 bp, Homo sapiens
tctctcaaggctgctggatggtgtcatctgcagcactgtcatttgcttagggagg

SEQ ID NO: 6858953 - DNA, 65 bp, Homo sapiens
tgggggatattttgctgtggtacattaggaggataataatccttctataagcaaaatgtttgcca

SEQ ID NO: 6858954 - DNA, 63 bp, Homo sapiens
gattctgtaaccttaatttcctcaggttttttcagcctgtgggtacaacagggtcacagaatc

SEQ ID NO: 6858955 - DNA, 64 bp, Homo sapiens
cccagccccagacacgctgtcctgcctcaggccgggcaggcacatgggcgggtctggtggcggg

SEQ ID NO: 6858956 - DNA, 87 bp, Homo sapiens
aggcagtaagtggtacagtgtttaagagatggcatttgcagttggaaagcctaggatgtaagtcccagctctgccacttactagctt

SEQ ID NO: 6858957 - DNA, 72 bp, Homo sapiens
gctagcaataatctagaacatatgagagcatggacatcctttctgcatgctcgaagttctggattaaatagt

SEQ ID NO: 6858958 - DNA, 129 bp, Homo sapiens
catcagagtcacctagaggacttgttaaaacatggactgctgggcctaacccacagcgtttccgattagatgggtctggggtgaggcccgggatttgcatttctaacaagctccctggtgacgcccatg

SEQ ID NO: 6858959 - DNA, 92 bp, Homo sapiens
ttgaagggaagggctctttgctagtatctccattatctagaacatggttttagatgataaccataggtctatatgagcactttacttttcag

SEQ ID NO: 6858960 - DNA, 129 bp, Homo sapiens
ccctgtgcattgttcagggcaagcctagaggtccttgagcctttgctctggcggccagcagatggaactgctggagctccgggctgtaggaggccaggtgctctgcgctctcacttgcagcgggctgag

SEQ ID NO: 6858961 - DNA, 64 bp, Homo sapiens
gtttatagtttgaaagtgatgtgaaggaaacagaatcaatcacagacacattaaacatgtgaac

SEQ ID NO: 6858962 - DNA, 59 bp, Homo sapiens
aggactcacctgaccttttgcagcttgaatttcctcacttgtaaaacaaggtgaatcct

SEQ ID NO: 6858963 - DNA, 63 bp, Homo sapiens
gtgggtgtcagtatctttaacggccttcattcttggttgtgagattttatttgatatgcccac

SEQ ID NO: 6858964 - DNA, 78 bp, Homo sapiens
gaaaggttgcctcagaaagtggcaggtagggatagatggaaacatgtaaggtttacctcactattctgtgtccctttc

SEQ ID NO: 6858965 - DNA, 85 bp, Homo sapiens
ttatagcaacttaggaaacaaatacacccagtcaatatctgttgaatgaacaaatggtgctgcttgtgttcctgatgagtcatgg

SEQ ID NO: 6858966 - DNA, 55 bp, Homo sapiens
atacaactgccttagaaggaaataatttatattacctgggcatggcaagttgtgt

SEQ ID NO: 6858967 - DNA, 88 bp, Homo sapiens
gtgtctggacaggggtacctgggttacctgtctgtcccagaagagagggctggggggagctacaggtcccttggagtcatcaggatac

SEQ ID NO: 6858968 - DNA, 74 bp, Homo sapiens
ctaccaaatcagtgatggtgaaacagtatattagtttgttagggctgccataactgataccatagactgggtgg

SEQ ID NO: 6858969 - DNA, 58 bp, Homo sapiens
acccaggctggagtgcagtggtgtgatctcagctcactgcaacctccaccacgtgggt

SEQ ID NO: 6858970 - DNA, 77 bp, Homo sapiens
cagtgggcaccaaagcagaggctaagatgagtgggtgttattgcatttaacactcgctaagagcctgctggcccctg

SEQ ID NO: 6858971 - DNA, 124 bp, Homo sapiens
ttaaccaagacaatgtctattccaagactgtgatgctgtaaaatgctaaacatgctactgcctttcgtcatgtttagcattttacagtatccacagtcttggaatagacatcgataaaggtaga

SEQ ID NO: 6858972 - DNA, 61 bp, Homo sapiens
gccacgtagtttgtagtattttgttacataagccctgacaaatacatacactgtacgtggc

SEQ ID NO: 6858973 - DNA, 55 bp, Homo sapiens
tggtactgagaatagcgtctacaattcagtaggtgctcaagtttacatgtgacca

SEQ ID NO: 6858974 - DNA, 81 bp, Homo sapiens
gagtggcattacagagctgggtggagagaggggctagccatcttttgtgtcgcccaccgggctcatgtgtcatcgcctctc

SEQ ID NO: 6858975 - DNA, 55 bp, Homo sapiens
agggtgtgatttcagactgtctggctgagagtctgtctctgctaatcactaccct

SEQ ID NO: 6858976 - DNA, 60 bp, Homo sapiens
agccagggctgcaggttccttggtgagctttgcaaatcgtccccgacctcagtgctggct

SEQ ID NO: 6858977 - DNA, 95 bp, Homo sapiens
gtttccctcacagtgccccttcttatagaagcaaccattgttccttatacaagcaaccgttgcttctgtaagtagccattgttcctcctggagac

SEQ ID NO: 6858978 - DNA, 117 bp, Homo sapiens
ccaggtagtgtgccttcctttcattgtgggagcctccacattagtggtgggtcctggagaaggcagaccatagactggaggatctcctgttttgggtgggggcagacactactctgg

SEQ ID NO: 6858979 - DNA, 79 bp, Homo sapiens
tacaacagctctgagagctaggtgttattttttcccttatttttcagaggaatgacttgtagctctgagaagtgaagta

SEQ ID NO: 6858980 - DNA, 110 bp, Homo sapiens
gagggtgagtgatatttattgagcacctactgtattccaggaactgtgtagacagtctcatgtgcaaatctggatgtgctgggtgtctgtacacattgtcattcatcttc

SEQ ID NO: 6858981 - DNA, 68 bp, Homo sapiens
gcactgaggaaggagggagtggttctatagttaactttgaccgtaatttttccttagagacctcatgc

SEQ ID NO: 6858982 - DNA, 73 bp, Homo sapiens
gtaggtcactctgggccctactgggcttggttccaggttgcagtttgggtccagatttgttctatgtgtctac

SEQ ID NO: 6858983 - DNA, 88 bp, Homo sapiens
ggctggtctggaactcctgacctcgtgatccacccacctcggcctcctgaagtgctgggattacaggcatgagccaccacacccagcc

SEQ ID NO: 6858984 - DNA, 75 bp, Homo sapiens
gcctggtgagtctgagcccccgggaagctgggctgagtgctccagagctccagggctacagaaggcacagaaggc

SEQ ID NO: 6858985 - DNA, 56 bp, Homo sapiens
caagggctatgcatttgtgcactttcagaaccagagtgctgcagacagggccattg

SEQ ID NO: 6858986 - DNA, 69 bp, Homo sapiens
ggggctggcttgccaagctcagggagtcgaggtctgagtgcttgagctctgggcgggcaggtcagcctc

SEQ ID NO: 6858987 - DNA, 100 bp, Homo sapiens
gtagctgattttttccctctgtcttaaagctcattaattagaagctaacttcccccagttgtagctttttaatgtgctgctttagaagagctttcactgc

SEQ ID NO: 6858988 - DNA, 73 bp, Homo sapiens
gaagctgcgtgtagccatacttatcctcacatcccattagtgagaatttagtcacatggccacacctagcttc

SEQ ID NO: 6858989 - DNA, 58 bp, Homo sapiens
cctgaagcagtatcccagaaggtccacccccgtaccttcttataagataggcctcagg

SEQ ID NO: 6858990 - DNA, 126 bp, Homo sapiens
gttcttgacagactgagaatgatactgagaatgttttctgattgatttggtgagctgtctgtttatagcatcattagagattattttccatggctaggaattattcttgacctcacagtaaaggac

SEQ ID NO: 6858991 - DNA, 60 bp, Homo sapiens
acccctgccattgcctgccccctagcagatatttgatggccagtgtgcagttgcaggggt

SEQ ID NO: 6858992 - DNA, 72 bp, Homo sapiens
gagcctggagtcagcaagatgaatcagcaggagcccgaaggccctgccatcagccttgctgcagccaagctc

SEQ ID NO: 6858993 - DNA, 65 bp, Homo sapiens
tcaagaatggttagatgtctggaaattaagctcataattatcagatataaaactgcaaatcttga

SEQ ID NO: 6858994 - DNA, 97 bp, Homo sapiens
gcccctgagaatatgggaaggaaaagtatccacagctcaggaggaagggatagcattggcctcatggagggagtgctcttcccatagagcaggaggc

SEQ ID NO: 6858995 - DNA, 63 bp, Homo sapiens
gagctcctagttggggagtgacttccttgacaccaacccagcacctccttagctatgaccatc

SEQ ID NO: 6858996 - DNA, 84 bp, Homo sapiens
gtagaaggcagagctgatagagagaaacagatttgcgataatagcatttctaccttgtcttttctactgtaagcatatttttac

SEQ ID NO: 6858997 - DNA, 56 bp, Homo sapiens
gacatgcaatgcagtggtaagttacaacagggattgtgaccaggtaagtgcatgtc

SEQ ID NO: 6858998 - DNA, 77 bp, Homo sapiens
gtcagtttaggagagacgcgttctttatctgagccacacaaccgggcagctggagcgaggtcttggtcctggagtgc

SEQ ID NO: 6858999 - DNA, 69 bp, Homo sapiens
ttagtatatcggtagttagctccaaacacatgtaactaacatttagttacagctaactgctgttattag

SEQ ID NO: 6859000 - DNA, 67 bp, Homo sapiens
tagcaaaggtagagttttgagaaatttaatgtgttcccatcacacacttataactcttcctttgttg

SEQ ID NO: 6859001 - DNA, 126 bp, Homo sapiens
ctctcctctatatactgttggtgtctcctacaggctgaactcaatgatgagtcagagaaccaagaagactggttgatgaggtcaggctccagggggcgctgaaacaggtgaagaatgggggagatg

SEQ ID NO: 6859002 - DNA, 76 bp, Homo sapiens
ctctgatttttgacatcaataccctagaataggcaataacatatgcaactattttagataatgataaaaagaagag

SEQ ID NO: 6859003 - DNA, 103 bp, Homo sapiens
ttgaggtagggttttgctctgttgcccaggctggagtacagtggtgtgatcacaactcactgcggcctcaacctcccaggctcaagcgatcctcccacctcag

SEQ ID NO: 6859004 - DNA, 73 bp, Homo sapiens
agagcgcattgtctatacatcaataatgatcaggctttactgagcatgtcatgatgtgcagatactgtgctct

SEQ ID NO: 6859005 - DNA, 81 bp, Homo sapiens
tgcattctcactgctgtatagtagtccattgtatgcatttaccacaatttatccattgtatagttggtggagattagggca

SEQ ID NO: 6859006 - DNA, 80 bp, Homo sapiens
cctttccctccagagagaaaggaggccgctcccaagtccgtccttgccccgtggccttcctgttcctttgaagggggggg

SEQ ID NO: 6859007 - DNA, 76 bp, Homo sapiens
gatgtgaactacagaagaaactatcactatgtttctcagacataggaatgggagtttctttgtgtttttttgcatt

SEQ ID NO: 6859008 - DNA, 60 bp, Homo sapiens
ggcccaggttggagtgcagtgacatcatctcagttcactgcagcctttgcctcctgggtt

SEQ ID NO: 6859009 - DNA, 77 bp, Homo sapiens
catcatacctcccaccccctccgggaagggaaattacatttccccattttagcaaggggtggcgagagggaagaatg

SEQ ID NO: 6859010 - DNA, 99 bp, Homo sapiens
ccattccacaaaaggggcagttttttcccattagaaagggttattgggacgttcttcccgttgctttttcaaatgaaagctggtctgtgctgcgggagg

SEQ ID NO: 6859011 - DNA, 64 bp, Homo sapiens
ttggtgattacacagcagtaatttcaggactgttttccttaggaatccggatggtaattactaa

SEQ ID NO: 6859012 - DNA, 65 bp, Homo sapiens
caccagcacattagtatctaagaacatgaaagttcagcatatgtcttttacctaatgagctggtg

SEQ ID NO: 6859013 - DNA, 64 bp, Homo sapiens
ctgagaccttggactccatccttctgccaaattgtggctgagggtggtggcttaaggtgctgag

SEQ ID NO: 6859014 - DNA, 102 bp, Homo sapiens
ctggagtttagcaatttgaactgggctcagctggatggttctactaatctgaggtaaccaaaatcagctgagcctgtcccagaccagagaataactctccag

SEQ ID NO: 6859015 - DNA, 74 bp, Homo sapiens
gctcatcatgtttggaatgttttaatataaattttgctactttgaaagaatttaagaacatttcaggactgggc

SEQ ID NO: 6859016 - DNA, 61 bp, Homo sapiens
ttaactggggaagcatttcatggttatgtagcctttggcttggaaagtctcacccagttga

SEQ ID NO: 6859017 - DNA, 70 bp, Homo sapiens
ccagttctttctgtgtgcaacacactcatttaactccaatgacaatctcatgtaatacagaaggaaatgg

SEQ ID NO: 6859018 - DNA, 91 bp, Homo sapiens
ggcgcaggccgcgaggcaggcccgggtgtgcagcaggacgggaagccaggccagcaggcacacctgccactggcgggcatccggctgcgcc

SEQ ID NO: 6859019 - DNA, 55 bp, Homo sapiens
ctgaggctcagaatgagtgagcaaccttcagtggttgcacagacaatgagcccag

SEQ ID NO: 6859020 - DNA, 77 bp, Homo sapiens
atcttgaggttttaagttgaagggggagaaaaagacatttccaaaggccctaataagcttgataaagcccacaaggt

SEQ ID NO: 6859021 - DNA, 80 bp, Homo sapiens
gtaataactatgtcatggtgctgttttgggacttcaatggtccaaggcaaataaagtacctggcatattacagatgttac

SEQ ID NO: 6859022 - DNA, 120 bp, Homo sapiens
gattgagacaggtgtatgtattcagtctgtatcatgtttatgtgtaggatatgtttgcttcaaaatatttccttgcaacttaggcatgtttattcattgtttattcttactgcatcaatc

SEQ ID NO: 6859023 - DNA, 83 bp, Homo sapiens
tgtccaaggccacacctgggttaagcagcagagttgggacttaattctaagtcaggcttctcccagagcccttggtcttgaca

SEQ ID NO: 6859024 - DNA, 57 bp, Homo sapiens
gcctgtcacccccccatctcacggattctccaaaggactttgggaggtgtgaggggc

SEQ ID NO: 6859025 - DNA, 81 bp, Homo sapiens
gggaggatcacttgagcccaggaggctgcagtgagctgtgattatgccactgcactccagctgggtgacagagatcctgtc

SEQ ID NO: 6859026 - DNA, 129 bp, Homo sapiens
atgtataaaatcaccggaaacgcttgttaaagatttttaggctctaccctcagagctttctcattctgcaggtcttggggtagacctgagaatttgcatcttaaacaggtagtgctgctgctaatgtat

SEQ ID NO: 6859027 - DNA, 73 bp, Homo sapiens
gaataaagactcatgtgctaaactcaacaaatctggtgtcctatctaggattttgagtctggcatgaatattc

SEQ ID NO: 6859028 - DNA, 130 bp, Homo sapiens
tatgccttttattttaaattctgaatttaaattttatattgggagtcgttttgattcttgaaaaatgcgttttgagctgattagagcttcccaattaaaacggtacaactgaatatattatatgggcatg

SEQ ID NO: 6859029 - DNA, 83 bp, Homo sapiens
ccattaccaccattggcttctggcagtctggacggaattaaacaactgtctacacaaatcaaagcttcacgtggtggtcatgg

SEQ ID NO: 6859030 - DNA, 83 bp, Homo sapiens
actatgaatgcaagtcacacatttcttccattgtagcttctcataaagagctagagactgtacgtggcaagtatctaagtagt

SEQ ID NO: 6859031 - DNA, 83 bp, Homo sapiens
tagagacatatagaacagttggttaacacaaatattctgcaatcacaatatatgtggtattgaccagcttttcaaagtttcta

SEQ ID NO: 6859032 - DNA, 76 bp, Homo sapiens
ttaggccatgcagcaaagaggctagttttccagaattggatccacttcttctaggcatccttgctgtaatgtttaa

SEQ ID NO: 6859033 - DNA, 58 bp, Homo sapiens
ggcagcccaggtctggcccagcctggccggaatgccctggggcaagatctgggtgacc

SEQ ID NO: 6859034 - DNA, 62 bp, Homo sapiens
gagacagggtttcaccatgttggccaccatgttggccaggctggtcttgaactcctgacctc

SEQ ID NO: 6859035 - DNA, 55 bp, Homo sapiens
gctatctgcaggaactgatatctattatatacagtaattgccctgcaatgatagt

SEQ ID NO: 6859036 - DNA, 57 bp, Homo sapiens
ctagaaatgtagattcttagtgtcctcctaccagacctacagaatcgagcattctgg

SEQ ID NO: 6859037 - DNA, 92 bp, Homo sapiens
acattgtacagtgataatcatggaatctgctatgttatttcccacttaggtagggggaaaaatgtaggcagatgattatctatttaaaatgt

SEQ ID NO: 6859038 - DNA, 102 bp, Homo sapiens
gaagcttttattgccctagaaagaggctgcccataaactttccacctgctttaaccgctggggaatgtgtgggtatccacgatttctggccaatgagaattt

SEQ ID NO: 6859039 - DNA, 59 bp, Homo sapiens
tcaatctgtgtatgctgggagtagtaaaatcacaatgcagctctaaagccacagattga

SEQ ID NO: 6859040 - DNA, 70 bp, Homo sapiens
tcacacttgattttgaacctttctactaaggtgctctggtttggtggaaagaacacaaaattaggaatga

SEQ ID NO: 6859041 - DNA, 129 bp, Homo sapiens
ttatctgcgtattagagcacctggagaaatttaaaggctatggctgcctgggtcctgcttccagatattctgagttaattgttccagggagtttttaacgtttctccagtgattctaaagtacagccaa

SEQ ID NO: 6859042 - DNA, 98 bp, Homo sapiens
gggcttgttagaacacaaattgctgggcaccacctccagagttcctgattcagtaggtctggagaggggcctagaatttgcatttctaacacattccc

SEQ ID NO: 6859043 - DNA, 68 bp, Homo sapiens
gcttaggggtatgtgggtagtgcatatgtgcatagattcctgtcagcactgccatgtgctctgcaggc

SEQ ID NO: 6859044 - DNA, 71 bp, Homo sapiens
accaatactcccttttattgccttataactctctcaagctatgaaatggtagtaggaagggctatcttggt

SEQ ID NO: 6859045 - DNA, 72 bp, Homo sapiens
cgttgtcttcttagccagctaacttaagcaccttccaggggctctgagctctgactagtattgaggcaaacg

SEQ ID NO: 6859046 - DNA, 69 bp, Homo sapiens
gctcttcagtgtccttagttagctttggggaaaattaatctgcggggtggtgctcgacacgcaggatgc

SEQ ID NO: 6859047 - DNA, 62 bp, Homo sapiens
gagtgggcccgagccagtggtctgtgtttgccattcagaccccaccaggcatgggccccctc

SEQ ID NO: 6859048 - DNA, 87 bp, Homo sapiens
ggtctccattcctgctcctcaggagctgctggtctcacggaagctcctgatacatgcaggaataatttcaaatggagcataaaagcc

SEQ ID NO: 6859049 - DNA, 78 bp, Homo sapiens
gatgatgtgggtcttatcacacggtagacattgtgaccttcagaagtttacataagtgatgatgatacctctaacatt

SEQ ID NO: 6859050 - DNA, 90 bp, Homo sapiens
ttccctgattaattatgatcagcaaagtgcttcagtgggagcttagcaggagctgacataagcactttctaaccatagatttcagtggaa

SEQ ID NO: 6859051 - DNA, 70 bp, Homo sapiens
gtggataagaggcccctgtagatgatacagcgggacagagcacagtccagctcagatgcagggatcacac

SEQ ID NO: 6859052 - DNA, 73 bp, Homo sapiens
gggtgtgttagagggagggggcagaaccccgggtgcacttgcttgtggggaacccctgtcccactgtcacccc

SEQ ID NO: 6859053 - DNA, 83 bp, Homo sapiens
tgagccctaagaactagtaggattgagaggattagggtaaagagggtaaacctactccatggtttcagtctggctggagctca

SEQ ID NO: 6859054 - DNA, 81 bp, Homo sapiens
tttagaaaatttaagtcatatgagtaatagtctaacctttttattgtgactaatgcttaatgtaggctggaagcttctaaa

SEQ ID NO: 6859055 - DNA, 100 bp, Homo sapiens
ccatttcctccagggcctctttcctggcttttgggctaattcagtattcagtgagaagggggtatagatcaggggttgggagaatggcagctggacatgg

SEQ ID NO: 6859056 - DNA, 62 bp, Homo sapiens
tagtccccaggctctgacatagatgggagcacagagttgcttgtgtgagggcctgggagctg

SEQ ID NO: 6859057 - DNA, 83 bp, Homo sapiens
agttctggatgctgctgtgcgtgctcccttgggaattcttttgcactttccaagagcaccgcagcagcccaacacccagcact

SEQ ID NO: 6859058 - DNA, 79 bp, Homo sapiens
aattgatactagagaacaaatgcattctgttttcactaggaccagtggctttatctagcagaagcattctgtatcaatt

SEQ ID NO: 6859059 - DNA, 67 bp, Homo sapiens
ttaggactagagctatgaagccagaatgtggtaagagccaggatttggccatggcttcgggaactga

SEQ ID NO: 6859060 - DNA, 120 bp, Homo sapiens
tgctgatcctgacttaagtacaacacttacgagactaaatctgatttcccaggttgcatcctctccagctttagaatttcatgtttggtctttgtaggagttgaactttgggaaggggca

SEQ ID NO: 6859061 - DNA, 73 bp, Homo sapiens
ggcctcagcattctgtggtcttctatggagaaaggctaattttctgaaggctttgaatggaatgaaaactgcc

SEQ ID NO: 6859062 - DNA, 89 bp, Homo sapiens
gctgtagtttaaacagcataaggaggtcatggaggcacaactatattctcaggtctacatgcacactgaatgcttactttgagctaggc

SEQ ID NO: 6859063 - DNA, 61 bp, Homo sapiens
tttgctaggagctcatctgagggaagagacacagaccttccctggagctagtctgagcaga

SEQ ID NO: 6859064 - DNA, 63 bp, Homo sapiens
ttcaaacattttctacttccaggactcatctccatgctgtgtccagtagagactatgcttgaa

SEQ ID NO: 6859065 - DNA, 129 bp, Homo sapiens
aaaaaacccgctacgtatacatatctcaagagagaaatacatttgttttaccctagtagatggtccatttgcaggaaaaataaatagtgtttttgcaactaaggggtgggtgaagaattcaggtttttt

SEQ ID NO: 6859066 - DNA, 97 bp, Homo sapiens
gtgtcgggtggtgggcagtgggtagtgggtggagggtttggtgtttagtgtcttcttttctgtcagtgcccaaattcctgcccaattacttagacac

SEQ ID NO: 6859067 - DNA, 82 bp, Homo sapiens
ttttcagtaggcttggcatgacagtacatcctcataatgagtttgctgcagctttgtcacatgcacaggcattcatagaaag

SEQ ID NO: 6859068 - DNA, 79 bp, Homo sapiens
attcaacactgtgagttccaaatggtccttgaagatccacatttccaaggaacatatttggaaagccacagcagtgaat

SEQ ID NO: 6859069 - DNA, 73 bp, Homo sapiens
tattttacagactactttagatgctagtaattttcctgctggtgcataaatatttggagtggtttgtattatg

SEQ ID NO: 6859070 - DNA, 76 bp, Homo sapiens
aatgtaatataactgccagttaaggtagacagtagttgtggtcttagttacatttgatatggagttgtgtaatatt

SEQ ID NO: 6859071 - DNA, 82 bp, Homo sapiens
tggtcagaacacgttggagttgtggattaggtcaaagctaaaatgaaatgtctaattccacctttttccaactttcaatcca

SEQ ID NO: 6859072 - DNA, 57 bp, Homo sapiens
gcccaaactttctctgttttgtctcagcccaaaggtgagttggtaggaagtttgagc

SEQ ID NO: 6859073 - DNA, 73 bp, Homo sapiens
gaggctaaaacatttaatggtaactgaaatagcacaagaagttaataacagttgaaattagagtcctggcttc

SEQ ID NO: 6859074 - DNA, 96 bp, Homo sapiens
aatagacccatttgtccagcaaagatattgagcactcactcctattcatatttgttgagcactcactcctgtttgtctgctggacaaatagctgtt

SEQ ID NO: 6859075 - DNA, 59 bp, Homo sapiens
taggcaaggcatttggctcttggtggttacattaagtcagctttacctgtcatgacctg

SEQ ID NO: 6859076 - DNA, 55 bp, Homo sapiens
ctggggcctctgagcagctttccaggctcaagagaatggaaggagtggaccccag

SEQ ID NO: 6859077 - DNA, 78 bp, Homo sapiens
gagggccaggtatagtttgatcttcagtttcctctctggatttgtgtgactttggaataagctatataacttaccttc

SEQ ID NO: 6859078 - DNA, 65 bp, Homo sapiens
aaaacaaatgagtttcttaatagctgccccacttagtctgagtgtcttaggaagcttaatgtttt

SEQ ID NO: 6859079 - DNA, 67 bp, Homo sapiens
gtctcattggttctgccagagtcaggagtcagtcctgcactgaacactgtggccggaacagtgggac

SEQ ID NO: 6859080 - DNA, 100 bp, Homo sapiens
aaatgtctctcccagactatctttgcagactagcttacatcatataaaaatattctcagtcctataagatgtatcagttaagtcttcatggcagacattt

SEQ ID NO: 6859081 - DNA, 77 bp, Homo sapiens
agcctgccaattgtgtcattatatttttccgtaagtaattcaagtttgtggaagaaacaagacacttttggtatgtt

SEQ ID NO: 6859082 - DNA, 75 bp, Homo sapiens
atagcatcacctggcagatgggaccaagactgcattcttggtgcattactcaatctgtggtacaaggtctgctat

SEQ ID NO: 6859083 - DNA, 102 bp, Homo sapiens
ggcgtggtggtgcatgcctgtaatccccgctactcgggaggctgaggaaggagaatcacttgaaccgggaaggtggaggttgcagtgtgccaagatcgcgcc

SEQ ID NO: 6859084 - DNA, 92 bp, Homo sapiens
caacttgatttttactcacatttcccactcctacatccttatctcggaccccttgggatatagagaaggactggctgggctggagtcagttg

SEQ ID NO: 6859085 - DNA, 80 bp, Homo sapiens
aggtaaaatagcaaaaatgacaaaagaagacatgaggtgtttaatcaccctctttttcttaggtcagggctatgctgcct

SEQ ID NO: 6859086 - DNA, 71 bp, Homo sapiens
tattgtaaaacttttttccattcactgtcatgttatattatttttaatatttgccagtgtgtggtacagtg

SEQ ID NO: 6859087 - DNA, 63 bp, Homo sapiens
gtcctgggctttgagggcaggatggatgagaatgcaccaccatgcagaaggatccccataggc

SEQ ID NO: 6859088 - DNA, 58 bp, Homo sapiens
cccttatggatcctcttctcttctctggatgtgaagggaaaggatatgatcctagggg

SEQ ID NO: 6859089 - DNA, 91 bp, Homo sapiens
atttatttaactgttgagcaatgttttgttgaatgaatagaccacagtttattcattcccatagcatactgggttatagttttttttaaat

SEQ ID NO: 6859090 - DNA, 80 bp, Homo sapiens
gggtgatggaagagcggcgaccgcgcgctttcctcgtggcgccgccagggcctggcgcgtggccgccgctcctcttcccc

SEQ ID NO: 6859091 - DNA, 83 bp, Homo sapiens
gtgccagcaagggccaacaactgtgcaaaggccttatgtttttgaggaagacagaggctagtgtcactggcccagggtagcat

SEQ ID NO: 6859092 - DNA, 75 bp, Homo sapiens
gagatcttcaaggttttagataactaaaccttatactcagaggtgtgatgttatctaaaatggtttgatgatctt

SEQ ID NO: 6859093 - DNA, 56 bp, Homo sapiens
gcagggtgcttagaaatggacctgcctagagggaggtctggacccttggcccctgc

SEQ ID NO: 6859094 - DNA, 57 bp, Homo sapiens
ggcgccctgggactccgcccgagctcggccgctcggctgtgtgggtcccgggcagcc

SEQ ID NO: 6859095 - DNA, 60 bp, Homo sapiens
gtgggagtggggcatgtgaacctggatgtgcgccacagccagggagcgggtctcagccac

SEQ ID NO: 6859096 - DNA, 59 bp, Homo sapiens
gtgtgcagggggccagcgcagccactgggcatctggggcagcgctggtcgcctggccac

SEQ ID NO: 6859097 - DNA, 103 bp, Homo sapiens
gggagtcgacaagagaggtgcaggaggcggctccggggctgtatccagagcaggaagctggtgcagttcccagggccggggtctgtcctcataggaggctctc

SEQ ID NO: 6859098 - DNA, 59 bp, Homo sapiens
gagcctgggcctgcactaggcacagagtacagcccttgtccttgggcagtgcccagctt

SEQ ID NO: 6859099 - DNA, 78 bp, Homo sapiens
ggttagtttaatttttcagctgtgaattgagaacaaactatcctaatacatagtgttttgaagaattaaacatggact

SEQ ID NO: 6859100 - DNA, 90 bp, Homo sapiens
aaatgagaatgtcttccatttggcacttcactgaggcatcccaaggtaccttagggcacttccagtggagtaaatggacaattagtattt

SEQ ID NO: 6859101 - DNA, 73 bp, Homo sapiens
gcagggggtatttcagtattatacaactgctgtgaccagacttgtatactggctgaatatcagtgctgtttgt

SEQ ID NO: 6859102 - DNA, 80 bp, Homo sapiens
ggctctctgatgttcttcgatgatctgtttaccttattttaataagaaaaacaacacacgaatgaggcatgggaaaggcc

SEQ ID NO: 6859103 - DNA, 102 bp, Homo sapiens
ttttgatggcctctccaatatctagaactccagaatgtaggcactggataaactgtggctcatgaaatgaaagagttctaacattgaagagagtaatcgaag

SEQ ID NO: 6859104 - DNA, 56 bp, Homo sapiens
ggaggccaggaagagccgcccttcctcctagcaggcgcgggcctccctggcacttt

SEQ ID NO: 6859105 - DNA, 72 bp, Homo sapiens
cttaggagtatggctcaattctttccctgaaattcttatttgatttagcaagattgagccgtcttccatgag

SEQ ID NO: 6859106 - DNA, 60 bp, Homo sapiens
gccctgctcacctgcctcttctccttcctgtctgggagggggctccttggtgtgcagagc

SEQ ID NO: 6859107 - DNA, 59 bp, Homo sapiens
ggcccctgagcaaaggaaggatgactgtgaccccaaagatatccatctgctcagtgtcc

SEQ ID NO: 6859108 - DNA, 61 bp, Homo sapiens
gaccggcccagagcaggcttcatgccagcactgcagccctgcctgctgcctgtggccggtc

SEQ ID NO: 6859109 - DNA, 66 bp, Homo sapiens
tgttggcaatatattctgaattcagtttatcattggaattgggatctcagatatattatgttaaca

SEQ ID NO: 6859110 - DNA, 65 bp, Homo sapiens
attaggcaaggactggcattatcttatgtttcttggaatttccttggaacaatgcagtctctagt

SEQ ID NO: 6859111 - DNA, 63 bp, Homo sapiens
cctggcgcagtggctctgctccacactcctcctcttcaccctggggccagccacctcgcctgg

SEQ ID NO: 6859112 - DNA, 55 bp, Homo sapiens
tttaggcagaagccctgctgatgggagagggctaggagggagggccgggcctgag

SEQ ID NO: 6859113 - DNA, 84 bp, Homo sapiens
ggagctgcagatgttcatccattttcctttccttctgaagttccttctgccatggaaagagaagttgggaggaatttcagcacc

SEQ ID NO: 6859114 - DNA, 60 bp, Homo sapiens
ccacttggtgaggaactgaagcccctgccgacagcaagcacagactccccgccatagtgg

SEQ ID NO: 6859115 - DNA, 118 bp, Homo sapiens
ggaagtgctcagcaaatatgtctagggtgtcaggaggtagaagcctttcttggctgtaagaagatggccaggagggtggttactcaatctctgttagccatggtgcactcagcagtcc

SEQ ID NO: 6859116 - DNA, 74 bp, Homo sapiens
agaaagggtcaggtaaacacagggggatagggtaggccgattctaagcatctcattcttgcctgtccattttct

SEQ ID NO: 6859117 - DNA, 70 bp, Homo sapiens
caggcctgtcctgggtccccgcaggtcagtgtgaaggcgtgcgctgccggcggaccctgggacaggggtg

SEQ ID NO: 6859118 - DNA, 118 bp, Homo sapiens
ggggagatgtctttgtaccagtccatgatgcccagagaatctttcagaaaggaatgagtccattctcccttttctatcccgttgcttagggcaggtagacggtgcagggtggctccct

SEQ ID NO: 6859119 - DNA, 76 bp, Homo sapiens
cggatctcttagatcctgccctaagatgttatatttagatctgtgaaaatattttagggccaggagataagatctg

SEQ ID NO: 6859120 - DNA, 69 bp, Homo sapiens
ccaggttcttatgttttgtcagtggagaagggtttgagtctagccagactggcaatagcaaatgcttgg

SEQ ID NO: 6859121 - DNA, 129 bp, Homo sapiens
gaagcacctctggagtgcaggtcctcagctactgagcacagtgcaaaccctcgggaaagtacacgtcttgtacatttctcacctgcacctgcgacggtggtggagtttgcctgacagcagaggtgagac

SEQ ID NO: 6859122 - DNA, 76 bp, Homo sapiens
ggaggggagcctgcatttcttcatgcctctacccatcctgaagaaggtagaaaggaacaggtcagcgttctcttcc

SEQ ID NO: 6859123 - DNA, 67 bp, Homo sapiens
agggaataaatgggggaatcctgttttggtatttggctaggccagagagacctcatgaaatttccct

SEQ ID NO: 6859124 - DNA, 85 bp, Homo sapiens
ctttatgttctgagcactgaactttaatcatttctgaaggtggacagagtctaagaggtctttaaatcagtcctcaaatataagg

SEQ ID NO: 6859125 - DNA, 112 bp, Homo sapiens
aacctattgaatcaggacaaggtgatggttctgctcctgtggcaatctaggtctcagaatctggtatgcaggcagggtgtaaagagcagattgcattttcaagagaaaggtt

SEQ ID NO: 6859126 - DNA, 130 bp, Homo sapiens
aacaccccatgaattatgaagttttccagtctggctggtaggaataggcacaattcccagacttgtgtgagtgctgggtactgttcccattaacactttcaggtggttcttttcctaactttgggttgtt

SEQ ID NO: 6859127 - DNA, 78 bp, Homo sapiens
agatggtgctgactgaggatggcttggcagggttactccctgggctttacctggtccctgagtagttatgcagcatct

SEQ ID NO: 6859128 - DNA, 59 bp, Homo sapiens
aattgagcatcatgtttgaatgagcctacaatgttctgctttgcatacagatgccaatt

SEQ ID NO: 6859129 - DNA, 118 bp, Homo sapiens
tcaggaagctcatttcggtcatgttgcggtgctttgctggaatcgaggaatgtgcttaattcgaaggtgtctttgtcggttacagcaacgctgctgctgaatgccgtgagaagcctga

SEQ ID NO: 6859130 - DNA, 58 bp, Homo sapiens
cccttagataatttccttttctctatggtaaagaagacaaggaggatatgtttaaggg

SEQ ID NO: 6859131 - DNA, 66 bp, Homo sapiens
ctggaggggaccttgggacaagggcttctttggtagccctggccaggttcacaggcttcctttcag

SEQ ID NO: 6859132 - DNA, 62 bp, Homo sapiens
ccacactgtctccatagagtagcttgatggctctgaccagtcgggcacaggagcggctgtgg

SEQ ID NO: 6859133 - DNA, 91 bp, Homo sapiens
cttatggcaatttgcagtttgtcttataagcaaagatgttggtgtaggatacatctatgggaaaaatgagagaagtggaatttgccatgag

SEQ ID NO: 6859134 - DNA, 70 bp, Homo sapiens
ttaggttgaactatatgaaattgccaaaggtaaaattaagttgtcagcaatttcatatgattctacctaa

SEQ ID NO: 6859135 - DNA, 58 bp, Homo sapiens
ggctctagagccagagagcacttgaaactcatttcagctgctgactagttgtatggcc

SEQ ID NO: 6859136 - DNA, 87 bp, Homo sapiens
gggggaatgaagataatgtgtctgtctttgccagttcagtgtgtacacttaagaggtatgggatgtggtgcattatcagattccgcc

SEQ ID NO: 6859137 - DNA, 55 bp, Homo sapiens
agcatggcatggggtctgtggatgcatacggtgcagtagactctaatgttaagct

SEQ ID NO: 6859138 - DNA, 61 bp, Homo sapiens
ggtgtccttatgcataccagagtgtaagtcttcatacattctgatgccataatgaggactc

SEQ ID NO: 6859139 - DNA, 59 bp, Homo sapiens
gataatatgcactttttgttgaaaattctctatgacaattttggcaaggtgcatgtttc

SEQ ID NO: 6859140 - DNA, 61 bp, Homo sapiens
catgtgtacacagatagtaatggcaatgtaatagtagccattattcactgagtacttaatg

SEQ ID NO: 6859141 - DNA, 90 bp, Homo sapiens
gaggcaaattatatgaaagtttgaatgagatttaagactgtcaaaactattctttaggattaagacattcagatatttctaatgttcctc

SEQ ID NO: 6859142 - DNA, 75 bp, Homo sapiens
gggacaggagccgagggccgcgtgcaccccttgggcccttggaggggccggcatgtgcctctctgtccctgtgcc

SEQ ID NO: 6859143 - DNA, 57 bp, Homo sapiens
acagagtcataagcggagctcgccattgcctaggggagcagagtgctttgactttgt

SEQ ID NO: 6859144 - DNA, 67 bp, Homo sapiens
cctgcacctctgtgcttggaactgaatgtgccctcaggaagcaactgtctaaggtggagaggtgggg

SEQ ID NO: 6859145 - DNA, 58 bp, Homo sapiens
cttttggaagggtttcagttagtctttgtagaggtaactggagctacttcccaggaag

SEQ ID NO: 6859146 - DNA, 66 bp, Homo sapiens
ttttacaagctgagtcgttaaaacaaatggttaaattcatctggactagctccttcagctgtaaaa

SEQ ID NO: 6859147 - DNA, 55 bp, Homo sapiens
attctgttccctccttccctccttctatatttacagaagaaggagggaagagaat

SEQ ID NO: 6859148 - DNA, 68 bp, Homo sapiens
tgagatacacagaggtaaagatgagggcaagtttgtgggctctggtctctggttccttttgtattcca

SEQ ID NO: 6859149 - DNA, 55 bp, Homo sapiens
tggggtcctgagctagaaaattgaactcctagtccagttttcagcagaacaccca

SEQ ID NO: 6859150 - DNA, 70 bp, Homo sapiens
ggggtgagtgtaccatcttctctctgggtcagctacaaagacccagagagcatttggacaaaggtagcct

SEQ ID NO: 6859151 - DNA, 60 bp, Homo sapiens
ttatccagacatcttgcacacatatactgctggttgacaagtaggcaagagtttgggtag

SEQ ID NO: 6859152 - DNA, 66 bp, Homo sapiens
tacagtgaccctatttccaaatataagattacattctgaggtactgaggtttagggcttcattgta

SEQ ID NO: 6859153 - DNA, 61 bp, Homo sapiens
cagttggaggaatgaggctgtaacaaaggaaaaatatatttctccctcttcctctcagctg

SEQ ID NO: 6859154 - DNA, 67 bp, Homo sapiens
agtgttctgggtgtcagcgtgtcccaggggatcctaaggtcctgggctgttgcatcatccttaaact

SEQ ID NO: 6859155 - DNA, 73 bp, Homo sapiens
gatgtctgaaagtagggctgatctagagaaattggaaacattagagcaggtttcaactttttcatgagatatt

SEQ ID NO: 6859156 - DNA, 75 bp, Homo sapiens
tgcctggagtgcctgtgccctggccaggcctctctttggtcagggaagagccccagggacagcctcgctccagca

SEQ ID NO: 6859157 - DNA, 70 bp, Homo sapiens
accctgccctctccagctcaggttccaggataagttctggggtccattagtgggttggaggggtaaaggt

SEQ ID NO: 6859158 - DNA, 109 bp, Homo sapiens
gacggaagtgccaggaaagtgttaatgcttcaatttccttgattcttgtcccttaatttttaggggtcattgaaatcagaagggttagactctctagaggctgttggtc

SEQ ID NO: 6859159 - DNA, 55 bp, Homo sapiens
aggcacttgtaattgcagtcatacagatatttgtatgattatcaacttaatgcct

SEQ ID NO: 6859160 - DNA, 115 bp, Homo sapiens
cctgtgacttaagttttatatgcttcatttcagcctggttgatatttacaagtatacctcataatacagaagcatgccaggcagatatgtgagcttacagaatttgtaatcgagg

SEQ ID NO: 6859161 - DNA, 69 bp, Homo sapiens
cagaggttgagctgacaccacatggtccgtggcctcccaccataaatcacattgttagcatagactgtg

SEQ ID NO: 6859162 - DNA, 56 bp, Homo sapiens
aaattgtgctttgactcctgcctgtttaggtccctggaaaattcagagtgcaattt

SEQ ID NO: 6859163 - DNA, 70 bp, Homo sapiens
gcacagttctctcagtctccagaggtccagcaggcctgggaggagggaggcgagaagaagctgctaatgc

SEQ ID NO: 6859164 - DNA, 109 bp, Homo sapiens
cattgcactccattgagaaaatttagaagttgatgtggttctctctgtcacgagcctgcatggcaaagattaccacatctacagaatatttctcctttggaacacaatg

SEQ ID NO: 6859165 - DNA, 70 bp, Homo sapiens
gctgatttaatggttcattaatttctctgctatcattgatggaggttttaggctgccattatttatcagt

SEQ ID NO: 6859166 - DNA, 55 bp, Homo sapiens
tgaggatgtgattatgcacattgatcagtaagtggtcaatgtaatcatatcatca

SEQ ID NO: 6859167 - DNA, 60 bp, Homo sapiens
ctggtccagttgtctcctaagcctgtacaatgctaggatttgagataaaatctggacggg

SEQ ID NO: 6859168 - DNA, 117 bp, Homo sapiens
gaatgatctcatcaagaaatgtgttatcacttcaaattttcagaagaaatggaagcaaatcatgatcacttgaaaatttgggagaaactgataaagcaagtttgaaagagtccgttc

SEQ ID NO: 6859169 - DNA, 124 bp, Homo sapiens
tttctgtgcccactaatcaacttctgttcatccccaaccccaggcctgcgcatttctgactgtgcttgttagaaaagccccagctggagggggtgagcagtccctgttgctgtgaccacggaag

SEQ ID NO: 6859170 - DNA, 126 bp, Homo sapiens
caaagtgagaaagtgttctttgatttgacaatgtgtttatgtgtgggccttactatagcttctttgtgaatgtttgtgcataaatatgttttgaatatactgtttaaatatttccttaattctttg

SEQ ID NO: 6859171 - DNA, 76 bp, Homo sapiens
cacttggtttgggagtacataacattttttaattaaatttgtgttattattgtacttacactcaaagggccaggtg

SEQ ID NO: 6859172 - DNA, 71 bp, Homo sapiens
catgaaggcagtggctggaaaacctgctccatttttccctgacttagagagcaggtattacttcctttatg

SEQ ID NO: 6859173 - DNA, 81 bp, Homo sapiens
catctggactgccttcctcgtaggcactgagggcccggaacaagacattttctcagtgctgtgctggaagctgttcaaatg

SEQ ID NO: 6859174 - DNA, 67 bp, Homo sapiens
ggttgcccagtttgctgctcccacccttgccgagcaggggcaccagctccagctgacgtgggcagcc

SEQ ID NO: 6859175 - DNA, 99 bp, Homo sapiens
ggattatatctttctaatgtggcatgtgaaatattaagccgaggaagtatcaactgaaatatttactttattttataggtcattaaagaaaaagaatcc

SEQ ID NO: 6859176 - DNA, 67 bp, Homo sapiens
ccaagaggaccttgccagggcagtgctaggcagagtctctctgcctgcctaggtctggcctccttgg

SEQ ID NO: 6859177 - DNA, 62 bp, Homo sapiens
gaggactggtggctgattaatgttcaatgacccacggggacagcccaggccgacagttcctc

SEQ ID NO: 6859178 - DNA, 61 bp, Homo sapiens
gctggagggaagggaggaggaaaagcctcagtaagaggactccaccctctctgctcccagt

SEQ ID NO: 6859179 - DNA, 128 bp, Homo sapiens
tgggaaaatgaatttaaaatgaagtcaggggaagcatcagatgtgactgaaggcaggaagagtttgccttggcatgtggcatgtggctgaatctgtctgggcttctatatctgttcagcaggttccca

SEQ ID NO: 6859180 - DNA, 61 bp, Homo sapiens
ggctgagagtttcctctggggcacactggaaaagcatgttgtccagggcaaactcatcacc

SEQ ID NO: 6859181 - DNA, 100 bp, Homo sapiens
agaaaatggtaaagtgttctgagcctttctaagaaacattgctcacatatgcaggttgttgcatcttgatagtgtctgagtaaaattacaaccattttct

SEQ ID NO: 6859182 - DNA, 71 bp, Homo sapiens
catctcactttcaattgcaatattccagcagctcaatggccacatagggcttctggctactgtatgagatg

SEQ ID NO: 6859183 - DNA, 62 bp, Homo sapiens
tggttcacaggtcctgggagcaggtgggcagccaagccttttgccccaggcccctggagtta

SEQ ID NO: 6859184 - DNA, 123 bp, Homo sapiens
aactctattaatctaaacaaggaatcctattttctttgtgtgaagaaaaaaccagcagataaatttctaagtgtcacaaagagaattgtgggtgtaaagttgttgttattattaatatgagtt

SEQ ID NO: 6859185 - DNA, 79 bp, Homo sapiens
cagcactggggtcaccaggattgggctgtaggcctgcatggacgatgcgccgcgtggcagtcttggtgactgggtgctg

SEQ ID NO: 6859186 - DNA, 59 bp, Homo sapiens
ctgaagatgtctgagatgctcatagggcagtagccagctggttcttagtgcattttggg

SEQ ID NO: 6859187 - DNA, 120 bp, Homo sapiens
gcggccctgaaggcagggcgcagctggtggctgggccttccgattctcaaggctctgactccatttagggccttgggagtcggaaggcccatcagcctgctgagttctgcctccacccgc

SEQ ID NO: 6859188 - DNA, 76 bp, Homo sapiens
gcctagtgatgcactcttgagttagcaagtggggtgacaccactctgaaagcaaaactagagaaagcagcatgggc

SEQ ID NO: 6859189 - DNA, 66 bp, Homo sapiens
aggtcatgccaggcaggggacatagattaagtcagggttgggagtgtgaacctgcatggcgtgctt

SEQ ID NO: 6859190 - DNA, 65 bp, Homo sapiens
aagagcctggggattggcaagggaaggggcctggccaacacccttcatcacttccagaggttctt

SEQ ID NO: 6859191 - DNA, 60 bp, Homo sapiens
aggacacctatcccatgaagcccgtattttctatcagtggcttcttggagatggtgtttt

SEQ ID NO: 6859192 - DNA, 70 bp, Homo sapiens
cactttgggaggccacggcgggtggattacttgaggtcaagagtttgagaccagcctggccaacatggtg

SEQ ID NO: 6859193 - DNA, 76 bp, Homo sapiens
acaagtgagggatctttgggatttcactgggcctcaacttatcactcagtgacagtttcaggcatttttcaaaagt

SEQ ID NO: 6859194 - DNA, 57 bp, Homo sapiens
tgcaccaagtctggcactgaatggctattttcccagcctcatgccaggccttgggta

SEQ ID NO: 6859195 - DNA, 59 bp, Homo sapiens
aggctcagttcacgtcaactttcttgttaggaaaagcacactgttgactaattgagctt

SEQ ID NO: 6859196 - DNA, 64 bp, Homo sapiens
atgagagtgatagagcaggccctgtcacaaacagttttcaaggctctgcttctatcacatccgt

SEQ ID NO: 6859197 - DNA, 74 bp, Homo sapiens
ctggcagctctgtggtggggcagagtttgcaggaagcttgttcctgaaactggctcagctaacacgagggccag

SEQ ID NO: 6859198 - DNA, 59 bp, Homo sapiens
ggagggcaggagcagggaagcagatgggacagtcggctgtggccctgcttcatgcagcc

SEQ ID NO: 6859199 - DNA, 68 bp, Homo sapiens
caaaatgaagctgaagaaacaggctgtgatcagattatgacaggccttgagttttgggctttattttg

SEQ ID NO: 6859200 - DNA, 119 bp, Homo sapiens
ggacattcccagtaagtaatcccggggaagtattatagcatattagcccctccacagagatgggctggcattgctctattgcctcctccggggcagagtcccttctggcatatgtgtcc

SEQ ID NO: 6859201 - DNA, 71 bp, Homo sapiens
tgcatctgcaaatccctactgggcacaaatgcaaaacagttgccaatgtcctttttgggatttgtagggca

SEQ ID NO: 6859202 - DNA, 85 bp, Homo sapiens
ccaggaggtcacgggatgggtgtggctggggatctgatgctcacagagcctcctcttctgcctatatctgcctgtcttcagctgg

SEQ ID NO: 6859203 - DNA, 60 bp, Homo sapiens
gcattaagaatcacacggctgtgtctccaatggctgaagcagccaagtgatttttgacgc

SEQ ID NO: 6859204 - DNA, 60 bp, Homo sapiens
aatgcttgaagtcagggcaatggaggtaaatacagtccatttgtgcttcttcaaagcatt

SEQ ID NO: 6859205 - DNA, 70 bp, Homo sapiens
gcattgtccctgtcatgcgggtgaagcccaccgaggtcgtcactctctaagcatgacagacagacagtgc

SEQ ID NO: 6859206 - DNA, 77 bp, Homo sapiens
agccaaaacacagagatgtaaagttaggcgattatgttaggttgtcctatgtgttatattagtatctgtatttgtct

SEQ ID NO: 6859207 - DNA, 79 bp, Homo sapiens
gatgtcagagcacccttgggtgccagccacaagtggccctccagcaggctgagcacccagggggaggctgccctgactc

SEQ ID NO: 6859208 - DNA, 57 bp, Homo sapiens
ttcctagtgtcttcagtggcctccaactcagggccaggtcacatgaagcctagagaa

SEQ ID NO: 6859209 - DNA, 74 bp, Homo sapiens
ggccagaggagaaggtggaaaccagaagagcactcactgctgctcagactctggccacttgcttcacactggcc

SEQ ID NO: 6859210 - DNA, 91 bp, Homo sapiens
ggtttcatgggtgtatacatacgtcaacacttgtcagattctacactttgaacacagtgtgatcgtatgtcaattacccctcagtgaagct

SEQ ID NO: 6859211 - DNA, 58 bp, Homo sapiens
actgcacacctccagggcactatttccacatgaatgttgtcccctagagttgtgcagt

SEQ ID NO: 6859212 - DNA, 89 bp, Homo sapiens
tacaaatatctgttccagtccctgctttcagttcttttgggtattcatccagaggagaattgcgggatcatatggtaattctattttta

SEQ ID NO: 6859213 - DNA, 107 bp, Homo sapiens
ggacagggaaagctccagggcttgccccctccttctgagcaccagcaagacaggtgaccaccagcaggcaggtgggccaagtccctgtctccatgttggccctggcc

SEQ ID NO: 6859214 - DNA, 58 bp, Homo sapiens
tatctgggaaaggagacctgaggtgagcgtggagtgatcacctttcctttctcagatg

SEQ ID NO: 6859215 - DNA, 119 bp, Homo sapiens
actttccatttgtattatgttggtcacttcaggactagttaccatatatcaaacatggaggacattacttcagtttttatagtaagtagctgagcccagacagaaaactagtgccaagt

SEQ ID NO: 6859216 - DNA, 61 bp, Homo sapiens
atgaggtctaaagtgcgagatgatatgcctctacagggcaccacttcctttaggaccttgt

SEQ ID NO: 6859217 - DNA, 77 bp, Homo sapiens
atctctagctagaatattgatctgaaatttgtttaatcagagggaatatatttacagaagcatgtaatagctaaggt

SEQ ID NO: 6859218 - DNA, 60 bp, Homo sapiens
tgtgtcactgttcctccagctacaggctgattgatgtactatggaaagacagtagacaca

SEQ ID NO: 6859219 - DNA, 72 bp, Homo sapiens
gtctgccaggcacgtgcagcatcaggaaactcataaaatcttttctggctgctttttaactgctggccaggc

SEQ ID NO: 6859220 - DNA, 80 bp, Homo sapiens
gaggcttcattacgttaaggttcagaaatcaataccccaaaatatggggctttgacatgctgaattaaagaagcagcctc

SEQ ID NO: 6859221 - DNA, 64 bp, Homo sapiens
gtgacacgcatgtacacacaactgaaacaaaggttttgtgcagcttctgtttattgtgtgccac

SEQ ID NO: 6859222 - DNA, 62 bp, Homo sapiens
gtattaggtggtggaattgtagatgaagttttctttcttcaaataatttcatttacttatgc

SEQ ID NO: 6859223 - DNA, 65 bp, Homo sapiens
tgggcctggagcagagactagggaaagcttccctttccttgattgcttgttttctctccagctca

SEQ ID NO: 6859224 - DNA, 59 bp, Homo sapiens
tggaatatgtggaagaacttggtgtcagtcaacttgcctcctggaagtcacatgtttca

SEQ ID NO: 6859225 - DNA, 61 bp, Homo sapiens
agctagtgtgtgatctaatatgaccccttctccttgaggtcatttacatgacagattggtt

SEQ ID NO: 6859226 - DNA, 62 bp, Homo sapiens
gccccctccctccctacgtgagctcaccctgcaagagggtggggtgagggggagaggggtgc

SEQ ID NO: 6859227 - DNA, 64 bp, Homo sapiens
catcagcctttctgtttcctaaggtcagctgtgtgacatctaaacctgggcacagagagagatg

SEQ ID NO: 6859228 - DNA, 130 bp, Homo sapiens
taatggaacttagaatgttagaatattgtaatattcgaagaatgttagaatattgtaatattcgaagaatgttagaatattgtaatattcgaagaatgttagaatattgtaatattggaagttccattta

SEQ ID NO: 6859229 - DNA, 60 bp, Homo sapiens
gacctcagtattgttcaggatgcagccaaaatccagctccatcatctcaaagctgaggtt

SEQ ID NO: 6859230 - DNA, 82 bp, Homo sapiens
gagctcattctgttaaatagactgcagtgcaccctgggaaatattggttctgtgcctgcagttctatttgttcaagtagctc

SEQ ID NO: 6859231 - DNA, 86 bp, Homo sapiens
tgagcaatgacaccaagaagttgacagccaggtgaatgttatacacaagctcatcggctgtcatcttcacgtgaccaacagctaca

SEQ ID NO: 6859232 - DNA, 61 bp, Homo sapiens
gaggcaggatcctggcctcatagagcccccaatctgaggggagaggcaggatcctggcctc

SEQ ID NO: 6859233 - DNA, 130 bp, Homo sapiens
gagaggaaatcagttatgggaatatgatgctgaggtatagtattttcttaatttacttattatttgatgcttaagctcagttatatatttcaacattcaacatttaaatcttaagctggtttttatctac

SEQ ID NO: 6859234 - DNA, 59 bp, Homo sapiens
caggtgctctgctgcaggtaagccagttgtcacatcctggctctccttggaggcatctg

SEQ ID NO: 6859235 - DNA, 63 bp, Homo sapiens
aggcccttgctatcatggagcttacattctagtggagaagccaggtgataagcaaataagcct

SEQ ID NO: 6859236 - DNA, 86 bp, Homo sapiens
ggcattagggctgcacagacttgctcatttatctattttaacagttaacaaagtattgtttgtgtatctctgaaattctaaatgcc

SEQ ID NO: 6859237 - DNA, 71 bp, Homo sapiens
gttcatcaagctggcatatgtagttcttaacaaacacattaaggaaacattcggaatgtcacttgcagagc

SEQ ID NO: 6859238 - DNA, 78 bp, Homo sapiens
gaagcgaccatgtgcacgtgtctcttagcgacaataaccttgctggtctgatgtggagacactgttttgtgtggcttt

SEQ ID NO: 6859239 - DNA, 58 bp, Homo sapiens
ctccagaggtccccgcggcactctcggccggcaacggctcccgcgcggggccttggag

SEQ ID NO: 6859240 - DNA, 62 bp, Homo sapiens
aactttggcaggtggtctatgtgataagtcaccttatcatttaacagaatcattgctaggtt

SEQ ID NO: 6859241 - DNA, 76 bp, Homo sapiens
ccaggaaaataccaagctttaacccagttggcagttccttgtggcatacatttggttagacttgggtttttcctgg

SEQ ID NO: 6859242 - DNA, 121 bp, Homo sapiens
cccattttgtatctgactctttctaatagtagggctggagcctgaggccagggacctccactctacccctcagggtctctcacagcacctggcatgagaaaggctcaggacagatatgcgg

SEQ ID NO: 6859243 - DNA, 83 bp, Homo sapiens
cagagccaccagatcactgcatgtatgaaagtaaatattgtgaattgtgctttcattgtgataggaagccatggaatgttctg

SEQ ID NO: 6859244 - DNA, 79 bp, Homo sapiens
aggtcggtgtccactcattgccctgcgggctccttacctcattgaagtccatttaggagccatgagtgacatcacacct

SEQ ID NO: 6859245 - DNA, 104 bp, Homo sapiens
ccagacaatagagtacatcccgtaagattctatttttgtggaactgtagaataggcaaagtcaatctatggtgatagaaatcagaatgggtgcctccggtctgg

SEQ ID NO: 6859246 - DNA, 81 bp, Homo sapiens
gggaggggaaagagggtaaaggatgtaacagttgctgtgtcctcctgacactttacacatcttttctcatttaaccctctc

SEQ ID NO: 6859247 - DNA, 60 bp, Homo sapiens
gagctgctggaaagtgagctgtcgccgatggcactcataccagctcctgttcagcagctc

SEQ ID NO: 6859248 - DNA, 80 bp, Homo sapiens
ggtgggccaacgggagaatgcagctggggccgccccacttcctgcccccgtggaggggcctctcattctccctggtccct

SEQ ID NO: 6859249 - DNA, 75 bp, Homo sapiens
atgcaattgcacttttaaatgggtccgtgttttattaacctcaaacacttatccacatttgaaagatagttgtat

SEQ ID NO: 6859250 - DNA, 79 bp, Homo sapiens
ccctcttcacagtgctatgttggttttctggtgtgatacacatcaaaagctggttacgtattaagtactcagagagtgg

SEQ ID NO: 6859251 - DNA, 90 bp, Homo sapiens
gggtgcatgtatgtgtgcatttgtgtgtgtgtattttataaccatgcaggtatatagcacacagtttataaaagccatcatgcagttccc

SEQ ID NO: 6859252 - DNA, 76 bp, Homo sapiens
gggcagaggctccagggtgtgtttactggggtctctggcgacaccccgtgagtactctcctcctccagccatgccc

SEQ ID NO: 6859253 - DNA, 63 bp, Homo sapiens
ttgttcttgtctttgccttcacctaagaaaataatgaagggtggtaaataaggataagaagga

SEQ ID NO: 6859254 - DNA, 64 bp, Homo sapiens
tgcgagcccagccagctctctggggccctttaccccatggatgctaattgtttgggctgaagca

SEQ ID NO: 6859255 - DNA, 61 bp, Homo sapiens
tctcatctcctcccacagccccagccctaatgtagacagagagctctgatgggaggtgaga

SEQ ID NO: 6859256 - DNA, 94 bp, Homo sapiens
gcccttagaggagtgtcgatttggggccagccccatgtctgccttgggtacagataacatcctgggcttggccctgttgacctgctcttgcggc

SEQ ID NO: 6859257 - DNA, 87 bp, Homo sapiens
ctcctgcggtatcctgggccagtcactcccattttggctccttggaaggtgaagctggcttgacatggccttggaggacctcggggg

SEQ ID NO: 6859258 - DNA, 88 bp, Homo sapiens
atattgatgatcactgtgtgtatatgcacacacacgtcatactttcagtatgatatatataatgtatgtatacactgatcatcagtat

SEQ ID NO: 6859259 - DNA, 76 bp, Homo sapiens
gggctttacagaggtagtttagttttggggaagggctattgctattaaactataaactaaatttctcccaaagttc

SEQ ID NO: 6859260 - DNA, 77 bp, Homo sapiens
gatgtctggggaagagccttctatacaaggcctggacagttctgctcctgtgggagaagggctttttcttgggagtc

SEQ ID NO: 6859261 - DNA, 87 bp, Homo sapiens
cggtgcggtacttgtgacgggagcttgtgaagtgagccgcctccctgatgtgtcttggcggccagcaggccctgtgatcctgcgccg

SEQ ID NO: 6859262 - DNA, 69 bp, Homo sapiens
gtttccacaacagtccagctcatcagtggcaccgttggagctgtgtctaccccacgggttggaggaaac

SEQ ID NO: 6859263 - DNA, 81 bp, Homo sapiens
ggacccaagaatatgaccttatttggagatagcctttttaaagaggtaattagggtaaaatgaggtcatatagatgggtcc

SEQ ID NO: 6859264 - DNA, 61 bp, Homo sapiens
tcgggggagtgatataaaacagattcttatattcattgcctctgtttcttcctccatctga

SEQ ID NO: 6859265 - DNA, 66 bp, Homo sapiens
aggacttttctccaagccagtccttcccctgtccccccttgtaagggctgtctggattagaagcct

SEQ ID NO: 6859266 - DNA, 127 bp, Homo sapiens
gttaggaagggggttataggaagggagggtataagttttggttggcctcttcaaactgccagcctcctacaaaactgtcaggagaggccatcagctttttctctctttgtatttctctgtttttaac

SEQ ID NO: 6859267 - DNA, 76 bp, Homo sapiens
ccttacatgacaatacttcaataagctgaatttgtattcctctcatagacttgtagtttgagtattgttactgagg

SEQ ID NO: 6859268 - DNA, 63 bp, Homo sapiens
tgttgctttgagactcaccgtggtctagaaactcctttaggtgccaagatgtcacagacaaca

SEQ ID NO: 6859269 - DNA, 94 bp, Homo sapiens
cctccaagcttgagcagcagttttgaagtgtggagatgggaggtgagttattcacatctctaacaaaggagctgctgcttctggcttcaggagg

SEQ ID NO: 6859270 - DNA, 75 bp, Homo sapiens
gtgattctcagtgtggaaatgagaatgaagttttttttaaagacaggctacaataattcccatgcagagaaccac

SEQ ID NO: 6859271 - DNA, 76 bp, Homo sapiens
gttctcaaaggcccattgtcccgttgattttatcagttattctttgttaataaggtggtaatgtggtcttaagagc

SEQ ID NO: 6859272 - DNA, 56 bp, Homo sapiens
gattaatagaggtggcatgttatagatctgatctgttactcccgtctctatctatc

SEQ ID NO: 6859273 - DNA, 67 bp, Homo sapiens
tataagggttgaacattgcttataatatacccataatagggtagaagaagcatggtcaaaacttatg

SEQ ID NO: 6859274 - DNA, 56 bp, Homo sapiens
caggtttagaggtgatttggacctttctgttggcttcagaattacccctggatctg

SEQ ID NO: 6859275 - DNA, 60 bp, Homo sapiens
tacaggtggtctttgctccttttggccgggagttggaccaaagggcagctggcttctgtg

SEQ ID NO: 6859276 - DNA, 124 bp, Homo sapiens
tgcggccactgtgagagcacaaggccaccctcagcctgcagggctgcctgttgtggaggctgcatccccagcgcctgcagcgttgcagagccccaggaaggccccttgacctctccctgctgca

SEQ ID NO: 6859277 - DNA, 73 bp, Homo sapiens
tctattgttcttggaaactgggagttaaatgtagagatatggttacattcaggctcagtttttttgacaaaga

SEQ ID NO: 6859278 - DNA, 57 bp, Homo sapiens
tagacctgaatgatcattttcaaccagatggaggaaggtgtcattgatgggattcta

SEQ ID NO: 6859279 - DNA, 83 bp, Homo sapiens
aatctttgactttggcattgttccaacagtatgtatcagtaaaattatatagcagaaacaccacaatgtcaaggtcagacatt

SEQ ID NO: 6859280 - DNA, 83 bp, Homo sapiens
ggcacatgatgctgacatattgttaataactattacattgatgatacttgccattaatggctaatagtgtgtattcaatggcc

SEQ ID NO: 6859281 - DNA, 57 bp, Homo sapiens
ccagaagcagtgagagatgtgcactgattcatctgcatcctttcgcatgttttctgg

SEQ ID NO: 6859282 - DNA, 91 bp, Homo sapiens
cttacctgctggacgttttggtaatgcctaacttcgtgactgtgttttcatgctttgtggagtattactgtattatgttccatgttttaag

SEQ ID NO: 6859283 - DNA, 100 bp, Homo sapiens
gagtttttaggatattttaatggtttatggggaccgcaaacagatatttgaaattagttttgtctccaaaaacctgagataaaaacttatttggaaactc

SEQ ID NO: 6859284 - DNA, 75 bp, Homo sapiens
gcagatggagcagctgttgcccctggtgagggcactgtccccacccttgcacagggcaccagttggccatcttgt

SEQ ID NO: 6859285 - DNA, 72 bp, Homo sapiens
catccgcagagctcacacaagatagctgtgcctgcgtgtgcccatatgcatctgtgtgcgtgtctgcgtgtg

SEQ ID NO: 6859286 - DNA, 129 bp, Homo sapiens
aggacagtgggggactgtgccccttgtccttgaagcaggaacgttctggggtgtgtggccagctccttctcacagctttcagattgttcccaagggcatggagcatggagcaggtccctcgtggtctct

SEQ ID NO: 6859287 - DNA, 69 bp, Homo sapiens
gagtggaccaagggctctggacagagtggagtggacagcagctcctctgcccctaccctttggctgctc

SEQ ID NO: 6859288 - DNA, 62 bp, Homo sapiens
ttctattaagtcaaaggcagttggacctgctgtggaattcagctacccttggcttaatagga

SEQ ID NO: 6859289 - DNA, 112 bp, Homo sapiens
tagactattaaacatgcatgtacacacacatacatgcacacctaaatatatatgtatatatgtgtttgtgtgtgtgtgtgtatatatgtgtatatatatattttatagtttg

SEQ ID NO: 6859290 - DNA, 57 bp, Homo sapiens
tccagacccatgaccctggggactgttgtcacacaagggtctggtggtggggttggg

SEQ ID NO: 6859291 - DNA, 60 bp, Homo sapiens
tatttgttgtattctttctatatttgtggcactgcattatatgctggagtacaggaaata

SEQ ID NO: 6859292 - DNA, 57 bp, Homo sapiens
atcttcagtgcctgggacgcactctgcaccacccatgtgcacccagagcctgaagat

SEQ ID NO: 6859293 - DNA, 65 bp, Homo sapiens
tggagggctggtactgtggctgtcacctctgctggggtgtacagtacttcagaaccagcctcaca

SEQ ID NO: 6859294 - DNA, 90 bp, Homo sapiens
catcttagatttgccagtgttcagtatgcattaagtgttcaataaatgtgtgtccacttgagtctgaggctgtgtgtttattctctgatg

SEQ ID NO: 6859295 - DNA, 78 bp, Homo sapiens
gtggcccacacagacagcatctaataatgggagtggagaggaaagggaaaggcactcagatgcatgttggtgggtgac

SEQ ID NO: 6859296 - DNA, 126 bp, Homo sapiens
ctggctgctcctgggaataagtgccaaatctggggtcagacagccctggggccagtcttccttgggtactggcttcctccttcaggagctgcactgggcccactggtatcctatccctacagctgg

SEQ ID NO: 6859297 - DNA, 72 bp, Homo sapiens
aatttctcttgtgttccagacagaggctttcaattggcgtagcatttccactgctgagaaccagggagaatt

SEQ ID NO: 6859298 - DNA, 59 bp, Homo sapiens
gccatcttggaagccaatattgctggttttaaaggaaaccagataaatggctccagggc

SEQ ID NO: 6859299 - DNA, 76 bp, Homo sapiens
agatgagaaaatcgttagcattttgctattgcagtattttgacaccagcagcagcaacaatagcggtcactcgttt

SEQ ID NO: 6859300 - DNA, 60 bp, Homo sapiens
tcaacttggctttttaaagtcctgtttacatttttaacaactttattgaggcatagttga

SEQ ID NO: 6859301 - DNA, 87 bp, Homo sapiens
gcttctgttgcttgtgtgtcctgagtcaagtgtgggcagtccagtggctctgctgatcttggctaggctcactcacaggtcaggggt

SEQ ID NO: 6859302 - DNA, 77 bp, Homo sapiens
gggccctggaagaggctggaggatactgcgctgtcactgagacacctgccccaggtcctccatctcagccactgccc

SEQ ID NO: 6859303 - DNA, 56 bp, Homo sapiens
gcaggtggtccccgtggagtgggcaagtgtattcctctgacaatgatgtcacctgc

SEQ ID NO: 6859304 - DNA, 67 bp, Homo sapiens
gtggccactgattggcccatccatgagtctgtgacactcacagtccaggagtttccaattaagctac

SEQ ID NO: 6859305 - DNA, 58 bp, Homo sapiens
agagtgatgattaacttcatatgaggtacttaacgtgcctgaattagaattatcctct

SEQ ID NO: 6859306 - DNA, 92 bp, Homo sapiens
gtttctgatatggtttggctgtgtgtccccactcaatgccagcccgtgaaagcagctgggagggaggctataccctgcaaagccacaggggc

SEQ ID NO: 6859307 - DNA, 85 bp, Homo sapiens
gcaacagaaagtgtactgttggatgttgcagttttcttttccacaccaggaaaactaaactacatctcatggatgaggctgttgt

SEQ ID NO: 6859308 - DNA, 122 bp, Homo sapiens
ttcaaatttctgaaaatgtagtgcagctaatgtataaagtgttaataacttttgaacttaaatgttcttaaattaggcatattataaggcattttgttgaactaagtgacttaacatttgaa

SEQ ID NO: 6859309 - DNA, 68 bp, Homo sapiens
taaagggaggaggatttattgtactgtgtgatttcactccactgtatattagttgtcccttcttttta

SEQ ID NO: 6859310 - DNA, 83 bp, Homo sapiens
gtgtcctcagggtggggcaggttggcacttccctctggctctccccggagcagggcttgccgcttgtcctcctctctactcac

SEQ ID NO: 6859311 - DNA, 61 bp, Homo sapiens
accaggtgcggccagcttcattcgttaccttggttagcagtgttgccgttggctgctgggt

SEQ ID NO: 6859312 - DNA, 104 bp, Homo sapiens
attgttacagtgatagtgatttggggatgggaaaggaatcatgaggatattaacataactccagggcctttaatttatcccatagatagtttctgattgacaat

SEQ ID NO: 6859313 - DNA, 63 bp, Homo sapiens
gcagcggtgacagcggtgacagcagcctggccggtggcggcagctgcacgttgtcccgtctgt

SEQ ID NO: 6859314 - DNA, 56 bp, Homo sapiens
gggctccggggtcagcagcggagacagagaagacccctgctcaggccaaggagccc

SEQ ID NO: 6859315 - DNA, 99 bp, Homo sapiens
agagcatcactgagtctaggagggttttccacaatttgagcagcagattctatctgaagttaaaattacggagaaaacttttactttctgtactgcttt

SEQ ID NO: 6859316 - DNA, 78 bp, Homo sapiens
gcatctctattgatcatcttgtgctgacggctcaatggtcagtgtgtgggcaacagtaaggtgattaagaggaggtgc

SEQ ID NO: 6859317 - DNA, 130 bp, Homo sapiens
ttgtgtcacaactgtaaagatactcttggtgaagtggcttttcagggactgtactcatcagacaagggattttctttcttatggggtagtcctttagtcactggaactgtttatgttacttaaaccacaa

SEQ ID NO: 6859318 - DNA, 78 bp, Homo sapiens
cattgtctgttttgtgtttttggaagtatttgagagtggtatttttgcaagtattgtgggaaagcagaaaggagaatg

SEQ ID NO: 6859319 - DNA, 62 bp, Homo sapiens
cttctaactactccactcccacaacaggatgttctgctctgattggcagggagagtttgaag

SEQ ID NO: 6859320 - DNA, 66 bp, Homo sapiens
ctggaatggaccccaagggatgcgtgtgctcatgagagaggagcgctgtgcgccctgggtcctcag

SEQ ID NO: 6859321 - DNA, 72 bp, Homo sapiens
gcagactgctgatgttttttaaaggaatttaatgatacagtttcattcccaagagtaaacatatcagtctgc

SEQ ID NO: 6859322 - DNA, 56 bp, Homo sapiens
cggcttccaacaagctttgctgaaacccagaaccagccaagagtgtctgggggccg

SEQ ID NO: 6859323 - DNA, 74 bp, Homo sapiens
ctgaaatagtgctgggaagggagtcaagatactggggttcaagtcttggctctcctctctcctaactatgtcag

SEQ ID NO: 6859324 - DNA, 84 bp, Homo sapiens
ggaacctaatatgcattccaaggaataggataattatggataaatgtgggttttctcaaagtatgctttctttgggagggttcc

SEQ ID NO: 6859325 - DNA, 75 bp, Homo sapiens
aatattgaggtggttttgctttatgagtgaagtgtaagatcacttctctacttaggagaactttactacaatatt

SEQ ID NO: 6859326 - DNA, 65 bp, Homo sapiens
tctggtcccagccctgggtccctgccctggcccctcctcgccagcgtggccaagggtggagcagg

SEQ ID NO: 6859327 - DNA, 62 bp, Homo sapiens
cccattttacagatgtaggaactgaagtttggaaagctgaagtaactcacatcgttagtggg

SEQ ID NO: 6859328 - DNA, 129 bp, Homo sapiens
gaaatgaagtcttttaaataagttatcttttgggtagttattctgcacacctttaaaatgcattttacttatttgtggtgggtggagtagaaagatgaattctggagaagttgagaggaaaataatttc

SEQ ID NO: 6859329 - DNA, 69 bp, Homo sapiens
ttcagctgcaggcctctcctggggatgacctgaccttggcgcactcctctctgaagtctgcaggctgaa

SEQ ID NO: 6859330 - DNA, 125 bp, Homo sapiens
aaggtttcttatttccagtattaaaaggaaaatcatcaaggcaaagtaaatattcaagtggctttgaacaatttgtgcctgattgttggcctgttatctttaattcaactgtgaagtttaacttt

SEQ ID NO: 6859331 - DNA, 74 bp, Homo sapiens
gggagcattttctcctggagcccagatgctggctgtccacgcatccctccacagagaggctacaaaatggtccc

SEQ ID NO: 6859332 - DNA, 98 bp, Homo sapiens
gatttgtatgtgtatgggcagggaggtgagggaaagggactgctgtgcgttccatgcatcttgattccattatctttgtggccctaatgcaagctttc

SEQ ID NO: 6859333 - DNA, 74 bp, Homo sapiens
taggggtctggcgatgcactttgtgccagaattggaatgccatactctgccctgagtcatgccagatggaactg

SEQ ID NO: 6859334 - DNA, 128 bp, Homo sapiens
atcagaattccttggagggttttttaaaacacagatttctggtcttcacccttagcatgtctgattcaggagatttgggatggagcctgataatttgtatttctaacaagctcccatgtagtgatgat

SEQ ID NO: 6859335 - DNA, 59 bp, Homo sapiens
gtcctgagggcgattcagcaggtttgattatatgccaagtacctgtgaataccccaggc

SEQ ID NO: 6859336 - DNA, 61 bp, Homo sapiens
tacagtgagtggcagagccagagattcaaacctaggtctttgtgcccctatcactcatgta

SEQ ID NO: 6859337 - DNA, 128 bp, Homo sapiens
tggtgaacacaatttaattcatagcatctatttatgtggagttttaaatgatgataaaattagatggtctatatcaaggcatggaaaatgctagataaatgactgctgtgcttaattattacctacca

SEQ ID NO: 6859338 - DNA, 57 bp, Homo sapiens
ggccatggtgaggtcttctcagtggaagtttaaatcatagaggggacaatcattgcc

SEQ ID NO: 6859339 - DNA, 75 bp, Homo sapiens
ggtgatttctaaggtgatcctttcttagtctgttccaaggggacttaagaaaatctggatcttctgggaaatccc

SEQ ID NO: 6859340 - DNA, 59 bp, Homo sapiens
cctcctttcctgttttcctgagtgatccctccccactggggaagagaagagaaaggagg

SEQ ID NO: 6859341 - DNA, 130 bp, Homo sapiens
ttggtaccttatagggacttagtatatagcttttggaaagttaattcttactgaattttgatgatacttcttgtttcatgtaaatgtggatgcttccgttatgtgagtcctaagatttgggatttaccaa

SEQ ID NO: 6859342 - DNA, 67 bp, Homo sapiens
gtaagttctctggcttaatgtctctatgaataactctcttcgaatgacagtaagacagggcatttgc

SEQ ID NO: 6859343 - DNA, 61 bp, Homo sapiens
gaaataatacagtgctcttctccatttgctgtggagccctgtggttcattgttattatttc

SEQ ID NO: 6859344 - DNA, 56 bp, Homo sapiens
aagtccagggatcaaagtaggcaaaaatataatgcccaactttatttccttgattt

SEQ ID NO: 6859345 - DNA, 66 bp, Homo sapiens
aaatgtaccagcctaagaagtggcaccatattttctatttatcccactaattaagctgtcacattt

SEQ ID NO: 6859346 - DNA, 91 bp, Homo sapiens
agcaggacggttaaggtttcaagggaactgttttggttacctgaaaggcaaccccccagataatcccttgaggtgtctttgctgttttgct

SEQ ID NO: 6859347 - DNA, 79 bp, Homo sapiens
ttggatgagactaacatttacattggcagactttgcgtaaagcaggctgccttccataatgtacgtaggcctcatccga

SEQ ID NO: 6859348 - DNA, 69 bp, Homo sapiens
gggtgcggggatggattccgggtccctgtgtcttggaactaggagctcattcatcctcttttctgcccc

SEQ ID NO: 6859349 - DNA, 114 bp, Homo sapiens
tctctatccctgattaaagaaattaagactttactataactgccttgtagagtgtgtgtatgtgtgtgtgcacacgcatgcaagtgcaggtgtgtgtctggtgagggggagaga

SEQ ID NO: 6859350 - DNA, 61 bp, Homo sapiens
ggtacccgctctgcctctttgctgcgtcacagggtgtgataagttacacagaggagggccc

SEQ ID NO: 6859351 - DNA, 73 bp, Homo sapiens
ggtgaggtttacaaacttgttttaagtaagtgttcattaattctgatgcactcaatgtttgagaaccactgcc

SEQ ID NO: 6859352 - DNA, 66 bp, Homo sapiens
ccctgccttcagttttcaggtgtttacctcagagactggggacagcagaaagaaggcaaggcaggg

SEQ ID NO: 6859353 - DNA, 66 bp, Homo sapiens
gtgtttaatgcttggccaatcatcatggtcactggggaggatttcaattggccaggcataaaacac

SEQ ID NO: 6859354 - DNA, 55 bp, Homo sapiens
ggccctcactaaagctgcaggggtacatgactctgaagggctgagtggaggagcc

SEQ ID NO: 6859355 - DNA, 80 bp, Homo sapiens
ggcctgaaccacagcaagccagcttgtcactgagcctgtcacgtggggcagaagcaaatgccttgctgaggcctcaggtc

SEQ ID NO: 6859356 - DNA, 63 bp, Homo sapiens
tcctggcttctgtctccttattagaccctgcccaatgtaatagggaagcacaggggctttgga

SEQ ID NO: 6859357 - DNA, 65 bp, Homo sapiens
gattcaagtctcaatgtattatggtgagcaaaagagggccagcaagatgaagttgagctaggatc

SEQ ID NO: 6859358 - DNA, 88 bp, Homo sapiens
gtagaggtgagcatgtactaattgttcacacttgtttataaaagcatatatactgtgaatttttagtacgtttaatgttgacttcaac

SEQ ID NO: 6859359 - DNA, 89 bp, Homo sapiens
cagcagaaagaccgggactcggagggtggccagagtgtcattttattctctttaacaggaggtctggccaccagtcctggcctctggtg

SEQ ID NO: 6859360 - DNA, 66 bp, Homo sapiens
gaagaccagtggatactgcttgctttgggaaactggaacctagatctcagcagtttccatggattc

SEQ ID NO: 6859361 - DNA, 67 bp, Homo sapiens
ctgggaagtgtagtccgaagttgcgggccggggccaagcaggaggcgcgtgggactacacttcccgg

SEQ ID NO: 6859362 - DNA, 60 bp, Homo sapiens
gtagaaatgccatcgtgaagtaagacattttaaaaaattctcttatttctggcatgctgc

SEQ ID NO: 6859363 - DNA, 55 bp, Homo sapiens
tgcctcttggagcctttcctctagtcacttcctaagaaaggatatatgggaggta

SEQ ID NO: 6859364 - DNA, 63 bp, Homo sapiens
gagatggccagtgccaggacaacagtggggaagctgtgtcttttcctaagctctggcagtctt

SEQ ID NO: 6859365 - DNA, 60 bp, Homo sapiens
gcaggcgtgtttcacgtgccagaaagcacatcttctgtgttaggcacaagcatgctgtgc

SEQ ID NO: 6859366 - DNA, 81 bp, Homo sapiens
agcctgcgttttgggtgtgcctagggccagggctcagaccattatctccctgcagccttgcatgccttcccttgcctggct

SEQ ID NO: 6859367 - DNA, 63 bp, Homo sapiens
cagcaggaggcatggcttcccttctccctctttcttcatatggatgaagcaatctttctgttg

SEQ ID NO: 6859368 - DNA, 86 bp, Homo sapiens
taaggatcatgtagtgcattctccatcatctagggccattctgaggactgtaatgatactgaagggtgacatgacatgcatcttta

SEQ ID NO: 6859369 - DNA, 57 bp, Homo sapiens
catccttcttgccttcacccttccctgaccacacagccagggtggcaaaggagggtg

SEQ ID NO: 6859370 - DNA, 88 bp, Homo sapiens
tatacctagctagctgctcaagtatatggacccacaagaatctgatgagtccaccttagtatatgggagtctctggctttagggtatg

SEQ ID NO: 6859371 - DNA, 78 bp, Homo sapiens
actggcaggtaaaggaggaataaagaggtggtgaagacatatttttatcctgctttgttcctcttgagcactactagt

SEQ ID NO: 6859372 - DNA, 80 bp, Homo sapiens
gaccacagatagtataatttcattcatatgaaatatccagaataggtaaattcatagaaatggaaagtatattagtggtt

SEQ ID NO: 6859373 - DNA, 67 bp, Homo sapiens
aacaaactgtgttctttgcttttagggaattgctttccccccaaagttagtcagaaccagccatgtt

SEQ ID NO: 6859374 - DNA, 80 bp, Homo sapiens
cccccagcatgcaatccactattctaaagcccctcatcttccctttagggagttttacgctgtgggttgttttctagggg

SEQ ID NO: 6859375 - DNA, 75 bp, Homo sapiens
ctgcctgcctctgagtcctgcactcacccgtccaccaggacagggatggctgtcaggatgtagtgttgctgggag

SEQ ID NO: 6859376 - DNA, 99 bp, Homo sapiens
gaggcaggagaatcacttgaaccccggaggcagaggttgcagtgagccgagatcgagccactgcacttcagcctgggcgacagagtgagactctgtctt

SEQ ID NO: 6859377 - DNA, 126 bp, Homo sapiens
tgaacatagagagaattgaattttaattaatggtcataagtaccattttgggggcaaatgttgcatgtgtgtcatttagggtggagctgaccataaagacattttattcatttttatttatgttta

SEQ ID NO: 6859378 - DNA, 55 bp, Homo sapiens
ttcagagggcttgctatgtacagtgtaatgcttcagcatagctgaccttcctgag

SEQ ID NO: 6859379 - DNA, 101 bp, Homo sapiens
gctgcttaattaaagcctgctggcagagggggttactcacttcagcaagttgctgaccccagagtatcccacttggctgccagcagattgaaaggagtggc

SEQ ID NO: 6859380 - DNA, 100 bp, Homo sapiens
cttaattatttacctgctactgttattgtgtctgctgaacctatgataacttaaaaaaaggattctggttacattgttacagctggaggtttttgttaag

SEQ ID NO: 6859381 - DNA, 68 bp, Homo sapiens
tcatggtttggttaagattcctgccacttccaacctggaaggcagaccatgaatcatgaccttcctga

SEQ ID NO: 6859382 - DNA, 67 bp, Homo sapiens
ggtagaccaatgcatacgtgtttgtggcaagtgtgcttgtttggcaaatgtgtgtgtggtgtaggcc

SEQ ID NO: 6859383 - DNA, 56 bp, Homo sapiens
ttgctcagcactggagccagctagccccacatttggaactggactctgctgtgcaa

SEQ ID NO: 6859384 - DNA, 86 bp, Homo sapiens
gaccatgataaatgttctatccattcattgagagtaaacacagcagtcaactcaagaaggatgagctattgctatttaaaatggtt

SEQ ID NO: 6859385 - DNA, 70 bp, Homo sapiens
ttttggatgttcagatgctgttttcttatataggtgaaagtacacacctatatcagcaaagcatttaaaa

SEQ ID NO: 6859386 - DNA, 55 bp, Homo sapiens
ttcctgtggtatgggagtgatgtggggttcccagctccagaacatagcacaggaa

SEQ ID NO: 6859387 - DNA, 59 bp, Homo sapiens
tgcctgcctgcctgcctccccaagagcataaacgtctgggtctctagtacaggcaggca

SEQ ID NO: 6859388 - DNA, 78 bp, Homo sapiens
catttccctaataattggcaatgttgagcatattttcatgttcttattggccaattgtataacttctttggagaaatg

SEQ ID NO: 6859389 - DNA, 59 bp, Homo sapiens
ccacagccagccctgccctcccctttatgacaggagaatccagagttacatggctgtgg

SEQ ID NO: 6859390 - DNA, 63 bp, Homo sapiens
ctggcctctgtgggagctgagcatgggaagcttcactgagcaaatgctttgtaccttaggtag

SEQ ID NO: 6859391 - DNA, 59 bp, Homo sapiens
ataccacagcaaatgaggccaactcaacccctgagatgacactaagcatgttgtggtat

SEQ ID NO: 6859392 - DNA, 101 bp, Homo sapiens
agtgtgctgattaaatcattcaattcaacttgcctttgtagctcagggaaatcattaaaaatggagctggctgttgaataatggcatatatttggcactct

SEQ ID NO: 6859393 - DNA, 125 bp, Homo sapiens
ggactaagtcatgcctaaggtcacttggttgatacatagcacagtttaggtttggattctgggcatgtcactcctgagttagttgctgtgtctcagtggcagtgataagataggttcaggagtcc

SEQ ID NO: 6859394 - DNA, 72 bp, Homo sapiens
cattttaggaaattatggtttcagatatgctgtggggactcagactggacatttgaaataatttcctgattg

SEQ ID NO: 6859395 - DNA, 77 bp, Homo sapiens
tggtgcccatgcctggagcacagcccagtcccaccctgcccctgagggtggctcacatgttcttaaggcaggtacca

SEQ ID NO: 6859396 - DNA, 80 bp, Homo sapiens
ggtacttgaagagtggttatccctgctgtgttcgcttaatttatgacgaatcatacagggacatccagtttttcagtatc

SEQ ID NO: 6859397 - DNA, 83 bp, Homo sapiens
ttctgatgtgtttggcataggatgtgggttagtattggtgttttccaaaaagtaagtcagtctaatgtgcaggcaagattgaa

SEQ ID NO: 6859398 - DNA, 58 bp, Homo sapiens
ccaccactgaggcacaggagccaaaggctgggcaacagctttgtgcctgagaaggtgg

SEQ ID NO: 6859399 - DNA, 70 bp, Homo sapiens
ggcccaatgtgtggtcctaaagtctagctggatgccgcctgtacactttttactacagattctaggtgcc

SEQ ID NO: 6859400 - DNA, 121 bp, Homo sapiens
taggcatgcttgagtactgagtaaggagcagtgttttgattctgggagccagatcatcctaaacacatggaggtagctgaggatgggaacttggccttgactcacaaacttaatgtgctta

SEQ ID NO: 6859401 - DNA, 105 bp, Homo sapiens
aggccgagtgtaaggagcagtcatggtctttcattcctggcccacccagcaggatgtatacaggcataagagatacatgaaagactgtctctcaacacttagctt

SEQ ID NO: 6859402 - DNA, 72 bp, Homo sapiens
gtattgagctccaagtacatttctcccaacactaaatttccattagaaataaaatgttttggggctgggcac

SEQ ID NO: 6859403 - DNA, 76 bp, Homo sapiens
ggtggttacagaacatgaatgttgccccaattgtttcagtacttatggcaacagacttttcatgttctgagctgtc

SEQ ID NO: 6859404 - DNA, 92 bp, Homo sapiens
gagaaggactgcagtacactacacgaaggcattgcacctgtgtgtgatcaggcttggtgtcagccccttggttagtgttgaacgttaatttc

SEQ ID NO: 6859405 - DNA, 59 bp, Homo sapiens
acagcagagaagacacaggcttcatcatcaagcagaactggacctgtccttctcgctgt

SEQ ID NO: 6859406 - DNA, 56 bp, Homo sapiens
ggtggtggtcccgacttgggagatcctgggaggtcctgtggtgggggctggcctcc

SEQ ID NO: 6859407 - DNA, 129 bp, Homo sapiens
tatgcaagattttctaaatcccctggtgtatggttctaggctttgtcttttgttctccatatccttacttgtcatataaatgcaaagcttggcgcttacttacccaggctacctgaaattgctgatata

SEQ ID NO: 6859408 - DNA, 71 bp, Homo sapiens
tcagcctctcaaagtgctaggattataggtgggaggcaccacacctcgcccagcaacttttaaaggtctga

SEQ ID NO: 6859409 - DNA, 67 bp, Homo sapiens
gcatttcaaatggaatacctaggtggcccagggggacccctgacccctatatcctgtttctttctgc

SEQ ID NO: 6859410 - DNA, 73 bp, Homo sapiens
atatgtgttgggcagttttctatgctgcaatttatcgcaagaatagcagcaaagcaggatctgctcactgtgt

SEQ ID NO: 6859411 - DNA, 93 bp, Homo sapiens
aagccattaaggagaggtatttctcccagctttgcctacaaggaggtcaaaggctgtccaggagaaaatagtttgaagtgttttgtttggctt

SEQ ID NO: 6859412 - DNA, 66 bp, Homo sapiens
ttaccattgttttgccatttgtgttcatgcatcctcagatgcatgaacggagggtaagctgggtaa

SEQ ID NO: 6859413 - DNA, 71 bp, Homo sapiens
gtgaatttaagactgacttcaccagtggcattattctgtactggacaggttcatggttttaatttagtcac

SEQ ID NO: 6859414 - DNA, 79 bp, Homo sapiens
ttctaggtaaaattgcattcaggatgcaggaaggtacaaaaatacttctaggggatttcctaaatgcggttattgagaa

SEQ ID NO: 6859415 - DNA, 60 bp, Homo sapiens
ttgcatgggctcaaccttgaccacatgactcatcagtgtgggctcagtaaagtccagcag

SEQ ID NO: 6859416 - DNA, 63 bp, Homo sapiens
gtgagagtgctgttaggttaatatagttctcaaaggattggattctacttaacaacacctcac

SEQ ID NO: 6859417 - DNA, 56 bp, Homo sapiens
ctagaaaagaagagcagagctaggtgttgcacttttttctctgaacatctttctgg

SEQ ID NO: 6859418 - DNA, 71 bp, Homo sapiens
gagcaatgatttggataggcctgaacttaaaccaagttgtcacctctattcaaatctcattcagattgctc

SEQ ID NO: 6859419 - DNA, 89 bp, Homo sapiens
tgccttaagtaagctctgtcttatatgaggtcatgatatattagggttgggtatgaccttaaatgtgacatagtctagcttctcatgca

SEQ ID NO: 6859420 - DNA, 63 bp, Homo sapiens
aggataacctaggatttggaacagtgctgttgttagacagacagtgtgagttcagggtggcct

SEQ ID NO: 6859421 - DNA, 73 bp, Homo sapiens
ttttttctcatttctggtttggaaaattgaggcaaattctgggcagtagagtcagaaccaagatgaggctgaa

SEQ ID NO: 6859422 - DNA, 61 bp, Homo sapiens
caggttctatactgaataatttttgttggtattttggcttcagtaattcagataatgcctg

SEQ ID NO: 6859423 - DNA, 112 bp, Homo sapiens
gtgtcttatacccacattccaccagccagaagttagtcattgaagccccacctcaatgcaaggtggggctctatgactaacttctggctggtggaatgtgggtagaggacac

SEQ ID NO: 6859424 - DNA, 78 bp, Homo sapiens
gaaatgcaaattatgtggtccctcctcagatctactgaatcagaaactctggggacagggctcagcaatttgtgtttt

SEQ ID NO: 6859425 - DNA, 64 bp, Homo sapiens
aaacctcttctcaagatttctgggtatttaaatcctcagcatcacagaaatcattttggggttt

SEQ ID NO: 6859426 - DNA, 73 bp, Homo sapiens
gttcggctccatcacgtaggcatgattgattaattgattgcccataggtcgattgccatgtggttgatccaac

SEQ ID NO: 6859427 - DNA, 80 bp, Homo sapiens
tgtgtgaaacagtggccaattctggagatgaaatataatttcagctgctatgttcctaggtatgccaattgtttcattca

SEQ ID NO: 6859428 - DNA, 114 bp, Homo sapiens
ggcaacaactctggtttatatgcattggtctgctgttagttgtctaatgctcttaatttccataacagaaacagataagtgtaagtgtatgagaccggattctcttcatttgcc

SEQ ID NO: 6859429 - DNA, 77 bp, Homo sapiens
tgggaactggaaaggctctgaatgggaggagtctcttctgaattcttccttctgggctttaccagaccatattccca

SEQ ID NO: 6859430 - DNA, 63 bp, Homo sapiens
gcaccacacagctgtgtctaattatggctggaagttctatttaaaaagaggccagctgggtgt

SEQ ID NO: 6859431 - DNA, 58 bp, Homo sapiens
ctggctccctggacatggggcctggggagtttggtgcccacgtgatagggactgctag

SEQ ID NO: 6859432 - DNA, 63 bp, Homo sapiens
gccagaaagaggaggacctgggactcatctagcttcctggtcctgaatctctttctcttgggc

SEQ ID NO: 6859433 - DNA, 63 bp, Homo sapiens
catcctccaactccatggttctcagattctgtctgtcagatgaaaggggaccatggtgtgatg

SEQ ID NO: 6859434 - DNA, 108 bp, Homo sapiens
caagttcaagaactgggaggcaagaaagagcacagcttgtttaaggattagccatgtttagttgcatggctggaatgcaactgtgtgttgttggggtttttgaggttg

SEQ ID NO: 6859435 - DNA, 58 bp, Homo sapiens
tagaggaactgcctttcttctgtttagaagagacagagaagggagagcatttcctctg

SEQ ID NO: 6859436 - DNA, 76 bp, Homo sapiens
gcagcagagctgattgagctggataacctgttatgtctttaatgatatatgtctgtaactttgtctactgtgctgc

SEQ ID NO: 6859437 - DNA, 68 bp, Homo sapiens
ggtggctggcaggtaaagccccggggcagtaggatccggaacgtcccggtggcctcctgcctgcctcc

SEQ ID NO: 6859438 - DNA, 86 bp, Homo sapiens
gactcttacatgtgctactacaggtagaaatgaagccagattgcagagcgttctggagggaatatctgaagcagcacatgtaagtc

SEQ ID NO: 6859439 - DNA, 85 bp, Homo sapiens
tgcgggaggccctcacactgtctcctctacctgcttctctcttgctctgaagatgcctgtagcaggaagatgtgagcttcccaca

SEQ ID NO: 6859440 - DNA, 62 bp, Homo sapiens
tcacgggcagattgggaaggttcatcactctaaataggtatgagcatttttaatttctgtgg

SEQ ID NO: 6859441 - DNA, 72 bp, Homo sapiens
atgtgctaaaagccatgtttcagatacataaatggggaaggaattccgtaactgaggcagcttttaagacat

SEQ ID NO: 6859442 - DNA, 62 bp, Homo sapiens
ttctcccttttagcttccagtcgggttgcccagtgggcagtgctggaggctggagggaagga

SEQ ID NO: 6859443 - DNA, 68 bp, Homo sapiens
cacgagtctttgcccttctattatggttggagttttcttagcagcttccagagagggcagttcttgtg

SEQ ID NO: 6859444 - DNA, 76 bp, Homo sapiens
tcctcacagcatggcttctgatcaaggaactcacttcacagaaaaagaagagtgtcaatgggccatgctcatggga

SEQ ID NO: 6859445 - DNA, 64 bp, Homo sapiens
ttgtcagctggcaggttaaattctaaattagacgcaacacctgaatgagcatgcgagctgagaa

SEQ ID NO: 6859446 - DNA, 74 bp, Homo sapiens
cagggcaggaggaggcaggtgggcagaggaatagcagccgtttgttctggaggccccttccttctcccgtcttg

SEQ ID NO: 6859447 - DNA, 91 bp, Homo sapiens
attgccattattgttgttgttattttaaatgaggaaattgaagttcagaaaaattgtatagcttcttaaagattacacaatgaaaggcaat

SEQ ID NO: 6859448 - DNA, 110 bp, Homo sapiens
tatacattaaggatttgtagtattattgtatgtagtaattaagagtggcttaaccctttgaagtgacttaattcattatatttatgcctataattttaacaatatgtata

SEQ ID NO: 6859449 - DNA, 61 bp, Homo sapiens
tgaggtaagagttttccatttctgaaggactgctaacagagaaagtaaagattctacctca

SEQ ID NO: 6859450 - DNA, 78 bp, Homo sapiens
cagagggcaaggtgagagtttgggttctggagaaatttgctacaattggcagctgaaacccaggcctcagctcttctg

SEQ ID NO: 6859451 - DNA, 72 bp, Homo sapiens
tgatttgttttaacttccagctcccctttcttagtattcagacgggagtccatgcagcttgagacaggtaca

SEQ ID NO: 6859452 - DNA, 56 bp, Homo sapiens
cagtgggaccggtgctattccaggtgctaatcaatgccctggaactgctcttactg

SEQ ID NO: 6859453 - DNA, 99 bp, Homo sapiens
gctctaattatattgaaatgttcagaggacaatataaaccacagaggcaaaatacaagtggtgtgttcatgtcactggaatcctcaatgtgcttgtagc

SEQ ID NO: 6859454 - DNA, 60 bp, Homo sapiens
tcatcccttccttgaatcctttagggtctacagttacttgcaaagttgaggaaggcatgg

SEQ ID NO: 6859455 - DNA, 82 bp, Homo sapiens
ttcctggtcattttccccagcttctgagggggccttgcctattaagacccattctcagaattgaatggaagggaccaaggaa

SEQ ID NO: 6859456 - DNA, 56 bp, Homo sapiens
aggtccatcgtggatgaactgctccccaagaaaagtgacagaaacacgctgggctt

SEQ ID NO: 6859457 - DNA, 99 bp, Homo sapiens
gtggcgcacgtcatgcacatttgtttacatattgtctgtggctactttcatgctacagtgacagaattaaacagtcatgacagaaactatgtgtcccgc

SEQ ID NO: 6859458 - DNA, 64 bp, Homo sapiens
gtccattctggagagaaaccttacaaatataatgagtgtggtaaggtcttcactcagatttcac

SEQ ID NO: 6859459 - DNA, 68 bp, Homo sapiens
gcatataagctcggtggctcatgcctgtaaccccacccagcactacccactcaggagcttatctatgc

SEQ ID NO: 6859460 - DNA, 81 bp, Homo sapiens
aggagagttgtatgtgtttatctgagctgaaataggagcacttgtctacccagtttatatataagcacattgctcttgcct

SEQ ID NO: 6859461 - DNA, 66 bp, Homo sapiens
tgttcttcttgccagatgtggtggcctagatcgctgaaagcccacatttttggcttagaggcctca

SEQ ID NO: 6859462 - DNA, 68 bp, Homo sapiens
ggaatggatgagtccacgtttagggcagcttcaggtgtaggctgctgtgcatggagggccgttcatct

SEQ ID NO: 6859463 - DNA, 81 bp, Homo sapiens
cctcagaacaaagttactaaaaggattttcaggtgacacaggctgcagctggaagttagttatgtaactttggttttgtgg

SEQ ID NO: 6859464 - DNA, 71 bp, Homo sapiens
gtgcctatgtctgagtgcatatgtgctgggggggctctgttgaatcagcactggcgctgggcaggtggcac

SEQ ID NO: 6859465 - DNA, 67 bp, Homo sapiens
cttattcacactgaatctcccatgccttgtatagcactaggcacagaatggcattcagtgttttgag

SEQ ID NO: 6859466 - DNA, 67 bp, Homo sapiens
gcatgagctttgtgggtaaagagagctcaccaaattcagcctccagcagcacacacagctcagtagc

SEQ ID NO: 6859467 - DNA, 89 bp, Homo sapiens
gatatcattgttcttcattgttgtctttacctgtatttcaatgtatatgaagtggaggattagcatagtttaataaatacaatgatgtt

SEQ ID NO: 6859468 - DNA, 69 bp, Homo sapiens
ctaaagagagttcaagactccttatttgaaaggtcaaggtttatgggaaagtcatgtattcatttttag

SEQ ID NO: 6859469 - DNA, 55 bp, Homo sapiens
gacttgtagtcacatccaagaattaactcattcggtgagatttgtattataagtc

SEQ ID NO: 6859470 - DNA, 76 bp, Homo sapiens
gttcctcacagcccttggcccaggaccccccaagtctccacctccatggctcctgggaagtggctggctgaggggc

SEQ ID NO: 6859471 - DNA, 127 bp, Homo sapiens
ttttgaaagaatgagaaagggagagaatgagagagagtgtgtgtttgtgtatatgtgtatgtctaagtacttggtatatatcggcactattttaagttattttaattcttacatcaaccttttgaag

SEQ ID NO: 6859472 - DNA, 58 bp, Homo sapiens
atgagaagatcatctctgaagagtcaggtgaccggttcaagagccatgctcttcttat

SEQ ID NO: 6859473 - DNA, 80 bp, Homo sapiens
gtgcagagctctcctgccctgtgctacgcaaccgctctccacacagggctcagcagagaccagggaggaagggctcgcac

SEQ ID NO: 6859474 - DNA, 61 bp, Homo sapiens
ttgtgcagtttctatgttgtccaaaccctttgccccaggagtgggtgagaagctgcagcaa

SEQ ID NO: 6859475 - DNA, 80 bp, Homo sapiens
ttgaataggtctgacagcatttggaaaaagacagcttatgatgtgggcatcatggtcttatttcactgtcatccttttaa

SEQ ID NO: 6859476 - DNA, 55 bp, Homo sapiens
gtgctgaggtgggtgggcagcctggagaagacttgcctgccctccccttcaccac

SEQ ID NO: 6859477 - DNA, 55 bp, Homo sapiens
cccaggctagagtgcagtggtgccatctcggcttaccgcaagctccgcctcccgg

SEQ ID NO: 6859478 - DNA, 95 bp, Homo sapiens
ctgacattgctgacagagctgctgtgaggatgcttagaagccatgaatatttttaaatgtcacagtctcgtgagcatctgctgtgtgtgtgtcag

SEQ ID NO: 6859479 - DNA, 80 bp, Homo sapiens
ggtattttaatggcatttgggctggcttttctgcattatagtattgtttagagaagggcttaaaatgctcttgaattgcc

SEQ ID NO: 6859480 - DNA, 124 bp, Homo sapiens
tgttatagtcagaaaatatagtctattggggcagtaatcaacacaactaagtaatattgtcatttgagcaatttagtgtgtattgctattatttccaacagcataatagttttcctctgaaata

SEQ ID NO: 6859481 - DNA, 67 bp, Homo sapiens
tagctgtgccatctgatataagagccaccagtcacctgtggctcttgaaatgtggctggcgcaactg

SEQ ID NO: 6859482 - DNA, 80 bp, Homo sapiens
ctgtccaagctccctggcacatgggcacacttcacactcactctgtggctccgtgcctgtgccaggggtgtgctggaggg

SEQ ID NO: 6859483 - DNA, 130 bp, Homo sapiens
aatatcactgtgtttacatctccagttaaagtctattacatccacttttattgcatgcatgctactggatgcgatggccagagagtggaagtcggatttgtatgaaggagaaggaacaatatctggtaat

SEQ ID NO: 6859484 - DNA, 81 bp, Homo sapiens
tgttttgttttgttttaaattctgtatctgctatcctaggaaccctgaaaagaagatatgagattttcaaacaagaggaca

SEQ ID NO: 6859485 - DNA, 85 bp, Homo sapiens
gggggggacccagagacccgcagcctcggagctgggcctagagcaaggcagagcaccaggtcgctggcacgctcgcatcctcccc

SEQ ID NO: 6859486 - DNA, 84 bp, Homo sapiens
cctgggagcttgttagaaatgcagaatcttggccccatgccagatcagcttaatcagaatctgcattttaacaagattcccggg

SEQ ID NO: 6859487 - DNA, 68 bp, Homo sapiens
tagagtatgctagaagggagcactatgttagaagggagcagagttgtttctgaatagctcattttctg

SEQ ID NO: 6859488 - DNA, 72 bp, Homo sapiens
ttaaactatgattcatccttcaggacgcctgctaaggcaggctgcctggctgtgagtgaaaacatattttag

SEQ ID NO: 6859489 - DNA, 79 bp, Homo sapiens
atgccccaagttttatagtccagtctgaggaggcagtgtctgatttagataggactcatagattggttcaatcaggcat

SEQ ID NO: 6859490 - DNA, 79 bp, Homo sapiens
ggtgttaatggctgaagacatcctaatatgtatggccctttgataacatattttacaggagccttttatgccttaaccc

SEQ ID NO: 6859491 - DNA, 89 bp, Homo sapiens
gggtaacgtttgataacttctgttctttggagggacaagagatcccttctagaccaccagttaatttttgtatgtttagactgttatct

SEQ ID NO: 6859492 - DNA, 55 bp, Homo sapiens
aagaggtgagaagctacacttagattctctgagtgcatggactactggcttgctt

SEQ ID NO: 6859493 - DNA, 65 bp, Homo sapiens
cactttgagtggccaggcctatgtatattctgggatcttgcagaggcactgtgtcagttggggtg

SEQ ID NO: 6859494 - DNA, 57 bp, Homo sapiens
ctgccaggcgatggattggctgaccttggttcaggcctccacatcttgtctgttcag

SEQ ID NO: 6859495 - DNA, 59 bp, Homo sapiens
cagggtgtggtctgcattcggaatcataaaaattaattttggctatgtggtacactctg

SEQ ID NO: 6859496 - DNA, 57 bp, Homo sapiens
ctcaggccattcttccagctgccattgagggtgggggctggagcttattggcctgag

SEQ ID NO: 6859497 - DNA, 63 bp, Homo sapiens
ggcctgtgcttgcgggtgtggagccggcctccccgggctctgcctgcccagcagcaccttgcc

SEQ ID NO: 6859498 - DNA, 70 bp, Homo sapiens
tctgtgtctcaatcccatgctgcaaccgggggtgtcctggagcaaatcagatgtgaggatgaatcataga

SEQ ID NO: 6859499 - DNA, 92 bp, Homo sapiens
cggctcaggcagtgacatcaattccaaagacagaagcagctgctggcttcttcagctgtttgtttgatgtgtttgggggactttgcctgctg

SEQ ID NO: 6859500 - DNA, 75 bp, Homo sapiens
tttgtttatttgtgatctcctccctctagaatgctgagagtgttttgaaggagaagattcataggaagaaacaaa

SEQ ID NO: 6859501 - DNA, 82 bp, Homo sapiens
ggctccgctcatgaggtggccgaggagcaggacatggcacactcattcgcctgtccttccacatggccaacttctgctggcc

SEQ ID NO: 6859502 - DNA, 71 bp, Homo sapiens
ctggcacataattgaacgtgatgagtatgagcttctgtttggaactcaggtgtacaattttatgtgtgcag

SEQ ID NO: 6859503 - DNA, 115 bp, Homo sapiens
gtcttacagtagatttcatctttctaatgccagttactgtgtttcacctgagtatggtggctcatgccataatcccagagctttgtgaggccaaggcaggaggattacgtaaggc

SEQ ID NO: 6859504 - DNA, 65 bp, Homo sapiens
cctggatctgtttgtgcttgtggcatgctgtacatctgcggtcagggtacattttggatacatgg

SEQ ID NO: 6859505 - DNA, 91 bp, Homo sapiens
gctgttgtctgggtgaggcatccctgtcgtgggagcagccacagctctgcctggtctcccagagcagggacgctttgtccgcatttacagc

SEQ ID NO: 6859506 - DNA, 63 bp, Homo sapiens
ggcagcttttgtgtgttcgctcctacttggtcttgtcagacttcctgggcatgcagagtcccc

SEQ ID NO: 6859507 - DNA, 74 bp, Homo sapiens
catcttcaagagaaagcagactttgtcatttaatttgtatgatgaagaagctgcaacttcttaatgggaagatg

SEQ ID NO: 6859508 - DNA, 104 bp, Homo sapiens
ttatttgggtgtgctcaatagatttagttgaagtggaaaagaaattattcaaatttcagaccatttgcaattatcaatttatctgctgttttccagccaagtaa

SEQ ID NO: 6859509 - DNA, 67 bp, Homo sapiens
gcatgctgagaaacagacgtgttggagcttcagggtctgctataacattggatgctcagcacactgc

SEQ ID NO: 6859510 - DNA, 60 bp, Homo sapiens
tggtctctttgcccaagctgcccaagccactataagccctcagctctgggaaagaggcca

SEQ ID NO: 6859511 - DNA, 77 bp, Homo sapiens
gtcatagcagtattccttcctacctccccctgaacatttattcaaatattcttcagagagtagaagcaagctgtgat

SEQ ID NO: 6859512 - DNA, 62 bp, Homo sapiens
gtttcccagtctgcagagttctttcctactatgaagaagaggtgattctgcaggctggaaat

SEQ ID NO: 6859513 - DNA, 58 bp, Homo sapiens
ggtctggagctaatcttgttggtgaagcctgaatgactggaggaggagctgcagaacc

SEQ ID NO: 6859514 - DNA, 84 bp, Homo sapiens
ggtagggcaggtcagagcagaattcaattatcagtataagtaacatgtaaagatttgagttctgcttatagaccaatggcttcc

SEQ ID NO: 6859515 - DNA, 99 bp, Homo sapiens
gtaagaatactaggaagccatcggaggggtttgaacagaggagggacataatttgacttgtattttgtgaggatcactctggctttggtgtgggtagac

SEQ ID NO: 6859516 - DNA, 73 bp, Homo sapiens
gccagtgacagtgagttcatcaagacatgatcagtcattttcttcaggtgaacttatttatcagaatcctggc

SEQ ID NO: 6859517 - DNA, 89 bp, Homo sapiens
cagcaggtgttattttggtcttcagctttgcatgtcttcaagtttagcacgatgccttgcacagtttgagcactgacatacatctgttg

SEQ ID NO: 6859518 - DNA, 85 bp, Homo sapiens
gcctagtcatctctttctccacactttctctcccaggcctaagaaggtttacagtccccaggtgaggataaggacatgtctaggt

SEQ ID NO: 6859519 - DNA, 82 bp, Homo sapiens
caggttgcaggtgtgggcaggggagcaatgcctggaagcagccacatttgctggtgcaccccagcactaagcgtgcaatctg

SEQ ID NO: 6859520 - DNA, 77 bp, Homo sapiens
agatgatgtccttcttagaagagattcatgtttttaattgtatgttttatttctccaagagggagcttatattgtct

SEQ ID NO: 6859521 - DNA, 68 bp, Homo sapiens
gaggcataagtagaagagattgttaagaagggtattcatgtgtctttgctctttctgctttatgcctc

SEQ ID NO: 6859522 - DNA, 99 bp, Homo sapiens
caaatatatatgctagcagggatacagttaaaaagttcaatggttatttaggaattacctttggagttagctgtgttcaaaaattagcatattagtttg

SEQ ID NO: 6859523 - DNA, 88 bp, Homo sapiens
taactagtaatatttttgcctgtgaacttgcatgagttttgatacaaatgaatcaccatcatttattcacagtgtgggatggtagtta

SEQ ID NO: 6859524 - DNA, 57 bp, Homo sapiens
ccacttccttgagtggtacacattattatatttgtgctggttcaaaaaggaaggagg

SEQ ID NO: 6859525 - DNA, 79 bp, Homo sapiens
ggaacaatgtgccaagatcaaacttttcttattataaaaggatattggaaggataagtttgattcttgccatagcttcc

SEQ ID NO: 6859526 - DNA, 60 bp, Homo sapiens
gcggcgcctgggacccgccagcagggccgcctgccacggctgggagctccgggtgcacgt

SEQ ID NO: 6859527 - DNA, 76 bp, Homo sapiens
taatggttagcttccacatctgtcttcagtacaggaaggaactagactgtaagctctgtggaggcaaaaaccattg

SEQ ID NO: 6859528 - DNA, 67 bp, Homo sapiens
gagcatgtttactcttttaaaaatgaattgaaatgatcgattgtacttttgtcaggtggacatgttt

SEQ ID NO: 6859529 - DNA, 57 bp, Homo sapiens
tgtgtgtgtgtgcacgcgtgtgtgtgtgtgtatgtgtgtgtgtgccctcaccacata

SEQ ID NO: 6859530 - DNA, 78 bp, Homo sapiens
tacaaatgggatgtggcattttggaaaaacttgacaacttatccttcattttacagaaagtttcccatgccgtttgtg

SEQ ID NO: 6859531 - DNA, 67 bp, Homo sapiens
tcttcattttacaggcagacctgtctaactacaagccagacttgggttttctcctgtagtttgaaga

SEQ ID NO: 6859532 - DNA, 57 bp, Homo sapiens
cctgcctagggagggcctctctgcctgagtgtgggtggaggtctctgtctgggcagg

SEQ ID NO: 6859533 - DNA, 101 bp, Homo sapiens
aggctggggactagcagaatagaggagtttgctggtgtgtgcagtggcccccacgcctaccagtaggagctcttggggtttatcatagtccagtccagtct

SEQ ID NO: 6859534 - DNA, 88 bp, Homo sapiens
ccctgtgtctgcaggctgagcgcctgccgggatgaagtgccagcccagcgccggcttatgcggctcagtgcctgcaatttgcacaggg

SEQ ID NO: 6859535 - DNA, 60 bp, Homo sapiens
cagaagctgtgctgggggatctgttgggtgacctgcaggactccctgggcccagctcctg

SEQ ID NO: 6859536 - DNA, 84 bp, Homo sapiens
cagggttaagccacaagcatcctggacagtttcccctattaccccacaatgatattgggcctccgggatgctggccacatcttg

SEQ ID NO: 6859537 - DNA, 75 bp, Homo sapiens
atggagaattggaagaggacttagagaatattttgctgcatgttgtaagatgtacttttgtcctcacctctgcat

SEQ ID NO: 6859538 - DNA, 61 bp, Homo sapiens
ggctgaaattggatccttgggctatttacatctagtttagcattacagagccagttttgcc

SEQ ID NO: 6859539 - DNA, 104 bp, Homo sapiens
caaagggagccactcagagggggcctttggagaatccagtcatggtccgaggctaccctgaacggactccaggggctgctaactggactgtgtgagctctgttg

SEQ ID NO: 6859540 - DNA, 66 bp, Homo sapiens
gaaatctgagctctaatgtcagccttgcccctggtaatacagtactgctgattagagctgaggttc

SEQ ID NO: 6859541 - DNA, 90 bp, Homo sapiens
gcttccaacctgctgaatcaaaacaaaggtttactctgtgagataaatacacacattctaaagccttttgacagacagcttgcatgaagt

SEQ ID NO: 6859542 - DNA, 129 bp, Homo sapiens
gccgggactgggagaggcaagcaaggggactagagctcaggatttaaaggggcactcactcttaaagttgtggagtgcctccttgaaatctgtgctctggttgcctcattggcctcatctagtcctggc

SEQ ID NO: 6859543 - DNA, 62 bp, Homo sapiens
ggctttaacagcagctttgctgtatggtgtccagctctctagtggtcatagctgttgtagcc

SEQ ID NO: 6859544 - DNA, 73 bp, Homo sapiens
agggtgacttttctgaacttggtactggagctattcttagatccaactttcattagaaatgcagtgtcacctt

SEQ ID NO: 6859545 - DNA, 77 bp, Homo sapiens
gttcacttcctggagtgggaattcctacactgcagatcatgagaatgctgaggagtcagttccactcaggtgtgagc

SEQ ID NO: 6859546 - DNA, 81 bp, Homo sapiens
acgcatatgagatgctcagctaataaaatcagtatgagaaaatatttatacattttaatatgcttagtgtgttatttttgt

SEQ ID NO: 6859547 - DNA, 83 bp, Homo sapiens
gcaagaggcgttagaatttgagattgagagtcacttatttaaaagccacatcacagtttgtcagaaatcataacaccttttgc

SEQ ID NO: 6859548 - DNA, 62 bp, Homo sapiens
ttgtatacaggattactcatagcaactcttaggaggtagagctaatgtgattctgcatacag

SEQ ID NO: 6859549 - DNA, 66 bp, Homo sapiens
gtgcaatacatgttgagaaaatatctggcactagaacttatgccaagtatttgggtaacattgggc

SEQ ID NO: 6859550 - DNA, 57 bp, Homo sapiens
gaggagtaagtataagatttggagtcagaccacagttcaagttttgacttagtcctt

SEQ ID NO: 6859551 - DNA, 68 bp, Homo sapiens
aggaggggaaggatgtgacgtggctgacatgttgtacgtgtactcagtacttgcatcctctccttcct

SEQ ID NO: 6859552 - DNA, 75 bp, Homo sapiens
ctttccccactgttgctttggatcataagtggcagatgccacatatttccatgcagcatgtcataaaggtgaaag

SEQ ID NO: 6859553 - DNA, 69 bp, Homo sapiens
gttattttggagaaatgggacttaatctataatagttactatgtatttggtctacattttccaaataat

SEQ ID NO: 6859554 - DNA, 77 bp, Homo sapiens
ggcaaggcaggataaatagtaaatgtaagtaataataaaatttagcctttgctttacttatttattgagagccagcc

SEQ ID NO: 6859555 - DNA, 84 bp, Homo sapiens
agactgaaacatttgattgatgaattaaatgttagtcttaaaattcaaattgaaacatttgattgatgaatcaaatgttagtct

SEQ ID NO: 6859556 - DNA, 75 bp, Homo sapiens
ctattaggttggtgcaaaataattgcggtttttgccaaaggtaaaactgcaatcacttttgcaccaacctaatag

SEQ ID NO: 6859557 - DNA, 55 bp, Homo sapiens
gccagctggagtgagagtgggctgggctgaaacgctccactgttgttgagctggc

SEQ ID NO: 6859558 - DNA, 71 bp, Homo sapiens
gggttaatattttgagagctttctataatcccttccctaaagataagtagagctttctaaaatgtaaatct

SEQ ID NO: 6859559 - DNA, 103 bp, Homo sapiens
caggctgtcagaggggaggaggtggagatggcgatgtttagtggtgtgttcacgtggctgactttgcctgtctttagcagaacacttcccctaaaagtacctg

SEQ ID NO: 6859560 - DNA, 62 bp, Homo sapiens
tcagatgagcatgggcacaagcatatgtaaggacacagacatgtgtttctccttgtttctga

SEQ ID NO: 6859561 - DNA, 82 bp, Homo sapiens
tgacctcactgcttcatgaggctgagagaagggaggaagggatcttcttgaagtcctccagaagttgcaccgagtggggtta

SEQ ID NO: 6859562 - DNA, 67 bp, Homo sapiens
ggtctcctgacctttagtcccttgctctttccactaaaacaagccaccaaaggtgatcaggatcacc

SEQ ID NO: 6859563 - DNA, 82 bp, Homo sapiens
caggattcagggtatttacactatgagcacagaaaaggcctttccttggttcctggctcacaggtgagatgcatgaaacctg

SEQ ID NO: 6859564 - DNA, 63 bp, Homo sapiens
tgatgcagtcatcacggcttttaggcctctcccattggcctcactttaacctgatgactatca

SEQ ID NO: 6859565 - DNA, 100 bp, Homo sapiens
agacatgcacacgccagggtctctccctgtattttcaggaatatggagaagccatcgtcttcctgaaaatacagggagaccccctgtcgtgtgcatgtct

SEQ ID NO: 6859566 - DNA, 59 bp, Homo sapiens
aatgttttgtagcccatgcttatggtgaagatccattttcaagcattagccaaagcatt

SEQ ID NO: 6859567 - DNA, 69 bp, Homo sapiens
atctctcatgaacctatacagaatcccagtaagaaattattgcatggatggatggttcgatggatggat

SEQ ID NO: 6859568 - DNA, 71 bp, Homo sapiens
catctctgcctctcaggtccctgagatcaatggcccaagatagtaggtgatgcctgagagtgccctggatg

SEQ ID NO: 6859569 - DNA, 57 bp, Homo sapiens
tcgggctcctgcacttggagaccagcctctgtgaaacacaggtgtagtgagtcatga

SEQ ID NO: 6859570 - DNA, 86 bp, Homo sapiens
gcctcctagaagtcactttctacttggtttctcaagttctttgtccttgctacttaagaatcaaagagaaatactttgaaggaggc

SEQ ID NO: 6859571 - DNA, 86 bp, Homo sapiens
ggcgtgggagccggggcccagggcagcagtgcagctcaccccagacccgggcacagcggcggctgcccggccacctccgcccgccc

SEQ ID NO: 6859572 - DNA, 129 bp, Homo sapiens
ggcgacaggaggcagctgccagcatgactttgaaaacccttggagatcctagaagacttgccacatgtaacgtggagcagctgctgggatcatttaggagaaatgcagaacttggcacccacccacgcc

SEQ ID NO: 6859573 - DNA, 75 bp, Homo sapiens
acaagttcaaaacgttttcaaaagtgaaaaagcttacaccaagtttgtcaagtttgcaaatacgtttgaaaaggt

SEQ ID NO: 6859574 - DNA, 61 bp, Homo sapiens
gaagagtttaattcttaaggtaatatggctctctagggcagaaactggaattaaacttttt

SEQ ID NO: 6859575 - DNA, 58 bp, Homo sapiens
gctggaggggtaataggatggggcagacagttataatcctcctgtgactcctccaagc

SEQ ID NO: 6859576 - DNA, 62 bp, Homo sapiens
gctttcaaatcctaattccaacaacaactggctaagtgactttgggcaagttaggatgaagt

SEQ ID NO: 6859577 - DNA, 57 bp, Homo sapiens
gctgtggatgctatggatcatcctcttcaaaggcaatttttccttggtctctatagc

SEQ ID NO: 6859578 - DNA, 57 bp, Homo sapiens
cctttccccgcgggaggtgccagctgatgtggcaggtgtatccccgcgtggggaagg

SEQ ID NO: 6859579 - DNA, 73 bp, Homo sapiens
ctgcagaatggggccaagtggatcattattttcaccagttgaaggagtcagatccggcatggtgtcatggcag

SEQ ID NO: 6859580 - DNA, 117 bp, Homo sapiens
ctgccaacccgaaggttttctttagactctgagtctctttgccagtcctaagcaatttaacttgcctggggaggaagggggacgctgtctgtagcaaaagaggaattcaggtggtag

SEQ ID NO: 6859581 - DNA, 63 bp, Homo sapiens
caggccctttcctgggcataggctcccagaagctaccagacatgccaagggagggacagcctg

SEQ ID NO: 6859582 - DNA, 92 bp, Homo sapiens
tctagttggcccaaagcagtagtgtcagtacagcaaattgtggtatgctctattgtcgtttgctgtgcttacatatgtattgaagtcagaga

SEQ ID NO: 6859583 - DNA, 58 bp, Homo sapiens
acctgaggagctcagcctcccatgaccaaccctgtgttgggctgtgcctcctcgtggt

SEQ ID NO: 6859584 - DNA, 64 bp, Homo sapiens
gtgtatctgtagctagagggagagtccagagcctactcctcttctgtcatgttgctgatatcac

SEQ ID NO: 6859585 - DNA, 56 bp, Homo sapiens
taagaggtagttaagtttcagtcacagttgagtgatttacccgtaactatttctta

SEQ ID NO: 6859586 - DNA, 99 bp, Homo sapiens
gattttcagagttgactacagatagccaattaagtacatagtcataccattgtttggtgataacaaatatatttggtcttatctgtagatgctagaatc

SEQ ID NO: 6859587 - DNA, 68 bp, Homo sapiens
ggggccggggacccctgccgcgcccccgtacccggacggggatggggcgaggaggggtgctgggcccc

SEQ ID NO: 6859588 - DNA, 55 bp, Homo sapiens
gagatgttttgctgagaatgggagctttggccttaaacttcagtgcagaacactc

SEQ ID NO: 6859589 - DNA, 61 bp, Homo sapiens
gtgcagtcaggttaaggccttcccaggcctctggcctgagagttgccctacttgtttgtgc

SEQ ID NO: 6859590 - DNA, 88 bp, Homo sapiens
gaggaagcacagttaacgatgggggcagtgttacattgcttgaagccttccttctcaatgggctggccttttggtattgtggttcctt

SEQ ID NO: 6859591 - DNA, 98 bp, Homo sapiens
tgttgcaaaataacttggtgtctatgattcagtttatgtaaaataataaatgtatgtaggaatacgtgtgttgaaagatgtacatcaatttgctaaca

SEQ ID NO: 6859592 - DNA, 55 bp, Homo sapiens
tgcaactgtttcttccaaatgccctgctacaaagggcatggaaacaaaggttgca

SEQ ID NO: 6859593 - DNA, 79 bp, Homo sapiens
aggggattaggaaggaacaaaccctgtgtggtggctcaatttctttgcctcaatcacaccagtttcctttcaattcttt

SEQ ID NO: 6859594 - DNA, 85 bp, Homo sapiens
tctgttaaccctcggcttcccttaaagttttctgtgttcattggtcagtttggaattagaggcataagagggaagcagggataga

SEQ ID NO: 6859595 - DNA, 62 bp, Homo sapiens
catcttcagcatccctgcctgtccctggcgttcagtgtgcccagcagcagatgttggaggtg

SEQ ID NO: 6859596 - DNA, 57 bp, Homo sapiens
gccaaaatgcagattcctgggtcccagtgattctgactcagtacatctggagttggc

SEQ ID NO: 6859597 - DNA, 57 bp, Homo sapiens
cgcatgcttcctttgcttcctttgcttctgcaagggaacaatgagcaagtgcatgtg

SEQ ID NO: 6859598 - DNA, 83 bp, Homo sapiens
gtggctcctccctgggcagctgtgggttccaagtctaacactttggttagtacccttggaaatgcagtgccctggaaacccac

SEQ ID NO: 6859599 - DNA, 61 bp, Homo sapiens
tgagctcctgattctcagagatagagactaatcatgtctttgtttgctgctttagggttta

SEQ ID NO: 6859600 - DNA, 92 bp, Homo sapiens
gagaattgcttgaacctgccaggtggaggttgcagtgagccgaggtcgcgccactgcactccagcctgggtgacagagcaagacaccgtctc

SEQ ID NO: 6859601 - DNA, 78 bp, Homo sapiens
agagagttccatgccctctgtactgccagtcagattttaacctttatttttgcccagtgctgacagggaggaacctct

SEQ ID NO: 6859602 - DNA, 87 bp, Homo sapiens
atgctgggctgtggcacggcatgtttgcggtaagctactcagatttaaggcccttagtgtaaattgtgcttgagataaggccagcat

SEQ ID NO: 6859603 - DNA, 82 bp, Homo sapiens
tctaataaattttgttggcattgccctttttttgaagtccaaatctttcaaatttggtatgcaagccatcaagtttaaaaga

SEQ ID NO: 6859604 - DNA, 82 bp, Homo sapiens
tggatgactgttggcaggcagaaaaatagaatataccaggttcccatataaagatttatttgttgctatgagtcatggtcca

SEQ ID NO: 6859605 - DNA, 130 bp, Homo sapiens
taaagattgattcaaggcagtgtggcacagtgattacagataagaagtcagatggagcaggtttgaaggtcagctctgctgttcttatgtgtcctgtagcctaagaagctgtctggtatacgatacatta

SEQ ID NO: 6859606 - DNA, 114 bp, Homo sapiens
ctgtacattcatcatatagtcagaattcatgatagtattttttgtgacagatagttcagactatcaagattttcaagaaaaatctctaaattggttttggtataaatgtagcag

SEQ ID NO: 6859607 - DNA, 56 bp, Homo sapiens
tcctgtgtctcagcgtgaagcatcacgagatgcacgagatgctcctgggacaagga

SEQ ID NO: 6859608 - DNA, 74 bp, Homo sapiens
gccctgtcctccagattatgctctcagttataaaagactgaggaggctaatttgaggatttcctgcataggggc

SEQ ID NO: 6859609 - DNA, 61 bp, Homo sapiens
ctgaggagttggtgaataagccccagccattcggatgggcaggctttccacgggctcccag

SEQ ID NO: 6859610 - DNA, 69 bp, Homo sapiens
aaaggagttaccaattcagacatctcttccacttgtggtgatggttaagttaggtaagtgacctctttt

SEQ ID NO: 6859611 - DNA, 64 bp, Homo sapiens
agtttgtctgtcttcaaagcctgcactctttccagaatattgtgctacttctagaaggcaaact

SEQ ID NO: 6859612 - DNA, 125 bp, Homo sapiens
gcataccgacttgaagtcaaattttactctgaaaatagtagctgaggaactttcattgaggttctaacctcctgaagtctctgttttctcatttgctaaatggataaaataacttcaaaaattgc

SEQ ID NO: 6859613 - DNA, 69 bp, Homo sapiens
ttaaagcataatgaatatctagagacttataaatatcagtgaccatctgggaatttattggcactttaa

SEQ ID NO: 6859614 - DNA, 67 bp, Homo sapiens
agagcctgtcaattgtaaagaggagaaaagaaaagaatgggctctctctgggcactgtatgggttct

SEQ ID NO: 6859615 - DNA, 98 bp, Homo sapiens
aataggtcattttttgatgtacatattgttttgtaaagtgtggagattatttaattgataagtcacattctgaaatccatgtgggtagatgatgtatt

SEQ ID NO: 6859616 - DNA, 58 bp, Homo sapiens
ggctgccggctggacctgagccagcgagaaggggcttgtgcgagttcagctgggagcc

SEQ ID NO: 6859617 - DNA, 66 bp, Homo sapiens
gagggggctgggatttgaacccagggctgcacaggtgaggcctgggttgttttttctaacctcctt

SEQ ID NO: 6859618 - DNA, 86 bp, Homo sapiens
acaataggtatggacaatctgagccatggctggggtccctgagcccagtgggcctcatgatggctcaggaagtaggtgctgaatgt

SEQ ID NO: 6859619 - DNA, 55 bp, Homo sapiens
gagtcaggtttctgcctatagagagacacattcctgaaggcttaactctgacctc

SEQ ID NO: 6859620 - DNA, 57 bp, Homo sapiens
ttcatgccaccttttaagtgaagcataaacatttgtgtctgcagaagatggcatggg

SEQ ID NO: 6859621 - DNA, 121 bp, Homo sapiens
tgggaactgcagtcatttgaaaagatagcaatcaagcatttctttcagagccctgttcatctttcagtggctttgcttctccagatgcttttgctctttcaattatctctgccttctccca

SEQ ID NO: 6859622 - DNA, 55 bp, Homo sapiens
ggcagttcagaggccaccagctcggggagtcccgtccgttgcttttgaaattgtc

SEQ ID NO: 6859623 - DNA, 78 bp, Homo sapiens
ccactactgttgggagccctggaagcacaaagatggatcaaacatgcccctggcatcaagggacttccagacaggtgg

SEQ ID NO: 6859624 - DNA, 78 bp, Homo sapiens
ctggtttttcgtcggggagacaatctcactgttgccaaacatgggtttcaggggcgtgctcttccccgacgagcccag

SEQ ID NO: 6859625 - DNA, 75 bp, Homo sapiens
gcagcttttcttgacaggtaaaatgctaccgcaattcagtggaaggcatttaggaactgcaatcagaaaacctgc

SEQ ID NO: 6859626 - DNA, 89 bp, Homo sapiens
gacaaagatacatgagcagactttcaaggagtgaaggcacttacattggctggactttttgcaggtcatttgagctggtgtattttttc

SEQ ID NO: 6859627 - DNA, 83 bp, Homo sapiens
ccccggctctcctctggatggtgtattgcaaggagggagctgttctccccattatgcagtcattatgtggagatctgctgggg

SEQ ID NO: 6859628 - DNA, 57 bp, Homo sapiens
gcccaggtggagtgcattggcatgatctcgactcactgcaacctccgcctgctgggt

SEQ ID NO: 6859629 - DNA, 116 bp, Homo sapiens
gagtagaaaagcccgacaaatggtatcttaggtgatcaaggtcaacattaataataataaataatttgatattttgcacgcttggtatgatataatgaaaatggcgctttcctctc

SEQ ID NO: 6859630 - DNA, 82 bp, Homo sapiens
gactgcccttacacagtgacattttccccgctatgtctcacagctttgaggcgtatgtcatggaatgtcacagagccaagtc

SEQ ID NO: 6859631 - DNA, 80 bp, Homo sapiens
gctgggcacacatggacaatgtatgtaagagtacagagcaatgtctatttacatggaatattgtcttgtgaaggctcagt

SEQ ID NO: 6859632 - DNA, 86 bp, Homo sapiens
gcaatggttaaatgggctaatatgtgctaaaaccagtgactgacaagtagcactatatgttagctattatcatcattaattattgt

SEQ ID NO: 6859633 - DNA, 75 bp, Homo sapiens
tcagatgatagatgctaaggtccctgaatgtgtggagcaaagccaactactcacccttagtgtactatcatgtga

SEQ ID NO: 6859634 - DNA, 71 bp, Homo sapiens
gtgtctttcctcttctggcaggcagggacatgaacaaatccgtgactcagcactgacccaggagatgacgc

SEQ ID NO: 6859635 - DNA, 72 bp, Homo sapiens
tgctaccattcatcattagttgtggaattcttgaaactcaaaaacttcagagtatctaactgatgggtagca

SEQ ID NO: 6859636 - DNA, 60 bp, Homo sapiens
ggcatcggaggctgaagtttcccgggttgaccaaccctggctccttatctctcctatgcc

SEQ ID NO: 6859637 - DNA, 84 bp, Homo sapiens
aggatgttgagtatcaatgctttaacagaaatcaccacctgcatgaggaaaaggtatgacatgaagcatggataactcacacct

SEQ ID NO: 6859638 - DNA, 58 bp, Homo sapiens
atggccttccctgggtcacagaactggtggaatgctggctttgtgccaggaaggttgt

SEQ ID NO: 6859639 - DNA, 79 bp, Homo sapiens
cttaggccagtgcttctcttcacacccaactcctccagtcctgggtcaagtggtggagagatgaggacacaggaagaag

SEQ ID NO: 6859640 - DNA, 61 bp, Homo sapiens
gtcagcgttattcttagcctggagagttggtacgtcccgtggcgcatgagagaaacgagac

SEQ ID NO: 6859641 - DNA, 60 bp, Homo sapiens
gagggatctttaggcagcctcaagctggaaggtgtgtgtggtgggcaggggaggtctctc

SEQ ID NO: 6859642 - DNA, 58 bp, Homo sapiens
gcttgttctcactactgcatggggatagggagtactcagaccagtgggataaataggt

SEQ ID NO: 6859643 - DNA, 57 bp, Homo sapiens
cctgagtcctgctgagcagagagggactttctgagtcttctctccaggttgcttagg

SEQ ID NO: 6859644 - DNA, 95 bp, Homo sapiens
tgctagtaaattatagaagtggaagccaaagtcttgacagtgaccttcaatgtccttcccgactggctcactccactcctatgacttttctgaca

SEQ ID NO: 6859645 - DNA, 66 bp, Homo sapiens
gaaagtgagcgttttcttggtcagttccgccaccacaggggtgctagtcataagaagcctcctctc

SEQ ID NO: 6859646 - DNA, 82 bp, Homo sapiens
ctggccaggcaggaggtggggagtccctgctgagggaggttgaatgcccccagagaagtgtcctacagctcctgcctgccag

SEQ ID NO: 6859647 - DNA, 79 bp, Homo sapiens
gattactgggagaaaattactgtgactagccatctggtttcccagccaatactgttgattcatagtgcttctagtagtt

SEQ ID NO: 6859648 - DNA, 127 bp, Homo sapiens
ttaggagcgatagatgataatagaattaaaagtaatctccaagggttgtgggtggtcacatgctagcattacaagtagctactctcaaggcctgtatggaggttgcctgtgcataagagtgggataa

SEQ ID NO: 6859649 - DNA, 82 bp, Homo sapiens
gtgtgtttggacgacggattctgggtggacttttggaccaactaaaagaccctctagagtcccagtgatctgcagagcacac

SEQ ID NO: 6859650 - DNA, 63 bp, Homo sapiens
tgtctggctgaagcttttgcagctcttcagtgatggagctgggatgataacctcagtcagaca

SEQ ID NO: 6859651 - DNA, 101 bp, Homo sapiens
cattccagttttattctcagacacacaacttctgcttagatagttcagagttcccataatcctgtcttagaaaaaggctgtggtcttagggaagtggaatg

SEQ ID NO: 6859652 - DNA, 69 bp, Homo sapiens
gacattgtaatcatgcatcagttagtttttggctctttaattttgaaagcagatgtttgattgcttgtt

SEQ ID NO: 6859653 - DNA, 76 bp, Homo sapiens
tgtgtcaaagaggcaggtgttactggaaactgcactaaattaaaagttttccttcaaacagcttttttttgactca

SEQ ID NO: 6859654 - DNA, 84 bp, Homo sapiens
cacaccctgaatcattgatgcttaaggtaaaacagacacctggtataccagatgtctcaatctaaacattaattcctctgtgtg

SEQ ID NO: 6859655 - DNA, 84 bp, Homo sapiens
tagtgagaggggttatgcttgacatttggaaagttcttaagtgagccatgccggagtgagaagctgaataacatccttacgcta

SEQ ID NO: 6859656 - DNA, 74 bp, Homo sapiens
ctgttggtggacagagataataaactgaacttagtagttgctataatcatttatgaggtttttgctatgaacag

SEQ ID NO: 6859657 - DNA, 83 bp, Homo sapiens
ggaatgcaggggaggggcatagttcaccatcacatgaattcaaatgtagtgaaggtttatttgtgcctttctccatctcctcc

SEQ ID NO: 6859658 - DNA, 61 bp, Homo sapiens
gtgcaaaatgctcatcagcgatggctgggagaactaccagagctggcagagtatcaagcac

SEQ ID NO: 6859659 - DNA, 78 bp, Homo sapiens
tgtataagtcacaggtccttataagagcactcaggaattgtctctcacttgtagtacttcagacctggtgatgataca

SEQ ID NO: 6859660 - DNA, 60 bp, Homo sapiens
gctgttctcccttgaacttggcttcacttctatccccaccatttagtaaggaagaacagc

SEQ ID NO: 6859661 - DNA, 57 bp, Homo sapiens
ttgttcactgctacatccaggtgcctgggaaagagccaggctcctagcagcatacag

SEQ ID NO: 6859662 - DNA, 79 bp, Homo sapiens
aggaagaagctgaaggaggctctggtactactcaacattgtactccaggtagaaccaccttctcctttaccaccttcct

SEQ ID NO: 6859663 - DNA, 59 bp, Homo sapiens
agactcagttttcatttcatgagcaggtatacaatctgttttaatggagactgatgttt

SEQ ID NO: 6859664 - DNA, 70 bp, Homo sapiens
ggtgctcctctcagctttgtagtcttctctaactcatccagcagccacagggccaggtgagaggtgctcc

SEQ ID NO: 6859665 - DNA, 105 bp, Homo sapiens
ctatgggattattgttgtgtactaggaagagcataccatggaattggaataggaattcctactctgtactttcttgttgtgtgatcttggttattttgcccatgg

SEQ ID NO: 6859666 - DNA, 73 bp, Homo sapiens
catctaagccccgtggaaagggaagcaccctgcacagtggcgtcatcattcatctatttccggggtaaagatg

SEQ ID NO: 6859667 - DNA, 67 bp, Homo sapiens
caaagaacacccagacgttgtggaaggaaaaaagttcatggatcttttacaacatttgtgttctatg

SEQ ID NO: 6859668 - DNA, 84 bp, Homo sapiens
tctgggcccttatgaagctcaagacagaagggacacatatagatagtattgaaagtttcaattcttgaacttcataggtctaga

SEQ ID NO: 6859669 - DNA, 56 bp, Homo sapiens
cccaggctggagtgcagtggcatggtctcggttcactgcaacctccacctcccggg

SEQ ID NO: 6859670 - DNA, 56 bp, Homo sapiens
gtttcctgactgtggaattatattgagtgattggactgattgcagttcaggataac

SEQ ID NO: 6859671 - DNA, 68 bp, Homo sapiens
atgaaagcaaggtgagcccatcattccttaaaagttgaggccatgacttaatcatacttgcattttat

SEQ ID NO: 6859672 - DNA, 109 bp, Homo sapiens
cttgcttcaatgtctgtgacaagagtagaatagcgagcagcaagaggcctcaaattttcaatgcctcgtcaaagtctggctgttcctgcctgtgataatatggaaatgg

SEQ ID NO: 6859673 - DNA, 81 bp, Homo sapiens
gaggagatcagtgtatttcctgcatggtgatgtaagtggtgagaaaaatgcggctgtggcggtgcaagaaataagctcctc

SEQ ID NO: 6859674 - DNA, 69 bp, Homo sapiens
gaatgaatctgtaagtgacaaggtacctgggttctaatcctgtctctgtcagtcacttacagaacattc

SEQ ID NO: 6859675 - DNA, 61 bp, Homo sapiens
ggagacagtgacttagagactgaggcaagagtgccgtggtcaatcatgggtcattgtcttc

SEQ ID NO: 6859676 - DNA, 74 bp, Homo sapiens
tgtgtaccttctctctcttctttgtaggggcccttttaggcttgggctctggctttggaggagcaggtttagca

SEQ ID NO: 6859677 - DNA, 97 bp, Homo sapiens
gttgatccatggaccacactttgagtagcaaggctgtaagagacattcatccttggagttctgtttggcttaaaaattgtgacccctctgtttcaat

SEQ ID NO: 6859678 - DNA, 79 bp, Homo sapiens
gctgggatagacatatttgaaaccaagagaaaaatgttttgaaaacacattcatcttctttagatagtatggttgcagt

SEQ ID NO: 6859679 - DNA, 55 bp, Homo sapiens
tctttgcagccccaggaagtggatcttgagtagtctactgacctctggccagaga

SEQ ID NO: 6859680 - DNA, 68 bp, Homo sapiens
taaggatttctttcattttgagttctatcttgtagtaaaacctgatagtttaatgaatgaattctttg

SEQ ID NO: 6859681 - DNA, 64 bp, Homo sapiens
ccaggatggtcaggtgggcagtgggttgagcgtgcagcctcgtacccagcctcctgtgtcctgg

SEQ ID NO: 6859682 - DNA, 72 bp, Homo sapiens
acagtttaattgatgtatcatgttttgtcgattataggaattacttgcatgattttatgttgatgtaactgt

SEQ ID NO: 6859683 - DNA, 71 bp, Homo sapiens
tcttgaagtgggagacatcgtggtatgttgagaaaatatgttgattctttatgacttttcccaattcagga

SEQ ID NO: 6859684 - DNA, 74 bp, Homo sapiens
tgccttgcaggttttaaatacatctctgacatgcaaaataaatcaatgtcatatcattttagagcttgaaggta

SEQ ID NO: 6859685 - DNA, 58 bp, Homo sapiens
ctgtgttgtgaaaaataaacagagctgtcgaataagctctgctctgtttcatagacag

SEQ ID NO: 6859686 - DNA, 92 bp, Homo sapiens
cagattcttagttacatcttcgagttggctttattaaactgagaaaaattgaagttatgatgcagctgcttgatttcaagtaacagaaactg

SEQ ID NO: 6859687 - DNA, 91 bp, Homo sapiens
atgagattcggactgtagaagttcagactgcctcagttcagactgcctcatggggcagtctggaggtcagctggcttctggtgtctctcat

SEQ ID NO: 6859688 - DNA, 66 bp, Homo sapiens
tggaggagaccattccactcagcattgattctgacatgagcctgaatgatgggatgcttttcttca

SEQ ID NO: 6859689 - DNA, 56 bp, Homo sapiens
cccctttgttttgcccttgcagcagcaaatgatgctctggcaggaagacggatggg

SEQ ID NO: 6859690 - DNA, 87 bp, Homo sapiens
acgggtccgtggggtctttggcatcgcaggcatccgcgtggccgtggcagacacagcggcctccgatgctgatatccttgatgctgt

SEQ ID NO: 6859691 - DNA, 61 bp, Homo sapiens
gagactctttcgtttcctggttctcacacgtggaatttggatctttgatagagtaggtctc

SEQ ID NO: 6859692 - DNA, 66 bp, Homo sapiens
ctagggtatgaatttggtgtacaggttgaacagtctgtgtataaaattgccaaatccatgcccagg

SEQ ID NO: 6859693 - DNA, 70 bp, Homo sapiens
ggcactggcagattcggtgtctggtcagggcctacttcctggttaatagatggcacctttctgctgtgtc

SEQ ID NO: 6859694 - DNA, 107 bp, Homo sapiens
gccccacccttatgacttcatttaaccttaattacctcctgaagaccctgtctctgggtatggtaacgttggggtttaggggttctacatatgaatttgggggaggc

SEQ ID NO: 6859695 - DNA, 99 bp, Homo sapiens
gcctgggggcccatcagtgctctgggctgcctgacatgaggcccttgggtctctgtgcctcagtgtcctcgagttccagttgagatgggtgcccatggc

SEQ ID NO: 6859696 - DNA, 64 bp, Homo sapiens
cgatgtgatgtgcaggcccacttcttaccccagatagcctcgggtgctgcctgtagtcatgctg

SEQ ID NO: 6859697 - DNA, 59 bp, Homo sapiens
ttttataaatacagagtgtgccagatgttgttcatctttggcacttctgttttaaggaa

SEQ ID NO: 6859698 - DNA, 77 bp, Homo sapiens
gcttgaacttccaaggcatgttctcaagtagaagtgtcctcctcacaactgctctgaggcacatgccatcggaaagc

SEQ ID NO: 6859699 - DNA, 85 bp, Homo sapiens
gccacaaagagggctccagcggtgtcggctgcctcggtgtgcggttcactgtggctgtgtccacctgctgccttcctctctgggc

SEQ ID NO: 6859700 - DNA, 59 bp, Homo sapiens
tatatacagtagtgcctctgttttatatttttaataaccagaggcaggctctgtgtgtg

SEQ ID NO: 6859701 - DNA, 70 bp, Homo sapiens
accaggcctctagctcttagactagctgtgctccatggcagatctgagccaagctcgatgttgctctggt

SEQ ID NO: 6859702 - DNA, 72 bp, Homo sapiens
tggctcttcaaactggggaacttatttattaaatagttctataatgaaagcacttccctagtcttgtgacca

SEQ ID NO: 6859703 - DNA, 81 bp, Homo sapiens
gtgggcagagatggcggctgttgtgttcaccaatttatccatggcatctagcgcagtggctggcacatagtagctgctcac

SEQ ID NO: 6859704 - DNA, 85 bp, Homo sapiens
agttatttatatactaggtcgccttgaagaagggattgtgttttcataaatcttaataatccctgaggcatcaagtacagtgatt

SEQ ID NO: 6859705 - DNA, 76 bp, Homo sapiens
ttcatgtgttaacatcctaacccccagtgttatagtattaggaggtggggcctttgggaaatagttaagacatgag

SEQ ID NO: 6859706 - DNA, 60 bp, Homo sapiens
taacaaaggttgccaaactaagtagcttttttgttgttgcttggttctggcctattgtta

SEQ ID NO: 6859707 - DNA, 84 bp, Homo sapiens
aaatctaaaaagtgtacatgtttacagcatctgagtatctccaataataagatgactttaatatgtgaaaacatttgtggattt

SEQ ID NO: 6859708 - DNA, 126 bp, Homo sapiens
taatgatgttctgtgactttcagtatagcacggggggaatatttagggggaaaaaatgacctgcttaaatagtcaaatcagtggcaattattgagataacagtcattcaatcatctaacgtcatta

SEQ ID NO: 6859709 - DNA, 67 bp, Homo sapiens
ctctgaaagttagagaaaataggtggccataagccttaagccatataatgagtttaaacattcagag

SEQ ID NO: 6859710 - DNA, 74 bp, Homo sapiens
ttgtccttcctaaaagaatacactggatgatgaaataatacaggcatccaagattacttcttttgggaagacag

SEQ ID NO: 6859711 - DNA, 72 bp, Homo sapiens
agctgaaccttagtctggagtgaccctaccaaggtccatcacacccagggagatccaggctgagagtcagct

SEQ ID NO: 6859712 - DNA, 70 bp, Homo sapiens
aggctgtacatacctgaaagcaggaattatacttctaaattttctatgcttatcgtttagtacattgcct

SEQ ID NO: 6859713 - DNA, 85 bp, Homo sapiens
ttcctaagggcagggaccgtgtctgcccattcactgctatagttcagcatggggctggcacagtctctattaactactttgtgaa

SEQ ID NO: 6859714 - DNA, 76 bp, Homo sapiens
gccattccacagagaccagttacagcgtccaggtaggtaaaaaggcaggatcctgaagactgggctcttgaattgc

SEQ ID NO: 6859715 - DNA, 85 bp, Homo sapiens
ttccctgttgctgtccttcctggataactggggcaattttattcttaaagttttcctgtgtccaagatggcagccaagcagggaa

SEQ ID NO: 6859716 - DNA, 85 bp, Homo sapiens
aggggcaacttattggagaattggagaatcagaattgcaagttctttttgtcattgactttgtgccatttttataaaatgcctct

SEQ ID NO: 6859717 - DNA, 69 bp, Homo sapiens
ggcactgacacgtggagaattccgaagcctcacctgctatacgtgaggtttatgattctgcacgtggcc

SEQ ID NO: 6859718 - DNA, 75 bp, Homo sapiens
aaagtaccctgaccatagttatttttcccacatgctgagaaactgagaaactaacctggtagggttccaaacttt

SEQ ID NO: 6859719 - DNA, 63 bp, Homo sapiens
gtgcatcctgggctgacttacttctgccagatgtggtggaggtcccagtctgtgatgactcac

SEQ ID NO: 6859720 - DNA, 63 bp, Homo sapiens
atctgaaagtatatttcctgctgtttatctgcttccagaactggctgaagtttactttttggt

SEQ ID NO: 6859721 - DNA, 78 bp, Homo sapiens
acaatagcagttttctattctccttgggatattctgcaacatcctaagtttagcttgagatggaaagcctgtgtgtgt

SEQ ID NO: 6859722 - DNA, 106 bp, Homo sapiens
cccagaagagaccccatttctcagtctcctctcacagttaagtgtggccaaatgaccaagttgtggccaatggctcatgagcaggaccgacgggtctaattctggg

SEQ ID NO: 6859723 - DNA, 105 bp, Homo sapiens
ggctcttcattgcgccagaagtgacaatgctgtgctcctcatgaggctccagtggaagctgaatcctcacagaggggcagccatctgggactctgggtggaggcc

SEQ ID NO: 6859724 - DNA, 68 bp, Homo sapiens
tcttttgtgtggcttaatatttatagcagattccaagtctcctttgaaagttaggactgtccaagaga

SEQ ID NO: 6859725 - DNA, 59 bp, Homo sapiens
gccaaggataccagctgtgagatttgaacaagttactcaaccttgctgagtgtcctggt

SEQ ID NO: 6859726 - DNA, 57 bp, Homo sapiens
agtgcagggggaaagggtgtcttatcagcaagggacaacagttttctcatctgggct

SEQ ID NO: 6859727 - DNA, 99 bp, Homo sapiens
gagaatagttattggtctgagctcaagtgacagttaggaaatctgtctgttcccgaggcctcaggctgattgtcaagggtacaggcagatgatgttctc

SEQ ID NO: 6859728 - DNA, 77 bp, Homo sapiens
gttcaatgtcatttaaagagttctgtttgagctgaaaggggagaatccttgtttagggggcagaggtggcattaggc

SEQ ID NO: 6859729 - DNA, 76 bp, Homo sapiens
cctaaatgtgtgtaccaccagttcaagtaattttcctttagttattgggacttaaaggtaaagattgccatttggg

SEQ ID NO: 6859730 - DNA, 65 bp, Homo sapiens
tgtgtgtgtgtgtgtacagctcctttatagatgcatttatttctctgtctacatatatacacaca

SEQ ID NO: 6859731 - DNA, 57 bp, Homo sapiens
gtgggctcctggcagtcatgctcatcaaccgcatggcagaggcagtcatgaccctgc

SEQ ID NO: 6859732 - DNA, 114 bp, Homo sapiens
tggagcagggcctgtgtgagagggagatggtgggaggccaggtggcagccttcattcatttcttcactttgcctctggccatcccccattaagctagaacagagtcctgctcca

SEQ ID NO: 6859733 - DNA, 61 bp, Homo sapiens
gttgggtgagggacaaaagtttcttcaacaaattaccagagtactgcagctctcactgaat

SEQ ID NO: 6859734 - DNA, 62 bp, Homo sapiens
gcgccttgagcctccaaggttgccttatattcttggcaaaagtacactggttgttcaagggc

SEQ ID NO: 6859735 - DNA, 78 bp, Homo sapiens
gtgtgttcagccctactgttatatatagcagcagtattcttttcaattgctgaataatattccactgtatgaatatac

SEQ ID NO: 6859736 - DNA, 63 bp, Homo sapiens
ggcaagggttgaagataaataaggtagcaacgtctactttatatttttggccttaactatgcc

SEQ ID NO: 6859737 - DNA, 109 bp, Homo sapiens
gccaagcacacagacccacccctggtcccatgaggaggctgtggagcactccatctgtgctcgggtgaagggttaagctgcctcccctcatgggagggagggtgctggc

SEQ ID NO: 6859738 - DNA, 83 bp, Homo sapiens
ctaattgtgtttgcaatagccttatttccaaatgagtttacattttgaggaagtatgggctaggatgtcaacactgaatttgg

SEQ ID NO: 6859739 - DNA, 59 bp, Homo sapiens
ttgatatagcggccagatgtgactttggttgttttcccttcatatgtggttgtatacaa

SEQ ID NO: 6859740 - DNA, 67 bp, Homo sapiens
ctgtacaaagacaggtagcaggacagatatggcgcacaggctgtactttgtggttcctgtcttacag

SEQ ID NO: 6859741 - DNA, 117 bp, Homo sapiens
tataaagccatccagtattttgtttggtatttatgttacagcagcccgaatggactaacatgggttgtctagttttgggtgctgatatgaatgttcatattgtactgggtctttgta

SEQ ID NO: 6859742 - DNA, 68 bp, Homo sapiens
tctccagagtcacactgcctgggtttggatcctgattctaccactccactgccagcgtgactttggga

SEQ ID NO: 6859743 - DNA, 59 bp, Homo sapiens
gctttcccgccaagtgcagccggaggacagacagccatgcgtgtccttggcgggagagc

SEQ ID NO: 6859744 - DNA, 68 bp, Homo sapiens
tctttctggaccttatttataggtaggcagattctaaatttaggcctctataagcagctccaggcaga

SEQ ID NO: 6859745 - DNA, 61 bp, Homo sapiens
actctgacttccttttctgatccagttgataattgatccgaaacttgaaggaagtgagtgt

SEQ ID NO: 6859746 - DNA, 57 bp, Homo sapiens
ctgggcagtttacattcctaccacctggcttggggccggaatgtacaggccgctcgg

SEQ ID NO: 6859747 - DNA, 60 bp, Homo sapiens
gcgcggcctcacccctcggtgaccctgcggagagccgcgcgcgggcggtggggcgcgcgc

SEQ ID NO: 6859748 - DNA, 83 bp, Homo sapiens
ctgtgttcaattaagaggctaagttactctctctgtgggagcctttgaagatcccaggtaatggcttctataattctactcag

SEQ ID NO: 6859749 - DNA, 63 bp, Homo sapiens
atttgggagggaccctaaactgagcgttgcttgggtcagccgctcagaggttctgtccttggt

SEQ ID NO: 6859750 - DNA, 56 bp, Homo sapiens
gtacatgtaaagcatccttctagggtgaacgatcatccaggaaatttttacattac

SEQ ID NO: 6859751 - DNA, 65 bp, Homo sapiens
tttcacttcttcctctttgtcttgagtcagcagtgactgggatgtctttaggggaagagaagagg

SEQ ID NO: 6859752 - DNA, 83 bp, Homo sapiens
tccagtctatagtaaagcatgaattggagagagagacttgaggtctaaacttcactttaagtgcttgatctataatgatggga

SEQ ID NO: 6859753 - DNA, 70 bp, Homo sapiens
ctgagtcaaagtctgtcttgtaacatgatccccagatgatcagtgtgcacgatacagattgagagctcag

SEQ ID NO: 6859754 - DNA, 91 bp, Homo sapiens
gtggatgggcagctccatcctggccttgctgtccaccttccagcagatgtgggtcagcaagccaggagtatgatgagtctggcctctccat

SEQ ID NO: 6859755 - DNA, 65 bp, Homo sapiens
gctgctgctgtggagataagcagtccagcccctgagggatctggaaggttcctcccagctccagc

SEQ ID NO: 6859756 - DNA, 72 bp, Homo sapiens
tacccttaggtagctgacgttttaggtgttaaatcgaaggttattgaagcatttgcagatgtgccttgggtg

SEQ ID NO: 6859757 - DNA, 73 bp, Homo sapiens
gattagtattttcaccatatgaggtaaaacattttaatcattgttatcttattgtgatgatgaagaactaatt

SEQ ID NO: 6859758 - DNA, 85 bp, Homo sapiens
gttcttttcatgatgaaactgttatgtatcttgattgggtggtggtgatcctatgactctatgcatgtttcacaattcaaagaac

SEQ ID NO: 6859759 - DNA, 100 bp, Homo sapiens
gaagtccagggagacctagcacagcttctccttgatatcgcgcatgatttcccgctgggctgtgttggtgaagctgtagcctctctccttgaggatcttc

SEQ ID NO: 6859760 - DNA, 69 bp, Homo sapiens
tgactaccatccttaggctgaagtgattgtgaaggaaaagacatctattggagtatggggctggagtca

SEQ ID NO: 6859761 - DNA, 59 bp, Homo sapiens
gggacggcatcatgggggtggtttctcatggttcagcgccagccccttggtactgtcct

SEQ ID NO: 6859762 - DNA, 55 bp, Homo sapiens
gaactctgaggagaaagagcttggtgccagatgcaatcccaggaactcagggttt

SEQ ID NO: 6859763 - DNA, 89 bp, Homo sapiens
ttaagcatattatgtagatgcacttgcgtgtttgcaaatctcttcccaacgagggatttgattcttcaagtgcctgataagatgtttga

SEQ ID NO: 6859764 - DNA, 56 bp, Homo sapiens
gcagccctcatcccgcctgcgttccacatgaacaggtctctgggcttgagggtggc

SEQ ID NO: 6859765 - DNA, 80 bp, Homo sapiens
agcattcattttggggagctgagaaacaacattctaaccctagattgttcttgcctctgttcattgccataatgaattct

SEQ ID NO: 6859766 - DNA, 70 bp, Homo sapiens
cttcctacaggtgaagtattacactaagggttttatataaaatctcattgatccttatactttacggaag

SEQ ID NO: 6859767 - DNA, 78 bp, Homo sapiens
gcagtgacatcactccagggttgggcttgggctggctgtgctcagctgagcccctgtaccctgagtgcttcccactgc

SEQ ID NO: 6859768 - DNA, 70 bp, Homo sapiens
aggctttcttaggtcaggtatcagcaggtattgttcaatgtccactgcctctcaggatgcttgacagctt

SEQ ID NO: 6859769 - DNA, 116 bp, Homo sapiens
tacatgataaagaaactgtagagggaagagaaatttgaaattgaagatatttacccatcttccaatggtttctagatttttcctactttctttctgacctgaaattttttcattta

SEQ ID NO: 6859770 - DNA, 86 bp, Homo sapiens
accatgccttccctcagtccctctcatcttcacttagattccatcccatagtgagtcagtgacatgaacttgtggggagacatggt

SEQ ID NO: 6859771 - DNA, 90 bp, Homo sapiens
gatggaagcaggtttaaaattttacataagaagttacctttttcaggtaatggtgtttttctgtaattttcccaaacctttcgcttcctc

SEQ ID NO: 6859772 - DNA, 66 bp, Homo sapiens
gcacccagtaagcatgaggccctgggcgcagcacgccttcaggagctggtagtctcattgggatgt

SEQ ID NO: 6859773 - DNA, 92 bp, Homo sapiens
attttagaggattcatgttcacctgtggcactagtggttaaaataataattaacatgactgttgccatatgggggcacgtaaaccctgagat

SEQ ID NO: 6859774 - DNA, 95 bp, Homo sapiens
gataaggaaacgcacaaagaagttagatgacttgttgaaagtatctattatttaacataggcagcatctcatttgacttctgcattttctttatt

SEQ ID NO: 6859775 - DNA, 88 bp, Homo sapiens
actgttttggaaatgcaaattccaaagcacatcagaactatgtcatcatggcattttgcctgctgttttgggtcatttacataacagt

SEQ ID NO: 6859776 - DNA, 82 bp, Homo sapiens
tgtccttgtttaaacaaaatggaatattttccccttaataaaactcttgggaagaattgcccatttctgtctttcagggaca

SEQ ID NO: 6859777 - DNA, 56 bp, Homo sapiens
attgtacaggttggaggaagtggacttcagtttgtccttagcaacactgttataat

SEQ ID NO: 6859778 - DNA, 55 bp, Homo sapiens
gtggccccttgggggctccaggcaggaaagaaagcagagccctctccatggccac

SEQ ID NO: 6859779 - DNA, 125 bp, Homo sapiens
gaaatagaaaatagcattaacggggttttaaagcttgtattgcaatatttgaaacattagaaaaaaatgaatatgtggaagatatctgcaatataatttaaaggctcattagttcaatttatttc

SEQ ID NO: 6859780 - DNA, 70 bp, Homo sapiens
acccttctgcagggcaggtccccaagccccgtatctcaggttctgaccaggatgtgtcctcagcagtggt

SEQ ID NO: 6859781 - DNA, 61 bp, Homo sapiens
tgcatctcctctgggaaaagcgtgagttcccttgaaagccaatgccttctagaggagtcca

SEQ ID NO: 6859782 - DNA, 87 bp, Homo sapiens
gcgtgtggggccagcacaggtcagttttttaagagcctccgtagaacagggtcttatttttgttcctgagctgaaatgcacacatgc

SEQ ID NO: 6859783 - DNA, 59 bp, Homo sapiens
gtccctgtgatccataggcatccagtgtcactagaaactggagaatctgaatacaggac

SEQ ID NO: 6859784 - DNA, 62 bp, Homo sapiens
ccggctggttaggtgagggtgcgccagcatcagcctggctggctccacctaggtagctccgg

SEQ ID NO: 6859785 - DNA, 64 bp, Homo sapiens
ggctgccagtgagtgcagaccggagactagacagaaaggtctcaaagagcagtcctggccagtc

SEQ ID NO: 6859786 - DNA, 59 bp, Homo sapiens
aagcatggcctctccgctcccctccctcctcaagagtccggtggtgatgagccatgttt

SEQ ID NO: 6859787 - DNA, 86 bp, Homo sapiens
gtgttgcagggcagagggtgcctcacctggccaagtctctggatagcctggtgccaacagagctcccattctatctctgccagtgc

SEQ ID NO: 6859788 - DNA, 55 bp, Homo sapiens
tcctccacgatggcacacctggtggctggtcactgtggctgcaggcgatggagga

SEQ ID NO: 6859789 - DNA, 77 bp, Homo sapiens
gggggtctgttgaagtgtttattttggccttcccatgggtgaaggcccagcttgaatgctgcccatgagagacccct

SEQ ID NO: 6859790 - DNA, 58 bp, Homo sapiens
agagctgtttttccaaactattgagcatggtgacttagtgattggaaaaactagtttt

SEQ ID NO: 6859791 - DNA, 76 bp, Homo sapiens
tctttgaggactaacttggcagacgcagccaggtgtgaacagcgcttatgtggctgccgcggtgcttcctggaaga

SEQ ID NO: 6859792 - DNA, 64 bp, Homo sapiens
catcatctgtgctggagagccttgagtatatcactttactacggagattccagccaggttgatg

SEQ ID NO: 6859793 - DNA, 62 bp, Homo sapiens
tcttaggcagccttctgttatagcacatcatctccaccgctacagaggcatacagcttaagg

SEQ ID NO: 6859794 - DNA, 57 bp, Homo sapiens
gtctttcaagtgttccaggcattggtatgttctagtgttctcagctactagagagac

SEQ ID NO: 6859795 - DNA, 57 bp, Homo sapiens
tacaattactacagctaataaagtgcaactgaagagcacatagcagcagtaattgtg

SEQ ID NO: 6859796 - DNA, 59 bp, Homo sapiens
acaccgtcaaggctactgagtgccctgtgtaggttcagggctgtggctttgtgctgtgt

SEQ ID NO: 6859797 - DNA, 91 bp, Homo sapiens
gagccagccccagcccgcctggccgctcgagtcacccttacccctcccgaggagtggcgaggggaggtcctggcggcgccggcggcggctt

SEQ ID NO: 6859798 - DNA, 78 bp, Homo sapiens
gctagctcaggtgagtttttccaaacccatgtagaacggacaaaacacatgcagtgctggagctgccacttgagctgc

SEQ ID NO: 6859799 - DNA, 79 bp, Homo sapiens
taaggactcactcattgatttatagaatgttcaagcctcctggttttaactggactgaagtttatctgagtaattctta

SEQ ID NO: 6859800 - DNA, 60 bp, Homo sapiens
ggggcagagaaggattgaaaccagagcccatcactactctcctctctgcctttctgccct

SEQ ID NO: 6859801 - DNA, 57 bp, Homo sapiens
acagagcaggtccagaagtgccaggacaggttgtcaggcttggaccttctgctctgt

SEQ ID NO: 6859802 - DNA, 129 bp, Homo sapiens
gtacttggttgctacagcccttggacaatgtccaccgtgatgatggaatgtgaagataaataagacacaattcctgtcatcacagtggccacaatctagaaggcacagctgtggacatttttaaattac

SEQ ID NO: 6859803 - DNA, 72 bp, Homo sapiens
ctgtgcttctcaaaaggaggtaggtggaccattttcatcagattcacctgaagggcttattaagaagtacag

SEQ ID NO: 6859804 - DNA, 59 bp, Homo sapiens
tactgatgatttttcagcagaggatctcagtcaggtttgttttggaaagatcattggta

SEQ ID NO: 6859805 - DNA, 77 bp, Homo sapiens
atttgtaagggaaaggggatattatgctgtgcactggtaataaggctaagtgaaaatggtttcccagccttacaaat

SEQ ID NO: 6859806 - DNA, 62 bp, Homo sapiens
ctgaaaaagacatttgggtcactgagtgactaaaagcactctctgtttacatgtttcttcag

SEQ ID NO: 6859807 - DNA, 67 bp, Homo sapiens
tctgtgattccgtggcattttatttgttcatttatgacagcactttaaatgttcacggaaataatga

SEQ ID NO: 6859808 - DNA, 70 bp, Homo sapiens
gcctccctaccctccccgcaacacaccctctaggaccctaggctaggcttggaggcaatgggaaggaggc

SEQ ID NO: 6859809 - DNA, 66 bp, Homo sapiens
tgctgtttccagcctagagatggtgaggggacttttccttggctctttcctggcctgctagcagca

SEQ ID NO: 6859810 - DNA, 64 bp, Homo sapiens
aaagttagaagcacaaagtgtagttccgaagagaacctcttgctgcctttcgtgttcctccttt

SEQ ID NO: 6859811 - DNA, 67 bp, Homo sapiens
acattgccacttgccactttatagttcagctaatacagcatgaagtataggtaggaggatggtatgt

SEQ ID NO: 6859812 - DNA, 62 bp, Homo sapiens
ttcctgagagctttgatgcactgtttcctgttgtaggatgggcaggcactggctctcaggga

SEQ ID NO: 6859813 - DNA, 55 bp, Homo sapiens
acaggtctccagagtgagaggatgaatgccatctcctctttatggaaaaacttgt

SEQ ID NO: 6859814 - DNA, 56 bp, Homo sapiens
gtttaggagataaatttcaggcataggggatcttttctatgctcctatctctgagc

SEQ ID NO: 6859815 - DNA, 116 bp, Homo sapiens
gttttgcctacatccacctgcattcccagttatgagaggtcaactcctatgagctttgtatggttcagtggatatttctgtggctggaaggtgatgcatggtgatgaaagtaaaac

SEQ ID NO: 6859816 - DNA, 59 bp, Homo sapiens
ttccaaagcacttgatgtaaagtaataaaactactgtacataaaggtttgactttggag

SEQ ID NO: 6859817 - DNA, 82 bp, Homo sapiens
tgactcaccaaggacactgatgttcatcctgtagataggaggctaccattaaagggttaaaatcaggtcattgacaaggtca

SEQ ID NO: 6859818 - DNA, 66 bp, Homo sapiens
atttttggagaatctttcaaggcctgttcctcaattttagcaggcagaaaatagtcatccaaaaat

SEQ ID NO: 6859819 - DNA, 66 bp, Homo sapiens
aggtggcagagcagagtgattgttctggcctctgttgccagatgggctaactctgctctgtaactt

SEQ ID NO: 6859820 - DNA, 60 bp, Homo sapiens
ttttggtgcacctagctttttctaggaagttctaaccctacaggaggttgtgcagtagaa

SEQ ID NO: 6859821 - DNA, 68 bp, Homo sapiens
tgagtactgggaccaaaagttgggctctacttcctgaactcaaagagcttgcttttcccagtactgca

SEQ ID NO: 6859822 - DNA, 62 bp, Homo sapiens
tgcagcgcggccgtgttgtcactgtgcagcagtgcgtgcaggaaggcgcggctgtgcctgta

SEQ ID NO: 6859823 - DNA, 104 bp, Homo sapiens
gggaagaaggggggaacatggatattggggagcatcagccctgtctgctgaaaatcaacactcagagtgcatctcctatttgtagtctctactccttgctttct

SEQ ID NO: 6859824 - DNA, 65 bp, Homo sapiens
caggcttgggtcagaaggcttgttccttagtcacatgttgctacaagtaaatgacaccaggcctg

SEQ ID NO: 6859825 - DNA, 124 bp, Homo sapiens
gtttgataaatttaggagtattttaatttcataggctaatttctaaggattttctcagacttcatcttatgagatgacttaatgttggtcatatcattgaagcttttctatttttccatcaaat

SEQ ID NO: 6859826 - DNA, 62 bp, Homo sapiens
atcagttaactgtctcaggccatgggcgctattgacattgatagttggctttgagaactggt

SEQ ID NO: 6859827 - DNA, 75 bp, Homo sapiens
taggaagcctctgctctggggctccccaccagagagactttcttgggattgccctgcagttcgggatgctttcta

SEQ ID NO: 6859828 - DNA, 76 bp, Homo sapiens
tcaatgtatatatgtgtatatatgagtgtgtgcataggtgtatttgcacaaatttgtgtatgctcacgcattttga

SEQ ID NO: 6859829 - DNA, 61 bp, Homo sapiens
ccaggcaattctgaaagcatttagtgataaacacattcacagagtgatggatgttgcctgg

SEQ ID NO: 6859830 - DNA, 68 bp, Homo sapiens
gttttagacttgtatgtaaagccaggaaagatcttcctattgtaagggcttacatatagtcataaaac

SEQ ID NO: 6859831 - DNA, 59 bp, Homo sapiens
ctcgtgctggggaggcagcagagaacacagtcaccttgacatgttttcttccccgggag

SEQ ID NO: 6859832 - DNA, 66 bp, Homo sapiens
gtggctgcagagccagcaagctccttggagttgcatgagaaggacaggtttgcatggttgcagaac

SEQ ID NO: 6859833 - DNA, 62 bp, Homo sapiens
ggagctggagtgcaggttggggttcgtgaactaacaaattcctgatcaagttttctggctcc

SEQ ID NO: 6859834 - DNA, 57 bp, Homo sapiens
gctaggttggggaagttctcctggattaatatcctgcagagtattttccaacttggt

SEQ ID NO: 6859835 - DNA, 74 bp, Homo sapiens
ttcagcagaactttcaaggaacctgggaacctatcatgaggcatggttgtcctgcagctcctgttcttgctggg

SEQ ID NO: 6859836 - DNA, 75 bp, Homo sapiens
gcttcagttcatcttgcttttcaaactcctgcttcacagaaccagctttgacctaaagtaggaaacagcagaagc

SEQ ID NO: 6859837 - DNA, 78 bp, Homo sapiens
ggccattgtcagtttaatatagtcaatgtaactgaagaatgggttaccttgactagaattatttaatcgacagtgacc

SEQ ID NO: 6859838 - DNA, 92 bp, Homo sapiens
gctgtgcccagcagtttattcctaactctgaatcctcacagcagccttggtgggttggagtgacagatgaggaaactgaggctgggagaggc

SEQ ID NO: 6859839 - DNA, 80 bp, Homo sapiens
gtggagtcagcagttctgtactttagagtaatatgagaatcacctggaacacttacgaaacacagattgctgagctccac

SEQ ID NO: 6859840 - DNA, 87 bp, Homo sapiens
cttgctaacaagcatttagttagtaaatgtttgtacacctagcagaactgtacctgagacttggtttaattaaaatgtgttagtaag

SEQ ID NO: 6859841 - DNA, 57 bp, Homo sapiens
aagccagcattttcccattccttacaggcccctcatgaggtgaagggagtgctgctt

SEQ ID NO: 6859842 - DNA, 69 bp, Homo sapiens
agaatcctgatgaaaaggagagaacgtgggagaataaaagactatcataagtcttttcatcaggaatct

SEQ ID NO: 6859843 - DNA, 62 bp, Homo sapiens
agccatagggttgtcttggtccattgttgttgctataacgaaataccacaaactctgttgct

SEQ ID NO: 6859844 - DNA, 91 bp, Homo sapiens
gagtggtgaacgtttgttgctgatttccccttgagtgttcacttgagctccgtgcgcacacaagatgcggagacatgtgatgctgctattc

SEQ ID NO: 6859845 - DNA, 57 bp, Homo sapiens
gacatggtccctgttgtctctgcacttacagcctggaaactagcagcaaccatgatc

SEQ ID NO: 6859846 - DNA, 75 bp, Homo sapiens
tggcctccagtgccctccttgggggcctgttgcctctgccctggcccccagcagaggaggtgcccctggctgcca

SEQ ID NO: 6859847 - DNA, 76 bp, Homo sapiens
ggcctggcttccatatggcacatagtggcttttctaagactgttcacatgtctgccaatgaggaatggccctggcc

SEQ ID NO: 6859848 - DNA, 77 bp, Homo sapiens
cctgacagcctgaggcttctgtaaccctgtcctagggaccccgtgaaggataggggcagggagcagggctggacagg

SEQ ID NO: 6859849 - DNA, 60 bp, Homo sapiens
cagatctcacctctgtgtattatttgagaaggtaggaaatgtcggacagattgagatctg

SEQ ID NO: 6859850 - DNA, 69 bp, Homo sapiens
gtccatgccattaacattagctagcagacatcaagctgcctagtggataaaatgttgtttgacaagggc

SEQ ID NO: 6859851 - DNA, 89 bp, Homo sapiens
gtactcaggcagagctctgccttgacaccttctcaaccttctccacagaatctgggggacatagtcaggggcagtatttgccatgagtc

SEQ ID NO: 6859852 - DNA, 66 bp, Homo sapiens
gcactaaaccaacatgtaataagtatttaatagttgttcattgctgttgttattgttggttggtgt

SEQ ID NO: 6859853 - DNA, 59 bp, Homo sapiens
cagaaggcatagaccggattatgcaatcactgagaagtagcttctggatgtgttttctg

SEQ ID NO: 6859854 - DNA, 61 bp, Homo sapiens
agccctctaagcaagagaggaagtttcattcctgaactggctttctattcttagaggggct

SEQ ID NO: 6859855 - DNA, 62 bp, Homo sapiens
ccttgctctctttgaaagatcttattaaatacaatgatctcattctttcaaagggagtgggg

SEQ ID NO: 6859856 - DNA, 64 bp, Homo sapiens
ctgtgccactcagtttgattgtttcagtgatggatgggaatttgaagctgtcagaggtggacag

SEQ ID NO: 6859857 - DNA, 68 bp, Homo sapiens
tgccttccctggcaacaaacaaggtctttccttccccaggaagggtgtgtgtgagggacacaaaggca

SEQ ID NO: 6859858 - DNA, 80 bp, Homo sapiens
ggaattagtgcaggcactgcagattacaggcgcagttactggtgagattgcgctcacttcagatgccaactgtaagttcc

SEQ ID NO: 6859859 - DNA, 62 bp, Homo sapiens
ttgtcattctgccaatttgttagtacataaagatcagctgaaaacaaattggcaaaatgcaa

SEQ ID NO: 6859860 - DNA, 69 bp, Homo sapiens
gaggagaattttaaccaggacatcagatggctcccagtggtcttagccactgtctggttttctctcttc

SEQ ID NO: 6859861 - DNA, 62 bp, Homo sapiens
cgtgggtataggatatttccgccattgtaaaaagttcaattggaaaattccatacacccacg

SEQ ID NO: 6859862 - DNA, 62 bp, Homo sapiens
gtggtggggttggaagcttgaagacaaaaaataagagtttcttcgcattccctcctctctac

SEQ ID NO: 6859863 - DNA, 130 bp, Homo sapiens
gtaccttgaaagaagggtttatttcctgactgtcagtcaactgtggcctgattagagggagcaggatctgaggaggtcagagtctggctgtggagtcatttctgatgagtttttcttttacctataatac

SEQ ID NO: 6859864 - DNA, 69 bp, Homo sapiens
ctgctttagattttactaagtggatatctgtctagtaagagagaagcaacacttggtaagactaaatgg

SEQ ID NO: 6859865 - DNA, 128 bp, Homo sapiens
tcgccacagcgcgaccaggccagcgatgagggactggcatccggaggcttcaccctccgctccacagggtcggcagcagagcggggcctccggaagctccgccccacgcgttcccggggcgcatgcga

SEQ ID NO: 6859866 - DNA, 60 bp, Homo sapiens
aggttatatgtcatactgaagtcatacagctgacagtgagatttttatatgtattagcct

SEQ ID NO: 6859867 - DNA, 62 bp, Homo sapiens
ggccaaagctggactgctcagttcattttccagttcagtagctgtagtaatccagcttcgcc

SEQ ID NO: 6859868 - DNA, 57 bp, Homo sapiens
ggtgcagagtccacagaaagctgtctaaatacatgcttggggtgggtctctgatacc

SEQ ID NO: 6859869 - DNA, 58 bp, Homo sapiens
aagtttgtggtcatttattatagcgcccagaaggcactaaggtaatggccaagaattt

SEQ ID NO: 6859870 - DNA, 78 bp, Homo sapiens
ccaagagctacagatatgaaatcaggaaaggtggagacttacccacagctctgccaatgtcatactgtgtgttcttgg

SEQ ID NO: 6859871 - DNA, 130 bp, Homo sapiens
ctttccagaaaccacacttgagtccacagcagagcggaaggggcaggaggcatcaggaccatttccagatttctctctggccctgattgtctagatttgcatccaatcactgcaagagtttatacaaaag

SEQ ID NO: 6859872 - DNA, 64 bp, Homo sapiens
ttctgcatctggctgtgccttgtttcgaaatataatggaagcaacactgccttcaggtgaagaa

SEQ ID NO: 6859873 - DNA, 84 bp, Homo sapiens
ccatgaaaattggattgggagaatgtgagatatagattagattccatatgatcattattttgtcaaatccattttctattatgg

SEQ ID NO: 6859874 - DNA, 112 bp, Homo sapiens
gtcagctctggtctaggtctgttacagcgggaatggatttacacagtgtttgtataaatttaaattcctgctgcctaagcagtctggatgctgtgccatgagccttcttgac

SEQ ID NO: 6859875 - DNA, 69 bp, Homo sapiens
ggtggtcacttctttcatcgaaactccttgtcccctcggagtctggtgtatgaaagtgaattctccacc

SEQ ID NO: 6859876 - DNA, 63 bp, Homo sapiens
gctataagacagatactgacttttaaagctgtgctgtggcaagtcagaagctgtaaatatagc

SEQ ID NO: 6859877 - DNA, 126 bp, Homo sapiens
atgagaaggaagagtcgaggtgtagggttagaggtgtatgagtacaggtttgagggtttcctttcaacatataccataatgcccccatccccaaacccaaaacacgttctccatgatccttagcgt

SEQ ID NO: 6859878 - DNA, 60 bp, Homo sapiens
attcagctcagacagagaccgtgtgctgcaggtgaggaacacaggctttggagtctgaat

SEQ ID NO: 6859879 - DNA, 60 bp, Homo sapiens
tgagcaaggagcagtctttctttctaaaatactagtctggttctgctactctcttgctta

SEQ ID NO: 6859880 - DNA, 77 bp, Homo sapiens
tgtttcagtctggaagccctggcatttctattcatgtccacagcatggacatgaggaactcaggagtcaccagagca

SEQ ID NO: 6859881 - DNA, 65 bp, Homo sapiens
cagactcttggtctccagcacagaatctctgattcagggagtctggagtggggcccaagaatctg

SEQ ID NO: 6859882 - DNA, 66 bp, Homo sapiens
caggattggtttcataggcatgtgacctatgttgttgcataggtacccgtacttagaaagatcctg

SEQ ID NO: 6859883 - DNA, 75 bp, Homo sapiens
tttatggtaacttgcaaggagttaatgtactgtgaattcattcttgtacattgatttctgcattagctccgtgaa

SEQ ID NO: 6859884 - DNA, 68 bp, Homo sapiens
gttcggctgctgcgggcttgacagctcccgccactggggctggagggggaggctgcggactgctggac

SEQ ID NO: 6859885 - DNA, 101 bp, Homo sapiens
aatgtaaattatgtcctctgaagttgtgcaatgcctgagtcctaggtgtgggcaaaagcatttgagcacattttaaagagaaataattcctcatctgcatt

SEQ ID NO: 6859886 - DNA, 57 bp, Homo sapiens
taaggggtggggatagtattcaccattttggaaccttaacttaatccctatctcttg

SEQ ID NO: 6859887 - DNA, 63 bp, Homo sapiens
ggggcttcaaaaggcagcagcctacttgtgcaaccttgggagaggccagcctttggagacacc

SEQ ID NO: 6859888 - DNA, 55 bp, Homo sapiens
gctgcaatggagtcaggctggtggaactgaaacaaatgcctgatattcaagcagc

SEQ ID NO: 6859889 - DNA, 65 bp, Homo sapiens
gctggggagtgaaattcttaaattcctaggcagacatggcatttaggattctttatctcctaagc

SEQ ID NO: 6859890 - DNA, 77 bp, Homo sapiens
ctgcctgttttccacatgaaaattaatgtaatattttgtttagaaatcacattgtaggtcatttgcaaatgaggcag

SEQ ID NO: 6859891 - DNA, 58 bp, Homo sapiens
tctctgagcacctaagatatatcatgaatcctgggtgataatcatttttgctcagaga

SEQ ID NO: 6859892 - DNA, 88 bp, Homo sapiens
gtgtgtaaaacaacgaggatttctacattgtatgattattgtaaaaaaatgattaaacaatgtaaagttcttgtagtgcttggcacac

SEQ ID NO: 6859893 - DNA, 122 bp, Homo sapiens
catcacagtgtggtccacggctgactttgttacctgcttggagtcaacatctaactgtgcttgagatgagttttagaatccaagaaggtgagcaaatggggacacaaacacatgaggtgatg

SEQ ID NO: 6859894 - DNA, 78 bp, Homo sapiens
tggctgaagtgtgatctgtttgacatgtgagcgtgttctccagtgaagcacacagctcagagcactcagactcagcca

SEQ ID NO: 6859895 - DNA, 69 bp, Homo sapiens
gcaccaagacccggcaagatgaaggccccctgtctctctgcagagctgccatcccctgctgggctgtgc

SEQ ID NO: 6859896 - DNA, 67 bp, Homo sapiens
gatggtcttgcttggtgttacttatgtggatgcagttatctagcaagtgaacaggagctagatggtc

SEQ ID NO: 6859897 - DNA, 67 bp, Homo sapiens
gctcaggcaccatatgatgtgtttccagacttccatacctggtgcagtgcacacgttgtgcttgagc

SEQ ID NO: 6859898 - DNA, 58 bp, Homo sapiens
gccctgttaggttctttgctcttaccattggttcagtctttgaagttctgacagaggc

SEQ ID NO: 6859899 - DNA, 73 bp, Homo sapiens
ttgatcaatcaagaataagttgtaaagctgtctgccagtattctcggtatttgctcaatttatcttggatcaa

SEQ ID NO: 6859900 - DNA, 80 bp, Homo sapiens
gaagattaggaaaccaagtttattccaagttaccccaagtcttggggtaaatgaattaaaaactctgggcttcaattttc

SEQ ID NO: 6859901 - DNA, 69 bp, Homo sapiens
tgctctttgtccttttccccaaattcactttccaatcttagatttttaaagtaggggaatgcaagagca

SEQ ID NO: 6859902 - DNA, 70 bp, Homo sapiens
tcctgtggtcccttggctcacaaacagctcctcagagctgcactgtgaagttcataggggctcaacagga

SEQ ID NO: 6859903 - DNA, 72 bp, Homo sapiens
ggtctagaatctaaactatagtttgatgaaagctttcatttatataaaaattgaggattgagattgtagact

SEQ ID NO: 6859904 - DNA, 119 bp, Homo sapiens
tttttcttccttgccttcaacatggccatgacatttggcttggcaacaactttctagcaaacacaagaaaacagcatgagggatgtaagccaatatggtaaggaggcagatttgaaaga

SEQ ID NO: 6859905 - DNA, 68 bp, Homo sapiens
tgctgagcttattaggttatttcaaggatgaaatcagacagctcctgagaagcacttaatacacagca

SEQ ID NO: 6859906 - DNA, 57 bp, Homo sapiens
actccttcaagattgctgttgacaagttaagttttaaacagttctctttgaaggtgt

SEQ ID NO: 6859907 - DNA, 72 bp, Homo sapiens
gctgtgtgagaatgtgtgactctattgagcaagtcagatttgcttttaacataatatggattttcatgcagt

SEQ ID NO: 6859908 - DNA, 63 bp, Homo sapiens
ttagtacaaaggcccttgattacttttttacgctgtgattcggtgacataggtcttgtggtga

SEQ ID NO: 6859909 - DNA, 60 bp, Homo sapiens
ccgggcccctctccgccccacacagcgcaccgactgccacgagggctggaggggacccgg

SEQ ID NO: 6859910 - DNA, 59 bp, Homo sapiens
ttgaggctctgtgatgtgccaggcactgttctaagtgctggagacatagcaggcagcaa

SEQ ID NO: 6859911 - DNA, 69 bp, Homo sapiens
tgatcaaagctatgctttagtaatattctcagaaaatacttagttgatgttctggaggtagaaggatca

SEQ ID NO: 6859912 - DNA, 55 bp, Homo sapiens
caccagacaggtgtatgcatatatcatgtgtgaatatgtgtatgtgtgtgtggtg

SEQ ID NO: 6859913 - DNA, 64 bp, Homo sapiens
ttactaaactacccatgacagtttcagatctatggcctggaagagtctctggatggtttaatag

SEQ ID NO: 6859914 - DNA, 99 bp, Homo sapiens
ccaccccccggcacacatcctgggccttgatcacacaggtgcattggagaccaaatcccagccctgatgacacgggcatcaggtgcagtggccccctgg

SEQ ID NO: 6859915 - DNA, 81 bp, Homo sapiens
ctgccgtccgttcagagcagatgctctcttgctggttcatttttccaaatgcatgggttgggggtatgatgtgcttggcag

SEQ ID NO: 6859916 - DNA, 81 bp, Homo sapiens
tttgtgcccttctacccttggctgtgttgcctgccctctggtagagacagcaatggcaacagcaagcaaagaaggcccaga

SEQ ID NO: 6859917 - DNA, 77 bp, Homo sapiens
tgaggcagaggagtagacaaggatgcgttgcagggctcagggccctgagaggttggcctgtccagcctcttgcctta

SEQ ID NO: 6859918 - DNA, 91 bp, Homo sapiens
acagaaagccaagaaaagtgagcttcagaaatgaacactgtctggaaccaggctaagatgtggtctgagcatttttaccaggttttattgt

SEQ ID NO: 6859919 - DNA, 64 bp, Homo sapiens
ctagagggatgttaggatagcaccaaagagacattctatttgtttccctaaggtctggctctgg

SEQ ID NO: 6859920 - DNA, 57 bp, Homo sapiens
gggtgggcagggttctggagactggcattgagccacgctccctgatccctgcttccc

SEQ ID NO: 6859921 - DNA, 91 bp, Homo sapiens
gaattgtggggtgttagaaaggctattggaccagttattagaagacctgaaatatggtttctagaccttttgatgaatacctgaatgactc

SEQ ID NO: 6859922 - DNA, 62 bp, Homo sapiens
agatggggttcctcagtttagattttgtgtatatgacactatctaaaaggagctctttatct

SEQ ID NO: 6859923 - DNA, 78 bp, Homo sapiens
gtgagttggtcagtttccttcaggccattgatctaagtagaagagatttaatggcctgtatggaaagtgaaagtttat

SEQ ID NO: 6859924 - DNA, 56 bp, Homo sapiens
cataggctgtggcagctggaagtggtagtgactaatgctggatgccaagggctgtg

SEQ ID NO: 6859925 - DNA, 85 bp, Homo sapiens
gggatggatttggagttgataaaatgatatcttctttatgaaatagaagtaaggagtatctgttttctcacccaagtatagtccc

SEQ ID NO: 6859926 - DNA, 58 bp, Homo sapiens
cagaagagcatttagtccctctcatgacgtccatctgagggctcaaatgtgcttgctg

SEQ ID NO: 6859927 - DNA, 90 bp, Homo sapiens
ttccattttgaggacactgaaggctacaaggttgaagtcacttggaagatgaaatcaatcctgaagtctcctggatttttctgagtggaa

SEQ ID NO: 6859928 - DNA, 63 bp, Homo sapiens
tgcatgtgggttgtgtttactgatgaattgaatgattcccaagagtagacaactgcaggtgtg

SEQ ID NO: 6859929 - DNA, 70 bp, Homo sapiens
aaaacagactttcgtcattcttgtgcagagatatgctttgcaggcccaggagatgtaagacttctgtttt

SEQ ID NO: 6859930 - DNA, 61 bp, Homo sapiens
gatttctattttaaaggcatatggctttgtgcaaggggctatggttttaaaggtggatatc

SEQ ID NO: 6859931 - DNA, 57 bp, Homo sapiens
tattcccctatcttgtagattggaaaacagaaaactggtctgcagtaagagggaata

SEQ ID NO: 6859932 - DNA, 78 bp, Homo sapiens
agatgctagactcaccaagaacaaggcactggataaatctctaaaccattctaagtcactgtgaaaggtgaagcattt

SEQ ID NO: 6859933 - DNA, 64 bp, Homo sapiens
ccaaatctcctggagccttcagccaggcagcgagcttttgacagattgaaggttcggagatagg

SEQ ID NO: 6859934 - DNA, 83 bp, Homo sapiens
gtccttgtagtctcctgccacttcttgctatggagtgctgtaccaaggtctctgctagtttctagttggcttgacataatgac

SEQ ID NO: 6859935 - DNA, 97 bp, Homo sapiens
gtcctgctttgggtaacttggctcagtgtgagggagatgtgagtatacctgtcccacgcgctgtgctgcttccggtctgcccatcttgcccgtggac

SEQ ID NO: 6859936 - DNA, 96 bp, Homo sapiens
gagctagtcacctagctgctgagagatgccaatctcacgggcttgatttatccccatgacatttgtgctcctcagcagttctcaggtgagtaattc

SEQ ID NO: 6859937 - DNA, 97 bp, Homo sapiens
gcagaggatccagaggcagcagtgataagataggacagaggaaaactttctgaactctattcctgcttctcctcattcctgcctctcattcctgtgt

SEQ ID NO: 6859938 - DNA, 130 bp, Homo sapiens
attagaacacctgggagagctgttaaacaatatataagtctgggcctccttcccagaggtggtaattcagttggtctgtgatggggcgtaggcatgaatatttttagaaaaatcccccagtgcttctaat

SEQ ID NO: 6859939 - DNA, 64 bp, Homo sapiens
ccgggaggaagaatggagtggagtgggcccagcaggaatgtctgttccacctttcttcatttgg

SEQ ID NO: 6859940 - DNA, 63 bp, Homo sapiens
tgatgatcctgtcctgaatcaccaggaggagaccgcctggatgttcacgggcagcgttcttca

SEQ ID NO: 6859941 - DNA, 79 bp, Homo sapiens
gagcatttagctagagtcacagcagccttgttggtttcgagtccaaatggcctcgaaggttattgtctttacgttgttc

SEQ ID NO: 6859942 - DNA, 97 bp, Homo sapiens
gggctaaggctgaaatctaagaggatggttggaaataagggatatatttttaaatatcagggtcattttagaccagcttctatagaaactagagccc

SEQ ID NO: 6859943 - DNA, 58 bp, Homo sapiens
agtcatgggatctgcaaaagaggtagttttactactttctttctgatccttatgcact

SEQ ID NO: 6859944 - DNA, 69 bp, Homo sapiens
ttacctcactgggcctcagttttctcaccatgagatggagaaaatggagactttgcccgtgtaaggtaa

SEQ ID NO: 6859945 - DNA, 85 bp, Homo sapiens
ttcatcagttcagttctctgagtgtgcttggtaaccagttatttagcttgcaaacactcaaagccatcattgaagttttggtgaa

SEQ ID NO: 6859946 - DNA, 60 bp, Homo sapiens
tgccgcattgttggaaatttagtttttaaaatttttaacattattttgaacaatgctgta

SEQ ID NO: 6859947 - DNA, 60 bp, Homo sapiens
ctgctcagcggaaggaagagcggtccccttccccacccgcattcccgatcagcagagcag

SEQ ID NO: 6859948 - DNA, 77 bp, Homo sapiens
gagttatttattttggtcttttatttaaagcagccctaatttttagattgtttgaataacagacaaattagaagctc

SEQ ID NO: 6859949 - DNA, 62 bp, Homo sapiens
ccttctttgaaatactgagagttacacaatgaatgtgatatctctttcattttagagtcagg

SEQ ID NO: 6859950 - DNA, 109 bp, Homo sapiens
tctatgacacattgaatttggctgcacatttatgaatgttatgtaaagggaaagagtgaccatttccttgcaaatagctttctgagttgccacaagatcaatatcgaga

SEQ ID NO: 6859951 - DNA, 56 bp, Homo sapiens
gagtgggagaaaggcatagtttaattatatgtaattaaaccaggtaatttccattc

SEQ ID NO: 6859952 - DNA, 65 bp, Homo sapiens
caagctggcagaaggcaattagagactgggaaaggacttaggaatgaaagtgttttgaaagcttg

SEQ ID NO: 6859953 - DNA, 92 bp, Homo sapiens
tactcataacacatgagtgattttgtagatgagtaccaattatttcttagtctcatggtctcaggagagtctcttcatgttttaattgagta

SEQ ID NO: 6859954 - DNA, 79 bp, Homo sapiens
tattggaaagataaagtttgattgaatatagggaccactgacagagtctgtacttcctttaaactttagattactaata

SEQ ID NO: 6859955 - DNA, 61 bp, Homo sapiens
cactgctgctgtttttcaattcattttggttgactaacattgaatttaaaatacagtggtg

SEQ ID NO: 6859956 - DNA, 56 bp, Homo sapiens
atgaagggatgactgagacagctgtgtttattggctgccctcagtcttgtctttat

SEQ ID NO: 6859957 - DNA, 79 bp, Homo sapiens
gacctttgttactgatttcagtgggcttttacagaaatgataacgctgatgtcttggtccctgaaaatgacaagaggtc

SEQ ID NO: 6859958 - DNA, 65 bp, Homo sapiens
cttggtggagctgtgagtagaatctgtcttgctgaacagagtcttatttgcagtgtcacactggg

SEQ ID NO: 6859959 - DNA, 68 bp, Homo sapiens
gagaagtccttagcctaggacggtccagccaaactgatgtgctgctgttccggctacagcccttactc

SEQ ID NO: 6859960 - DNA, 57 bp, Homo sapiens
ggcagccaccctgggaggcagacatggcctgtttcctgaggcccaggttggactgct

SEQ ID NO: 6859961 - DNA, 58 bp, Homo sapiens
acagcaatcaatatggcattctttccttttctaggagccagaaagcctgtgattatgt

SEQ ID NO: 6859962 - DNA, 86 bp, Homo sapiens
ggaacagcccactctgaggactgtagttctgatggtcctggtgctgctatcaggcaaggcccttagagtgtctcaagttgaaagcc

SEQ ID NO: 6859963 - DNA, 81 bp, Homo sapiens
tgcacatagttacctcgattaaaaaataagtttttggagctataaattttcaaacactgctttgagagggtctgtcaggca

SEQ ID NO: 6859964 - DNA, 71 bp, Homo sapiens
tcatggcttgggggctaccctaacattgcctgtatgaaatgcaggctttgacttggggcagccaggccaga

SEQ ID NO: 6859965 - DNA, 87 bp, Homo sapiens
acgcaggaacctggagtagtagcattaactaaggcccaaagatggagtgcttataatgttactgacaacaacaaacaaagcctgtgt

SEQ ID NO: 6859966 - DNA, 77 bp, Homo sapiens
gtagagcagctaacagcaggttccgggctcgtgggaaggaactaaggagaaactggaggtgctgttaaaaactctgc

SEQ ID NO: 6859967 - DNA, 67 bp, Homo sapiens
tatttcttatattgggtcatggatacttgagtatttattctctatatctttttcaatgttggaaata

SEQ ID NO: 6859968 - DNA, 55 bp, Homo sapiens
tggaggagtagattttcagaggtttttattctgccattctgaaagcccttttcca

SEQ ID NO: 6859969 - DNA, 58 bp, Homo sapiens
ctaaaggatattagaggagaaatacaacatagtgcttttcttatcttttgtccttgag

SEQ ID NO: 6859970 - DNA, 59 bp, Homo sapiens
gaggcagcctcagtggacctcgtccttgcacgggggaagctccacggtggggccgcctc

SEQ ID NO: 6859971 - DNA, 62 bp, Homo sapiens
cagcagtggatgctaattattggcatgggaaagtgctcttaggatacacagcttcactgttg

SEQ ID NO: 6859972 - DNA, 62 bp, Homo sapiens
ctttagttatttagactacagtaaacttcttgtgagtggtcatgaattctagatgactggag

SEQ ID NO: 6859973 - DNA, 124 bp, Homo sapiens
tctaaccagtataaacagagccaaagagattcagagccgtgtggcatcatttatcgtcaaagttgacgggacccaagaggctacactgttttgatgtctgaggcttgaccttacactaatgaga

SEQ ID NO: 6859974 - DNA, 56 bp, Homo sapiens
gctcccacgcaattcttttcaggggcctttctcttggggccagagctgcagggagc

SEQ ID NO: 6859975 - DNA, 69 bp, Homo sapiens
tttgtaatatattcagccttcagttagagtgtggattaaatttgacttctgattaaggatgaatgcaaa

SEQ ID NO: 6859976 - DNA, 73 bp, Homo sapiens
gtgttggctgggggtgctatagctgcatcaaacccccacagaagggtagcaccgcttcagctcccttgcccac

SEQ ID NO: 6859977 - DNA, 60 bp, Homo sapiens
tgtaatgttagaaacaattgctggtcaagttcaacttgttgctattgtttttaatttgca

SEQ ID NO: 6859978 - DNA, 80 bp, Homo sapiens
gatgatgggtgaaggtcagtggccctggggcccctgctactctgtacactccctcaggccctgaccaccatccctccatt

SEQ ID NO: 6859979 - DNA, 71 bp, Homo sapiens
tgagtgtatatcaggagagagctttagtttttgtctttaaatgattgttctcattcctgcagtaactctca

SEQ ID NO: 6859980 - DNA, 62 bp, Homo sapiens
ggtggtgaagtctgcaggctctaaaaccagaaaacacaggttcaagtcctggctctaccacc

SEQ ID NO: 6859981 - DNA, 68 bp, Homo sapiens
ttttattttacttgggagacttttaagctctgagcataaattttcctggtcttccaaataaggagaaa

SEQ ID NO: 6859982 - DNA, 59 bp, Homo sapiens
cagctcgggagcttggggtagctttgtgaatgcgtggctccctggaaatcccgaggctg

SEQ ID NO: 6859983 - DNA, 79 bp, Homo sapiens
gagacgagacacgaagggttgacaccacccaaccaatatcctggtgacttccgggtgtcaagccccagctgtcacgctc

SEQ ID NO: 6859984 - DNA, 63 bp, Homo sapiens
gagtagcagccacagaggacccaagcccaagtcttggcctgagttaagttagtgctattgctc

SEQ ID NO: 6859985 - DNA, 77 bp, Homo sapiens
ggttcatgcagacccaggatccaaatgttgcctggtatcttgtctggagtaatatttctaccctgctgccttggacc

SEQ ID NO: 6859986 - DNA, 91 bp, Homo sapiens
atagggttctgcataaaacatgatttctgctaggtttatattaaatatggttgttgaacaaagctttcttgattttgcctgtaaaccctat

SEQ ID NO: 6859987 - DNA, 74 bp, Homo sapiens
tagattttttggaagcaaattccagaaccacagagttgactggtcgatatgtctcttgagtttgttttaatcta

SEQ ID NO: 6859988 - DNA, 69 bp, Homo sapiens
catggcattgtgagtctgtatattattatgccccatgccttggcataaagacatgcttacttgcccatg

SEQ ID NO: 6859989 - DNA, 130 bp, Homo sapiens
ctcacagtttccatgggtctggaattcaggagtagcttggccagcagctctggcttagggtctcctgtgacgttacagtcatatgttggcggaaactgcagtcatctgaaggcctgaccagggctggaag

SEQ ID NO: 6859990 - DNA, 78 bp, Homo sapiens
ctgctcccaatgacccctctccttaagactcaggcacaagcccatgggacctgggccagaggacagtctggaaagtag

SEQ ID NO: 6859991 - DNA, 69 bp, Homo sapiens
aggatcttcaagtaagttgtggtttccttcaaaattaatttagaaatcacaaacgaattgatggaacct

SEQ ID NO: 6859992 - DNA, 130 bp, Homo sapiens
cgatcaagcctctgttagattatggtatgagaagagtagtaacagaaattatgatggattcttaccttctttcctaatatgtgttactgactttttttgtgtggctattctgcatgcattggaagagacg

SEQ ID NO: 6859993 - DNA, 75 bp, Homo sapiens
cctttcctagagcttccactctagaaggagtctcaggttaacattaggactcactttgggctgggagctgagagg

SEQ ID NO: 6859994 - DNA, 65 bp, Homo sapiens
cctggagctggcttccttccactccatgctgaaagtaggccagtggagcagaagtctgctggggg

SEQ ID NO: 6859995 - DNA, 56 bp, Homo sapiens
aggactgtgctaagaactaaatgaggaaatgctcataaggtagcaagcacagtcct

SEQ ID NO: 6859996 - DNA, 58 bp, Homo sapiens
aaggcatttgtgtggctcagttactggcaagccagttctgaatgccccaaatgacctt

SEQ ID NO: 6859997 - DNA, 90 bp, Homo sapiens
ttccattatcccatatttcatgtgcaccataattcaccagaagtttggatgttgaatacctgcggtgtccatgaactggttgtcatggag

SEQ ID NO: 6859998 - DNA, 67 bp, Homo sapiens
aagatgttggggctccttagaaacttgagcaccttagatgtcagtacttctgggatgcctgcatctt

SEQ ID NO: 6859999 - DNA, 68 bp, Homo sapiens
ggccagcaagactcagcaggataccaggaagatgttcactggaagactatcccgtgattttgtaagcc

SEQ ID NO: 6860000 - DNA, 83 bp, Homo sapiens
agagctattttaatagtatcttttctgttattgttatttaatgtttattgagtaatggagcaggaaatacatcaatgagctct

SEQ ID NO: 6860001 - DNA, 61 bp, Homo sapiens
agttagtcatttagaatgcagagttcattttcatgaacaatcaagtttctaaatgacagct

SEQ ID NO: 6860002 - DNA, 55 bp, Homo sapiens
ctttccaactgggtgggcagctttctgaagttaaggctcctgtcctggtggaggg

SEQ ID NO: 6860003 - DNA, 97 bp, Homo sapiens
gtggcctggtatggcccttctattgcttgcaccctgctctgtgggctatatcaccatgagtcagtgggcttggcacagaaaggcacattccagctac

SEQ ID NO: 6860004 - DNA, 60 bp, Homo sapiens
tttcgtccctcccaaggctggctgacataacggagggcccagctatgtgacctgatggaa

SEQ ID NO: 6860005 - DNA, 79 bp, Homo sapiens
gagcatgggtgccaggaagggggatccttggaagccattctggaaggctgcccaccacacctgctcctgcacccacctc

SEQ ID NO: 6860006 - DNA, 68 bp, Homo sapiens
aggattctgttgtatgattgaggaactaacagaagagtggtgagatttgatatcatgcaacaaatgct

SEQ ID NO: 6860007 - DNA, 78 bp, Homo sapiens
aaaaatttactattcctgggccccattccagactagtcaaattagaatttctgagtgaggcccaggcatgcgattttt

SEQ ID NO: 6860008 - DNA, 60 bp, Homo sapiens
actgggccaggggctttggagcatgcaaagataagcagaacatagggtcttttgtctagt

SEQ ID NO: 6860009 - DNA, 55 bp, Homo sapiens
tggcttggtgagcagagtgtaggccggatttcagcccccgtttgccgcccagcca

SEQ ID NO: 6860010 - DNA, 62 bp, Homo sapiens
cgagactgagatctgaatggtgtttgtgggttcccgaggcctggcaggaatctcagtgcttg

SEQ ID NO: 6860011 - DNA, 64 bp, Homo sapiens
gcaaaagatacatgttaggagcaaccgtgggtgttctgcgggctcgttagctgtattcagttgc

SEQ ID NO: 6860012 - DNA, 57 bp, Homo sapiens
gtgcatgcacgtgctatgtatgagtatccacattcatatacctgcatgtgcatgtgt

SEQ ID NO: 6860013 - DNA, 76 bp, Homo sapiens
cgccggcagccaggacatgcacggggccgggagtgcattcaccccctgcgcccggcacgtcataaagctgtgggtg

SEQ ID NO: 6860014 - DNA, 127 bp, Homo sapiens
tgcaggcaaagctccaatacctcagcggggaatgcttggagccaaaatgacatgagagtgaagtttctcttggctcctcacagcatcagtgaactctcagctgatggggtaagggaggtggtttgca

SEQ ID NO: 6860015 - DNA, 89 bp, Homo sapiens
gcagggcatcaaggagagccccatcctcgcagaatggaatacggaagaacacacgcacaatcgccagtatgtggctgtctttgacctgc

SEQ ID NO: 6860016 - DNA, 76 bp, Homo sapiens
aggtatggcaaaagcaaagtccctgaatgtgtcattagaagtgatggtaagtgtgggtactcttgcttccactcct

SEQ ID NO: 6860017 - DNA, 60 bp, Homo sapiens
ggccagggctgctgggggagttgaaggtaccttggacccctgctcgggagccctgctgcc

SEQ ID NO: 6860018 - DNA, 67 bp, Homo sapiens
aaccctgagagctacaggtctcgtcctcgccattttacaggtgggaaaactgaggctctcagcagtt

SEQ ID NO: 6860019 - DNA, 59 bp, Homo sapiens
cgtggccacagtggagctgagcatgaccagcagttgctgcagcatctccttgtgccatg

SEQ ID NO: 6860020 - DNA, 129 bp, Homo sapiens
ctggtgctctgtggctgtcatgcagactggggttggggttctgttccctctactgtactggagctccaggtcatgggaggcagcagagcccagccctggcccttcgagcttccgtcctgcaagcaccgg

SEQ ID NO: 6860021 - DNA, 65 bp, Homo sapiens
gggtacctgcagggccatggtggcggctgccgcgttgttgctgctgctgttgtcgtccggtgctc

SEQ ID NO: 6860022 - DNA, 87 bp, Homo sapiens
cagggaagaagtagcatgattattatactgtggatctttgtcaactccctgttttcaaggctaatccacagtatatgtgtttccctg

SEQ ID NO: 6860023 - DNA, 63 bp, Homo sapiens
ccataactgaatgtattacaacagaatgtgtagaagttttgttgtggcaaatttgtgttctgg

SEQ ID NO: 6860024 - DNA, 55 bp, Homo sapiens
cggtgggattcccagcgacttccttaggagtccgcgctccatgggagtccccccg

SEQ ID NO: 6860025 - DNA, 90 bp, Homo sapiens
ccaggtggaaggaactgccctgcagaaagggtccccaggagccctgttaatgggaatttattcagcaggtcaggcagcaattttccctgg

SEQ ID NO: 6860026 - DNA, 59 bp, Homo sapiens
atgagcaagatgatctgccaacacagcttgtcagttaccttatggcatcttttgctcat

SEQ ID NO: 6860027 - DNA, 67 bp, Homo sapiens
ctccttactgtacacctacagaaaaggagagttggtggaggctctcctgtaggtgtacagtaaggag

SEQ ID NO: 6860028 - DNA, 58 bp, Homo sapiens
actggagtacagtggcgtgaacacggctcactgcagcctcaacctactgtgctcaagt

SEQ ID NO: 6860029 - DNA, 102 bp, Homo sapiens
cgttgaaggagagcgagtggcggatggagttctgccagcgctgctggttctgccggtagaaggggaagaggtccatgatccactggtagatctcgctcagcg

SEQ ID NO: 6860030 - DNA, 66 bp, Homo sapiens
gtctgcacgtgccagggaggggtcacaggatgaatgctatatccctcctttttgggaccgtgcagc

SEQ ID NO: 6860031 - DNA, 62 bp, Homo sapiens
aagggggaaatttcaatgtttaaaaatggtttataataggatcacattgaattttcttcttt

SEQ ID NO: 6860032 - DNA, 70 bp, Homo sapiens
ttcacaagtgtgaaggcagagccccagagcccccatgtgatcaggtgctgagccaagtgcacttgatgaa

SEQ ID NO: 6860033 - DNA, 57 bp, Homo sapiens
gtgctgagtctcctactatacgtttcacgggctccctgtgatttagggatccggcac

SEQ ID NO: 6860034 - DNA, 67 bp, Homo sapiens
ataggtcaactctcattggaagtccatgagtaaccccagctccttccactgattttggttgacctat

SEQ ID NO: 6860035 - DNA, 69 bp, Homo sapiens
gtttctgttgctcagataatgcagtctcatctcgtctgtgatttcagcagcactcatggcaatgggaac

SEQ ID NO: 6860036 - DNA, 76 bp, Homo sapiens
ccacctaaaggcttcagtttacaatgcattggccagaattgagtcatgtgtgcctagtttgaagatggctaggtgg

SEQ ID NO: 6860037 - DNA, 66 bp, Homo sapiens
ccaattatatgtcatcttgactgaaattctttcatgatagaatatctgtcttgacatgttggttgg

SEQ ID NO: 6860038 - DNA, 63 bp, Homo sapiens
agatacaaaagataagatttagcagtttattctttggtaggttgtaagaggtcttttgtttct

SEQ ID NO: 6860039 - DNA, 59 bp, Homo sapiens
ggattaagacctgtcagtacaccaagactggggcccagtcacctggcaggtttttatct

SEQ ID NO: 6860040 - DNA, 62 bp, Homo sapiens
gctttctgagttatgcagtctgtgtcaccaactactcaactctgctgctgtagctctaaagc

SEQ ID NO: 6860041 - DNA, 79 bp, Homo sapiens
ggtggagaagggagtgaggtcaggatctcagggaaagaacactttacctactgcatccaggcctcttgctgctcacact

SEQ ID NO: 6860042 - DNA, 74 bp, Homo sapiens
ctttcctgtctggtccctgtaggtatttgacttagtgacctctgagttaaaatcatagcagtgacttgggaaag

SEQ ID NO: 6860043 - DNA, 65 bp, Homo sapiens
tggttcaaaagcacctggtttatataatcatacatcctgtaacattgttatgaatcaggtcacca

SEQ ID NO: 6860044 - DNA, 57 bp, Homo sapiens
agcaatgctaccgggtgattcgtagaaaattgggattcatgccttctagcatttgct

SEQ ID NO: 6860045 - DNA, 55 bp, Homo sapiens
ctgttaagtgaatgtcatgtcaggcaagcttctgcagccttcattcatctggcag

SEQ ID NO: 6860046 - DNA, 82 bp, Homo sapiens
gtaaaaccactgtgtgggccaaactaaacatgtttactagactcaactcctgggcagtttgccccgtcaccctggtgtgtgc

SEQ ID NO: 6860047 - DNA, 82 bp, Homo sapiens
gctttaagctgtctatatattgcttgaataatctggtaaaatatcttacatattattcatgtagattcagtatagtatttgc

SEQ ID NO: 6860048 - DNA, 57 bp, Homo sapiens
aaatgcatttttaattagacccagcagatctgggctaggagtctgaaatttgcattt

SEQ ID NO: 6860049 - DNA, 57 bp, Homo sapiens
ggaggatgtggggtggactcagggacccaccccctctgtggccagtcccacacctcc

SEQ ID NO: 6860050 - DNA, 68 bp, Homo sapiens
cagcacttaggaagcaggcctaaaatttggcaatatattatcaaaagagctctgcttcctaggaaatg

SEQ ID NO: 6860051 - DNA, 86 bp, Homo sapiens
ttattacgttggtgcaaacataattgtggtttgtgcaactacttttaatggcaaaaactgcgattacttttgcaccaacctaataa

SEQ ID NO: 6860052 - DNA, 58 bp, Homo sapiens
agtcagtttccctggaaagcagcctgttagatggagctttgagtgcaggaagcttact

SEQ ID NO: 6860053 - DNA, 55 bp, Homo sapiens
cagccgcgctcgtgccagacaggtgtttttcctcctgcctgagtggatgcagctg

SEQ ID NO: 6860054 - DNA, 59 bp, Homo sapiens
gagtttatttgactggattctcagccgaatcagtgctgggagccactgtttttgaactt

SEQ ID NO: 6860055 - DNA, 76 bp, Homo sapiens
ttgctctgtttcccaggctggaatgcagtggtgtgatcttggctcactgcagcctccatctctggggttcaagcga

SEQ ID NO: 6860056 - DNA, 83 bp, Homo sapiens
gcacccctctgaaaggcaaaatttaggacaggagcttaagagagtttacaggctttgcttcctgttctagcctcagattctgc

SEQ ID NO: 6860057 - DNA, 62 bp, Homo sapiens
gcttttattataatgaggcagggaaagttttgaccccgctcatcattgcacataatggaagc

SEQ ID NO: 6860058 - DNA, 56 bp, Homo sapiens
tcagagtaaacctgtcatcaagaagcctgcgtgggatgtctaactggtttgcctga

SEQ ID NO: 6860059 - DNA, 81 bp, Homo sapiens
agtgccccaggtcaggaggcctctgccatttcccaattctgacgggaagtgatggagaaaagcctcttccttgtgggtgct

SEQ ID NO: 6860060 - DNA, 57 bp, Homo sapiens
cctgagatttcattgtctggcctctctaaagggatgataatggtctcatctcatagg

SEQ ID NO: 6860061 - DNA, 70 bp, Homo sapiens
ggaaggaccctggagacccactgggagagtactgaaattttccaggtgagagaggcccagggtctgagcc

SEQ ID NO: 6860062 - DNA, 62 bp, Homo sapiens
gaactaaatgaaattactggtgttcagttttcacctataaaaccagcagtttcatgtggttt

SEQ ID NO: 6860063 - DNA, 86 bp, Homo sapiens
cagcattcagagcttcagatctcctggacgtcttgttaaattgcagattctgatttaataggtgtagggaggggctccagatcctg

SEQ ID NO: 6860064 - DNA, 65 bp, Homo sapiens
gggttaggggatgagggtacaaatcctccacactgctcccagtctggaatcctcccccttggttc

SEQ ID NO: 6860065 - DNA, 76 bp, Homo sapiens
tacatacctgacagaggctcaccagcctttcactggacattttccagcgaccagggaagcttcttcataggtagta

SEQ ID NO: 6860066 - DNA, 61 bp, Homo sapiens
atcataatcagtactcttcttctcactagcattgtagagggaagactgctagatttaggat

SEQ ID NO: 6860067 - DNA, 93 bp, Homo sapiens
ggaatgattcactcagaccagagccagagaggtgcctgccctgggccccatgaggctgcggttccactctggccctcctctgaccatcactcc

SEQ ID NO: 6860068 - DNA, 81 bp, Homo sapiens
atatagcactatctttagcattactttattcagtaaatgagaactgcaaaagttctgctggagaggactggatgcatatat

SEQ ID NO: 6860069 - DNA, 76 bp, Homo sapiens
gaagttgtggagtacagtattaagattagtgacaacacatgaagtgaattgactgattatgcgtactctctacttt

SEQ ID NO: 6860070 - DNA, 104 bp, Homo sapiens
tcctcccagaaccaaatgaagaaactgaggcttagagaagatgggatttttcagctaaaagatctttctcttgaactctaaagcccaggcatgttctggcaggg

SEQ ID NO: 6860071 - DNA, 55 bp, Homo sapiens
cagtagcaggcaggtgcttttgtagttcagggatgctgccatctttctgtaattg

SEQ ID NO: 6860072 - DNA, 69 bp, Homo sapiens
ggtgcggctggtgctgaagctgaggctgccggagctaggcgaggctcagctcggctcagccctcgcgcc

SEQ ID NO: 6860073 - DNA, 60 bp, Homo sapiens
tcaacaagaagggtgattaggggcagaggcctgcaagaggcttcatggcccacccgttga

SEQ ID NO: 6860074 - DNA, 60 bp, Homo sapiens
tggcatgttgtttatgtttctggagaataaaatcttaccagatcaataaacgcatgtcca

SEQ ID NO: 6860075 - DNA, 56 bp, Homo sapiens
gcttccttctaccacatcatgctgcagaaaacacagcagatgggaagagacgaggc

SEQ ID NO: 6860076 - DNA, 89 bp, Homo sapiens
gagtgaatacagagtcatgaggcagtcatatgggaagggaacataagtagtgagctgccttatggagtatgaaaactcatgttttactc

SEQ ID NO: 6860077 - DNA, 68 bp, Homo sapiens
attccagtcagctcattgggatacatggtggcatgtaccacagtgtgacttctgagctgccatgggat

SEQ ID NO: 6860078 - DNA, 96 bp, Homo sapiens
gtgagtttggggatgcagctgtcagggagaacatcccttcttgaatgagcagaagacttcatgaatccgctgaacatgctgcagcactaaattcac

SEQ ID NO: 6860079 - DNA, 86 bp, Homo sapiens
ctgggcccagctcacgtggtttttgccctgcacgctcaccacgtggtctccgatgcgggggaagctgtgggagaaacggggcccag

SEQ ID NO: 6860080 - DNA, 79 bp, Homo sapiens
aggtataacccacttcaattaacttcagcattacagtaatgagtgattacaaagatgattgagggggcaaaacgtactt

SEQ ID NO: 6860081 - DNA, 90 bp, Homo sapiens
gggttggcggggagaggggccctttttcaggagacagttttcctttttacctcctggacctggggtggcctcctctccactggcaggccc

SEQ ID NO: 6860082 - DNA, 93 bp, Homo sapiens
gaggggtgacatggagggagaagtccagggtgcggtccccacagcccgtggcctcctacgcagcttgaggatgcatcctgcctccctcccctt

SEQ ID NO: 6860083 - DNA, 55 bp, Homo sapiens
ggttgtttttctggaaggtttgtggtctagccattgaacagagagaaaaacatcc

SEQ ID NO: 6860084 - DNA, 62 bp, Homo sapiens
ggcagtgtggcctgagtaagtccacagcttgtcatgcttcctacatgttatgccacactgcc

SEQ ID NO: 6860085 - DNA, 65 bp, Homo sapiens
cccggtggcttgtagcctacacctggtcattagtggacactgtaaccatgtggctcaaccctggg

SEQ ID NO: 6860086 - DNA, 81 bp, Homo sapiens
atcttcagtcatatactacatttgaaaattgcagtattatttgtggtttgcaaaattcacaatgagtataatggtgaagat

SEQ ID NO: 6860087 - DNA, 57 bp, Homo sapiens
tactgataagagttgtaggagtgcgatctctaattcctcagcatgttttgtcatgta

SEQ ID NO: 6860088 - DNA, 85 bp, Homo sapiens
tgttgctaggaaaaccatttgagaacctgtgtcctttagcaaaataaaatggagaaaggataaggttatcaatttttgttcaaca

SEQ ID NO: 6860089 - DNA, 88 bp, Homo sapiens
gcgcagccattcagaccccacagtccacattcctttgagccagtccattgagggtcctcagggaatgtggcgggtcccctggtctcgc

SEQ ID NO: 6860090 - DNA, 59 bp, Homo sapiens
tgtttgtactcaaagccatgagaggcagcgcatagctgcagactggaagagtgcagaca

SEQ ID NO: 6860091 - DNA, 87 bp, Homo sapiens
cctcttaagtggctctggtggttatattattgtgcggtgctatgagtcactgtctattaatataacttacccagggcttgtaacagg

SEQ ID NO: 6860092 - DNA, 84 bp, Homo sapiens
gtgggggcaacgtgtagcccttgatgctgcggccagtgcggacgcggctgctgagcacgtagttagggtccaggtcgtctccac

SEQ ID NO: 6860093 - DNA, 58 bp, Homo sapiens
tctagagatacattggtcatttaacttaatgtcacaggttaccagctgtatcactaga

SEQ ID NO: 6860094 - DNA, 72 bp, Homo sapiens
tgcacatatcagttgcctgtacaatcctgataaaagggcttgctttctaccacagagcataatggtgtggca

SEQ ID NO: 6860095 - DNA, 72 bp, Homo sapiens
ccaataacctaaattatcatgagaattatgaagccaagtttttatgtactttgtgataatttaggttgaagg

SEQ ID NO: 6860096 - DNA, 105 bp, Homo sapiens
agtgttccctgggcctcattgcactttgggtccaggacaggcagctgctgctctttggccttcgtcctggaatcctagaacagtgtcagaccagggttggacact

SEQ ID NO: 6860097 - DNA, 84 bp, Homo sapiens
ggtaggagcactggctttggcttcagatgagtgtcgagcgcctcactctgccatctctagctagggacctatctgcttcatgcc

SEQ ID NO: 6860098 - DNA, 55 bp, Homo sapiens
gcacatgcagtttacgtcactgaccactgttggtcaaaacaatcattggatgtgc

SEQ ID NO: 6860099 - DNA, 69 bp, Homo sapiens
gagtcaccttggccgctgtcccggaggggagcgctgggagcgcggcgccgggacgcggcggagtcattc

SEQ ID NO: 6860100 - DNA, 76 bp, Homo sapiens
gcctcacatattcatggttactgagacagaattatggcgattgaagtaaggggctgaggattatgatttgtgaggc

SEQ ID NO: 6860101 - DNA, 76 bp, Homo sapiens
tcaaagtgaattctgcactactgaagggggagggaggatttcctgtgccttcagttagtttagaatctaattggga

SEQ ID NO: 6860102 - DNA, 59 bp, Homo sapiens
gtcagtaacacacacacaaccaactttattggcacaaccaaactgtgtgtgatattgac

SEQ ID NO: 6860103 - DNA, 64 bp, Homo sapiens
gcagtggcatgagtataggcttctcactcacatggtgtttggtagtttcttcttgagccaatgc

SEQ ID NO: 6860104 - DNA, 76 bp, Homo sapiens
ttcagtgttactagtatttaatatgtggattgatattggtgtcctgttatatgttgggtagtcatggtacatggaa

SEQ ID NO: 6860105 - DNA, 60 bp, Homo sapiens
ctactcttggagacatattatgaacaggagtacatttctgcaggctcatctcaagagtag

SEQ ID NO: 6860106 - DNA, 62 bp, Homo sapiens
tgactgtcatgtgctaactgtccacaaaatgtctgctggcatagaaaagtacatgattttca

SEQ ID NO: 6860107 - DNA, 67 bp, Homo sapiens
ccgcgctgggtgcccggctggcgctcctcccgcccaaggtgccctgatcgctaggctcccggtgcgg

SEQ ID NO: 6860108 - DNA, 60 bp, Homo sapiens
gtgaaatgatggatatgtgaatttgcttgactgtggtgatcatttctctatgtatttcac

SEQ ID NO: 6860109 - DNA, 95 bp, Homo sapiens
tgtatttttgtgtgaattgtatgtggaatcaaatatgtatgtttttcgtagaacatgtgtggacatgaatctacatgagcatgcaagtgaatata

SEQ ID NO: 6860110 - DNA, 93 bp, Homo sapiens
ctcttttgggagtaggataggtgtagcagactaaggaaagccttgctttgttaagatgctgttctgctcttagtaaacagataacataaagag

SEQ ID NO: 6860111 - DNA, 72 bp, Homo sapiens
gtgtttcattgaagttttacatcctctccaaaacttaaggtgttttagttagtggggctgtcagtctagcac

SEQ ID NO: 6860112 - DNA, 71 bp, Homo sapiens
cccaaagaagctggcctgtatggtgaggtgtggccgcagatggtggtgccacacattgtcaggttagtggg

SEQ ID NO: 6860113 - DNA, 107 bp, Homo sapiens
gcaggaaggctggttaaaaatgtagattcctgggcactacaactattatgtttcagtaaaggtctggtgtagggcctaggggtatggattttagccagcttcctagt

SEQ ID NO: 6860114 - DNA, 107 bp, Homo sapiens
ggttcccaggtgatatgtgctcctggtcttccatgaggagttcatgaggtgagcttgatgaggcctatcttggcagagggaatggtacatgcaaagctctggaaatc

SEQ ID NO: 6860115 - DNA, 64 bp, Homo sapiens
tgccaaggagctggatcagggcagtctttgcacatcattcgtggggaccctgcagtacctggta

SEQ ID NO: 6860116 - DNA, 71 bp, Homo sapiens
gaattcagtttgctagtgtttggttgatggtttttgcattaataatcatcaaggatattggtctgtagttt

SEQ ID NO: 6860117 - DNA, 60 bp, Homo sapiens
atagcttacaggtgatatcagcaaggcacacatatgtgagttgaatttatttgtaactat

SEQ ID NO: 6860118 - DNA, 99 bp, Homo sapiens
atggccttgaccgacctcacgtttaagggcctgtgcacagttctgttacctggagtaggtgatctgtgacaccggcctttggttgctgtgtttggccat

SEQ ID NO: 6860119 - DNA, 64 bp, Homo sapiens
ccaaagccaacagccagggctgtgcctctgaggacccacacaggcccaggtatgtttgttttgg

SEQ ID NO: 6860120 - DNA, 103 bp, Homo sapiens
agttttcccccttattcttttgttaaattctggctgccacattttctactatgaaataaaactagtctgtggagtcagagaataaagaatgcataagaaaact

SEQ ID NO: 6860121 - DNA, 63 bp, Homo sapiens
gagaggggaataaacactttgtcactaattaatcttgaaggctgaattatttgttcctttctt

SEQ ID NO: 6860122 - DNA, 90 bp, Homo sapiens
aaagcggcttgatggaatgtatgcagcctgggatgagagtcagctagctggattctggccttggctctgtcacttcatccatgtcacttt

SEQ ID NO: 6860123 - DNA, 78 bp, Homo sapiens
gaggtattttcatggcagactgtaataggagaattataagtaattttcaaaccacaggtctgcaagcatgcatacctt

SEQ ID NO: 6860124 - DNA, 61 bp, Homo sapiens
cagcaggcagccatttcactgtggggctccctgcatcaatgcactgaatggcaccctgttg

SEQ ID NO: 6860125 - DNA, 78 bp, Homo sapiens
agagagagatgagaactcaatatgatggatgcttgttgctgtaatacagatttcattactgaattctcactacaatct

SEQ ID NO: 6860126 - DNA, 68 bp, Homo sapiens
ttggggttcctggctgtaagcgtgtttcctaggaaacctcctgggattgagtgcagcaggctctctga

SEQ ID NO: 6860127 - DNA, 60 bp, Homo sapiens
gccagtgtttatagcagtgagggcactgtgatcaaatcctccaaaagctgtaatgctggc

SEQ ID NO: 6860128 - DNA, 59 bp, Homo sapiens
gtcacctgaggggaggtgacaggaactgaacccactgtcactctgtgtttccctgggac

SEQ ID NO: 6860129 - DNA, 79 bp, Homo sapiens
ctgaccataggtaagttttagaaagtgtgcaatttggtctattttataatgcacacttagtatgactacataggcttag

SEQ ID NO: 6860130 - DNA, 83 bp, Homo sapiens
caggtggaaatagagggtcagttccctactgagccctactgacatcaaggcccagtggggagctgaggttcaactcccacctg

SEQ ID NO: 6860131 - DNA, 77 bp, Homo sapiens
gcaataaatacagataaggccagcatttctggagtgtttaatacattgtgctttgcaggctatatcttatttgacgc

SEQ ID NO: 6860132 - DNA, 69 bp, Homo sapiens
gggaaaactactgatttgtgaattgatccctaattagtcttcttaggtcagtagtttcatttttttccc

SEQ ID NO: 6860133 - DNA, 69 bp, Homo sapiens
caaggaggcctgcgagaaggggcctgggcacaggaaggctgctcctctgccagctgcagggcttccttg

SEQ ID NO: 6860134 - DNA, 65 bp, Homo sapiens
ttgcactttgctcaagccatttgttcaggacaagaagttcctgcaccagaaatagcgaagtgtaa

SEQ ID NO: 6860135 - DNA, 66 bp, Homo sapiens
ggctcttctgtttcacaggccaaggggctcacagcccagggcctttgcaaagaagcagggcaggcc

SEQ ID NO: 6860136 - DNA, 77 bp, Homo sapiens
ggaaagagtatgggagctttactctgttcagaaaggagaatttatggaagtatagctcacaatctatgatctgcacc

SEQ ID NO: 6860137 - DNA, 75 bp, Homo sapiens
ggcgctgctgggtggtggagccgctgcagtggcctctggtgctgcttctgcagaggcctcgcctcctctggcgcc

SEQ ID NO: 6860138 - DNA, 66 bp, Homo sapiens
ttgttacatgactcaaaggcaccctacttggaatggaagggtgccattgggcagtcattgaagcaa

SEQ ID NO: 6860139 - DNA, 56 bp, Homo sapiens
catgcttatgatttgctaagccataaagaaactggatactgcagatcagaagcctg

SEQ ID NO: 6860140 - DNA, 79 bp, Homo sapiens
gagtcgaggccttggctatttacaaggtaggtgacttaaggcaagtaacatgccttgtaaatagctaaggccttaactc

SEQ ID NO: 6860141 - DNA, 95 bp, Homo sapiens
ctcatgcactctctcctcaggcacgagcctgatgagactgatgactgtgcatcgtgctcctggtgaggctctgcagaagtagggggggcggtgag

SEQ ID NO: 6860142 - DNA, 129 bp, Homo sapiens
ggctccacctgggagttgtaagcaggactgccagtgctttgagaggagggtgctttgctgggtgggccctaactttcttctccatggcaggtcctcagcaaagggcagcccctgggtcctgcgggagtt

SEQ ID NO: 6860143 - DNA, 64 bp, Homo sapiens
agtctatgcttaaaatatgaaactgagcaaaagtcattggtcaatatttttatgagcatagatt

SEQ ID NO: 6860144 - DNA, 59 bp, Homo sapiens
ccgcgggaggctgttctggggctgatattaattgggtcagtcccaacagcttctcctgg

SEQ ID NO: 6860145 - DNA, 58 bp, Homo sapiens
aatgctcaatgaaacgtttgtgtgtgtgtatgtgtacacagatatttcattgaacatt

SEQ ID NO: 6860146 - DNA, 55 bp, Homo sapiens
agtagaggtaggtcttcgagtctcagggacatccctggcctgcccaatgtctgct

SEQ ID NO: 6860147 - DNA, 81 bp, Homo sapiens
gattatgaggcagtacacacaaagccctgctgagtggtgggcaggccatacgtcctttgagtgatagctgctgtcattatc

SEQ ID NO: 6860148 - DNA, 79 bp, Homo sapiens
cagggaggaaggggtcttgggagtcctggctgaggatgtgctcccatcagccaggactcacaacaccactatctaactg

SEQ ID NO: 6860149 - DNA, 55 bp, Homo sapiens
ggtggctcacacctgtaatcccaggcctttgggaggccaaggcgggtggatcact

SEQ ID NO: 6860150 - DNA, 57 bp, Homo sapiens
tcacatcctatcagtcacggtttcagatatgaaactagagcatgtgagtgggagtga

SEQ ID NO: 6860151 - DNA, 98 bp, Homo sapiens
tcttaaagggagaacattaatgcgaggtattactgacactcagatatttacttttaaattgagaacatgttctcttccttcagaatacatctttgaga

SEQ ID NO: 6860152 - DNA, 61 bp, Homo sapiens
gtcttttttacaccttacatcagaagcaccatggtatggtggattttggtgtcagagagac

SEQ ID NO: 6860153 - DNA, 96 bp, Homo sapiens
ccgcagggagaagagctgtgtgctgtgatgtggtttataaattaccatttggaaggagctgcacagcacagcagcctgcaactactcttcctgagg

SEQ ID NO: 6860154 - DNA, 77 bp, Homo sapiens
tgcctcagtttcatctgcagaaaaacatagagatatttacttgctctaataaattattgtgaggttgaaatgaggta

SEQ ID NO: 6860155 - DNA, 88 bp, Homo sapiens
tggagagagtggattcagacagaagagctggctctgtgctggttttccaggggtcagcccttttgtcagcgacgagtctgcctctcta

SEQ ID NO: 6860156 - DNA, 64 bp, Homo sapiens
gctgcacagttaatatgtgacagaactaatgaaacctagttctcaagacaattacctgtgcagt

SEQ ID NO: 6860157 - DNA, 61 bp, Homo sapiens
gctcaaagaccagacagaggagcttgggattagagtagagagccttgtttggtctttgagc

SEQ ID NO: 6860158 - DNA, 74 bp, Homo sapiens
cttctttgttctgttgtctcacgtactctaaggtcaaaatctttgtcaccagtagaggcagtagagcagagtgg

SEQ ID NO: 6860159 - DNA, 104 bp, Homo sapiens
gaggcaggagaattgcttgaactcaggaggcggaggtcgcagtgagcggagatcgcaccactgcactccagcctggcctgggtaacagagcaagactccgtctc

SEQ ID NO: 6860160 - DNA, 73 bp, Homo sapiens
ctgtagctctgcaatgaagcccaggatctggtttctcccaacttttgaccttggactcactgtctggctgcag

SEQ ID NO: 6860161 - DNA, 60 bp, Homo sapiens
gtctttgagataggtattatcatcccctttctataaatggtgaaatagatactcagagat

SEQ ID NO: 6860162 - DNA, 94 bp, Homo sapiens
ctcaaatttctggctggacatggtggttcacatctgttttcccagtgctttgggaggctgaggcaggaggatcacttgaggccagaagtttgag

SEQ ID NO: 6860163 - DNA, 84 bp, Homo sapiens
gacagaggcttaattaaaaactaatgaagtgaagacgctgggcttacccagtatgcaaattatttcattgtatgttaccctgtt

SEQ ID NO: 6860164 - DNA, 120 bp, Homo sapiens
tttcaaatccctgcttgggaatgatgggggcaatttgccaaaatgcagattcctgggtcccagtgattctgactcagtacatctggagttggccccagaattcaagttggttttttgaga

SEQ ID NO: 6860165 - DNA, 66 bp, Homo sapiens
ctggcacacagaggccctcgggaaatgtggaatgaaagaataaacccagacagcccttgtgcacag

SEQ ID NO: 6860166 - DNA, 89 bp, Homo sapiens
tccctatgttaatgtaaactgatttaggcctagttaaatctctaaaatccctttatagcagtgcctagatattgtttgaaccattggga

SEQ ID NO: 6860167 - DNA, 59 bp, Homo sapiens
gatatgactcatgttgacccattggggtcaatattctcagggacatgatgtgtcatatc

SEQ ID NO: 6860168 - DNA, 83 bp, Homo sapiens
cggggagagacgagcagaagcctggtggtctggggaagtttaaccagtgtcttgatgaatggggcttctgtatctgatctttg

SEQ ID NO: 6860169 - DNA, 70 bp, Homo sapiens
gcaaagcacactggagatgtcgattgaaaactctccttaaaatctgtcaacagtttcccatggcttttgc

SEQ ID NO: 6860170 - DNA, 62 bp, Homo sapiens
ttccaggactgggtgtttgaaggaggagaaaataacttacccttctgctctagagtctagaa

SEQ ID NO: 6860171 - DNA, 77 bp, Homo sapiens
agttctttaccacatggcccccagaggcagttcacaacatagatgtgaactttttctctacgggccagcaaagaact

SEQ ID NO: 6860172 - DNA, 62 bp, Homo sapiens
ttatgcacacaggcttaattcatgggatgttaaaatcttactgaactaaatcttgtgtatga

SEQ ID NO: 6860173 - DNA, 61 bp, Homo sapiens
cctcggagcacgccggccgcccgcccgcccgcctggcgctgctgccaccgcgtgctccagg

SEQ ID NO: 6860174 - DNA, 90 bp, Homo sapiens
gtcttcccacccggggcgcatttctgttcatcatctggacacatgcggctcgcagatgtgtttcctggtgaacatctggggtggggcggc

SEQ ID NO: 6860175 - DNA, 94 bp, Homo sapiens
caaatttggtttgtgacagtttagaactactgtggctaggattgaataaagattgccagtcagtggtttaaaagttatggtggctcagatcttg

SEQ ID NO: 6860176 - DNA, 86 bp, Homo sapiens
ccataaacagtgatacgttccagctcctttctcagtctctgcatgtatatcaaggtgctgatctcagctggtacatcactgtgtgg

SEQ ID NO: 6860177 - DNA, 87 bp, Homo sapiens
cctgtgtgctgtgcatttggccccactgcagctgctggatgcagtccgctagcagctgtggaggggctgtggcttcagggacatggg

SEQ ID NO: 6860178 - DNA, 87 bp, Homo sapiens
gcactggaagacaggcctgaggagatgctgccctggacccagagacatggttcccaggccctgggctctcctggtctggtcacctgc

SEQ ID NO: 6860179 - DNA, 130 bp, Homo sapiens
ctccagatggtccctccctggccctctggtgccggctgctgagttggccaggagaccactacgtgcttctcccaaccagggcctgcacctgtttattccacccaagttggccagttggggtgccaggctg

SEQ ID NO: 6860180 - DNA, 70 bp, Homo sapiens
ctctccctaagacacattcatacgttcaactgaacatttattgagcacctactatgtgctagggatagag

SEQ ID NO: 6860181 - DNA, 66 bp, Homo sapiens
cagtcccattgcaagttatgcgaatcacggctttcctgaccccttggcgtggctttcgaggggctg

SEQ ID NO: 6860182 - DNA, 64 bp, Homo sapiens
tctctgccaagggcttctgaaatcttgtttacatccacacagcttggggaggccctgggagtga

SEQ ID NO: 6860183 - DNA, 58 bp, Homo sapiens
attttctattctgctggtttagggttaccatcacagactcatcctgtagatagaaaat

SEQ ID NO: 6860184 - DNA, 68 bp, Homo sapiens
aaggactcttgggatgacactggacctacctggatgatccaggataatttctccatctcaaggtcctt

SEQ ID NO: 6860185 - DNA, 103 bp, Homo sapiens
ccaacccccttgtctggaattctggcttcttgtctaatttgttattcttaataaaaaattactcacaggaagagtgaataccaagactctccccttgggttgg

SEQ ID NO: 6860186 - DNA, 64 bp, Homo sapiens
gggaaagcataactaatatttattgagcaccaaccatgtcagtgtctatttatatgctgttctc

SEQ ID NO: 6860187 - DNA, 76 bp, Homo sapiens
tggtcaagatgggtgttgtgatggttaattttatgtgtcaacttgactgagccacacatgcccagatttttggtta

SEQ ID NO: 6860188 - DNA, 59 bp, Homo sapiens
tcctccaggcacctcactggctccgtgtcccagaggaggcaagtgacttgcttggaggg

SEQ ID NO: 6860189 - DNA, 55 bp, Homo sapiens
tagtagccaacatttatgatccaacataattgttggatctagttgttggctacta

SEQ ID NO: 6860190 - DNA, 76 bp, Homo sapiens
tggcagttcctgctgctcacctttttgtcatcctcttctcttttcaggggcaaacaggagagtaaagagagggcca

SEQ ID NO: 6860191 - DNA, 63 bp, Homo sapiens
aaatgccagggtcatcccctgggtctttgactcccgatcccagcatttaaatcctggccattt

SEQ ID NO: 6860192 - DNA, 92 bp, Homo sapiens
agaaaatgtgacagagttctcagacctctggatagatgtgaggagcatttttcagtttagactaaaggtagaggtttctctagtccaaatct

SEQ ID NO: 6860193 - DNA, 73 bp, Homo sapiens
atcaaggtgtctgtgtttataattgttaactcttgactttgtttgaaatgatatagcagacatagcctatgat

SEQ ID NO: 6860194 - DNA, 59 bp, Homo sapiens
atgccccttgacctgtgatagcttcaatgaactcagagaagggatgggtcaaggggcgt

SEQ ID NO: 6860195 - DNA, 69 bp, Homo sapiens
tctctccattcaccttcatctcagttttctattctagtctctgaactggacatgaagcaaaatgggagg

SEQ ID NO: 6860196 - DNA, 73 bp, Homo sapiens
ggtgtgaggcaagggcatactaggcagagggaacagaaactccagaggcctaaggatatgctttgcttggcct

SEQ ID NO: 6860197 - DNA, 57 bp, Homo sapiens
ctgctattgataaatttggtctagtaggagattaaggtgactaaataataatagcag

SEQ ID NO: 6860198 - DNA, 70 bp, Homo sapiens
gccagttacccacaactactgaataataaacccaagagcaacttcagtgtttggtggcctgtggctaggc

SEQ ID NO: 6860199 - DNA, 65 bp, Homo sapiens
gggactccagggccactgggccagcggcagagagaaatggggcctccctgtggcctgggggtcct

SEQ ID NO: 6860200 - DNA, 67 bp, Homo sapiens
ctctcctggtgtggaggacagggacttctccattccatccctttcaatctccttcacagcaggaagg

SEQ ID NO: 6860201 - DNA, 96 bp, Homo sapiens
accagggcctcagattcagtgggaatgaagtggaggcccagaaagaatcatgtccaggtgaagctctaccattcccagcagtatttgaggactggt

SEQ ID NO: 6860202 - DNA, 57 bp, Homo sapiens
tttagggtcgttgcattggagggaaatggcttcctctcagattcagagatccctaaa

SEQ ID NO: 6860203 - DNA, 79 bp, Homo sapiens
acccttagaaaccatcagataattcatactggagagaaaccctacaaatgtgaagaatgtggtaaagcttttaagtggt

SEQ ID NO: 6860204 - DNA, 65 bp, Homo sapiens
gggtctcaggaggcagcgctctcaggacgtcaccaccatggcctgggctctgctcctcctcaccc

SEQ ID NO: 6860205 - DNA, 58 bp, Homo sapiens
ttctagatttggggcatgaagttctgccactaaggcataaccagtacccaagtaggaa

SEQ ID NO: 6860206 - DNA, 78 bp, Homo sapiens
gaataggttgtcagtggttatacttactgtttctccaccaggatgaaattatattaaaatcacttgaatggcctcttc

SEQ ID NO: 6860207 - DNA, 64 bp, Homo sapiens
agggagtgctcgggttgtctgaagctggtagtggcagccagcaaagatgtccggggcaagcttt

SEQ ID NO: 6860208 - DNA, 76 bp, Homo sapiens
ccacagtgtgcccagtaattggctgaagcttctcaggaagaacacaacctcagctaaaggctgaggcatatcttgg

SEQ ID NO: 6860209 - DNA, 61 bp, Homo sapiens
ggccagaaagttaagctgtggcccttcagagttttatagggcccagcacaatcttcttgcc

SEQ ID NO: 6860210 - DNA, 63 bp, Homo sapiens
ggaaaggctgtggccgtcagggaaatggagccagatggtcctcatgatcgatgccaagctccc

SEQ ID NO: 6860211 - DNA, 57 bp, Homo sapiens
ggtgcaggcggtggggcaagtaacggcttttggtagccccgcccctccgacccgccc

SEQ ID NO: 6860212 - DNA, 78 bp, Homo sapiens
aagcaggtactgtggttcagtggacgtgtctgtttctacgtatttgagatgtgattcccactgaatcactgcctcctt

SEQ ID NO: 6860213 - DNA, 64 bp, Homo sapiens
ggaagtggtagagccatgagtgactctgcccaggtggtttctaccctgtgtgctttaccactct

SEQ ID NO: 6860214 - DNA, 68 bp, Homo sapiens
ctgtaggtgtatccagctctgcactgaaggggtgagcactacacacagtcagctggatactcttgtag

SEQ ID NO: 6860215 - DNA, 100 bp, Homo sapiens
gcgggacgtcctcatcggttggagagaggcgagttacctgtgctcccggttgtttaggggagagcgagtgggctggcctttccctaggagaggactcagc

SEQ ID NO: 6860216 - DNA, 96 bp, Homo sapiens
tctgtgtgccttggtttccccatctgtaaaatgggagtgaataatagagcttctctcccagattgttgatggcttaaggaaaacaatgcatataga

SEQ ID NO: 6860217 - DNA, 86 bp, Homo sapiens
aattaagtttaggtttgacaatgattaggtagcttctcatctcttgtagaaaagtatttcaatcatttgtgttcctgagagtaatt

SEQ ID NO: 6860218 - DNA, 85 bp, Homo sapiens
actggggtcttcttggcttaccgcttctgatatggaaccatcaccccacaagctgtggtgggacaagagtgatcagggccctagt

SEQ ID NO: 6860219 - DNA, 63 bp, Homo sapiens
tggagaaactctctcagacacccatttggaaatgcattagtgtttttctcagtgagtcctcca

SEQ ID NO: 6860220 - DNA, 95 bp, Homo sapiens
tgcaggaatccttagtgaccaatactgtggatgccagcagtggcagtgaggattgctgaggtctttgatggtgttggctgctaaggtcttctgta

SEQ ID NO: 6860221 - DNA, 106 bp, Homo sapiens
gtttcagatcagctgaatagaaattagcaggtggtgaccacattttataatatgatttttgaagaagtataactatttgctttcttcaatttagttttttaaaaac

SEQ ID NO: 6860222 - DNA, 56 bp, Homo sapiens
ttgggaaaaccatttgcacgttagattacagggtatttatgcatatgttttcccag

SEQ ID NO: 6860223 - DNA, 59 bp, Homo sapiens
gctggcctgtcctgacccagccttggtatctccgggttgtgaaccacagcaggcctggc

SEQ ID NO: 6860224 - DNA, 130 bp, Homo sapiens
taggaaagaaaaatatatacatttccttcttctttttcactttgattacacagcagctaaaaatactggaggctgtttccatttaagtgaatccagaataaggatattaaaagagtttgcctgtctcctg

SEQ ID NO: 6860225 - DNA, 130 bp, Homo sapiens
tacaaagatgtagaagaggaggtgatgtagagtaaaggccagagtactagaggctggatgtgttaaatatcagctgtgtgaccttggccaaattattcaaatgttctggcttcagttcctgtatcaaaaa

SEQ ID NO: 6860226 - DNA, 78 bp, Homo sapiens
ttagtgacttttgtaatgagagctcctggtagcaagcaaccaattgctacactggctgttttgcagaaagaacattga

SEQ ID NO: 6860227 - DNA, 64 bp, Homo sapiens
tagaagggccttcactgtctaagcaactcaatcagctgcttcagcactttgagagcctccttta

SEQ ID NO: 6860228 - DNA, 101 bp, Homo sapiens
ttttgtgtgtatgtgtgtgtgtgcttactttgaattatataacatattcccatttaatcatttatattgactttaaagaagcaaacagcatccatatggaa

SEQ ID NO: 6860229 - DNA, 58 bp, Homo sapiens
gcaaggtggctgcatagtctccagtgtgaacaaagtctggagataagcagtcccaggc

SEQ ID NO: 6860230 - DNA, 79 bp, Homo sapiens
ggctctgacctgagacctctgggttctgagctgtgatgttgctctcgagctgggatctccggggtcttggttcagggcc

SEQ ID NO: 6860231 - DNA, 68 bp, Homo sapiens
actccaaggaaacatgaaatgcattggggacacatcccttcaaggcagattcatgtttcctgaaaagt

SEQ ID NO: 6860232 - DNA, 64 bp, Homo sapiens
tccagttgctgcttctctctagagaccttttatgcttgtttagttctctatgaagtcaacagga

SEQ ID NO: 6860233 - DNA, 55 bp, Homo sapiens
aagcagcatgtgggttatcgggaagagtgtgaacttccgagcccacctgctgctt

SEQ ID NO: 6860234 - DNA, 62 bp, Homo sapiens
tcctcaaaagtcatacatggtgcttactacagagttgctgagtaaatgtctgatttccagga

SEQ ID NO: 6860235 - DNA, 88 bp, Homo sapiens
gcttattaggaagccagaatgggtgaataattcacataacaagtttgtgagcctggttaacttccccatgtctgcatttcaaatcagt

SEQ ID NO: 6860236 - DNA, 64 bp, Homo sapiens
tagactgttacctatatttatgtgccctgttgggacttgcatatatttgttggtggcaaaccta

SEQ ID NO: 6860237 - DNA, 73 bp, Homo sapiens
tgataatatttactttttggcagcattgaagtaatgaaatgtttttcaaaggcattgccaataagtagaatca

SEQ ID NO: 6860238 - DNA, 67 bp, Homo sapiens
ttgcattcataggaagaaaatgggcaatgcagaaggaacattggcctagagaagcttactgaagcaa

SEQ ID NO: 6860239 - DNA, 101 bp, Homo sapiens
gtgtgctgagaacttgactcctgagtttcatcgtagagtacttctgagggtcagaaacactctacgtgcagctcctaacacagtcgaggcacacagcaggc

SEQ ID NO: 6860240 - DNA, 80 bp, Homo sapiens
ttaggttggtgcaaaagtcattgtggtttttgcctttaatttcaatgtcaaaaaccacaatgacttttgcagcaatctaa

SEQ ID NO: 6860241 - DNA, 75 bp, Homo sapiens
aggcttctaggaaactttctggctgtggtgggtgggaagtggaataggacagcaacagagttatcctaaaagtct

SEQ ID NO: 6860242 - DNA, 65 bp, Homo sapiens
tacagtctgagaattactgctctaagagaatgtttgtgcttggagtcccatagtctcaggctgta

SEQ ID NO: 6860243 - DNA, 58 bp, Homo sapiens
gtgagcactgagcattcgtcttcccaactgtccctataaggccatgttctatgcttac

SEQ ID NO: 6860244 - DNA, 63 bp, Homo sapiens
tatgatatttttgaaagtcttttttcacctctgtggtgaaatgaaagttcttaaaatgtcatg

SEQ ID NO: 6860245 - DNA, 85 bp, Homo sapiens
ggccaccagggactgcacttgtcttgggctctcaaggctagaggcaagggctgcccacagagccctggagggcagtcccggggcc

SEQ ID NO: 6860246 - DNA, 110 bp, Homo sapiens
agggatttaggcagtaggaagccccatggatatatgtgacagctgttacggctggaccactcaccatgtgcttggcaccttacctaatatgttatcctgcctaattctct

SEQ ID NO: 6860247 - DNA, 115 bp, Homo sapiens
tgattcaggaagagggttgttatggcattgagcagctgctgcatgaccttgggaaaattgggtttcctgttaattacacagctggccttatgtagctgtcctctccactggatta

SEQ ID NO: 6860248 - DNA, 101 bp, Homo sapiens
tgaggcaggagaattgcttgaatccgcgaggtggaggttgcagtgagccaagattttgtcactgcactccagcctgggcaacagagtaagactctgcctca

SEQ ID NO: 6860249 - DNA, 65 bp, Homo sapiens
tggggctctagtcattgccagaacactgaagtattttcacaccagctggtaaagactgtccccca

SEQ ID NO: 6860250 - DNA, 56 bp, Homo sapiens
ccagagttctgtctgccacacgaaagagaatatttgcttacttgatagaactttgg

SEQ ID NO: 6860251 - DNA, 118 bp, Homo sapiens
aatctgtacatggatgcttatagcagcttgattcacaattaccaagacttgggagcaaccaagatgtcctttggtaggtgaatgagtaaacagactgcagtatatccaggtgatgatt

SEQ ID NO: 6860252 - DNA, 77 bp, Homo sapiens
gttccctgaaagcttgtaagaaaaatattttaaaatctattttcaatgaaaaatattgtttttggctctcagggaat

SEQ ID NO: 6860253 - DNA, 56 bp, Homo sapiens
tccgaacactcaggaagccagagctccagccaggcctgagcactgtggtgtgtgga

SEQ ID NO: 6860254 - DNA, 78 bp, Homo sapiens
ggcgggaagcacagccaggttaggggctgcctgggagagtagttttggcttcagtcttggctatgcgcagtatctgcc

SEQ ID NO: 6860255 - DNA, 78 bp, Homo sapiens
tgttgggcacttagggaatcttagagctggaaggatgcaatagagtctccatcttttcacctggctgtaaccccggca

SEQ ID NO: 6860256 - DNA, 96 bp, Homo sapiens
tgtcctcttccctgttgagtaactatgcttgagaatcagttttactaatggaagactgcttaatttaatagttgcaaaagatatcttaggagagca

SEQ ID NO: 6860257 - DNA, 75 bp, Homo sapiens
tctatcgtcccattggaattgctggcctatgacctgcctgggatatttagctcagttttcccttgggagcgtaga

SEQ ID NO: 6860258 - DNA, 77 bp, Homo sapiens
tttgaataatttcagtgggctctgggctataagactggtccccagttgtctagtaccagtccctggagtaatttagg

SEQ ID NO: 6860259 - DNA, 110 bp, Homo sapiens
tcttaatcaaaagtccccagtaagagccaggcttctctcaggagcatcagcctcagcgacagtccctgggctggagttgctgagaaggtgtgtttgccttttggctgaga

SEQ ID NO: 6860260 - DNA, 122 bp, Homo sapiens
ggaaaagtgtattgttaattttatgtgtcaacttggaaggtgtttctggatgggaataacattgacactgatgtcctctgagtaaagaagattgccctccatgatgtatgtgcactttatcc

SEQ ID NO: 6860261 - DNA, 72 bp, Homo sapiens
gctatgtaagtgatgccagtaagtctcagctagggtggaaaaatcaggctgacaactgagcattttcgtagc

SEQ ID NO: 6860262 - DNA, 59 bp, Homo sapiens
gactccccatccaggcagcaggtgctccctgggcacttaccctgccaggcatggggttc

SEQ ID NO: 6860263 - DNA, 130 bp, Homo sapiens
cgcgcgcgccgcagtcccccgcccccgctcagtgcggcagcggctgtcggccagccggagttggcgccgcggcctgcccggcgcagccgctgtccacctgccagcgggggaggggcgcggccggcgcgcg

SEQ ID NO: 6860264 - DNA, 68 bp, Homo sapiens
gtgttagagtcttgtgctcatttgctgacatgcttagatttggtaatgagatggaggactcttaatat

SEQ ID NO: 6860265 - DNA, 56 bp, Homo sapiens
atacatcttccttttaaaatgcatttacaaaagtaaaatttaagaaggaggggtgt

SEQ ID NO: 6860266 - DNA, 78 bp, Homo sapiens
gttcagaagtcttatttgtcatgtatgtgaatgatgccctatcagtatctgagaaacaacaggaaatcagacctgaac

SEQ ID NO: 6860267 - DNA, 84 bp, Homo sapiens
taacaggagaatagttctggaactctacagcaaccacaatgcctttgtcaagttcttttgaagagtccagagtacagcctgtta

SEQ ID NO: 6860268 - DNA, 90 bp, Homo sapiens
aggaagagtctcagatcatagtgcagctctggagtctctaccaggctaacggggacacccagagcagacactgtccattagagaaatcct

SEQ ID NO: 6860269 - DNA, 61 bp, Homo sapiens
cactttacaaactcctcactgttggttggcaactaaacacagcaagagggagtgtgatgtg

SEQ ID NO: 6860270 - DNA, 78 bp, Homo sapiens
ctcagtggatggagttagaaaaggtatgtatgtatactcacatatatacatgcacatttttatacattttcttttgag

SEQ ID NO: 6860271 - DNA, 61 bp, Homo sapiens
cctgggttccagcaccctctagccccttagctgctggtagatctcaggtgctgaactcagg

SEQ ID NO: 6860272 - DNA, 93 bp, Homo sapiens
taatgtatttgacagagattgaatcaggaaataaattcatgacatttcagttaactagtattacctgtttgtagaatctctgttggaacattg

SEQ ID NO: 6860273 - DNA, 85 bp, Homo sapiens
attcagcctagtatttataatcatgcttaagtctaactttgtattcacttaggggtttgggcctgatcggaataaggagctgaat

SEQ ID NO: 6860274 - DNA, 76 bp, Homo sapiens
ctcattcaggtaggcatttgtgaggaagccagggaactccaccctggattctttcataaaagtcacttcatatgag

SEQ ID NO: 6860275 - DNA, 65 bp, Homo sapiens
ctccctcttccccctcctgctttgaaatgcttcattggcatgggctgaggtgggatagaagggag

SEQ ID NO: 6860276 - DNA, 60 bp, Homo sapiens
gtccccctctggggggcactcactttgtggagcccccggttcctgtttgcagaggggggc

SEQ ID NO: 6860277 - DNA, 130 bp, Homo sapiens
tatatgtatgtgcttctaggaagagcgggtaaatgagatgacacaccctgcccactagcaatctgctactttggcacctaggtttgggagggtgaacagaatcatttgtttgtctcagcaactgcatata

SEQ ID NO: 6860278 - DNA, 62 bp, Homo sapiens
aggtaaacatggggactgctaccaaccccaggagctagggaggtacacttcatgtttcacct

SEQ ID NO: 6860279 - DNA, 78 bp, Homo sapiens
taactctagtatcacagttactcaaataatgactagctggtttgctttcaatctgttaaaactgcgagctgtgggtta

SEQ ID NO: 6860280 - DNA, 75 bp, Homo sapiens
gatgggctccctggcggcttgagaagcagagaaagggaaatagcacattcattgacatctgcctggagtcccatc

SEQ ID NO: 6860281 - DNA, 55 bp, Homo sapiens
ggctttgcttaacgtgcttctagctcccttcaatgctattatttgtagcaaggcc

SEQ ID NO: 6860282 - DNA, 75 bp, Homo sapiens
tggataatccactctgctgactttcaagattattatattattcaattctcaggaatgttgcagagtgattgtcca

SEQ ID NO: 6860283 - DNA, 79 bp, Homo sapiens
attcctgaagccccatttccaattttcaaatttcttcttggagaagaggtagaaaataatggagagaagctgaaggaat

SEQ ID NO: 6860284 - DNA, 71 bp, Homo sapiens
tcagtatacgtgtgctgttgtttttggttttacttaataagtgtttagtgtgatacacatacgtaaactga

SEQ ID NO: 6860285 - DNA, 71 bp, Homo sapiens
cgtttctgggtttctttagccagagcgggcacctgcataactcctgcgtggggagagttaccctggaagcg

SEQ ID NO: 6860286 - DNA, 58 bp, Homo sapiens
aagccagccccatcaaagcattttcctactgacgaatgcagggttacagggctgactt

SEQ ID NO: 6860287 - DNA, 67 bp, Homo sapiens
gttgggcagaggctgtgcagaggacacaggagctgcccttcatcattctctgcagcctgggctcggc

SEQ ID NO: 6860288 - DNA, 82 bp, Homo sapiens
cagggagcacattcagggaagagagggaggaggcaggatgtccctctgccttcgctgctccctgaaacacagtgctgtcctg

SEQ ID NO: 6860289 - DNA, 130 bp, Homo sapiens
gcctcatcaagctctggcctgttttccacttccctgccctgagctgaggtggctgccttagtaaccgcacagatgtggtgacacaggcagctcccagcacggctgaggggacatctcagaccccagagcc

SEQ ID NO: 6860290 - DNA, 66 bp, Homo sapiens
tcttcggtgagctgcgggcgaggactggggtgcggctccttagccagggcagctcaaaatccagga

SEQ ID NO: 6860291 - DNA, 81 bp, Homo sapiens
ctgcagaccctttcccactttcccttacactgcacccatgttggtggcaaggtgataagtggggcctggcttttttggcag

SEQ ID NO: 6860292 - DNA, 129 bp, Homo sapiens
agggtgtggccaactgactagatcaagatgtggggcagggtctggactgaaagctgaggggccactcacactggcagctttggggacagccaaggttgccccatgcttcagtgggaaggtgatttttct

SEQ ID NO: 6860293 - DNA, 118 bp, Homo sapiens
agatgtgcttggttaccatttttttataagctcatattgccctctttatattaaggagccaaggaaaacagtatttgtgtttacttcctgaaaaatggcaggaaatcaaggtacatct

SEQ ID NO: 6860294 - DNA, 85 bp, Homo sapiens
tttgatgtcacatatgttctccatgggtgggattagctgtgctaagcctcactgtcaccagccctgattagagaatgtcatcaaa

SEQ ID NO: 6860295 - DNA, 67 bp, Homo sapiens
tgagcttcaggaccatttcaggcaatggttaattaactataggtgtccctttgtgttctgaaactcg

SEQ ID NO: 6860296 - DNA, 68 bp, Homo sapiens
gagatgggaggatcccttgggccaaggagttggaggccagcctgggcatcacagggagacaccatctc

SEQ ID NO: 6860297 - DNA, 58 bp, Homo sapiens
tgaccactggacagaggaaatatggaggaccacctccagattccgtttattcaggtca

SEQ ID NO: 6860298 - DNA, 85 bp, Homo sapiens
gagaggtatcccacaaatggatgatgtcaaatcgcatcttaatatgctaagagcatgtggctcatccctttatttctagcctttc

SEQ ID NO: 6860299 - DNA, 57 bp, Homo sapiens
tttcatgagacattggcatttgcgtccctctgcaataatagtcactgtctaatgaag

SEQ ID NO: 6860300 - DNA, 64 bp, Homo sapiens
tcagaacttggactccagactcctgttttttggtttgtgtcaggcatctggagggaagctttga

SEQ ID NO: 6860301 - DNA, 70 bp, Homo sapiens
gttttctactgatggatgctacgtaagaggccgacccaggcctcttctgggtaagctattggaacgaggc

SEQ ID NO: 6860302 - DNA, 82 bp, Homo sapiens
catcagccagcacttttaggagctaccagggaagcaaaatgctacgctttgctttgtggtggttcttccaagtctggaaatg

SEQ ID NO: 6860303 - DNA, 70 bp, Homo sapiens
gatggctctgccacctttccctaagaggtccagaagaaatcttttacttggaatgggaggcagaggcatt

SEQ ID NO: 6860304 - DNA, 79 bp, Homo sapiens
agtgtcaggtagctgcagagactattttactacctgcagaacagttacaaaagactagattctgtaagtatttgatatt

SEQ ID NO: 6860305 - DNA, 55 bp, Homo sapiens
agcagagcctttatcaatctggtaccctaaataagtgcatggagaaaggcttgct

SEQ ID NO: 6860306 - DNA, 104 bp, Homo sapiens
aggagcaaattgataaagatgcctgggtcagtggcaagctgggtggttcctaatttataaaaacacctcgagttccattactcagccccttcttttctgctcct

SEQ ID NO: 6860307 - DNA, 88 bp, Homo sapiens
gcatggcttctgtactgtaaaaattggtttggaagctcagggatcacaggaccctggagtgccggaatcaagatacaacctgccttgt

SEQ ID NO: 6860308 - DNA, 130 bp, Homo sapiens
acagggtttcactgtgttagcgaggatggtctcgatctcctgacctcgtgatctgccggccttggcctctgaaagtgctgggattacaggtttgagccaccgcgcctggccctcacacttcttgctctgt

SEQ ID NO: 6860309 - DNA, 80 bp, Homo sapiens
acatgctgctagagagtgacaatcgcaagtgtggctgcttttacagtcagagctatgttgttatattatagtaggattgt

SEQ ID NO: 6860310 - DNA, 61 bp, Homo sapiens
ttgttgtcagcctgtgttacaaagccttgtgttgcaatgtgacagaacaggttgggagcaa

SEQ ID NO: 6860311 - DNA, 72 bp, Homo sapiens
tgtgaattcttaaagattaaattttattttatctctatgtagaggtaggaaaccaatcttttgggaggcaca

SEQ ID NO: 6860312 - DNA, 55 bp, Homo sapiens
gagtgttctgcttgaacttagcttgcagcttcaagcctgagcagcggcagcactt

SEQ ID NO: 6860313 - DNA, 62 bp, Homo sapiens
tggagggcctggctgcccccccagtaactcggggctcatcaggggcagagctaggccctgca

SEQ ID NO: 6860314 - DNA, 94 bp, Homo sapiens
tgtatgctcatgagctaatgattgaaatacctgtatctgtgataacagcgtaatagatacaactgtttaaacattaagtcctcgtgaaaataga

SEQ ID NO: 6860315 - DNA, 66 bp, Homo sapiens
gactgtgggaatgctgatgggatctccaagaagacaccttagagagatgtcgccttgcccagggtc

SEQ ID NO: 6860316 - DNA, 75 bp, Homo sapiens
ccagaccactagtctcatgacagcccaacagcgtgaggcccatggcagctggctgctgttgagacttgtgtttgg

SEQ ID NO: 6860317 - DNA, 88 bp, Homo sapiens
cctgaggcttagtggatagtggtcccctcgacagaagctggagggtcctgcacctgctgagggatagctgctcactggcacactcagg

SEQ ID NO: 6860318 - DNA, 90 bp, Homo sapiens
gtgggtgactcagtcctgctggggaccctttgagagacacagagcacgtgcttctgaatcgttcccatgcaggacgggaggcaggcccac

SEQ ID NO: 6860319 - DNA, 73 bp, Homo sapiens
agagcacagtatctgcacatcatgacatgctcagtaaagcctgatcattattgatgtatagacaatgcgctct

SEQ ID NO: 6860320 - DNA, 65 bp, Homo sapiens
gttccatttgctaagccctgggcctaggctgcacctacccagagctgggcttggcaaactgtgac

SEQ ID NO: 6860321 - DNA, 90 bp, Homo sapiens
agctgcggtcccctcctcccttgacctctaggctgcccaggactaagaattccagcctacagagggcaggtggaggggagacagctagct

SEQ ID NO: 6860322 - DNA, 57 bp, Homo sapiens
tctggaaggcttcaaggtctaagagcagaaacacagcagggacctgggtgttctaga

SEQ ID NO: 6860323 - DNA, 64 bp, Homo sapiens
agttggcacttagccccagtctaaagcaaaagtcttaaatttagctgtggcgtaaggctcagct

SEQ ID NO: 6860324 - DNA, 77 bp, Homo sapiens
caccctctctcagcacagctggctctggaagccactcttggcccaacgagcagagctgggttcaagatggaagggtg

SEQ ID NO: 6860325 - DNA, 82 bp, Homo sapiens
gctgagatctgcaacttgcctctagccattacaatattgcaaaggtaaagtgattttggcagaggtaattcaaatcccaagc

SEQ ID NO: 6860326 - DNA, 95 bp, Homo sapiens
ttgcctttgccagccacagggaagctcaggggctctggccagctagagaacaagaaaccctgtagcttccccactgctgtgttgtgtagtggtag

SEQ ID NO: 6860327 - DNA, 130 bp, Homo sapiens
agaaaagtattagatgatgctgacaactgctgagtttccaaatcttgcagatatttgggtagtataaatctggagaagtttgtacattcaaatgtcccatcttcaggcaggcattgtacaatatttttgt

SEQ ID NO: 6860328 - DNA, 83 bp, Homo sapiens
ggcagatgaccaaccatcctggtttttctggttttagcattgaaaatcctgtactcaaggtaaaccaggatagttggtcaccc

SEQ ID NO: 6860329 - DNA, 78 bp, Homo sapiens
tgttccactggttttggaaatcagtacaagctgctatccagtttgcagtacctcagttccaaaaagcttagtgaaata

SEQ ID NO: 6860330 - DNA, 57 bp, Homo sapiens
tcttttctagctttgaagaagcaagatgctgtgactccttcagctgctaggaaatga

SEQ ID NO: 6860331 - DNA, 97 bp, Homo sapiens
ctgatgagaatctgaggtcaggaagatgagtagcatggagggctgatatgagcactaggggtgggctgtgtctgttttacgtcaagattaacatgag

SEQ ID NO: 6860332 - DNA, 61 bp, Homo sapiens
ggctgcagtagagccctcactgggagtttcttccagtgcaccaagaggcctagactcagcc

SEQ ID NO: 6860333 - DNA, 57 bp, Homo sapiens
gatgattgagaaaacttgcaatttgaacaaatgttttaattgcagtcttcatttatc

SEQ ID NO: 6860334 - DNA, 81 bp, Homo sapiens
agatctgattccctgagggtaaaatgagtgtctatcttgcataggcatcaattttccttaaggatcctcaagtaaagatct

SEQ ID NO: 6860335 - DNA, 58 bp, Homo sapiens
tgaagtgaagctgagtggactctggccacatcccttgtgagaaatatcagctgcttca

SEQ ID NO: 6860336 - DNA, 66 bp, Homo sapiens
atgggctgtgaggtccggcaggtgaggccagcagttgtctatggtcctgagtgagacctggcccgt

SEQ ID NO: 6860337 - DNA, 81 bp, Homo sapiens
agagaagcatcagaattcaatggatatctcctcaacaagtacagaacagatgtctcccatggttttgaccttgcagtctct

SEQ ID NO: 6860338 - DNA, 55 bp, Homo sapiens
gcaacagcccaggttctgtgtggagtcattgaatgaactggagcttgggctttgc

SEQ ID NO: 6860339 - DNA, 65 bp, Homo sapiens
cagttgtatgtaccacaggtggtggtagaacattctattagcttttaagtgtgctacatgctatg

SEQ ID NO: 6860340 - DNA, 57 bp, Homo sapiens
ggcacagagcagattctccctgtgtcttttcacagggctcagatttcattctgtgcc

SEQ ID NO: 6860341 - DNA, 58 bp, Homo sapiens
gccctctgatgctcaccgaggacaactgtggccttgtctggattgttacacagagggc

SEQ ID NO: 6860342 - DNA, 84 bp, Homo sapiens
gaaattcaggcatgtgaagtaactgtccaggatccagtgacaacatcatggtgggccaggtgcagtgctttagtcctctagttc

SEQ ID NO: 6860343 - DNA, 56 bp, Homo sapiens
ggggaccgggagtggggtggcgggagaggacgcgcagaatctcgacttctggcccc

SEQ ID NO: 6860344 - DNA, 111 bp, Homo sapiens
gagcctgcctgatcatcttcactgtcaccttgctcatcctcggaggatgaggacttttcatctgaggaactggcaaagatggccctgaataagtccatggatgggcggctc

SEQ ID NO: 6860345 - DNA, 82 bp, Homo sapiens
tttgtttcagttaaattctccagttaccaattcactttagacagtgaaaaaatggaatgacagagagtctgaatgaaacaga

SEQ ID NO: 6860346 - DNA, 84 bp, Homo sapiens
ggaacatctgattacatgagaatattcctggggttacacattaaggtgacataaatgtattgcttatgaaaacaggtcagtacc

SEQ ID NO: 6860347 - DNA, 68 bp, Homo sapiens
ggcaacatctcattagattcttcttcttggagtaaacaatagagtccagaagcctgatgaggtctgct

SEQ ID NO: 6860348 - DNA, 55 bp, Homo sapiens
cagtgtctcagtttcacttgaagatttgcccagcatttagaaactgttgacactg

SEQ ID NO: 6860349 - DNA, 83 bp, Homo sapiens
gggagtttctctgtgagaaatgcagaatcttgagaaaaattccagacatactggatcaggatctgcatcataagaagattctc

SEQ ID NO: 6860350 - DNA, 67 bp, Homo sapiens
ttgtcatttccttggcattgctagagatgggttgaagaatagtctggcagtaataggggagagacaa

SEQ ID NO: 6860351 - DNA, 56 bp, Homo sapiens
ggagttttgggcacaggctgtcctggataattggacattttggtgaacacagcttc

SEQ ID NO: 6860352 - DNA, 62 bp, Homo sapiens
gacagttggcttcaaaggcagagagggtaagaaggagacgccatcagcttcaagccaacttc

SEQ ID NO: 6860353 - DNA, 64 bp, Homo sapiens
ggagtctatatctcatgagtgctcccaccaatggtgctcagcagaaatgatggtatgggacttc

SEQ ID NO: 6860354 - DNA, 75 bp, Homo sapiens
aggacaatggaagctgtctgaagctgtctagtgttcaagaccaatatgtattagacagtaaggcttcagttgcct

SEQ ID NO: 6860355 - DNA, 55 bp, Homo sapiens
gcttttactcatgacagaaggcaaagcaggagcaggcacttcacatggtgaaagc

SEQ ID NO: 6860356 - DNA, 56 bp, Homo sapiens
ccagtgtgttccctgcctcactgcagcagcctgcaaagggctgagggccacgctgg

SEQ ID NO: 6860357 - DNA, 58 bp, Homo sapiens
ccagccacagctgggtgcctgacggggctgcttttcccttgttggctgctgtggctgg

SEQ ID NO: 6860358 - DNA, 102 bp, Homo sapiens
tgggatccaagactgaattggcaagcaagttatccagttcaagggaaatacagttccatcgtgctttgtgatactgagcttggcattcagactttgaggcca

SEQ ID NO: 6860359 - DNA, 58 bp, Homo sapiens
gaaaatcccagcagctatgtatgggatggttacaccagacactgtgctaaggattttc

SEQ ID NO: 6860360 - DNA, 82 bp, Homo sapiens
ggcaatgtctggaagtatttttggtcatagaagctgggggtgctacagggtctagaggccagggacactgctaaacattgcc

SEQ ID NO: 6860361 - DNA, 63 bp, Homo sapiens
tgagaaggctgtgaatctgaagactaaaagtctggagtctgacttagttttattcatccctca

SEQ ID NO: 6860362 - DNA, 64 bp, Homo sapiens
gtgagggttgctttctttcggggtctccgtgcttggtgacgctctggagaatagtagcttttgc

SEQ ID NO: 6860363 - DNA, 61 bp, Homo sapiens
gctgctcagtgggcctgagcctgaagctgtattaaggagtctaggcttcatcctgggcagc

SEQ ID NO: 6860364 - DNA, 68 bp, Homo sapiens
ttgaggagagggatactgagttttggttggagaaagaacagcagaacctggcatcctcttgacctcaa

SEQ ID NO: 6860365 - DNA, 92 bp, Homo sapiens
gcacctgcaaggtagtatctgatctcactaaaaaaagttagaggatttttcttaaaaatggtttttagtgagatcgataaatgcatgcgtgc

SEQ ID NO: 6860366 - DNA, 89 bp, Homo sapiens
tttcatcagatgcacctgaggctctaaactcagtcccatcctcaactaggaacattctggcagtggggcctcagtgttgtcatgagaag

SEQ ID NO: 6860367 - DNA, 58 bp, Homo sapiens
tgtctgctggttgggagcttaaagacacaaatgtggtagagcttcaactcagcaaaca

SEQ ID NO: 6860368 - DNA, 104 bp, Homo sapiens
aagtatttagagtctttaagtgtgctgaaatggtgtgctgtgcaatgatatatgtacacattcaatgtattacatattattttaaagcttttatctatttattt

SEQ ID NO: 6860369 - DNA, 55 bp, Homo sapiens
ctttctgcctgagctatattcatctcatactgcatgaatgtgctcatggggaaag

SEQ ID NO: 6860370 - DNA, 60 bp, Homo sapiens
ttactagtttttcctctgtcctgtggaaaagtctgacaggcattcagggaagtttggtag

SEQ ID NO: 6860371 - DNA, 76 bp, Homo sapiens
tggtctcgatctcttgaccttgtgatccacccgctttagctccccaaagtgctgggattacaggcatgagccacca

SEQ ID NO: 6860372 - DNA, 60 bp, Homo sapiens
tttcagacatgggggcaaacagaggactgggacctgtggttctgccatcccggtttggaa

SEQ ID NO: 6860373 - DNA, 80 bp, Homo sapiens
gcatcatcttgactttgtaggtaattgtgtctgagatcaggggcacttgcctgcagggagacaaattataagaatgaagc

SEQ ID NO: 6860374 - DNA, 72 bp, Homo sapiens
ttccatggccaacatattgacttttttgttaggagggtggaatcacccctactccatagtcaattcatggga

SEQ ID NO: 6860375 - DNA, 62 bp, Homo sapiens
tctctcatctttcctaactctgcctatcatccgtgtggggcaagcaaggcagggtaaagaga

SEQ ID NO: 6860376 - DNA, 102 bp, Homo sapiens
ttggctcagaggcaatcactgatggagggcaagggcatggctaggtggcacaggattcaaacccagcacagttctttctctagctgtgaagccttgagtgaa

SEQ ID NO: 6860377 - DNA, 59 bp, Homo sapiens
tccaaagaacctggctactgtcctttctggggcgtgtgatggagaggttagaatttgga

SEQ ID NO: 6860378 - DNA, 58 bp, Homo sapiens
ggtgtttcttgataaagcagaaaatcagcaggtgcttcttttctgtgccaagaaaact

SEQ ID NO: 6860379 - DNA, 61 bp, Homo sapiens
atgtgctctaggaccttagaagtgggagcagttgctttcatttgtaaggattagggtgcgt

SEQ ID NO: 6860380 - DNA, 78 bp, Homo sapiens
tcctgggcttgggccccataggagccaaagacctgggacccccagggctttggccccctgctgcagacctgcccaggg

SEQ ID NO: 6860381 - DNA, 67 bp, Homo sapiens
ctccatgtcttacacctgaaaccctcccaccagcctgggagcccgttttacaggtgagaaaatggag

SEQ ID NO: 6860382 - DNA, 56 bp, Homo sapiens
tggctgcagaacctcctcaggagaccttattcttttcctaggatgttttgagtcca

SEQ ID NO: 6860383 - DNA, 109 bp, Homo sapiens
gtcaataaatatgggatgaacaaaggatttatcattacaatccacaaataaaacctcccatttggctaagttgtaatgtaaacaatctgttcattgatttggctttgac

SEQ ID NO: 6860384 - DNA, 69 bp, Homo sapiens
ctaagctgtccatcactgggggggatgattagataatggatcacttacccagactgtggaattgttaag

SEQ ID NO: 6860385 - DNA, 81 bp, Homo sapiens
ctggaaataactgtacactggccccagggcggggctgctgaaatctagcagccctctccttgctagactgtaagtgtccag

SEQ ID NO: 6860386 - DNA, 65 bp, Homo sapiens
ggtggggccagcagtatgcgaggcatcaccaccatcacggtaaaccagagcctgctgagccccct

SEQ ID NO: 6860387 - DNA, 64 bp, Homo sapiens
agaggtgctagaaaacctagatgcctgtgattccatttcaaggcttcacattttctaggccttt

SEQ ID NO: 6860388 - DNA, 130 bp, Homo sapiens
aatttaatgtttcccctgtggcctaaaagactaatgaagcttcttaagttcctgcagcagtcccagactgtaacttaggcacaagaagctgggtcattaagctaaaggtctctggatgagcatcatctct

SEQ ID NO: 6860389 - DNA, 60 bp, Homo sapiens
tctttctgaagtcttctaacagatgattgttctaagtcatcattgacttgtgcagagaga

SEQ ID NO: 6860390 - DNA, 64 bp, Homo sapiens
gctgaggctggggaggcagaggctgcagtgagccaagattgtggcactgccctccagcctgagc

SEQ ID NO: 6860391 - DNA, 62 bp, Homo sapiens
tggggctgctcctccatggggactgtgtccatcttgggaaggcccaggagtgagcagcttta

SEQ ID NO: 6860392 - DNA, 60 bp, Homo sapiens
tttcagtgcccagagctttgcaggtcccaccgcttccctcaagcatcccctgtactgaga

SEQ ID NO: 6860393 - DNA, 80 bp, Homo sapiens
agtgattctcttgtaagctatgttcaggtggtcaagataaaaatgacattcctagcaacatggtcctacattaaattatt

SEQ ID NO: 6860394 - DNA, 88 bp, Homo sapiens
tggttccaaagtcagctgccagtcccaattccacatggtgcctatacacttggcccctagtgttgggctgggttgacttctccttcca

SEQ ID NO: 6860395 - DNA, 60 bp, Homo sapiens
ctgttggttacaagtttgctctgccccatcaaagagggccaagatgtcttgtgactacag

SEQ ID NO: 6860396 - DNA, 60 bp, Homo sapiens
gtaggagccatccccatgagaggtaagccatggaggcgatacctggggaaaggtacctgc

SEQ ID NO: 6860397 - DNA, 55 bp, Homo sapiens
agaaaacactgccccctctctccttttgagcgaggtcagagacgtggtgtttttt

SEQ ID NO: 6860398 - DNA, 77 bp, Homo sapiens
gtgcagcaatttgcagtaatttatggttgttacgtaagatctttaagccttgagtctgtgctgtaatttgtctgggc

SEQ ID NO: 6860399 - DNA, 56 bp, Homo sapiens
gctcctgcttagcttctctcccggacaccctgagactgagaagctcgcagtgatgc

SEQ ID NO: 6860400 - DNA, 56 bp, Homo sapiens
gcctggaggaatgtagctgaggtcaccaaaattggattcctggcttccatcttggt

SEQ ID NO: 6860401 - DNA, 68 bp, Homo sapiens
tgaaaaggagccttaggtaggttatatgtatagcagatatcttcccctactctatggcttccttttca

SEQ ID NO: 6860402 - DNA, 64 bp, Homo sapiens
ccagggcaattatttggagggttaaacgaatttatgcaaacaaaaccctctgaatagtatctgg

SEQ ID NO: 6860403 - DNA, 60 bp, Homo sapiens
gtgcatttatatttgcctttggtatggatcgtataactgcctaaggcagtatgattgcac

SEQ ID NO: 6860404 - DNA, 57 bp, Homo sapiens
gtgattcaaatgtaactaattacttttgagactgagtttggaagttatatgagtcgc

SEQ ID NO: 6860405 - DNA, 117 bp, Homo sapiens
tccttgtctcagtcttttcatctataaaatgggaccctaatgcatctagttcctagaatttaaatattcctggcaggtgtattggctgttgtgtggaatctgagcagcgaacaagga

SEQ ID NO: 6860406 - DNA, 95 bp, Homo sapiens
gagaaatgaaaaaagacctaaataaatggtgatatataacaaatttatgtattaggagattccatgtttttaaggtgttaattttcccccaaatc

SEQ ID NO: 6860407 - DNA, 78 bp, Homo sapiens
tgagatggagaagcagaaaaatatgtctttgcattgattagcagggaatgtaattaatctccttcaactcccttttca

SEQ ID NO: 6860408 - DNA, 55 bp, Homo sapiens
tttttcatgagactagaagtcatttatttatgaatcttttatgtgtcatgaggag

SEQ ID NO: 6860409 - DNA, 77 bp, Homo sapiens
aattcagcaagtgggaaggttcggatgaagatcttgtggaaaattatctgaacaacctttattacttttccagaatt

SEQ ID NO: 6860410 - DNA, 59 bp, Homo sapiens
aggccactcagggggccaagatcctgtcactccttttctctaggccctgcgaatggctt

SEQ ID NO: 6860411 - DNA, 125 bp, Homo sapiens
ccgagagccacgcagagcctggccttggccttggcctcctggtgctggggctgccgccgctgcgggggttgccgctgcgccgggtgctgctggggccgaggttgaacagagacgccagctttcgg

SEQ ID NO: 6860412 - DNA, 76 bp, Homo sapiens
ctaagtactgtgaaaggagaaatggaaactaggttaactacttagtgttttgctaatcctattaatcggtatgaag

SEQ ID NO: 6860413 - DNA, 58 bp, Homo sapiens
gggcgtatcacctgaggtcaggagtttgagaccagcttggccaacatggtgaaacccc

SEQ ID NO: 6860414 - DNA, 60 bp, Homo sapiens
ccctaggggcaatgatggtgctggggtgtgatgttttcagtatgaagttgtgcttggagg

SEQ ID NO: 6860415 - DNA, 69 bp, Homo sapiens
ggcatagtggaaaaagaatagggttagataaagttgtatgttatgacccttctggttcctaccaatgtc

SEQ ID NO: 6860416 - DNA, 61 bp, Homo sapiens
aagccctggaaaagcatcattgagattggttcacctcccatccattgttttcccagggttt

SEQ ID NO: 6860417 - DNA, 62 bp, Homo sapiens
tcaagtggaggcagtttaagtctgagaaaaattattctttctgaagatgctgtttccagtga

SEQ ID NO: 6860418 - DNA, 55 bp, Homo sapiens
cacagggccagccctatttttggtaaagttaaattggaaactggcttggcctgtg

SEQ ID NO: 6860419 - DNA, 61 bp, Homo sapiens
ggtctattgagcagcctctgaaagctgcagagaccactcctgaggtagttcagtcaagacc

SEQ ID NO: 6860420 - DNA, 60 bp, Homo sapiens
ggcagaaggcagatcccacaaaatgcagggaaagcactgcagggtgttcctgcctttgct

SEQ ID NO: 6860421 - DNA, 78 bp, Homo sapiens
ggggctcaatgaatgcttattaaattgaaatgaattataaattatgaaggctttttaaagcatttgttggagccaacc

SEQ ID NO: 6860422 - DNA, 77 bp, Homo sapiens
gcttatgccattatttctgcatatcagggactattagtattttcactaatttactactgctatctagaaggcagagc

SEQ ID NO: 6860423 - DNA, 116 bp, Homo sapiens
aagtgcattaaaatgctttctcagattttactactccaattaatgattccattttcttcaagggttattgactgaaatgagagtgattcccatgtgggaggcatgttcatgtactt

SEQ ID NO: 6860424 - DNA, 111 bp, Homo sapiens
tttcaggcctctccttcttcatgtgataggtctagataccacctgtgtacctggaaacttgcaattatatttgtggtttttggctcctttataaggggacaggccttgaga

SEQ ID NO: 6860425 - DNA, 112 bp, Homo sapiens
gactgtggcaaaacattcctataaaagccagtgcagctggaaattcacctatcagagggtagaacaaccaaaatgtatgtgtactatagtgttgtgtatttttgtttgagtc

SEQ ID NO: 6860426 - DNA, 65 bp, Homo sapiens
aggccaagcaggcaaggttgtggggcacctggaaggtgggtgtccagcggcctggctgctgacct

SEQ ID NO: 6860427 - DNA, 87 bp, Homo sapiens
cagaaggcatgggcgagcagagccattgcctatcatgaaacacccttgcatgggacaaacctttgatttgaaaccctatgcctgctg

SEQ ID NO: 6860428 - DNA, 69 bp, Homo sapiens
cagtagggatggcaattattatggcagcggaggtgaagtatgctagtgtgtctatgtctgttcctactg

SEQ ID NO: 6860429 - DNA, 61 bp, Homo sapiens
cctgaggcatggtcctgagggagctcagccaaaaggggcttagaagtacacatgcctttgg

SEQ ID NO: 6860430 - DNA, 93 bp, Homo sapiens
ccactgttatgcctctccagatgctgaaatccagttcggggacctatcgtctctgggctgccttttagctcttgtgggacttgattaacttgg

SEQ ID NO: 6860431 - DNA, 55 bp, Homo sapiens
cacatgcatgaaatccataaacacaggggcatggctgtgtgtgcgcgtgtgtgtg

SEQ ID NO: 6860432 - DNA, 114 bp, Homo sapiens
ctcagcttacttcctgctctcagacttcatcctccacatgaccccccagcccagggtgatggggctgggaggaatttggggaatagagacctggaatggggtatgagacctgag

SEQ ID NO: 6860433 - DNA, 72 bp, Homo sapiens
gcttacttgtaacaatctgtcataaatgtccttagaaatataaatgcttgattacaggttgttactttaggt

SEQ ID NO: 6860434 - DNA, 66 bp, Homo sapiens
agttaaaacacatgagtagctagtaccaaaatgtcccacatcgtgctgtacttctgtgttgaagct

SEQ ID NO: 6860435 - DNA, 104 bp, Homo sapiens
tacagtgtttaagagaatcaccccataatattaaatgcttttgtattaataaatctggatgtatatggcattttaatgtatgagtattttcattgaacactgtg

SEQ ID NO: 6860436 - DNA, 66 bp, Homo sapiens
cgtggagaaagctgacttggctggtgtggtacagagaagccagcttgtttacatgcttattccatg

SEQ ID NO: 6860437 - DNA, 74 bp, Homo sapiens
gcttcagctcagttctaacgttctccgggagttctcaccatcgttttctccaggccaattccagctgagttagc

SEQ ID NO: 6860438 - DNA, 96 bp, Homo sapiens
gggattggtattttatggctttgtcttaaaattctcagcaatgttttgttttcttttaaaagcctgaagattataaacagacataagagcaagccc

SEQ ID NO: 6860439 - DNA, 82 bp, Homo sapiens
ggcattgttcacttgcatttttagatgcttctgtcttgtcactataactagatatgagcttgaaatgaactgaaatcttgcc

SEQ ID NO: 6860440 - DNA, 85 bp, Homo sapiens
tttcctagaagaccggtgagagcatttgaattataatccaaatattttcctggctttcattgaaatacagtcttgacttaggaaa

SEQ ID NO: 6860441 - DNA, 124 bp, Homo sapiens
gggacttaagatcaaagcctcctgttggataaggacagtgaagagccatatagaaatcatccagaaccttcagtgggtatttactgattccttcacctgaggaagctgtatattattaaatccc

SEQ ID NO: 6860442 - DNA, 64 bp, Homo sapiens
tcagtagcctctgacagtgcaaattttattgcctcccaaatttgtagacgtcagaagttactga

SEQ ID NO: 6860443 - DNA, 59 bp, Homo sapiens
agggtcgggggagaagaggcctgggcaggacaggccacctgggatctcatcctggccct

SEQ ID NO: 6860444 - DNA, 96 bp, Homo sapiens
gaatgcagtgataaatatgtatggagttcatgaattctacaatgattgacaagctgtttatgaactacagatataactaacatcctttttgcattc

SEQ ID NO: 6860445 - DNA, 66 bp, Homo sapiens
gctgggtgctgttcatcatcatgagtgctgaaatgggagcctctgagcctgtgtgcggcacccggc

SEQ ID NO: 6860446 - DNA, 82 bp, Homo sapiens
gaagatgcccacgagggtccccagcacgctgctcttggctggagagggcaatgtgcacgcccttggggacagatgcctcttc

SEQ ID NO: 6860447 - DNA, 57 bp, Homo sapiens
ggtttttccttaaatctgtttctagtgataacattagctcacaggttaaaggacatc

SEQ ID NO: 6860448 - DNA, 81 bp, Homo sapiens
ggaagctctctctcagtgccgctctgctgtcatttggctgcagattgggccagcagcagagctctggtctgcatggctgcc

SEQ ID NO: 6860449 - DNA, 68 bp, Homo sapiens
aagaggtggagcagatatctttcccagccctctgctgtgacagaattggtctgttctctcacctactt

SEQ ID NO: 6860450 - DNA, 79 bp, Homo sapiens
ggaaggaaaatgcatattggattagcagccagcagtttctgtgattttctaggcatctatgcaatttgcagatcttttc

SEQ ID NO: 6860451 - DNA, 65 bp, Homo sapiens
ggactttctcaggcacttcttccccgcactgtctgcttgggcggggcaggagcctgggttaaacc

SEQ ID NO: 6860452 - DNA, 74 bp, Homo sapiens
aatgccagaattgagttcttttagaattcagtgtccttgtattgaattcttttagaattcagtgtccttgtatt

SEQ ID NO: 6860453 - DNA, 57 bp, Homo sapiens
aatggctgaggctggaggtggcagctgttttcacggttcctaccttcctctgttatt

SEQ ID NO: 6860454 - DNA, 68 bp, Homo sapiens
gtggctacatggtgtattgattattgctgtctttttggacagaactgggaaatgcacatatgcatcac

SEQ ID NO: 6860455 - DNA, 56 bp, Homo sapiens
aggatgggggaggaaaagagaaaataaacagaagtcgctctcactcgccacatcct

SEQ ID NO: 6860456 - DNA, 63 bp, Homo sapiens
gggaaggacacagccatgactggaacccaggcagcccagctcatagatcaggctttgattccc

SEQ ID NO: 6860457 - DNA, 103 bp, Homo sapiens
ggcgggctgagctcctgggcagggcagtttggcaggatggaggggtgtgcaggccaaccccgggacaatcgccgcactgtgcccagtggtggggccccaagcc

SEQ ID NO: 6860458 - DNA, 61 bp, Homo sapiens
agcatttttttgaggctttagacaaaaagtgtaaatagagaatcagcttggagaagatgtt

SEQ ID NO: 6860459 - DNA, 122 bp, Homo sapiens
tttggatgtaatgtaatgaataaatgttactaacaactcctctctggagttatgcagagtatgtttgtgaaaagcctatgacacacccagagagagctgtatttgatacataatataccaaa

SEQ ID NO: 6860460 - DNA, 89 bp, Homo sapiens
gagaggtattaaaatcctgctggcctccacttgctcctcttccccgtggagcaaggagcactgagccagcatgggtatatctggctttc

SEQ ID NO: 6860461 - DNA, 56 bp, Homo sapiens
ggggccttggatctgtgccccgcccatggaacagcgcccgggctcggagaggcccc

SEQ ID NO: 6860462 - DNA, 93 bp, Homo sapiens
ttcattccttttggctgtttttggttgttgggtaagagtataaatatctctatactgatattttcaactagaagccagaaaactgggattgaa

SEQ ID NO: 6860463 - DNA, 81 bp, Homo sapiens
gcctgagatacatacttctttacattccatagcttagcaggtccatatgggcatataaagaagtatgtttcccaagcaggc

SEQ ID NO: 6860464 - DNA, 82 bp, Homo sapiens
ccccgccccggccgctctgggttcagccccggccctgcccacgcgcgcaggaggcgccggagccggacggagcggggcgggg

SEQ ID NO: 6860465 - DNA, 77 bp, Homo sapiens
caaggaaaggaatatattctgcagacctatggacattaaaagttactctgctttaatggaaagtgtttttttctctg

SEQ ID NO: 6860466 - DNA, 74 bp, Homo sapiens
ctggtacagctggccacagatccccagggaggtagcaagctccccatccctgcaggtgtgcaagctgagaccag

SEQ ID NO: 6860467 - DNA, 105 bp, Homo sapiens
ctatgtgactaaggaagactcaatgcatgagtcactcagtgcagaatgtaccattgatatattgtttctgagttttcatgtataattcacttccacagtgcatgg

SEQ ID NO: 6860468 - DNA, 55 bp, Homo sapiens
catgtgttttctttaagccagttggtttgggacttttggcttctggcaacagatg

SEQ ID NO: 6860469 - DNA, 62 bp, Homo sapiens
gcactgagctttggaggagcagggggcaatgaggtggccggtgtgacgaggactcaatgtgc

SEQ ID NO: 6860470 - DNA, 66 bp, Homo sapiens
acggtgtgatctcaaagcatggagcagaatgagtctccactttgtccgctatgggatcttcactgt

SEQ ID NO: 6860471 - DNA, 59 bp, Homo sapiens
tttcagaggacaaccagccatctccactcaccataggaaggtggctgcatcctcagaag

SEQ ID NO: 6860472 - DNA, 68 bp, Homo sapiens
agggctcactccaaatatcacctgttcagtaggctttccaatagcactgaagatgtcttagtggccct

SEQ ID NO: 6860473 - DNA, 76 bp, Homo sapiens
atgcttctccacataagacagtaactacagttctgtggtaaatgcaacaggactgaagtcattgccaaagaagcat

SEQ ID NO: 6860474 - DNA, 87 bp, Homo sapiens
ctcttttggccttttcagagaaagcagatttactcctgctttaaggagctcagtctctactttcatttgacttgaggcattatagag

SEQ ID NO: 6860475 - DNA, 70 bp, Homo sapiens
tgaggatttctatggttctttccttccttttgcagattgcagaagaattgtagaaccataccaatcttta

SEQ ID NO: 6860476 - DNA, 55 bp, Homo sapiens
ggatgctgtgcactactctggcatttagccatgtatagtggaattgccagcttcc

SEQ ID NO: 6860477 - DNA, 67 bp, Homo sapiens
ggtgtttgtcaggattggggtcatgagtcttttagtggaagcattcatgtccttcctgaacggcact

SEQ ID NO: 6860478 - DNA, 80 bp, Homo sapiens
tccttcaggagaatatatttgagaatattcatgagacttggcaacagctcttgcacttcatgaatatgttttcctgttga

SEQ ID NO: 6860479 - DNA, 59 bp, Homo sapiens
gactgcatcctggaaatagctaagatcagattacctcttggcagaatccaatgcacgtt

SEQ ID NO: 6860480 - DNA, 72 bp, Homo sapiens
agtgctcatgaggcttaattatcagtgaaatgtcttgctttagatttcacagcttaataaggctcagagact

SEQ ID NO: 6860481 - DNA, 82 bp, Homo sapiens
ctgaaatggagcactgtgtttagaataaacgtgatgattacataatgatatctgtactttacatgcagtgctactctttcgg

SEQ ID NO: 6860482 - DNA, 59 bp, Homo sapiens
tcttgggaactctaacattttgcaaacatgagattgtatgataacaggagttttggaga

SEQ ID NO: 6860483 - DNA, 84 bp, Homo sapiens
ttaaagtggtaaatgataccgaaactgcccggattatcactagatattcaggcaaggctggtctcatactctggttcactttaa

SEQ ID NO: 6860484 - DNA, 59 bp, Homo sapiens
cttttaaagatggcgccctgtgagttaccatgacaacctatagatatcatctttagaag

SEQ ID NO: 6860485 - DNA, 66 bp, Homo sapiens
ctagaagcttcagggaagataaaaagcattatgtttatatccatctttgaagtaagtaaaagctgg

SEQ ID NO: 6860486 - DNA, 65 bp, Homo sapiens
caaggattctcactagactagaaagcagttctctgcaactggtggggttgggtgaagagtctgtg

SEQ ID NO: 6860487 - DNA, 74 bp, Homo sapiens
gggcaggtaggaaatttatagaggtgtttcaaaaagaaattctagaataatcactttaagtattgcatttgccc

SEQ ID NO: 6860488 - DNA, 97 bp, Homo sapiens
actgtggaaagtatactcatgtctcagaggacccctggctaatcagcctctgccaactgttgtcataaggagatgtgggtatgcttagtcctccagt

SEQ ID NO: 6860489 - DNA, 98 bp, Homo sapiens
gagatgtagatatggacatagatatagataaatgaagatggtgggctattttagtcaggatgctattgttattaatctctgctccatactgcaagctc

SEQ ID NO: 6860490 - DNA, 104 bp, Homo sapiens
agaacctcccctttccgtgctggctctgggccaagcagggaggcaaagatctgagagtcaccctgttctttgtccagaaggacagcacagagaatggcacttct

SEQ ID NO: 6860491 - DNA, 74 bp, Homo sapiens
tatgcatatattttcccatcttaaagtttattgataaaaaatgtcttctcaaggattcggggaagtactgcgta

SEQ ID NO: 6860492 - DNA, 60 bp, Homo sapiens
cgcctggaacctctaggaccagggacacaaactcttatcttggaaatggaggtactggtg

SEQ ID NO: 6860493 - DNA, 59 bp, Homo sapiens
gctcaggcctggcccatgggacatcatctgtgtgttgtatgagtcagtgtctgacccgc

SEQ ID NO: 6860494 - DNA, 72 bp, Homo sapiens
ggaaaagcaagggacatttctcataggagatgacagttcatttggctcctgagggatgcttaggcttttgcc

SEQ ID NO: 6860495 - DNA, 55 bp, Homo sapiens
gcagctctggggcaggcctgagactctgcatttctctcaagctcccaggtgctgc

SEQ ID NO: 6860496 - DNA, 79 bp, Homo sapiens
tcttgtcttagatgctgggaccacagagtgttgtggctgactgtttatttgacactctcctccagtggataggccatga

SEQ ID NO: 6860497 - DNA, 55 bp, Homo sapiens
tcaaaggataactgagggcagtcaagtaaggctccatgtaggtggtatcctttga

SEQ ID NO: 6860498 - DNA, 64 bp, Homo sapiens
caccatacattctctataagtgcatgtgtgtttacataaatgcacagaaaggatgtggaaggtg

SEQ ID NO: 6860499 - DNA, 55 bp, Homo sapiens
tcatcagagccattgttaagaagaggcgagtcttctcacaatggatacctgatga

SEQ ID NO: 6860500 - DNA, 57 bp, Homo sapiens
ggaggttataggggtgatttttgcaactgagctgtggctatggttaccataaccgcc

SEQ ID NO: 6860501 - DNA, 118 bp, Homo sapiens
tcagtgaaatgaatagacatcttgtttcacctgtttcacctccctgaactgtaggagaaagagcccagtcctggacttggagtcagggaaacctatgtaagaacgctaggtttgctga

SEQ ID NO: 6860502 - DNA, 55 bp, Homo sapiens
tcatgggctgctgacaggggctcagggatgctccctggccccatccatcctatga

SEQ ID NO: 6860503 - DNA, 76 bp, Homo sapiens
tcacttgagcctgggaggttgaggctgcagtgagcaaagatgctgccactgcacttcagcctgggtgacaaagtga

SEQ ID NO: 6860504 - DNA, 108 bp, Homo sapiens
gttacagtgtttggatgtaatagaatttgttattcataggatttgatctgtatttcctaaaagtcttaggagtagaattctcacatatattgtcaagcttattgttac

SEQ ID NO: 6860505 - DNA, 62 bp, Homo sapiens
tgaacagcatgcatgcaagactaaatgctagcgtaatagcatagatttttgcctgctgttta

SEQ ID NO: 6860506 - DNA, 63 bp, Homo sapiens
ggacatctgtcttcatcagcatgtgatctggtggagatacgtgctgttttaagatacaggttc

SEQ ID NO: 6860507 - DNA, 63 bp, Homo sapiens
cttcctggaatgtctgctcaatgtttggggcctagctccagtgacactgctgcattcaggaag

SEQ ID NO: 6860508 - DNA, 96 bp, Homo sapiens
agagagatttgatcttttctgtagatggggtgagactaggattaaatttcaaaatttgagaaaaatattttcattccatttatgggagaactttct

SEQ ID NO: 6860509 - DNA, 78 bp, Homo sapiens
attgaggtgaaccctaaactatcagtagctataagtcttcttttggcttcttgtttggtttaagaggattcctgcaat

SEQ ID NO: 6860510 - DNA, 76 bp, Homo sapiens
cctctgccatttcttgcagtcaagtgttaaggtggagaactttcaacatcaagaatgcatggaattagggaagggg

SEQ ID NO: 6860511 - DNA, 60 bp, Homo sapiens
gtattaggttggtgcaaaattgacaatggcaaaatacacaattttgcaccaacctaatat

SEQ ID NO: 6860512 - DNA, 98 bp, Homo sapiens
agcaaccatttgatcccggcttcatttcaggctgaagaataatttcttctggttgtttttcttcggtgctgggttgatcctggggccgagtggctgct

SEQ ID NO: 6860513 - DNA, 85 bp, Homo sapiens
ggggcaatgtggtcatctctagggaccctccctgctctaacattctttgaatgtggtgggtcctgaggtggaagcactctgtccc

SEQ ID NO: 6860514 - DNA, 61 bp, Homo sapiens
ggccagttctcaggaatacaggcggcagctctgcttgctcttgaccttggagaactcggcc

SEQ ID NO: 6860515 - DNA, 67 bp, Homo sapiens
gtcttagcatgtcagcaccgggtttataacaccttgatggtgtaatccacacatctggcatgtgagc

SEQ ID NO: 6860516 - DNA, 64 bp, Homo sapiens
cagcaggaaggtgggaagcttcccggggatgtttttcctggaggtcaagtccccccttgggctg

SEQ ID NO: 6860517 - DNA, 59 bp, Homo sapiens
ttagaatcttgtatcagaagttgtggaattccagagtttctgaagtatatgggttttaa

SEQ ID NO: 6860518 - DNA, 57 bp, Homo sapiens
gatttcagtggctgtctcaaatgtcaaaatgatggagaggacagagagactgaaatc

SEQ ID NO: 6860519 - DNA, 60 bp, Homo sapiens
tagccttttgggaagggctattttttgacaaactatacacaaaaatccttcccaaagcta

SEQ ID NO: 6860520 - DNA, 58 bp, Homo sapiens
agaaatgagtggtggagccaaaatgaaaatcttcagtttgactccagagcccattttt

SEQ ID NO: 6860521 - DNA, 74 bp, Homo sapiens
gccaggttagtgcagttggttagaatgtggcaatatgtccataattatttcccatgtgaatcaattggcttggc

SEQ ID NO: 6860522 - DNA, 84 bp, Homo sapiens
gtgttttaccttcttggagcttatgtgcttaataaacatcattaagaatacaaacttaaggctttacagaaataggcaaaatat

SEQ ID NO: 6860523 - DNA, 78 bp, Homo sapiens
ggtttgttttatccaggacctcagttattatgaggattcatatcttctcacacagggctccttgggctgacacaaatt

SEQ ID NO: 6860524 - DNA, 129 bp, Homo sapiens
aagcctcaccactgtatccccagcgaggtctctcttacatgcaagctggaaggaggcttgctaatgtcagtctctgaattctgatgcaagtgagaggcagcccatagtgatataggtggaaacagactt

SEQ ID NO: 6860525 - DNA, 59 bp, Homo sapiens
gcattaggacagagatgtcaagaggcattcccacccctcttatattcctttcctgctgc

SEQ ID NO: 6860526 - DNA, 68 bp, Homo sapiens
tcctcaggctgtgccacctgtgtgacatccatgccagccctctgtcccatgtaggcacatgcctggga

SEQ ID NO: 6860527 - DNA, 79 bp, Homo sapiens
ctggaagaaaactggagagttgtgacctagtttaacaccagtatgatgatgaaaattgcagctctgagatttctactag

SEQ ID NO: 6860528 - DNA, 67 bp, Homo sapiens
tctgtccattcagccatccatctgaatatattaagagttttacagaatgtaggctgacctggacaga

SEQ ID NO: 6860529 - DNA, 63 bp, Homo sapiens
ccagacagattcagactatctccattttttttaccaatggtagatgtgaatgaattctgctgg

SEQ ID NO: 6860530 - DNA, 88 bp, Homo sapiens
caggaacagttttctatggtagaagcatgagttcatttgcaattttgtgccatgttttccattgccatggaaactcacaattttcctg

SEQ ID NO: 6860531 - DNA, 65 bp, Homo sapiens
ggcatctcttcaattgtcacaaagcttatcatgttcacttgctggcaatttagagatttctagcc

SEQ ID NO: 6860532 - DNA, 61 bp, Homo sapiens
gattgaaaggaaaaccagagtgatgttatgactcagaaagtgactcttttccttttgaatc

SEQ ID NO: 6860533 - DNA, 130 bp, Homo sapiens
aagcacaactaaatctcagccattttcaagtacagctaggtcttcagcactttaagaactgcctctcagtgcaaagtggaaaatgaaaaccagctcctgcatattgattgtagctgattacaattgtgtt

SEQ ID NO: 6860534 - DNA, 58 bp, Homo sapiens
gggttcagagtcaggtgtgatactattgatatactatcagttcccctcctctgtacct

SEQ ID NO: 6860535 - DNA, 58 bp, Homo sapiens
agtgatccgatgtcagtcgcagattccttttggtgtctgccaagggtgtggagttatt

SEQ ID NO: 6860536 - DNA, 79 bp, Homo sapiens
aggccagctgtcactcagaaaggcccaggagcaagtcaaggagtctaccaatggccatttctggtgacagctattgctt

SEQ ID NO: 6860537 - DNA, 93 bp, Homo sapiens
gggatcctttccttagattatctttttaagggttggcctgggcatagataggtcaactttaagatgatcttttttcaattgagggcatatccc

SEQ ID NO: 6860538 - DNA, 74 bp, Homo sapiens
tctggtgcagttctaagaaaatcaggttattcatctcattcaaagaatcctgggttaattatgattcaccatga

SEQ ID NO: 6860539 - DNA, 56 bp, Homo sapiens
aggggagccgaggggcatctgtcggcccaagtcagccacagccctctgctctgcct

SEQ ID NO: 6860540 - DNA, 59 bp, Homo sapiens
gtaggtctagggcgaaatccagaaactcgtttttgtcaagcagatgtcctctggactac

SEQ ID NO: 6860541 - DNA, 76 bp, Homo sapiens
ggctgtcagaaagtgtgggggtacaggtgggcgtgtgcagtagtcatgccctgtgccagtcacgctgtgttgtgcc

SEQ ID NO: 6860542 - DNA, 100 bp, Homo sapiens
gtgtcctgtaaatgcttttagtgacttattgaaccttgggcacatccggacccaggctccaaggccaaagggccactgtcagcatttaaagccagggtat

SEQ ID NO: 6860543 - DNA, 58 bp, Homo sapiens
tctcttattttgcctttgacaagtttatattgagcatgttatcaggcaatgtgggaga

SEQ ID NO: 6860544 - DNA, 71 bp, Homo sapiens
cttaatggtgatttcagtgaaagatctggagatgcttcaacaaatttagacatagctgaaatcattttaag

SEQ ID NO: 6860545 - DNA, 67 bp, Homo sapiens
ccacagctagggcaatctgattgcccccaaatctattcctatacactcagtctgccccaagctctgg

SEQ ID NO: 6860546 - DNA, 57 bp, Homo sapiens
agagatgacatgagggacttaagggactccattccccctgtcccccatggtctctct

SEQ ID NO: 6860547 - DNA, 91 bp, Homo sapiens
ggggcttcatccttctttggacagtactttaaagcagagcaaggaaccatagctctttttcctcactgtatcaaatgaggatgcatttccc

SEQ ID NO: 6860548 - DNA, 57 bp, Homo sapiens
actacccagatgctatagtgaaatgtgtgtgttcatataaactcaggatctgggagt

SEQ ID NO: 6860549 - DNA, 81 bp, Homo sapiens
tgggtaagatgcttttctagaaacattatctctataaagttttctgtgtaaggtgaatttctgggaggttaatctggctca

SEQ ID NO: 6860550 - DNA, 64 bp, Homo sapiens
gtgatgtacttggaaaagtcctgactttggagtaagacacaggttcaaatccgagtcacatcac

SEQ ID NO: 6860551 - DNA, 63 bp, Homo sapiens
ggacttgtatgcaggactgcctggttttgaaaatggctcaggcatccttcccgctgcgagtcc

SEQ ID NO: 6860552 - DNA, 73 bp, Homo sapiens
ctgggttggtgggcgggcaggagcgcacctgggtccgtcctctcagggctcgctcgctcgctcgctcgctcag

SEQ ID NO: 6860553 - DNA, 88 bp, Homo sapiens
taggaggaggcctcccaatctattgtgtctgtgaggcctgcccaattccacagcagccctcagcaggaaagatcaacaggttccccta

SEQ ID NO: 6860554 - DNA, 65 bp, Homo sapiens
ggcagtgtttatgggtaacacatgtgcacacttggcattgataaccctgtttcccaaatactccc

SEQ ID NO: 6860555 - DNA, 66 bp, Homo sapiens
ttcccctcagcattgctcataaacgtataacagttgttttcaggtttacagcaatgttagcaggaa

SEQ ID NO: 6860556 - DNA, 82 bp, Homo sapiens
tgtttaggcaagagtgactacgtgaaagaaatattttagggcgagcaaattcttttaaaggatactcttgtctacaaagaca

SEQ ID NO: 6860557 - DNA, 61 bp, Homo sapiens
tatggtatcatttttggaacataatcaatacactgacattttccaagagtgatgtttcata

SEQ ID NO: 6860558 - DNA, 88 bp, Homo sapiens
gctgcaaagctgccccggaagccttggggctcctctgtatagaagaactgggtggggcccggcggggtggtgaagggcagactgcggc

SEQ ID NO: 6860559 - DNA, 76 bp, Homo sapiens
tgaggtaacagcatttacctcaatgcatctgttagcaaatagcactgacgagcgttgatgtgaaggtttattccca

SEQ ID NO: 6860560 - DNA, 66 bp, Homo sapiens
ggtaccgcatcttagtacagaatagatcctaattattgtgaaaggtaagattctagatgaggtgct

SEQ ID NO: 6860561 - DNA, 79 bp, Homo sapiens
agtttacacatcattgtcagccttcatagatcctcctggcagaagccaagagggttgcactggctgagaattgtgagct

SEQ ID NO: 6860562 - DNA, 74 bp, Homo sapiens
agcagcagataatgggactgtctctgcatgctatgtcattacagctttgcactgagacagctcagtccacttct

SEQ ID NO: 6860563 - DNA, 78 bp, Homo sapiens
cctggggagaaagaggtttcccaaccaggcctgtcacagtaagcagccaaggacacggagcctcctgtctctctcagg

SEQ ID NO: 6860564 - DNA, 57 bp, Homo sapiens
taaggcaagagcagggtctttgggaatgaatgcactttaggcacctctcttgcctta

SEQ ID NO: 6860565 - DNA, 80 bp, Homo sapiens
cccacagcctgacttgatgaatgacctgggtggtgggtttatgagtcaacgtaggggatttatggggaagaaggcgtggg

SEQ ID NO: 6860566 - DNA, 73 bp, Homo sapiens
gagttcatggccatgaaaattggttgggtcttgatgtcctctgatctgtcttttattcatgagctatgcattc

SEQ ID NO: 6860567 - DNA, 59 bp, Homo sapiens
gagcattcattgcccttaccttgactatgaaggagtgaagatggagtagtgtaatggtt

SEQ ID NO: 6860568 - DNA, 61 bp, Homo sapiens
tgtgagccaggggattcatcagggacgctttggtggccaggagcagaatcgcctgctaaca

SEQ ID NO: 6860569 - DNA, 83 bp, Homo sapiens
tagactttgattataaattcactcctggtagacctgaactacagttattaggtacttctactagttgtggtgagatcaagcta

SEQ ID NO: 6860570 - DNA, 91 bp, Homo sapiens
ttcattttttggtaatgtttcattgcagatatgtagacactttgttcagtcttaacttgccctttgtaatgataatgttaaattagatgaa

SEQ ID NO: 6860571 - DNA, 85 bp, Homo sapiens
gtgccaccaagcacacagggcagaaatgttgcatctgagataggttatgagaagactgtagcttctgtcttgagtcttggatcac

SEQ ID NO: 6860572 - DNA, 74 bp, Homo sapiens
aggacggccggggtcagagacagggctgctgctgcaccaaaaaggcggtatttgctctcggcccggcccctcct

SEQ ID NO: 6860573 - DNA, 55 bp, Homo sapiens
ggcttaaaaggaaaatgagagtcagaggcaaaaattggcatgtttcttttaagcc

SEQ ID NO: 6860574 - DNA, 58 bp, Homo sapiens
ggaggctcagactccatcctcaaggctggcaagaagacagggtgagacatgagcctcc

SEQ ID NO: 6860575 - DNA, 57 bp, Homo sapiens
gtctggaggagcgaggaagacggaagcatgtgctggcccttctcttgcttcctggac

SEQ ID NO: 6860576 - DNA, 74 bp, Homo sapiens
aaagaaacttcaagatgtcttcacaatagttagcatacattattgtttagatgtattggtccagtggttttttt

SEQ ID NO: 6860577 - DNA, 58 bp, Homo sapiens
gcccaggctggagtatagtggcgcgatctcggctcactgcaagctccgcctcccgggt

SEQ ID NO: 6860578 - DNA, 76 bp, Homo sapiens
atgaaaacattccctctttcctattcagtctcatagcagtgatataactgaagccagagggaggacatattttcat

SEQ ID NO: 6860579 - DNA, 64 bp, Homo sapiens
ttctactgtattcattgcctaaagtgtgttagaatctttaatgcatgcagggaagacagtagaa

SEQ ID NO: 6860580 - DNA, 66 bp, Homo sapiens
gtctatttttgaaagcccctcttaagtgcaaagcccagcaccaaggatgggtggcaatagaaagac

SEQ ID NO: 6860581 - DNA, 71 bp, Homo sapiens
gagaatgagccatatctggttccctaccttcatggagtgtacagttcagggaggagaatggactccttctc

SEQ ID NO: 6860582 - DNA, 81 bp, Homo sapiens
gtaaaaaacagggcctttcagggtaaaaggtcagaaaggacactttatattctaagacggcctaaaaattagaatttttac

SEQ ID NO: 6860583 - DNA, 71 bp, Homo sapiens
cctgaggctgtggggttctgctttcaacgagaacgacccttcggtgagagagcaccccagcggcacgcagg

SEQ ID NO: 6860584 - DNA, 76 bp, Homo sapiens
agttaaggaatttattgcctatgtaactttatattttgggatagcactaagatcagacatggctggattcaaggct

SEQ ID NO: 6860585 - DNA, 56 bp, Homo sapiens
gaatgagtacccatgcaagctgaaagatgagaatttcagctgtagagattacattc

SEQ ID NO: 6860586 - DNA, 83 bp, Homo sapiens
agggagggctttccagggctagggagccctcctgggcttctcaagtctgcctgggctgcagttcctggtcctgaaccttcctt

SEQ ID NO: 6860587 - DNA, 57 bp, Homo sapiens
tctatggagttggtattagtcatgtggataagaatagctaatattctactctaagga

SEQ ID NO: 6860588 - DNA, 61 bp, Homo sapiens
tggcagctctgttcaacatgaggcagtgttacaccattgtattagtcagcttgggctgcca

SEQ ID NO: 6860589 - DNA, 67 bp, Homo sapiens
catctttcatttgcagactctttggcgggtagttttccccaaactggtaatcggcaagtgagacatg

SEQ ID NO: 6860590 - DNA, 93 bp, Homo sapiens
ctgtgaatgtgagggcaaagaactctgctgaagttgttggtcttttgtcagaagaaggctttaagtactggcattctttcctcatgagcacag

SEQ ID NO: 6860591 - DNA, 63 bp, Homo sapiens
gccaaggccaccaccagcgagggggcgcggggagagccatcctccctggtggtgcctacacgc

SEQ ID NO: 6860592 - DNA, 101 bp, Homo sapiens
agtttttttttataggttggtggaaaagtaattgctgttttgccattgcttttaatggcaaccacaactacttttgcaccaacctaatatttattaagact

SEQ ID NO: 6860593 - DNA, 70 bp, Homo sapiens
gaagaccagagggctgtgtaaggatgttgtggggatttcagagatggatcagatacagcctttgtacttc

SEQ ID NO: 6860594 - DNA, 130 bp, Homo sapiens
accacttcagggatgatttctggaccattgataaaaagcttagtcaatagtgaatatagagtatgatttcttagtttttatctttcttttgaattgctttaagtgggtggtagctgaatccctcgagggt

SEQ ID NO: 6860595 - DNA, 62 bp, Homo sapiens
gaatggctgtctggaccttggaaagtaagagtctgaatctttatctagtcagtcagtcattc

SEQ ID NO: 6860596 - DNA, 95 bp, Homo sapiens
gtgtgagccactgtgcccatctataagtctttattagtgttttttgtacttgagcatatagacacccagtgattgagacttgcccagggccacac

SEQ ID NO: 6860597 - DNA, 76 bp, Homo sapiens
tgtgctgtaatgtttatttagctcagatttgcaatatgaaatgtacattctgaataggcattttatgagcagtata

SEQ ID NO: 6860598 - DNA, 84 bp, Homo sapiens
gccacctcactgcatgggcaccagtctctaggtggtgatgggacagtggcaaccagggatggagcttgcagagcatgaagtggt

SEQ ID NO: 6860599 - DNA, 56 bp, Homo sapiens
tggtttgggtgtgccattttcatttagtttattattgaatatggaatgcctggcta

SEQ ID NO: 6860600 - DNA, 83 bp, Homo sapiens
gaggaaaccattgctgccctaatatcacatgttacaagtcttcgagcccatggtatctgagatgttaggagctagcattcctt

SEQ ID NO: 6860601 - DNA, 73 bp, Homo sapiens
tccaactggaaactacagcctatcctgaatgtgatcttgacaaataggaaagggaagtggattctagatagga

SEQ ID NO: 6860602 - DNA, 85 bp, Homo sapiens
atatatagacattatatatatggggattatatatattaagaaaatatatttatatatagtcaaacatatatgtgtgtgtgtatat

SEQ ID NO: 6860603 - DNA, 79 bp, Homo sapiens
gtgtcttgcaccactctgttgttccactgctgtagcaatatatttaagtggtaatgaacacgctggtggtgcaagaaac

SEQ ID NO: 6860604 - DNA, 64 bp, Homo sapiens
tcgcgcagccagggctgttagctgctgctcttatgattgaggccagctgccacccggtccgtga

SEQ ID NO: 6860605 - DNA, 77 bp, Homo sapiens
gaaagtacagaattatgccatgagggtatctaggattgcactgtgctaattcttcactgagtattttttgtattttt

SEQ ID NO: 6860606 - DNA, 67 bp, Homo sapiens
cacgcgtgctggctttttgggtgagcccctggggtcctcacagcagctctgagaggccagcactgtg

SEQ ID NO: 6860607 - DNA, 69 bp, Homo sapiens
ctgttgtctttttactatgtttactcgagaaatgtagatatttgtcaggtagtaggtagaaactcacag

SEQ ID NO: 6860608 - DNA, 83 bp, Homo sapiens
tctatttgatctcatttgatcatgtgctatgaggtaggcactattaactctattatataggtgaataaatgagtttagacaga

SEQ ID NO: 6860609 - DNA, 73 bp, Homo sapiens
gcattttacttggttgttttaacttggcatgatatgcacaataccttgccagtagcaccaatgagaattttgc

SEQ ID NO: 6860610 - DNA, 68 bp, Homo sapiens
ccagcagggaaattcagtttctgtcctgggaggaaacagactctcatggaaagacttggatgagctgg

SEQ ID NO: 6860611 - DNA, 68 bp, Homo sapiens
tccacagaggtgtggagaaatatgtgatttgggctgagtatctcattaattcttacaacaccctggga

SEQ ID NO: 6860612 - DNA, 62 bp, Homo sapiens
gtgacatttcccatcagtatcctctacttttctttctcagtggtgcctggtggcaaattcac

SEQ ID NO: 6860613 - DNA, 59 bp, Homo sapiens
aggtatgatagtccaagtttcctggccagtgcgccttcgaggacaccctatcaatacct

SEQ ID NO: 6860614 - DNA, 66 bp, Homo sapiens
gtcactagtcaccctccaactctccactccagcctcagccagtagaggaggcgtgattcatccgac

SEQ ID NO: 6860615 - DNA, 62 bp, Homo sapiens
gaaggttctgtgtacactacttcccaaggagctgagggatgtccttgtacaacagtaccttc

SEQ ID NO: 6860616 - DNA, 80 bp, Homo sapiens
ccacggtatatatataaacacattttatatatccattcatcaaccgatggatgcttaggttgttttattatatatgatgg

SEQ ID NO: 6860617 - DNA, 68 bp, Homo sapiens
ttaccttcccacacaattaagtcatttttctagtctgtctaaagtgtaaataatttgagggaaggtag

SEQ ID NO: 6860618 - DNA, 74 bp, Homo sapiens
gattcttatgagtgaactttacctagaagcttactgacaaaatgttcgtaagtcaaagtttattcaaaggaatt

SEQ ID NO: 6860619 - DNA, 73 bp, Homo sapiens
ggtgccaggagggggtggagtttcgccggcccgcggacagaggctgccggatctcccgaccccctccagcacc

SEQ ID NO: 6860620 - DNA, 88 bp, Homo sapiens
aggttttagctattagcaggagtgtgttctatttttgagcttttacatttcaaaagtaaagacattctttgttgtgctttaataatct

SEQ ID NO: 6860621 - DNA, 73 bp, Homo sapiens
tgctgaagatttcaccagtggaaaagatgtctcagtaaaggagatgatttttgccagtgtgatgattcaggca

SEQ ID NO: 6860622 - DNA, 56 bp, Homo sapiens
agagttcatattcagagatcgctaatacatgttaatgatgtcagaagatgaagtct

SEQ ID NO: 6860623 - DNA, 67 bp, Homo sapiens
ctctgatgtattgtcaggctatgtccaaatttttaatttggaaactatagtcacaatagatacaggg

SEQ ID NO: 6860624 - DNA, 80 bp, Homo sapiens
gacttagcttggcagctctgctccacatgagtttattctaagactcaggctacaggggcagaagctattcaagagaagtt

SEQ ID NO: 6860625 - DNA, 82 bp, Homo sapiens
gggtatagagttgactaggcttacgggagggtggcctggaggtcatcacaggctaagaccctcctggggccagctctgaccc

SEQ ID NO: 6860626 - DNA, 98 bp, Homo sapiens
tgattttcccttcagaggtgtagattgcgtaccttgcgtgcagagattcaacgtagtcactctgcaagatgcaatattaggctctgaaccacatttca

SEQ ID NO: 6860627 - DNA, 129 bp, Homo sapiens
atggcttatctctgcagagcacttagctcagcacccagtgattagggctacctggggttggccattaggctgagatgctgtggtccacagggagtccgtgctgaccttgtcctgcacattctaattcat

SEQ ID NO: 6860628 - DNA, 82 bp, Homo sapiens
gcctgtgttgcccaggctgttttcaaacttgggcccaagcagtcctgctgcctcagcctccagaatagctgggattacaggc

SEQ ID NO: 6860629 - DNA, 61 bp, Homo sapiens
cagtgagtccgcagctctcagctgagtcgtcagtggctcagaaaatgaaatggactctctg

SEQ ID NO: 6860630 - DNA, 123 bp, Homo sapiens
gagcttaaaagagagtgctgcatagtaattaagggcataaattgtggagccagtagttctgggttcgagttctggctatgcaatttaggagttctgtggttctaggcaaaccctctaactctc

SEQ ID NO: 6860631 - DNA, 57 bp, Homo sapiens
ggaggagttggctcctcagtgtcccctttgttgccccaaaacacagccaggttctcc

SEQ ID NO: 6860632 - DNA, 67 bp, Homo sapiens
ttctgagtttggaaccactgctttagatgttataaatccatttgcagctaggatccaaagtcaagaa

SEQ ID NO: 6860633 - DNA, 65 bp, Homo sapiens
gccacaagtggtcagaggaggaataggacatgaggttttatgttctcattctcaggcccagtggc

SEQ ID NO: 6860634 - DNA, 56 bp, Homo sapiens
gggccctgctgccaccatggctgggaccttgcccgccttgggcacaggcagggccc

SEQ ID NO: 6860635 - DNA, 61 bp, Homo sapiens
gcctagtgtgggcccccaggttagcccttctagggctgtcctggcggggacgcaaagtggc

SEQ ID NO: 6860636 - DNA, 75 bp, Homo sapiens
ggctgccagtgggacccgctgtgggcagggggatttcttcccagagtccaggctaagtcccttctgccttcagcc

SEQ ID NO: 6860637 - DNA, 78 bp, Homo sapiens
ctcttgaacaatattactgtttttaaaattgcatccccaaggggtacagatggaatgggggaacaaagttgttctgag

SEQ ID NO: 6860638 - DNA, 73 bp, Homo sapiens
gtcactgcactccagcctgggtgatagagccagaactgtctgaaaaacaacgctaagggctgggtgcggtggc

SEQ ID NO: 6860639 - DNA, 55 bp, Homo sapiens
tccatgagctagggattcatcagtaatgagacagatgtggctcccttcctcagga

SEQ ID NO: 6860640 - DNA, 62 bp, Homo sapiens
tgtcatcctgtctttgttttaaatatgctaaatgcatattttgtaacttggaataggtaaca

SEQ ID NO: 6860641 - DNA, 93 bp, Homo sapiens
gggcctggaggaaataagtggttgcttgttttcattctttgagactctaaagaaacagcatgttggaccatttaactttttactgtcaggctt

SEQ ID NO: 6860642 - DNA, 72 bp, Homo sapiens
aggagctggtggctccaggacccagtggctccaggacccagtctacagccacggtctatggaggcggctctt

SEQ ID NO: 6860643 - DNA, 56 bp, Homo sapiens
ggcagaatttgccattcaagctgtgtttaggaaactccaccttcatggcatctgcc

SEQ ID NO: 6860644 - DNA, 80 bp, Homo sapiens
gcaagcagctggggaggtcgtggggaagccgtgcagaggctgctgccgtaaatccctcagtgatcttctcccctgcctgt

SEQ ID NO: 6860645 - DNA, 61 bp, Homo sapiens
ttttggtccagttctgtgatattgctgttgatcaagggcaatgaaatgaattcgaccagga

SEQ ID NO: 6860646 - DNA, 77 bp, Homo sapiens
gaattgtgtttttcctttcctacttgttggtcaggttctttttaatcataagaaggaaaatatttaaaatataattt

SEQ ID NO: 6860647 - DNA, 59 bp, Homo sapiens
aggagtttagtcacttgtgcctgaggggtggcacagccctccctgggtgacgggctcct

SEQ ID NO: 6860648 - DNA, 81 bp, Homo sapiens
gtgctgggtgttgggctgctgcggtgctcttggaaagtgcaaaagaattcccaagggagcacgcacagcagcatccagaac

SEQ ID NO: 6860649 - DNA, 77 bp, Homo sapiens
tgtattagcttctggttttgttctagtctgaagtgcattatattatgcaaaatccagaacaaaattagaggagtgca

SEQ ID NO: 6860650 - DNA, 93 bp, Homo sapiens
tgccctgtgagttctttgatattctactgcaaatcctgaccaagtgttttgccatgtgtatcaggccagtagagtttaggcttagagtctgca

SEQ ID NO: 6860651 - DNA, 66 bp, Homo sapiens
catatttattcttctgccagtgcttgaaatcaagcttgatcagccatggcagtaggatgggaggtg

SEQ ID NO: 6860652 - DNA, 63 bp, Homo sapiens
gcacagagcaaggatgggtctatagtatagagcctccatacatctcatctgtgctctccgtgt

SEQ ID NO: 6860653 - DNA, 58 bp, Homo sapiens
ggtgtcagtctgggatgagactaaaggactctccatggtctttgcctgagattgcatc

SEQ ID NO: 6860654 - DNA, 98 bp, Homo sapiens
cttttcaatggcagcgtattattgcatagattatgccatatgatgccagtgctctgttgtggcataatttgttgaatgagttccctgtcaatgaaaag

SEQ ID NO: 6860655 - DNA, 61 bp, Homo sapiens
aacatcagcacacaatagcaaggggcccattccatgatttctttgctcagagtatgatgtt

SEQ ID NO: 6860656 - DNA, 59 bp, Homo sapiens
tttcattgtagagtagacacaactgcagtgagcagtagtggattacaagacagttgaga

SEQ ID NO: 6860657 - DNA, 77 bp, Homo sapiens
gcagtaccaatgcttggattctggggtgggctatgacctcatttggccagtttccacctaggcaatttgtgtcctgc

SEQ ID NO: 6860658 - DNA, 82 bp, Homo sapiens
tgaaaaaagtcaaagtgccaatcgtgcattatattgcttcaaggtagctaaatggatcttggttctttaagggattctttca

SEQ ID NO: 6860659 - DNA, 106 bp, Homo sapiens
gattaatttatttttattttgcatgttttaaggctgtggggattactgctctgaagcagatccaaatatagttcttgaattctatgtagagctgaaagaatcagtc

SEQ ID NO: 6860660 - DNA, 55 bp, Homo sapiens
actctattttctcattttgcatgtcctgtagctgtgctctatgaggatatagggt

SEQ ID NO: 6860661 - DNA, 125 bp, Homo sapiens
gtacttgaagagttgtgggcattagtgccaggatgctgagcttaaccctgttagcaaatgtgttgttaccacttgcttgttaagtcatgtttcagggtagtatggctcaaaaatttaccaggtac

SEQ ID NO: 6860662 - DNA, 57 bp, Homo sapiens
acactgaatatacaatgaatatgggcattccctagagattcgatgtgtgttgcatgt

SEQ ID NO: 6860663 - DNA, 62 bp, Homo sapiens
ctcccgtgatcctggaggagagggtctgaatatatgtggccacccctaaagactcacgggag

SEQ ID NO: 6860664 - DNA, 107 bp, Homo sapiens
gattacctgggtttggcacacctggttagggctctgagtgggaaagagggtcctgaaaccaggctgagcccccagccagagccagagccaatgctggagccggtgtc

SEQ ID NO: 6860665 - DNA, 56 bp, Homo sapiens
tgtctgaagcactgggcgttgccccactctgtcctcgtcatctgtgctctcggaca

SEQ ID NO: 6860666 - DNA, 56 bp, Homo sapiens
aggctgtagtgcatgtgctatgatcatgcctgtgaataatcattgcactctagcct

SEQ ID NO: 6860667 - DNA, 91 bp, Homo sapiens
cagcctgtgtgtgtcatgcccagcacaaaccctcccgggctgaagccagttcccagaggcaaagtctggatgtggaaaatgcaccaggctg

SEQ ID NO: 6860668 - DNA, 63 bp, Homo sapiens
aggatgaatatttagtgggatagatggatggatgtccttgacctacccgtgaatgtttattct

SEQ ID NO: 6860669 - DNA, 66 bp, Homo sapiens
ttgggagattcattgagccaagatgttattttggaaggatctttgagctttaagtgattctctcaa

SEQ ID NO: 6860670 - DNA, 109 bp, Homo sapiens
tgtattttgtagcagttggactagattcagttctggaaattgttttataaccttttggcagttttgaaatgaaatgtagttcaacatttttatttttctgtgaaataca

SEQ ID NO: 6860671 - DNA, 93 bp, Homo sapiens
gagtagctgggattacaggtgcgtgccactgcgcccggctaatttttgtatttttagtacagacagggttgcaccatgttggtcaggctgctc

SEQ ID NO: 6860672 - DNA, 84 bp, Homo sapiens
gctgcttttgggtgcttcgtcagctctgaggcacgtcaaatacgtgtattttgctttcagcgttgtgtgagggaccctggcggc

SEQ ID NO: 6860673 - DNA, 78 bp, Homo sapiens
catcttcacaagctggcttgggagaatttgcagacacaggtttgggtttcacattttcaaaagctggtgctgaagatg

SEQ ID NO: 6860674 - DNA, 68 bp, Homo sapiens
gctgatagactgaatgttgggagacagagagaaagcagccatggatgctcccagtctttggtctgagc

SEQ ID NO: 6860675 - DNA, 68 bp, Homo sapiens
gaggcggtgtgagcaatgtgtggttaatgttagggaaacagtgcatttacaccagtttacacttcctc

SEQ ID NO: 6860676 - DNA, 73 bp, Homo sapiens
tttagtgtagaggatattgaatatcacagtgaatgggtaatgctagctgtcacaaatatttctcagcactgaa

SEQ ID NO: 6860677 - DNA, 84 bp, Homo sapiens
gaaactgcattttgggggccagacagcacagaacacaattccatgtttctctgtgttctagcctggggctccttggcagaattc

SEQ ID NO: 6860678 - DNA, 66 bp, Homo sapiens
cctggattcaagtctttctttctaggcaaacccttgactcactgggaagagatgctatgattcagg

SEQ ID NO: 6860679 - DNA, 130 bp, Homo sapiens
tgctttctcctggccttcatggcctatgaccgttacctggccatctgcagcccactccgctaccccttcctcatgcatcgtgggctctgtgccaggttggtggtggtctcctggtgcacaggggtcagca

SEQ ID NO: 6860680 - DNA, 87 bp, Homo sapiens
ccagggtagaagctccatcctgcattgctattcagatgcacacatcacatctgggaggtggcagggtgcatgctgctgctcccttgg

SEQ ID NO: 6860681 - DNA, 72 bp, Homo sapiens
gcaatagatcattagcgggggtgagaactgggtgaactcggtcatttttctcctccttctgtgattcaatgc

SEQ ID NO: 6860682 - DNA, 103 bp, Homo sapiens
gtggaggtggtggtaatagacttgtattatggttcgcttagttcctgagtacgtgattaatactaattgtaactacaaacaagtactgaagctactcctctgc

SEQ ID NO: 6860683 - DNA, 117 bp, Homo sapiens
gtgatctgtgaagaggaaaaagaataaagcaaccagagattgtggcctttgggtttctgcctgctgagaaatgacagatagaatcccagccagctggaagctctgattcacagaaac

SEQ ID NO: 6860684 - DNA, 121 bp, Homo sapiens
ctcagatctagattatgaatagagactagaatagggggtaggaagccaacagcaccccttccctccaacttgcatctgtttccctctttccttctctgtttttgtatatggtcttttgcag

SEQ ID NO: 6860685 - DNA, 57 bp, Homo sapiens
gttgtccttaaaaactctgctccctgaatgctcagggagactgatctgagtgataac

SEQ ID NO: 6860686 - DNA, 61 bp, Homo sapiens
aggagctgaagaatagcaggtgggcacactgatgggttctcctgttgtttttctttctcct

SEQ ID NO: 6860687 - DNA, 75 bp, Homo sapiens
cagggcaggaatttgacattgcgaaagggaaaaataaagaaatgagctttgggcatgtacagtttttctgtcctg

SEQ ID NO: 6860688 - DNA, 77 bp, Homo sapiens
acagtgttacatgaggttaattaagcatcctggaattcagcaggaagcctgttagagacttgatggagaacacatgt

SEQ ID NO: 6860689 - DNA, 56 bp, Homo sapiens
cctggctgtgcatgtttctatggtgtctgtgtgttgagaggcagggtgaggccagg

SEQ ID NO: 6860690 - DNA, 125 bp, Homo sapiens
cactcacgctgtaaaatcccccatctccgggtgcagactgggggctctaacagctttcatgaatatcgaaaattctcttaaagcttccagtttcaatctggatatttggatatatgtgtgatgtg

SEQ ID NO: 6860691 - DNA, 65 bp, Homo sapiens
ttgctgatgagtcattggtttagagtcttaatttttagatgtgttcaccaatggacttacagtag

SEQ ID NO: 6860692 - DNA, 84 bp, Homo sapiens
cctgacacatggaagacattgggtaaatagctgctgaattaattcattcagcaactatttatcaaattcctactttgtgccagg

SEQ ID NO: 6860693 - DNA, 129 bp, Homo sapiens
ctcccacctcccggcctcagccgcccagccccccggttcttctgccctatctctgagccaactttctactgtttgggagtcacctgggaggactggggaggctgtggtggaggagatgggcaggaggag

SEQ ID NO: 6860694 - DNA, 108 bp, Homo sapiens
tatcagaatcactgaagaacacacattattgggctgcaccccagagtttctgactcagaaggtctagggtgggcccactaatgtatatttcttacaagtttccaggta

SEQ ID NO: 6860695 - DNA, 105 bp, Homo sapiens
aagttagtggtcaccaacagcaagatagcacacactgcatctacaaatgtatgtgacatatcttcacattttgtgtgtgtgtgtgtgtgtgtgtgaccacaactt

SEQ ID NO: 6860696 - DNA, 89 bp, Homo sapiens
tgctaaaatttaggacatcatgtcactaactgctactgatatatttattgcttaatcattagcgcttgggacacatggagtgcttagca

SEQ ID NO: 6860697 - DNA, 105 bp, Homo sapiens
tgtaggaatgtttatggagtgacaggcagatgttttagttgtactatgtatgtgctaagtgaaaactaaaatgatctcttttatgatatcataggcattcttaca

SEQ ID NO: 6860698 - DNA, 61 bp, Homo sapiens
aagtttgttcattcattcatccctttagcattatgccagaggatggatagggaagagattt

SEQ ID NO: 6860699 - DNA, 129 bp, Homo sapiens
ttaaatgagagaccttagggaggcagctttgttgccatgtggcttatcacattgtccatggaggaagtaatgttcctcctttaagtggtgtagcctgagagaaagatggcctccaagatctttaattaa

SEQ ID NO: 6860700 - DNA, 65 bp, Homo sapiens
tgtttcccaggctggaatgcagtggtgtgatcttggctcactgcagcctccatctctggggttca

SEQ ID NO: 6860701 - DNA, 98 bp, Homo sapiens
tgacttcatctgcctcagaagccacaggaaagcagcttcgtcatcctaaactgaatgtcttttaacctctggacttcaactggcaaagactggagtta

SEQ ID NO: 6860702 - DNA, 70 bp, Homo sapiens
ccaagggacctgggaagtcagccaaggacgcttgcctgggtgtctcctggctggtttctctgtgctgtgg

SEQ ID NO: 6860703 - DNA, 69 bp, Homo sapiens
gtttttgtccatggaggcaaaccaagaggacaggggatgctgactccaggctggctccacacataaagc

SEQ ID NO: 6860704 - DNA, 77 bp, Homo sapiens
aatgacagccacagtgatttcatccttctgggcttctctaacaagccacatttggagaagatactttttggatcatt

SEQ ID NO: 6860705 - DNA, 72 bp, Homo sapiens
gagctgccaagtttctcagtttaaggactaataaagttgggatgtgggtaattctgggagactgggtagttt

SEQ ID NO: 6860706 - DNA, 80 bp, Homo sapiens
tgaagatgtcagcaggggtggttgcttctaagggtgtctctctttggcttgcagatgatcaccttcctgtgacatcttca

SEQ ID NO: 6860707 - DNA, 68 bp, Homo sapiens
tgtactgcctgttttctgatagattttttctacaaagatttgtattaccaggaaataatgctagtata

SEQ ID NO: 6860708 - DNA, 67 bp, Homo sapiens
gcagagggtccgcaggcagggccgagagcaggcagcccaggcctggctccaccgccgcggagctcgc

SEQ ID NO: 6860709 - DNA, 67 bp, Homo sapiens
tatggcatctgttgagttctccgtgctcttcttcagagagcatggttcctattcacataggttcatg

SEQ ID NO: 6860710 - DNA, 129 bp, Homo sapiens
tttatgtgtgctcttcaagatgatacagatatggagaactcaaaaagtgaccagatttaaacccagatgtgaataattattttcacttatttgagttttcagctttggttttcttgttgattacatgaa

SEQ ID NO: 6860711 - DNA, 95 bp, Homo sapiens
gagatgtcattgtttgctgctgtagctaggctttctgttaaaaatcacagcatgaggcttaaactgctgcaaccattatccagtgctaacatgtc

SEQ ID NO: 6860712 - DNA, 80 bp, Homo sapiens
agcaatcacttagtatatgacgctttcaagggcctttcttggaattttccaagtcacaaagtgctgtacatgggattgct

SEQ ID NO: 6860713 - DNA, 59 bp, Homo sapiens
acctgtttagaaagcttatgaggaagatctgttcctcctttgagttgctgtagacaggt

SEQ ID NO: 6860714 - DNA, 76 bp, Homo sapiens
agaatggggtagtgggcagcctggcaggcagggtgccaggcacagaggccgaaacccaggcagcctgctccattct

SEQ ID NO: 6860715 - DNA, 107 bp, Homo sapiens
tcagaggtcacatagtctagcaggagagataatgtgaagataatgcaagagtttgaggaaaatcttctgctatttttctttatgtaaccctagtctaccacttctga

SEQ ID NO: 6860716 - DNA, 69 bp, Homo sapiens
ctcctgggggctccttggcagtggcaggctggggacagtgcctggcaggctggggacagtgcctgggag

SEQ ID NO: 6860717 - DNA, 58 bp, Homo sapiens
acactgagctgagcattcttgttccagaggaatcgtctgggagagcctagctctgtgt

SEQ ID NO: 6860718 - DNA, 65 bp, Homo sapiens
gagaaactggatgcagggatgcagccatgacagtatcatatctgcataaaagtgccagttaattc

SEQ ID NO: 6860719 - DNA, 85 bp, Homo sapiens
gttttctactgttgaggtccttgccatataatggggggagaaagctttttatatggatggtaacggatggcccagtgaagagaac

SEQ ID NO: 6860720 - DNA, 61 bp, Homo sapiens
aatatttttgaggccctgttatgtgccaggcactgttagctgatagggttttagttatatt

SEQ ID NO: 6860721 - DNA, 63 bp, Homo sapiens
gcttaggctagggtgcaatggtgcggtcataactcactgccgcctcaaacttctgggctgggt

SEQ ID NO: 6860722 - DNA, 67 bp, Homo sapiens
caaggctgtgttagctgccctcctctgagcttgcacagtttccagggcatctgctattacagcactg

SEQ ID NO: 6860723 - DNA, 55 bp, Homo sapiens
tttttctagtttctgaggttgtatattccttctgtacagtcagggaatagaaaaa

SEQ ID NO: 6860724 - DNA, 77 bp, Homo sapiens
tgatggaatatggcagtacgttgaaaattttcaccttggggattattcactgaaaatagcggatgtcctttttatca

SEQ ID NO: 6860725 - DNA, 62 bp, Homo sapiens
gagggtgtggaagttagtaagagggacctggtgaaggtccaaaggggcagtgtccagccctc

SEQ ID NO: 6860726 - DNA, 57 bp, Homo sapiens
tcctgcagccaagggtcatcgatatcggttgaggactttgtcctgtggcagcagtga

SEQ ID NO: 6860727 - DNA, 63 bp, Homo sapiens
ggcccctccacatgggcacagagaacttggtgcgatggagtcagtgtgtcctgtgtctgggtc

SEQ ID NO: 6860728 - DNA, 64 bp, Homo sapiens
tgtgactgctgcgactgcttctcatcaccccagaagatggagaatggaatgttgtgcaggaaca

SEQ ID NO: 6860729 - DNA, 72 bp, Homo sapiens
cgcgaccccgcaacgccggcaccgaaagggccttagaaaccctctggtccaaggctcggtggcggggaagtg

SEQ ID NO: 6860730 - DNA, 64 bp, Homo sapiens
ctgaggagaaatgggatggttcctgtgagcagaaagacaaagaactgtctctgttctccattag

SEQ ID NO: 6860731 - DNA, 60 bp, Homo sapiens
gggtagaataggaagtcctggtcagacccaaaagggctgtcacaagaccctagtctaccc

SEQ ID NO: 6860732 - DNA, 90 bp, Homo sapiens
ggagaatttcttgaacccaggaggcagaggttgcagtgagccaagaccatgcaataacactctagcctctgggtgacaaagccagactcc

SEQ ID NO: 6860733 - DNA, 55 bp, Homo sapiens
ctaggcacctgggccctgtggcctgtttggctcccacgcaggggccctgttctgg

SEQ ID NO: 6860734 - DNA, 118 bp, Homo sapiens
gtcatagcttccttagttttctgataagttgcagaggttgcaatgtgggagattttcttgctacttaagaaatactttgtaaatctcacaatgattaagaagtctgagaagctctgac

SEQ ID NO: 6860735 - DNA, 60 bp, Homo sapiens
tctactaaggaatatcataagaagtagccatatgaaactggttactctattccctgtaga

SEQ ID NO: 6860736 - DNA, 119 bp, Homo sapiens
tctcacttccattgtggccttttgagtttcagattaagcctgacatccaattacgtggatttcgtacaggcctgatacactgaactctgcgtgttcttggcctcatggaacatttggga

SEQ ID NO: 6860737 - DNA, 67 bp, Homo sapiens
ctcaatccttgttctgtctcctccactcaaattcctgaaggtggtttgcagacagaataaaagtgag

SEQ ID NO: 6860738 - DNA, 55 bp, Homo sapiens
ctgagttttctgggattcatttatggggttcacccagtgctttttaagagctcag

SEQ ID NO: 6860739 - DNA, 83 bp, Homo sapiens
gagtctcgctgtcaccaggctggaatgcagtggcccgatcttggctcactgcaacctccgcctcccaggttcaagtgattctc

SEQ ID NO: 6860740 - DNA, 66 bp, Homo sapiens
ctgaactatgtaaaagtaagctgcagccatgaatctaggatgttccattaccacctacatagtcag

SEQ ID NO: 6860741 - DNA, 67 bp, Homo sapiens
gctgtgcttttggtagatcccaagcaaggacataaggttcccagcatggaatccccaagaaagcagc

SEQ ID NO: 6860742 - DNA, 69 bp, Homo sapiens
tttatgacagccttgggtacgagagctcccacaagcagacaaagccactcagtgccaggttgttaagaa

SEQ ID NO: 6860743 - DNA, 81 bp, Homo sapiens
ctgaaatggaagacacgtagggcttttctttgcctgagcttttggttggggcaagaagtgccctgaagttcgaattttcag

SEQ ID NO: 6860744 - DNA, 75 bp, Homo sapiens
gtctgcccacaattgtgagtatgaagtgatgagacaatttatctttctctgcactatacaatgttttgggcagat

SEQ ID NO: 6860745 - DNA, 72 bp, Homo sapiens
aggtctctgaaatgcttagatgaggcagcaggagtttgaattactggctgagtcagcaggtcacagagacct

SEQ ID NO: 6860746 - DNA, 84 bp, Homo sapiens
ccttttcccctttgctaggtcaaatgcatgttgatcatacacgtatgtatgatatatgtgttgagcttgcggttggggatgggg

SEQ ID NO: 6860747 - DNA, 72 bp, Homo sapiens
ctttactatcaggaataaacaattacatctgcggggagcagaagatctttgtttgtatttttgaaaggaaag

SEQ ID NO: 6860748 - DNA, 84 bp, Homo sapiens
ccaggcctcagtgtacccatttgtggaccaccacccaccttggagggttgagtgggattaaatgaggtgacagtgaggcactgg

SEQ ID NO: 6860749 - DNA, 71 bp, Homo sapiens
gccaaactccctagatgactttttctaactctgattattttcattagcaattgtgcatctagtagcttggc

SEQ ID NO: 6860750 - DNA, 76 bp, Homo sapiens
agcctttggaagagggaatgcccaaagaggattttcaattagtcttgctgtgtattgcatctcccttgccatctct

SEQ ID NO: 6860751 - DNA, 61 bp, Homo sapiens
gaggaggaagttctctgtaggctgctatttttcatcagcctgagagatgtgctttttcctc

SEQ ID NO: 6860752 - DNA, 59 bp, Homo sapiens
ccactcccctgcaggggaagctgaagacagagatcttcagccatgcagccgggaagtgg

SEQ ID NO: 6860753 - DNA, 60 bp, Homo sapiens
acagaggaaggctgagctgcccttcacacacgtgggcttgcctggagccattccatctgt

SEQ ID NO: 6860754 - DNA, 78 bp, Homo sapiens
accctgatgagaatggtgattctgcagaaaactgcactgcccgtggctgtatctgggaggtaaccatgctgatggggt

SEQ ID NO: 6860755 - DNA, 78 bp, Homo sapiens
catctgtatttcaccaggaaattcagttttaataatcactgtgttactacatatgcagtttgaattgaaatgcagatg

SEQ ID NO: 6860756 - DNA, 104 bp, Homo sapiens
agcacagcgtgcctttcctcccagcttcctcagaggccacaggcatttttggctcagcgaggtccctggggaactaggctgtgcggagggaggagtgtgcagct

SEQ ID NO: 6860757 - DNA, 83 bp, Homo sapiens
gagacaaaattggagcagtgagtgaatgttgccttgacctcatgggtgtagtgtttgcatctcattgatttccactttgcatc

SEQ ID NO: 6860758 - DNA, 61 bp, Homo sapiens
gccctgcctgacagagaaggttcagcctcactcccgctcaccactcactcaggcaagtcgc

SEQ ID NO: 6860759 - DNA, 77 bp, Homo sapiens
ctcattgtgttttacctacttctgaatatgtgtcatacttaggatcagagtggtaagtaagtgaaacatccagtgag

SEQ ID NO: 6860760 - DNA, 55 bp, Homo sapiens
agtggttcacgcctgtaatcccagcactttgggaggccaaggcaggcggatcact

SEQ ID NO: 6860761 - DNA, 55 bp, Homo sapiens
ttgaataagataagatttctgctctcatagggctgagagctgtgtatctgtttag

SEQ ID NO: 6860762 - DNA, 68 bp, Homo sapiens
gaggacatctgaggccctcagagccaccgaatctcatgcagagggcctgctggggcctcagacacctt

SEQ ID NO: 6860763 - DNA, 73 bp, Homo sapiens
agggcttcttcacccttctcttcatttccagagagccaatcccagaggatggagagaagggattccaggccct

SEQ ID NO: 6860764 - DNA, 75 bp, Homo sapiens
cgtttctcattgccctgtgctggaatcttcccccaggattggggaacagggcctgagctggggaaaggagaggcg

SEQ ID NO: 6860765 - DNA, 81 bp, Homo sapiens
ggggcatctccactgctctcagaaacacaactttgtacacacgccaaattgcttttgggggcagttacagcagagatcctc

SEQ ID NO: 6860766 - DNA, 77 bp, Homo sapiens
aatccaattgtaaggtcatccagttctaaggtcaaagttgtaagatcatagattgttcttaactttataaatgggtt

SEQ ID NO: 6860767 - DNA, 70 bp, Homo sapiens
ccaggctgagtgctcctggaggacagggactgtcttcttcatctctgtgtcagcagcactcagcccatgg

SEQ ID NO: 6860768 - DNA, 58 bp, Homo sapiens
tgatgttttcctttggcttccttgctgagtcatgactagatttgcctgggaaagctca

SEQ ID NO: 6860769 - DNA, 71 bp, Homo sapiens
ccttggtctagccttccaacctaccttccaacctggaaatttgggaggtgtgggaaacgggtgacctcagg

SEQ ID NO: 6860770 - DNA, 78 bp, Homo sapiens
tctgggcctcctttccattcagagagcgcttggtcaagcaattatagtccaagatccttccgatggagtgagcccaga

SEQ ID NO: 6860771 - DNA, 57 bp, Homo sapiens
ggtgggagaagaaccatcatggctaagtagatggagtcaggaagagcttctcccact

SEQ ID NO: 6860772 - DNA, 63 bp, Homo sapiens
aggaaggaagagacaccatttggataattttcttgcctcaagtaatgtatctctgttcttcct

SEQ ID NO: 6860773 - DNA, 56 bp, Homo sapiens
tctgtcacactaaaacaagaagttgggtcatattcacaattctaaattgtgacaga

SEQ ID NO: 6860774 - DNA, 89 bp, Homo sapiens
agaatgtgggtgaaaagactgagagtaattttctacttgaagcagagtcttcactgaaaaccatacttctttctgcatgcccacactct

SEQ ID NO: 6860775 - DNA, 97 bp, Homo sapiens
gaggcaggagactcatttgaacccgggaggctgaggttgcagtgagccaagatggtgccattgtactccagcctgggtgacagagcgagactgtctc

SEQ ID NO: 6860776 - DNA, 76 bp, Homo sapiens
ccatcccctgggaagttgtaccttctgttatgaagatgaccagcctcctaatgacagtcaactcccagatgggtgg

SEQ ID NO: 6860777 - DNA, 60 bp, Homo sapiens
ggtgtgaaggcatcagcaggcaccgatgcgctatcccacctatttctgtgtcttcagccc

SEQ ID NO: 6860778 - DNA, 71 bp, Homo sapiens
acatgtgtcctttccaatccagggctattgtcaggagtaaatggagagaccctttgaagaggataaagtgt

SEQ ID NO: 6860779 - DNA, 91 bp, Homo sapiens
ggaaagtgatgcagaacaagtgatgtctcatgcatctatttctcattggctgcatctcttataagacaggctttgctgtatatcactttcc

SEQ ID NO: 6860780 - DNA, 129 bp, Homo sapiens
catgctcttttcttatccttttacttctttggcttgacaaaaataacacagcataaaatgcacctagcattatgatgtttgttcttgttcctcttctgataaggactaaatgtataattaaggaaaatg

SEQ ID NO: 6860781 - DNA, 55 bp, Homo sapiens
gcatgaatggaaccccctgagtaatgtgactgactcaggaagagccagttcatgc

SEQ ID NO: 6860782 - DNA, 93 bp, Homo sapiens
ttcatattcttttctattacaattctgcaaggagtatgcaggcatttccactttagtattcatgtaaaattggatagactctgaataaatgaa

SEQ ID NO: 6860783 - DNA, 69 bp, Homo sapiens
ttctgcggaatgaggtcatcttgtaatctggagcctttctacaagatgcaagagcccttggcagcagga

SEQ ID NO: 6860784 - DNA, 61 bp, Homo sapiens
gctcctatgagtaacagcatgttgaagacttagtaattttcacatggtggggactcagagc

SEQ ID NO: 6860785 - DNA, 87 bp, Homo sapiens
tgagatggtctgaaaaaccatattgtgcatctgtttgtgcacagttcagctcacattgcagacgtatattattttaccctatgctca

SEQ ID NO: 6860786 - DNA, 66 bp, Homo sapiens
ggccgcgagggaggcgacctcggcatccaaacaggcacttgcgccaggtgctatccctgcgctgcc

SEQ ID NO: 6860787 - DNA, 59 bp, Homo sapiens
tgtggcctggagtttgatgtaggccagtggtgtctggttccttgcacctctaggccaca

SEQ ID NO: 6860788 - DNA, 120 bp, Homo sapiens
ctcttgccttggcacctgggtggcttgctgcccacaaccccgtgtctaaaaatacaaaaattagctgcgcatggtggtgggtaccagtaatcccagctactccggaggctgaggcaggag

SEQ ID NO: 6860789 - DNA, 63 bp, Homo sapiens
taggaaaggggatagaattatgtgaatggtttaagctaatcagaatttgtcccctgagttctg

SEQ ID NO: 6860790 - DNA, 94 bp, Homo sapiens
gcatcacctgggagctgttaaatgcagaatttcaggtcctatcccaggcctaccaaactaaattctgcaatttgacaagatccccaagtgacgc

SEQ ID NO: 6860791 - DNA, 69 bp, Homo sapiens
tggcggagttgggggcacttcgaggtcgccttggggcgaggtggtcgtgagggggtcccagatatgcca

SEQ ID NO: 6860792 - DNA, 57 bp, Homo sapiens
ggcaggctgtttgaaggattaggccagataaccctggcaagccctctttagcctgcc

SEQ ID NO: 6860793 - DNA, 71 bp, Homo sapiens
ggccttggaaatagttgtgagtcaggcagtatgcttttgttgcttctcacccttactatctctttgatgcc

SEQ ID NO: 6860794 - DNA, 74 bp, Homo sapiens
tggtggaaatataactctggtaagactgatttgggattttatttaatttgaagaaagttttctagattttacta

SEQ ID NO: 6860795 - DNA, 78 bp, Homo sapiens
cttagtgtcatcatttgcttgactatggcttgcaattgatattgttagaagtaatccagcaaatttcaagatattaag

SEQ ID NO: 6860796 - DNA, 72 bp, Homo sapiens
tcttgctcactttgggtttatgtcaatcattgagagtatttctgatcaatatcattctagagctaggcagga

SEQ ID NO: 6860797 - DNA, 90 bp, Homo sapiens
cactaggcactattctcggttgtgggtacagcagggaacagcacagaccaaaatctttgccttcactgagcttatgggatagtgctggtg

SEQ ID NO: 6860798 - DNA, 75 bp, Homo sapiens
atacagccagtcggcgggcgccttggaaagtttccggccctccaggaggcttcctggctcttgattggccagtgt

SEQ ID NO: 6860799 - DNA, 86 bp, Homo sapiens
aggatggtagagatacgagaggcaggggtttggagaatgtcccttagcagcaactttacagccccacttccgggctctgctgtcct

SEQ ID NO: 6860800 - DNA, 122 bp, Homo sapiens
tttctctgtgcaagcttctatcagctttgcctcacttgctctgggaagaaaaagtctctcctgggatttaatttgctatcagatgtgcaaaaggtcaacatttggtgatcttgcaagaagga

SEQ ID NO: 6860801 - DNA, 120 bp, Homo sapiens
acacagatcattggacctcaccccagagttctgattcaggaggtgttgccagtgccgccggtccagggaccacactgtgggaaccactgaatcagggagcctggtcccagttatatgtgt

SEQ ID NO: 6860802 - DNA, 118 bp, Homo sapiens
agtatccttgtgaaaccttgaaaggatttggacatttacaatagtgaaatgggatgttaggtatcaaaggatcagtcgctgtagctgttaaaatcaggatttagggatttatgatgct

SEQ ID NO: 6860803 - DNA, 58 bp, Homo sapiens
cggaggaattggcagctccgtggcgggcctggcacccacagagctgccaattcctgtg

SEQ ID NO: 6860804 - DNA, 74 bp, Homo sapiens
tgatggttcattctgaagtcttcagcacttgtattggtgatagctgaagatactcagttatgacagaatcatca

SEQ ID NO: 6860805 - DNA, 72 bp, Homo sapiens
gtcaccagcctgccttcccagcttggctttttcattaccttggagaaagaagccgggaggcaggccagttgc

SEQ ID NO: 6860806 - DNA, 67 bp, Homo sapiens
cctggcacatgcagtactcaaggatttgatagataaatgagtaatttgcttgcattcttgtgccagg

SEQ ID NO: 6860807 - DNA, 55 bp, Homo sapiens
cattttattttgtggtcaaattcaaatgctgatctaatggcttcagagtaaaatg

SEQ ID NO: 6860808 - DNA, 87 bp, Homo sapiens
cttgttctgttagtaaacaaacataggtttgaaagtcctaaaacaaggaagactttcaaacctatgtttgtttattaacagaacaag

SEQ ID NO: 6860809 - DNA, 66 bp, Homo sapiens
ccagtctggagaccctggtgctgattggctattcttgggcacaaggccctgggtcaccacatctgg

SEQ ID NO: 6860810 - DNA, 64 bp, Homo sapiens
tacttgagtagcatgattctaggtattgatatatgcaataaaagagatcaaagcttgccaagta

SEQ ID NO: 6860811 - DNA, 55 bp, Homo sapiens
tttgcagtttcattgctgaaatgattcttcttatttcagcactttaggcagcagg

SEQ ID NO: 6860812 - DNA, 61 bp, Homo sapiens
gctgccagggccaccgcggggggtcagcttccattgctgagctgtgctacgccctgggagc

SEQ ID NO: 6860813 - DNA, 115 bp, Homo sapiens
tttagagtacctccctcacttcctgaaggatttgtccattgcttatttctactttgccagtatgcaaccgttgaatatttgtatggcactttcaaagatcctggagtactctgaa

SEQ ID NO: 6860814 - DNA, 71 bp, Homo sapiens
gcttccccacctccagagataggagcgcgccacctcctggcacagcctccacccctggggagtggaaaagc

SEQ ID NO: 6860815 - DNA, 57 bp, Homo sapiens
ttgttgttgcttaacagtatctaaaccattgggtaagacacagtataagcacaacaa

SEQ ID NO: 6860816 - DNA, 75 bp, Homo sapiens
gggaggcatgtgttatccacttaattattaagtgatattaattttgatttcttggtgtcttaacagatctctcct

SEQ ID NO: 6860817 - DNA, 75 bp, Homo sapiens
gcacttggactggacccgaggaatgttggattaaaaagccgattcccgttcctctactccagctaccccaagggc

SEQ ID NO: 6860818 - DNA, 60 bp, Homo sapiens
agttcagccatttgttaactatgtgttcttgggaagctaatagccaacgtgtggctaact

SEQ ID NO: 6860819 - DNA, 106 bp, Homo sapiens
gcaccatcatctggaagcttgttagaggtgtggaatcttgagccccatccaaggcctagggagtcagaatctacattttaacaagatctccaggtgacttgtgtgc

SEQ ID NO: 6860820 - DNA, 55 bp, Homo sapiens
ggtcgccagccctagtctgctgcccaggggtcagaggttattgcctggtatgacc

SEQ ID NO: 6860821 - DNA, 63 bp, Homo sapiens
aaaagccctttcaaggactaaagaaataaaggctacaaatgtctggagcttgaaatggctttt

SEQ ID NO: 6860822 - DNA, 88 bp, Homo sapiens
cattgtgctctataattattgtctgaagagttatttactgactgttgaatacacttccaaatattgattatcttgaagggatacagtg

SEQ ID NO: 6860823 - DNA, 70 bp, Homo sapiens
gccatgtattattcagtctgtctagggagttaagtccctttgttttcactcccactgagtgaaacattgc

SEQ ID NO: 6860824 - DNA, 57 bp, Homo sapiens
cctcactgtactacgacctccagggccacctctttgccatggagagcagcagtgggg

SEQ ID NO: 6860825 - DNA, 96 bp, Homo sapiens
tgtgaatattaaagcacatttaagtatgaaatatagcaccttgtttatagtgagtgcttaattatattattatatgtgaatgtgtatatatacaca

SEQ ID NO: 6860826 - DNA, 75 bp, Homo sapiens
tttcccagtcactgctttgtccctgtgtggcccacagaagggctgtgttctgactcagtgagtggaggtgggaag

SEQ ID NO: 6860827 - DNA, 76 bp, Homo sapiens
atgctttttgtaatcctaaaattaattccagttagcttggcaaaagttttaggttattttatttggaaggaagcat

SEQ ID NO: 6860828 - DNA, 87 bp, Homo sapiens
tcttaaaccttgcatggagatagccgaaaaatgttcacaattgaactgtgaccagctgcctggtctatctgcagcagtggttctaga

SEQ ID NO: 6860829 - DNA, 83 bp, Homo sapiens
tttccctccgctcctgggcttcactggtacaagtgggagctctcagggtccacacatgtgtgcagcttagaagtgcagggaaa

SEQ ID NO: 6860830 - DNA, 68 bp, Homo sapiens
gctggcagtcagtggaacctgctgggggtatctttacacctctccaggggaacattgttcctgccacc

SEQ ID NO: 6860831 - DNA, 77 bp, Homo sapiens
tcttaatatgtagcatgcaaaagctgaaggaataaaataaactttcactgacagttctggtttgcagatatataaga

SEQ ID NO: 6860832 - DNA, 78 bp, Homo sapiens
gatttattggctcatctatcagaaagtccagatatagtgagggcttcagcattgttggatgacatcgttcaatacatc

SEQ ID NO: 6860833 - DNA, 112 bp, Homo sapiens
gagaaagtgtggccctaccaacaccttgatttcttgcttgcatattgtctctccccctcaaggactctatcaagacagtgcaagaagagcaggcacctggtccgtgctgctc

SEQ ID NO: 6860834 - DNA, 78 bp, Homo sapiens
ctggtgggcgcctgggcaggatgggcccggtgcattggaggcagcctcccgctgggcgccgacctgctggccctgcag

SEQ ID NO: 6860835 - DNA, 60 bp, Homo sapiens
tccaggccttgacaggtcagtttgctagaagaggagaatggccccttctctgggcctgga

SEQ ID NO: 6860836 - DNA, 81 bp, Homo sapiens
gggtaagtcacataattatatgttaatcttcaattttctcatctatgaaatgaagttggaccatatgattttgaaagtccc

SEQ ID NO: 6860837 - DNA, 104 bp, Homo sapiens
ccacctcaatccggagcgttctgggaaaggcctgggtgtcctgggttctgaagaccccagggacgcaccccgctgcggtctccttccctgcccggatggactgg

SEQ ID NO: 6860838 - DNA, 60 bp, Homo sapiens
cctggagcttttccagttgacatgttcctcccctccatttcccactgccacagcttcagg

SEQ ID NO: 6860839 - DNA, 70 bp, Homo sapiens
aggcaactttaaatggctatgtctgtgtaaagtatcatgcattctgacctggaaatttatagttaaacct

SEQ ID NO: 6860840 - DNA, 61 bp, Homo sapiens
ctgtccagttgtatgtccagtgtctctgtaattaagatgatgaggacctacaggtggccag

SEQ ID NO: 6860841 - DNA, 95 bp, Homo sapiens
aacagaggcccagagagaattaaaggagctatgctatagaaagtactatagaaagtaggtggcacagcccggattctatgactggccttcatgtt

SEQ ID NO: 6860842 - DNA, 79 bp, Homo sapiens
tgcttaagataagcccattaattttacctttgtaaacatgtttcagcatgactgtgtgattaaggcttcattctgtgca

SEQ ID NO: 6860843 - DNA, 75 bp, Homo sapiens
actgctttctgctttctatccttgtcacagtacagaaacagctattgacaaggatatgaatggcttgataatagt

SEQ ID NO: 6860844 - DNA, 69 bp, Homo sapiens
ttctaagctaagtagactgttgaacttggttcctcagggggaatctcctccaaacctctgcttttagag

SEQ ID NO: 6860845 - DNA, 87 bp, Homo sapiens
acaagtcaagagtcactccataaatcccagggccacccactttcttaactcccatgggaatttctcgtggatgacaaatttgcttgt

SEQ ID NO: 6860846 - DNA, 120 bp, Homo sapiens
gatacatacctgcaactgtgactgtcaacttgctattaatgactaagcaatcatgaatagcaagttgctattaaacagtcattaatagcaagttgacagttttaggtgcaaggatgtatc

SEQ ID NO: 6860847 - DNA, 83 bp, Homo sapiens
ggccagacctgcctgggttcaaatcccagcttcttcccacagccacattggaaccctgggcaagtgacttggcacctctggtc

SEQ ID NO: 6860848 - DNA, 84 bp, Homo sapiens
gaggctgttaattgatataaagaacttcaggtaggtcctaaccccttatttgatggttgattataaatcagttattcttgcctt

SEQ ID NO: 6860849 - DNA, 66 bp, Homo sapiens
agatggggctgttggggaaacacatgcttatttccctgctggtgaccactgcagcagttcccatct

SEQ ID NO: 6860850 - DNA, 89 bp, Homo sapiens
caatgactcgctcagcattgattgtgaggcctctgcaggagcagtcagctctgactggcagaattctcagatgtagaagtgggttgttg

SEQ ID NO: 6860851 - DNA, 90 bp, Homo sapiens
gtaggatgaccaatggtcccactttgcctgggactttagtggtaaaactgaggataacccaggcaaactgggtcatattggtcactctgc

SEQ ID NO: 6860852 - DNA, 57 bp, Homo sapiens
ggggtggcctgtaggcagcatgggtgtcccgtgctcctggacatggccagtgatccc

SEQ ID NO: 6860853 - DNA, 68 bp, Homo sapiens
tcgcagaccgcggtgcacgtggccctgaccaggggcagagccaccacacgctgcaccacgttctgcgg

SEQ ID NO: 6860854 - DNA, 58 bp, Homo sapiens
gggccgcctattgggcaacctagagcacacctttcctcaggccaaacccagcgcgccc

SEQ ID NO: 6860855 - DNA, 60 bp, Homo sapiens
gcttctatctgacctcagggtagcttcttagggcgagaagatcctagagcagatgggagt

SEQ ID NO: 6860856 - DNA, 87 bp, Homo sapiens
acagctctgcgattatactaaaacgcattgaattgtcttcagacaagcagtgtatatagtatgtgaattctgtctcagtatagctgt

SEQ ID NO: 6860857 - DNA, 78 bp, Homo sapiens
tcctgctactgccattgtctctgccatctcaggaaaggagctgagaagtggattctaaagatagtgacagttccaaga

SEQ ID NO: 6860858 - DNA, 67 bp, Homo sapiens
ttcattcaacaagtgttcgtaaagtgcctgcaatatgccagccactctactaagcatttgagatgga

SEQ ID NO: 6860859 - DNA, 59 bp, Homo sapiens
ctgctgggtccccctgctgattgattaaatcatcatcactggggtgaagcccaaagtag

SEQ ID NO: 6860860 - DNA, 68 bp, Homo sapiens
catccatttcctccactataaaggggaattttaattcctacccgactcggtagtaggggaattgggtg

SEQ ID NO: 6860861 - DNA, 55 bp, Homo sapiens
agcccaacttacaacaagaaacagaatatctctttggccttgatggagttgggtt

SEQ ID NO: 6860862 - DNA, 66 bp, Homo sapiens
ccagagaaataaggggaaaatggcaaataatgataaaggcatctttcccctagttagtttttctgg

SEQ ID NO: 6860863 - DNA, 98 bp, Homo sapiens
gtgggtttttcggccaggcgtggtggctcacgcctgtaatcccagcactttgggaggccgaggcaggtggatcaccacgtcaggagttcaagaccagc

SEQ ID NO: 6860864 - DNA, 91 bp, Homo sapiens
gattgcagaacaaggcaacagaagataactgggaccagaactaaaatatggggtctggattatttgtcttgctgttgctgttgctgttgtt

SEQ ID NO: 6860865 - DNA, 68 bp, Homo sapiens
ccaccaggtgctgaagagaggatgacacaaatgagaaatccttgaacttagacactaggaagacatgg

SEQ ID NO: 6860866 - DNA, 81 bp, Homo sapiens
ctgctcttatttggggtatagagagggaagagaatagagaaatggggctgttctgaccctgagtctattttctaaaagcag

SEQ ID NO: 6860867 - DNA, 70 bp, Homo sapiens
ctgggagaaaggataggaatgtgctttgggctatgtcagatggcagacagatcccagttcttattctcag

SEQ ID NO: 6860868 - DNA, 59 bp, Homo sapiens
gtgaccagtgatctactgggattttgagaggaaaaagagtccccccagaatactggcac

SEQ ID NO: 6860869 - DNA, 77 bp, Homo sapiens
gcggggagaggaagaaggtctggcctttctactcagtaaggctctgtttaggttaacccttcttttcctcttgctgc

SEQ ID NO: 6860870 - DNA, 93 bp, Homo sapiens
aaaatgttgaagtctctctggagagtagaagcctgggagaaaacaaaaccaaacccattttccattgtcacccagagatactgtcaacatttt

SEQ ID NO: 6860871 - DNA, 62 bp, Homo sapiens
aaattgtgctcacactgatattgtaactactgttgcttatcatctgtatgtggctataattt

SEQ ID NO: 6860872 - DNA, 69 bp, Homo sapiens
gaaatactggaaaacactactacatgcacgtgcacatgcgcagcactagtgttcttcagtaatattttc

SEQ ID NO: 6860873 - DNA, 60 bp, Homo sapiens
actttgcaggtacatgagcatcttttgtgtcaaagtctacctctgaggtatctgtaaagt

SEQ ID NO: 6860874 - DNA, 68 bp, Homo sapiens
cagtgcatttgtcaggaattgaaaagttttggagccagttcgaggactttctcctgcacaaagtgttg

SEQ ID NO: 6860875 - DNA, 56 bp, Homo sapiens
gctctccggcgcggcagcccccagtggcgaaccgcggagctgcaggagccgaaggc

SEQ ID NO: 6860876 - DNA, 75 bp, Homo sapiens
tctgcagtcagttttcttaaagggaagatctagaaacaaagaaataatagaattttccagaatcgactctgtaga

SEQ ID NO: 6860877 - DNA, 89 bp, Homo sapiens
agggttagaaggtggacatgacctctattcctccgcacatgtctggtagaatgtgaggaagaaagaggtaagctttcatttcattccct

SEQ ID NO: 6860878 - DNA, 70 bp, Homo sapiens
ctctgtcactgggcatcggagctgaaaggaggacaagaccctgaggcttggaggctccagtggaactggg

SEQ ID NO: 6860879 - DNA, 62 bp, Homo sapiens
aattttgttcagagtattaattgatttatttgtaaatcagcttatgccttttgaggaaagtt

SEQ ID NO: 6860880 - DNA, 112 bp, Homo sapiens
gtcctttagtctctatttttgctcctaattgttcctgcaggtagtaggttaacatgtaacgtacttacagaaggaagcaattgaacatggcatagatactgaaagaaagggc

SEQ ID NO: 6860881 - DNA, 76 bp, Homo sapiens
ctctctggacagggcaggggccacccttgttggccttgacttcatagtgcctacagtgtccccagctctgtgagag

SEQ ID NO: 6860882 - DNA, 80 bp, Homo sapiens
gttggcttatgaggctctgcatataattttctctaaaatatgtaactattttgtagtctgtggggactttcaaagccaat

SEQ ID NO: 6860883 - DNA, 62 bp, Homo sapiens
gccagaggatgaggtgaacatatttgtatgctctgtggtctacaaatgtattttattttggt

SEQ ID NO: 6860884 - DNA, 99 bp, Homo sapiens
gaggcatgagaattgcttaaacctcggaggcggaggctgcagtgagctgagatggcgccactgcactccagcctgggtgacagagcaagactttgtctc

SEQ ID NO: 6860885 - DNA, 71 bp, Homo sapiens
tattttaaattattgtctcatgtttacagcaactgatgctggatttgcatttatgatagtaatatgaaatg

SEQ ID NO: 6860886 - DNA, 84 bp, Homo sapiens
ccacacagccaaagagggcagctggatgtttcagtgggggtgttggctggggtctagttccagccttgccacttttctgtgtgg

SEQ ID NO: 6860887 - DNA, 95 bp, Homo sapiens
gctaaaccatagttttgggataatttaaatacttctcatccgtttggacaaaactgaggagaaatttgagtgaagcttaaggctcttgtttcagc

SEQ ID NO: 6860888 - DNA, 62 bp, Homo sapiens
aacatataaactcttaagttcagagacgtaagttcatggaacttttagagtttaacagtgtt

SEQ ID NO: 6860889 - DNA, 101 bp, Homo sapiens
caggccgggcccgggggccaggcagttgtcctctgtggagccttatcggggcccacaggccctgctgccttgaccccacccgggccccaaaactcggcctg

SEQ ID NO: 6860890 - DNA, 60 bp, Homo sapiens
tttttatcatctttacgggaatgccagggtgaggtctgccatttctattgatgagaaaag

SEQ ID NO: 6860891 - DNA, 72 bp, Homo sapiens
agagaagagtattgtgtgtcctgtttatatgatgaaaataaatttttctagggctgccatttgcttttctct

SEQ ID NO: 6860892 - DNA, 89 bp, Homo sapiens
aggacacacagttggcagcaaaaccagaatcagaacccaggtctttccaggcctctctgttgctgttttgtgtttgtatgtttgcttct

SEQ ID NO: 6860893 - DNA, 71 bp, Homo sapiens
gcctgtgtgtctggaagctcagggagcagctgtgacctgcacgtgggattcctgagctcccatgaacaggc

SEQ ID NO: 6860894 - DNA, 63 bp, Homo sapiens
tggtttccaaacagcattccaagacagcttcatcacatgtctggcattttggctgggaaacta

SEQ ID NO: 6860895 - DNA, 84 bp, Homo sapiens
ctttaattaggtggcctgggtacatgaagtatctttttggatgcctagaacacaaaaagggacgacaacaggccacctaataag

SEQ ID NO: 6860896 - DNA, 77 bp, Homo sapiens
agagattgatctgtgtaattttttgtgccaacttgtcaggttttggtaccaggggttatttctgcatattcatttct

SEQ ID NO: 6860897 - DNA, 57 bp, Homo sapiens
cagctctctcacgccgggacgctgatcatttatttctgcatcctcccagcagagctg

SEQ ID NO: 6860898 - DNA, 55 bp, Homo sapiens
gggaggtgtgcatgtgtgtcattctcctagagttttcatgagctgctcacttccc

SEQ ID NO: 6860899 - DNA, 61 bp, Homo sapiens
tgctttaccttccatttaaggaggaccagggagttaggaacttcttgaggaaagtaaggca

SEQ ID NO: 6860900 - DNA, 61 bp, Homo sapiens
tttttggcaaataaccattttcttacaggtttttaatctaaagatggttatgtgctaaaga

SEQ ID NO: 6860901 - DNA, 82 bp, Homo sapiens
cgcctctttgcctggtcctgtgggtgctgtgcaggctccctcagccaagctcggcattcccaggcctggctccgagtaggtg

SEQ ID NO: 6860902 - DNA, 63 bp, Homo sapiens
gtgttccctggtaaactgactcccaaccgtgactaggatatcggagggcttattagggagggc

SEQ ID NO: 6860903 - DNA, 60 bp, Homo sapiens
ttgtatgagtatggtgtataggcactgtatgtggtgtgtgtatgcagtatgtgtgtataa

SEQ ID NO: 6860904 - DNA, 69 bp, Homo sapiens
tttctatttggctggatgatagaactaagaatagtatttcttacattcttatctcagttattttggaag

SEQ ID NO: 6860905 - DNA, 129 bp, Homo sapiens
atattttaattctacccttctgttgtcataggcataagttatttatctgtgacatagagaaattctattgagttacagaaaatacttaatgtttctaatcaatatattagtattttgggattaaaaaat

SEQ ID NO: 6860906 - DNA, 108 bp, Homo sapiens
gtgtggtggcaggcacctataaccccagctacttgggagtctgaggcagaagaatcacttgagcccaggaggtggaggttgcagtgagctaagattctgccactgcac

SEQ ID NO: 6860907 - DNA, 63 bp, Homo sapiens
cttaatgtggaagatgttaagtgaatgtctaaatggtgttgctgataacatgttttcattaag

SEQ ID NO: 6860908 - DNA, 66 bp, Homo sapiens
ttccaggtgacttttaatctatatatgtttggtaaaactatatttggaaagaaaatcattgaggaa

SEQ ID NO: 6860909 - DNA, 79 bp, Homo sapiens
tgtcttctgcccaaagataccgtgaagatttgacgcagtcttgtgctagcctcccttttccatggtgtggcactggaca

SEQ ID NO: 6860910 - DNA, 81 bp, Homo sapiens
agccctttcccattagtactttagcataaagcagtttatcagattcagctggttgattctaaggtgataatatgcagggct

SEQ ID NO: 6860911 - DNA, 85 bp, Homo sapiens
gcttaagcagaagaactctggatttcttgggcctcaggcatattacaaagcttgaggttaggaaccagtgtttgactgtaaatgc

SEQ ID NO: 6860912 - DNA, 102 bp, Homo sapiens
aagcccccctctgtaaatggtgggaacacagtttcctctcctaaatatttctcaggaatttcagggagcttgtgtttcttttagtgacatcttacttcgctt

SEQ ID NO: 6860913 - DNA, 64 bp, Homo sapiens
cctttcacatagacatgcacacagctacacaacgtaggctgacaagttcgtctaaagtgacagg

SEQ ID NO: 6860914 - DNA, 90 bp, Homo sapiens
ggagggagagggattgaaggcaggaacacaagttcagggatgtctgcagacatcagcctgtccctggtttactcttcagcccctccttcc

SEQ ID NO: 6860915 - DNA, 72 bp, Homo sapiens
cagtaatattcctttgcacctgagcaactatacattgaaggaatcagctttcagttcagaaaggaaatgctg

SEQ ID NO: 6860916 - DNA, 74 bp, Homo sapiens
tagcaatattgatcttggaactgattttggtgttacaccgcccgagcgggtttaattagggtttgaaaatgctg

SEQ ID NO: 6860917 - DNA, 85 bp, Homo sapiens
agtcaggcagtagggagatgcttctgcgtagattgccctgcagttcctttcaagatctacacagaggcagctgtctgctctggct

SEQ ID NO: 6860918 - DNA, 76 bp, Homo sapiens
cattaatctctatttttcttggaccagacagggcaaaaaatctgaattccccagaagagatagactagaattgatg

SEQ ID NO: 6860919 - DNA, 89 bp, Homo sapiens
gcatgggaactgtttagggtggtaagaggatcaaggcggtgcacaaagagatgtgtgtagtgattttcttccaaccagttttcccaagc

SEQ ID NO: 6860920 - DNA, 63 bp, Homo sapiens
gacatctgcctaagtggccctgttggagcctggggaaagcagggctgtgtaggtaatgatgtt

SEQ ID NO: 6860921 - DNA, 85 bp, Homo sapiens
tgcttttgtcatctttggttttctatatgccacgaggagttcaggcatgtagcaaaccaaaggcaacaagaattttcttacagca

SEQ ID NO: 6860922 - DNA, 63 bp, Homo sapiens
gctgttattgcataaaatcaggttagagatgatggtcactctgactaaagtgatagtgatagt

SEQ ID NO: 6860923 - DNA, 57 bp, Homo sapiens
tttgtgctgaggctgatagtggaactgaaaatgctcctaccttcagagtggcacaaa

SEQ ID NO: 6860924 - DNA, 61 bp, Homo sapiens
gagtgtgcatgtcccggaaacactggcaagactgacagtgggatatgggggcagcattctc

SEQ ID NO: 6860925 - DNA, 89 bp, Homo sapiens
ctttgctggtggcagggggatggagggatccaagcagtagaaaaagcatttctctgctctgtgcctcagtttccctgtctataacaagg

SEQ ID NO: 6860926 - DNA, 63 bp, Homo sapiens
ctggtgtggtaatgagaattattttaattgctttttgccaggcctttctcatacctcacttag

SEQ ID NO: 6860927 - DNA, 90 bp, Homo sapiens
atggggtactgttcaatgcatatagatatagaaatccagtcgtacaagatgaaaagttctagatatctagtgtataacattgtggcttat

SEQ ID NO: 6860928 - DNA, 76 bp, Homo sapiens
agataagctacctttgccagaacagtagtaactcctttctttgcttgatggtccactggcatgaggagctttgttt

SEQ ID NO: 6860929 - DNA, 82 bp, Homo sapiens
ggggaccaccagggctggtgcaggaaggagctggcagcagcacggctgtcaccacccatgtaccacgtcttccaatgtcccc

SEQ ID NO: 6860930 - DNA, 76 bp, Homo sapiens
gcagaataaaatttgccttaccttcttccaagagccccctactgttggaaataagggaggcaaaatcttactctgc

SEQ ID NO: 6860931 - DNA, 80 bp, Homo sapiens
tggcctgtttaatttccttccaggttcctaaggctcaggacttctagggccattagactgccaggaagggcctaaagcca

SEQ ID NO: 6860932 - DNA, 57 bp, Homo sapiens
agctctttatgtggaagaggcactgttctcaatctgtgcttctccgaaggcagagct

SEQ ID NO: 6860933 - DNA, 64 bp, Homo sapiens
tggggagccacaagtgctgatgaaaacagaagtgagctgtgttatgtcctcatgttgttctcca

SEQ ID NO: 6860934 - DNA, 128 bp, Homo sapiens
tgctccactgtctaggattctatttttccccctctgccttttcctatcccagcatcccaagtcagctgctggaattatagaaaaatagagggcaatagtagaaagtcctaaaggcattgtgcagagta

SEQ ID NO: 6860935 - DNA, 75 bp, Homo sapiens
tgaattacttaagagaaactttgagatggccttaaatgtcattccctcaaagcgttctttatataagtcaattta

SEQ ID NO: 6860936 - DNA, 72 bp, Homo sapiens
gcgatttccttggagaatgttttcctgcagtgcttcacactggcagagggaaaaccattccccaacaggagc

SEQ ID NO: 6860937 - DNA, 93 bp, Homo sapiens
ggctcctatatgtcctggtgggtggacgcctgctgctccagacccatttggggccagctccttggcagtgcctcgcccaccacatgaggggcc

SEQ ID NO: 6860938 - DNA, 70 bp, Homo sapiens
ttgcaagatattgatttccagctgatgctttaactgagccctcagcaaaggcaattcattattcttttaa

SEQ ID NO: 6860939 - DNA, 81 bp, Homo sapiens
atagggttggtggtaagaataggggctttggagccaggcaaatgtgatttgtattccagctctgattctcactagctctgt

SEQ ID NO: 6860940 - DNA, 56 bp, Homo sapiens
taaacatttcatgcagaaggaagttggggcaaaggctccagaacttcatgagttta

SEQ ID NO: 6860941 - DNA, 80 bp, Homo sapiens
aggtatttgttacagcagcaccccacttctcagtaccaatttctgtcttagtccatttgggctgctataacaagatacct

SEQ ID NO: 6860942 - DNA, 76 bp, Homo sapiens
cccaccccatcacacagggaggaggtgctgtgcccgctgggggggcagctgcccctctctgggccctttgggtggg

SEQ ID NO: 6860943 - DNA, 90 bp, Homo sapiens
agatccagttttctcagtgattattgattgcattcagaacagcttctgtttccctatgaacagatcaatagaactgacaagcctcagttt

SEQ ID NO: 6860944 - DNA, 83 bp, Homo sapiens
tttcaggcagaggaaacatgagttgtatcaggcatagaaacctggaacaaaatatttatgtttgctcagacctcagtctgaag

SEQ ID NO: 6860945 - DNA, 68 bp, Homo sapiens
ggggccaaaacattctctgcagcagggcctgccctgtgcattggagggtgtttcacatccctggcctc

SEQ ID NO: 6860946 - DNA, 69 bp, Homo sapiens
ctgtctgtcccgtcaccgccccatgttcgttcatctcactgttgggcagtttggtgacgccagttgcag

SEQ ID NO: 6860947 - DNA, 74 bp, Homo sapiens
atctacactgaatgccatttgtaactatcattctggccaaggcccggaagcaaggttgatggcagtggtgagat

SEQ ID NO: 6860948 - DNA, 69 bp, Homo sapiens
aggaccccagagataccagttttaatgactaggtagagatagaaaataagattgtgtgtcctgtgtgct

SEQ ID NO: 6860949 - DNA, 85 bp, Homo sapiens
ggtctgcagaggaatgagagaagacaggcaagtgagacccagagagaggctgcactaacctgacattcttgggtgctcacagacc

SEQ ID NO: 6860950 - DNA, 55 bp, Homo sapiens
atgagagtactagaaacttccttaaagactcaagggggtgcatgctggctctgat

SEQ ID NO: 6860951 - DNA, 98 bp, Homo sapiens
cattggagttacatagtcctagtgaagaggaagtggggcacatgcaagatgtaatgtgctgctttgcctcatctttatttctattttaagcttcaatg

SEQ ID NO: 6860952 - DNA, 64 bp, Homo sapiens
caaatcagaaggaagaagtcatgggagattgctcaatcatgtaatgtcacttcctccctctttg

SEQ ID NO: 6860953 - DNA, 59 bp, Homo sapiens
gcttgtgtgtatgtgtgtgtgtgtgtgtctatgcatgaacacaatacgtgcatgcatgt

SEQ ID NO: 6860954 - DNA, 83 bp, Homo sapiens
gtggttggtcattgattctgctcagtcatgttggattgttaacaacaacatcctaagtactgggtagttttagagatcatcat

SEQ ID NO: 6860955 - DNA, 99 bp, Homo sapiens
acctctagtgagagaacaagtcatctttatccaaaacactcagctgagccacagaagagtgttgaaaagatgctaagtggctgattttcacttcaaggt

SEQ ID NO: 6860956 - DNA, 59 bp, Homo sapiens
gggaaagggaagtagagaggaggagcctcagatgctcaggctctgtactccctttgccc

SEQ ID NO: 6860957 - DNA, 63 bp, Homo sapiens
gcctgcatgcaacagtgccctggaatcccagcccaggatttcagctcagtctgtgcagcaggc

SEQ ID NO: 6860958 - DNA, 69 bp, Homo sapiens
gtcgttttagttcggtttcccaggacacagagcagggtggagaagagtggagactggatctggagagac

SEQ ID NO: 6860959 - DNA, 55 bp, Homo sapiens
ggtcctaagtggcagctggtatagtatgtgttttcagttgttgatcacttagacc

SEQ ID NO: 6860960 - DNA, 93 bp, Homo sapiens
cgtaggccgcattctgggagttgtagtccggtggagcgggggttggcgccgcccgcggacccagccggactccacttcccgtcgagccctgcg

SEQ ID NO: 6860961 - DNA, 110 bp, Homo sapiens
gaagccaatttgcatctcttgctcattaagtagctcacagtggctggaaatttgacagccttaatgtttgaacttcttgaacagcaggtttagaactgccagtgattttc

SEQ ID NO: 6860962 - DNA, 56 bp, Homo sapiens
ccagcaggagatgcctgtgtctccagagacgcgagagagtggtgtctgccagttgg

SEQ ID NO: 6860963 - DNA, 95 bp, Homo sapiens
tgccctctgccctttctgcccctgcattcgaaagtgatcatgagctgcccgtgccctggtcattggtagtgcagggagaggaactgccgagagca

SEQ ID NO: 6860964 - DNA, 72 bp, Homo sapiens
aggtaatagaatattaatactgaaaggagtatcagctaatacatagagataaaaatcagtagtattctgcct

SEQ ID NO: 6860965 - DNA, 56 bp, Homo sapiens
acgtgttcaatttccatctgactccactctctatttcagattgaggttctgcacgt

SEQ ID NO: 6860966 - DNA, 80 bp, Homo sapiens
gagcaggactttctcccacccacccgtcttcccctatgcaggtgtccagacaggctgtgggtagggggcgatgcctgctc

SEQ ID NO: 6860967 - DNA, 67 bp, Homo sapiens
tggagcccaagtctgcactcggcggcacccttattcatcactccatgcgcctgtggtttggtttcca

SEQ ID NO: 6860968 - DNA, 56 bp, Homo sapiens
gaacacttagcatataccaggcactgttctaggcactgggaatatgctgagggttc

SEQ ID NO: 6860969 - DNA, 69 bp, Homo sapiens
gcatgattcagtcttttaaaggcctagaaccacacacttaactaggaatatttgatatctgaattatgc

SEQ ID NO: 6860970 - DNA, 60 bp, Homo sapiens
ggaaggaagtcattagtgcagactgagctgtggagttgggttcttgcaggatttccttcc

SEQ ID NO: 6860971 - DNA, 78 bp, Homo sapiens
tactacatgaaactgaaggacaaccagaagaactggaagcgctatgaccttctgaatgtccttgagttcaaccaggtg

SEQ ID NO: 6860972 - DNA, 58 bp, Homo sapiens
gtggagtcatacagaacaagactgtttcttcctaacagtgcttctgatatgatgccat

SEQ ID NO: 6860973 - DNA, 65 bp, Homo sapiens
agccaagggtggcacctggaagggatgggttacaaagagccgtccacacacctgcactctgggct

SEQ ID NO: 6860974 - DNA, 63 bp, Homo sapiens
gcaggctgctgagatccttaggcagcccagaacacaggcggcctcgggtcccttgcagcctgc

SEQ ID NO: 6860975 - DNA, 96 bp, Homo sapiens
cagcctttgttctcagtgtcacgttttgccttagtaggagatgatgtccccacaatcacgtccattcatgaggcaagagcactggggtctgcactg

SEQ ID NO: 6860976 - DNA, 60 bp, Homo sapiens
ggattgctatgaggatggaaaaaactgaccaatgtgggggtattttactcatagcaggcc

SEQ ID NO: 6860977 - DNA, 85 bp, Homo sapiens
ctcacacactcaaggggaatcagagaagacttcctgaaggaagtgatgtctaacttgatccctgagggatgagtaaaaagtggag

SEQ ID NO: 6860978 - DNA, 56 bp, Homo sapiens
ttggctagcaggaaaacgcctcatagccttggatgtgagtgccacctgctggccaa

SEQ ID NO: 6860979 - DNA, 63 bp, Homo sapiens
cagggcccaggccactgggttggcttctctacactctccccacaacctgcctgatgggccttg

SEQ ID NO: 6860980 - DNA, 98 bp, Homo sapiens
gtggatgtcacataccctcctggtgcatgctactgtctagaggaggcactggggcctctcaggtcacaggatggccaggaatagatgctgtcagacac

SEQ ID NO: 6860981 - DNA, 66 bp, Homo sapiens
cgtcagtttgccatggattaaggtaactataataggttacaaggatattcaggtaaaagctctgtg

SEQ ID NO: 6860982 - DNA, 84 bp, Homo sapiens
ggcactgggcacagtccctgtccttgtagcccatcaggtggatgatgatatggtggggtcacgacagagggaagcccagatgct

SEQ ID NO: 6860983 - DNA, 110 bp, Homo sapiens
attggcagataaggattggaatcagtgagttctcagcttagtatgctgtgggtcatacaggcatagtgttgagaagcatactggtacttagttgacacttatttaataat

SEQ ID NO: 6860984 - DNA, 62 bp, Homo sapiens
tcaactttggatggctgtgtgtttatttcaaaatgatatcacagttgcccaaatatttttga

SEQ ID NO: 6860985 - DNA, 76 bp, Homo sapiens
cggtacctagtaaacagtaggaactgagaaatgataacaattacttactttagatcatactgtgtgccaggcattg

SEQ ID NO: 6860986 - DNA, 65 bp, Homo sapiens
ttgtggacaggcagttggtgggagagctggcctggatctcattctcccatcaggtctttttatag

SEQ ID NO: 6860987 - DNA, 62 bp, Homo sapiens
acatgagacaattgttgatgttcagaggcccattacctctcatgatcagagattttccatgt

SEQ ID NO: 6860988 - DNA, 72 bp, Homo sapiens
aaattagtcatgttgtattacttctttttatggcaatgctctgaaagtctgcaaatgtcagcatgttaattt

SEQ ID NO: 6860989 - DNA, 81 bp, Homo sapiens
tgcccctttggctccagccaggagcccacgcttcattaaaaactgtgagctgtgccaatctgtctggggctttatggggta

SEQ ID NO: 6860990 - DNA, 70 bp, Homo sapiens
ctagtgagaggtgtggccaggactcaagctggatctgtccctgcattggctgtgctataccacctcctgg

SEQ ID NO: 6860991 - DNA, 80 bp, Homo sapiens
tgttttgaactctataagttcttgagctcactaattgaagagatttttcaggccatagcacagggaaggaattcaaaaca

SEQ ID NO: 6860992 - DNA, 68 bp, Homo sapiens
gctttgggtttctaatatgctctaagtcaacactaggattgtgttgatctgtgttagaagctaagagc

SEQ ID NO: 6860993 - DNA, 78 bp, Homo sapiens
tgctgagtacattgttgcgtgagatggcatttttgtcattttgtggacattgatcagcctcccatgcagtagttggca

SEQ ID NO: 6860994 - DNA, 67 bp, Homo sapiens
ggtgaaaaggacaagctttggagttagacaacctgagttcaaattttggctctgccatttttcagcc

SEQ ID NO: 6860995 - DNA, 130 bp, Homo sapiens
aaggcttctctctggttttgcctaagatggagagcagtcttggtgtcagtggtctgagtctgatctgctcagtcaaggaaaaatacctccagggagtgttctttaacatggtgaacagcagagaggcatt

SEQ ID NO: 6860996 - DNA, 70 bp, Homo sapiens
actaatggattaacgtccctgtcgtgtgacattttctggtatgacagctgaagatgttgaaccgtatggt

SEQ ID NO: 6860997 - DNA, 72 bp, Homo sapiens
tgtgcaatcaagaggctatgaggagtgaggtttcctcttggattggccttctaattagtctaggatgacata

SEQ ID NO: 6860998 - DNA, 83 bp, Homo sapiens
ggaaattgcatttggggagcttacctgttctaagatcttcctgagaatgaattttctgtaaggctttttagaagcacatttct

SEQ ID NO: 6860999 - DNA, 71 bp, Homo sapiens
cctagattttattgttctgtagtgacatgtagccaaaaagcaacatgtatctaaggacaagatgatattgg

SEQ ID NO: 6861000 - DNA, 92 bp, Homo sapiens
tagtgtgcttatctccatcaggattcagtatctccagctatcagacaagcttggaagagcacagtcctcataggagagtgcagcaagcatta

SEQ ID NO: 6861001 - DNA, 85 bp, Homo sapiens
gaactgtttcctctgcttcttctaagttaattttctaaaactattttctatagaactggaaataatttggccagagggaattgtc

SEQ ID NO: 6861002 - DNA, 65 bp, Homo sapiens
ctaaagtgtgtgggttctaaattcagaaaaatcatatttccgagttttggacctacatattgaag

SEQ ID NO: 6861003 - DNA, 58 bp, Homo sapiens
gggaggaggtaagaagagaaagggctaagtgatccagttctaagtgttaccttttctt

SEQ ID NO: 6861004 - DNA, 129 bp, Homo sapiens
acctcctgtcagatgagtggtggcattagattctcataggagcatgaaccctattgtgaaatgagtatgcaagggattgaggttgcacgctccttatgagaatctaactaatgactgatgacctgaggt

SEQ ID NO: 6861005 - DNA, 69 bp, Homo sapiens
agacacattccaagcattacaatgtgatgctactccatcacattgttatgtaaatgttttgaagtgttt

SEQ ID NO: 6861006 - DNA, 73 bp, Homo sapiens
tggtttgacacaagtgagtgaccagagttggtgtcttcttggaactgaccttgtgttaccatatgacaaacca

SEQ ID NO: 6861007 - DNA, 55 bp, Homo sapiens
gctacaggagataaaggcctctccatgagacactgcagaggctgtcacctgtagc

SEQ ID NO: 6861008 - DNA, 58 bp, Homo sapiens
gaaatgccctcccactgaatgtaccttgtgacttgcaaaagtgatgggatggcacttc

SEQ ID NO: 6861009 - DNA, 86 bp, Homo sapiens
gtatcttttctgcccaggctgaaggaacatccacagatacagatgtggcatgtttattatccttgcctggagcttctaagtcgtgc

SEQ ID NO: 6861010 - DNA, 82 bp, Homo sapiens
gcctttgctattgtaaatagtgccacaataaacatatgtgtgcgtgtgtctttatagtagcatgatttataatccttagggt

SEQ ID NO: 6861011 - DNA, 57 bp, Homo sapiens
catgacagaggagtgcaggtgatccttcctgtggaaacaaggtagttctctgtggtg

SEQ ID NO: 6861012 - DNA, 77 bp, Homo sapiens
gagtgtggcctgcaggcaccttgggggccagtcctgggcctcacctagcagaggtgtgattcctgccaggctcactc

SEQ ID NO: 6861013 - DNA, 65 bp, Homo sapiens
tagtcctctgctttcaagctggtactctttaataagacaattcacagctgaggcacctgaggtta

SEQ ID NO: 6861014 - DNA, 80 bp, Homo sapiens
ttgtgctaaatataagttggcaataatactgtaatagtgataggaaccatctattccagtgtgcttttatgttagaataa

SEQ ID NO: 6861015 - DNA, 58 bp, Homo sapiens
gggagggatggtgtgagaggctcagtgaaggcactgagtgctgcatgcctttcctcct

SEQ ID NO: 6861016 - DNA, 71 bp, Homo sapiens
tttgatacgtattctgggccgattacaaaacttccagaactagtctttgtaaatgcctagcataattcaga

SEQ ID NO: 6861017 - DNA, 77 bp, Homo sapiens
gatcaaggtgacagggggcttggtttctagggaggtctctgttcctggtttgcagatggctcccttctcattgtgtc

SEQ ID NO: 6861018 - DNA, 74 bp, Homo sapiens
ctcctctgggtcctggtggccatcaattgtgctgcccatggatgcaagcattaccacccatggatccagaggag

SEQ ID NO: 6861019 - DNA, 62 bp, Homo sapiens
tggggacttgagccatgcagtcatccctctagaaaagactgcagggcaagttagagacccca

SEQ ID NO: 6861020 - DNA, 83 bp, Homo sapiens
gagtcttactctatcacccaggctggagtgcaatggcgctatctcagctcattgcaacctcctcctgggttcatgtgattctc

SEQ ID NO: 6861021 - DNA, 111 bp, Homo sapiens
ggggctgttttagacagaggaggcggcaggtgcgcgtatgtaggtttgaggtagattttgctacccaggaaatgggctcttgcctcttccacctgcctgtgaactggccct

SEQ ID NO: 6861022 - DNA, 59 bp, Homo sapiens
gtggcaccatgatcatgtttgggggtccctaagcaaaccctgacacatacatgggccat

SEQ ID NO: 6861023 - DNA, 60 bp, Homo sapiens
ggtttttctgtggaaagctgttaggaagttattgataaacagctactctgcagataaatc

SEQ ID NO: 6861024 - DNA, 56 bp, Homo sapiens
taggaaatgccagccttcctccaggtgcccagctccttccagggcagcatttcttg

SEQ ID NO: 6861025 - DNA, 61 bp, Homo sapiens
gaggaggttccgggtggagaagtgctgtgccactggcagctgccaccctgggagctcactc

SEQ ID NO: 6861026 - DNA, 121 bp, Homo sapiens
tggctgtgtcatgacaggcctcatgatgctaacagagattcttcccttcttttttccaaaagcaccaaaaaaaagggctgaagtagtctctgtagcatctccccaaagtgttaaacagcta

SEQ ID NO: 6861027 - DNA, 83 bp, Homo sapiens
agaataacaagaaagccatgaatgttatagaggaatccagaaagcctctcctttagcttctgtggcacattcatgtttattct

SEQ ID NO: 6861028 - DNA, 72 bp, Homo sapiens
ctcttcctcaggtcagaccaaggcctcttcccttgctctttatggaagccagccttgtctgcctctttagag

SEQ ID NO: 6861029 - DNA, 58 bp, Homo sapiens
ggctgttcctctgagagctgatatccacaagaggtggtggcggtctagaggaggggcc

SEQ ID NO: 6861030 - DNA, 69 bp, Homo sapiens
cgcagtgaccctgagggtgctgggtttctgtttgagggagaagaaactcctgagcccctaggtattgtg

SEQ ID NO: 6861031 - DNA, 84 bp, Homo sapiens
aagttttatgaaatttaaacacagatcaagtactaataagaaaatctggtactcaagttgagatgtgctggattttggagactt

SEQ ID NO: 6861032 - DNA, 68 bp, Homo sapiens
tagacctgccttgattgtcctgcttctgatgggatagacaaaagaaatcaggaacagtaaggagccta

SEQ ID NO: 6861033 - DNA, 58 bp, Homo sapiens
tcctgaattcctctttgcatccatattcagggatgcaaagagacctgggaaattagga

SEQ ID NO: 6861034 - DNA, 63 bp, Homo sapiens
ccatcttggctcacattactgataaatatttcagtatttcctatagtgagggcctaaagatgg

SEQ ID NO: 6861035 - DNA, 82 bp, Homo sapiens
tcccagacacaagagatacctgctgttgctatttgtgaccaaataccatatttgtcaataactaccaacaggggctctggga

SEQ ID NO: 6861036 - DNA, 57 bp, Homo sapiens
ccagctgcgggcatcgagagttcagagcggcaccagacagtcggcgcgtgcaggtgg

SEQ ID NO: 6861037 - DNA, 68 bp, Homo sapiens
tacctccagaaatttggatgcagcaagtctgaaaggatctctgttttgttacaagtactctggatgtg

SEQ ID NO: 6861038 - DNA, 97 bp, Homo sapiens
gactcaagcccagtagactttcctttgtccctctgtgttgggcatgcctcagcctcctgaatcagcccctggagggcattgaggctggcttgatgtc

SEQ ID NO: 6861039 - DNA, 69 bp, Homo sapiens
ggcaattttcatgaattattgatttggccaaaaataattgaaaaggtttataattacatagagattgcc

SEQ ID NO: 6861040 - DNA, 79 bp, Homo sapiens
taagaccctttggtgaacctctgaaaggcagtgactaggagaccctctctgctggacaaaggggtttccgacagtctta

SEQ ID NO: 6861041 - DNA, 56 bp, Homo sapiens
ttcacagtgtgatctatgggcaatgtgctgctacaccaccatgtttcacctgtgaa

SEQ ID NO: 6861042 - DNA, 77 bp, Homo sapiens
acatttgctgacaaacatgttctccccaggtggagtccctcccccacctctggccaagactcgtgtttgagaagtgt

SEQ ID NO: 6861043 - DNA, 55 bp, Homo sapiens
tgaccctcagaacaatgagaaccggccagtgggggaattattgcctctgaggtca

SEQ ID NO: 6861044 - DNA, 63 bp, Homo sapiens
tgctggggtctgtgaggagggctgcaccggctgtgaggcctgactgacctgattctaattgca

SEQ ID NO: 6861045 - DNA, 81 bp, Homo sapiens
gtagaacgagaaaagcgaaggacctggagtgccttcagcaatgcactgagtctctttcctcgctttcattttggtttctac

SEQ ID NO: 6861046 - DNA, 69 bp, Homo sapiens
gagggcaggatggcagagaaaagggtgcgtgaaggcataagcacctgaaattttctccatttccccctc

SEQ ID NO: 6861047 - DNA, 58 bp, Homo sapiens
ggctactgaaaaagaatccagacctctgaaagggtttgtgacaaattttttagaagtt

SEQ ID NO: 6861048 - DNA, 61 bp, Homo sapiens
ttatacttgatcctggcagggtaagaagtagtagttttaagctccctgaagggcaagataa

SEQ ID NO: 6861049 - DNA, 79 bp, Homo sapiens
tcctggtgctgggagttcatgagacttattctcaaatcttcagagaagaaaattccgtgaacacctgggaacatcagga

SEQ ID NO: 6861050 - DNA, 66 bp, Homo sapiens
caaattttagcatctgaactgttgaaaaggaaggattcatcagcacagcagatgcttcaatgtttg

SEQ ID NO: 6861051 - DNA, 88 bp, Homo sapiens
aatatcaaatagagctgatgagagcagatattcttattcttgatgttaggaagaagtcattctgtctttcaccattagttttgatgtt

SEQ ID NO: 6861052 - DNA, 55 bp, Homo sapiens
gttttccatggaggtctgacctgaattcaccagtgcaacctcattggtggaagat

SEQ ID NO: 6861053 - DNA, 103 bp, Homo sapiens
aaagtggttagtgcaactgagaagctgaatttttattgtatttagatttatatttaaatgctcacataaaggtagcagctacagtattggacggtgcagcttt

SEQ ID NO: 6861054 - DNA, 79 bp, Homo sapiens
ttttaaacagagaagactttgagcaaatggggatctaatttgaggaaggttttcttggtgcttaagtagctgtttgaaa

SEQ ID NO: 6861055 - DNA, 81 bp, Homo sapiens
gcatggcccagatttgcaggcaactgctgctaggaataatcaaaccttatacttattcagcacttgctctgtaagtcatgc

SEQ ID NO: 6861056 - DNA, 58 bp, Homo sapiens
cagtgattcagactcatcatttctgacttgatctggaatcctcaagtttggatcactg

SEQ ID NO: 6861057 - DNA, 64 bp, Homo sapiens
gggagtaaactatggtgaggatgcgcccgttttatctgcttggacatcccatctggtttttccc

SEQ ID NO: 6861058 - DNA, 78 bp, Homo sapiens
caggccagagagggctcactgagaaagcagttcttgagcaaagacatgaatgtgtgctcttgagccttcacatgtctg

SEQ ID NO: 6861059 - DNA, 65 bp, Homo sapiens
cagcatagctgattaaggcaaaaaactaaaatgaaaataagagtcaagcctttagtcacttgctg

SEQ ID NO: 6861060 - DNA, 130 bp, Homo sapiens
catgcattattgcattcaactcaataaccttttctgctagctgtttttaatccttaatttatagatgaggaaattaaagctctggaagattaggtaaattgctcaaggttcataggtgtaataagtaatg

SEQ ID NO: 6861061 - DNA, 71 bp, Homo sapiens
catagaaaaaggttctcttgttcattatttttgaataaactaatctgcaacatagagggctttttcctgtg

SEQ ID NO: 6861062 - DNA, 58 bp, Homo sapiens
agctgcaggagtcgcctaggatatggcccgtcacgtctggggatgaccctgcactgct

SEQ ID NO: 6861063 - DNA, 76 bp, Homo sapiens
ggaaagtttccaagtatatgtttgctaggtataatcaacgaaatcggcatgctttaaaacgtatgtgtaattttct

SEQ ID NO: 6861064 - DNA, 86 bp, Homo sapiens
ggaattcctgtccaattctccttccctgggttgacacctctgtaaggtcagatctggaagtaggagagtgggcaccaagggagtcc

SEQ ID NO: 6861065 - DNA, 65 bp, Homo sapiens
aagtgagtctgagcgctttgggattccccctcccatctatcttcttggagctgccatatttagtt

SEQ ID NO: 6861066 - DNA, 55 bp, Homo sapiens
gatttttccacaataaacataggatgaggtctgtgtatagaaagtaggaaaggtc

SEQ ID NO: 6861067 - DNA, 69 bp, Homo sapiens
catcagtgttgtcatgttgttgcacattgcagggtttccttttgtaaggctaaataatattccactgtg

SEQ ID NO: 6861068 - DNA, 99 bp, Homo sapiens
gtatcttttaagaaccaatggtgatttttagggaaatgttcttaagcaatacttaggaacaaaaggttttcctgaaagacatagtgtccgcagagatgc

SEQ ID NO: 6861069 - DNA, 65 bp, Homo sapiens
gtgtgagcagagttgtttctcctgaggcccctctccttggcctgcagatggctgctgcctcacat

SEQ ID NO: 6861070 - DNA, 73 bp, Homo sapiens
tagtgcagtctaagtccataatggcagtaaataattgatttatttttgtcatattatggataaacatgcatta

SEQ ID NO: 6861071 - DNA, 80 bp, Homo sapiens
ggtttaaatatacaagtaattagtaagcagagcctttccagagccgaagggtttctgaagggattacttggttttgaacc

SEQ ID NO: 6861072 - DNA, 68 bp, Homo sapiens
agctacttatttttagaaagtgaattctgagattaagcttagcatttatttcttagaaattgcttgct

SEQ ID NO: 6861073 - DNA, 65 bp, Homo sapiens
ttgtcggggtcactcagaagctcatctttgtttggccatttgttgggctaagagtgaccaggcag

SEQ ID NO: 6861074 - DNA, 64 bp, Homo sapiens
aaagatacacatctatttaagagacagagcattaaactttgtaattgatcatgtgtgtattttt

SEQ ID NO: 6861075 - DNA, 82 bp, Homo sapiens
cacctcggtgtgtccaaggcacggatgacggtggagaggagccggccatcccttgaagtcacctgtgccacatactggggcg

SEQ ID NO: 6861076 - DNA, 129 bp, Homo sapiens
cttttgagtagttgtttattcaaaaatatgcctacgtctttagcaaattactcacagggtcagcgactgttgaccctgtgtgtttgttagactttgagtgtaagtgacaatataaacacagccatatag

SEQ ID NO: 6861077 - DNA, 85 bp, Homo sapiens
tcatagcagtgatggtgagcaggattcgcctcttgcagaaggactgccacagagcaattctgctgaattttcattgagaagttga

SEQ ID NO: 6861078 - DNA, 92 bp, Homo sapiens
gatagggcctcaattcataatggatgattaaatggatgaagagacaaatattatccaagctttctgtttatccactcatccatgcctctatc

SEQ ID NO: 6861079 - DNA, 69 bp, Homo sapiens
gtttccatggtgcagaaatccaggcatggcccgactgggtcttctgctgggggtgtctcaccaggctgc

SEQ ID NO: 6861080 - DNA, 67 bp, Homo sapiens
ttccactctactctggccagtcacctctcttcatcaatcctggggatgactaaagagaagtagggaa

SEQ ID NO: 6861081 - DNA, 72 bp, Homo sapiens
cagttggattcaaaatatcagtcccggcctatgtggtttacctccaaaggtctaactgatagaattcatctg

SEQ ID NO: 6861082 - DNA, 81 bp, Homo sapiens
gaaatgtgttgttagaagccaggatggagcaggttttgccaaaccctgagtcctagtggcttgtaacagcacacatatttc

SEQ ID NO: 6861083 - DNA, 75 bp, Homo sapiens
atccaagtatcctcagaggcagatggtaagaatgaaagttcccactaccatctgttctgacccaaatccttggat

SEQ ID NO: 6861084 - DNA, 100 bp, Homo sapiens
gaggaaccgagaccagggacagaggggcctctgggtgggggatgtggagggcaggggacagactcagcacccgggcctttcctccctggcttggagattc

SEQ ID NO: 6861085 - DNA, 77 bp, Homo sapiens
gtgaagtcccttgagggagtactgtttgagcagactaaaggataaagagccagatgtgcctccagggtgacatccac

SEQ ID NO: 6861086 - DNA, 56 bp, Homo sapiens
ttgtgggaacctaacagtggcaggttataaaaggaaaatgcagcatgttcccataa

SEQ ID NO: 6861087 - DNA, 80 bp, Homo sapiens
gtttgtagctttatgctgtgtcaggaatttgataccccctatctggggatgttatatgacatggttgaacctgaacagac

SEQ ID NO: 6861088 - DNA, 59 bp, Homo sapiens
gcacgcacccagccagcatctcagagcactcctgtgtgctgcctgagctgggtgctggc

SEQ ID NO: 6861089 - DNA, 55 bp, Homo sapiens
aagccactgcagcaggagctgccatggggaaacatggtacctgctttagtagctt

SEQ ID NO: 6861090 - DNA, 64 bp, Homo sapiens
gctttaagactgatgtccagtcccatggggaacagaagccacatggggccgatattagctcagc

SEQ ID NO: 6861091 - DNA, 79 bp, Homo sapiens
gcagctccacctcctccagggaggtctgcaggactgggttcaatggcagtgatgaggacctctttggccggtgggcggc

SEQ ID NO: 6861092 - DNA, 83 bp, Homo sapiens
gatggagccaggcctattcacatgacccaggcataggcaagcccatgatactgactggttcagtgaaaggcatgggatccatt

SEQ ID NO: 6861093 - DNA, 73 bp, Homo sapiens
gccagtctgtgtactgggtttctgtaaatcctccctgagatatggatcctctcagtatagtggtaaaattggt

SEQ ID NO: 6861094 - DNA, 92 bp, Homo sapiens
gctggtgtgagtgtgcttcagacattgctctccacccatgaggacgcatgggacccactagggcatgtgactgtgaccacatcacacacggc

SEQ ID NO: 6861095 - DNA, 85 bp, Homo sapiens
gggctgctgtggccgctcctcttggaatgcgtggctcagggataccatgagcccagcaggccatgagtggggccacctgcacccc

SEQ ID NO: 6861096 - DNA, 61 bp, Homo sapiens
tcattgaatgagatgcaatagacaagttatttattgtagtctgtcctgtcttgttcagtga

SEQ ID NO: 6861097 - DNA, 59 bp, Homo sapiens
ctggctgcagctccgaggaagaagagtcctgggcggactcctcaggctgctgctgccag

SEQ ID NO: 6861098 - DNA, 64 bp, Homo sapiens
gaatagcatagtttgggtgaaattatcaggcaattgcatgccttttatgcagataatgctattt

SEQ ID NO: 6861099 - DNA, 87 bp, Homo sapiens
ccatacacacactaagtaaagacatgacacattggagagtaactacacatatatgtcagtgttgtaatgttagattaggtggttagg

SEQ ID NO: 6861100 - DNA, 87 bp, Homo sapiens
agcacacaggcctaacagccttcgacagttggagtagtgttccatttattttagtcccctatcgatgggatttaggttgtttgtgtt

SEQ ID NO: 6861101 - DNA, 97 bp, Homo sapiens
tcttccctgcctctttctgtcttcactagtcagtaactgctattgttgaagcaggttattttgctcagggaacttacagatgagggcaggcattgga

SEQ ID NO: 6861102 - DNA, 78 bp, Homo sapiens
ggtcaaatggcagcagggagaggtggtaggatgaatatgaatattttccttctaatattctgcctgtttttgtttact

SEQ ID NO: 6861103 - DNA, 56 bp, Homo sapiens
ggtgacagccgcttgccctgtaactttctgtttcggggcaagtcgcgctttcagcc

SEQ ID NO: 6861104 - DNA, 77 bp, Homo sapiens
acagacttggaatctgctttttattgtataaatcaattttagcagtatttgtaaatagtagtaagatgccaagatgt

SEQ ID NO: 6861105 - DNA, 87 bp, Homo sapiens
gggaattattgaatgatatttgtattacaaagtcacagtatcaatatgtctgtgtaatgtgtgatacatagatcctaatttattcct

SEQ ID NO: 6861106 - DNA, 74 bp, Homo sapiens
ttacctaacttctctgagtcttggtttcttacctgaaggatgaggacaatccctaactcagagagttaatgtaa

SEQ ID NO: 6861107 - DNA, 55 bp, Homo sapiens
ggtcagcatctggttgagggcagtataaccacgccgcctgtgctaggagctgacc

SEQ ID NO: 6861108 - DNA, 58 bp, Homo sapiens
gcatacttcttgctgctttcagggccacagtccaagcccagccagccagcaggtatgc

SEQ ID NO: 6861109 - DNA, 96 bp, Homo sapiens
ccagagcgggagggcaggtcaagagtctggacatgctgaacttgggggttgggaggatgccctggtagagaggtccagttgactgtccagttctgg

SEQ ID NO: 6861110 - DNA, 86 bp, Homo sapiens
attttagtaataattttagcttttatttcatcatatataataatttgtagtgactggtgtgaagttaaatagaattaacctagaat

SEQ ID NO: 6861111 - DNA, 87 bp, Homo sapiens
gaattttctgtattcaaaccacagtatgaatgtctgaaaaatgcaatcatgtttggaagatttatattttggtgaagacataagatc

SEQ ID NO: 6861112 - DNA, 82 bp, Homo sapiens
tcctttatttttgagaatagcatgatgtcttttggtggtgtttggaagatataataactgttgtcatcccaagatagggaga

SEQ ID NO: 6861113 - DNA, 67 bp, Homo sapiens
gtgtgccctggggagcccagccaggcgctcactgctggggtctggccaggggtccctgaagggccat

SEQ ID NO: 6861114 - DNA, 64 bp, Homo sapiens
gggcttattgattaaaacacagattgctgggccctgcaaaaaaagtttctgattcagtaggtct

SEQ ID NO: 6861115 - DNA, 56 bp, Homo sapiens
cccaggagacctgtgaaaggaccgtttactcctttcttgaaacagcatcttttggg

SEQ ID NO: 6861116 - DNA, 67 bp, Homo sapiens
ttgactagtgccctcagacctagaacactctagcccataatgttctctgttcatggcactatgtcag

SEQ ID NO: 6861117 - DNA, 56 bp, Homo sapiens
ggctacagactgcataagggcagggatcatattcaccttattttgctgctgtagcc

SEQ ID NO: 6861118 - DNA, 98 bp, Homo sapiens
ttggacaaggtgattgtataggaatgacgtcatttccttgattgggcaacataaaccctgaggaagcccttgtcatttctgtaagttatattttccaa

SEQ ID NO: 6861119 - DNA, 66 bp, Homo sapiens
ctctcctgctcttggatcactttctctgtttgaaagaatccctgtgacgagcatccctatggagag

SEQ ID NO: 6861120 - DNA, 69 bp, Homo sapiens
ggaaggcagttaccgcaatggaggagcccgttctctggagtatctctaaatctggttcacttgctgtcc

SEQ ID NO: 6861121 - DNA, 55 bp, Homo sapiens
ctgcagaggcactccgtgtgctgaaacagctgaatcacaagaggagttccctgag

SEQ ID NO: 6861122 - DNA, 57 bp, Homo sapiens
agtgatacctgcaaatcctcatggaacctgaaagtccatgataatgaaggtgttatt

SEQ ID NO: 6861123 - DNA, 59 bp, Homo sapiens
ctatcacaattcctatagtttgtgaggcacattaaattcatcagctgtcattgtgatag

SEQ ID NO: 6861124 - DNA, 95 bp, Homo sapiens
gtggagtgccgtctcgcacatgaaggctggggtcgtgaccaccttgtttttctggtccacgtgagcttcgtgtgcagagttacggaaaaagccac

SEQ ID NO: 6861125 - DNA, 59 bp, Homo sapiens
gcacaggcacagagggccactggtactcacatgggctaaagcaattctgctgcttttgt

SEQ ID NO: 6861126 - DNA, 88 bp, Homo sapiens
agaaaacctgatttcccttttctcagaaccagggaaggcccattgctcaggcctcacttcttcaagagaatgggagacgtgtgcatct

SEQ ID NO: 6861127 - DNA, 62 bp, Homo sapiens
gcatcattgagaccagcttctgggtatttatttgcagtcctgattggctggggttctgatgc

SEQ ID NO: 6861128 - DNA, 81 bp, Homo sapiens
gccactttagtgtgtggaacccaaagctatttgcaatttaattaagttaaagatactggaggttcctacaacatagtgtgc

SEQ ID NO: 6861129 - DNA, 98 bp, Homo sapiens
ttctcactgatatttctccaatgcttaggaaagtttgaggtgtattcataagctctgccaaacttttttaggttcataggcataatctttagtatgaa

SEQ ID NO: 6861130 - DNA, 100 bp, Homo sapiens
gatttcaaatggttctttgcgcaactttaaattaattctttaaatgcgtgaatgaatgaagactgaattggtatgattgtgctagagagcctctgaaatt

SEQ ID NO: 6861131 - DNA, 61 bp, Homo sapiens
acaagagacaagaggttcttctggcctccaggagaagtttaagacctttgatttctcatgt

SEQ ID NO: 6861132 - DNA, 56 bp, Homo sapiens
tgatgctatgtcctgagcttctcctgaacactgaggtcctggacatatgtgcatca

SEQ ID NO: 6861133 - DNA, 61 bp, Homo sapiens
tcaccaaaagtaatccactgtgatacaggaagagcaaacttacagaatctactcgtggtga

SEQ ID NO: 6861134 - DNA, 62 bp, Homo sapiens
atggcagacctgaaggttcggcgctcttttctagcctgtgagtgccccgttatgtttaccat

SEQ ID NO: 6861135 - DNA, 55 bp, Homo sapiens
catgaccagagaggacggccaggagtaggccctgcttacatcttttctgggcatg

SEQ ID NO: 6861136 - DNA, 92 bp, Homo sapiens
cacctggtcatttccttgggaaattactctgctaggagaagagttagatgcttttccttgagatttttttctaggtaggaaattgccatgtg

SEQ ID NO: 6861137 - DNA, 79 bp, Homo sapiens
gctttaagagaagtacattctgatagggaagggaagctatctgcctttgtcctcctgaggattactttactcttggagt

SEQ ID NO: 6861138 - DNA, 81 bp, Homo sapiens
aagaggaaaagagcactcatgaccctagtgtgctggcatcctgttgtcctttatagctaaggtcagactgtttctcctttt

SEQ ID NO: 6861139 - DNA, 91 bp, Homo sapiens
ggtcttcttcatgccaggaggctcattgcattgtgcattcttctaaggacagaacaggatgttccaaagagcacttttcatgatcctgacc

SEQ ID NO: 6861140 - DNA, 72 bp, Homo sapiens
caagaccaaagcaagattacagaggcatagccccatggcgaggtgtatgctgtagctaaaagctgggatttg

SEQ ID NO: 6861141 - DNA, 57 bp, Homo sapiens
ttgcagtttgtggcaactttgatcacataggaatgattcctggtagccttactgcaa

SEQ ID NO: 6861142 - DNA, 62 bp, Homo sapiens
cagattcccatctcctgagcctctataagctcttacggctgtttttccaggaaatgaatctg

SEQ ID NO: 6861143 - DNA, 57 bp, Homo sapiens
agcatggacagtggcagcagtggcaactgtgatggctgctgatgttcgctgcatgct

SEQ ID NO: 6861144 - DNA, 58 bp, Homo sapiens
tagagccatgcttaaataagaggcagcattgtgttgcctcaaaataggcatagctttg

SEQ ID NO: 6861145 - DNA, 79 bp, Homo sapiens
attctgaatataatggagccagaagatcttgaagcttgtcagtggatcaggtattacttggctctgttataagatgaat

SEQ ID NO: 6861146 - DNA, 63 bp, Homo sapiens
ctctggggttagatctgatgctagagtcagatatttagctgttcaccttttctatccccagag

SEQ ID NO: 6861147 - DNA, 58 bp, Homo sapiens
gggccccactggggctgcctgcacccagagacgatgccggcgggatctcagagggcct

SEQ ID NO: 6861148 - DNA, 62 bp, Homo sapiens
ctgtattgataaggatggctgcaattatcgccttaactagccatggtccccgtcaaggacag

SEQ ID NO: 6861149 - DNA, 91 bp, Homo sapiens
cagggttttgctctgttgcctaggctggagtgcagtggcgtgatctctgctcactgcagcctctgcctctcaggttcaagcaattctcctg

SEQ ID NO: 6861150 - DNA, 71 bp, Homo sapiens
tgcctcgtctggttctagaagctgtctgttcacaaagaccataactaagtcagtttttcccagacgaggca

SEQ ID NO: 6861151 - DNA, 77 bp, Homo sapiens
tatgtgaattctcagaaggcaagggctgggggtaatactgcttttaatgaaagtctgctcttatgagttttcagatg

SEQ ID NO: 6861152 - DNA, 57 bp, Homo sapiens
tcccttaaaactcatgtgttgtttacaaatatactaatgatatgagagtgggaggga

SEQ ID NO: 6861153 - DNA, 83 bp, Homo sapiens
gttgtctaagtggagggctaagctgagggataggtgccttcttgcctcctcctgagctctggcctttccagagctaagacagc

SEQ ID NO: 6861154 - DNA, 62 bp, Homo sapiens
gggtccagactatgaagaactttctaggttacaatggggagttttggatttattctgggctc

SEQ ID NO: 6861155 - DNA, 102 bp, Homo sapiens
gccatcagtgacacaggcaggaaaacaatgagccaggtggtagcataaactttggaatgagactgctttggcacagtgtttactagctgtgtgaccttgggc

SEQ ID NO: 6861156 - DNA, 66 bp, Homo sapiens
tctgtattttccccaggagcaatgattcagtatttgctaagtcagcatttgtggtgactttataga

SEQ ID NO: 6861157 - DNA, 59 bp, Homo sapiens
cagagcagaagcggtcctcacagcacccattctctgcttgagctcccgcttcttctttg

SEQ ID NO: 6861158 - DNA, 78 bp, Homo sapiens
cactggcttaaacgaatagggatttttctaacaaaataaaagttttggagaaggaggattgttggtgatggctcagtg

SEQ ID NO: 6861159 - DNA, 56 bp, Homo sapiens
tagtgcattcatctgatcctgtgcttgctgtgatggtgaaggaggatgatgtattg

SEQ ID NO: 6861160 - DNA, 80 bp, Homo sapiens
tctggcggcaccatcttggcatttacactctacagaaaaggtacctgaggagaaagatggtccaagttacttgccacaga

SEQ ID NO: 6861161 - DNA, 72 bp, Homo sapiens
tggcagctctgggggaggcctggcctccaggagatgctcctccctgaggctggcccttccatcccgcagcca

SEQ ID NO: 6861162 - DNA, 80 bp, Homo sapiens
ggctggacagtggtgggtgggggtcaagctggaaggttccatggggctttcaaactccagctcaccaatcaagtggggct

SEQ ID NO: 6861163 - DNA, 69 bp, Homo sapiens
ctctgtattcctgagaaggaactattctcaaggacctgagtccaagttcatcttacttagagtacagag

SEQ ID NO: 6861164 - DNA, 74 bp, Homo sapiens
gcatggaaaatcattatttacagttctgaacagctttcatactgtcatcattctgtaacgtaaggtgtttctgc

SEQ ID NO: 6861165 - DNA, 57 bp, Homo sapiens
gacagtagtaaagctaggaccagaactcaggctgttttatacctgcaagctgctgtc

SEQ ID NO: 6861166 - DNA, 80 bp, Homo sapiens
gggccagggtgtagggattccagatggaagcaaaagacacactcaccatctggataggaacctctgcttgacccaggccc

SEQ ID NO: 6861167 - DNA, 75 bp, Homo sapiens
gctctcttaggactttttctcagtaagccctgataccttgatgtgagaaggccaagaagaagcctatagagatgc

SEQ ID NO: 6861168 - DNA, 67 bp, Homo sapiens
gttgccttcaatcaggatggtctcatcccagcagttcatctgatgtgactgtctcatttgaagtgat

SEQ ID NO: 6861169 - DNA, 59 bp, Homo sapiens
gcccttgggaggttccactggggcaaaagccagagttttgtggaatgttccaaggaggc

SEQ ID NO: 6861170 - DNA, 80 bp, Homo sapiens
gctggttctggccaggatggcaagaccagtggtctctcagaggtcatgtggctttcttttcttcctggccatagactggc

SEQ ID NO: 6861171 - DNA, 97 bp, Homo sapiens
gaagtgttcaataaaaaacagttgttattggaactgattgatgataatgatgattaaaattatttccttgcaagtttctgtaacaacttggcacttt

SEQ ID NO: 6861172 - DNA, 73 bp, Homo sapiens
gggagatgatattgaggattgaggaaagcacaccgccaggaagggtgttccctctgccatcaaattctcaccc

SEQ ID NO: 6861173 - DNA, 112 bp, Homo sapiens
tctgtgatgtaggggggtgtgtgtgtctgtgtatgtgtacatatatataagtatatacatgtgggtctaaacatattatacagctataaatatatattgtccttcttataga

SEQ ID NO: 6861174 - DNA, 55 bp, Homo sapiens
cttgcgggcctcagccgtgccgctccacacgaagcactggtagatggcccgcagg

SEQ ID NO: 6861175 - DNA, 99 bp, Homo sapiens
gggcccagagagtttttgctccatcagccaggcctttgggcatctaacgccctgcctggagcattctgaaggtggcagaggcccctggtctcagggccc

SEQ ID NO: 6861176 - DNA, 82 bp, Homo sapiens
gagttcatttatatgtgtttgtgtgtgtatttcataataaatttcatatctcaggtatacttgcagacatttatatatactt

SEQ ID NO: 6861177 - DNA, 76 bp, Homo sapiens
gtggatgttggatgaccttgtaattataatttttaggtgtgataatagcattaggtttatgcagcaaaatatccat

SEQ ID NO: 6861178 - DNA, 67 bp, Homo sapiens
gaggcttgatgcatgaggcagcctatgttattgaccccaactatgggccagcaccatgttaagcacc

SEQ ID NO: 6861179 - DNA, 86 bp, Homo sapiens
ccacctctctgcaccccagcactctgactcttacctgctcgggggagaagtggtgggatggaggctggatctgcagagcaaggtgg

SEQ ID NO: 6861180 - DNA, 101 bp, Homo sapiens
acaacatggatgaaccttgaagacatatgctaagtgaaataagtcagatacagaaggacaaatactgtgtgattccactcatatgaggttcctagagttgt

SEQ ID NO: 6861181 - DNA, 95 bp, Homo sapiens
acatccacaaattccccaccccatattccagtccactctctcctttcccagtagctgagctctgtgaatgtggggagggagatccttctgattgt

SEQ ID NO: 6861182 - DNA, 69 bp, Homo sapiens
caacgatcctctactgacctccgggcttaatgcttcgagttcgtctccaaggtcagtagaatgattttg

SEQ ID NO: 6861183 - DNA, 63 bp, Homo sapiens
agggcattggcacagatctgctttcaccctgagtctctctaggtgtctctgtgtccatgcctt

SEQ ID NO: 6861184 - DNA, 57 bp, Homo sapiens
tgtgttacattaggaaaactaagtatctttaacttagagtttccttgtatgaacata

SEQ ID NO: 6861185 - DNA, 76 bp, Homo sapiens
aggagagggcctagaagctccatatgcaggaccctcccagatattgccctgtatgtgtctttatctggctcttcct

SEQ ID NO: 6861186 - DNA, 74 bp, Homo sapiens
ggactaggttgaacctgcataagatttcatgtgacggagttgtgtcaagatgaaagatgtagccattctggtcc

SEQ ID NO: 6861187 - DNA, 78 bp, Homo sapiens
acatgagcaggacgtagggagttaatacgtgaagctccttccctgatagcaccagctccccacgtctctgtcttttgt

SEQ ID NO: 6861188 - DNA, 59 bp, Homo sapiens
ggctgtagttgatgatttctgatattctaaagagtgttaagatgcattacctgcaagcc

SEQ ID NO: 6861189 - DNA, 103 bp, Homo sapiens
tgaggtggagtctcactctatcacccaggctggagtgcagtggcacaatctcagctaactgcagcctcctccacctctgggttcaagtgatcctcccacctca

SEQ ID NO: 6861190 - DNA, 68 bp, Homo sapiens
tagaggtagtaacattttgccatctggcaaagccactagaccagatggattcattaatgacttctcta

SEQ ID NO: 6861191 - DNA, 73 bp, Homo sapiens
gtatacaactattgttgggtaaggttagattctaagtaattttcatgaataaaaaccccacaatgttgtatac

SEQ ID NO: 6861192 - DNA, 58 bp, Homo sapiens
ccgtccactgtgtgatacttagttatggcagccctagcaaactcatacatgtgggtgg

SEQ ID NO: 6861193 - DNA, 81 bp, Homo sapiens
gcctggcaagagcagctcacacctcatcagggtggggccagtaggtgccccaggaattttggtgtctgctgctgccatggc

SEQ ID NO: 6861194 - DNA, 87 bp, Homo sapiens
acggggaagtgaccacatactttctttttcacgcataggatttgtttatctatgttgagttttagaaagttaacatcatttgtttgt

SEQ ID NO: 6861195 - DNA, 110 bp, Homo sapiens
aaatgtttatttgcaaatagtgtttggtaaagttgattggtgctctgtgttaatacagctagattgtattgtattaattttactagcaaacattttgtgatagagccttt

SEQ ID NO: 6861196 - DNA, 59 bp, Homo sapiens
tgggtgcaggaaaattacctggagtactggcaggtgcccagaagtgatcctgcatgcta

SEQ ID NO: 6861197 - DNA, 70 bp, Homo sapiens
agcaccaggcaccaaagggcctccgtcaaagcttacgacccagaggcctgaccgtggtgactctgctgct

SEQ ID NO: 6861198 - DNA, 56 bp, Homo sapiens
gctgtagatcactttctgttgctgcaacccaacagtaacagcagggaaatacgtgc

SEQ ID NO: 6861199 - DNA, 61 bp, Homo sapiens
gcagtgctggagggaggcaggttcagaattgaccttagagctacctccctgccagcaatgc

SEQ ID NO: 6861200 - DNA, 81 bp, Homo sapiens
gttgaagattaaagtcagcttggaacttcataaagaataccaaagtgtctttatgtttactccagctgagctatttttaac

SEQ ID NO: 6861201 - DNA, 73 bp, Homo sapiens
ttgttccacaaatatttcttgagcacctggtatttgcccagcactgtgctaggtgctaggaagataggaataa

SEQ ID NO: 6861202 - DNA, 102 bp, Homo sapiens
agtaggggtaaattctgtgtgctgttagggagctgccctgacaacccaggctgtagctagactccagacaagaccacatcctgccagaattcttcccttgct

SEQ ID NO: 6861203 - DNA, 65 bp, Homo sapiens
cttgcatttgtttgggctaatcttaaggtgcacagtaaccctaaagtggcccagcaagtgattag

SEQ ID NO: 6861204 - DNA, 95 bp, Homo sapiens
ttcctagctgagatatctaggtggctcaggcctgctttgaacagtctaactttttcaaagtaaacgctttgggccacgggacactcagctaagaa

SEQ ID NO: 6861205 - DNA, 79 bp, Homo sapiens
gtgatggcttttaggcttttaagagaaaggcatatcttcacctttaaattcccatgcttaaaagcttgaattccaccat

SEQ ID NO: 6861206 - DNA, 88 bp, Homo sapiens
ggcagcagagtgattcatattagagcagaagaggggatcagggctgcagaaagacaagatcccctccctgtgtgcctcatttgctgcc

SEQ ID NO: 6861207 - DNA, 129 bp, Homo sapiens
cccagatgtcagatgatgagtgtgattgttttagtggctcagacatgccctgtgagagttattatgactgtacagcagacaaacagaaacaggctgctgagccatttgctgggtcatccttgtcctggg

SEQ ID NO: 6861208 - DNA, 88 bp, Homo sapiens
tgtattagggtgggagtgtcccgattttccaggtactgtctgtcacagtttcccttagctaggaaagggaattccccaaccccttgca

SEQ ID NO: 6861209 - DNA, 100 bp, Homo sapiens
ctgcttttcatcctcaatacattggtttcaaggacactgagctttgtaaagtcccttcactttactgggcctcagtgttctcatctgtgagaggaagcag

SEQ ID NO: 6861210 - DNA, 75 bp, Homo sapiens
gggatttggtttggattgcgtttcttaataagcatggtggctgttgtgcagagtgcaatgtagacatcagggacc

SEQ ID NO: 6861211 - DNA, 58 bp, Homo sapiens
agccagttgtggggctagccctggggctcttctcccggggctgccaaatacgatggct

SEQ ID NO: 6861212 - DNA, 72 bp, Homo sapiens
ggtgtcagactttgcatatcctcttgctggcataatccagaatatggctgaggaatgacagatgtccgcacc

SEQ ID NO: 6861213 - DNA, 88 bp, Homo sapiens
ggagagcagaaagttatgtcttgcacaggtgtcactgaaacattcacctttaatgcctaagaatatgctctttcataaactgctctcc

SEQ ID NO: 6861214 - DNA, 112 bp, Homo sapiens
gaagaaatgagagctcacatctggccccattttctgcatggagaaactgagtcctgtgggggctgctcaggctcatgcgaacttgagggtaagtgagagcttagctttcttc

SEQ ID NO: 6861215 - DNA, 99 bp, Homo sapiens
gtggagggattaggaaaaggtcattttttcctctgttggtgagaatgttgtcagctgcaggaacaaaaatgtgtcgtcttacctaataaaactttctac

SEQ ID NO: 6861216 - DNA, 56 bp, Homo sapiens
ggaggccgggggaaagtctaagcgagcgtcgtgcccgggactgttgccaggcctct

SEQ ID NO: 6861217 - DNA, 58 bp, Homo sapiens
gctttgaagacagatcaatataagcctaaggtcttcatgttaagtctgttatcagtgc

SEQ ID NO: 6861218 - DNA, 55 bp, Homo sapiens
agtgtagtagaggctttagagtctgaaagacctgggttcaaagtctggctccact

SEQ ID NO: 6861219 - DNA, 58 bp, Homo sapiens
ttgtttggaacttggtgccaccctgccatcgtagctggcttgctaatgttccaaataa

SEQ ID NO: 6861220 - DNA, 60 bp, Homo sapiens
taggtttgtgctcagaggagggactgcacccaaagcagggcctccactgtcactgacctg

SEQ ID NO: 6861221 - DNA, 75 bp, Homo sapiens
tcagacatgtgtaagatgtgatatatgtagaattacttttatggaaatagtatacagatacttagacgtgcctgg

SEQ ID NO: 6861222 - DNA, 67 bp, Homo sapiens
ttgggaaacagtatagctaacaaacagattggctttggagtcagtgggcaagctgtgctgttactaa

SEQ ID NO: 6861223 - DNA, 75 bp, Homo sapiens
tgctggattgtgaatggattatttttgtatgtgtcaaatatgtagcattcaaacattaatttattcatccatgca

SEQ ID NO: 6861224 - DNA, 80 bp, Homo sapiens
tgattccggtgttgtttgcttcagccaaactcctctgtctccattggagtagtcagcagataatataggttgaataatca

SEQ ID NO: 6861225 - DNA, 56 bp, Homo sapiens
attggacaggctatataatttaataattgggattaggctgtgtagcagtgtgcagt

SEQ ID NO: 6861226 - DNA, 126 bp, Homo sapiens
atttactatgtactggccactcatctggcccactcagagctgagtggcttcagcaataagcaagtcattgctgtttgccaagatcactttcaggagagtggggatagaagccaggtttcaatggat

SEQ ID NO: 6861227 - DNA, 65 bp, Homo sapiens
tctctgaggaagaggctgtaatttgcatgcttaatctcatgtctattccacttttccttcaggga

SEQ ID NO: 6861228 - DNA, 57 bp, Homo sapiens
tggagataataatagtacctatctcatcagatgtaggtttttctgttattatgttca

SEQ ID NO: 6861229 - DNA, 58 bp, Homo sapiens
gagtccagacaccatacctgatgcatcccattctattcagattatggatgtctgattc

SEQ ID NO: 6861230 - DNA, 66 bp, Homo sapiens
ttaccaattttgcagcttctggtggcctctgatatgaattagaggcaactgatttctgccaggtaa

SEQ ID NO: 6861231 - DNA, 63 bp, Homo sapiens
tgtctacaaagtccgcagtcattgggatactaatcccatgataactgggatttagagtggtca

SEQ ID NO: 6861232 - DNA, 97 bp, Homo sapiens
ggaagtcagagaggtccgagcctgagctagggctggtgaggagcgtgctcagatctgctccccgacagccaggctctcctcgtacagctcacgctcc

SEQ ID NO: 6861233 - DNA, 64 bp, Homo sapiens
gccaggagattggcagatgactcaagagcctaaaacttgttttattctgcaatttccctgtggc

SEQ ID NO: 6861234 - DNA, 65 bp, Homo sapiens
tggtggctgccaaaagcactgaagtattagaccacacctcaaagctttctgtgcagtgaacacta

SEQ ID NO: 6861235 - DNA, 59 bp, Homo sapiens
cagacaggaattctggcgtggtctacgtttctccagcgccccgctggaaatcttttttg

SEQ ID NO: 6861236 - DNA, 88 bp, Homo sapiens
ggagaatcgctcgaacctgagaggtggatgttgtagtgagccgagatggcgccactgcacttcagcctgggcgacagagcgagactcc

SEQ ID NO: 6861237 - DNA, 116 bp, Homo sapiens
gccatgggctcaggagttgtttcagttctgagtgatgcttctatggaaccacctgccacagaggatgtgttcagctcaccagaatgggaaataatgacaatgacgggctcataggc

SEQ ID NO: 6861238 - DNA, 121 bp, Homo sapiens
ctggaactcaagtcttctcatatatcatgtccttgcacatcctattcagttcggtcgggttcatgcagctctacagacagagcaggtgggatagcaggagggttaagagcaactgttccag

SEQ ID NO: 6861239 - DNA, 56 bp, Homo sapiens
caggcttgaccagtttctagacttccttagatgtcagtgtagcaggtgcaagcctg

SEQ ID NO: 6861240 - DNA, 128 bp, Homo sapiens
caggcatgaaggccaaggcccctccgtgctggctgcattaaccagcttgtcgggcctcagctcccaggcccagagtttgggaccgggccaggcaggctcagagcaggccaggcattggcagatgcctg

SEQ ID NO: 6861241 - DNA, 61 bp, Homo sapiens
tcactattatcctgttaaattgctctacagctgccatgggagtaattgcggtgattagtga

SEQ ID NO: 6861242 - DNA, 130 bp, Homo sapiens
gaagctgtgtttcctgagctggagccagagaatcggtctgggatccctgagggccggttgtttttaccatagatgacaagtacaggggcctgtcctggcttctgctggtaccagcttgcataatagcttc

SEQ ID NO: 6861243 - DNA, 68 bp, Homo sapiens
gtttggcccagggtcagcggcgctccctgcaggccggtggggatggcctgagagaattctgggccagc

SEQ ID NO: 6861244 - DNA, 86 bp, Homo sapiens
cttccctcctcccctccagagcctggacattctggaaaagtgtcttcctttaagaatggtcattctggcaggacaggaaaggggag

SEQ ID NO: 6861245 - DNA, 78 bp, Homo sapiens
caggcacagtgatgagccggctgaggctgtgggatcgtttattggggctctgtccagccaggctgcagcacccgcctg

SEQ ID NO: 6861246 - DNA, 65 bp, Homo sapiens
gtgcaatgtctgtgatatgaaatgcagtcttacatgcacactatgttactcacatgttcttgcac

SEQ ID NO: 6861247 - DNA, 88 bp, Homo sapiens
gctaaggatattgataacttttaaaacttgtgaaaaatttggtattttacatgaagaaaattaagcagttgtaaatgtctgtaatagc

SEQ ID NO: 6861248 - DNA, 122 bp, Homo sapiens
ctcactagctatgtggcctcagcaaatgattccactaccagtgctctgttctaacctctgtgaaatggggatcacaagagtgtcagccccagagtatgtggagggctatgtgagctggtgag

SEQ ID NO: 6861249 - DNA, 60 bp, Homo sapiens
caggtgatctcctggttgtgatgcttgtaaatcaaagttgcaaagggcaaaggtcatgtg

SEQ ID NO: 6861250 - DNA, 62 bp, Homo sapiens
gggctcccagcctggtggacagaaggacaaggaagccgacttgtgccagggatggggagccc

SEQ ID NO: 6861251 - DNA, 85 bp, Homo sapiens
cggagggctcccttccatgcagagaactgaagtacatctcacagagaagcctttgagctcagttactgcatagaatgaacctccg

SEQ ID NO: 6861252 - DNA, 76 bp, Homo sapiens
tctatctcctgtctactgtaaagcagatgtctgcaaactccttcagtatttgctcatacagtgatactgggacaga

SEQ ID NO: 6861253 - DNA, 67 bp, Homo sapiens
ataattcatgggcctttcaccttggtgaaatttccacaagttcactgatgtaggcctattgagctat

SEQ ID NO: 6861254 - DNA, 58 bp, Homo sapiens
atccatggaggacaagagcaataaagtatcatctttgtgtctctctgcatccagggat

SEQ ID NO: 6861255 - DNA, 68 bp, Homo sapiens
ttcaccattctaagacattggttccaatctttgtttttggattcaagtttcctttggaatctggtgaa

SEQ ID NO: 6861256 - DNA, 113 bp, Homo sapiens
ggcctggccctgggcggccgcgcaggatctggggccgtccgcgggctgcagcccggttcgggagcctcgtggcggccactgcgcctgcctgcagcggctcgcggggccgggcc

SEQ ID NO: 6861257 - DNA, 83 bp, Homo sapiens
gggctgagtcaatgttgctctcaccagtcattcctcaaatatttatggagttcctactgatgtgacagctgagcagaccgccc

SEQ ID NO: 6861258 - DNA, 58 bp, Homo sapiens
aaagtgatttagtcttataaaggggatcatttcacgacctcaaagtctgagtcacttt

SEQ ID NO: 6861259 - DNA, 81 bp, Homo sapiens
gaggcagaaaaatcgcttgaacccaggaagtggaggttgcattgcactccagactgggcaacaagagcgagactccgtctc

SEQ ID NO: 6861260 - DNA, 83 bp, Homo sapiens
aggcatcttgttccggtagagacatgttggttggggacactcctagcccactgttttcatttctctgtggagcacccctgcct

SEQ ID NO: 6861261 - DNA, 56 bp, Homo sapiens
tgcaagtagagttcacttgtctttgtcttgaaagcaaagatttcttttctcttgca

SEQ ID NO: 6861262 - DNA, 80 bp, Homo sapiens
catggcttttttcttgggcactcttttgctgtctctgagtgaagccagctgtcatgagctgcccagtggagagggccatg

SEQ ID NO: 6861263 - DNA, 70 bp, Homo sapiens
tatattggcgcactgcctctgttgttttccttttcgcagaatacaattagtgatcagtgatgcctttata

SEQ ID NO: 6861264 - DNA, 70 bp, Homo sapiens
gctcacacatttattacatgcatgtgtcgcctatcctcccatagatatatgtagtgcggtgaatgagagc

SEQ ID NO: 6861265 - DNA, 56 bp, Homo sapiens
gttgatgcattgccgacttactgggatcttcagtggaggttcccaatgcagacaac

SEQ ID NO: 6861266 - DNA, 61 bp, Homo sapiens
cagggaatccatggtcataaggtactttttatcatgtggaacacttaacttgggtttcctg

SEQ ID NO: 6861267 - DNA, 55 bp, Homo sapiens
ggactgaaggcattccttggaacactctttccttttgaatttatctcttcagtcc

SEQ ID NO: 6861268 - DNA, 85 bp, Homo sapiens
caagtgagaggtgacattgagaacacagctaaattgacacagtgccaggtattgttctaagtgttttgttcatgtcacttaattg

SEQ ID NO: 6861269 - DNA, 62 bp, Homo sapiens
tcttttcgtgtctcaggggcattgaaataaaaattatttcattatttcttgagcaaaaagga

SEQ ID NO: 6861270 - DNA, 73 bp, Homo sapiens
cttcatttgataaacgtgaactgtttttggagatttttaaagaataccctccagtagtcatgatcaaatgagg

SEQ ID NO: 6861271 - DNA, 58 bp, Homo sapiens
tggctgagagaaaaggcccaggaatcatccttgacttctctctgccaactcacagcca

SEQ ID NO: 6861272 - DNA, 65 bp, Homo sapiens
tacattgaattttttagcatgtaagtatcttcaataaaattgcatgcaattaaaaggtaagtgta

SEQ ID NO: 6861273 - DNA, 70 bp, Homo sapiens
acatattcctgtttttaacactttggcagcaaataagacaagattactaaatgtgttataggagttatgt

SEQ ID NO: 6861274 - DNA, 69 bp, Homo sapiens
tgaagaccagtgcatggcgtttgctaggagtttatatcatgttcttacgtatgtgtgtagctgtcttta

SEQ ID NO: 6861275 - DNA, 86 bp, Homo sapiens
ctttgttttgttttccttccactttagcgggaaccacatcttcaagggccgtgctgccggcatagcagtgaatgagaacggcaaag

SEQ ID NO: 6861276 - DNA, 64 bp, Homo sapiens
cagttctttgtggggagttctcagtccatgtcaaggagacgtggctcccctctacagagggctg

SEQ ID NO: 6861277 - DNA, 72 bp, Homo sapiens
tgttgaggcagctgggatacaagggatactttggccatttatcccttctctttccctctgtctctaatgaca

SEQ ID NO: 6861278 - DNA, 65 bp, Homo sapiens
gggcgcggcggcgcgggccccgccgaggggggacacctggctgaggcacagctgccgccgtgcct

SEQ ID NO: 6861279 - DNA, 76 bp, Homo sapiens
ggggagaaatagtcagtctgattaagggcaatctttaccaatctttaatccaatatcctggctatttactcttccc

SEQ ID NO: 6861280 - DNA, 83 bp, Homo sapiens
gcttgatgttgtaaaaagtacactacgtggagttagaaaccctcagtgtctaaccttgtggtctgctggtgctgttcttaggc

SEQ ID NO: 6861281 - DNA, 103 bp, Homo sapiens
ccaggttctgcatccaggccctagactccttgcctaatcccagctccccgcgaagatgcagccagcaggaacgtctaggttttgcagctaccaaccaaccagg

SEQ ID NO: 6861282 - DNA, 55 bp, Homo sapiens
tgaaggagatttttagggaggcctggtggctgtgggacttcccatatcttcttca

SEQ ID NO: 6861283 - DNA, 59 bp, Homo sapiens
gcttcagggttatgcaagagtgagaaacaaatgagaccacatcagctgagccttgaagt

SEQ ID NO: 6861284 - DNA, 89 bp, Homo sapiens
gtgtctacccttcatgtagcgttccatagagatctatgaaaatgtcggtctggaagaactagggatgttgacatatttgggtcagatac

SEQ ID NO: 6861285 - DNA, 111 bp, Homo sapiens
ttaaaagatttagtatcataggtatttgagttggggttttattttggtaattttatcactgtagtagaccaaacatttaaaaccattattttaatgccttaaattttttaa

SEQ ID NO: 6861286 - DNA, 91 bp, Homo sapiens
gcagctgtgcagaagccatgcttcctggccctgccagagatcaacagtaggccttgttgaactcctggagggcccaccgcttctcagttgc

SEQ ID NO: 6861287 - DNA, 55 bp, Homo sapiens
atccttactgaatgcgtattgtatgttaatgactgttgagcaatcagtaaaggat

SEQ ID NO: 6861288 - DNA, 85 bp, Homo sapiens
gacgtttttcatcacttcacacttttgcagtgtttgctacaatcaagacactgtgcttagatgctgaacgtgatgcaaaggagtt

SEQ ID NO: 6861289 - DNA, 84 bp, Homo sapiens
ctattaggttgtgaaaagcaattgcagttcttgccatcactttcaatggcaagaaccacaattacttttgcaccagcctaatag

SEQ ID NO: 6861290 - DNA, 68 bp, Homo sapiens
gccttcccaggaaggatcgtttgggagtcttctacaccttagattccccatgagatcttttcaaaggc

SEQ ID NO: 6861291 - DNA, 91 bp, Homo sapiens
cctgatggtgctcacagggccagcagcttggccaaccttggggagctgtgccagaggctggactttctgctgggctccgtggtccatgagg

SEQ ID NO: 6861292 - DNA, 74 bp, Homo sapiens
tgcagtcacagtgacaggatgtggttctcatcttggccaagaacaacagctccatattctgccattgcattgca

SEQ ID NO: 6861293 - DNA, 72 bp, Homo sapiens
atctctttcaggcccatatttttcaaatccatcattattcaattgaagattttgatgttcctgaggagaggt

SEQ ID NO: 6861294 - DNA, 78 bp, Homo sapiens
ctttttcagctctaagttttatgcaaactttattaaacagatcaaatatttttgatgaaaattttgggctgaattgag

SEQ ID NO: 6861295 - DNA, 92 bp, Homo sapiens
ataacatactgtcttcaaagccataatgttaatcttgactccagtagtctgggatggttagaaacattgatcgttcaagatatgtatgttgt

SEQ ID NO: 6861296 - DNA, 122 bp, Homo sapiens
ggtggctcctgggcacccacaggcctgtgcccccttcagagcttgcttgccatgtcaccagagaagaggaagctggcggctcaggaggggcagttcacagagccacgtcctgaggagccacc

SEQ ID NO: 6861297 - DNA, 55 bp, Homo sapiens
gtttttctaaagttggtgacagtttccgtaaggaaatacacattcatagaaaaat

SEQ ID NO: 6861298 - DNA, 59 bp, Homo sapiens
gtgctgagtgcggccgaattctacactgtaaatgtgctgagtgtggccgaattctacac

SEQ ID NO: 6861299 - DNA, 77 bp, Homo sapiens
ggtgaggaactttttctttccaaaggtggcaggaacaagtctgtactgacttttctcccgccttcgggatcctctct

SEQ ID NO: 6861300 - DNA, 57 bp, Homo sapiens
gacagggaggagcagagcttctgagtcacacagtctgctgagctctgcctcccagtc

SEQ ID NO: 6861301 - DNA, 98 bp, Homo sapiens
gttttgcctcttaaattcatgtatttcttggcgtcttgcttagagtcacctttttgacacatgagtcctgccaggtatgtgggttagtgagtctgtac

SEQ ID NO: 6861302 - DNA, 70 bp, Homo sapiens
aaggtctccatccttgtcatcttcatgttcagcaggctgaggagcaggaagaagaggaggtgttggtctt

SEQ ID NO: 6861303 - DNA, 72 bp, Homo sapiens
agtgcaggggctctaatgcatgatcacttaaggaccaccacaaatggtatttgtcattcgagttctgctact

SEQ ID NO: 6861304 - DNA, 98 bp, Homo sapiens
gggtgggatttgatctccaccttctgctccctggccagggccccctgcttcccagggccttggttggccagcaggtcccggggcatcaatcaccgtcc

SEQ ID NO: 6861305 - DNA, 81 bp, Homo sapiens
tgtgtttcttgcactccccggactgtggcgaaatggcgtgctttgtgtgtctgtggttggggggaagtgggggaaatgaca

SEQ ID NO: 6861306 - DNA, 57 bp, Homo sapiens
ttggtcagctaataaggacaggtagacttgctcctaactgcttagcttccaggccaa

SEQ ID NO: 6861307 - DNA, 60 bp, Homo sapiens
gtctcagccagaggctgcgaggggcccaacaggccgccaaaggtgcttctggccagagat

SEQ ID NO: 6861308 - DNA, 59 bp, Homo sapiens
agagataattaggttaaatgaggccatgagtggcctcatccaatatgactgttatctct

SEQ ID NO: 6861309 - DNA, 77 bp, Homo sapiens
actttcattgcctttggaaggtcttagtcagcatcttgcctctgctcaaagactcaaaccaagagtgcgatgagggt

SEQ ID NO: 6861310 - DNA, 57 bp, Homo sapiens
ggggcaccctgaggctgaggataggtgggtctgctcaccccgtaagcccagggcccc

SEQ ID NO: 6861311 - DNA, 75 bp, Homo sapiens
aagccaaggttctgggagtttgggtcggctgatgatacttagaagatctttgcaattccgtttattaacctgctt

SEQ ID NO: 6861312 - DNA, 55 bp, Homo sapiens
tttcccagttccctgctctataccaggtcatcctgctaagcgctgagatgggaga

SEQ ID NO: 6861313 - DNA, 77 bp, Homo sapiens
attatgctcatagatgaagcttgcttccaaataaagaacatcctagagaaatgggacaggctgcatctgagcatgat

SEQ ID NO: 6861314 - DNA, 57 bp, Homo sapiens
gtgggtaaattcaaaatcagatgaatcattatcttttttgtcacctgatttgcccac

SEQ ID NO: 6861315 - DNA, 79 bp, Homo sapiens
tacggagcatatgacctacaacctagcatgattggttcccacttgtcataggcatggatgtgggttcagatgctgtgta

SEQ ID NO: 6861316 - DNA, 91 bp, Homo sapiens
gctgttatgtagatgaagtgtaacttgtaatgagtgtttctggaaaacaaaacattcaaaacccagttcagtcacctgcagaactttcagc

SEQ ID NO: 6861317 - DNA, 76 bp, Homo sapiens
tcttttcattttcacattctcagcatctatacagttttcatcacttagtagattctgagtatgtgtttgctggaga

SEQ ID NO: 6861318 - DNA, 55 bp, Homo sapiens
atttttcctgggtgctttagtttttccatttgtactaaagtacccctggaagaat

SEQ ID NO: 6861319 - DNA, 68 bp, Homo sapiens
tacaaagctgggctggccaacccaggtcctcgagaggggaggttgggtgtccccggccgagtttggta

SEQ ID NO: 6861320 - DNA, 94 bp, Homo sapiens
gtgaggaggaaactgccaggccttgttagttgagggaccgatgtccctgcgattgccatggcaacggtctggcttatcatacttccgctctcac

SEQ ID NO: 6861321 - DNA, 130 bp, Homo sapiens
cacttggaacaatcactacagcagaggaataaagccaacactgaagccgttaaaccttgcatcgtttcttgtgtgttgactcttggacttcaagggtgtatggtacttctcagctgaatcagtcagggtg

SEQ ID NO: 6861322 - DNA, 100 bp, Homo sapiens
gttttgtacctgctggttaagtatggtcctgaggctccgtatttcacatactagagatcagaggtaaggagtcccaaccatccgagccatggtacagaat

SEQ ID NO: 6861323 - DNA, 59 bp, Homo sapiens
atctgctgtcacatgtttgaagcatgaatatatccttccaagaaacaagtgatgcagat

SEQ ID NO: 6861324 - DNA, 56 bp, Homo sapiens
ggagtgaatactgtatctcaggacagatgactctgtcccatgtgacagtgtcaccc

SEQ ID NO: 6861325 - DNA, 57 bp, Homo sapiens
tagtgcctcggagacaagcagcttctgggtgagcgctaggcagtcctgacggtacta

SEQ ID NO: 6861326 - DNA, 72 bp, Homo sapiens
aagagaattgacctgttcttgtggctctggtcagattgagaccagcagttatgaggccaggactagtctttt

SEQ ID NO: 6861327 - DNA, 129 bp, Homo sapiens
ggcagagggcatattaggcactcgacttgtttttcacagtgatgacgtgggagcacacataagaaggctgtgtgcttgttgttctcagttgtggaaatagatttgtgatcacctctctaagcccctcct

SEQ ID NO: 6861328 - DNA, 80 bp, Homo sapiens
tgttatgggaaatggcaagttctaatgattagaatagcgttttactttaattaatgaactgtggcaggaagcccaaggca

SEQ ID NO: 6861329 - DNA, 77 bp, Homo sapiens
gagccctcagcccggttcccggctggccttggcccacacggtctggccctggctggagcccaggctacactcggctc

SEQ ID NO: 6861330 - DNA, 83 bp, Homo sapiens
gaggtagaagtctatttgctgtccgagcaacaggtgttccgaaggttccctcttgctctggcaagtaaagattttgtttcctc

SEQ ID NO: 6861331 - DNA, 80 bp, Homo sapiens
gagcactagaccaagaatcagacctgtcagggttaactggttgtttgatccaagcaaattgtctgacatctctgggcctc

SEQ ID NO: 6861332 - DNA, 129 bp, Homo sapiens
atggaaatttctgttccaaaggtgaagtctctcatggctgacagcactggatcgcattaacaaggaaaccagccctgctctctggctgtgggatcagacacaaaatctaaggaacagtttgacttcaat

SEQ ID NO: 6861333 - DNA, 79 bp, Homo sapiens
cggatagcgcaattgatttgctctttgctttttacttgggagacatgcccagctgaacatgtagagcatctcaggtctg

SEQ ID NO: 6861334 - DNA, 55 bp, Homo sapiens
ggaggccaaggaggagcttgccaagaagtgtggcatcaccgtgtctcaggtctcc

SEQ ID NO: 6861335 - DNA, 58 bp, Homo sapiens
tgttctaaatttgcatggtccaatatggtagccaccagcgacacaaggatttagggca

SEQ ID NO: 6861336 - DNA, 63 bp, Homo sapiens
gtagtgtagtggatcaaagcacaggttttggagttgagacctgaattttaatccttgctctat

SEQ ID NO: 6861337 - DNA, 63 bp, Homo sapiens
cccgccgcctcaagccagcagttctggaaaatgagtgaatgcagactgcctgcaggtgttggg

SEQ ID NO: 6861338 - DNA, 63 bp, Homo sapiens
gatgatatacaaactccgaagtttgtaccttcatcaaggtaagacttaggagttttagacatc

SEQ ID NO: 6861339 - DNA, 78 bp, Homo sapiens
atgcttcctaaatgattcagaaatttcaagctttcataggtaagcctgtgaatagagttctgtgattatttgggacat

SEQ ID NO: 6861340 - DNA, 82 bp, Homo sapiens
gcctggccctaggtcttccagccctagactctatgctgtcacgcttcagcagggtctcctgagagaagatgctgggggcagc

SEQ ID NO: 6861341 - DNA, 57 bp, Homo sapiens
ttcttcagatggtgagacctcccttctgtggacagtcattcaccaaatctgtaagaa

SEQ ID NO: 6861342 - DNA, 60 bp, Homo sapiens
gtctttggcttgtctcctcagttgcttacaaagttgtatctgggagtcaatctcaaatgc

SEQ ID NO: 6861343 - DNA, 59 bp, Homo sapiens
gctcttggtctcagcctctgaaatagctgcctgctgactcatagtgtaaacacaggggt

SEQ ID NO: 6861344 - DNA, 57 bp, Homo sapiens
ggcccaggtccagcgagtacctggaaacccaggcacactgtgtcctggagctgggcc

SEQ ID NO: 6861345 - DNA, 64 bp, Homo sapiens
agtctggagtgttttgtagcaatcctgggatattgtattcttttgcttgcagaactttcaggct

SEQ ID NO: 6861346 - DNA, 86 bp, Homo sapiens
tggcttgtctcccactctggaccgtcagccggcctcgcggagacccgaggggctggcacgatggctgcagcggcggcggcaaccca

SEQ ID NO: 6861347 - DNA, 79 bp, Homo sapiens
gctgcaaaagagactggtgcaaacacaatgaagacggctgtgcttacttagccattcacttttgccctgtccttgtagc

SEQ ID NO: 6861348 - DNA, 59 bp, Homo sapiens
ggtttattgaaggccaccccacaaccatcacacaacgtgggagcctctgtcgatgaact

SEQ ID NO: 6861349 - DNA, 78 bp, Homo sapiens
ctgtgctcagccatgtcatgcctacctgtattgtcccagtggcactgcgagaggagccagggcgtcggctcggcacag

SEQ ID NO: 6861350 - DNA, 125 bp, Homo sapiens
gagtttaaaagtgaggggctgaacagggctgaagggaggtgctcattttctcctactgatgctattcatactagtcagtaatcagggcttcactttcatgcatctctgacctcaagctagaattc

SEQ ID NO: 6861351 - DNA, 64 bp, Homo sapiens
ctgggcaggcactagcagaatgaggctgcctttgggggagcctcgcaaactgggcactgctcag

SEQ ID NO: 6861352 - DNA, 69 bp, Homo sapiens
cttcaagccagtgatgtttgctgccttggtacattgtccgtggctccacaattacacactggagggtag

SEQ ID NO: 6861353 - DNA, 93 bp, Homo sapiens
ggttcttcccagagagaccagccttgccaattttgcagtattgttgaaataagaaagaatttctggaagattgcaaggcatttggaaagaacc

SEQ ID NO: 6861354 - DNA, 96 bp, Homo sapiens
attatgatgcctttgccgtaatctcctggagactgggaactggatcctattatttgaagcatttccacacttaaggaatatgatagggttaataat

SEQ ID NO: 6861355 - DNA, 85 bp, Homo sapiens
tcgatcctccctctaaggtcttgacagttagagaacctaaaagtcattacaaattttctaaggagccaggactattagagattga

SEQ ID NO: 6861356 - DNA, 129 bp, Homo sapiens
gggcctggatgagggtcaggcaagccaggtgcttagggcacaaaatttcagaaagctctcactctgagagtcctaaaatgctgtgtgccagagccctggcttgcctaactgtttcccgcctcatcaccc

SEQ ID NO: 6861357 - DNA, 64 bp, Homo sapiens
ctagaggctgttacactcccagatgccaacaaagcattgtcaggggttgtggagtttcccatag

SEQ ID NO: 6861358 - DNA, 64 bp, Homo sapiens
tgcaattttttcccagttagccaggaacactttagagattccagtggcttcctggaaaaaagca

SEQ ID NO: 6861359 - DNA, 82 bp, Homo sapiens
tcctctgctggcctcctcctctgtctgcatgcgtgcgtccttgcaagggaaagacgcagcacaaaggaaaggatcaggagga

SEQ ID NO: 6861360 - DNA, 62 bp, Homo sapiens
ggagggagggggcgactcttaaaggcacagggtgcttggaagaggaggccctgctcccgtcc

SEQ ID NO: 6861361 - DNA, 59 bp, Homo sapiens
ctgagcacctattatgtgccaggaactcttttaggtgtgggatatatagtggtgaacag

SEQ ID NO: 6861362 - DNA, 61 bp, Homo sapiens
cacttatcatgtctggagatacttttttcacaactaaaggagtgctactggcatgtaggtg

SEQ ID NO: 6861363 - DNA, 63 bp, Homo sapiens
agttccctactctgctcagtctcaggcagcagcactcttggtgtctgagcagagggaggaact

SEQ ID NO: 6861364 - DNA, 56 bp, Homo sapiens
atatctgtatctatatttcaatagatgtgtagttatagagatatagaagtagatgt

SEQ ID NO: 6861365 - DNA, 76 bp, Homo sapiens
tttcccttccctgagttgaagtcattagtgacccagaaaacaggaagggggtgaggcctcatttagggagaggaaa

SEQ ID NO: 6861366 - DNA, 57 bp, Homo sapiens
atactacattattagagcctgggttttaggtccatggagctgggaactatgtagtat

SEQ ID NO: 6861367 - DNA, 76 bp, Homo sapiens
accctgtgctccaggaggttgctgcttcctttctcattttgaaggatgaacaagtggcctctggtcacctaagggt

SEQ ID NO: 6861368 - DNA, 87 bp, Homo sapiens
gcagagactggggatctgtcaggtgacacactaggagcaaagatcgccttctgtgccctctgtacccacctacagccagcctgctgc

SEQ ID NO: 6861369 - DNA, 77 bp, Homo sapiens
atcttctaggccctttttctcctgttgtttctttgtttcaacaaagagaaatatttaggaaaggagtcccttaagat

SEQ ID NO: 6861370 - DNA, 108 bp, Homo sapiens
ttcctaaagatcaataagttggtggtctttaattactagggtcgttccgtgtttctccccttcctgtttcaaagacagccatatttgtccttttctggtctttaggga

SEQ ID NO: 6861371 - DNA, 88 bp, Homo sapiens
aaaactctattgctattattctgttgcttttacagtatgtagtatattatgtttactggaagaaaaaatggaaaaacaatggagtttt

SEQ ID NO: 6861372 - DNA, 109 bp, Homo sapiens
ttggttatgaaaatggtcagtgcctctagaatctgtaggctaaactatggagccaaactccatagtttagcctacagattctagaggcactgaccattttcatatacaa

SEQ ID NO: 6861373 - DNA, 86 bp, Homo sapiens
agtgagacagactgacaggcatgggacgagggggtgctggacttggaacccagagcctgaggatgtcccagctcagactattcact

SEQ ID NO: 6861374 - DNA, 57 bp, Homo sapiens
cagggtcaggctgctagaagctgagcttttgcagcttggtttttagtttctgaactg

SEQ ID NO: 6861375 - DNA, 78 bp, Homo sapiens
ctgcacggagaaggaggcgaagcgtgtgcgggtagacacgtgagcacgctgtttccttctgatgtaaacactgggcag

SEQ ID NO: 6861376 - DNA, 66 bp, Homo sapiens
ggtcctgcattgccagcaagctagaagccactgttcggtaatgtttcagttgagaatgcacggacc

SEQ ID NO: 6861377 - DNA, 90 bp, Homo sapiens
ccaggttctacaaaccacatgctgagagccattggtgtagtagaatcagactgcctgggttgactcttagctgtaacacttagagcctgg

SEQ ID NO: 6861378 - DNA, 94 bp, Homo sapiens
gactatagtttcctgtgccatgagaaagtcctcgttctgaagtttaactctccaacactgtcacatgaaacttgctcatcacagtggactagtc

SEQ ID NO: 6861379 - DNA, 71 bp, Homo sapiens
aaggactgcgcttgatcatgtacctaatacttctcctcactcggaagttgatagagtacatgattgttctt

SEQ ID NO: 6861380 - DNA, 81 bp, Homo sapiens
gattttaagctggctgtcagggtgagctggctttggcccccagccagggctgctcccaattctgctgccttgctgtacttc

SEQ ID NO: 6861381 - DNA, 89 bp, Homo sapiens
tatccccacagtttatgaagctgaccttgtcttgctgatggtatactctggctcaggcagggcatggatggtggaatcctttggggatg

SEQ ID NO: 6861382 - DNA, 75 bp, Homo sapiens
tggctgtcccctgtgagtttactgccatgtcccagagggctttggtgcaaaattagagaaccacaggtctagcca

SEQ ID NO: 6861383 - DNA, 72 bp, Homo sapiens
gcagcgggctgtccgccgacttggccaggccgatgtcggagatgggcgagaaggtggacttccacttgctgc

SEQ ID NO: 6861384 - DNA, 62 bp, Homo sapiens
gcacccagagggcagggtctccatggtagaccaaagtccccttaaacatgctctcttggggc

SEQ ID NO: 6861385 - DNA, 59 bp, Homo sapiens
taagtagtagggccagaatttgaaactaggcctgtctgacttttgtgcccatgctctta

SEQ ID NO: 6861386 - DNA, 63 bp, Homo sapiens
ggcagtggttagaaacatgagctccagaatcagaaaaacctgtgttcagattctgattctgcc

SEQ ID NO: 6861387 - DNA, 64 bp, Homo sapiens
tgaaatgcttgtgcttctgggagtttgccccattcttcgtggcactccctgcataagtgattta

SEQ ID NO: 6861388 - DNA, 56 bp, Homo sapiens
atacatgtgtatgtgtttgtgtgtatatttgcacctgcatccatatatgcatgtgt

SEQ ID NO: 6861389 - DNA, 79 bp, Homo sapiens
ggccatccaattaataatgcagctctgtcgccattaaacaatttggcagtggtgactgggactggatatgaacatggtc

SEQ ID NO: 6861390 - DNA, 74 bp, Homo sapiens
gtgctggaggccatgaggctctaggtgctaagaaaacagaaagcgcttggggacggggctccaggtgacagcac

SEQ ID NO: 6861391 - DNA, 64 bp, Homo sapiens
ccttcagtaagcagctgatttcacagctcaggctagacctagatggtgtcactgcttcttaagg

SEQ ID NO: 6861392 - DNA, 81 bp, Homo sapiens
ctttgttggctacctttagttggttggatgctggacctgttgatgaccagacagcagtgacaagactaagaaggcccaagg

SEQ ID NO: 6861393 - DNA, 66 bp, Homo sapiens
gtcactttgttagcttccaattgcttctgtaacaaattaccacgaatcagtggctaacaaggaaac

SEQ ID NO: 6861394 - DNA, 55 bp, Homo sapiens
tcactgcagagacctctagtcataatattcgatgcactagagcagctctcagaga

SEQ ID NO: 6861395 - DNA, 72 bp, Homo sapiens
catgacagagctataatagagcttcagtgatagcttcttgcttcattttcctaccttgtagctcagtacatg

SEQ ID NO: 6861396 - DNA, 103 bp, Homo sapiens
tgtatatatgatatatatatatatgcacatacatatgctctataaatataagctctgtgtgtgtgtgtgtgtgtgtgtgtgtgtatatttatacatgtataca

SEQ ID NO: 6861397 - DNA, 59 bp, Homo sapiens
ttgcgcatgtacccatacatctgcaacataccccagcacatatatgtgcacatgtgcag

SEQ ID NO: 6861398 - DNA, 56 bp, Homo sapiens
agctactggagaacacaaaaccttgtctggtttggttcagtgtatcctcagtggct

SEQ ID NO: 6861399 - DNA, 60 bp, Homo sapiens
gggaagtgggctttgtggtcagcttccatagtgaaaagttggttctcagagccccttccc

SEQ ID NO: 6861400 - DNA, 70 bp, Homo sapiens
ggctggggagctgcacagagccgaccccagatgcccctccaccccctgccctctcacagctccctcagcc

SEQ ID NO: 6861401 - DNA, 95 bp, Homo sapiens
taggtgtgtccagcctgagagtccaggctcttcctgaagaagaggtcccactcctgctgtttacggaaaagcctggggctcagcaacagcgccta

SEQ ID NO: 6861402 - DNA, 72 bp, Homo sapiens
cattacttaactgctaactggtttgatacttttttcaggtctcgtaggtatcagtagtagaaaagtagcatg

SEQ ID NO: 6861403 - DNA, 122 bp, Homo sapiens
ggatgcgattaaaaggaaaaatacaggaaggcaattagaaacaaaatagttatttgattttggtgaacagtaaaaattttagctaccagtgtttttaatgaccacttgctttgtaattgacc

SEQ ID NO: 6861404 - DNA, 82 bp, Homo sapiens
ggttccaagtctttgctattgtgaacagtgccacaataaacacgtgtgtgcatgtggctttatagtagaatgatttataatc

SEQ ID NO: 6861405 - DNA, 64 bp, Homo sapiens
ttcaagtcttccatggtattctgatgtttctcagcaaattaaggaatgcctctggagtcttggg

SEQ ID NO: 6861406 - DNA, 73 bp, Homo sapiens
gcattctagagcatatgggttgtgtaattggatggttcacccaatcccatcaccatctgctctccagataagc

SEQ ID NO: 6861407 - DNA, 81 bp, Homo sapiens
tcacatggacagtgccctatgaacagctctctgttgaccaacaaaaagatgcttcgtttatagatggcattttcaaggtgg

SEQ ID NO: 6861408 - DNA, 67 bp, Homo sapiens
gagacaggattagtgttcttatcttctaggtcaagtgcaatctaggtggtagatcactaggctgctc

SEQ ID NO: 6861409 - DNA, 81 bp, Homo sapiens
ctttcctgtaacttagcatggttactaaatagacctgtagcactaatatttacatagtaaccagtggcttacagaagaaag

SEQ ID NO: 6861410 - DNA, 86 bp, Homo sapiens
aactgcagcttgcacagagaatacagtataggttcttttgactttgggcatgagtctgtaactgtgtgctctgtggagacccagtt

SEQ ID NO: 6861411 - DNA, 77 bp, Homo sapiens
ttgaggtcagcaaagagtgttaaaaatcccatgatatgaaattttcatttaatgcacggatgtagcctctgacccag

SEQ ID NO: 6861412 - DNA, 68 bp, Homo sapiens
cttagcagggttacgatgatttcatgtgtttttcagaagacactggttctcttaaccctattgtggag

SEQ ID NO: 6861413 - DNA, 113 bp, Homo sapiens
gaaccgttcaaaggaaaactcctggcttggccttgttaaggaggccctctcagtccaggaggtggggcctctcaggattaaggccacagatccaggtaccttcgatgatgttc

SEQ ID NO: 6861414 - DNA, 97 bp, Homo sapiens
acaggaacgctgtttgtgcatttatgcatcccagcatgtgacaaagcgtttgtcacacattgttgcttaagttgcatatatttccagtcccacctgt

SEQ ID NO: 6861415 - DNA, 62 bp, Homo sapiens
ttcatagtgtctttgctctctgctctttgtacctgcacacaaagagcaaagatgcttctgaa

SEQ ID NO: 6861416 - DNA, 79 bp, Homo sapiens
catgactgggatgttgctgctgtaaacagtggtgtccccattaggggacatgtgcagacagcaagcaggctcagtgatg

SEQ ID NO: 6861417 - DNA, 57 bp, Homo sapiens
gaaaagggcaaaaatttacctgtgaattggaaagatgtcaagtgaattgtccttttc

SEQ ID NO: 6861418 - DNA, 92 bp, Homo sapiens
gagctagtatcttgcagaattaattccagcggccaccattcacaaaaattatgtgaaaataatgcctctggagttgcttgtaaatgatgctc

SEQ ID NO: 6861419 - DNA, 109 bp, Homo sapiens
aaagagaaagggtaagagagcaatgatgacaatgaggatgactaaaagtgtgtttttagtttgtcaaccactgtcacagatttcctttcttgctccttgtgaactcttt

SEQ ID NO: 6861420 - DNA, 81 bp, Homo sapiens
gtgacgacatgagatttgggagggaccagaagcagaatgatatggtttgacactgtccccacccaaatctcatcttgtagc

SEQ ID NO: 6861421 - DNA, 74 bp, Homo sapiens
tcacatctttctttgcacactcagggtaataatctaaatgctgagtattctctgaagtcaatggaaatctgtga

SEQ ID NO: 6861422 - DNA, 59 bp, Homo sapiens
gccaggctcagtagcgattcctcctgcgtttgaatgccctttgctcttgtggctctggt

SEQ ID NO: 6861423 - DNA, 59 bp, Homo sapiens
tttgatcctttagccatttgaccttctgaacaggtgcaaaagaaggctgcaggttcaaa

SEQ ID NO: 6861424 - DNA, 75 bp, Homo sapiens
ttctttggtaaatgcaggttcttctcacaaagcctttcatcccttattgcagggagagccacattttccaaagaa

SEQ ID NO: 6861425 - DNA, 60 bp, Homo sapiens
cttctcccaacatgtggaggtcagatgccttgtgctgccctcacctcatgtcgggaagag

SEQ ID NO: 6861426 - DNA, 129 bp, Homo sapiens
agtattttttaaattatgactttattactttaagtggggtagaggcaaatatttgttttaaaaaaggcaagattcagagtcttctaacctcatatcttcaatgtttgaaagaataatgatgaatttatt

SEQ ID NO: 6861427 - DNA, 79 bp, Homo sapiens
ttgcctttgtcttgtgttcccacaggaagatcattaccattagaatatttgaccgtgaggaatatgagaaagagtgcag

SEQ ID NO: 6861428 - DNA, 59 bp, Homo sapiens
aacatttattctaattctgggaatcacaaaatactcccaacggcattagagtagaggtt

SEQ ID NO: 6861429 - DNA, 59 bp, Homo sapiens
ttcaatttcataatatctagctcagccagatatgtggtgtagcaagagtatggattgaa

SEQ ID NO: 6861430 - DNA, 89 bp, Homo sapiens
ggaagtagtcgttgatttgggaatggtctggcaacatgaaagagattgtctgcttccttgatcattcccaaaacttagggagcttttcc

SEQ ID NO: 6861431 - DNA, 83 bp, Homo sapiens
gtttgagagatttaagtagaggtgataggactctaattgcaattcactcacagtaagagttctctctcatttgagctcaagac

SEQ ID NO: 6861432 - DNA, 57 bp, Homo sapiens
gtttgcatgtattaagtcaatagtaatgtactgtgtgttatttatttacatgtaagc

SEQ ID NO: 6861433 - DNA, 79 bp, Homo sapiens
caaagattttgagtcttgtatgatttggtagttagtattaattaactgaactgataacatacacggagtaaaaaatttg

SEQ ID NO: 6861434 - DNA, 61 bp, Homo sapiens
cttgtcttggagtagagatttagtgaacttgaagagtagcaagatgtcactccaagttaag

SEQ ID NO: 6861435 - DNA, 55 bp, Homo sapiens
tcccaggagcaccttttgagcccaactcacatggctatctcagggagttcaggga

SEQ ID NO: 6861436 - DNA, 64 bp, Homo sapiens
gtagaccttggtgtgagggaagctgcaaagaactcctctgtgtgcccacctgacacctggctgc

SEQ ID NO: 6861437 - DNA, 64 bp, Homo sapiens
ggacgcctgctctcactggacagctgctctcactggacagctgctctcactggacgcctgctct

SEQ ID NO: 6861438 - DNA, 98 bp, Homo sapiens
aagaaacttgtcatctggaaacaggaaaaatcacatgaagtaattttatttgtatcatggctttttcactgttcgctacatttgtgacagctgatttt

SEQ ID NO: 6861439 - DNA, 62 bp, Homo sapiens
tggggcaggcccggggaaatgggccaacttcccctcaagaccccaggcctgggcctgctcta

SEQ ID NO: 6861440 - DNA, 81 bp, Homo sapiens
ttcgtttatatgggaatgtggtgatagtctataactactagtgacagtttgtaaccatcactacactcccatgtagctgaa

SEQ ID NO: 6861441 - DNA, 61 bp, Homo sapiens
aatgcactggtgaaaggtggagaataaatatattttccagatggatactagaatttgcatt

SEQ ID NO: 6861442 - DNA, 69 bp, Homo sapiens
cttgaacccggggggtggaggttgcagtgagccgagatcgcgccattgcactccatcctgggcaacaag

SEQ ID NO: 6861443 - DNA, 70 bp, Homo sapiens
gaaaaaggacatggatacttgataagggggaaatcaatctttctttctttcgtttatttatttagttttt

SEQ ID NO: 6861444 - DNA, 115 bp, Homo sapiens
gctggataatttgattttgtactcctgaaatttgttttaattctgattaagcctaacttgcgatctcaccagaaaggattagtttggtataagttaaattaatttcttttccagc

SEQ ID NO: 6861445 - DNA, 67 bp, Homo sapiens
tacagaaatacagtcaggcctaggtaaccaccaaaactctttttagtcctagactttatgttctgta

SEQ ID NO: 6861446 - DNA, 57 bp, Homo sapiens
tcttaatggagtcagtgtttcacaaaggaggttccctgaaacactctttccatgaga

SEQ ID NO: 6861447 - DNA, 58 bp, Homo sapiens
tataattcatcagtgtgtgatgatattctttaaagaaatgccatacctgagagttata

SEQ ID NO: 6861448 - DNA, 82 bp, Homo sapiens
tgttggtgtaaagcatttgtttctcctggaaagtgcacaacggggattttctaagaaatggaaaacgattgccacactcaca

SEQ ID NO: 6861449 - DNA, 77 bp, Homo sapiens
tgtggagctccccaactcagccgaggcttcagctatagttggagaagaggcctggccccagttgctaggagctccca

SEQ ID NO: 6861450 - DNA, 71 bp, Homo sapiens
gccccaactcctcaggctgcccggcaagttgcgccgggtccccgggctgccggcgcggcccggagcatggc

SEQ ID NO: 6861451 - DNA, 57 bp, Homo sapiens
agtgtctgcatgtggtgtgctatctctttcatctggtcacaggaagcagcaggcact

SEQ ID NO: 6861452 - DNA, 59 bp, Homo sapiens
agatttcccaaatacttgttatctacttaaagtttatagcaaagttgtttgggaaattt

SEQ ID NO: 6861453 - DNA, 64 bp, Homo sapiens
ggagttgagtccggtacaatgtccttcaaaatcaggccacagatgagaagctgcattcaattcc

SEQ ID NO: 6861454 - DNA, 81 bp, Homo sapiens
ggcttacccaagggaagactggacttctatgtggctggtttccacatcactgaaccccaactttctacagctgggtcggcc

SEQ ID NO: 6861455 - DNA, 93 bp, Homo sapiens
tcagccttcttgtagctccctgggagaggcgctaacactgatctttgcgtctgatgtaagttcttccagaggctcttaagcaggaatatctga

SEQ ID NO: 6861456 - DNA, 80 bp, Homo sapiens
tccttaattttcccttacccagtattcactcatcctttgcctctcctgtgatttgggttcttaaagggctaggttaggga

SEQ ID NO: 6861457 - DNA, 86 bp, Homo sapiens
tcccaatcataagacccagccagtatttttactacatttcctctcctcatctgtttgtattggtttggtttggtttatgagtgggg

SEQ ID NO: 6861458 - DNA, 95 bp, Homo sapiens
gcttaagtacatttatcattgccaaaatcctaattatgaacactttatagttgatgattcaagaaaataggatggccatggatgaactttcaggc

SEQ ID NO: 6861459 - DNA, 60 bp, Homo sapiens
ggacaggtgtgaggctggcacatggccgggcaactccactgccagctgctgcatctgtct

SEQ ID NO: 6861460 - DNA, 75 bp, Homo sapiens
tgttttcagtagcacaattttgtccctaacagaactttccaacaatgttagacagatgtgtgccacttaaggtca

SEQ ID NO: 6861461 - DNA, 63 bp, Homo sapiens
tgtgtcccttggaacctcagctctgactcgccacaggtcacatgctgaggggtctatggcata

SEQ ID NO: 6861462 - DNA, 128 bp, Homo sapiens
gtccgggtcgtcctggtttggcttccttaggactgtgccgctttcactcgagctcctgcagcggcagcccgccgccttgtggccagggtggaaaacggcacccggcggacagggcaggagaccacggc

SEQ ID NO: 6861463 - DNA, 129 bp, Homo sapiens
acaatttttgatgaaatcaaccggtgggtttagtctagcacctggtcaattcagtcaaaaatgtcaaaaaccctgtgaccgaattgacaggtgttagactgactgactggtcaattccatcaaagcagt

SEQ ID NO: 6861464 - DNA, 70 bp, Homo sapiens
ggggctatcaatttctacagttggtggaggtcttacaagaaaaaagtaagcaataccaggtgtgggccct

SEQ ID NO: 6861465 - DNA, 105 bp, Homo sapiens
cagccaacgagaagttgagttgtcaattgcctcttaattatagttacttggagaagtctggaagatgaccctgagggcaattggaaacacagattttctttgctg

SEQ ID NO: 6861466 - DNA, 100 bp, Homo sapiens
tgagaattcggctatgtatgtatgtttggtgggcagagccaaaacctttccatgaatcttggtaatgtaagcagcaaatgtggattcactgagaagctca

SEQ ID NO: 6861467 - DNA, 56 bp, Homo sapiens
tggattctgctccacactgattcatttcattggaatgaaagttggattaggagcta

SEQ ID NO: 6861468 - DNA, 91 bp, Homo sapiens
gccccatctccagggtttcttctctgtatagtttcctctaaatccagagttcctattacagggaagccttgggaacattttagaaggaggc

SEQ ID NO: 6861469 - DNA, 61 bp, Homo sapiens
cagctgtctctgccttatggtccagggcaagtttccccctgtaatatacacagacagactg

SEQ ID NO: 6861470 - DNA, 89 bp, Homo sapiens
tctattaaactccagtgaatactagaatttcttatattaaaattattaggatctcatgtgttctggtgatttctactgtgtatatcaga

SEQ ID NO: 6861471 - DNA, 63 bp, Homo sapiens
tgagactgggcagcttaaaccacagacatttgttttctcacagttctggaggctgcaagtcca

SEQ ID NO: 6861472 - DNA, 60 bp, Homo sapiens
tgctctttgaggtctcttgaccgcattcatggatgatatggcagagcccagaactgagca

SEQ ID NO: 6861473 - DNA, 73 bp, Homo sapiens
gaataggaaggagagaaaaccagagccacaggaagaggaacttgatattggtgtacatctccccttcatgttt

SEQ ID NO: 6861474 - DNA, 74 bp, Homo sapiens
tgaagtatatgtctttaatctattcttgaattaaacttgaagtctttggagatagatgaagacttgtactgtca

SEQ ID NO: 6861475 - DNA, 87 bp, Homo sapiens
tgtgctttgggggtccagtcctgtgagttgcctcccgtctagtaacgggcaggcctgcccagcaggatggagagggctcccagcaca

SEQ ID NO: 6861476 - DNA, 59 bp, Homo sapiens
tgcattctcaacccagagtttctggttcaggggacctggaatggggttgagagcttgca

SEQ ID NO: 6861477 - DNA, 88 bp, Homo sapiens
acatctggaactcagctggtcttctgtgagctcacgccaatttcatattgagtccagttgttcacagaggcttttcagtcctagatgt

SEQ ID NO: 6861478 - DNA, 101 bp, Homo sapiens
tatactcttgctggcagtgtatgaacatgttcattgacttaccaacactatactaatctggtaggtatgtctcattgttcgtgtgtgtgtgtgtgtgtgtg

SEQ ID NO: 6861479 - DNA, 119 bp, Homo sapiens
ctgaaaatgtatctcagtttgcctttatagcatctgtttctctttgtgagttaagaaagtcacactgggagagaaacgggtgctggaaggctgctcttacaagagactattaacctcag

SEQ ID NO: 6861480 - DNA, 81 bp, Homo sapiens
accgctgagattgggaggagcatgtggggctggaaaagataaatgcccttggtgtccttttctcttttcactctcagtggt

SEQ ID NO: 6861481 - DNA, 78 bp, Homo sapiens
cctctgcagaggagctgaaacttctcatatggaaccagtgggtttcctccccgaccttcacctacccgtctgcagagg

SEQ ID NO: 6861482 - DNA, 57 bp, Homo sapiens
ctggctttggtcatgtgatcatccctggatgtaatcaccatgaatgaagaaatccag

SEQ ID NO: 6861483 - DNA, 60 bp, Homo sapiens
ctggccactggtggtcataggctgtaatcacttggcaaccgttgatatattggtggccgg

SEQ ID NO: 6861484 - DNA, 100 bp, Homo sapiens
agctttgggtgttttctaagcacagagggacattcctactagagctgcacaagtctcagcccaagcaggagtgtcccctggctgttagaaagccagagct

SEQ ID NO: 6861485 - DNA, 61 bp, Homo sapiens
ggtcagttccctttcgtatggactgggcaactgaaacccagacagggaagggaattagacc

SEQ ID NO: 6861486 - DNA, 80 bp, Homo sapiens
tcatctaacaatggccctgtgatggatgtattaggttgaactgtatgaaactgccattcttataggtccaggatagctga

SEQ ID NO: 6861487 - DNA, 74 bp, Homo sapiens
cccctttccaggtaaggtcacattctgaagtactaggggttaagatttcaacatgtctttttttggtagagggg

SEQ ID NO: 6861488 - DNA, 69 bp, Homo sapiens
ccacctgctcccccaggggctccgcctcgtgactcacgctcaggcaagtctccgggcgcgaacagctgg

SEQ ID NO: 6861489 - DNA, 55 bp, Homo sapiens
gcacaattgacattttgggccaaataattcttggtaatggaggggtgtcttgtgt

SEQ ID NO: 6861490 - DNA, 58 bp, Homo sapiens
catttaatagatgctgtttcaggctactgaggaaagacagaacagtgtctatgaaatg

SEQ ID NO: 6861491 - DNA, 55 bp, Homo sapiens
gcggtgcctcctccagtgttgctgctgtccagcagctcagtggctggggcgctgc

SEQ ID NO: 6861492 - DNA, 99 bp, Homo sapiens
gaagagtcaaggtgtttctttggccaacaacatggaagctttagaactgaaatggttaatcagtttagtgccatgtttggccaaagtggccaggtcttt

SEQ ID NO: 6861493 - DNA, 130 bp, Homo sapiens
ataggtaaagaatcgaatacataaggatgctctgtaatttggacaaacagaatagagctaaaagccagagacaggattctattgcagtttttttctgagtccgaattcattcttcttaaattttacatat

SEQ ID NO: 6861494 - DNA, 60 bp, Homo sapiens
aggcggggggcaggcagtacgttgggggatccgagtacctccgcttggccccaggtggct

SEQ ID NO: 6861495 - DNA, 60 bp, Homo sapiens
gcaggccaggctaggggctgtcagggaccttccccagcgtcccctcctccctggtcctgt

SEQ ID NO: 6861496 - DNA, 56 bp, Homo sapiens
gcaggggtagtgtcttcctgagtctccttcctcaccagacgctgtgaggcccctgc

SEQ ID NO: 6861497 - DNA, 67 bp, Homo sapiens
aagctgcttggggctcctgcagtgtaaatttagatcatcaggaaatcttgcaaaggccccaaggctt

SEQ ID NO: 6861498 - DNA, 61 bp, Homo sapiens
aaagcctatgaaggagagcattatgctatacctgtatgtatgtatgcatcttttatgtttt

SEQ ID NO: 6861499 - DNA, 68 bp, Homo sapiens
atgcggggtccctgattgagcctttctgtcccctgcaggacagaggtggacctcagcaggctctgcat

SEQ ID NO: 6861500 - DNA, 84 bp, Homo sapiens
tagtaatgatgacagtgataatagcatttatagaacaccatacgtgaagagccttacatgcatattgtcatttagtccttactg

SEQ ID NO: 6861501 - DNA, 78 bp, Homo sapiens
acaatagtgttctagaggattctaaaggaagctgccccagcagccctgagagaaccatctatactttggatatgttgt

SEQ ID NO: 6861502 - DNA, 103 bp, Homo sapiens
gcagggccggttccaggcccagacggggtgagggagtcccacacctgagacagatggccttgccccatctgggaatccctggaggttgtgccgagtccctagc

SEQ ID NO: 6861503 - DNA, 65 bp, Homo sapiens
tggcgctggagtgatgcctgtgtctctgagagccacttgggacatagcatctcctccatgggcta

SEQ ID NO: 6861504 - DNA, 67 bp, Homo sapiens
gaagtgtgcatggatctagatgggttgagaatctttgcttgtcctgctctaggttcctgcatatgtc

SEQ ID NO: 6861505 - DNA, 130 bp, Homo sapiens
ggttgtatagtgctaattactgagagctggttatcctactccttcacaccttgaccgttaaataattctaataatgtgatgagcctgaagggtgaggatgatcgtcacacttccaagcagctgtgctaac

SEQ ID NO: 6861506 - DNA, 83 bp, Homo sapiens
aatgcttgatactatattgtttacagacttccttgtgactcatggctcttcacatgtcagtcttaaacagatgggaaggtatt

SEQ ID NO: 6861507 - DNA, 125 bp, Homo sapiens
atcaggaatgctcattatccccagaagccctgagcaatttctacccaagtttcattggccaaaactggacctgtgaccattctgggtagcaagggcaactcggattgtgagatgagctcttagat

SEQ ID NO: 6861508 - DNA, 79 bp, Homo sapiens
tgtgcatttcatgcagcttgaagtaagagaaaaattgaatagaccctcttgccgtatttgtactgcattatgagacaca

SEQ ID NO: 6861509 - DNA, 84 bp, Homo sapiens
ggtttatagtctctccacattgttataaaggaatgtaatagatcatgtttccttatatgacattgggacagtttgttaggaacc

SEQ ID NO: 6861510 - DNA, 70 bp, Homo sapiens
gtcattcttctcttttgaaacttcacagatctctctccttctggaaagttttactgaggacacatgtggc

SEQ ID NO: 6861511 - DNA, 65 bp, Homo sapiens
tcatgcaggcctatggagcagtgtagacactagggagcagagcactgcagcgtggtctggcagga

SEQ ID NO: 6861512 - DNA, 64 bp, Homo sapiens
gttgtgaatagtgccgcaataaacatatgtgtgcatgtgtctttatagtagcatgatttataat

SEQ ID NO: 6861513 - DNA, 76 bp, Homo sapiens
caccgtggtaagtttttccttatgtgctcttcattttaattcttattggaatctctggtatctggggaccatggtg

SEQ ID NO: 6861514 - DNA, 103 bp, Homo sapiens
aatctagtttaacctcctactccacttaggttatcttctccttctgttttcttttctctcaaaaggaggataagttagttgggtaagaagtattaccaaggtt

SEQ ID NO: 6861515 - DNA, 90 bp, Homo sapiens
ttatgcggtactcttcacattagatgtgtggccacagtttctaaactaataatgagcacacatggtctgatagagagagaaaccacatga

SEQ ID NO: 6861516 - DNA, 83 bp, Homo sapiens
ggctcacaccacacctgttctggctcccgctcagaggtggaggccgccaggtgctccagctggagatgggggctggtggagct

SEQ ID NO: 6861517 - DNA, 59 bp, Homo sapiens
aggtgggaagtgagcagcgggatgaagttgcaagggtgtctctgctgcgcatcccactt

SEQ ID NO: 6861518 - DNA, 61 bp, Homo sapiens
tggagctaggcgccggcagggcaactgggcatgctcagaagccgggcaggttttggtctca

SEQ ID NO: 6861519 - DNA, 57 bp, Homo sapiens
ggcaactttctgcagctgagacagaccctaaaggagctgacagttggagacaagtcc

SEQ ID NO: 6861520 - DNA, 66 bp, Homo sapiens
ctgtggcattgaggtatttggttgtggatattggatgttgacccctgcccgggccttagtgcccag

SEQ ID NO: 6861521 - DNA, 60 bp, Homo sapiens
cttacatacaccaccttggatctttcagattgctaagagttttggggggtgtgtcggaag

SEQ ID NO: 6861522 - DNA, 66 bp, Homo sapiens
cattagccatgtgggaaaaacagccagagaaagcattcccaggctagtcctcccatgtagccaatg

SEQ ID NO: 6861523 - DNA, 62 bp, Homo sapiens
aattctcatggaactctgatgggatgattggttaacactgttagagtgtctgtgtgggaatt

SEQ ID NO: 6861524 - DNA, 57 bp, Homo sapiens
gcagggctcaacaggacacccctgccagagcaggagggcctcctcggtgggccctgt

SEQ ID NO: 6861525 - DNA, 73 bp, Homo sapiens
acagctccatcacctggaagcactgcagaggaccctaccttaggattctgcaccatcttccagctgagcctgt

SEQ ID NO: 6861526 - DNA, 76 bp, Homo sapiens
aggaggtctgcagaaaggcacccactgggtctcatagtgtgaggcctcttgtgtttgtccttgttcccagcctcct

SEQ ID NO: 6861527 - DNA, 55 bp, Homo sapiens
gcaaggaagcagctgtcactcaaagtgctcagctcaatgtcagcagcttgcttgt

SEQ ID NO: 6861528 - DNA, 70 bp, Homo sapiens
tctgttcttgtcactgtaatttgctggctttagggtaagcagcaactgctagagtggcacaagatacgga

SEQ ID NO: 6861529 - DNA, 81 bp, Homo sapiens
tcagggccgtgccagcctggtgcgcctgggggacccacagcagaggtcctgcatgcacttggctggcacgtgtagttctga

SEQ ID NO: 6861530 - DNA, 72 bp, Homo sapiens
acttcaagagttatgaaagcaaggcattttcaaaaatcaaaagaaaatgaggctatttcatagattttaagt

SEQ ID NO: 6861531 - DNA, 72 bp, Homo sapiens
tgttcatgtttcatttgttactataattatataatttaattcagtgttaagtgaaatgatgaaatgtgaata

SEQ ID NO: 6861532 - DNA, 84 bp, Homo sapiens
caccctaatcttaacacttttgtggctccatggcttcctcagtgattttaggaggaaaaaggccacagcaagtgtgttggtgtg

SEQ ID NO: 6861533 - DNA, 74 bp, Homo sapiens
acacctttcccactctagagccctctccctaactcagggccaatttgggacatgggctcagtggaaaagagtgt

SEQ ID NO: 6861534 - DNA, 129 bp, Homo sapiens
ggctgcctgcgggccatactctctgcagcccacaccagcgccgccctctgcaggggctgaggcagatgctgctgggtgccgagggtggcgccttcgtgtttgccggagggtgtggggcagcgggccgcc

SEQ ID NO: 6861535 - DNA, 61 bp, Homo sapiens
caattgtgccagaaagctaatttgcctttactgggaaaacacagcttacctggcaggaatg

SEQ ID NO: 6861536 - DNA, 62 bp, Homo sapiens
cctgcctgtctttatcccctgtagatacccactgtctatccaagggcctggagtacagcagg

SEQ ID NO: 6861537 - DNA, 66 bp, Homo sapiens
tctaattgtacagtatttgaagaatatgaggttaaattcattattcaaataatctgtagaaagagg

SEQ ID NO: 6861538 - DNA, 60 bp, Homo sapiens
taaataggcctgtaggagaatagatgggagatactatcattttgtgacaatgcctgttta

SEQ ID NO: 6861539 - DNA, 77 bp, Homo sapiens
taccttgaaacaagacaggttactggcagatggcttaagaatggaaaatttgccttggtgatttgtaaaatgaggta

SEQ ID NO: 6861540 - DNA, 57 bp, Homo sapiens
agtctttagggaggtcagagttcccagaaaactgggaattgggacaaactgaaaact

SEQ ID NO: 6861541 - DNA, 104 bp, Homo sapiens
ggaactggacatgggaccaaattgttcccttcaagctgctataggttgctgggctggcgcaaactggcctgcactttagtgcttggtttgccatgtctaattct

SEQ ID NO: 6861542 - DNA, 55 bp, Homo sapiens
tagagggggcagtaacctcaaagtgttaccaacctttgggataactgttctccta

SEQ ID NO: 6861543 - DNA, 57 bp, Homo sapiens
tcacccatgcaagatgcattcctcaggtttctgagtcagctgcctccagcagggtga

SEQ ID NO: 6861544 - DNA, 91 bp, Homo sapiens
gagtcaatagctcagcactgtcagcactccggagagttacaggctataattagatggcatggaggtgtaaggcatgcttggcagttgattc

SEQ ID NO: 6861545 - DNA, 85 bp, Homo sapiens
gtcaagttgtcccttcaggtttcactggcaaatgtaaattattgctaatagaatgcagcagtgaaatttctgaataacaaatgac

SEQ ID NO: 6861546 - DNA, 66 bp, Homo sapiens
tcttcccagaggaggtgccagctggatattggaggatgagtaggtggtacctgaatgaagggagga

SEQ ID NO: 6861547 - DNA, 121 bp, Homo sapiens
catttaaaggatattatttggaagaaatgcactggtggtgagtgagggaccagcataagaagagctgtcctttaactagttaccatgttttatgcaatgttctcaatatgatatccaaatg

SEQ ID NO: 6861548 - DNA, 129 bp, Homo sapiens
ccatgggggttttggtgggattctgggtaggccaggaagcagtgtggctaggaagagacctccaggcaaagttgacgctgtcacccagatggcctataatccagggtagtaaactcagacgcttgcagg

SEQ ID NO: 6861549 - DNA, 105 bp, Homo sapiens
agttggcctgtttttttcagtttgaggttgttctgttgtaactggtcttgtttttggtagccatcattatcactgacaacctagagactgagtagaccgccacct

SEQ ID NO: 6861550 - DNA, 89 bp, Homo sapiens
ggtttgaaacagttgtactatgatgaagttaggacttttttaaaatttctaatttgtctctactttggttcacagctgttcatgaaact

SEQ ID NO: 6861551 - DNA, 61 bp, Homo sapiens
gaaattgatatctctgaagcctgctgccttaatggcagtcttcagagaaattaactctttc

SEQ ID NO: 6861552 - DNA, 63 bp, Homo sapiens
tgaaaccatcctgagaaaataaaggagataccacttctgtcttgtctcttctccctggtttta

SEQ ID NO: 6861553 - DNA, 59 bp, Homo sapiens
gcctggagtgcagtggcgtgatctcggttcactgcagcctccgcctcccgcctccaggc

SEQ ID NO: 6861554 - DNA, 74 bp, Homo sapiens
tgtcaagtcgaaggctttttgggtaattgtaggtcctgtcttctactttttcccaagagctttaaaactgtaca

SEQ ID NO: 6861555 - DNA, 130 bp, Homo sapiens
cttataatttcccaatttatttagtcaaggacacagaaaaatggagtcaagaggaacacagcagaaacagatacagcatgtttcagagttgtcttcttgacctctgaggtctttaactgggaacatgaag

SEQ ID NO: 6861556 - DNA, 61 bp, Homo sapiens
tgtgctagagcttgtttcagtcctggcccagctggttggaatttgtgactggctctgcata

SEQ ID NO: 6861557 - DNA, 82 bp, Homo sapiens
gaggtgttaaatctcactcagggatcaggtaaattctatgaagtggcatttgacctgggacttgaaaaatgattatcatttc

SEQ ID NO: 6861558 - DNA, 58 bp, Homo sapiens
caggtttacaaagtaaagtgtgggtccaactcccggatattattagccatgtgacctg

SEQ ID NO: 6861559 - DNA, 56 bp, Homo sapiens
ctaggttctactagtaagtgtcccagctgggagctctattactttgtatagcctag

SEQ ID NO: 6861560 - DNA, 95 bp, Homo sapiens
tgtgtctcatcttcttgtatttcctataacctttctcttatgtctcggcaaaagccatgcacagtaggggttacagggagttacactgaggcata

SEQ ID NO: 6861561 - DNA, 70 bp, Homo sapiens
ggctaagccaccctccttaggaatactgtgtaaatcagtaattcatctactcctggagtctggtttggct

SEQ ID NO: 6861562 - DNA, 56 bp, Homo sapiens
agacattagaaagccataggtgtctgagcccacttagccactggtttctgatgttt

SEQ ID NO: 6861563 - DNA, 55 bp, Homo sapiens
tgcgatcatggcaaaggccttgaagatggcgtctgtggggcctgtgatggtcaca

SEQ ID NO: 6861564 - DNA, 56 bp, Homo sapiens
cacctgaacggacgtccacggcatgggggacctcatctgtggcatctgtcatggtg

SEQ ID NO: 6861565 - DNA, 63 bp, Homo sapiens
gatgtttaagaaagtcttccatagtgtacccacctcactatgctagaagttttcttcagcctc

SEQ ID NO: 6861566 - DNA, 86 bp, Homo sapiens
accttaattccatctgtaaagtccctttagccatgtaatataatatattcactggtgtcagggatcagtgtggacacttttagggt

SEQ ID NO: 6861567 - DNA, 83 bp, Homo sapiens
tttatttgatagatatatctgtcatactggtattagtatattttactaagaaatcaagttggaggtagatcttaacaaataaa

SEQ ID NO: 6861568 - DNA, 80 bp, Homo sapiens
ggggcattgcagctgttgtgatccatttacgaggaacatctgatgagagtgaaatgtcacatgtcacactgctgtgcctc

SEQ ID NO: 6861569 - DNA, 79 bp, Homo sapiens
gtgaatttcttttgaggatattagtgtttccctattgtatctagctttaaaacattggatatttattaaaaggatttgc

SEQ ID NO: 6861570 - DNA, 76 bp, Homo sapiens
gagggaccaacggggctggttccattcgtttatcacaaaggaaagactgttgcctgaacttagcctggtggccctt

SEQ ID NO: 6861571 - DNA, 66 bp, Homo sapiens
gtggaaaggggagggatattagaggatagatgtgacagttcttctgggaagctggtcctgttctat

SEQ ID NO: 6861572 - DNA, 123 bp, Homo sapiens
gccgggcttccttcacggaccttgcgaacctgcagctccagccgactgtaagaaggaagtgcctttttgcaggtggggtcggggaagtagggccgcgaaggcctctgggaaatgtagttcggc

SEQ ID NO: 6861573 - DNA, 80 bp, Homo sapiens
caggtgagccagtccctctgcctgtggttctctgggggcagtgtgttcagggagtcccaggcaggggctggcttgctctg

SEQ ID NO: 6861574 - DNA, 60 bp, Homo sapiens
gctgccatgccacagcactcacatacccactaattctgtgtgatgagtgaggctggcggc

SEQ ID NO: 6861575 - DNA, 60 bp, Homo sapiens
cagcagggtatacagggaatttggcttctctggctcctgacctttcccctgtgccctctg

SEQ ID NO: 6861576 - DNA, 92 bp, Homo sapiens
gacactcctagcagagggacagtgtaatgcataaagttacggagaaaggaaggtgtgttctgtgctcatacacgttcagctgctcagaggtt

SEQ ID NO: 6861577 - DNA, 60 bp, Homo sapiens
tatctatgctgcttcagttaaggccttacattgccagccttaaaatcttagctatgggta

SEQ ID NO: 6861578 - DNA, 58 bp, Homo sapiens
gggaggagcatgagagggtagtgaaacagtatgtgacacacccgagctgctgtctccc

SEQ ID NO: 6861579 - DNA, 99 bp, Homo sapiens
ttcctggtaattcggatgcacattaaaattaaagttttatttagagcattggtcccctaagttaggtagaagtttactttgaagtttgcaagccaggga

SEQ ID NO: 6861580 - DNA, 75 bp, Homo sapiens
cactggtatgtctgagtctgctccagttgaaaatcatgccttgaaaatgcaacctgagactccaggcacctaatg

SEQ ID NO: 6861581 - DNA, 60 bp, Homo sapiens
ggctcaggctggagtgcagtggggcaatcttggctcactgcattctcagccttctgggtt

SEQ ID NO: 6861582 - DNA, 118 bp, Homo sapiens
taactccacagctgctgtgatctttgtccatacaatgtaacatctttgagcctctctttgcctccagaatgaaggtgataccgtatctcataaaattcacagaggcctgaatgagtta

SEQ ID NO: 6861583 - DNA, 96 bp, Homo sapiens
agagtgggaggtgggtttgggaaacagtgatgccaagaaggaagggattttcacttttcgtggtaggcattctcctagaagctctccctctcacct

SEQ ID NO: 6861584 - DNA, 82 bp, Homo sapiens
ttccaccagaaagcatcattgtgatttctctcattatctaaaatgaataagaattattataatgataaattagtggcaggag

SEQ ID NO: 6861585 - DNA, 89 bp, Homo sapiens
gagaggtcaagaggctcattaaaagtcacacagctggtgagtattatcattacaaacaggctgtacttctaatcatctcttatcctttc

SEQ ID NO: 6861586 - DNA, 72 bp, Homo sapiens
cactagaagcacctgtgttcatgcctcatgagtagcagagctgagtgatgagaggagaatgggattctggtg

SEQ ID NO: 6861587 - DNA, 92 bp, Homo sapiens
tgtggatacccttccccacacattttagagctccaagtacagcacagtgatggcatttcatgctccttggaacctgtgaggtgggtgccaca

SEQ ID NO: 6861588 - DNA, 77 bp, Homo sapiens
tgttactcataatgtagttcatggctggctgttttttgcctcagcttctactgaaattgcaattatcatggtcaaca

SEQ ID NO: 6861589 - DNA, 55 bp, Homo sapiens
ctgcctgcatgctgccatagctggtaggcttctccaagcagcagctgccaggcag

SEQ ID NO: 6861590 - DNA, 80 bp, Homo sapiens
agtttctaaacctttaccagactagcaagagatgttccattcaaataagttctctgatgtatgggtgacaggcaagagct

SEQ ID NO: 6861591 - DNA, 75 bp, Homo sapiens
cctcatcagggtctgaaactgatcacagcatcctgccatgctgtttcaagtgaagtcagacattctgcattctgg

SEQ ID NO: 6861592 - DNA, 124 bp, Homo sapiens
gacagttagtgggtaaggtcaaattcaagagcgggtaggaacaaagagctgcaggttccaaggggatgcaatggacctagtagaaaaatgttaatccctctaggtgtctttcaatttaattgtc

SEQ ID NO: 6861593 - DNA, 66 bp, Homo sapiens
gcacaggcagtctcatcaggcatgtagtcaatgaatgactgttcactaatgggaatgttaatgtgc

SEQ ID NO: 6861594 - DNA, 83 bp, Homo sapiens
agaagtctgatatgagagatttagtagatgcagcattatttgcagtctcactgcaagcattctgctcatttcatcaaactttt

SEQ ID NO: 6861595 - DNA, 61 bp, Homo sapiens
ccaggaaggtatgggaagaaaactgattttaatgtgagtgtctcccttttaaccttactgg

SEQ ID NO: 6861596 - DNA, 114 bp, Homo sapiens
ctagggatcccctgagctgagttcctacagagggaagatggtccaatcttactacactgtgagctcatccccatggtccgtcgccttccagttgcctgctcagcccgtccctgg

SEQ ID NO: 6861597 - DNA, 66 bp, Homo sapiens
gttatcatagctagataccttatggaaatgagtgaagcatttctaagtgtattgagcttggaagat

SEQ ID NO: 6861598 - DNA, 82 bp, Homo sapiens
atctaaaaacttatcagtagatttcaggggagaggaaaagaccattttaattcttttgcaagactattgattagtaacagat

SEQ ID NO: 6861599 - DNA, 66 bp, Homo sapiens
ggctagaaagcccccgctggcgcacgctgggccactggtccatttgccctgtggggatttccagcc

SEQ ID NO: 6861600 - DNA, 130 bp, Homo sapiens
ttcactagagccaaaagtagattaaaaatcagtcactcattaatactttgcctagctactaaattggaggtgcctaaacaagatactaatgaggtgactgagtcttaacctggttttggcctccactaaa

SEQ ID NO: 6861601 - DNA, 69 bp, Homo sapiens
agaacgttgaagagaaccgcggcttattgtcaaagggaaaagtaaccgcagagttttctttctgcttct

SEQ ID NO: 6861602 - DNA, 86 bp, Homo sapiens
cccaggctgccgtcgccatgacaacaccagccgtcctaggcaggggcaggccgggtggggtcaccaatgggcgagtgggggccggg

SEQ ID NO: 6861603 - DNA, 61 bp, Homo sapiens
gcctgctctggggcttcctcacgttcctgattgagaaatgaaggccctggagccacgaggc

SEQ ID NO: 6861604 - DNA, 74 bp, Homo sapiens
gggcagagtccaccctccttccatcaggcctctgagcaggagtcagaggacaactggggcaaggagttctgccc

SEQ ID NO: 6861605 - DNA, 87 bp, Homo sapiens
ttgttaaaaatacagattcttggacccacattagacctaaagaattaggatctctctgaaagggctaaataatttggattttaacaa

SEQ ID NO: 6861606 - DNA, 57 bp, Homo sapiens
acaggcagggaccttggctaagtcaccacctatctgagcctcagtttccctgtctgt

SEQ ID NO: 6861607 - DNA, 91 bp, Homo sapiens
gcgcctgtgttcagccctggtcagcctgaccccaaagcctatgctctagctgctgtgctgtgggactcaggctcctgtgggacacagacgt

SEQ ID NO: 6861608 - DNA, 65 bp, Homo sapiens
ctgaatacactcaggtgggcataagccatagaaatgcaaagtagtccagccttgggtgtagccag

SEQ ID NO: 6861609 - DNA, 72 bp, Homo sapiens
tgtgtgtgcacacgtgcgtgtgcatgtgtgtgtctgcacatgcaaatgtgcatgcatgtttgtgcatacata

SEQ ID NO: 6861610 - DNA, 57 bp, Homo sapiens
acatagaagtgatgcttatccactaacagtcctgttttggcagtgtcatgtctatgt

SEQ ID NO: 6861611 - DNA, 111 bp, Homo sapiens
tctgtggcttgtcttctcattctctggagatcagtggtttttacactttcttctgctgaagccaagtattgtggaagaagccatggggtcaccagaggataggtgcacagg

SEQ ID NO: 6861612 - DNA, 59 bp, Homo sapiens
ctgttaaagatagttaagcttctcacctataaaatggtgagagctatctacactgacag

SEQ ID NO: 6861613 - DNA, 55 bp, Homo sapiens
ggtggattgcccatgacagattatttgtctaaactggcttcatttgcaacccact

SEQ ID NO: 6861614 - DNA, 83 bp, Homo sapiens
ccctgctccctaggtggccccaggcctctgccagccctgtggggctcatgtggcagggttggccaccttaccatgagatgggg

SEQ ID NO: 6861615 - DNA, 63 bp, Homo sapiens
gagtgctggctccatcactgggtgatggctgggcatgccactaacatccttggggtctgtctc

SEQ ID NO: 6861616 - DNA, 55 bp, Homo sapiens
acatggccacagggtcacacgctgttaggggcagagccaaatgctgtggttatgt

SEQ ID NO: 6861617 - DNA, 96 bp, Homo sapiens
ggcagagagctggtaaggcatggctcacctgggacatgagtggggagagaccctcaggtcacggatctgagctggaggagcctcactgtgtctgct

SEQ ID NO: 6861618 - DNA, 80 bp, Homo sapiens
caatgaccagttttatggagcagacagctggtcagttgtactctggcacagaaaaatgctccattcctattgttcagttg

SEQ ID NO: 6861619 - DNA, 57 bp, Homo sapiens
tcagagactgtagctgtgttttcccccagtggcactgccagctgcagttcttaatga

SEQ ID NO: 6861620 - DNA, 106 bp, Homo sapiens
ggctgttaggcattctgtctgtcctgagctggcttgtcaaccagggcatgagtgagtcagactgccctgcagccggccagctcattagtcagccagccattcagcc

SEQ ID NO: 6861621 - DNA, 98 bp, Homo sapiens
tgttgttgtgagctttgattttaaggtctttgttattgccggataatcaagcaaaatctgactaatacagggcactttgagtgaggctcatcccaaca

SEQ ID NO: 6861622 - DNA, 75 bp, Homo sapiens
gatgtagtggacagcgaaagtgcctgggaagtatattattattacattttatttattgagtgctgtcctggcatt

SEQ ID NO: 6861623 - DNA, 77 bp, Homo sapiens
gtgaggggctgtttcttgaggctactcctggtaccaattcgcgcattgccaggggcccagcaggagacagaaggcac

SEQ ID NO: 6861624 - DNA, 68 bp, Homo sapiens
tgaagccagcctcccaggtatggaagtcccaggtgatatccacagccatcccttggaagctggtttta

SEQ ID NO: 6861625 - DNA, 129 bp, Homo sapiens
tgtgtgctatttccagattgtctccaagtagttggctgctgggtatgattatgaaactgaatgatgggccatggagtgtttcatgccatttccagattgcccccaagtatttgtggacatgttcacaca

SEQ ID NO: 6861626 - DNA, 64 bp, Homo sapiens
cgcccgcagacccccggcgccaagcctcagactggggctctgggcgctggtggtcttgcgagcg

SEQ ID NO: 6861627 - DNA, 81 bp, Homo sapiens
cgtagcaagaggaaaatcaatgtctttttaaagggataccgtatatgttaaaaagtaaattgacgttttttcatggctttg

SEQ ID NO: 6861628 - DNA, 73 bp, Homo sapiens
gcaagccccgactctccctgagagggaggcattatataataactgtccgcagagggagaggctgggtgcgtgc

SEQ ID NO: 6861629 - DNA, 57 bp, Homo sapiens
agggactccctgggccgacacgggccagcctttccctgtgttggctctgggatccct

SEQ ID NO: 6861630 - DNA, 57 bp, Homo sapiens
gctgacttggccaaggccccgggttagtcgcagacctgggatggggccaggtttagc

SEQ ID NO: 6861631 - DNA, 80 bp, Homo sapiens
gcagaagaaggggacttggggttcaccttaagagggaacgcccccgttgaggttcacttcctggatccttactgctctgc

SEQ ID NO: 6861632 - DNA, 92 bp, Homo sapiens
ggtctcactctgccacccaggctggattgcagtggtgcgtgatctcggctcactgcaacttccgccttctgggttcaagcaattctctggcc

SEQ ID NO: 6861633 - DNA, 94 bp, Homo sapiens
atttagcttctttgattgcgtctataactaattggataccttcctgtgagtgtgcaggaaagccagttagttaaaggcgcagtatggttcaaat

SEQ ID NO: 6861634 - DNA, 62 bp, Homo sapiens
ggcacacagaggacatgcatttgtttcttcaagaaacatttattgagcacctactgtgtgcc

SEQ ID NO: 6861635 - DNA, 67 bp, Homo sapiens
gcagtttcagaaaaatatggccattttataatggtcaaatttagtctctggaagatgaataaactgc

SEQ ID NO: 6861636 - DNA, 94 bp, Homo sapiens
tttctcagattaagatgtcttgggtttcagtttacttctttaaagaaagattcagagttagtactgaggacccagactttcttgatgtgggaaa

SEQ ID NO: 6861637 - DNA, 65 bp, Homo sapiens
gagtcattgcacactagctcagcctagatgttagcctgggtgtgaccctgggtgggcaatggctc

SEQ ID NO: 6861638 - DNA, 63 bp, Homo sapiens
gctggcagatgtatatcacagcttatgtgaacaacatgctataagctgtgttccactgatagc

SEQ ID NO: 6861639 - DNA, 59 bp, Homo sapiens
gggttgagatggagaaggaagctgtttaataaaatttctaatttctctctctctctctc

SEQ ID NO: 6861640 - DNA, 78 bp, Homo sapiens
tagacaagaggatgtggcctctatcctggaagggcctacagtttaggaaatgaggccaacatgtgaactttgaaactg

SEQ ID NO: 6861641 - DNA, 57 bp, Homo sapiens
gaggcccaaatttccacaaacacatagaatgtgtaaattgaaggaaatttgtgcttt

SEQ ID NO: 6861642 - DNA, 74 bp, Homo sapiens
aaagctatccaccaagtcccactataatttgaaagacatactgaaaagtagtattgggacttgggagatgtttt

SEQ ID NO: 6861643 - DNA, 64 bp, Homo sapiens
gcgccccagggtgagaaaaggctggatgcataatgcattcacattgagcttcactgtggggtgt

SEQ ID NO: 6861644 - DNA, 56 bp, Homo sapiens
ggaggagtgtggggcactctgccctgcagccaacagggccctccctccgctcctcc

SEQ ID NO: 6861645 - DNA, 59 bp, Homo sapiens
ttctgatgaggaggtctctaagcaaaccaccgatctgcttaaagcctccctcataagga

SEQ ID NO: 6861646 - DNA, 69 bp, Homo sapiens
ggggccctggcgagctttgttctccaggacaatggccactgtccattgaggaaggacttgcctggcttt

SEQ ID NO: 6861647 - DNA, 73 bp, Homo sapiens
tgtaggaaatccttcctccagaaaagatggctcattcaccatcagagagtgcaccctggagagaagctccacg

SEQ ID NO: 6861648 - DNA, 78 bp, Homo sapiens
caccgcatgctgatatgattgataaaggtagaactattttctattatgcattaattagattagcaggactttgcagtg

SEQ ID NO: 6861649 - DNA, 75 bp, Homo sapiens
tttgagtttagggtggagactggaagcaggggagccctggccctctgcaggtcacgctccagcctggaacccagg

SEQ ID NO: 6861650 - DNA, 70 bp, Homo sapiens
ccactctccaagttatcaagatgaagacccaagatggtggcattcactctgaaggtagcctggaaagtgg

SEQ ID NO: 6861651 - DNA, 92 bp, Homo sapiens
tacagagtgtcttttgaaattatgttcttgagaaaggtaagttccctaaaaatcccaccacctcaggaacagaattttctaaaactgttgta

SEQ ID NO: 6861652 - DNA, 72 bp, Homo sapiens
gtcagatggagggacgccgtgcgggaccgtgcgctcgcgcctggcttttgttcccggcgtctgacttctgac

SEQ ID NO: 6861653 - DNA, 87 bp, Homo sapiens
ctagtttcacatcccaggcattctgtgaggcactggggatagtgaccgtcctcaggaaggcttcacacgagtgctgtcagaaacaag

SEQ ID NO: 6861654 - DNA, 117 bp, Homo sapiens
tcactgactctgacaacatccctttttctatagatagaaatatataagtacaggggcatgccacttaatacatcattcatctaaggaagaggtatgtatttgtcagctggtaagtgg

SEQ ID NO: 6861655 - DNA, 70 bp, Homo sapiens
tgtcagcaaagccatttagggattagagcagctccctcagtaaaagctgcttattcaaaaggtgctttca

SEQ ID NO: 6861656 - DNA, 58 bp, Homo sapiens
aagagattataacagtttggacccagtgggagcttgggggtgtaagcagtgatctctt

SEQ ID NO: 6861657 - DNA, 60 bp, Homo sapiens
gcttccctaggggccaggttcttgcaaagggggaaggggcctgtagagcttcagggacgc

SEQ ID NO: 6861658 - DNA, 57 bp, Homo sapiens
tattgagttaatggtgtatccccaatactaccattggggaacactgttcattctgta

SEQ ID NO: 6861659 - DNA, 80 bp, Homo sapiens
taatgctgaattacaacctgatgccaactaccatggcagttaaaagagactccgtgcccctggcactaggtcagacgttg

SEQ ID NO: 6861660 - DNA, 92 bp, Homo sapiens
ccagaaaatattattagcatcattatcagtccagtaaattgttttaaaaaccaaaaagacactagtggaaattgatttgtggtgtttcctgg

SEQ ID NO: 6861661 - DNA, 88 bp, Homo sapiens
ggaaggctctctcactctgctctttggacaatgccttgcccctcttggtggcagcttcctaggagagggcagagtcgggggctcttct

SEQ ID NO: 6861662 - DNA, 125 bp, Homo sapiens
tagttaaatttaaatttcagataaataatgaataatgtttttgtataagcatgtcccaaaattataaggggcatttagttatactaaaacatttttgctgtttagctgaaattcaaatttaattg

SEQ ID NO: 6861663 - DNA, 78 bp, Homo sapiens
gcctggcctgactcctggcaggtaggccccctctccagtccgcccaggctttggtaggtgtgcctgcccaggctaggc

SEQ ID NO: 6861664 - DNA, 69 bp, Homo sapiens
cgtaggatactcagtgctcattatgttgaagtcagctcttaagccagtatgagtcactgaatcctcacg

SEQ ID NO: 6861665 - DNA, 72 bp, Homo sapiens
agagggactccacctgctgcttctggatctgaagaagaggggactatgagccaaggagtgcaggtggcttct

SEQ ID NO: 6861666 - DNA, 78 bp, Homo sapiens
ctctacgttactgatgtcattagaaacagactgattgggttcgttaagcatttggatctgagacagagtaaggtggag

SEQ ID NO: 6861667 - DNA, 83 bp, Homo sapiens
acagtatcagactcaagcagataggaattagacaatcaaccagagtaagtttggtccagtttagcattgagtgctttaattgt

SEQ ID NO: 6861668 - DNA, 82 bp, Homo sapiens
cctacatcccaagccagctggaggagcagcttccagtcttcagagatgggcccctcttcttcagttggccttggtagtcagg

SEQ ID NO: 6861669 - DNA, 127 bp, Homo sapiens
gggtctagataactaaaacagaaacaacagtcatattgaagaagactggcaagaggtcagcatcccatgatcgcgctgcactgttgctttatatgattgtgtttgatggcacgattgtttacaaccc

SEQ ID NO: 6861670 - DNA, 55 bp, Homo sapiens
tcacagtaactttgttgctttttataagaatgcataggcaatggggttgttgtgg

SEQ ID NO: 6861671 - DNA, 72 bp, Homo sapiens
tgtgtgtgtgtgtgtgtgtgttttgaacttagagcacaactcaattcagactagacacatttcaagcactca

SEQ ID NO: 6861672 - DNA, 90 bp, Homo sapiens
cgggtcagggctgagaacaggcccagcctctgtccagggtgaatctgggcccagcggggtactgggacatctgttttccatcctgattcg

SEQ ID NO: 6861673 - DNA, 80 bp, Homo sapiens
gtgttctttttgttcccagagaatttgttttcttaatcttaatcctgaaaacagaaattctgggacagaaaattgaagac

SEQ ID NO: 6861674 - DNA, 57 bp, Homo sapiens
gtcatgtcttccttgcacacacacactagatggtgttgtcagctcaggaaacatgac

SEQ ID NO: 6861675 - DNA, 58 bp, Homo sapiens
ggcctggggctgtgggagacaaggcatcagaggggtgccatgcctgtgtctccaggcc

SEQ ID NO: 6861676 - DNA, 90 bp, Homo sapiens
tcatgaatgttcttaatggcatctacaatagtgaatcctttccagaagttttccaatttactttgctgagatccatcaaaggaatcatga

SEQ ID NO: 6861677 - DNA, 66 bp, Homo sapiens
tttgcagcaggaacagtttatctctggctgaaaccaaagcagatgaaaatgctgccgtgctgtaag

SEQ ID NO: 6861678 - DNA, 55 bp, Homo sapiens
tatctacaggtgtcaggtaagatgttaaatacatgaacctggaagtcagtagata

SEQ ID NO: 6861679 - DNA, 79 bp, Homo sapiens
cttgagacataatgttgagcttgaaagtaggtttagttttttgaatacacagttcttggtttaatagttaagtgtcagg

SEQ ID NO: 6861680 - DNA, 55 bp, Homo sapiens
agggttaggagtgcctctgtcactaacttgtgagtcactggacctctctgagcct

SEQ ID NO: 6861681 - DNA, 126 bp, Homo sapiens
ctgagggggtctttcaaccttccctctacatatccggcatctgaagcaaatgaaacagctctcaatctgatgagttgacagtttttcaaatctggcatgtagtgggtgctcttggagaagcctcag

SEQ ID NO: 6861682 - DNA, 77 bp, Homo sapiens
aaatgcctctgctgtacacaatcttcacaactctaaaaatgacattgtcatggccattgttagcagcaaaggcattt

SEQ ID NO: 6861683 - DNA, 75 bp, Homo sapiens
gagtaactagggagcagccctgccactcctcatgtgatgcaccaggagccagggaagctgctttctaggggattc

SEQ ID NO: 6861684 - DNA, 64 bp, Homo sapiens
gcttttctgagggggacttcgctggcaggacctcttaaccactgctgccacccctcaccagagc

SEQ ID NO: 6861685 - DNA, 68 bp, Homo sapiens
ctcagtctgcctgctaactcctgcaccatctttctggtgtacttgatgtgagagcaggtgtctctgag

SEQ ID NO: 6861686 - DNA, 71 bp, Homo sapiens
ggagggtggtggggacgggatggctcactgggcagctaacccgtgtaggccacttcctcctcgtcactgcc

SEQ ID NO: 6861687 - DNA, 63 bp, Homo sapiens
gtttctgttcattgcttcctatgtgctaggcaggctaggtacttttcaagtaataatggaaat

SEQ ID NO: 6861688 - DNA, 55 bp, Homo sapiens
gctcagaggagcatcataaggaaataagagaagtccttcaaagctcctagtgagc

SEQ ID NO: 6861689 - DNA, 59 bp, Homo sapiens
gcccagaatgttatagtgcccctggggtataaaacccaggatggactgctttctggagc

SEQ ID NO: 6861690 - DNA, 79 bp, Homo sapiens
gtggcttagtcttgtgccacccactagaccttgcatttcacttttaattgatctcttgtgtatggtagaaattagccat

SEQ ID NO: 6861691 - DNA, 63 bp, Homo sapiens
attcagtggggtcatgggtagtttgcagtgtgaatggcagatggactgtatgacctgaagaat

SEQ ID NO: 6861692 - DNA, 81 bp, Homo sapiens
ttttctagttaggattaaacagaagaaaaatggtggcaccattcccagaggtcttcagcatttgaactttacactagaaaa

SEQ ID NO: 6861693 - DNA, 61 bp, Homo sapiens
gggagctgctagggcattatgataaaggggtggctctttatctgtcctttgccagtgaccc

SEQ ID NO: 6861694 - DNA, 64 bp, Homo sapiens
tttgtgctcatgcattctttttgtgtgtgtgtatgcatatattctaccatgcatgagctataga

SEQ ID NO: 6861695 - DNA, 64 bp, Homo sapiens
ttatgacagtaggtaaatgatagctgtgataattttaaaggctcttctctatctactatcatga

SEQ ID NO: 6861696 - DNA, 60 bp, Homo sapiens
caggtgatgctggctctccacgtgcatccggcacgtttcactgcagccatcatcaacttg

SEQ ID NO: 6861697 - DNA, 79 bp, Homo sapiens
aagtgcagaaaaatttcaattaacagagggcttattacttgggcacaagttaatataagttttactgttactgccactt

SEQ ID NO: 6861698 - DNA, 99 bp, Homo sapiens
ctgtcccaagcagagaattcttcaagtacaagtgtatttggcttgatatacctgattatgagggcaaatatttttgtaaattttctaatgctgaaccag

SEQ ID NO: 6861699 - DNA, 55 bp, Homo sapiens
tccctttaggcaattgcattaagtaggttggctaagtgaaattgcatcagaggga

SEQ ID NO: 6861700 - DNA, 76 bp, Homo sapiens
ggcaggtgacagggatggcgctggctgcccgcgggccgtccggcggccgcagcagtgtcggcccaaacacaatgcc

SEQ ID NO: 6861701 - DNA, 76 bp, Homo sapiens
gatgttctgagacttctgaagctagaacataagaattcttgcaacttctgctaaaggaagttctcctggaatactc

SEQ ID NO: 6861702 - DNA, 64 bp, Homo sapiens
taagtctcagtttgaatgctgacactgacattcactgacagtgtgacttcaagctggctactta

SEQ ID NO: 6861703 - DNA, 59 bp, Homo sapiens
aggaggtgcgtggtgatcccctctgctgttgtgcagaggaatgtgcccacccatctcct

SEQ ID NO: 6861704 - DNA, 65 bp, Homo sapiens
ggattcacatgttcttttccactctctcattatggcaccagagaatttaggatgcatgtgaattt

SEQ ID NO: 6861705 - DNA, 89 bp, Homo sapiens
gcttagccagctatcctatgacagttttacaagtatagaactcttgaatatgctgaagttgaatattctgggaaaggaagggcgaaggt

SEQ ID NO: 6861706 - DNA, 75 bp, Homo sapiens
ttctggctttacagaccaaagacctacagatccaactacactggctgtgcaggggatttggttataaggaaagaa

SEQ ID NO: 6861707 - DNA, 96 bp, Homo sapiens
tttggaggagacagaagacttgtaacattgagtccactaaacagggtgtcacctgttgatgagcacaaagttgaaggtctgtccagtcaccccaga

SEQ ID NO: 6861708 - DNA, 83 bp, Homo sapiens
cactgagcttttcctgcacccgctgatgccaggcctggagctggccatggaaggccctgtggtgatgggagaggctcacagtg

SEQ ID NO: 6861709 - DNA, 64 bp, Homo sapiens
caccgtgagctgcagagtaacctttgcagttactagtttatctgtaattttgcagctcaaagtg

SEQ ID NO: 6861710 - DNA, 106 bp, Homo sapiens
gcttgtgtacataaaatggcatatcaactcatcctttatagatgcgaggtatattttacttccagcatatatagagaatgagcggttcttatttatgcaaataagc

SEQ ID NO: 6861711 - DNA, 58 bp, Homo sapiens
ttctcttttaccacaataatcatcacaaataatcctgtttggaaggtggagaagagga

SEQ ID NO: 6861712 - DNA, 111 bp, Homo sapiens
ttttgcctatcggagagacgtgagttgttgtggccagaggacacattgtagaaaattgtctgtaaagacggccaccaacatgcatgttgcctttcccatcaagaggtagaa

SEQ ID NO: 6861713 - DNA, 60 bp, Homo sapiens
tacatcatggtgagcaggaggctcactactgagcacagttctaactgcctaccagatgtg

SEQ ID NO: 6861714 - DNA, 127 bp, Homo sapiens
cccaactgggggatcttcctgtaacatttttatctggtgctttcatagacaccatttgtgtttgccaataacagaattaaagtgtttgtggagccatagaattttatcagaacgtttaactttgagg

SEQ ID NO: 6861715 - DNA, 98 bp, Homo sapiens
tctattaaagaaatggaattcatcatttgaaaacttttgacaaagaaaatctcaggcctagtttacttgaatgatgaattctattgtttatttataga

SEQ ID NO: 6861716 - DNA, 77 bp, Homo sapiens
cttagaaaggctttatttgatctatatgccttgtgccaagaaccaggaataagaagatttgatgatagctcttcaag

SEQ ID NO: 6861717 - DNA, 65 bp, Homo sapiens
tactctcacccactctcccaccgcccagccctacgccaggcgagggagcagtgcggtgggcggta

SEQ ID NO: 6861718 - DNA, 82 bp, Homo sapiens
tttaagtaagccttatctctatgaatctcctggggcacttgaggctgctcacagtgacttacagagattgggcttcaatgaa

SEQ ID NO: 6861719 - DNA, 82 bp, Homo sapiens
ggcgccggccccagacgaggtctctggggaactccaggggtgggagagccaccctctccagcggcctcagggccccggtgct

SEQ ID NO: 6861720 - DNA, 59 bp, Homo sapiens
ttattgcctcatctgcataggtaaatcagagtggtcagcagtgcagggtgaggcagcgg

SEQ ID NO: 6861721 - DNA, 68 bp, Homo sapiens
acattgtcgtcaatggacacatagattcgggcaagtccacctctactggccatctgatctacaaatgt

SEQ ID NO: 6861722 - DNA, 55 bp, Homo sapiens
tgaccttcactgagcttcacctccttctctggagatgagctgtgtgtgagggtca

SEQ ID NO: 6861723 - DNA, 112 bp, Homo sapiens
tagccggcatgttggcacgtgcctatagccccagcttctcagaaagctgaggtgggaggatcacttgagcctgggaggttgaggctgcagtgagctgtgatcatgccgcctg

SEQ ID NO: 6861724 - DNA, 70 bp, Homo sapiens
tatacttgtcaacattttatccagattatcagtctttaaaaacaagtctggatgcttgtgatcaagttta

SEQ ID NO: 6861725 - DNA, 92 bp, Homo sapiens
cccattaacctgaagacaacaatgctgaactgaggaaagccaggtacttataaagcttttcatcacagtgtagttccttctagcttaagagg

SEQ ID NO: 6861726 - DNA, 100 bp, Homo sapiens
tgtagaatacaaagagttaagatgatgtttcttgttgtagaattaatcagattcatattagcagtagtaaatgtcatgttggcaccttttccttctcaca

SEQ ID NO: 6861727 - DNA, 60 bp, Homo sapiens
cattcttgcaccgtgatggcttttgacaaattaaacaaagggtgcatgtttgcaagagtg

SEQ ID NO: 6861728 - DNA, 72 bp, Homo sapiens
ccaggtgtggtggcactcacctgtaatcccagctactcaggaggctgaggcaggagagttgcttgaacctgg

SEQ ID NO: 6861729 - DNA, 68 bp, Homo sapiens
tgcagtttgcataacaagagattctaaattctttgaagttgaataactccatgatatgctttattgca

SEQ ID NO: 6861730 - DNA, 85 bp, Homo sapiens
gttgaggtgttctattttagccctttgatcctggaatgtcactcgagtgagcaccaggaaagaaggggccagtggattcttcaac

SEQ ID NO: 6861731 - DNA, 63 bp, Homo sapiens
gggaactttgtgcaagaattggaaagcaaccatggatggtcgctgtgtccagaattgcacccc

SEQ ID NO: 6861732 - DNA, 55 bp, Homo sapiens
tcagtcctccacacaggcaccccagggaggaggctgccttgggcagaggaactga

SEQ ID NO: 6861733 - DNA, 84 bp, Homo sapiens
ttgaagttgaaaagaagtttatttatgccccaatcctaaataatttatgagctggggcaccatgaattttaaaatagactttaa

SEQ ID NO: 6861734 - DNA, 130 bp, Homo sapiens
gaggaatacatgggaagaacgcagggaatttttagggcagtgagactattttatacaatactataatgttggatacatgtcatcatatgtttgtaaaaatccataaaatgtacgacacaaaagcaaactc

SEQ ID NO: 6861735 - DNA, 57 bp, Homo sapiens
cctgtagtacctcagaagtaccttttgtaaaaggtattgcacaaagagatgcacagg

SEQ ID NO: 6861736 - DNA, 70 bp, Homo sapiens
atgcatttgacagctgtacagagtaacttcctttagagggaaggattaaaatttgacagagtttgagcat

SEQ ID NO: 6861737 - DNA, 129 bp, Homo sapiens
gccagctaagaaaaacagatcagtgaaatgcatattcttcgtattcttaatttcagccctatccaaatgtttacagaatagtttgaagagatttgcagtttcttgttatcagtcttattaagccttggc

SEQ ID NO: 6861738 - DNA, 77 bp, Homo sapiens
agctgtgtgaccttgttcagattgacccctgtttttgagatatttcatctggaacaaggtaataatagaacatagct

SEQ ID NO: 6861739 - DNA, 80 bp, Homo sapiens
cctagaccttgagaggaagtttgtagaaatattgatatggtgaacaatgattccagcttgacttctacttaatattcagg

SEQ ID NO: 6861740 - DNA, 58 bp, Homo sapiens
ttggccaggttgggctttgcagccatggaaacaagctgtaggggaaagcgttggctga

SEQ ID NO: 6861741 - DNA, 63 bp, Homo sapiens
catctattttccaggatttgtagggtatatgaaacctcagattaagaactcctggactgggtg

SEQ ID NO: 6861742 - DNA, 55 bp, Homo sapiens
aaggtttctccgaggctatttttgtgaccaccattttagtctctgatgaggcttt

SEQ ID NO: 6861743 - DNA, 79 bp, Homo sapiens
cagaggggagctctgatatgaatgtctagctcttcctcgcagaggaacatgtgaaatctcatagttagtctctcttctg

SEQ ID NO: 6861744 - DNA, 61 bp, Homo sapiens
gcttggagaagatgatgctaacaaaatgtaatgtaattgtttagaagtaattttctccagc

SEQ ID NO: 6861745 - DNA, 101 bp, Homo sapiens
agtaaaatgactcctaataaaagctctgtatattgagtgcttactatgttccatgcatcctggtaagcacttcatgtacatgatctaatttagcacttact

SEQ ID NO: 6861746 - DNA, 65 bp, Homo sapiens
aagtggagctataggctcagatattaactaccatggagggctgagtgctgggtctgttttcattt

SEQ ID NO: 6861747 - DNA, 64 bp, Homo sapiens
gggaatggtcactttgggaactgggagcttagcacactaggctccaagtctcagagtgaagccc

SEQ ID NO: 6861748 - DNA, 96 bp, Homo sapiens
gatactccagtgcctttgcaatgggaaacaaacagcatttaaaggtgtagggaagaaaatttaaatcactgttcattccacacaggcaatgagatc

SEQ ID NO: 6861749 - DNA, 73 bp, Homo sapiens
ttattcagctgtgtatcccagggcctagtttagtatagcctctgcaaggtgcttatctatatttgttgaatga

SEQ ID NO: 6861750 - DNA, 80 bp, Homo sapiens
caatggtaactgtgtggtgctcgatatatttgtggtaatcattacatgattcatatcaaatcatcacatagttcaccttg

SEQ ID NO: 6861751 - DNA, 75 bp, Homo sapiens
ggaaaagttttgtgcagagaaggagcagtagttaaatcttagctctgccactgtttctgtgatacgagacaagcc

SEQ ID NO: 6861752 - DNA, 74 bp, Homo sapiens
gtgtagagcttgtgtgtactggttatgggcacacctgtctgtgtgcgtcctgtgcgcacactgctgccctacgc

SEQ ID NO: 6861753 - DNA, 58 bp, Homo sapiens
aagagcactaacagagctgataggacctagattgcctgacagcaactgtagtcctctt

SEQ ID NO: 6861754 - DNA, 117 bp, Homo sapiens
gggtgggccaacagcagagggaaagcagtatgaaaggcaataactctgagtttcttctcattatgtgttactgcctttgataggctggactctccttttttgaaggtgtaagcaccc

SEQ ID NO: 6861755 - DNA, 77 bp, Homo sapiens
ctaggatacaaccaggtgtttaagatccactcattgatttattaaatgaatcttaattgagcacctgggtgttctgg

SEQ ID NO: 6861756 - DNA, 59 bp, Homo sapiens
gaggttggcgccctgcctggcccagagcagccaggcccagcaaccagcgccaaagcctc

SEQ ID NO: 6861757 - DNA, 70 bp, Homo sapiens
ggtgactggggcccgagccttgggccagctgcaggcggggtggtaggtggggtcggtgttaccagtggtc

SEQ ID NO: 6861758 - DNA, 65 bp, Homo sapiens
aattctgagactactatattcagatccttgtcttgagacattgagaaatacagtgttatagaatt

SEQ ID NO: 6861759 - DNA, 82 bp, Homo sapiens
atcttgactgagaatggcatatgattttgttttatcttattttagagagaaacatttagattatatgtcttttatctatgat

SEQ ID NO: 6861760 - DNA, 68 bp, Homo sapiens
ctgggccttagttatcacacagctctacataaatcaagcaagagggctggtcaggaaactaggctcag

SEQ ID NO: 6861761 - DNA, 58 bp, Homo sapiens
gcccaggaagccaccgggaagttttgccggagctgatttctaggggattttctggtgc

SEQ ID NO: 6861762 - DNA, 61 bp, Homo sapiens
taacatcttaactggatacttctgactcagagtctcccaggaggttgcagtcaagatgttg

SEQ ID NO: 6861763 - DNA, 82 bp, Homo sapiens
atttcagtggctttttttatctaacttgtcatccatctaaattcatatttgcagcttagtagggtaaagtttgccctgaaat

SEQ ID NO: 6861764 - DNA, 57 bp, Homo sapiens
agtcctgccccctggaacatccaaaccccctggtccaggttttctgaaggcaggact

SEQ ID NO: 6861765 - DNA, 55 bp, Homo sapiens
cttgatggagcgctgaattccccgggtgctgggccatcagggttcctccatggag

SEQ ID NO: 6861766 - DNA, 115 bp, Homo sapiens
ttaagtgaaccatgattttattctttctacttctgtctatgttttctctcttcatgttctggggacagaggcaaactagcagatgctggtagatgcagtagcttcatttatttga

SEQ ID NO: 6861767 - DNA, 83 bp, Homo sapiens
ggcctggtcccagcccggggtcctcagccacctcggttctcaagagagagctgccaggcccctgagaacccgctggccttgcc

SEQ ID NO: 6861768 - DNA, 55 bp, Homo sapiens
tggaaggtgtggcaggtctagtgggcaggtgagctggccctggccacggctgcca

SEQ ID NO: 6861769 - DNA, 55 bp, Homo sapiens
gatctttgacacagtggattaggtattatctcatttccatatgtggcaaatgatc

SEQ ID NO: 6861770 - DNA, 78 bp, Homo sapiens
tgctcctcatttacctcagagggatgttacaggcattcattttgaaagcctataaagctttttgagcaaggaggagta

SEQ ID NO: 6861771 - DNA, 79 bp, Homo sapiens
gtggttctggaaagaaggctaaggtcccacagggcagcaacttcctggaaggcctttgcctttagagttctagctttgc

SEQ ID NO: 6861772 - DNA, 66 bp, Homo sapiens
gctggaattgcataatatgtccttctagttttaaatatgtaggacaaataagcaataatattcagc

SEQ ID NO: 6861773 - DNA, 62 bp, Homo sapiens
agagggtgggctcctatctgggttactggcgtaatgtccctgccctctgggatccctcctct

SEQ ID NO: 6861774 - DNA, 76 bp, Homo sapiens
ggcagcagtgtaaacagtgtgtgactaattctttcttttaaggaaagcagttttatgcgattgtttccctgctgct

SEQ ID NO: 6861775 - DNA, 68 bp, Homo sapiens
gctacctgggaagtgggacctgagggctgaaggattgtgatgaactctggcctgcttcctcaggtagt

SEQ ID NO: 6861776 - DNA, 77 bp, Homo sapiens
ccctctttctacagccaggggtctctggggttcaggtagctgatcccaatctttcctgctcctggcctggaagtggg

SEQ ID NO: 6861777 - DNA, 115 bp, Homo sapiens
ggggatgttggtgagagggctcattcccctggcccagctcagggtggcggcccggtggtgccagcatcagcctggctcaggccagtagactagaggcctggcaccagcactaccc

SEQ ID NO: 6861778 - DNA, 113 bp, Homo sapiens
cagactatgaattattttgaacgattgataattttggttccaggttggcccagtaataatttattaattcaacttgacaacccaaattactggtatcacttattttatttttg

SEQ ID NO: 6861779 - DNA, 65 bp, Homo sapiens
gtcttttgtcagggatcagatcggtatcgggacctcctgctgcctttgcatttcctgcaactgac

SEQ ID NO: 6861780 - DNA, 57 bp, Homo sapiens
gtggcttctgaacttgttgggaattctgcatttccaaactgccaattcagaagtagc

SEQ ID NO: 6861781 - DNA, 74 bp, Homo sapiens
tatgtgaatgttaaaatcagacattgttcccttttctttacaacaacaagtctttggttttggctatatacatg

SEQ ID NO: 6861782 - DNA, 103 bp, Homo sapiens
gcgacctccctcaggcttctgtgcagcttctccatctccttgtattcactcccgacatctacaggagagcagaaagctcacatcaggacttggtgtccgttgc

SEQ ID NO: 6861783 - DNA, 63 bp, Homo sapiens
gcctgagaaggcccagtcaaggggctagacagttctgtttctcctgagggccttcttcctggt

SEQ ID NO: 6861784 - DNA, 67 bp, Homo sapiens
agcagagtcttcagcagccttctcaggaagcgggatccctgccctccccggtagctgaggacctgct

SEQ ID NO: 6861785 - DNA, 88 bp, Homo sapiens
cagatccctctaagtgagttgtctgaccctttcctgggggcagattttgggtttgggggaagacagacccactacatgagggagcctg

SEQ ID NO: 6861786 - DNA, 90 bp, Homo sapiens
gctcttcttttcagatttctttgcttgtgtttttagcctctatcacttcatagtttcaaaatttggcaaataatttgagggtgaagcagc

SEQ ID NO: 6861787 - DNA, 89 bp, Homo sapiens
agttagataaagcccctgatagttgctaccctgcaaacttaatgtttctctagcagcttgcacacatattagacggtaaatatttcact

SEQ ID NO: 6861788 - DNA, 110 bp, Homo sapiens
ggctcccaagtcaatgaaaatgcctgatcagctatggaattcgtaacattattcactatgaatcaaagttcatttgatcaccactggcattctggatattgacctgagtc

SEQ ID NO: 6861789 - DNA, 77 bp, Homo sapiens
ggagaagttttgtgtctagctcagggattgtaaacgcaccagtcagcaccctgtcaaaatggaccaatcagctctct

SEQ ID NO: 6861790 - DNA, 66 bp, Homo sapiens
ttttcaaaattcaggcagccctgggtgcagagccttggcttgggcactgtgggttgtctgtgggaa

SEQ ID NO: 6861791 - DNA, 71 bp, Homo sapiens
ctgagactttcatgtgcttttatatatccttgaaaaaaccccataggagaattagcatatggacttttcag

SEQ ID NO: 6861792 - DNA, 81 bp, Homo sapiens
gctaaaatggacattctcaaacaagtggtttgataagaagtgctcttgggaccagtgtctgtgagaaaagcacgtttgggt

SEQ ID NO: 6861793 - DNA, 82 bp, Homo sapiens
gtgatgttactaatgtcattggtaaagattaggttgaaggcatcttctttccttccagggtttttgccaatcaaatatacac

SEQ ID NO: 6861794 - DNA, 70 bp, Homo sapiens
caatgaatgaacaaacgtgtgctccatgctttgacactgttggtgggagtgtaaattagttcaaccattg

SEQ ID NO: 6861795 - DNA, 81 bp, Homo sapiens
cagttgaaagatcatgtggctgcctgtctagccctccactgacagaaatacaaagccagccattttcaaatgatctgactg

SEQ ID NO: 6861796 - DNA, 60 bp, Homo sapiens
ttaggaggaaaatttgagtcacacaaaacatctcttgtagcattcatttttgccttctaa

SEQ ID NO: 6861797 - DNA, 93 bp, Homo sapiens
aggacttggccttgatgacagggtggctggaggaatcagaacggtcagaccttctttgacctgcgggcacctttagttggaatggtcaggcct

SEQ ID NO: 6861798 - DNA, 74 bp, Homo sapiens
cagacaatgaagaagccaattggtaggctgagttaaactgtggcagtttgtctgatggctgtttcaatggtctg

SEQ ID NO: 6861799 - DNA, 93 bp, Homo sapiens
ggtttattgggctcaagagttctgcaggctacacaggaagcatggcgctggcatctgctcggcttctggtgaggcctcaggaagtttacaacc

SEQ ID NO: 6861800 - DNA, 120 bp, Homo sapiens
ggttcttccttgttcaccagtgtccgggacatgttggtcaaggcttttgttcgaatagaggaagggagagcaggagctgtgtatgcatcattctgaaccactttggtgagagggagggcc

SEQ ID NO: 6861801 - DNA, 72 bp, Homo sapiens
cctcctggccatggagaaggtgaagccaacagctggaggtagaggctgagccaattccttgagccagtgagg

SEQ ID NO: 6861802 - DNA, 84 bp, Homo sapiens
atgcatcattgtcactcagagtccatagtttacagtagggttcactcttggtgttgtacattctgtggatttggacgaatgtat

SEQ ID NO: 6861803 - DNA, 62 bp, Homo sapiens
tgcattggtggagaagttacaggctatttggagacacatggcatcatctttcttcattagca

SEQ ID NO: 6861804 - DNA, 57 bp, Homo sapiens
ctgtgcccctcctatattcattataaagttttacattgaagatgggtagaggcacag

SEQ ID NO: 6861805 - DNA, 126 bp, Homo sapiens
gactggctttgctgcagcaccttagcctatcttcactaagagcatcctatgtatgacttatatcctcaaagttgctctgtggtccaagatggctgcttgagccacctgtgtgtgacagcaccagtt

SEQ ID NO: 6861806 - DNA, 108 bp, Homo sapiens
agggagcaaaggtcctctctggtgagggcagggagtgtggggagcagctgtccaagaacagccctggcacctcgttgcccagccacagcccaggattccatgtttcct

SEQ ID NO: 6861807 - DNA, 55 bp, Homo sapiens
gcttgttgtcaatgttaattgttcaggtaaggcttacaaagtattgaggacaagt

SEQ ID NO: 6861808 - DNA, 83 bp, Homo sapiens
accttgagcaaagttaccttacctctctgtacttcagtttcctcaagtgaagcacagagaggtaaagtaactttgctcaaggt

SEQ ID NO: 6861809 - DNA, 74 bp, Homo sapiens
tccatttcaaataggtatggcttacataacttactagattttagacttttagtgatgtttggcacatgaatgga

SEQ ID NO: 6861810 - DNA, 77 bp, Homo sapiens
aggcctgcccaggctgggggtggccatcatcacggggcagggcagggtcaagggtgaaggctcctccaggaaggtct

SEQ ID NO: 6861811 - DNA, 56 bp, Homo sapiens
gggatatcattgagcccaggagtttgaaaccagcctgggcaacatagtgagatccc

SEQ ID NO: 6861812 - DNA, 71 bp, Homo sapiens
cactgcagaaggaggaggaaatccatttatctcaacaagagaagcttggctttgtcttctgtctgcttgtg

SEQ ID NO: 6861813 - DNA, 66 bp, Homo sapiens
gaaagaatgctgggagccatcttgaataaatggaaagttagacaaaatggcattcagcaacctttc

SEQ ID NO: 6861814 - DNA, 123 bp, Homo sapiens
ccatgtggaaaaatttcaaatgttttatgaagaccttccactcttaaggaggtagagcatgacttctcactccttaagtatgggctgtgcataatgacttgaatatgattccagtctacatgg

SEQ ID NO: 6861815 - DNA, 119 bp, Homo sapiens
ctatgtagaattaatctttattctttaactgtgcctagcagagtatcttgcaaattagggaacgtttttggaaacaaggtaactttgcaaggcttggaagatgagtagagtttgcatag

SEQ ID NO: 6861816 - DNA, 111 bp, Homo sapiens
cctgagatcacagttcccatcctcccccagagagtgcccaagcctggcagggccaagatggggatggtctaggccaggactggagtaggggcgggatgcctgcttcttggg

SEQ ID NO: 6861817 - DNA, 70 bp, Homo sapiens
gttgttttcagggtgtcattcacaggcattaacttatgttgtgatattttctgcaccttgacctcacaac

SEQ ID NO: 6861818 - DNA, 59 bp, Homo sapiens
atgcctgggcctcatcttcaatgagtctgattcagtaggtcaaggtggggcccgagcat

SEQ ID NO: 6861819 - DNA, 128 bp, Homo sapiens
tctgggggagtggggggagcctgcccggggctgtgggggagcctgcccggggctgtgggggagcctgcccggggctgtggggggagcctgcccggggctgtgggggaggctgctcttcactctcagga

SEQ ID NO: 6861820 - DNA, 81 bp, Homo sapiens
tcatggattcgtttgctagattttgaattcagtgatctaattcaagagaattcagttatctaattcaagaagatcaaatga

SEQ ID NO: 6861821 - DNA, 93 bp, Homo sapiens
tggatgaaaggcttgcaagggaaaagcaatctatcctagggttcgctctgtggacttgaaattacttttcaaccttttcttcttatttatcca

SEQ ID NO: 6861822 - DNA, 55 bp, Homo sapiens
ccccagcccccagcctcaccctcatagaccaggagtcagaggctgccagctgggg

SEQ ID NO: 6861823 - DNA, 60 bp, Homo sapiens
tgtgatcctgggcctggtacctgaagctgaggactcagttccagtgcccaccctagcaca

SEQ ID NO: 6861824 - DNA, 67 bp, Homo sapiens
ttagtggcagttttatatttcatgtgtaatctgtgtttatatttgcaagtatcaaacatgtcagtag

SEQ ID NO: 6861825 - DNA, 76 bp, Homo sapiens
ctgtcaagttgacatgtgctgtctcttaaattactcttcggtatgagaagcaaagttgcatgtttatttttgtcag

SEQ ID NO: 6861826 - DNA, 62 bp, Homo sapiens
gttatttcagagtgtattctgcagttgcagaagtctcgtggctgtcatgaactctgggaaac

SEQ ID NO: 6861827 - DNA, 68 bp, Homo sapiens
agcacatgctccatacagaatgggtcatgcagctttcaaagagcagcccttcctcaaggagctgtgtt

SEQ ID NO: 6861828 - DNA, 96 bp, Homo sapiens
gtgttcctgactttctctgtgcttattgttcagatagagatgattataatttcatttgtatttaacggtaagtcttccactctctagtctgaacat

SEQ ID NO: 6861829 - DNA, 66 bp, Homo sapiens
ctctgccagtcatattacccaatactttaacatccactagatattgcagaatgtgagttggcagag

SEQ ID NO: 6861830 - DNA, 112 bp, Homo sapiens
taggtcatagcaaagaaatgaatggtgtagctgtcagtcataagggaagtctggggaaaacagccctggttgctggcaactgactagatgcgtttgctttgtgctgacatta

SEQ ID NO: 6861831 - DNA, 115 bp, Homo sapiens
gcttggaaacttactaaaaatataatacaaattattggatcccacaccagacttactaaatcagcaattctgggagtgggtccaaggaatctgtactttatcaagcctaccaggt

SEQ ID NO: 6861832 - DNA, 63 bp, Homo sapiens
caaaactagattaccactgctagaatttcagtctggtctgtgtctgagctagtcttagttttg

SEQ ID NO: 6861833 - DNA, 73 bp, Homo sapiens
gaaacaacaattgggacccatctagtgtgtggtgtgaaaacaacactgtctgggactcaggagtctttgtttc

SEQ ID NO: 6861834 - DNA, 69 bp, Homo sapiens
gtggccctgggcgaggagccggcccgaggtgagtgtctgctgcccactccccttcctccccagggccat

SEQ ID NO: 6861835 - DNA, 92 bp, Homo sapiens
acacttactatatcaaagcacagggctgtgctgtgcattttagcatctgccaggagaattacaatgtaaggcatggttcttgttgtcagtgt

SEQ ID NO: 6861836 - DNA, 63 bp, Homo sapiens
tgtgggacaaggatgaagatattaaaaacgctgacctctagtttacaatgtccttggaccaca

SEQ ID NO: 6861837 - DNA, 89 bp, Homo sapiens
gactcctatggcaggtgtgtctcccaagaaggcccacccctgtgagatgtgtggcccgatcttgggagacattttgcatgtggcagatc

SEQ ID NO: 6861838 - DNA, 74 bp, Homo sapiens
ttactccatcctcaaactaaatttcctgaaaaagattagttagttcagaattttggtttggttggttggtttaa

SEQ ID NO: 6861839 - DNA, 91 bp, Homo sapiens
tgtgcgcatctgagcctccttttcctcatctttatcaaggaattaataattcccacctgaaaaaggtagggcctgaggcaaatgcgataca

SEQ ID NO: 6861840 - DNA, 67 bp, Homo sapiens
gctccttctgcccatctgcagacatgcgtgtccttcaagccagtgtccagaatgggcaaaaaggagc

SEQ ID NO: 6861841 - DNA, 57 bp, Homo sapiens
cagagtcctcacctgtattcgtttatttctccagagatgtgtgctagaggactactg

SEQ ID NO: 6861842 - DNA, 89 bp, Homo sapiens
tcagaacatctgcaccagtaacatgaagagacatggattggtgcggaaaatgtgcctctatgtcaattccatgcctggcagtggactgg

SEQ ID NO: 6861843 - DNA, 79 bp, Homo sapiens
cttctttgtgtatttcctgaaggtaaggacaaagtccatcttgttcccaggacataacacaaaatctgataaatagaag

SEQ ID NO: 6861844 - DNA, 65 bp, Homo sapiens
tctgtctgtggagccctcataagcagcatcctgccttagagatgggttttacttagaattacaga

SEQ ID NO: 6861845 - DNA, 74 bp, Homo sapiens
ctgttatttggaaggtataaacacaatttggaggtattttttaaaaatatttgctgtttgttctccagaaacag

SEQ ID NO: 6861846 - DNA, 58 bp, Homo sapiens
ggtatggaggtcacatcactcctttgcccttaggcttgagtggaacgctcttcacacc

SEQ ID NO: 6861847 - DNA, 120 bp, Homo sapiens
tggcgacaaaataatacatgtttcgggggaagcagatattgtgggagtggggaagatgggcaattgggaccactggcccaagcatacagtatttgctctccgcatgctgccactttgcca

SEQ ID NO: 6861848 - DNA, 68 bp, Homo sapiens
gagtgagacagtatactgagcaggaaatgaatttgccctttgctgtgataggtcatactgtctctttc

SEQ ID NO: 6861849 - DNA, 64 bp, Homo sapiens
gctgtttggccagcctgactgaacctgtcaacagctagaaagtgaggtcagctgggctagaggc

SEQ ID NO: 6861850 - DNA, 63 bp, Homo sapiens
agctgaccatattgtgttgtaactgtgtaggccaatatagcaaggacataatatgctacagtt

SEQ ID NO: 6861851 - DNA, 58 bp, Homo sapiens
gtctaatgccctttggggatataacagatgttcgactgcccaaggttggcagctgggc

SEQ ID NO: 6861852 - DNA, 103 bp, Homo sapiens
gtgtttttctacaagaactttctcagagaggttggtgataagaatatcttattagtatttttatactctgctactctagtggaaaatctattctgaaaaacat

SEQ ID NO: 6861853 - DNA, 98 bp, Homo sapiens
ggcagaaattagatgggtcgttgtcctggaaactagaggatttatgagacatagcatctaacatcttaggactctgattcatctatgttcataatgcc

SEQ ID NO: 6861854 - DNA, 66 bp, Homo sapiens
ctggaggagaaggacaaggggccagccacacagcctgggcaggggcctctgctttccacctttcag

SEQ ID NO: 6861855 - DNA, 109 bp, Homo sapiens
gcgtcctcctctctgctgccccgtgtgttttctcctctgggagacctctccccacagcaggagctcctcagaagagggtaacacatgggtgggggcttgaggaggatgt

SEQ ID NO: 6861856 - DNA, 65 bp, Homo sapiens
ggtcacggttgacattttgttaaatatgatactcactatagtgaacattctgtcaattgatgacc

SEQ ID NO: 6861857 - DNA, 55 bp, Homo sapiens
ttagtgggtctgatttatcctggactgccctgtgcttggagatgcagacctctga

SEQ ID NO: 6861858 - DNA, 55 bp, Homo sapiens
ggctgccctctgctgactgcaaaggcaaaccacatgcagatggcctgggcctgcc

SEQ ID NO: 6861859 - DNA, 55 bp, Homo sapiens
cgggcccagagtctgcaatggagtcttttctagactcagccaggctcggagctcg

SEQ ID NO: 6861860 - DNA, 102 bp, Homo sapiens
gacaaataattaccctctttttcctggtagaaacttctgtttacacggaaaattttctctaagatggatttcttccagtgagaatttgagcaatttattttc

SEQ ID NO: 6861861 - DNA, 73 bp, Homo sapiens
agcaggctgcagaggacagggatttagattgggaaactctttgtattctatcaagctgtcttctttactggct

SEQ ID NO: 6861862 - DNA, 74 bp, Homo sapiens
agagtcttgagggttctgccccaggcaggtggttgcatttgcagcctggctgtggcggtgctctcaggcacact

SEQ ID NO: 6861863 - DNA, 89 bp, Homo sapiens
atgaggaatttggaggttatgcattctcgcagtctggggatctgtgatagtcactctgttaggtgtttttgagccaccaggttcctcat

SEQ ID NO: 6861864 - DNA, 74 bp, Homo sapiens
ggtgtcagacctggagggaagttctgacttgggcccttatgcaccaagtcaggtgagactctctgggcctcact

SEQ ID NO: 6861865 - DNA, 64 bp, Homo sapiens
acccacagaacctgtgacaacaaccatgcatgtttgttgttttaagtcactaagttttgggggt

SEQ ID NO: 6861866 - DNA, 56 bp, Homo sapiens
gcctgagtctattctgtgtgtaaggtgaggtcttttcaatcattagaatctcaggc

SEQ ID NO: 6861867 - DNA, 83 bp, Homo sapiens
agctcacagctgcaggctgtaataggtttccagagaccacagccctatgcttttgaaatcttccacagcccaagctccaggct

SEQ ID NO: 6861868 - DNA, 75 bp, Homo sapiens
gatttgggacaaaggagaatcagcgtttcacgttcaaaattgaactgggaagctgttttgcttttaagttaaatc

SEQ ID NO: 6861869 - DNA, 128 bp, Homo sapiens
ccacgtggtgggagcggggatgatctgggaactgcccggctccagggggcatccacacagcctacggctcggatggtgcccctggatgtgtgctgttcggcttccaggcctgggactcccccaaatgg

SEQ ID NO: 6861870 - DNA, 56 bp, Homo sapiens
ctggaaagtcaggtcagaaactggggcagagcctctgctgaaaatgtgctctccag

SEQ ID NO: 6861871 - DNA, 70 bp, Homo sapiens
cctctgtgtgaaccttcggctcagttagaagcttcctccttgggaagggtttggaaagccgagatagagg

SEQ ID NO: 6861872 - DNA, 80 bp, Homo sapiens
atagaaactgatttggttaatttaggcttgcatttccttagtgttggaaatgtacttcctctgacttattcagtgtttgt

SEQ ID NO: 6861873 - DNA, 63 bp, Homo sapiens
ttgtctgtttgtatactggtctaatccacatcggatgtaccaggaggaggacaaattagacaa

SEQ ID NO: 6861874 - DNA, 59 bp, Homo sapiens
gggagccggacacagtcactcctgggagccgagttcaggctctctctggtctggatccc

SEQ ID NO: 6861875 - DNA, 122 bp, Homo sapiens
tctaaataatgtgttgtattcataaaaatcttgcccttccaaatttctgaaagcatttacgaacattaattaagcttcaggatagtggtgagtggcatttgttattactctcatctttcaga

SEQ ID NO: 6861876 - DNA, 60 bp, Homo sapiens
cattagcattcagtgacttgtaagagtaaacttccttctagatagtcctgtgtgcttatg

SEQ ID NO: 6861877 - DNA, 63 bp, Homo sapiens
tcccccgtgtgcatcgctggctgatcccagttccaggggtgtgagaagggcatgcagggagga

SEQ ID NO: 6861878 - DNA, 63 bp, Homo sapiens
gtcatgtgctaagcaggcctctggctcttgtttacctctatgaggcctcttcatggccatgat

SEQ ID NO: 6861879 - DNA, 60 bp, Homo sapiens
tctgaccaggctggctcagggcttcctggagtgggcagctctggagctgggcctggcagg

SEQ ID NO: 6861880 - DNA, 55 bp, Homo sapiens
tgaggtgataataactccctgctattactagcccctaggggcattgtatcaccca

SEQ ID NO: 6861881 - DNA, 56 bp, Homo sapiens
ggagaagttcagtcgtgatcacaggaaacacagtccttgctcatggggacttctcc

SEQ ID NO: 6861882 - DNA, 82 bp, Homo sapiens
caaattgaattcatctttgttctgtaaacttttcaaatctgttatgaggatgaaaagacataacaaatgtggcagcaatttg

SEQ ID NO: 6861883 - DNA, 77 bp, Homo sapiens
gtgtattgattctttcatggatcatgccttttgtgtttgttcctcagatgcatatgaattggtgagagagtatatat

SEQ ID NO: 6861884 - DNA, 68 bp, Homo sapiens
agaagatcatgcatatttgtagtagttcaataagaattgagctaaagcttgtgtttatactatcttct

SEQ ID NO: 6861885 - DNA, 69 bp, Homo sapiens
gtcaggaaggacccacgaagtcactggatgcagcccgggctctgtggcttctgcttgggcctctcagac

SEQ ID NO: 6861886 - DNA, 85 bp, Homo sapiens
agcttgttcttacactgtatagtcttgtggcagttatcatagcttatagttacattacttgtgcagttgttagtttgcctgagct

SEQ ID NO: 6861887 - DNA, 55 bp, Homo sapiens
ctttggctgacaggtttctggtccctgaatgcactcagaccaatgtcagacaaag

SEQ ID NO: 6861888 - DNA, 58 bp, Homo sapiens
tggattcaacaaatatttcttggatccctattatgtgccaagcaatgttgtgaatcta

SEQ ID NO: 6861889 - DNA, 115 bp, Homo sapiens
cattgagaaccttcctaacatacttcagtacttcccattctgagctctacaactgtggacagtcatatagtttaagagaatttgggggtgacagtgtgttcagggagttgcagtg

SEQ ID NO: 6861890 - DNA, 55 bp, Homo sapiens
gatctgattaccttactcctcaggcagaatcccctggagaggctgggaacaggtt

SEQ ID NO: 6861891 - DNA, 79 bp, Homo sapiens
gaaagatgcactttttctcagaaggattggtttcccaaagggagagccttagcccttttctgagtagaagacctctttc

SEQ ID NO: 6861892 - DNA, 58 bp, Homo sapiens
gtaagattagtgagtcacagtggatatcatttatttccagtttgactcctgattttat

SEQ ID NO: 6861893 - DNA, 87 bp, Homo sapiens
tggctgctatgccaatatcccttgaagtggtgctggtttggaagctgtgactagggttaagtgaggtcgggggatgtggggctgcca

SEQ ID NO: 6861894 - DNA, 67 bp, Homo sapiens
atcagctgtgtcagctggagtcctgggaagaggatgacattgctgcttccagctgggaacagctgat

SEQ ID NO: 6861895 - DNA, 59 bp, Homo sapiens
cattgagtcctgacccccaggacctcagaatgtgctgtcttggagatagggtcttaatg

SEQ ID NO: 6861896 - DNA, 59 bp, Homo sapiens
tgttgagtgtggtctaaacttgggaagttcctccagttattctagttccacatctcaca

SEQ ID NO: 6861897 - DNA, 78 bp, Homo sapiens
ggctaaatggtatttgtcaagcatagtcttttagcagtagttaagaatgtaaaactgtgtgacactataccaatttcc

SEQ ID NO: 6861898 - DNA, 71 bp, Homo sapiens
ctcataaagacctcttgtggagcaaagtctgggaagaagtccctgggctgctttgggatggtccggatgag

SEQ ID NO: 6861899 - DNA, 98 bp, Homo sapiens
ctagcagagggagagtgagctggagggtgagcctcatctcttaagtgctttcacttggaaatgacacacatcatttctgctcactccccattggctag

SEQ ID NO: 6861900 - DNA, 77 bp, Homo sapiens
ccccagaaccacgggtctgccttctgtatgggggacatccttggtgaggaagtggtcaggcatccgtgaccctgggg

SEQ ID NO: 6861901 - DNA, 129 bp, Homo sapiens
aatgtctgtttcattatcattatctgtttgtcagagtcacaactacatccacactttgttatgcccagaagcatcactactgacagagatgtgtaagtgacattacagacaacacaggaaaatccagtt

SEQ ID NO: 6861902 - DNA, 84 bp, Homo sapiens
gtgtgtgtgtgtgcacatgtgtgtgtctggttgtgtgtagaagagtgcaggtgactgagcataaatatgtgtccacatagatac

SEQ ID NO: 6861903 - DNA, 80 bp, Homo sapiens
catgttctctgggcaccaaatctgagctacttatgacttcctgatctaggacaggagcaggctgagagtccaagaaggtg

SEQ ID NO: 6861904 - DNA, 57 bp, Homo sapiens
acattcctgacagcaagtactgtactttcagtagagtacagtgaggtgttaggatgt

SEQ ID NO: 6861905 - DNA, 84 bp, Homo sapiens
cctgtgcatggttacttgggtcccacctttctctcaggttagaaactcaagcatcctgagctgggactcagtagcaagaacagg

SEQ ID NO: 6861906 - DNA, 77 bp, Homo sapiens
tggagctttccagggagagccgctgctccacatgtgtgctgtgtggccatggctgtccctgtacactaaagcctcca

SEQ ID NO: 6861907 - DNA, 104 bp, Homo sapiens
gagccagcgtgcagtgtctggaaaatcacccgcagcccaggcccttctgcaaaggatggggcctggaagggcctcgggcgtgggaccgcactccgctcgggctc

SEQ ID NO: 6861908 - DNA, 87 bp, Homo sapiens
gaggcaacacaggtagggaccactccgacatgtaggggctgccctccaagctccctgtcctgagttgtccaaacttctgtctgcctc

SEQ ID NO: 6861909 - DNA, 66 bp, Homo sapiens
atatggaagtgttgtatctttttaatagatacatagtaatctattataaggatataaaatggatat

SEQ ID NO: 6861910 - DNA, 111 bp, Homo sapiens
tcctctggttctgtagagctgacaattcattaatgtgaggtagtcaataacaaatatattttatgtcaagtggtgatgggttctatgaagaaaaatgactcaataagagga

SEQ ID NO: 6861911 - DNA, 60 bp, Homo sapiens
gacatgtctataaaataatttcagtaaaaaccattacatgggattgttctgtgacatgtc

SEQ ID NO: 6861912 - DNA, 104 bp, Homo sapiens
attataatacagtctcttttcttcttagtatctctccaagcccttgttttaaaggttttcacaggaagtatgttagagagaaatcagactggaattgttatgat

SEQ ID NO: 6861913 - DNA, 93 bp, Homo sapiens
ggctgggcagaaggcgggtgtgggacgggtgagtggccagctaaaagtgattggcagctgccatgtccacgtgctccgagcttggaaccagct

SEQ ID NO: 6861914 - DNA, 55 bp, Homo sapiens
ctcaggctggtttgggttgttttctgaagtcagaggccaaactcaaggctctgag

SEQ ID NO: 6861915 - DNA, 65 bp, Homo sapiens
cagcttgttttatttggggaccagcaagtgggtgatattttgagaacttcaggtgatacaagctg

SEQ ID NO: 6861916 - DNA, 91 bp, Homo sapiens
ctgaaatgggagccagtgatgggatcagaggttgttaattatactagtaatcaactgagccctggttctcaaagcctgttccctggatcag

SEQ ID NO: 6861917 - DNA, 67 bp, Homo sapiens
ctcaagggtgtgttatacatcctcactctcatagagaaagatctgaatgtaacacatgagctttgag

SEQ ID NO: 6861918 - DNA, 62 bp, Homo sapiens
cccctgcccatgatccgggactagaggagctataaatccagtcagtgcgggatggtcagggg

SEQ ID NO: 6861919 - DNA, 86 bp, Homo sapiens
tgctaggcatctgagcttggcctgaggatattcaccagcatgattgagaaaacatgcttgtcctcaggaaggcccaagtctaagca

SEQ ID NO: 6861920 - DNA, 59 bp, Homo sapiens
gcaagtatgaatcaaagactatctgtaatcagtgggttaagacagtcattcatgcatgt

SEQ ID NO: 6861921 - DNA, 126 bp, Homo sapiens
gttcagtcttaatgaagttcttagttcccagagtgcgctgtattaaaagtccagattgctaatcactttaccaaagtacaggagtatctttacctgagggaagtaataacgagcttgaacctgaac

SEQ ID NO: 6861922 - DNA, 70 bp, Homo sapiens
attcttgcataaagattttattgcataggttataggataaaatgcaagagaaatgttttgtggaaagagt

SEQ ID NO: 6861923 - DNA, 75 bp, Homo sapiens
tttccatttgttatgttctaggatgtgtgtgcataacaagatgtacaatgtaattctgattatgttaaattgaaa

SEQ ID NO: 6861924 - DNA, 78 bp, Homo sapiens
atggtaacagttattatcacattagtgcccaagttatgggagcaatctccactagatgataatcagctggatcatcat

SEQ ID NO: 6861925 - DNA, 101 bp, Homo sapiens
tgatgttcatggatatttcgatgaagagtgagatattcctcattacaattattcccatgcgatgtttatttcattctttatcaggagctgttttgtcatca

SEQ ID NO: 6861926 - DNA, 89 bp, Homo sapiens
tcattagccctattttacagatgtggaaagtgagccttagagaagtaagtaattgccataagtcacacatctgagaaataatgaagtga

SEQ ID NO: 6861927 - DNA, 66 bp, Homo sapiens
gcttcctggctcctctacacacccaaattgctaatcaatgctgcaatggcaggagccactggaagc

SEQ ID NO: 6861928 - DNA, 59 bp, Homo sapiens
ttttgttcaactctgctatgctaatgtatccatagtcaagcaggtgctgttggaggaaa

SEQ ID NO: 6861929 - DNA, 77 bp, Homo sapiens
tctgaggggtttgatcaacatgtcataaagtgaaaagaatcatgtctgttttgcaatgagatgcttgtcacccttga

SEQ ID NO: 6861930 - DNA, 59 bp, Homo sapiens
gagagcctctgtgactcacaggtcacacatccgtgaagctgtccttgataggggcactc

SEQ ID NO: 6861931 - DNA, 63 bp, Homo sapiens
gcagtatgtgcttaggagtcagaacggtgtggaaatcacagtctttttcttaagtagccacgc

SEQ ID NO: 6861932 - DNA, 127 bp, Homo sapiens
ccctgaaaaactatcatagaggctttttggacgtacacattagtgaggtattttgatatatcttcaaatactttatatacttcaaaactttaatgtggtatagctgagattctatattgatataggg

SEQ ID NO: 6861933 - DNA, 81 bp, Homo sapiens
gagggttggtttcagaggcttgaagcccaagccgtttccaccccatggcctgggttgttcagctgttgtcttccgttcctc

SEQ ID NO: 6861934 - DNA, 70 bp, Homo sapiens
cccacagaacctggaccttttgggtattgtttcagtggaacatgcctttcataagttcagttttcttggg

SEQ ID NO: 6861935 - DNA, 79 bp, Homo sapiens
agagaaataaggatttctcatttgtggattgaacagactcttctaaaacaaagttcaagtttcacaagaaaatttctct

SEQ ID NO: 6861936 - DNA, 64 bp, Homo sapiens
gcacatcgggcagcacgtttcaggaggattgttagacactctcaacctccatcgtgtgtcttgc

SEQ ID NO: 6861937 - DNA, 82 bp, Homo sapiens
aaggaattaatgacacatataaggaattgatcgactaaggtagagttgagaacagttaacttcatatgatcattaatccctt

SEQ ID NO: 6861938 - DNA, 121 bp, Homo sapiens
ccctcttctccctagtgacacacatggtcacatcagagtggtggcctggtgttccagctgtgtacacaccaagctgtgctactcatcccctgatggactgagttatttgtattagagaggg

SEQ ID NO: 6861939 - DNA, 69 bp, Homo sapiens
cccttcaaggaaaagataacttgatgaaatagtgatcttgtgttgatttcattttttcctttttaaggg

SEQ ID NO: 6861940 - DNA, 55 bp, Homo sapiens
ctttcttctccctcaatattaccagaataaggccagtattggggcctggaggaag

SEQ ID NO: 6861941 - DNA, 122 bp, Homo sapiens
tgaatgaataaataccttgagaaaatgcattggtttctacttgtaagtcaacgatttaaatgctgttgaaaaggccttaagtcaacctaatgcatgtgatttttttcaggtttttctattca

SEQ ID NO: 6861942 - DNA, 91 bp, Homo sapiens
tgacattctgtgggtggtttgtgaagaaggcaatacaaagaagagaatatgtctcttctatgtctttgtcagcaaactgaactaagagtca

SEQ ID NO: 6861943 - DNA, 58 bp, Homo sapiens
ttgaagtcctaatccctagcacctcaaaacatgactgtgtttggaaacaggccttcaa

SEQ ID NO: 6861944 - DNA, 88 bp, Homo sapiens
tatgaaaggtaagattgggtacgattattttatggtattttagaattcaagttttgtttaatccttgtacccatgctgtattttcata

SEQ ID NO: 6861945 - DNA, 61 bp, Homo sapiens
ggtcctgtccattttcgtgcctccttttatcagtaaagaggacagtcaaatggccggtgcc

SEQ ID NO: 6861946 - DNA, 73 bp, Homo sapiens
ctggagaggcagcaggctgaggaggattggaatcatcacccaaccgcctgacccacctgtggcttttagtcag

SEQ ID NO: 6861947 - DNA, 62 bp, Homo sapiens
gctcctggagagcagggaccctggcttattagcagctcagcagccagtctgttttctagtgc

SEQ ID NO: 6861948 - DNA, 92 bp, Homo sapiens
ttgaatgtgaggtttttcttctttgaactttttgtaagttagattctgaaactctgacttcatgaaatgttcaataagacctcaatattcag

SEQ ID NO: 6861949 - DNA, 88 bp, Homo sapiens
ttagagtttaggtggagaactctttcagtaccattgagtgttctctagtaagaggatcttacactgttgggtttctcacttgctttaa

SEQ ID NO: 6861950 - DNA, 88 bp, Homo sapiens
tggggcagtgcaaaagcctgaccatgctgatctccattgggtgggtccaatggaagaacgctcagggttacgtcaggaaggtgcccta

SEQ ID NO: 6861951 - DNA, 55 bp, Homo sapiens
gatgctgactttccgctgccacttctgaactgagtgactgagaaagatcagtgtc

SEQ ID NO: 6861952 - DNA, 55 bp, Homo sapiens
accactgttagggacactgcagtggacctttcctgcagtgcttcgagactgtggt

SEQ ID NO: 6861953 - DNA, 67 bp, Homo sapiens
cacaccgtgggtctcgctgtgaggacgggcctaagctcacaggtagcctcagagacagatacgggtg

SEQ ID NO: 6861954 - DNA, 75 bp, Homo sapiens
gtaggagaaaagtgaagaccgtcagtagaagcagaaagaacataaaagctcctctgttgagcatttttcccctac

SEQ ID NO: 6861955 - DNA, 98 bp, Homo sapiens
ggagcattgttcctagaagctgccttgataaagctgggagacaaagatcattgagaaggactgtctgcagatttatcagcagctgctgggacgtgccc

SEQ ID NO: 6861956 - DNA, 72 bp, Homo sapiens
tctatgtaagtgatttataaggagatatctgcacagagatctgtatgttcctttataaattattaatataga

SEQ ID NO: 6861957 - DNA, 58 bp, Homo sapiens
gcaccaggagcatctaggaggcggctttcaagacaggctgtgatggctcattgagtgc

SEQ ID NO: 6861958 - DNA, 76 bp, Homo sapiens
gggggcaggaggagaggtccagggccccggccagcctgtgggaggcgggaggctgaggagttggtcgccagccccc

SEQ ID NO: 6861959 - DNA, 87 bp, Homo sapiens
cagttggaaacctcggagtctttgtaagtttctgcagcagagctgtggagcacagcagggctctgggtgtggttctgtgttcagctg

SEQ ID NO: 6861960 - DNA, 56 bp, Homo sapiens
actgttcttcatttagcaaagactgacctggcactcattgctggacccagggcagt

SEQ ID NO: 6861961 - DNA, 130 bp, Homo sapiens
caaccaacaaaactaaacaaaacctcctgaaaactaaagagtctttatgattgtcaaagtagtaaatctttcttagagttatttgagatgctttgacagatatagaggggctaccatttcagtctgggtg

SEQ ID NO: 6861962 - DNA, 56 bp, Homo sapiens
gggcatggccaggtgaggggtccatgcagagtacatgacccagcaaggccaagtcc

SEQ ID NO: 6861963 - DNA, 76 bp, Homo sapiens
tcacttgaactcagaaggtggaggttgcagtgagccgagatcgtgccattgcactcccgcctgggtgacagagtga

SEQ ID NO: 6861964 - DNA, 91 bp, Homo sapiens
taggtttttcatcaaaaggctgaggggaaaagtatggtaagtagtcattctcctttttgtctctttccattaaattttgatgtaaagctta

SEQ ID NO: 6861965 - DNA, 76 bp, Homo sapiens
tagttattatgattatgtactaaaaactcagtttttgacttgaactagagggaaatgtatataaccatagtgacta

SEQ ID NO: 6861966 - DNA, 84 bp, Homo sapiens
ctcttttccattatggtgtcagctaatttgggagctcattatttatttggcactaatttagcctggcaaattaattagaaaggg

SEQ ID NO: 6861967 - DNA, 89 bp, Homo sapiens
agctgggtatggctgagacatcatagtatgctgagaaatcttccaaatgcatgtgctatagatgtgaattaaattttagccttctagtt

SEQ ID NO: 6861968 - DNA, 77 bp, Homo sapiens
agtggggccttcatctgggaaacactgcatccccagagtgctttggggcaggtggagtgcccacgtgcaggccccct

SEQ ID NO: 6861969 - DNA, 56 bp, Homo sapiens
tacttctgtaagtgcgccaaggggccgcaggtacttaggctgcacttgaggaagtg

SEQ ID NO: 6861970 - DNA, 80 bp, Homo sapiens
gcatgttaaatttgagatgcatatgggctatctaagtggaaatatttaataggcagttggatatgcaagtctggatatgc

SEQ ID NO: 6861971 - DNA, 69 bp, Homo sapiens
tggctacagcttggccacagagaagggaggcagagaagttagattctattctgtgtgttactgtaacta

SEQ ID NO: 6861972 - DNA, 56 bp, Homo sapiens
cccgggaggaggaagttgcagtgagccaagttcaagccactgcaccccagcctggg

SEQ ID NO: 6861973 - DNA, 101 bp, Homo sapiens
cctgcgggatgggcaagagacgcggtgacggggcccaggtttcctttacctggaggaactccacggtcttgtcgggcagcttggtgcttatgaaccgcagg

SEQ ID NO: 6861974 - DNA, 78 bp, Homo sapiens
tttagacaggagctccagcccagggaagtcatttgagccctggatcaagctgtacctgaaactggagctccctctgga

SEQ ID NO: 6861975 - DNA, 90 bp, Homo sapiens
gctcaaacatcccagatgccaattccacatggcgctaccaataagttggtatgcaaatgttgggttaggttttatttgttttgtgtgtgt

SEQ ID NO: 6861976 - DNA, 120 bp, Homo sapiens
cccaacttcaatttctagtaaaactatagctttaccatagaagagtattgggaatattaaataggtttaaatatatcatgagtaaaacttgatagtcttttactagaattataaaatggg

SEQ ID NO: 6861977 - DNA, 63 bp, Homo sapiens
caaagtcctggagaagtgaagtctgtctgcagctgcttctcagccttcattcttcagcttttg

SEQ ID NO: 6861978 - DNA, 91 bp, Homo sapiens
gccgggcatggtggctcacgcctgtaaccccagcactttgggaggccaaggcggggggatcacgaggtcgggagttcaagaccagcctagc

SEQ ID NO: 6861979 - DNA, 91 bp, Homo sapiens
ctgggcagtggaggcagggcagtgtggtgggactgactcaacagacatagtttcatctccaccctgcccttctcaggttgtgtgaccccag

SEQ ID NO: 6861980 - DNA, 70 bp, Homo sapiens
gcagatcataacagatacatagaattgaataagataaccctgatttctttgtgtgtctctgtgcatctgc

SEQ ID NO: 6861981 - DNA, 98 bp, Homo sapiens
cagacaaaaataagtgacttcatgttgtttacaacttaggggagattgacaataatcaagtaagttatgtaggatatcagaggatcataagtgtcttg

SEQ ID NO: 6861982 - DNA, 65 bp, Homo sapiens
agtgacatttgtaacacgtgacaggttgcttgataaagggtaacatttctcttacaaatgctact

SEQ ID NO: 6861983 - DNA, 62 bp, Homo sapiens
agtgagaacagttaaaagttgaaagttgaagttagaagctttggacttgtgactcttctcct

SEQ ID NO: 6861984 - DNA, 78 bp, Homo sapiens
gcagtgacacagctttctgaagagcatcttactaactaggattatgtgtgtgtgctttttttgaagtagttttaatgc

SEQ ID NO: 6861985 - DNA, 129 bp, Homo sapiens
ggctgggcacaaggtcgggaccagcgtcgtgcccagcctttgggtcagaagattccacaggagtagggctgggggtggatctggagccggggaggggtttggagctgggatccggcagagtgcccggcc

SEQ ID NO: 6861986 - DNA, 79 bp, Homo sapiens
ggggtccaggctggtgagctgcctacattgccaagaggggacccttggagggcttataggcggctgagccagggactct

SEQ ID NO: 6861987 - DNA, 69 bp, Homo sapiens
agaaaattcaggggctcacaagattaatgagatttttggcctaatagtctgaggcaccctgaatattct

SEQ ID NO: 6861988 - DNA, 95 bp, Homo sapiens
gttttcttcattgttgttaatgttctttcagccagtgcatcaattcatcctatttgaatgctgagactaaagagcttgagggcatgtttgaaaac

SEQ ID NO: 6861989 - DNA, 57 bp, Homo sapiens
gatgaggctgtagagggtggcagaggccaggccttgaaactctttgtaagccacgtt

SEQ ID NO: 6861990 - DNA, 130 bp, Homo sapiens
agctccagtgggaggcgggagatttcgcgcccagctccatcctgtctgtggcctcaggcttgcttagtctctgccaccatgagatgggcagtggtctgggtggcccccttcctctctcctcctggctgct

SEQ ID NO: 6861991 - DNA, 129 bp, Homo sapiens
tgaatcaaatgaaatgatttgggtaatgtgtctgggacagagtaattgtgtctggcacactgattattgttaagctgccagattcagtctgctaaatccagtctcctcatcagttaccttatgattctg

SEQ ID NO: 6861992 - DNA, 80 bp, Homo sapiens
gaaagcacacagcttgcagtacttgtttttgagccaagaggcagcagaaatattccaagtactgcagctttgatgttttc

SEQ ID NO: 6861993 - DNA, 63 bp, Homo sapiens
ctgaaggcaccaggggtgccagagagccaggagggcaaaatgctgcttcacccctgtgcccag

SEQ ID NO: 6861994 - DNA, 101 bp, Homo sapiens
ttcctcttgatctacaattgaacttcacggaatagtagttttgcaatacattatcagctattatgtgaagaaagtgcttcatggataaagaaatataggaa

SEQ ID NO: 6861995 - DNA, 58 bp, Homo sapiens
acccaggctggagtgcagtggcacgatcttggctcactgcaacctctgccccttgggt

SEQ ID NO: 6861996 - DNA, 76 bp, Homo sapiens
aatggatgctaacttctctcaaagccaatgctcagttacaacaaagctgagctggtgtttcagggtcacattcatt

SEQ ID NO: 6861997 - DNA, 56 bp, Homo sapiens
cactattccataatgcatggcaaagatggattgtcaagcaataattggtaatagtg

SEQ ID NO: 6861998 - DNA, 61 bp, Homo sapiens
gaacagaattgtgcagatgtactgcagcggtgtgtcagtgtctgcttatcagttcttgttc

SEQ ID NO: 6861999 - DNA, 89 bp, Homo sapiens
tctgtccttccttttgcttgcctcatgcccaattttccaagccaaggaaaggtttgggaaggcgtggaagcagaaggtctgggcacaga

SEQ ID NO: 6862000 - DNA, 55 bp, Homo sapiens
aaatagcttctaagccttttgatgtccattaagaggaaggaatggggagctgttt

SEQ ID NO: 6862001 - DNA, 62 bp, Homo sapiens
attcagtgtgaggttttcaagtagaacactttagttagtattgaaaacatttatattagaat

SEQ ID NO: 6862002 - DNA, 81 bp, Homo sapiens
caaggacgtgttgaactagctctctgcagcctccttggaggatgtgatcctatgggaggggtaggagtattcaggtccttg

SEQ ID NO: 6862003 - DNA, 76 bp, Homo sapiens
gttgagtatgtggaaagggggtgaaaaagcagctaaacccaagatgtaggtcacagtccctatccctactctcaac

SEQ ID NO: 6862004 - DNA, 106 bp, Homo sapiens
gggagcaagttcatacctacctgcctatcagctgcctgcttcttatcatggagatgtcagggaggacacttgatatggatcagaccactggtttggatgtcaaccc

SEQ ID NO: 6862005 - DNA, 106 bp, Homo sapiens
tatcctgaaagatttttaacatgctaggaagagtgattgaattgaataaggtcaagtttaaaaatcctttttttggtccattttgattattttgctttcaggtata

SEQ ID NO: 6862006 - DNA, 66 bp, Homo sapiens
ctttacttcaggggcagggtgggggattctggtagagaccatatcactgtgcccattgaggtagag

SEQ ID NO: 6862007 - DNA, 64 bp, Homo sapiens
caacacaggacagtctagtaacagtacagttcaaagggaacgttacttatagacgtgttgtttg

SEQ ID NO: 6862008 - DNA, 55 bp, Homo sapiens
caggcagagtcagattagacttgatagatattcaagtctctctaataaatgcttg

SEQ ID NO: 6862009 - DNA, 109 bp, Homo sapiens
cacatgccaacttttaaaagtgctataatggaatcagtttctctaagtcattccagggcatgacttatagaataatgtttttagtgtacccactgtgtgtgtgtatgtg

SEQ ID NO: 6862010 - DNA, 77 bp, Homo sapiens
tgaggtcacaagatatttcagtcctttgaaaaaggtgtgaaccccagctaaaggggaggaagtgttttgagagctca

SEQ ID NO: 6862011 - DNA, 61 bp, Homo sapiens
tgaaggccatcagagctccagagctgcctgtgtaacaggttgaggctctgttgtgcctgca

SEQ ID NO: 6862012 - DNA, 87 bp, Homo sapiens
gtcgctgtttttacacttttcaatgtagtctgtaatcgatgtatacaacctcaaaaacagcagcgtgaagtgtgttatgacagcgat

SEQ ID NO: 6862013 - DNA, 57 bp, Homo sapiens
gacatggtcccactagtcacgctgtgtagacatatgtgcatgcacctggactgtgtc

SEQ ID NO: 6862014 - DNA, 97 bp, Homo sapiens
gatttttctgtattgctcgaaataatttagaatatagagcctaaagtttactatcttctctgacattagattaattggaagcaagaacacagagatc

SEQ ID NO: 6862015 - DNA, 81 bp, Homo sapiens
aagtttacttctacagtctttggaaagagatagtttgcaaagcaaattgatactttaaaaaaggctgtagggggaatgctt

SEQ ID NO: 6862016 - DNA, 68 bp, Homo sapiens
gtgagaggtatggtatattggaagaagatccctaattcttctatactctgaatatctatatcttttac

SEQ ID NO: 6862017 - DNA, 70 bp, Homo sapiens
cacagcaccaggaagcctgagaatgcttagggctctagcccaggctttgtaccaggctttctggtgtgtg

SEQ ID NO: 6862018 - DNA, 62 bp, Homo sapiens
cctgacagccatctgcaaggttggatactgacgctttcctgactgtggctaatggtgttagg

SEQ ID NO: 6862019 - DNA, 81 bp, Homo sapiens
accttacggcagcaatcagtcaatggactagtccctgctccttagtcatgacaggcagggtttctccattctgcccaaggt

SEQ ID NO: 6862020 - DNA, 60 bp, Homo sapiens
cctttgtccatcgtgcctcatgtctcatggcttgtggagtgagagactggtggatacagg

SEQ ID NO: 6862021 - DNA, 75 bp, Homo sapiens
gttccagccatatgcttggttcctacttctggcccttttctggggccatggcccataccaggtgcatgctgaaac

SEQ ID NO: 6862022 - DNA, 65 bp, Homo sapiens
ttgtttttgagatggatttagctcttgttgccccggctggatggcgcaatctcatctcactgcaa

SEQ ID NO: 6862023 - DNA, 70 bp, Homo sapiens
gtggggctcagggctgctgtcagggctccagcctccagctgggccctgacttcaagcatccaggcctcac

SEQ ID NO: 6862024 - DNA, 95 bp, Homo sapiens
gggagattatcaagggattggcatttgagctggaaggatgagtattaatagcaatagctaacatgtattgagctcttatgtgaacagaccttccc

SEQ ID NO: 6862025 - DNA, 86 bp, Homo sapiens
ggtagatttgtcactggggccacatgcagaagagggccattgtcttctttcaatgttctgctcagtgagaacatcttcacgtcacc

SEQ ID NO: 6862026 - DNA, 74 bp, Homo sapiens
tcacctggagagcttattaaaaacggattgctgggccttacccctagagattctggtttggtgggtctaggtga

SEQ ID NO: 6862027 - DNA, 82 bp, Homo sapiens
ggaccagcgtcttgccccgcccatcgccgtctgaggttaggacaaagatcgagaggctggacagggctggggagggcgctcc

SEQ ID NO: 6862028 - DNA, 65 bp, Homo sapiens
gtatacatgaaactgcctgctttctatctgtttattggaaaactctaacaggcagacatgtaagc

SEQ ID NO: 6862029 - DNA, 71 bp, Homo sapiens
atcaaatcatcgcaagttacattacacttttgaagaaggaagtgtttcttggaatgttgcgattataggat

SEQ ID NO: 6862030 - DNA, 96 bp, Homo sapiens
ggcagtcacgtgtatatttcacattccgcggctattttcatggccttactgggaaatgtgcctgggaattagattttcttatacacgtgtcaagcc

SEQ ID NO: 6862031 - DNA, 73 bp, Homo sapiens
tctgatgcatgcatgtttttacccacagtcgtccatcaccagggatttttgtgtttgaggcatgttgcagaga

SEQ ID NO: 6862032 - DNA, 74 bp, Homo sapiens
gtttgtttccaaagtcttttcttaatctttgtgtgctcagtacaagttcaattacagagaagaggaacacaaac

SEQ ID NO: 6862033 - DNA, 58 bp, Homo sapiens
gcactaaatgttcacatgcaattttcaagagaagatatacatctggatatttgtgtgt

SEQ ID NO: 6862034 - DNA, 102 bp, Homo sapiens
agagccttgtgcacaagcatctcagtgggttgtatatttatttctctaatattttttcattagcagaggtaagtgtggcaataggggggtttggctggttct

SEQ ID NO: 6862035 - DNA, 72 bp, Homo sapiens
gtcagagttagcacctgatctcccattcctgagctccaatcatggttggagattgagggcaacattattgat

SEQ ID NO: 6862036 - DNA, 72 bp, Homo sapiens
gcttcttagccacagaggttgatgtggttaggtgccaaatttagccacttaacctttcgtgctttgactggc

SEQ ID NO: 6862037 - DNA, 58 bp, Homo sapiens
tgagagagaagttttataaatttcagaattcccctgatttatgcatgcctctctgtca

SEQ ID NO: 6862038 - DNA, 127 bp, Homo sapiens
ccagttaaatttgaatttcagataaacaacgcgtaatcatctgggataagtacgtcccatgcaatatatgggatatacctatcctagaagattatgcgttatttatctgaaattcaaattcaaatgg

SEQ ID NO: 6862039 - DNA, 100 bp, Homo sapiens
cagtgtctaccttggttctctactagggaaagtggacatggcttgtcttaggagtcaaagggaagtctgtttcattgtccctggatgttggattatactg

SEQ ID NO: 6862040 - DNA, 113 bp, Homo sapiens
atttatgttagctttcaagcactagtttttatttcagatgatagaggaagtcaacctcatcagtccacttgatgaaatcgaagtctagtagtttggtttctaaagacatgaat

SEQ ID NO: 6862041 - DNA, 69 bp, Homo sapiens
tggtcctgtagctctctaagttccagaagaagccctttagtgcacggggattgagagctacaaaggcca

SEQ ID NO: 6862042 - DNA, 116 bp, Homo sapiens
gattggctgatacaggattagagaggaagagaagggggtaaactggctaacagcttctgttctatgtggcatttgctcccttgtgttcaggtcttctcttttgtttcataaccatc

SEQ ID NO: 6862043 - DNA, 65 bp, Homo sapiens
ctggctcaggaaagttgctgctgactgcacaaagatctgagcagtgaccttcttgcttaagttgg

SEQ ID NO: 6862044 - DNA, 71 bp, Homo sapiens
ggttgccagtcgagtacagttgagccaaaactacagagctttgaaaattaattttacttcctggcccttcc

SEQ ID NO: 6862045 - DNA, 75 bp, Homo sapiens
agcgagagggtatgtgctgggtgtctaagagcccagaaatgcattagaagaagcccagcatggaaccagctcact

SEQ ID NO: 6862046 - DNA, 60 bp, Homo sapiens
ccaaagtcctttctccacctgcaaagccaaatatgtggaggccgagaacagggactctgg

SEQ ID NO: 6862047 - DNA, 79 bp, Homo sapiens
cagtacagagatctatttaatagtgttatacgcctggattaattttcctttggcactgtgtaaattgatcttgcaactg

SEQ ID NO: 6862048 - DNA, 75 bp, Homo sapiens
gcgctgcgcctcctcttccgcagccccgtccgcaacccgtcgctggcggagagggtggtacaattggaacagcgc

SEQ ID NO: 6862049 - DNA, 76 bp, Homo sapiens
ccaccaggctatctggccttgagctgtggcatggtgctgagagcgtgggcttagaggtcagagagcctgggtttgg

SEQ ID NO: 6862050 - DNA, 59 bp, Homo sapiens
tgtgacaggtggggaaactaaggtatggtggcatgccttgcctcaggccccaccccaca

SEQ ID NO: 6862051 - DNA, 90 bp, Homo sapiens
tttattttttcaaggcaaagagagtgtctctttttaatttgacccgcaagttagagattccatcatgctgctaatgcctgataaaatgaa

SEQ ID NO: 6862052 - DNA, 59 bp, Homo sapiens
tggtgcctttgagaccctacgtggcatatatgtgtctgaaggtctgagctagaggtcca

SEQ ID NO: 6862053 - DNA, 105 bp, Homo sapiens
catgttaatgaaaccaggtaaaatttggtcatttgagcagctgaccaggcttgtgaatgctgggactctgtacaaaagaaagttcctatttgggtcattgatttg

SEQ ID NO: 6862054 - DNA, 128 bp, Homo sapiens
tctttaggattgtgaaatgtgtttcttgtaaagagctgtcagattctagaaagttctctccatgtcagtgtcaggacattttatgaatcacctagcccttgacagacttactagatacaaacttcaga

SEQ ID NO: 6862055 - DNA, 89 bp, Homo sapiens
gtggagagaccttgaaacattaggaaatcattatttctcccgtctttttgtaagagatgaggtattcgtaatatttccaagtcctgcat

SEQ ID NO: 6862056 - DNA, 67 bp, Homo sapiens
cgtggtcgcaaactgatttccaagtccgttgtctgatgctgcgagacactatccgtttgttacagcg

SEQ ID NO: 6862057 - DNA, 57 bp, Homo sapiens
actttacaagcttatagcctaggaacaataggctataccatctaggtttgtgtaagt

SEQ ID NO: 6862058 - DNA, 58 bp, Homo sapiens
gtgggtcataattcttggtttgtgataatatttagttacatcagaaatcctgacccac

SEQ ID NO: 6862059 - DNA, 87 bp, Homo sapiens
tagagttttcaatgcactttcttatccatgatctcactgatgcttaagacaactcagtgaaacaggcaggggaagtatatatctctg

SEQ ID NO: 6862060 - DNA, 124 bp, Homo sapiens
ggtgtggcacagtcaggctttgccctcatgacagaagtggtcatatttctcccctgaacaagatgagacatctaatagggctacttactcatgggatagctgtggccggctgagtgttcacacc

SEQ ID NO: 6862061 - DNA, 79 bp, Homo sapiens
gctagttcctcaggcttaacttgtcttgatataaagggaatgacttcatggaggcaggttagccagacgaagttctagc

SEQ ID NO: 6862062 - DNA, 77 bp, Homo sapiens
gggaagaaaacctgacagtggaatggtgggcctgcatgcgagggcttggaggctttccttccacttctgaccttccc

SEQ ID NO: 6862063 - DNA, 119 bp, Homo sapiens
tccttcccctctataacattgaactagtttagctttttaagacgtttatccttaccttcctttcattttagtcatatgtgttttagatgagtgctgttccaattgtctatggttaagga

SEQ ID NO: 6862064 - DNA, 73 bp, Homo sapiens
gcggggtgcgggctgcgcttgggctccggctgggatccggctccggctctggttccagcgcgcccgaccccgc

SEQ ID NO: 6862065 - DNA, 59 bp, Homo sapiens
cagagccaggcctgccctcttttaaagttacaagcaaccagaggggcagtcggcttctg

SEQ ID NO: 6862066 - DNA, 76 bp, Homo sapiens
cttatagttctgacaaaccactgctccagctgaatattttatgaagctacagtttggcttgttagcagtctcaaag

SEQ ID NO: 6862067 - DNA, 84 bp, Homo sapiens
tattaggttgttgcaaaagtaattgcggtttttgctattgaagctagtggcaaaaaccgcaatttcttttgcaccaacctaata

SEQ ID NO: 6862068 - DNA, 76 bp, Homo sapiens
gagccacgcgggccgcgcaggagcgtctgtccgagggtcgcctacgagggactcctctgctcggctgcgcgggctt

SEQ ID NO: 6862069 - DNA, 78 bp, Homo sapiens
gagactccaggagaaatttagtattaatagactgccattcaggaatggctagcactctacctttctcagggagatctc

SEQ ID NO: 6862070 - DNA, 62 bp, Homo sapiens
ggagggaggatagagaacttttatttcagaagagtgcaaataaacaaatccttccttccccc

SEQ ID NO: 6862071 - DNA, 99 bp, Homo sapiens
gtttaagatttagtaagacagtcattgcatgttaattaaacagcaatggatcatttaccaacctgtttaatgaggtgtaacaactattgaatataaaac

SEQ ID NO: 6862072 - DNA, 83 bp, Homo sapiens
gccttaagttctttgtgagtaatacagagcgttccagtgttccaggaagggacagatctgtgcagactggcagggtcagaggc

SEQ ID NO: 6862073 - DNA, 103 bp, Homo sapiens
gcagttttagagatgaaattgctaggagattttaataattatagatgagttgtcctacatttgaaacctggaatctaccagcatgatttatctaccaatttgc

SEQ ID NO: 6862074 - DNA, 55 bp, Homo sapiens
caggctcagatgccctgcgctgctctccattgaggagttgggctctggaggcctg

SEQ ID NO: 6862075 - DNA, 61 bp, Homo sapiens
cgtgtggtcccggcaaggcaaggcgggcaagacgcacaagttctctgccggcacctacccg

SEQ ID NO: 6862076 - DNA, 76 bp, Homo sapiens
attttgaattatatttcttctgtatgtttaagtcagtgatgcactctgagcagtctggaacaagatatgacaagat

SEQ ID NO: 6862077 - DNA, 85 bp, Homo sapiens
gagccaggcagcatggattcaagtcccagtctgatacttagctgtgtaacctcgggcaatttggtaacatctatgatcttggttt

SEQ ID NO: 6862078 - DNA, 60 bp, Homo sapiens
ctcagcagttgccccctcccagctctggggacaggcgctgggggaggactgattgctgag

SEQ ID NO: 6862079 - DNA, 130 bp, Homo sapiens
ttcatagactcaattcttgtgtgttaggaaaatctttagtataggggacccacttatggagaggaaaataattctttctagtcttccctacctcccgtttttctttcaaacaagggtttgtaaaaatgaa

SEQ ID NO: 6862080 - DNA, 68 bp, Homo sapiens
gaaggcattctattctacatattggagccaaagaggaagaaaaaagtgtgaggatgagtcatgccttc

SEQ ID NO: 6862081 - DNA, 78 bp, Homo sapiens
gggggtctgtagccttgctttttcagtagcacttgtccatcactgtcaaaggctttgagaaggcagatactgaaatcc

SEQ ID NO: 6862082 - DNA, 78 bp, Homo sapiens
gttatactggaaagctctggaatggaaatatgtcatatctactttatgttctcttaatccggtgctttctgtggttgc

SEQ ID NO: 6862083 - DNA, 64 bp, Homo sapiens
tggctgaagctgaattgttgcagactaatgcttttcaaacttctgtacacatcagcatctccca

SEQ ID NO: 6862084 - DNA, 76 bp, Homo sapiens
ttctctctttccaggtatcaagcttcaggccagcatgggctgggatctcagcaacaggtgcctgtgaaggggagaa

SEQ ID NO: 6862085 - DNA, 98 bp, Homo sapiens
gtgtttacatagctttgactctatgatagtttttcagtagtgccagacacattggtatgtactcatcaactattgaattgaaaactttatgtagatac

SEQ ID NO: 6862086 - DNA, 59 bp, Homo sapiens
ctttgtcttccccacactgggttggagaaaaagccttcagcctggaggcagagataaag

SEQ ID NO: 6862087 - DNA, 61 bp, Homo sapiens
acagatgacacacacgcacccggaatagctacaagctctatgctctctgtgtgtctcttgt

SEQ ID NO: 6862088 - DNA, 82 bp, Homo sapiens
gtgttgctatatgagctcgggttttttctggagggccacagcctaacaaggtaagcctggccatgaaatgatggaacaatac

SEQ ID NO: 6862089 - DNA, 61 bp, Homo sapiens
tttgctggttgtattttctctgtgggaactctactgttgttatcgagaaagcaaccataaa

SEQ ID NO: 6862090 - DNA, 70 bp, Homo sapiens
acccccagcacagcctaggctgggactgccacccactgcgcactccagaggcagctgtgctgagttgggt

SEQ ID NO: 6862091 - DNA, 83 bp, Homo sapiens
gtaccgtgacgcttaatttcaggtgtccacttgactgaattaagggatgcccagataattggtaaagcattatttccaggtac

SEQ ID NO: 6862092 - DNA, 88 bp, Homo sapiens
gatctctgagatttctaatagttgagtcagctactgttggaatgagaaaagctctagttgtctataacatgttgaatttgtcagactc

SEQ ID NO: 6862093 - DNA, 59 bp, Homo sapiens
atcagtgatgaggtggctttcaaatgtgtcttctacattgatacctaaacatccctgat

SEQ ID NO: 6862094 - DNA, 57 bp, Homo sapiens
gcaccagacccagccttgtagttcgaggagaggaagaaaggcagagtgggttggagc

SEQ ID NO: 6862095 - DNA, 130 bp, Homo sapiens
cattggaatcacctggggagatttgtaagcttctgctgtctgggctgaacccccagaggttcggattgaattggtgtggggtgtggtccaggcatcgagatgtgtaaagacctccccaggtgatgatatg

SEQ ID NO: 6862096 - DNA, 92 bp, Homo sapiens
tgtaacatctcatgacctgcaggtgtttccacacttccttccccttgctcaggaggtgtaattactcttgcagtttgcctgtgaattgtaca

SEQ ID NO: 6862097 - DNA, 72 bp, Homo sapiens
agacacagtcaccttatcaggatgtctttgggatgcggttcctttctggaaacattacagggtgatgtgtct

SEQ ID NO: 6862098 - DNA, 59 bp, Homo sapiens
tggcctggcagagcaaggcctgccccactgggttcctgccttggtgtctggtagtgtca

SEQ ID NO: 6862099 - DNA, 92 bp, Homo sapiens
tgagattttggaggcgtggcagtctttggcaatgacaacttttgggttatcaccttgcagtggatgctataatgtattgccccagactttca

SEQ ID NO: 6862100 - DNA, 62 bp, Homo sapiens
gtatcttcaagttccaaagtgcagggttggaatcactctagtgttttggaacatggaaaaac

SEQ ID NO: 6862101 - DNA, 56 bp, Homo sapiens
aggagaagtagaagagccctggacttggactgacaagtcctgctttctactctgct

SEQ ID NO: 6862102 - DNA, 64 bp, Homo sapiens
gcagattatatgcatatgtggtacatatatctatatatgaatatatacatatggatatgtttgt

SEQ ID NO: 6862103 - DNA, 63 bp, Homo sapiens
ggcctgcactgtgggccagctgggtgggctcagtacccatatgctgctgcccctagtgaggcc

SEQ ID NO: 6862104 - DNA, 63 bp, Homo sapiens
tctgggaatgaataagacctgtgggctctagaaaactcagaacaggttttaaatctttccaga

SEQ ID NO: 6862105 - DNA, 60 bp, Homo sapiens
ggagctcttccagcttgttgctctgctgtgttgcctgcagttcctcagctgtagagctcc

SEQ ID NO: 6862106 - DNA, 95 bp, Homo sapiens
gtagaactttactgagattgcatgtctagctcctactccaaagctgaaagctctttaggggctcagaacatgtccttggtctctgtacagtttac

SEQ ID NO: 6862107 - DNA, 69 bp, Homo sapiens
gagggtctgagaagtcatttgaccacctagcctgaaaccagccctaggctcaggtgactccaagctctt

SEQ ID NO: 6862108 - DNA, 84 bp, Homo sapiens
tggataaataggtggatttgtggaagttgaacatcatggaaagggtgattccagatttctacacaagaccacagccatagtcca

SEQ ID NO: 6862109 - DNA, 56 bp, Homo sapiens
tcatgctctggtttagctgtttttgttctcctgggaatacatagccttagagttga

SEQ ID NO: 6862110 - DNA, 56 bp, Homo sapiens
gcctcagtgatatgtgggacaatatcaagtggtctcactcatatataattgaaggc

SEQ ID NO: 6862111 - DNA, 74 bp, Homo sapiens
acgaaagggtgtttctaaaggtcacaggagcccttgctgggtcgcctgtgggccctggacagagacccttgagt

SEQ ID NO: 6862112 - DNA, 63 bp, Homo sapiens
gcactgacttccagcaacttcctccaggcgagcgcctggaggcagtcacctgaagtcatgtgc

SEQ ID NO: 6862113 - DNA, 71 bp, Homo sapiens
tgttatttttgtggtttctggctttctagattctatttttagatactgcccattgagcaataatggtgata

SEQ ID NO: 6862114 - DNA, 130 bp, Homo sapiens
taaatgaagaacctatctgatgtttttgctttgttttctataactggactggattggatatttttattaagacctcctaggtgttatagaggaaaaaacgcaggaaatatagtgaaatatgcttcagatg

SEQ ID NO: 6862115 - DNA, 78 bp, Homo sapiens
acatagaactggtgaagtgaagggcagaagaaaggaatcatagggttagtatttgtccttcattatatttgtttttgt

SEQ ID NO: 6862116 - DNA, 60 bp, Homo sapiens
aggccatgtggccccagagtctgtggtttccccactatactttgtaggggcccatggttt

SEQ ID NO: 6862117 - DNA, 65 bp, Homo sapiens
ctgcaggtggcctccagggcataggtggggcaaaccctaccctgttggggccctggggcctgtag

SEQ ID NO: 6862118 - DNA, 103 bp, Homo sapiens
attgcctctaagataagtatgtcattactgctctgatactcatcacccacagactcactagtggatgattatcagatcatgtgacagcattggaccctgtaat

SEQ ID NO: 6862119 - DNA, 56 bp, Homo sapiens
tgacagcaataattttatcttccctccaaaggtaggattgaatccattgtttgtca

SEQ ID NO: 6862120 - DNA, 116 bp, Homo sapiens
tgccctgccccacctttgagtgtcctgtggagaggactggaggtcacttcctgaagcttgtcagaaaggcgccttccttctcctcgcaggagtctctaaaggatgtttaagggaca

SEQ ID NO: 6862121 - DNA, 102 bp, Homo sapiens
gaatgtacaaggaagcatgaaagggttaggacaagtgaaatttcatgtgtcgacatggataaattttactttcctgcctgccttaaatcttggttgtatttc

SEQ ID NO: 6862122 - DNA, 55 bp, Homo sapiens
atgcagctgtaacagaggcctcagactttcctatgagacagttctgcagctgggt

SEQ ID NO: 6862123 - DNA, 71 bp, Homo sapiens
gaactgcctggccagaccctatagaggtacaattaggtcactctagggcatctgaccatgggtggcagttt

SEQ ID NO: 6862124 - DNA, 67 bp, Homo sapiens
tcatagtatggatcacataatttggaaacagctagcctagctgtctgtctctgtgacttaactgtga

SEQ ID NO: 6862125 - DNA, 57 bp, Homo sapiens
ttttgagggaaatcagctgaatgttgaatatcagcattcatctgattaacctcgaag

SEQ ID NO: 6862126 - DNA, 62 bp, Homo sapiens
ttggagctggaaagtgcatcagaggttaccttagtccacttgtacctaattactagttccag

SEQ ID NO: 6862127 - DNA, 73 bp, Homo sapiens
ggattggcttgcactgtattttaagggcttatatttggaatctctctttaaaatattatagttcaaccaattt

SEQ ID NO: 6862128 - DNA, 89 bp, Homo sapiens
agtcctagggaaaagctcgattgacttttcttggtcacatgactctcatgggtacttttcagtgaccagaggagtgtggtcctatgatt

SEQ ID NO: 6862129 - DNA, 66 bp, Homo sapiens
gcctcatttgattccctggatttttagtctctgttgctgcccccaggctacacatcagatgagtgc

SEQ ID NO: 6862130 - DNA, 64 bp, Homo sapiens
ttaaacatggagagctcgggatctttttggacaggttcaagttccctggcactgctgtgattag

SEQ ID NO: 6862131 - DNA, 56 bp, Homo sapiens
atggtactacataaatattcaagtaggcagctatttggaaatacgagtagtatcat

SEQ ID NO: 6862132 - DNA, 70 bp, Homo sapiens
gtcttttctttccccttctcaagagtagatgcagctgttctcagtttaatatcagaagagaaagaatgat

SEQ ID NO: 6862133 - DNA, 80 bp, Homo sapiens
ctgagcttctagctgatgtccaacaataggtgccagcatgtgagttcagctggcacctatttggacctggatgagttcag

SEQ ID NO: 6862134 - DNA, 69 bp, Homo sapiens
ctttgccactttctatgttcaaagggtgctagtccacacttctttgcaaactatggagtgtgcttaagg

SEQ ID NO: 6862135 - DNA, 81 bp, Homo sapiens
cagactcttatttagtgatagaagcaaggactgaattaatggttatagctccttggttcattataaatgaaatggagtatg

SEQ ID NO: 6862136 - DNA, 63 bp, Homo sapiens
tattatggaatttataaagtgtaatttctaataggatattgctagcctatgagttcagtagta

SEQ ID NO: 6862137 - DNA, 60 bp, Homo sapiens
agggcttgccattgcctgttagagatcctttgggtccgttcagaagcaaggcaggtacct

SEQ ID NO: 6862138 - DNA, 123 bp, Homo sapiens
ttagtatcttcacaatcttttgggttacctgggtgaatattctttgtgcagtattggctaaggtgctaacagggttgattgctcaaaaatagcctcactcatatagctgaaaattggtgctgg

SEQ ID NO: 6862139 - DNA, 64 bp, Homo sapiens
gaatattttcatgtttcaatgggatcagtttttctaattctgactattggaaaagaaaatattt

SEQ ID NO: 6862140 - DNA, 84 bp, Homo sapiens
actgagtagtctgaaggattagagagcacttagcgtcctgctgggcacatggtgaatgttctctaaatactccttctacttagt

SEQ ID NO: 6862141 - DNA, 85 bp, Homo sapiens
agagagtggtatctatggaaattaattcaactgtctttaaaaaggtcatagatcaaagattaacatttctaagatgccatttgct

SEQ ID NO: 6862142 - DNA, 73 bp, Homo sapiens
tccattatggattagccttaatgtttcttgaatttctgttagggaacatcaaggtctgtgtctagttcttggg

SEQ ID NO: 6862143 - DNA, 61 bp, Homo sapiens
ttcagtatacattatctaattgtgcataccagatgcagaaaaggataaagtgcatgctgaa

SEQ ID NO: 6862144 - DNA, 82 bp, Homo sapiens
tgttcagtatttgaagccaagaagtgagtaatagtatatttgtgtgcacccacttgtgtatttgattgctttgtgctgaaca

SEQ ID NO: 6862145 - DNA, 57 bp, Homo sapiens
tccggatcatcataccttggtcattactgtcagacaaagtgtatgaacagatgcggg

SEQ ID NO: 6862146 - DNA, 72 bp, Homo sapiens
ctgtggatcctgcttggttctttttctgtgaactctcggcccagaagcaagagccggagctagttttcacag

SEQ ID NO: 6862147 - DNA, 99 bp, Homo sapiens
tgtgccttcattatattcttcatctggacgtttgtaaagctcttcaacagtacgatacgcttctaaggagcgctccagaaaaaatattgagagtgcaca

SEQ ID NO: 6862148 - DNA, 76 bp, Homo sapiens
ttggtgtctcaaagtgctgggattacaggcatgagccaccacactcagcctggtttaagcattttatatgactcaa

SEQ ID NO: 6862149 - DNA, 59 bp, Homo sapiens
tcagaaggctgaggtgggatgatcgcttgagcccaggagttcacattcagccttgctga

SEQ ID NO: 6862150 - DNA, 87 bp, Homo sapiens
tcttctgagtatggttatttttctgcattgggtttcagcaaactgtgctcacatgcttgaggaaagaaaaaccattctatcagcaga

SEQ ID NO: 6862151 - DNA, 76 bp, Homo sapiens
agggcctcccgtagttttctcagtttgctgtaagaagaatgaaaagaaagcagaggtgtttattatgggaggtact

SEQ ID NO: 6862152 - DNA, 85 bp, Homo sapiens
ggttcatatccactgctgttacttacgcaaaaggcaaatatttgtgctttgtaacaagttgatctggtagcctggaaaatggact

SEQ ID NO: 6862153 - DNA, 69 bp, Homo sapiens
cttgttgcccaggctggaatgcagtggcgtgatctcggctcactgaaacctccgcctcccggtttcaag

SEQ ID NO: 6862154 - DNA, 130 bp, Homo sapiens
acaaataagatagtttataagtagagtggttatcaggctctgtgttttgcccaggagagtcctagtttatccctactgtcctaggccaaacatgaatagtaacctctttcactttcagaagtgtcttggt

SEQ ID NO: 6862155 - DNA, 64 bp, Homo sapiens
cttgctggctggcaacctgggcaaattgctttacctctttgtgcctcatttgccatctagtagg

SEQ ID NO: 6862156 - DNA, 70 bp, Homo sapiens
cttccaagtgtctgctttcagctagtaggtaaataatggtgccacttacgaaaataggagacagtggagg

SEQ ID NO: 6862157 - DNA, 56 bp, Homo sapiens
gcagcaccccctccatggttgtgacaatcaaaaatgtctcctgcaggggtgtgggc

SEQ ID NO: 6862158 - DNA, 108 bp, Homo sapiens
gtcatactgatcaacaaccagctgagttctcggatggtcagcatcaactatcagccctatgagtgagccatcttagatctccgtctcagtgtgaagccctcagatgac

SEQ ID NO: 6862159 - DNA, 56 bp, Homo sapiens
ttttgttatctgtaagacagaccctaggagggtcagtctctccccggacagcaaaa

SEQ ID NO: 6862160 - DNA, 81 bp, Homo sapiens
taggagggaggtagcatgctggaagggacccagaattggagcctgaacaccttggttcctgagcgagctccatcaccccta

SEQ ID NO: 6862161 - DNA, 120 bp, Homo sapiens
cccgtcttgcagaatgttccctaagtgccaggctggcgtcaggggctgtacatagattatctctgatcccctctaagattgctgttgtggtaagtgtgagtggcccattttgctgatggg

SEQ ID NO: 6862162 - DNA, 75 bp, Homo sapiens
gttttcctttatggcctctagctgagaccaatggccctgaagtaattggcttctaaagagggcaaaaaggataat

SEQ ID NO: 6862163 - DNA, 105 bp, Homo sapiens
gtgggagcagccaggcaggccgatcgtcctgaaccggcagatgcagtcagtgccactgcctctccagggccatcctgcgcctgtccagttgctggtttctcccat

SEQ ID NO: 6862164 - DNA, 56 bp, Homo sapiens
aaacctcactgacacacatggtatagatttatttagctcatgagtctgtggggttt

SEQ ID NO: 6862165 - DNA, 59 bp, Homo sapiens
gcttttgtttctgtttatttttgtgtgaggagtgtgcacatgtagatgaaagcaaaggc

SEQ ID NO: 6862166 - DNA, 112 bp, Homo sapiens
gtaattggaaagcttttatcattttttgtaggggagagggaaatgagaataggcttaaaattgcttctttactataggcaattaacaaacataaaggctgtcattatgttac

SEQ ID NO: 6862167 - DNA, 55 bp, Homo sapiens
tctttcccgccagagcatgagtgtccatggatggctagttctgaagcggaagaga

SEQ ID NO: 6862168 - DNA, 86 bp, Homo sapiens
gagtagttgaactgaagtatttcgagccagcatgttagaatttttgggatggggatatgtgacttgacaaagcttcccaggtgctt

SEQ ID NO: 6862169 - DNA, 59 bp, Homo sapiens
gtcatcatccactggagccggcagggaatgtgcccctgtgggtcacatgggtgactgac

SEQ ID NO: 6862170 - DNA, 74 bp, Homo sapiens
ctcacactgtttatgccaaagccaaacgcaggcttcgaagcagagtctgtggatggactggcagaggtgatggg

SEQ ID NO: 6862171 - DNA, 75 bp, Homo sapiens
ctttagggatataactaatactggccatgagcattttctgttcctctgtcagtcatggttgttgcaaccctgtag

SEQ ID NO: 6862172 - DNA, 58 bp, Homo sapiens
catctgtcctccagcatctccatggtcatcaactgggaggagctgaatgaggcatttg

SEQ ID NO: 6862173 - DNA, 69 bp, Homo sapiens
tctactgcactggtgtctcatctgtgatgattcaaatgttctgttttcttcatgatactgtgttgtaga

SEQ ID NO: 6862174 - DNA, 117 bp, Homo sapiens
ccctagtgtactgaacagagattccttggtgatggtggctaggccagtgctattttgtgtgtggcagaggaaaaagtcactgggaccaagagcttctgtgaatttcacatgtaaggg

SEQ ID NO: 6862175 - DNA, 83 bp, Homo sapiens
taagtaaattctgtttcacagtatttgtttttctgagtgtacataatttcactcttttaagaactgctgatagaagttactta

SEQ ID NO: 6862176 - DNA, 73 bp, Homo sapiens
atctgtagagaagaagagtatttgtagtagatactgttgcctgcatattattatggttgctcttttcccagat

SEQ ID NO: 6862177 - DNA, 77 bp, Homo sapiens
caagggagcctaacaagtggtgtgcttctttcttacaagtaggcagtgaaagatgcagcaaactactttttactttg

SEQ ID NO: 6862178 - DNA, 63 bp, Homo sapiens
ggttggtgagtgcagggtgttaaggaagagaacggctcctctctggccacctgcgtcccagcc

SEQ ID NO: 6862179 - DNA, 56 bp, Homo sapiens
ctcataactgtgctcaggggagatggatttatcgtaactgagtcaaaggttgtggg

SEQ ID NO: 6862180 - DNA, 69 bp, Homo sapiens
gaattctctggagaacttccagtttcccaagaagaaacttagcaaatcttttggattctctagggaatc

SEQ ID NO: 6862181 - DNA, 75 bp, Homo sapiens
ttttcgcactaaatcctgttattaaaaagctcaggctaagatcaagccaagggctgtaacggacttgacagagaa

SEQ ID NO: 6862182 - DNA, 65 bp, Homo sapiens
cctatctttagacatacagaatttccagaaaaaatagtctggaagtctgtgtttttaacaaatgg

SEQ ID NO: 6862183 - DNA, 129 bp, Homo sapiens
acaataaaaaagtagattgagaatgttgaggccctagtatgacttcttatttcagttcattccacataagggcctgaggtctgaattccctaagacaggtcttgggtgcttacattctcttgatctagt

SEQ ID NO: 6862184 - DNA, 58 bp, Homo sapiens
ggagtaggccccgggagagagtgggataaagagtaactttctcccggcactcctgccc

SEQ ID NO: 6862185 - DNA, 83 bp, Homo sapiens
ccagaggcctaatcactggaggtcagtagacatataagtttccatcttaattaattatttgcctgtaagacaaggccttgtgg

SEQ ID NO: 6862186 - DNA, 89 bp, Homo sapiens
agacagaagaatgtgcaaaggctagtggattcattgattccagaacttcactggaacacactgtcttatgccatttacctcatttgtct

SEQ ID NO: 6862187 - DNA, 64 bp, Homo sapiens
acatggttgaatgctttatttgaagtaaagatgtgtgatctttgaatgaagttattaatgatgt

SEQ ID NO: 6862188 - DNA, 57 bp, Homo sapiens
ggctgaagagaggccttgagcaccttaggagtgcttggaccaggtcatcttcaagct

SEQ ID NO: 6862189 - DNA, 89 bp, Homo sapiens
ggagttttgctcttgttgcccaggctagagtgcaatggcatgatctcagctcactgcaacttctgcctcccaggttcaagcaattctcc

SEQ ID NO: 6862190 - DNA, 61 bp, Homo sapiens
gagagtctaggaacctcatataggtgcaatcataagtgtgtctttttgagcctgacttctc

SEQ ID NO: 6862191 - DNA, 103 bp, Homo sapiens
ccaaatagaattttggagttttgacatcttaaaactagttttccataatataggacattcattttgcaattgtgaaaactgggaggttaaaagtcttgtttgg

SEQ ID NO: 6862192 - DNA, 70 bp, Homo sapiens
tctgttttgtaaacatcagccactctatttctctctcagaagtggactttgatgtcttataaattgcaga

SEQ ID NO: 6862193 - DNA, 57 bp, Homo sapiens
cagagagctcaggaaaatgggagaaggacacacccccaggagcctgagtcctctctg

SEQ ID NO: 6862194 - DNA, 77 bp, Homo sapiens
tctgctttttcattgactgaaaaataatgaacttgaaatctagccttaatttttcagccagtgatgctgaagacaga

SEQ ID NO: 6862195 - DNA, 130 bp, Homo sapiens
cttaactctcagaagattgactctttgctgccaccttgctgataccatgaatgttaatgcccatggcactgggctttgcacagagtggatattcagtaaatgggtagttcttgtttctctcccacatatg

SEQ ID NO: 6862196 - DNA, 88 bp, Homo sapiens
tctggatgtcaaaatcagctcaagaacgttccccactacttttcttgggaaacagtctcttaagctgctcctcatatttttttctaga

SEQ ID NO: 6862197 - DNA, 66 bp, Homo sapiens
ggacctcttattctcaaatagtgacatattctccgtagtcactgtttcagaactgagtaaggatcc

SEQ ID NO: 6862198 - DNA, 73 bp, Homo sapiens
cacctgcctcatttgtccctgctggaacttgctgcctttgtcccacaccctgcagggcagctgaagctaggtg

SEQ ID NO: 6862199 - DNA, 93 bp, Homo sapiens
tcagattcctctgcttcctgatgtgagaaatgtcagtggctaaaagcaacatacagacagtttttcagatatttagtgaaaagagtcatctgg

SEQ ID NO: 6862200 - DNA, 73 bp, Homo sapiens
gggagcctggctccacaggccagggtgtggggggacctcctggccacacctcagccatgtggaggcagcaccc

SEQ ID NO: 6862201 - DNA, 59 bp, Homo sapiens
ttcatctttcatggctgatttaagggaggacttgcttcctgtccagccctgaggaagaa

SEQ ID NO: 6862202 - DNA, 80 bp, Homo sapiens
ctcattttagaatttcagtgtatcttccaaaagccattttaaatggctgtaggtctagatgactgatccttagggatgag

SEQ ID NO: 6862203 - DNA, 75 bp, Homo sapiens
actctgtatccctctcaaattgttcctacttcaaggtgaaatcagtgaaatgttttgagagccctggtgcagagt

SEQ ID NO: 6862204 - DNA, 61 bp, Homo sapiens
ctgggccttagggcactccctttgcagagcactcattaggaacatgtgctttggggcccag

SEQ ID NO: 6862205 - DNA, 61 bp, Homo sapiens
gacctttagtgtccaatattcactttttgtccttttttaagtttattggaactaataggtc

SEQ ID NO: 6862206 - DNA, 62 bp, Homo sapiens
atgttccttacaattgcaaaaaaatggacatgtgaaaactcacttgtaacttgaaggggcat

SEQ ID NO: 6862207 - DNA, 82 bp, Homo sapiens
ggtcctgtatcttagagagtcgtgttttgtttcatgcttgattgtgtctaacacacatgcctttcctaagtatatcaagact

SEQ ID NO: 6862208 - DNA, 60 bp, Homo sapiens
ggaatacacactgcagcatggggaaaatgaagaaacctcacatctgccgtagtgtattct

SEQ ID NO: 6862209 - DNA, 96 bp, Homo sapiens
cacagtagcataagagcactggagtagaaatcaaaataagtaattagttagtttggctttgtgaattattactcacatgatcttgggaactctgtg

SEQ ID NO: 6862210 - DNA, 56 bp, Homo sapiens
gctcagagggaacaaggggctgagttggctctgggagggtcttgcattttctgagt

SEQ ID NO: 6862211 - DNA, 61 bp, Homo sapiens
caggacatggacacttttgggcagttatcattttacccaacacagatgtgttagtgttttg

SEQ ID NO: 6862212 - DNA, 62 bp, Homo sapiens
cacagacccagaagggatgaaggtcggatatgagaacgaacttctgcctctgatggtttgtg

SEQ ID NO: 6862213 - DNA, 78 bp, Homo sapiens
gtatctgataggcaagtagaaaagtttgaagaaaaatcccctgtgagcttagagttcttttgatctgctgtcagatac

SEQ ID NO: 6862214 - DNA, 56 bp, Homo sapiens
ggcagggaaacagctgatcccagactagctggtgtcagcctggtgattcctctgtc

SEQ ID NO: 6862215 - DNA, 67 bp, Homo sapiens
cccaaacagtggcaaggacagtaataatgattattttagttcatctttacactgcacttgctatggg

SEQ ID NO: 6862216 - DNA, 63 bp, Homo sapiens
gccatgtctgctggctttactcttctattcggagactaaaacagtggctagtagacagaaggt

SEQ ID NO: 6862217 - DNA, 59 bp, Homo sapiens
agagcccaggcaggcatccaggcctcctctctctatccctgggctcctcctgctgctct

SEQ ID NO: 6862218 - DNA, 68 bp, Homo sapiens
agtgctgaggccatactccataccaattaaaatagaatctgttgggtaggatcagtggtatcagtatt

SEQ ID NO: 6862219 - DNA, 90 bp, Homo sapiens
tcactttccacttcccacctgtccaggggtgccctgtgttgacctcggcatgagcttcccagacaggatgggttgcagtgggtggagtga

SEQ ID NO: 6862220 - DNA, 58 bp, Homo sapiens
gttggctgctcagtgatatgagaatatgcccccatgcatgtttcaagggcatcccaac

SEQ ID NO: 6862221 - DNA, 86 bp, Homo sapiens
ggaactcctttccacggaatggaattctccgctggggctgcaggaactcctttccacagaatggaattctccgctggggtagttcc

SEQ ID NO: 6862222 - DNA, 115 bp, Homo sapiens
aatgattgctctaaaatagtggttgtcaaattttaacatgcattagagttactaaccatctgtgtaattctaatgcatgttaaactttgagaaccactattttagagcaatcatt

SEQ ID NO: 6862223 - DNA, 67 bp, Homo sapiens
cagacctggagggaccctggccctgtcgctgtccatgtgacactggcccaggctctcctcctttctg

SEQ ID NO: 6862224 - DNA, 62 bp, Homo sapiens
gttccccaggactgtgatagctcttcggctataccttcagcagctatttcagatttgagagc

SEQ ID NO: 6862225 - DNA, 56 bp, Homo sapiens
ttccctggaaagccatgcagtcacatccatccaccggcttgctggtttcaagggga

SEQ ID NO: 6862226 - DNA, 59 bp, Homo sapiens
agcagcctggacttggatgtggtgtgaaagtggtcttgcattactcaagctgtgctgct

SEQ ID NO: 6862227 - DNA, 62 bp, Homo sapiens
gggagatcgcagcttgctcaagaccacacagccagggagtggcaaagctgggattcaaaccc

SEQ ID NO: 6862228 - DNA, 66 bp, Homo sapiens
tcttgcttgttgctaagcagatgatgtaagaatatattaaaaatcataaatattagcacagtagga

SEQ ID NO: 6862229 - DNA, 55 bp, Homo sapiens
gcccaagtcagtgcttctggcaatatgtatttttctaaaggcatgtgactggggc

SEQ ID NO: 6862230 - DNA, 55 bp, Homo sapiens
tcgttgcacctcagtttcctcacctgtaaaatgaggataacgacagtgacgacga

SEQ ID NO: 6862231 - DNA, 67 bp, Homo sapiens
acaccagtcctgacctcatgctggcagagagagatctctactctgaagcctttgtacaggcctgggt

SEQ ID NO: 6862232 - DNA, 62 bp, Homo sapiens
tgggcgtggggccttctgcccgctggcctgcaccaggcggaagatggccccatagaggccca

SEQ ID NO: 6862233 - DNA, 76 bp, Homo sapiens
ttgagtcttgttgctggccccgtccagaggaagcagccttcctgactctgtacctggcatagcaaccttagcttaa

SEQ ID NO: 6862234 - DNA, 104 bp, Homo sapiens
ttctccatgggacagttaaataatgcaagcatggaatactccaggatgtcaaagtggatagagatcagtgtgagtaccatgctcagggatgactccatggtgaa

SEQ ID NO: 6862235 - DNA, 68 bp, Homo sapiens
gaattccagcagggtaggggtggaagggagtgcaaaaacatgcagtctggccttgccttgtcgagttt

SEQ ID NO: 6862236 - DNA, 90 bp, Homo sapiens
catggtctcaagcctgaagaggctccgcccacaagctggcccatgaagttagcaatgcctgtggcttcagtcaattgtcttgagactgtg

SEQ ID NO: 6862237 - DNA, 95 bp, Homo sapiens
cagtgaatgtgggaagtcacaagggagtccataggttcttatgggagtaggagattccagcactaatgggctctgtgaacccaggcaagtcactg

SEQ ID NO: 6862238 - DNA, 71 bp, Homo sapiens
cttgctgtgcacctgaataccacatactgacttgagcaaaacagtagtgttattgttagggctgaagcaag

SEQ ID NO: 6862239 - DNA, 79 bp, Homo sapiens
gtaaagaagaaacttcaaggatttgcaaatctttttcatcttaaaagttttgtggcctcctgtgaggttgtagttttat

SEQ ID NO: 6862240 - DNA, 61 bp, Homo sapiens
gcccactgatttagtttgtgttacctggactttccggggcagaaagcagatacagttgggt

SEQ ID NO: 6862241 - DNA, 66 bp, Homo sapiens
ttgggttagcttatctatacagactttttaactctaaaatgtaactttataggtgagaaaacttaa

SEQ ID NO: 6862242 - DNA, 81 bp, Homo sapiens
ggtgttagagtgggaggctggcatgtggtgaatattatagagaacataaaatagttaatccatttcagtgttccacttgcc

SEQ ID NO: 6862243 - DNA, 63 bp, Homo sapiens
gtgccctggctcacagtgtctctgaaatggtattattgtagtgggataattgtgattagggac

SEQ ID NO: 6862244 - DNA, 91 bp, Homo sapiens
aatgaattctcagacacaagagtaaagtcaaatactagaaaacggttttaaggtgctttatttagctctttctgtgtgtgcattgtttatt

SEQ ID NO: 6862245 - DNA, 120 bp, Homo sapiens
tggctagcagttttgcagatttttccccctaattatttgaagctgttcagcctggtattcgaactattgatgcagagccaaattgccagcaggggagagatctgtccaacccaggagcta

SEQ ID NO: 6862246 - DNA, 59 bp, Homo sapiens
ttgaggctctgtgatgtgccaggcactgttctaagtgctggggacatagcaggcagcaa

SEQ ID NO: 6862247 - DNA, 59 bp, Homo sapiens
agctggtttatttctatatccttgccaaaactggcagtgcatataggctgaaccatgct

SEQ ID NO: 6862248 - DNA, 72 bp, Homo sapiens
tgcacagtgaggatccggtcagctgtataggagttaacatcctggggtgctggctgagaccatcagggtgta

SEQ ID NO: 6862249 - DNA, 56 bp, Homo sapiens
aagcaattcacagttcacttaaagcaatagtgctgaaagtctatttagagttgctt

SEQ ID NO: 6862250 - DNA, 65 bp, Homo sapiens
ctctgcatcaggcattatggatgaaaggggacagtctcaaccttcaaaatgtttgcagtgcagag

SEQ ID NO: 6862251 - DNA, 73 bp, Homo sapiens
agggtgatttgttcatggccccatcttggtgtccagtctggccttgaaagggggtcttggaacaggtggccct

SEQ ID NO: 6862252 - DNA, 94 bp, Homo sapiens
agctgcctggagatagcagaagcaggcctctgggcagcacacgagccagcaccaggaggcccttctcatccctgctcctctccacacagtagct

SEQ ID NO: 6862253 - DNA, 76 bp, Homo sapiens
gacagttgtccttcaggcattcccatgcataagagccctgcctcaactcttcgtgtggtttgtctgtgtgactgtc

SEQ ID NO: 6862254 - DNA, 61 bp, Homo sapiens
acccaagatgtgggcactgctttgtagtcaagggctatttgagcagcagatgcacttaggt

SEQ ID NO: 6862255 - DNA, 59 bp, Homo sapiens
ctgagggaattcactggaacgccctgtctctgacagtacgatttcttgagtttcttgag

SEQ ID NO: 6862256 - DNA, 68 bp, Homo sapiens
ggagaacaagaaggctcagctggtggtgatcgcacatgacatggatcccattgagccagttgtcttcc

SEQ ID NO: 6862257 - DNA, 79 bp, Homo sapiens
atgttttcaaagtaaacttgtattcataaagtcaaaagttttgaaagtggtttttaaacaggttgaactgtgagaacat

SEQ ID NO: 6862258 - DNA, 78 bp, Homo sapiens
gggggagacaagccagagcaggacaggcccgtgccaccgaaaggaaagggccatgctgttgcctgctggtgcttcctc

SEQ ID NO: 6862259 - DNA, 69 bp, Homo sapiens
caaccttatttggaatggggtctttgcagatatagtcaagttaaaaagaggtcataccagataagggtg

SEQ ID NO: 6862260 - DNA, 102 bp, Homo sapiens
tcagagtgtcctgagaaccacccggagagcggggattaacgtggaagcagcggagcttctgagggaaccttgttcttgtggctgcccacaggacagctttga

SEQ ID NO: 6862261 - DNA, 70 bp, Homo sapiens
taggaagtaaaatgttgctgtatgaataggaaggagggtcttcctgtcaatgagaattaatgttttccta

SEQ ID NO: 6862262 - DNA, 56 bp, Homo sapiens
ctttctgtagggatttcacagtttctggttggcagagtaaggacccaagcaggaag

SEQ ID NO: 6862263 - DNA, 90 bp, Homo sapiens
cacatagtttggaggttagaggggccaagagcatggactctaggaccagcctaagtttgacttttggctctgccacttattagctatgtg

SEQ ID NO: 6862264 - DNA, 74 bp, Homo sapiens
attgtctcttaattgtcttagtctgtgcaggctgctgtaacaaagtatcacagactgggtaatttataatcaat

SEQ ID NO: 6862265 - DNA, 121 bp, Homo sapiens
gttgagcaataaacaggtttttaattttttccccttccgtctcttgagtgtctgtctctgatggatgatgtgacagaggaaggcggctccataaattctgaattctgaatactaaatcagc

SEQ ID NO: 6862266 - DNA, 56 bp, Homo sapiens
ggcagaagctgggcagcgaggtggcgtaaagcagggtcaccgcgtccagcctctcc

SEQ ID NO: 6862267 - DNA, 61 bp, Homo sapiens
tatagcatgcatcggtgcttcatcctttttatggctgaataacagtccatgcatggctata

SEQ ID NO: 6862268 - DNA, 56 bp, Homo sapiens
gtgtgtttttatcctttgaatcactgtaatagttatgttgaagaataaaaacacat

SEQ ID NO: 6862269 - DNA, 70 bp, Homo sapiens
gaagaagaagggtaaggagtgttgactgtgtgtgatcctgtcagtgggccgtcctctcattcttattttc

SEQ ID NO: 6862270 - DNA, 108 bp, Homo sapiens
tttcattagacttgttttgaaactcatgatcatcactgtaaatacctctgtgtggaaagcaatgaaataaaaccaaaagaagtagtgaagtcatggcaagctgtgaga

SEQ ID NO: 6862271 - DNA, 62 bp, Homo sapiens
agtggatggtattgggaccaggatatcagcatttccttattccggtcctaactctctccact

SEQ ID NO: 6862272 - DNA, 57 bp, Homo sapiens
cattctgagacaattgccgtcagttaggagaacttaataggggcttattttagaatg

SEQ ID NO: 6862273 - DNA, 82 bp, Homo sapiens
cttgctcgaaacaaccaaatgttttactggcatctgggagtgaagccaatgaacacatgtggtcagtttctttatgagtagg

SEQ ID NO: 6862274 - DNA, 82 bp, Homo sapiens
ccagtgtgccttgtgatgaatgtctctttttacaccttggggcagcctatcagtgataaagacgtgtcataattaatattgg

SEQ ID NO: 6862275 - DNA, 84 bp, Homo sapiens
gggctttttaaaacttgctgaagctgccaaaccagtgttgtgttctcacatcccagaatcctagcattgttgggggcaaagccc

SEQ ID NO: 6862276 - DNA, 76 bp, Homo sapiens
gcaccggaaacataggggtcattaaaaatagcttacacacagcacaaattttttttagtgatctcgtgtttttagc

SEQ ID NO: 6862277 - DNA, 56 bp, Homo sapiens
ctgtttcaatttgaggatcagccagaagttatgaggtgacaattcaggtgaaacag

SEQ ID NO: 6862278 - DNA, 69 bp, Homo sapiens
tcatcagtgtagagttgctggattggctggacactttccagctctgatccataatttataccaagatgg

SEQ ID NO: 6862279 - DNA, 69 bp, Homo sapiens
ggggaaaggatagggaatgggtctgagggcaaagaggcctagaacagcacatcttctgatcttttgccc

SEQ ID NO: 6862280 - DNA, 74 bp, Homo sapiens
cccttaacctgaccctgggatgcttgttttacaatcaaaataagagggtaaggaagcccccagaggtgggaggg

SEQ ID NO: 6862281 - DNA, 57 bp, Homo sapiens
gctccatgtacctggggtcacatttgaccagtgggcaggtgctccagggcaaggagt

SEQ ID NO: 6862282 - DNA, 56 bp, Homo sapiens
agtccagtgaactgtaaataggcaagttggatctcgtttaggcagaaaattgggct

SEQ ID NO: 6862283 - DNA, 73 bp, Homo sapiens
tctgacaagggtatattcaacaggctaatgtcagccttccaggtggtagtggcctgtgggtattgtcttcaga

SEQ ID NO: 6862284 - DNA, 122 bp, Homo sapiens
taatctgcaaatctgtgtatcatcatgagataaagcaaataggactattgcattccaattctgtacagtcttcttaatgcttttcatcctctgtgatttatattattcaagatttcatattg

SEQ ID NO: 6862285 - DNA, 55 bp, Homo sapiens
agtggtcttagcttgctgggctccatgggggtgggatctgccgagctagaccact

SEQ ID NO: 6862286 - DNA, 77 bp, Homo sapiens
tgggctatgataaatagtgctgccatgagtatctgtacactagttgtactagtggactcattttttttcatggccca

SEQ ID NO: 6862287 - DNA, 58 bp, Homo sapiens
aggggcaggtgctgcacttagactggccaagagccatatccgggaagaccctgcccct

SEQ ID NO: 6862288 - DNA, 64 bp, Homo sapiens
cacaggcattagaggccaaaatacccggcgacttcaccttgcagggccttggcttcttcctatg

SEQ ID NO: 6862289 - DNA, 89 bp, Homo sapiens
ccatgagggtaagtaccgttaatcccataatatggatgaggaaactgattcatttagagggattaagcaatttgcccaataccacatgg

SEQ ID NO: 6862290 - DNA, 91 bp, Homo sapiens
aagaaatctctagtagcaaaacaatcacagtttacaaacctgctgttttctgtcaaatttcagttagactgtgttttcattggggtttctt

SEQ ID NO: 6862291 - DNA, 114 bp, Homo sapiens
gttaaatatgttcacttttccccctttcccatagcaaaagcatgtgcaatacaccatgataaagtgattggataattattgttttagctagggaaagtgaaatttatgttttac

SEQ ID NO: 6862292 - DNA, 130 bp, Homo sapiens
gaatatggtcaataaatggtagctgccatttttgtagtcattagaagaggcgagccttgaacgactagcctctgttgaaaattacaaacaagagagtggcctacatttgcaaacagtgagcatagccacc

SEQ ID NO: 6862293 - DNA, 63 bp, Homo sapiens
ctctccctggtggccttcagcccacaactgcaaggcggttgtggtgttgggtgccagcgagag

SEQ ID NO: 6862294 - DNA, 116 bp, Homo sapiens
gtggcatttcactgtattggtaagaaacttcattagtagtgagactgtgcttcaggtgatgtcaatttcaacagctgataagaagacattttaaagataagatcagcaattgtcat

SEQ ID NO: 6862295 - DNA, 69 bp, Homo sapiens
cgtgttggaccaggacacagtggcaaggtgagccaggttggccttctgtgctcctggcctttcctcacg

SEQ ID NO: 6862296 - DNA, 58 bp, Homo sapiens
gctgaggaggtgtggttaggtggcagtcaaaggccacctatcctgctaccctcccagc

SEQ ID NO: 6862297 - DNA, 58 bp, Homo sapiens
ctccccaggagttttactttgcagggatgtctctctccttcaatatgaccctggggag

SEQ ID NO: 6862298 - DNA, 70 bp, Homo sapiens
gtaaatagaatcctgcagcaagccttgtgtttcaactgtataacagaagcttgaactggggatttttaac

SEQ ID NO: 6862299 - DNA, 79 bp, Homo sapiens
ccatggtaatactgtgatatcgagcgattgtctgggccattgtcccacatcttgtctgggtacacagtactgaacatgg

SEQ ID NO: 6862300 - DNA, 56 bp, Homo sapiens
gatatgtgacctccatatggtttcatctttctgaacacacagggagaccacatgtc

SEQ ID NO: 6862301 - DNA, 56 bp, Homo sapiens
tattttggctctcagcagttagcttttctggagcggaatagctgagggcaagagta

SEQ ID NO: 6862302 - DNA, 56 bp, Homo sapiens
ctgaggagggaagtccccaaagcacacacgcagtaagttgggctttccccctttag

SEQ ID NO: 6862303 - DNA, 58 bp, Homo sapiens
tgtccatacctttacctgtgtagctaaatgatgctagaggaaacagtaaagctggaca

SEQ ID NO: 6862304 - DNA, 129 bp, Homo sapiens
cattgccatgatttttctataacttggcgcaggccaatggtttcaggcaggactttcagagcagacttctgtcaaatttgccatatggagttactgggctcagattatagaggttttcctggttgtttg

SEQ ID NO: 6862305 - DNA, 55 bp, Homo sapiens
gagctgctttgtttcagattacatttgtacctctgaaatctgtaagcactagctc

SEQ ID NO: 6862306 - DNA, 78 bp, Homo sapiens
acaggaaaggacacagacttagatttaaattacatgtaagattctgtggttttagtctattctctgtcctttccttgt

SEQ ID NO: 6862307 - DNA, 116 bp, Homo sapiens
tctgcaccttgggaggaacagctaagtatcatggccaaaacttgttcctggggttcctttttcccttgagggtttcttgcttatggtgctgttgtccccacattaatctctgcaga

SEQ ID NO: 6862308 - DNA, 67 bp, Homo sapiens
ctgaacccaggaggttgaggctgcagtgagtcatgatcatgccactgcacttcagcctgggtgacag

SEQ ID NO: 6862309 - DNA, 94 bp, Homo sapiens
ggaaatgaatgttcagtaggcagggctgtggggagaagatattgctactgtgttctagccccaatgtccacccatgcctattgttttctctttc

SEQ ID NO: 6862310 - DNA, 59 bp, Homo sapiens
tctcctcctgtacacaattccgaggataagacattaccgcaaaggatgtataggtgaga

SEQ ID NO: 6862311 - DNA, 92 bp, Homo sapiens
attacctgggatcttgtttaaatgcagacgttgattcaggaggtctggagtggcacctgagactctgcatttctaataacatttcaagtgat

SEQ ID NO: 6862312 - DNA, 81 bp, Homo sapiens
cctgttgtaagcaagatttattgaattttctcatcatagtcttaaaagagcagtactccaataggtcttgtttactaaagg

SEQ ID NO: 6862313 - DNA, 55 bp, Homo sapiens
gctgtggccgggcccaggccgccagggacgctttgagacatggaccggccacagc

SEQ ID NO: 6862314 - DNA, 61 bp, Homo sapiens
ctcaggtcaggaaaataagattgtgggttttttttgcaaactcatcttttctgtcctcgag

SEQ ID NO: 6862315 - DNA, 60 bp, Homo sapiens
ttggccttctcttcccggtccttcctggagttgggaaaagctgggttgagggagcgttaa

SEQ ID NO: 6862316 - DNA, 97 bp, Homo sapiens
atgatgtgtgatgctacctggatgaaagccaggctcatatggatgaatgaaatattcaaaatgatatcctgacttttattaaagtaaaatatgttgt

SEQ ID NO: 6862317 - DNA, 77 bp, Homo sapiens
cagagaaccaaaacctgctactaaaggatcagcaggaactgcgcctggttcctttgttaaggaggtttgtttggctg

SEQ ID NO: 6862318 - DNA, 67 bp, Homo sapiens
ctgcattttcctgtgattcagaattctatcttggcaagatactcttctggacattgggcaatagcag

SEQ ID NO: 6862319 - DNA, 80 bp, Homo sapiens
gaatttggccttgaaatattagttccttctggagagccctatattctaaccagaataagctgtgttgtcaagctgttttt

SEQ ID NO: 6862320 - DNA, 121 bp, Homo sapiens
gttgggtgtgggagggatccaggcccccaagctctaaggccttgaaaggatgtcctgttaaggcagctactttcaatgtcttgggagtcaggttatgtggggccccctcccctacctcaac

SEQ ID NO: 6862321 - DNA, 105 bp, Homo sapiens
tctctagacccgaaaatgtcctctgtggtttggctgacaaatggaatctctttagaaaacatgcaaaagggtatctcagctatccatgaacgattcggtctagga

SEQ ID NO: 6862322 - DNA, 69 bp, Homo sapiens
gggtaataatggtacctacatcatgaagttgtaaatgcttattaaattgtagctactatactatcaccc

SEQ ID NO: 6862323 - DNA, 65 bp, Homo sapiens
ggggggttattcttattaaaatgtttagagaggactttctgttcatttctgcagaattgctcttc

SEQ ID NO: 6862324 - DNA, 103 bp, Homo sapiens
tctgaggtgtgatacatccttgcctggtctctgccctcctgacattgctgcttctggtgctgctgtgtcctgggctggtagagctgcgatgtgttttcttgga

SEQ ID NO: 6862325 - DNA, 81 bp, Homo sapiens
gcagtgcctggctaggactcatcctgtttcttctcttaagtgagtggagctatggagattcctatgcttatatgcaactgc

SEQ ID NO: 6862326 - DNA, 56 bp, Homo sapiens
caagcaggtcctgaatctggtccatcatgcagatagccaacgcagaaccatgtttg

SEQ ID NO: 6862327 - DNA, 62 bp, Homo sapiens
gccatgctctctggcaacttgtgttttggcaactctcaaccatgtgcccatgagagcatggt

SEQ ID NO: 6862328 - DNA, 76 bp, Homo sapiens
agacaaaaggaacaaaggccgttaataaccaccttgtctagtaggtggtgaaaatagcctttgaaccattttatct

SEQ ID NO: 6862329 - DNA, 68 bp, Homo sapiens
ggcaggtgagttcattatctgcacattggtatttctgcatatgtaaaaatgaatttataatacctgcc

SEQ ID NO: 6862330 - DNA, 79 bp, Homo sapiens
gcacagggaaaatgcatgtatgtaatatgcttgtcggcttcagcaacaactcatgtatacatacacatttactatatgt

SEQ ID NO: 6862331 - DNA, 88 bp, Homo sapiens
ccctgcgccaggacgctcacccaagaccatcggaagtgaagcatcagctgcaccactgcatgggtggtcgtgaggtgactgagcaggg

SEQ ID NO: 6862332 - DNA, 78 bp, Homo sapiens
ctctcgctcctcgttttgagcagctgtctttgagaggcaatcttctgaattgactggctcagaattgatccgtgagag

SEQ ID NO: 6862333 - DNA, 72 bp, Homo sapiens
aaatgcacacaccaggaaactataaatttgctccagcctggagtgatcttttattctggtagatgtttattt

SEQ ID NO: 6862334 - DNA, 56 bp, Homo sapiens
agtctctgtgagctcccaatggaaggtatagaagctactgggagctaacggagatt

SEQ ID NO: 6862335 - DNA, 60 bp, Homo sapiens
gggcacaggctgcacgaccccagcctggcctcgggcttgctgggagtcgcgtctgtggcc

SEQ ID NO: 6862336 - DNA, 60 bp, Homo sapiens
ttcccctgtcacagtggttctcaacgttcactgcatattagaatcacctgtggagcagaa

SEQ ID NO: 6862337 - DNA, 59 bp, Homo sapiens
gctttgtgattgatacttaaaaagtacataaatgtgttgtaatgtcaaagtcacaaggt

SEQ ID NO: 6862338 - DNA, 61 bp, Homo sapiens
tctgtagcagtgttccagcattgtgccaccagcacagtgggagacaggagatagttataga

SEQ ID NO: 6862339 - DNA, 55 bp, Homo sapiens
aacaaacattacctggtgctggttttatcaaggtccagtttgggttctgtttgtt

SEQ ID NO: 6862340 - DNA, 64 bp, Homo sapiens
ctggtttatgagggaagggatgttggccccatgaaatcattaaccctgtccccacgtaaggcag

SEQ ID NO: 6862341 - DNA, 57 bp, Homo sapiens
gtgatggagggagtttttgttgacttggtagttcctgtctgcagaccccttcattgc

SEQ ID NO: 6862342 - DNA, 65 bp, Homo sapiens
tttaaaactgtgaggatgtgcaaattctgcctacgaatagattggatttgccctccaggattaga

SEQ ID NO: 6862343 - DNA, 77 bp, Homo sapiens
cagggagccccagcatggagctttgggccttggtttcgggaaactgggactggccctggctgctaggctgctccctg

SEQ ID NO: 6862344 - DNA, 57 bp, Homo sapiens
tgagtgtcaaatgtgtgccaagctgctgctgcagacttgctctcttttgacagctca

SEQ ID NO: 6862345 - DNA, 58 bp, Homo sapiens
agatggagttagtaccagagtcttaggaagggaaaggatgtggtactgtggtttattt

SEQ ID NO: 6862346 - DNA, 58 bp, Homo sapiens
gcttcatttgagaacctctgtgttaactccacaaagggggaaacaggctcagagaagc

SEQ ID NO: 6862347 - DNA, 87 bp, Homo sapiens
tgagtcttctgctctggtcataagtttacaatcaaagtgtcagacaggctgcattatcatctggaagcttgactggggtaaagttca

SEQ ID NO: 6862348 - DNA, 69 bp, Homo sapiens
ctgatctctccaggttcagtcgatggaagatctcagagacacatttcatagactgggcctgggaaccag

SEQ ID NO: 6862349 - DNA, 74 bp, Homo sapiens
agaaaaagaggaaattgacccaatatcttgtgatgaggaaagtcattagataattatgtcaatttcttgcttct

SEQ ID NO: 6862350 - DNA, 73 bp, Homo sapiens
actgtaaggaggttggtgggttggattggggcttttgtggaactaaatccaccccatctgctattcttgcagt

SEQ ID NO: 6862351 - DNA, 86 bp, Homo sapiens
ggtcagaggtttgcttgcacagtggtttagagcctggactggccactcagccaaggctcaaattttgtgtctggcactttctggct

SEQ ID NO: 6862352 - DNA, 56 bp, Homo sapiens
gctgaaaagatgccagatcttagcgaagaactgcaagaagatggttaactttcagt

SEQ ID NO: 6862353 - DNA, 102 bp, Homo sapiens
tttgttactgaaggcgaaaatgatctgctatgtatattttatgagaaaatgtgttttgtttctagttctacaggcagccctccctttccgccccctaataag

SEQ ID NO: 6862354 - DNA, 66 bp, Homo sapiens
gatgaagtcttaagaaaggccaaaagcatgaacattatgtgctcttggtttttccagggctgattc

SEQ ID NO: 6862355 - DNA, 125 bp, Homo sapiens
gaagtttcccttggggaatggggctctaacggtgggattcctggcatgtggcaggtccacggagaagctacagcagtgcacagagaaccctgttccagtcctggctctcaacaaatggaaacttc

SEQ ID NO: 6862356 - DNA, 57 bp, Homo sapiens
tcaacaggttcaagccttgcagcagccaggctgctggagtctcttgaccctgggtga

SEQ ID NO: 6862357 - DNA, 71 bp, Homo sapiens
ggcagctacaaggcagcagagcttattaactaaaagcacagcttttagaaccaatctgcccatgtgctgtc

SEQ ID NO: 6862358 - DNA, 130 bp, Homo sapiens
tgccagacaaggccagctggaggagcctggaaggaggtggggcggggctctgagaagcatcgactgcggctgccctccctccctgcctccatctccaccctccaccaccaggccggtgtaatcagggcta

SEQ ID NO: 6862359 - DNA, 95 bp, Homo sapiens
actcacggcgtgtccctctgaccaggtggacggcgagtacaggtaccgctgcggcacttgtgagaagaccttccgcatcgagagcgcgctggagt

SEQ ID NO: 6862360 - DNA, 103 bp, Homo sapiens
gtatgtggatttaagtgcatgtgtgtataaatgcgtgtgtgtataagtgtgtgtgcgtatgtataaatgcatgtgtggatgtgtatatgtatgatctacatgc

SEQ ID NO: 6862361 - DNA, 78 bp, Homo sapiens
ccaaatgtttaggtcttagatacagtagaaagactctgtgggccacagacagagtgctgtatctgagaaagcaactgg

SEQ ID NO: 6862362 - DNA, 94 bp, Homo sapiens
ctgctttgtcttcctgtttgagatcttttcagaatttatcagtgtctctgagcatgttaaaagtctgagtgggagagaaaggaaggaaaggcag

SEQ ID NO: 6862363 - DNA, 74 bp, Homo sapiens
taatatctgcttgagtttgaagtcaggaatttgccaaacatgggctctgatgacggatttcagcatgagggtta

SEQ ID NO: 6862364 - DNA, 98 bp, Homo sapiens
catatgccatcaacaatgtcaacacttggtatgtcagggttattttttagttttagccattctggtggccatgtggtgatatcttattgtggtttttg

SEQ ID NO: 6862365 - DNA, 67 bp, Homo sapiens
gtgctgtctttgtcttggtatccctagtgcagtgcccatcctcaggcctggcccaggatgatggcgc

SEQ ID NO: 6862366 - DNA, 68 bp, Homo sapiens
tcttcctttcctttccaaaattctgccttccagagcagttgaggcagagtgatgctgggaatataaga

SEQ ID NO: 6862367 - DNA, 56 bp, Homo sapiens
ccatgatttcccctgctgcacatgcatgaacatggttgttgctaccggaagcatgg

SEQ ID NO: 6862368 - DNA, 77 bp, Homo sapiens
ccccatttcttattttcatggcttctgctcagtgtacccaagatagtcactgggagtcatgaggaaggaggtgccgg

SEQ ID NO: 6862369 - DNA, 83 bp, Homo sapiens
agaatcgcttgaaccctggaggcggatgttgcagtgaccgagatcgcgccactgcactccagcctgggtgacagagcgagact

SEQ ID NO: 6862370 - DNA, 78 bp, Homo sapiens
gggaagcggggtctccatgtgctgggtgatggatttccgggcacagcagctgggggccctgggtcaattatacttccc

SEQ ID NO: 6862371 - DNA, 57 bp, Homo sapiens
ttgctcccagctgccctgcatggtttaatagacaactatgtaaaagacagggagtag

SEQ ID NO: 6862372 - DNA, 98 bp, Homo sapiens
aggtcaactctgcttcccacaggatgagagctgagcggtttacgtgaatggccatcagacttgttttcattgttgtgtaggataaggtagagttgcct

SEQ ID NO: 6862373 - DNA, 56 bp, Homo sapiens
gccagcagccacagaagtcactggtttcaggtgagtgattctaagtaagctgcggc

SEQ ID NO: 6862374 - DNA, 74 bp, Homo sapiens
ggtggggggtcaggctcccctagaatgaagacgggcctcttggggcctgcagggcctgggcctaccccctcatc

SEQ ID NO: 6862375 - DNA, 68 bp, Homo sapiens
gggaaagactttcttgcagaaatattccctgtggaactttggggaaagacattctgagaagtaatctc

SEQ ID NO: 6862376 - DNA, 83 bp, Homo sapiens
cctcagccaatgactaacatgaggaatatgctaatttctgtgcccctcaggttcagagacatgttctagatcatcgccagagg

SEQ ID NO: 6862377 - DNA, 83 bp, Homo sapiens
agatttattgctgcagagatgggtgccctttttgtagcatgacttttatggaaagggcagttttctttgcattaagtttgtct

SEQ ID NO: 6862378 - DNA, 55 bp, Homo sapiens
gcctctgtttctgtttttgttcatctagtgaattaagaacagtagaacagtaggt

SEQ ID NO: 6862379 - DNA, 64 bp, Homo sapiens
cataacatccttgctactttgactttgtatctgacaacatctcagtctttgcaaggatgctgtg

SEQ ID NO: 6862380 - DNA, 69 bp, Homo sapiens
gagctgatggaagaaaagaccccctgctcttctcctcccaggtggaattattttgtcttcccttagttt

SEQ ID NO: 6862381 - DNA, 58 bp, Homo sapiens
caaggccagggaatttttctggaatctcagattcaaaagagatcacctgggatctttg

SEQ ID NO: 6862382 - DNA, 70 bp, Homo sapiens
cgcttcaaggctaaggaagggaaggaccggttttgccttcaaaggttttttccttccagcccttgctgtg

SEQ ID NO: 6862383 - DNA, 77 bp, Homo sapiens
tcggataatctcagagatatctgtgtcctacacagcagggttctgtaaggggcacatggatacctctgagaagctga

SEQ ID NO: 6862384 - DNA, 63 bp, Homo sapiens
gattcacattgttaatttagccattttgaaattcagatgagtgagcaagttgataatggcctc

SEQ ID NO: 6862385 - DNA, 59 bp, Homo sapiens
ggaggactgagacactcctggccaacatccctctcggccaaggctgagtgtctccctcc

SEQ ID NO: 6862386 - DNA, 76 bp, Homo sapiens
tggatggggctctggagaaaggccagtttacagaaaaaatacaaaagtcactttttctccatagtctcagattcca

SEQ ID NO: 6862387 - DNA, 67 bp, Homo sapiens
gtaatatcaggtagatttaatattctgtagtccaggctttggaaaacactgctctacttgatattat

SEQ ID NO: 6862388 - DNA, 96 bp, Homo sapiens
gaggcaggaaatcgcttgaacccagggtggaggttgcagtgagccgagaccgtgccattgcactccagcctgggtgacaaagcaagagtccatctc

SEQ ID NO: 6862389 - DNA, 69 bp, Homo sapiens
ttagacatcagcttgtgtgcagggggaagccatcaaagctgtcttttgtttgcctgttgatttgtgtga

SEQ ID NO: 6862390 - DNA, 96 bp, Homo sapiens
gaaatatgttgttctctcaaattactatgtatgtgtgtgtgcatgtgtgtatgtgcatgaacacatgtgcatgtatataatttataagatgatttc

SEQ ID NO: 6862391 - DNA, 63 bp, Homo sapiens
cagaataagcctgtgcatgggcagatggtgctttattcctaatttgcagggcatgtacatctg

SEQ ID NO: 6862392 - DNA, 97 bp, Homo sapiens
aggtcatgacatttgagcaacaatggaggtttggagggagtggctcttaggctaggtctacctggagtccgttgttaagttcaattttgtttgttct

SEQ ID NO: 6862393 - DNA, 126 bp, Homo sapiens
tacacttataaaacatttcagtagattaagtttagaggagggtaatttatttgaatgagtttactcattgagatatctgttaattttcttcatcctattcttctgattcttagttttgtacatgta

SEQ ID NO: 6862394 - DNA, 81 bp, Homo sapiens
tggctctcctagtgggtcagacagccagtgggccctggctctttcccagttggcccgctgatctgacccctctgttgaaca

SEQ ID NO: 6862395 - DNA, 56 bp, Homo sapiens
cctttctgacagtgatggggggccaggcctggtacccccatccatgtcaggagagg

SEQ ID NO: 6862396 - DNA, 75 bp, Homo sapiens
aattggacttgacacgtgagttggtgtttctggttgacaatacaagaggaacacaagctatgatccacaccaatt

SEQ ID NO: 6862397 - DNA, 61 bp, Homo sapiens
ttgattgctaagtggtatttgggtttgtaatcaaacatcacaatttcatttatgcagtcag

SEQ ID NO: 6862398 - DNA, 63 bp, Homo sapiens
gtcagggccatttgctggagctttgggccagttttccagggcccctgagcagatggccccggc

SEQ ID NO: 6862399 - DNA, 69 bp, Homo sapiens
tcttcaaagctgcaagctcctgaggaatctgctgaggttcttaattggccattgcaggtgctttgggga

SEQ ID NO: 6862400 - DNA, 57 bp, Homo sapiens
ggtaaacaagcacaagtctgttctgtgcctacataagatgggctaagtttgtcctcc

SEQ ID NO: 6862401 - DNA, 81 bp, Homo sapiens
ccaggaattgtgtacaatgactctcagtttggctttgtttagtgtttttctcatggtcaaatagaggttatgtgtttttgg

SEQ ID NO: 6862402 - DNA, 55 bp, Homo sapiens
gtaagcattcattgtctgtatagtcaggctgactgtacaggttttcagtgcttgc

SEQ ID NO: 6862403 - DNA, 59 bp, Homo sapiens
tggcagactttagggtctacatgtttcaaaatggaaaatgtagctcagtgaagttgtca

SEQ ID NO: 6862404 - DNA, 96 bp, Homo sapiens
tagcacattttgcttaatctagattttgcgtcaacaaataactttcagtaactgaggcaatcttgaagcggattagagcaaattcctcctgtgcta

SEQ ID NO: 6862405 - DNA, 73 bp, Homo sapiens
aagcctttgtcagacaaattggtcgtttggagcagtcattatatctccaaatgccaggaatctctgaaggttt

SEQ ID NO: 6862406 - DNA, 64 bp, Homo sapiens
gaatggcaggacagattttgtggattaatgggcagatgttgacgcacagagtcttgcagcgttc

SEQ ID NO: 6862407 - DNA, 62 bp, Homo sapiens
ttcctttgtttatttaaatatatagtttacatctgttggatatttgaataaaggataaggaa

SEQ ID NO: 6862408 - DNA, 59 bp, Homo sapiens
gggtcccaggactctgacacccccaatggcccttgtagccttggggagtcctgtgatcc

SEQ ID NO: 6862409 - DNA, 66 bp, Homo sapiens
tgtcactgatttcttagctctttaagacttaatgaaagaactctgcagggtggcaagttagtgaca

SEQ ID NO: 6862410 - DNA, 64 bp, Homo sapiens
gctgccacaaggctgggaagctgagcagagctggcaacaggttcagaggctacagtctgggagt

SEQ ID NO: 6862411 - DNA, 85 bp, Homo sapiens
gcctcgaaataaattttggtaaaatgaactagctttcctttgctgtagccaaggatatttagaaattttgcaaatgtttgagtgc

SEQ ID NO: 6862412 - DNA, 82 bp, Homo sapiens
tggtacttgaagagaagttgttcgtggtggattcgctttacttatgacgaatcattcacggacaacacttttttcagtacca

SEQ ID NO: 6862413 - DNA, 90 bp, Homo sapiens
tgaaatatggaaggtatatttggtttcaggattctcagggacattttggcctgtagaatctgtagacccattgtttttgcacatatttta

SEQ ID NO: 6862414 - DNA, 81 bp, Homo sapiens
tgttgtcacctattctgcatgatattaaatgtaaaattgccagcatttttgtcatttctcagcatgaaattggtggaaaca

SEQ ID NO: 6862415 - DNA, 73 bp, Homo sapiens
gatgacatgttaagtgggaccagtgtccttagtgctggcctgagtgccaagttctgtgttccccttggccatc

SEQ ID NO: 6862416 - DNA, 64 bp, Homo sapiens
aacagctgttggccagaatccaggaggtcaaaactggccagctgtatctttggccagcagtgtt

SEQ ID NO: 6862417 - DNA, 61 bp, Homo sapiens
ttgtgtgagcaagccagccaccatccatcttcctttggaaggctgtgacgctgctccacag

SEQ ID NO: 6862418 - DNA, 108 bp, Homo sapiens
tgaatgctccaatcttcactcacctggctcaattttaaaatctttgacttccacctgaactcttgtcaatgtggagtaggtagttgggcaaagagtttgggcatgtca

SEQ ID NO: 6862419 - DNA, 94 bp, Homo sapiens
taggagtgattagaaataggacagtgggatatagatttaaggcttttggcaaagttgaaacttgttctcttgtgcctatcccctagaattcctg

SEQ ID NO: 6862420 - DNA, 62 bp, Homo sapiens
gtagagacggggtttcaccgagttagccaggatggtctcgatctcctgaccttgtgatctgc

SEQ ID NO: 6862421 - DNA, 61 bp, Homo sapiens
ccagaaaatccatggctctttcgttgctgttaaatgacaataaagcaggtggatttattgg

SEQ ID NO: 6862422 - DNA, 61 bp, Homo sapiens
tcgcgcggcggaacgctccgcgctgcgccggtggcggcaggatacagcggcttctgcgcga

SEQ ID NO: 6862423 - DNA, 129 bp, Homo sapiens
atgagagttgcagcctcagcaccagctttgcaggaggtggctgaacttgagggagtacccagaagggggtcctcagagatgggcatctaagatacttcagagttgttgacgccatggggcaactttcat

SEQ ID NO: 6862424 - DNA, 93 bp, Homo sapiens
atgatataatgctttcaagtgtatacttttagtagaattgtccagcatgaaccaatttgtatgtaaatgtatatgctgagtccaatatattat

SEQ ID NO: 6862425 - DNA, 59 bp, Homo sapiens
cctgggccttcattgctctcccataccacttcaatggggaacagatcataggctcttgg

SEQ ID NO: 6862426 - DNA, 61 bp, Homo sapiens
tgagaagctaattgtatggaggtgccatttggtatcttacacgataactgttagtatttca

SEQ ID NO: 6862427 - DNA, 63 bp, Homo sapiens
cttgtatacagagaaggctcatgtcactcatttgacaaatattgagtgtctactgcatgccag

SEQ ID NO: 6862428 - DNA, 74 bp, Homo sapiens
gctgagtttctatgtgaaatgcacatgtctttttccttcatccagacgcgcatattccaagcataggaaacagc

SEQ ID NO: 6862429 - DNA, 86 bp, Homo sapiens
catttttgtgttcaatagattatttgctcattacttctccctttaacagggtctgagaaatgaatgaataaatgaatgaatgaatg

SEQ ID NO: 6862430 - DNA, 105 bp, Homo sapiens
gcttcctcagttttcctgtgctagagtcaatgtgttcaggatccaaagtctcagagagtgagtctgatttttctagcatttggtcgcataaaactgtagtcaagc

SEQ ID NO: 6862431 - DNA, 111 bp, Homo sapiens
tgatactttttctgtaacaatattaaatgcacatggactagccataagagaactcatcagcatcccagattagattttatatgcctaagtctttcatttgagatagtgtca

SEQ ID NO: 6862432 - DNA, 66 bp, Homo sapiens
cccagcagcctggatgttctttcaggataactaatgtcagactaggtactcttcaggctcctgtgg

SEQ ID NO: 6862433 - DNA, 77 bp, Homo sapiens
actctacttctgcagagaaaactcctgggtacttctaataagaaagatacactggagcttcctgacaggaacagagt

SEQ ID NO: 6862434 - DNA, 82 bp, Homo sapiens
ttctgagtggatgaatgtgggtcaagtacctacttctcagccagagaaaaaagaggtaatttgattggcagcactaccagaa

SEQ ID NO: 6862435 - DNA, 94 bp, Homo sapiens
gaaaggcagcctccccactaccagacttgcctttaggttttgtttaattctgccacttgcaaagcaaatgcctgaaggcgggcacctgcctttt

SEQ ID NO: 6862436 - DNA, 79 bp, Homo sapiens
ccaaatgtattactcctctgatgcctacaattccactataatagtctggtgggcttctgttagggaggcttatacatgg

SEQ ID NO: 6862437 - DNA, 57 bp, Homo sapiens
gctcaagccctgttgtctgatgatgggaacctccctgtctccctggcatggctcagc

SEQ ID NO: 6862438 - DNA, 57 bp, Homo sapiens
cagcacccaggggtcctgcgcaggagaaaccgctgtgctgtgctctttaaggtgctg

SEQ ID NO: 6862439 - DNA, 65 bp, Homo sapiens
ggtcaccaaattggaacttgagtgacatggtgatatatgtcactcaagttccaatttacatttcc

SEQ ID NO: 6862440 - DNA, 55 bp, Homo sapiens
agagggtgggcagctccattcctgccaggtcactgtgggctggctgcttcccttt

SEQ ID NO: 6862441 - DNA, 94 bp, Homo sapiens
gcctctttgattaaaacaggagaaaacattacataggtgtgtgatcctttgccaattttatcaccagtaagttttcagtttttttcccataggc

SEQ ID NO: 6862442 - DNA, 65 bp, Homo sapiens
agaaagtactctcataacttgggctggaatgaatatttcatgctcatcattagagtgacattttt

SEQ ID NO: 6862443 - DNA, 77 bp, Homo sapiens
ccactcagatgctgagctgtatggctggtcctcagggagacttgaaagcttagctctaaggtgtcaggatctgaagg

SEQ ID NO: 6862444 - DNA, 81 bp, Homo sapiens
agcatgcatggaaaagctaggcagccacacaatttgaagacgaaaggatatgaaaagggttgccaggctcctgtgtaggct

SEQ ID NO: 6862445 - DNA, 74 bp, Homo sapiens
ccctttggtcaacgtatgtagttgtgaagtcatgaaattgtgaagtcatgaaatctgagtatgtttccactggg

SEQ ID NO: 6862446 - DNA, 76 bp, Homo sapiens
ggagagaaacagagggagaaatgaaaaggaaacaaacaaagaatagtttattttagactccatctgattcagctct

SEQ ID NO: 6862447 - DNA, 56 bp, Homo sapiens
atccacagggtgtgttaagatgtaattttaatgcttttgtcattctttctgtggat

SEQ ID NO: 6862448 - DNA, 59 bp, Homo sapiens
gcttccagatcccatgctcttactactgccctgtattgaatatgtgaccttctgggagc

SEQ ID NO: 6862449 - DNA, 68 bp, Homo sapiens
caacctgagatttattgacttaacagtattttaaatagatttgttaagaaaaataaataggcaggttg

SEQ ID NO: 6862450 - DNA, 56 bp, Homo sapiens
tccccttgtgtgtgattccattccattggtatggaatatttgacacatagggtgga

SEQ ID NO: 6862451 - DNA, 128 bp, Homo sapiens
ctgccccacaaatctgagcaggcaataaaggatggtcttatttattgtattgccttatacctttgagataatgcacatgactgaactattgattttttattgcaccagacagtgctatttgggagcag

SEQ ID NO: 6862452 - DNA, 83 bp, Homo sapiens
ttgggagggaaactgaggcagggcttgcatagtcctttggaatgtgtctagacttgctggctccttgcttctagccctcctag

SEQ ID NO: 6862453 - DNA, 77 bp, Homo sapiens
ggagttaggtactcaaatcgccctcagaggactgacaaggcagccagtcattgtagggcatttagagagctaattcc

SEQ ID NO: 6862454 - DNA, 64 bp, Homo sapiens
ttcagtttgccagtattttattgatgattttcacatcgatgttcatcagggatattggcctgaa

SEQ ID NO: 6862455 - DNA, 70 bp, Homo sapiens
atgtgaagatcagggtcctagagtaacctaatattttgtacattggttatttgactcctcatttttatat

SEQ ID NO: 6862456 - DNA, 76 bp, Homo sapiens
gggagagaaagcatgaaatgagcgaatataatggcagccagaggccatggtattaattatctttttattctcttct

SEQ ID NO: 6862457 - DNA, 69 bp, Homo sapiens
cgtgatgcgagtatttttaggcagattgtggagatggagtcggaggctgtaaagaatagttggatggcg

SEQ ID NO: 6862458 - DNA, 58 bp, Homo sapiens
tgagatttctaaacttagcctaggttccaagaatctacttggttttgatagaaatcca

SEQ ID NO: 6862459 - DNA, 79 bp, Homo sapiens
ttgattttcttcccacttcacctccctctgagctctccaaaagggaaatgcagagggtgtgaaggggatgaaaagtcaa

SEQ ID NO: 6862460 - DNA, 100 bp, Homo sapiens
atatgtacacatacatatgtatgtatatatgtgtgtacatgtgaataggtctatatatacacatacatacgtatgtatacatgtgtgtatgtgtatgtgt

SEQ ID NO: 6862461 - DNA, 60 bp, Homo sapiens
gagttgtacctgattttattaccagttttcatctgaatccactggggaacaggacgattt

SEQ ID NO: 6862462 - DNA, 57 bp, Homo sapiens
cagctctggccagatctatcctctcttttctacaggacaggctacatgcaggagctg

SEQ ID NO: 6862463 - DNA, 61 bp, Homo sapiens
agtcccagttcggttcttcctcttggccccagatgtggtccctggaaaccgggcagggcct

SEQ ID NO: 6862464 - DNA, 85 bp, Homo sapiens
tacattcatatttgcagtatacctggagcagtgcctggcatgtagcaagcactatagaaaggtttattaagtaaatagagctgtg

SEQ ID NO: 6862465 - DNA, 57 bp, Homo sapiens
gagatacttaagatggggctccactttttgagccccccgactcccttatttggtctt

SEQ ID NO: 6862466 - DNA, 70 bp, Homo sapiens
tctaaaatgtcaaagatcctatgagttaaattagatagcatttggatttgatgatgttagatattttaga

SEQ ID NO: 6862467 - DNA, 56 bp, Homo sapiens
ggtgcccacctgtcttcctggattttgtatgtgacctccctaggcaggagggcact

SEQ ID NO: 6862468 - DNA, 109 bp, Homo sapiens
aggaatttggtacttgggggaacacaagaaagactactgttcaagcaatgttttcaatttatttgtgcagagaaatctttcttggaaacctcctaagtttcatattctt

SEQ ID NO: 6862469 - DNA, 87 bp, Homo sapiens
tttcctaatattttattcttggtaaattatttcttccaattacttaattttgatggatggataacgtgccactgaatggaaaggaga

SEQ ID NO: 6862470 - DNA, 57 bp, Homo sapiens
catgaattatttttcacaagatgaacatggttttaatctgtgagagtataatttatg

SEQ ID NO: 6862471 - DNA, 80 bp, Homo sapiens
attttcctaggatgacacagcaagtatagtaaatctgaaatcagagccagctacataatctgtgaggtcctatggaaaat

SEQ ID NO: 6862472 - DNA, 55 bp, Homo sapiens
ccttcatggagctggaagctgttattccccccagcccacacaccagctcaggagg

SEQ ID NO: 6862473 - DNA, 83 bp, Homo sapiens
ggaatcgtagttgtcttagtgtttagggaatcaaggggtcttcccagaccctgtgtctgcacattactcagctctcagattcc

SEQ ID NO: 6862474 - DNA, 82 bp, Homo sapiens
caaatgttaatctgaagagctggaatccagtctggtgtttgtaataccacccatgtgactacctcatgcagatatgcatttg

SEQ ID NO: 6862475 - DNA, 62 bp, Homo sapiens
cctgatgtgtgcagggcagccgaatgggcttccaggaagccaactccagcccctgcagcagg

SEQ ID NO: 6862476 - DNA, 59 bp, Homo sapiens
gagagagtatctgctggttcaccacacttcagatgttgtgtcagcaacaatactttctc

SEQ ID NO: 6862477 - DNA, 89 bp, Homo sapiens
gaaagcactttgggataaacatttgtgtttgctaaaaatgtctctaaagaattggaagtatttcatcaaaagatttatctgtgcatttc

SEQ ID NO: 6862478 - DNA, 86 bp, Homo sapiens
cctggagggattagtagtttttggactgttctaaagttagtgatgtaggctaggatggtcacagagatggacatgatgttgccagg

SEQ ID NO: 6862479 - DNA, 73 bp, Homo sapiens
aggtaaggagtacaaatgcaggtttgttacataggtaaacttgtgtcatggggttgttttgtacagattatct

SEQ ID NO: 6862480 - DNA, 64 bp, Homo sapiens
ctctggggtgtctgcgtttccacgccggatcaaacacctggaaaagaaacaagtcattccagag

SEQ ID NO: 6862481 - DNA, 124 bp, Homo sapiens
gtgcttaggatctgtgcaggggatgtggagccagactgcctgggttcaagtcctgttgctaccatgtattagctgtgcagccttgggtaactgacttcacctctctgtacctcaagttcctcac

SEQ ID NO: 6862482 - DNA, 102 bp, Homo sapiens
atgataatttctatttcttgcttgacttattatttggtgttttgtgttttatcccaatatggaacatcagtcataatttaacgaagagtagaattttattat

SEQ ID NO: 6862483 - DNA, 60 bp, Homo sapiens
agatggttacagctgtggaaatggagcttgatttccctataccagcagctttgattctct

SEQ ID NO: 6862484 - DNA, 61 bp, Homo sapiens
ctggaagtatttaacccagagaaaacagtacttggtctggacatgggctaaatattcccag

SEQ ID NO: 6862485 - DNA, 127 bp, Homo sapiens
atgttcaatataaatgagatcaactgaagaagcagaaaagggcacttttggcaccatccaacacgccttaggaagtgctgccttctctgcctactttgggtgaatatccagagatgttttagaacgt

SEQ ID NO: 6862486 - DNA, 73 bp, Homo sapiens
cccttccagtgtctgaacctgcagtgggagcactggtgctggccctgctgggtcagagctgaagagggaaggg

SEQ ID NO: 6862487 - DNA, 129 bp, Homo sapiens
ggaagatgtcttaaacaaaggtcagtggagctaaatcgaaggccagtgcctttccagggctccaggaaattccaagctcaatttaaggcttggcttgagaaagctcactgagaaaatgtgaatatctcc

SEQ ID NO: 6862488 - DNA, 112 bp, Homo sapiens
tgcccatgggagtctcgtgcagatccaaggtaggctcagggttgttctgcctttgggaaagcggggacagagtagcaaagggttaatctcaggggcttgtgctctctgggca

SEQ ID NO: 6862489 - DNA, 81 bp, Homo sapiens
acactatacttccattgctggtggccttgagaatagaaacatttggctcagcaagaatctgggagtaaaattctttggtgt

SEQ ID NO: 6862490 - DNA, 77 bp, Homo sapiens
gagggagctgttcaggactgcttcaagaagatcttgccaagccttgtctatatggggcagttaataaacattctctt

SEQ ID NO: 6862491 - DNA, 60 bp, Homo sapiens
atttgtagtgaagtgaaaataagaccgtcaaatccttaatgtgtttcctttgctacaaat

SEQ ID NO: 6862492 - DNA, 63 bp, Homo sapiens
gtccactgaaggtcaacatagagcaaagctttgctatggctccagatatgtcaccttcaagac

SEQ ID NO: 6862493 - DNA, 90 bp, Homo sapiens
atcacaaacttcataacagtggcttcagcaagtaaaatgttcaatgtatgtggcataaactgcctaaagctctgttgtcaaccttgtggt

SEQ ID NO: 6862494 - DNA, 55 bp, Homo sapiens
ttccctccccttcaagccagtggcagcctgctgcccaggaaggagaggatgggaa

SEQ ID NO: 6862495 - DNA, 79 bp, Homo sapiens
ggatttcataagacttaggtcgagtttggcttttagttgtgcctgccgcctatcgaactcttaattcattatgtcatcc

SEQ ID NO: 6862496 - DNA, 59 bp, Homo sapiens
aggctaagcctgcatgaaccatgagaatctgtcttctctgaaatatgtatgcttggtct

SEQ ID NO: 6862497 - DNA, 90 bp, Homo sapiens
ctgccaactccctcccctctctgcgctcccaggtcaaggtgcaataatatcatttggggacagagtgggggtaaaggggcagtagggcag

SEQ ID NO: 6862498 - DNA, 80 bp, Homo sapiens
caagtttgacatttaaattgcaggcagccctgggtccattccaggagctggctgtggttgagtgcagttctgatcacttg

SEQ ID NO: 6862499 - DNA, 61 bp, Homo sapiens
ggtactgccctggctgagatgcccgggaatgccactggagtggttagttattggcagtgcc

SEQ ID NO: 6862500 - DNA, 55 bp, Homo sapiens
tacaggaagtctcagtacagtaagcctggacatggcctacctggtgcttccttta

SEQ ID NO: 6862501 - DNA, 67 bp, Homo sapiens
catgcacaatcacaaagagacaagtgtcatgaagggaatgtacatggtcctttgagattatataatg

SEQ ID NO: 6862502 - DNA, 70 bp, Homo sapiens
gaatgtgaaactgaagcatccatactcaccattacacccaggaagtgtgggtgttctcacttagataatc

SEQ ID NO: 6862503 - DNA, 127 bp, Homo sapiens
ttaaatgagttaaagcatataaaaccttcaacatagtacctggcacataatagtggctcacacttgttgagatttgctatgtgccaggtagtgttttagcattctgtacatgtatttacttatgtaa

SEQ ID NO: 6862504 - DNA, 82 bp, Homo sapiens
gtgtggcctggatgagcttcgacatctggtcaacatcagccacagatgctgtcgagacctctcaccgtgttccaggccacac

SEQ ID NO: 6862505 - DNA, 66 bp, Homo sapiens
tgcagggagagtctctctcccggttggcgtgggcagcaacccatggtaccagcgagagtctctgca

SEQ ID NO: 6862506 - DNA, 72 bp, Homo sapiens
agtgtttgggggccttgtaacagatagtgaaaaggtggtatgatcaatagcttgcaggtgtgtccaagcact

SEQ ID NO: 6862507 - DNA, 65 bp, Homo sapiens
tgtagtgtggcctatctttgccagaggtgcttgagaggtcggtgtgcaggcaaagatgcattgcg

SEQ ID NO: 6862508 - DNA, 87 bp, Homo sapiens
gacatttattttcagacattaagtgatgggaagtagtagtaaggatttgtcatgtagcattttatgtctgcaaagtgctttacggtc

SEQ ID NO: 6862509 - DNA, 62 bp, Homo sapiens
gctaggtggcccttcccatgctcagttctctgccatctgtgggcatgctgctgctacttggc

SEQ ID NO: 6862510 - DNA, 89 bp, Homo sapiens
tagattcttactgtctgtgactactacgtgccaccaagaacttcccactggtgatgccaaaaacgtggagccacagatggagcagtcta

SEQ ID NO: 6862511 - DNA, 101 bp, Homo sapiens
cctgagattcaagcaataagtgcttatggttgaatgctactgaagtgttgcaaattttgttacacagtattgtgactataacttgagaatttaatttgggg

SEQ ID NO: 6862512 - DNA, 78 bp, Homo sapiens
gttcaaaatcattcgatgtggtgacaaggtacgttattattgctagatcatgtgctgtaatccattgaaggagataac

SEQ ID NO: 6862513 - DNA, 79 bp, Homo sapiens
gtcaagatttgaatccagacagtctggtgccagaggtatgcactaaacctctaggcatgacattgtctctcaaaatgac

SEQ ID NO: 6862514 - DNA, 64 bp, Homo sapiens
gtggctgccgcagaatgtctgtatgggaagaggttagggacccagtgcatttatgcggggctac

SEQ ID NO: 6862515 - DNA, 130 bp, Homo sapiens
actaaaaagcatatagaagaaaataaaaattactcataatatctatactcagagttaatatctgttggtatttgggtatgtatcatctgggtgggagtgtgggtaatttcccttctttgtgctttgatat

SEQ ID NO: 6862516 - DNA, 56 bp, Homo sapiens
gtgtccatgtgttctcattgttcagctcccacttacaagtgagaacatgtgcacac

SEQ ID NO: 6862517 - DNA, 63 bp, Homo sapiens
cacacaaactacagtgagaattgctataaaactacaatgcatagctagcttgtcatttgtgtg

SEQ ID NO: 6862518 - DNA, 63 bp, Homo sapiens
ggtctgatagagccaggagagactttatgaaatccagactctcacactaatgctctatcagct

SEQ ID NO: 6862519 - DNA, 75 bp, Homo sapiens
gggctgggtcgtctccctcgggctgcgtgtgtgtgtcgggaatcctgcgtgtcgtgtctgtgggcgatccggcct

SEQ ID NO: 6862520 - DNA, 71 bp, Homo sapiens
aggatgcagtcaggaagctaaccaaaacccaccaaaaccaagagggtgaggaaagcatcactgatcatcct

SEQ ID NO: 6862521 - DNA, 75 bp, Homo sapiens
tgtccagggcaggaagaggtatcaccgagcagggagagagtcaccctggcccggaagcctcgcctgcacagggca

SEQ ID NO: 6862522 - DNA, 101 bp, Homo sapiens
agctctctccaatatcttcctgctaacaaatctctgtctcaaagtgtttcatgggaaaaccaacctaaggcagtggatgtcaggaatggtcagaggaagct

SEQ ID NO: 6862523 - DNA, 72 bp, Homo sapiens
accagaggcagagccaggtctaggagtctcttctcaacagaggttctccctgtcccctgagctttctttggt

SEQ ID NO: 6862524 - DNA, 102 bp, Homo sapiens
ttccattgccaaggagcctttgtgttgctgacaagagaggagcaggctgagagaaaacgccctgtttgtcacaaagttacatctgcgagctccttcaaggaa

SEQ ID NO: 6862525 - DNA, 63 bp, Homo sapiens
acagagtcttacgtggtgataacaatgacattatgtctcttttatcacctgtaggttctttgt

SEQ ID NO: 6862526 - DNA, 62 bp, Homo sapiens
gtaatgaatggtgtctaaagaaggttgcctcattgtgaggtaagttagagcacaattcttac

SEQ ID NO: 6862527 - DNA, 59 bp, Homo sapiens
gggatgctgtgtcaatggtgggatcctacacagggctactggcattatgatagcgtcct

SEQ ID NO: 6862528 - DNA, 73 bp, Homo sapiens
cctctctgtctattcccccacctccgttaccacacataggtaagcagtgaggtgaggagtgttgaccaagagg

SEQ ID NO: 6862529 - DNA, 72 bp, Homo sapiens
gttttcctgacactggagtctatctgtaacataaactgtgggatacaggtagagtctctagtttatagaaac

SEQ ID NO: 6862530 - DNA, 85 bp, Homo sapiens
ctgtgtgccagaggctttcacaaggttagttccagactaccgcccacagttgggagcaatttcttgagataagcctggctaatag

SEQ ID NO: 6862531 - DNA, 76 bp, Homo sapiens
gtggataattctaagacatgccctgcatgataccttaatgggatatcaccagagggatagtctctgagttatttac

SEQ ID NO: 6862532 - DNA, 71 bp, Homo sapiens
atacttcctcattttagcagtcttgctgactgtactttatacagtgtctcactgctgaaatcaattagtgt

SEQ ID NO: 6862533 - DNA, 129 bp, Homo sapiens
atcatctaggtgctgggtccagcagtgtggcacaatcctatttgtaggctgggccagttctgaagatcacaatactcagctgctagacagaagtgtgtcaaaactgcacctgaaggaaagaccaaggat

SEQ ID NO: 6862534 - DNA, 57 bp, Homo sapiens
ccagcagcccacaggcgtcccttgtcagcaaaaagcaccctggaaatgggtggctgg

SEQ ID NO: 6862535 - DNA, 56 bp, Homo sapiens
gaagatattctctaaatactttcgaggctggcatttaaaagaaagagaatgtcttc

SEQ ID NO: 6862536 - DNA, 72 bp, Homo sapiens
aaacattcagcaataaaaactaatgaagaatccagacataggggaagttagattctgttgttgctagtgttt

SEQ ID NO: 6862537 - DNA, 99 bp, Homo sapiens
gaaactatttttaacacctgcatatgacagttgaaagtaactgtttcaagtaattaacataatttgaaagtagcagctgcatatgtgttaaacagtttc

SEQ ID NO: 6862538 - DNA, 75 bp, Homo sapiens
cttgattttaaaaactttttattctaatgtctattgatacagtagaaaagaataggaagtttaagcacaattgag

SEQ ID NO: 6862539 - DNA, 72 bp, Homo sapiens
ctttttcctgtctcttaactccaccagtgcagcagcaactagctgagctgcttgagagagagagagagagag

SEQ ID NO: 6862540 - DNA, 78 bp, Homo sapiens
gacttatccaataattcttcaagtgttttgcattgaagtcatttgtctagaatacttgggaatgggttaatttaagtc

SEQ ID NO: 6862541 - DNA, 77 bp, Homo sapiens
tagtctctcaaagtgctctagaaattgtcagtggtttacatgaaatggccatcggtgtccagagcaccctgaagctg

SEQ ID NO: 6862542 - DNA, 63 bp, Homo sapiens
caaactctggagatgtttatgcatgtgaaagccttacatatgcaggaaatatatctgagtgtg

SEQ ID NO: 6862543 - DNA, 60 bp, Homo sapiens
ttggagaaagacgactgcaatttgtttctacatgtgtggagtgagtgtgtgtttctctaa

SEQ ID NO: 6862544 - DNA, 57 bp, Homo sapiens
tgttgtccacccatgacacctgcctgtgtcccacaggagtcccaggggtgggccaca

SEQ ID NO: 6862545 - DNA, 108 bp, Homo sapiens
agatatcactgttttactgtagagccagtgctggcatacttcttgagagagggtaaagaagctatgttcctgcactgctcttgctcctcagttctcaaagtgaaatct

SEQ ID NO: 6862546 - DNA, 89 bp, Homo sapiens
gcttgcatttgtgtgtgtggagttgacagaaaccaccacataggcatgtgtatacttcttcctcacactctcacccatacaagcatagc

SEQ ID NO: 6862547 - DNA, 116 bp, Homo sapiens
agcacattcatctgaaaaggctcgggttgatgaatattttccgctgtccggtaaccatggcaatagggtcagcagatatgatacttaatttaatcttccagctgcctcagtgtgct

SEQ ID NO: 6862548 - DNA, 64 bp, Homo sapiens
cctttgggcagtgattagttcatgagggtggaacccttataaatggaattagtgcccttatagg

SEQ ID NO: 6862549 - DNA, 64 bp, Homo sapiens
gtgtttgcaccatgggatgtgtgattaggctgagcaggttgtcatgagttctcggggcagacat

SEQ ID NO: 6862550 - DNA, 58 bp, Homo sapiens
ggtgctccacattgtctttgtgtatgtgcagaaattataaacagaactcaggggcacc

SEQ ID NO: 6862551 - DNA, 69 bp, Homo sapiens
agaacaagtagccctgtgctctggagaatgatttacagtggttctcttcctcagcctggggccttttct

SEQ ID NO: 6862552 - DNA, 117 bp, Homo sapiens
tcagcttctttggtacaactttttcagggctgacaagcctattgtagggcagtgtcactgtaggtcagtagttattagttgccactgaaaacagtttctttaactacttaagactga

SEQ ID NO: 6862553 - DNA, 74 bp, Homo sapiens
ctgtgtcttcatgcaatacccatgatccattttgtctgaccagagtgaatgagaggtgagtattgggagaccag

SEQ ID NO: 6862554 - DNA, 61 bp, Homo sapiens
ggcttcagacatcaaactggaagttttctgaatttaggatatcaggtagatctttgaggtc

SEQ ID NO: 6862555 - DNA, 56 bp, Homo sapiens
aagtgaagattttgtagctttcagcaaaaatatgctgcctctgttggtcttcagtt

SEQ ID NO: 6862556 - DNA, 64 bp, Homo sapiens
ggccactgccagctgtctgtaagctcaggattagagagcctggcctttcgtgagagctggggct

SEQ ID NO: 6862557 - DNA, 81 bp, Homo sapiens
ctgtagctttttggtgtatgtgtatttgtgtgtgtgcatgcatatgtgtacatgctttgcacttacatcatgagcagacag

SEQ ID NO: 6862558 - DNA, 58 bp, Homo sapiens
atttccagtcctaatgatctggtagcttttcaggtatttgttattaagattggtaaat

SEQ ID NO: 6862559 - DNA, 85 bp, Homo sapiens
agcggctagctggtcagtttttaacttagctgtaacgaaataaggcccagagaagtttaatcattagaccatagagtcagctgct

SEQ ID NO: 6862560 - DNA, 56 bp, Homo sapiens
ctctgcttctgagatggaagctaactaaggcagaccccatactcaagaggtaagag

SEQ ID NO: 6862561 - DNA, 72 bp, Homo sapiens
tcacagaccagaggcatgttcaaagcaatttcagagatgaaaatggcatggagtttttgggaggtcctgtga

SEQ ID NO: 6862562 - DNA, 56 bp, Homo sapiens
gtgggttttttttccatctctgataggtgaagtcagagaagggggaaagatctcac

SEQ ID NO: 6862563 - DNA, 72 bp, Homo sapiens
tcatccatggcgttgtacttagcggcagtccattcatttattctcattgctgtgcaatatcccatggtatga

SEQ ID NO: 6862564 - DNA, 73 bp, Homo sapiens
gcagtgggccggacgccaggcccacgtcagaaacatggaacccgagtttcgttgcttggcacctgctcattgt

SEQ ID NO: 6862565 - DNA, 77 bp, Homo sapiens
ggtctgcagtaaacagttactaagaagattctctaactacatgagatgggtctctacctttctgtgtactgtttgcc

SEQ ID NO: 6862566 - DNA, 59 bp, Homo sapiens
ctccaagcactcaggcttcttttgagaacaggagcaaaggcaagcccaggcacttggag

SEQ ID NO: 6862567 - DNA, 89 bp, Homo sapiens
ctggagatgacctgagagaagcttgtgccggccactcatgccactgtggccttcgaaaacccagctgtttcccgtgtcataccctccag

SEQ ID NO: 6862568 - DNA, 64 bp, Homo sapiens
agtgaagcggcagatattagaaattttggactttcagagccatacaatgtctgtcgcaattact

SEQ ID NO: 6862569 - DNA, 57 bp, Homo sapiens
tacgggaagggcggggagaggctggccagggagggaggtttcccagcccttgctgtg

SEQ ID NO: 6862570 - DNA, 61 bp, Homo sapiens
tctgggccaacccttccatgggtgaagacaagcaagtccccctggaggcgggtggcccaga

SEQ ID NO: 6862571 - DNA, 55 bp, Homo sapiens
gctcaaatgtgtgtgttgaatgaatgaatgaatcatgctgacagacatcatgagc

SEQ ID NO: 6862572 - DNA, 59 bp, Homo sapiens
tggaagttggtagagtgacagagctcagcccctttttggcactctgctctgccaatcca

SEQ ID NO: 6862573 - DNA, 68 bp, Homo sapiens
tcatcaccgacgcttggcatggtcctagctgtgttttggtctccttcgcctgcctgtgtttgtgatga

SEQ ID NO: 6862574 - DNA, 56 bp, Homo sapiens
gcctggaggggcccaggcccaagaggattctttacccctggaagagctccccaggc

SEQ ID NO: 6862575 - DNA, 72 bp, Homo sapiens
tgttaattcatcacgggaaatatgaaagagtacctccaattctttacacattattttcagtgtgttttgaca

SEQ ID NO: 6862576 - DNA, 60 bp, Homo sapiens
attgttttggtctgtgcatggagttgttactggaaacttcatgtgtcattggagagcaat

SEQ ID NO: 6862577 - DNA, 63 bp, Homo sapiens
gacaaaggggcgctgcggtcctcagccacacagccagggtggcggggataacagccccttgtc

SEQ ID NO: 6862578 - DNA, 73 bp, Homo sapiens
gtgattatagaatgctacaaagtgtgtgtgggtgtgtgtctgtgtgtgtgtgtgtgtgtgtgtctgtgtgtgc

SEQ ID NO: 6862579 - DNA, 99 bp, Homo sapiens
ggcagcagagcaagctgctgaagccgagcaccgcatctgctgcagacggcctgtgtctgacgctgccatgttggtgccggctacacggtgatgctgacc

SEQ ID NO: 6862580 - DNA, 72 bp, Homo sapiens
taagtctttgctattgtgaatagtgccgcaatcaacatacgtgtgcatgtgtctttatagcagcatgattta

SEQ ID NO: 6862581 - DNA, 73 bp, Homo sapiens
tccagagaattaaacgtgcttcatatttttagcttaatttattagatttacaagcactgtttaaatgcttgga

SEQ ID NO: 6862582 - DNA, 83 bp, Homo sapiens
cacttagttatttctgcatcttctgcacatgccagtttgtgagctggtagctttcaatagatgcctttcagatgacttgagtg

SEQ ID NO: 6862583 - DNA, 83 bp, Homo sapiens
gtccgaatctggtagcagccaggacagctggtcacccagggaggcctgtgattccctgcctgtgctgtgacagcccactggac

SEQ ID NO: 6862584 - DNA, 88 bp, Homo sapiens
cccacacatgtgctcggccatgcctgtgggtgcaggcgccatgcgtctgcacacacagtgcatgggcttgtgccagcacacacacagg

SEQ ID NO: 6862585 - DNA, 98 bp, Homo sapiens
agtgtagaatcatgtctttcaaaccacacagtaaaatctgaactggagttttgatatacaactcgtatggcttgaaatgagaaccgtgaaaatatatt

SEQ ID NO: 6862586 - DNA, 69 bp, Homo sapiens
gatcctttgctactttgcagctagctaggacccaaatggtccactggtatccacagtggggaagtgatt

SEQ ID NO: 6862587 - DNA, 73 bp, Homo sapiens
ccacagtaagagatagtttatgtaccaacatttggccccaagttttatcagataatcttttacaagcatgtgg

SEQ ID NO: 6862588 - DNA, 74 bp, Homo sapiens
ttgggtgtgaaggagccctctatagccaaaatctcaaaaggggtttcatgttagttggttcttggaatattcaa

SEQ ID NO: 6862589 - DNA, 75 bp, Homo sapiens
cttcatcggttggaaagggatatctgtacttcatttgactttaagagcagtcatcatttttaccatctgatagag

SEQ ID NO: 6862590 - DNA, 70 bp, Homo sapiens
ttcctactttcatgggttttctttatctatatctaatgttcagcagacaagaaatactgtgaaagttgaa

SEQ ID NO: 6862591 - DNA, 100 bp, Homo sapiens
taggtatcccaagggttgttttgtccagaacacagactgacttcttcaactacgcgggactgcagtggtctgtgcttctgtacacgacacccaccaccta

SEQ ID NO: 6862592 - DNA, 94 bp, Homo sapiens
tttgagaccaaatagttcttatttgtcatgatactgctgagagtgtgtggactctgggaggtgttttgagaacttggaattttgtggcctcaga

SEQ ID NO: 6862593 - DNA, 61 bp, Homo sapiens
cagagccactgcattttacagcctcccttacagttgggtgtagcaacatgcctgagttctg

SEQ ID NO: 6862594 - DNA, 80 bp, Homo sapiens
gagggagattggccctcagaggcagccttgtgataggacagaagtccagaagcatcctggctctaggtgtcatcactgtc

SEQ ID NO: 6862595 - DNA, 76 bp, Homo sapiens
ctgcaagattgggaaaaggcttggaacctttccctttaggagggaaatgaagtgagccttgtctctaacctttcag

SEQ ID NO: 6862596 - DNA, 76 bp, Homo sapiens
ttgcttgaacccgagaggtggaggttgcagtgagccaagatcttgccactgcactccagccagggtgacagagcaa

SEQ ID NO: 6862597 - DNA, 72 bp, Homo sapiens
gttctgcttctccactgtgaggagacgtggccccacggtggggttgccacctcagcatggcaggagcccagc

SEQ ID NO: 6862598 - DNA, 87 bp, Homo sapiens
ccttttcacacatcagttagtatttgtaaggctgtttgagcagtgtgaattgctgcacccctaagtgtctctgatgtgttgagaagg

SEQ ID NO: 6862599 - DNA, 72 bp, Homo sapiens
gcttgaatccaggacttcgaggctacagtgggctgagattgcaccactgcactctagcttgggtgacagagc

SEQ ID NO: 6862600 - DNA, 66 bp, Homo sapiens
cctgactctgatttcgctgcataactcccaggggcatcctgctctgatgtcaggaagggagtcagg

SEQ ID NO: 6862601 - DNA, 76 bp, Homo sapiens
acttacttgattgcttcgatatgctaatttgaattcccctagaagcagactctgaggcaaggattcacatgtaagt

SEQ ID NO: 6862602 - DNA, 76 bp, Homo sapiens
ggagaacgttccagacagagggcacagaaagtgcaaagaagaccacttgctgtgccttctgcctggaacattctcc

SEQ ID NO: 6862603 - DNA, 61 bp, Homo sapiens
aggtggggctgggaaagattcccactgggacactagacaggtatttttttcagcgacacct

SEQ ID NO: 6862604 - DNA, 80 bp, Homo sapiens
catagcacaggagattcagagggctgggatgacttctgagctgctctctatacccaaggccctttcaatttctagctgtg

SEQ ID NO: 6862605 - DNA, 55 bp, Homo sapiens
gtctattgtgccctgggctgattatgttccacacagtcattcaggaccagtggat

SEQ ID NO: 6862606 - DNA, 130 bp, Homo sapiens
agaaggagacgttcgtgtgggtctttgggaaaggaggaatgtggcctagggaggagagaagctgatttcaagctccattcaagtgttacatcgttacctctctctgtttggcatgtttccatctgtttct

SEQ ID NO: 6862607 - DNA, 92 bp, Homo sapiens
ggtccaaatccacacagctggtcagtgcaagctgatactgaggttgtctgcctccatagtccttgcgctcatcacaggagtggcatttgacc

SEQ ID NO: 6862608 - DNA, 71 bp, Homo sapiens
ggaaactgttgagctgaggtcaggatggggtaaatgaaccatttcccacttcatcccagctcagatattcc

SEQ ID NO: 6862609 - DNA, 74 bp, Homo sapiens
tcagtgggtagggccagataccttcccttaacacatatacattcgtatgtaagagggtactttctgccaactga

SEQ ID NO: 6862610 - DNA, 60 bp, Homo sapiens
ctatttctgtatcctgctgtcagattttctccacagtttagcagagttatatggaagtag

SEQ ID NO: 6862611 - DNA, 59 bp, Homo sapiens
tgtccctgtcttctttgcagtgttgcttcaagctagtgcagacttcgaggagggggata

SEQ ID NO: 6862612 - DNA, 102 bp, Homo sapiens
gcactaaatttaaattgacataagttggtagaaaggactctgctagtgccataatttaggggaagctcctaactacggaaatgtgtgaataggaagtatggc

SEQ ID NO: 6862613 - DNA, 99 bp, Homo sapiens
gaggcaggaggattgctcgagcccaggagttggaggctgcagtaaggtgtgattgtgccactgtactccagcctgggaaacagagcaagaacctgtctc

SEQ ID NO: 6862614 - DNA, 57 bp, Homo sapiens
tagcagtagtagattatatgagaccatgcatggttcataagtgctcagttactgtta

SEQ ID NO: 6862615 - DNA, 73 bp, Homo sapiens
ccttgtatagccacacttattctcatgcacatgtaatttttaactgtgatggatagagtttggcgttccaggg

SEQ ID NO: 6862616 - DNA, 60 bp, Homo sapiens
tctgtacaagaaggaaaactagcaatttccatttggctgaggattgcccttgtttacaga

SEQ ID NO: 6862617 - DNA, 56 bp, Homo sapiens
ctcacagttggagaatttagatctttcagtgtccatctagcacctccaagtgtgag

SEQ ID NO: 6862618 - DNA, 81 bp, Homo sapiens
aggtttgtattgcttgagaagttagtggagggagaatattcagggctctttatcatcttgtttttaaagctaaataaacct

SEQ ID NO: 6862619 - DNA, 80 bp, Homo sapiens
gagatggggggcaagggctggccgaggagtcctgaggcagtcaccccctcctgcttccttgtctttagaccccaattctc

SEQ ID NO: 6862620 - DNA, 76 bp, Homo sapiens
ggcagaaattatgaggtaacagcttatcaacatttgaaaatattgatagttgatatcctcttaaggaatatttgcc

SEQ ID NO: 6862621 - DNA, 61 bp, Homo sapiens
cttgctgcaggtggtcttgtgcactagccaggccaggtatgagagccactctgtagctaag

SEQ ID NO: 6862622 - DNA, 90 bp, Homo sapiens
gggaaacagagcaaagagctagacctcagccagcaccagggcaggagcccggggctgctgggtccctctgtgccaacgtctctgcctccc

SEQ ID NO: 6862623 - DNA, 74 bp, Homo sapiens
cctgggacacagaccaccaggccctggtcaggacccctcccatgtggctgtgtggtttatttgtggctcaaagg

SEQ ID NO: 6862624 - DNA, 60 bp, Homo sapiens
acaagactgagtggcttaagaaaagctatttttaggctcggcacagtggctcactcctgt

SEQ ID NO: 6862625 - DNA, 75 bp, Homo sapiens
gtctcagttttctcatcagtcaaatggagacacaatagcctgtttcacaacgttgtggtgagagttacctgagac

SEQ ID NO: 6862626 - DNA, 130 bp, Homo sapiens
tttccttaaacctcaggaatcactgtctgccagctttcaactttttttctgaagatttctcatttctctcgttcttcaaaaagttgaagagttggggccttgctctggattagactttggtttaagggaa

SEQ ID NO: 6862627 - DNA, 59 bp, Homo sapiens
ggtttctcaccttcagcactactgtcattatggactttgctggggaaacgtgagaagcc

SEQ ID NO: 6862628 - DNA, 108 bp, Homo sapiens
ggtggaacttaactctcatgaatgtatttggaagtcctcatacctgattctggccttaccttagagtcacatgaggcccttcattaaaacaacatggatccttccacc

SEQ ID NO: 6862629 - DNA, 65 bp, Homo sapiens
gcgaggacatagtccagatggcaatcaaggaagaccccgccctcttgcttatggcactgctttgc

SEQ ID NO: 6862630 - DNA, 81 bp, Homo sapiens
tacactgaagtctgacagtagcagaactcaaaacaagatcatcttgtactagaatgccactgttagtgttgatttcttgta

SEQ ID NO: 6862631 - DNA, 92 bp, Homo sapiens
gaagtgttcattttacgctgtcaggaccctgtctgactcctctggtgggagcccttggcgggtcttggctctggaaatgcttagacaacttc

SEQ ID NO: 6862632 - DNA, 80 bp, Homo sapiens
gctttgactccatttattattttgaacaatcaagaaaaacagttttcttgatggtggcagaagagtgatatagaaaaagc

SEQ ID NO: 6862633 - DNA, 105 bp, Homo sapiens
actctttgacaatttctctagcagatgtttttaatcttggattgagggctcaagtgttacctggatccatgaaaaggctactttgggagtaatgacaggaagggt

SEQ ID NO: 6862634 - DNA, 57 bp, Homo sapiens
gaaggtagagaggagtttctgcatgttgttcatgtttaacactgcttctatattttc

SEQ ID NO: 6862635 - DNA, 68 bp, Homo sapiens
gcaggagcccagagtcctcagctcttcccagctaaccctctgcggcttgggacctgtggtgttcctgt

SEQ ID NO: 6862636 - DNA, 71 bp, Homo sapiens
tgtccctgtgcagagaagccactgggggaataagatcagttagcccccacaccatctcttgcaaggtgaca

SEQ ID NO: 6862637 - DNA, 126 bp, Homo sapiens
gggaagaaccaagcacctaactaatgagtgtcactggttgtgagggcaagtaaatgagttggttgttccccaaattctggctaccctcctaatgttagagattctcatgatttgcattgaattccc

SEQ ID NO: 6862638 - DNA, 75 bp, Homo sapiens
ccttctaattcccagcgtttagctcttggtagatgcttaattagtatttgttgaatgaatggagaattaataagg

SEQ ID NO: 6862639 - DNA, 103 bp, Homo sapiens
gccacgcctgggctccgcgcccagggctgctcatattgctggtctccaggggacctggcgtcagtgcttttgagaagctcctggagtgagtccgatgtgtggt

SEQ ID NO: 6862640 - DNA, 67 bp, Homo sapiens
ccatatcaaacgaagttattttaattactttactctttcttcttttagttgaaattgtttgatatgg

SEQ ID NO: 6862641 - DNA, 89 bp, Homo sapiens
ggagtttcgttctttttgcctaggctggagtgcaatggcacgatattggctcattgcaacctccgcctcccaggttcaagtgattctcc

SEQ ID NO: 6862642 - DNA, 77 bp, Homo sapiens
tgtttctttcctttttcttcttggttataggcactgcacagtgttagcatagctcagaaggagaccccgggataaca

SEQ ID NO: 6862643 - DNA, 80 bp, Homo sapiens
cagtcgactacctttcatcttattgtctttgatcctctctttagaagcttcttggcaggagataaaatattagttgattg

SEQ ID NO: 6862644 - DNA, 63 bp, Homo sapiens
gtgttgaaggcaggccttgaggactttgcatttagaaaagtaacaaatagctgcctttaaagc

SEQ ID NO: 6862645 - DNA, 65 bp, Homo sapiens
tcaacaagccagatacttggaaagaccctgagggattagggttcaaactgaatctggtttgaaga

SEQ ID NO: 6862646 - DNA, 69 bp, Homo sapiens
catagtccacagtgaggtgtttaaattgtttcagtagttatgaaatgaagaacattgatattgtctatg

SEQ ID NO: 6862647 - DNA, 63 bp, Homo sapiens
tggcacatgatgttgtggcatctggatatgttttcagcttctcctgatctaccatatcagcca

SEQ ID NO: 6862648 - DNA, 80 bp, Homo sapiens
acctgtgcttcagaaattttctcagtagttccggacaagttgttcaatttggacagatggcaagtttatggagttcaggt

SEQ ID NO: 6862649 - DNA, 56 bp, Homo sapiens
gggaccgaccagaaggagcttgagttcgtcatgcatcaggaaccttcattgctccc

SEQ ID NO: 6862650 - DNA, 103 bp, Homo sapiens
gttacctaggctggtttcaaactctggcctcaattgatcctcccaccttggcctcccaaagtgctgggattacagtcatgagctgccacaaccagcctgtaat

SEQ ID NO: 6862651 - DNA, 129 bp, Homo sapiens
agtaaggcattacaattatgaaaattaattttcttggactaagctatatttacccatagtacaaaaagcattgtgggtaaatatcctttgtgaaaattagacatgagaccagtaaatatatgctacatt

SEQ ID NO: 6862652 - DNA, 61 bp, Homo sapiens
agaagtgatctgacacatattcatgggaaattacattttatatgtgtatggatttctatct

SEQ ID NO: 6862653 - DNA, 68 bp, Homo sapiens
gcaataattgctttccagagttagacttcaaatcactgagtagctgacttattaaaagtttttattgt

SEQ ID NO: 6862654 - DNA, 63 bp, Homo sapiens
gggtggcgggacagccctgcccggggatgtgggtggtccaggaggcaggtgctgtcccctcct

SEQ ID NO: 6862655 - DNA, 97 bp, Homo sapiens
aatgtaaaattggtgcaatatttatggagggcaacttttcagtaggtaccaaaacccttaaaaatatgtcctccttgtgatcaagttattttacatt

SEQ ID NO: 6862656 - DNA, 69 bp, Homo sapiens
atttgagttagtgagtgaatcaagcctggttacatcacaaccaggaatattttgctcatttattttgat

SEQ ID NO: 6862657 - DNA, 75 bp, Homo sapiens
gcccacccggcgctccgcggggccccagctggtagcctgagtgcgactgcgggaacccgcggccggcggctgggc

SEQ ID NO: 6862658 - DNA, 71 bp, Homo sapiens
tgggaagcagtttcccagaagaattcagtggatggatggtatggattcctttggtgaactgccgaggtcca

SEQ ID NO: 6862659 - DNA, 114 bp, Homo sapiens
gctaggattcttgattggtcagagaatgttgttaaatacaagatttttctgggaaaagaatgacttttatgataatcaatgttctttgttcaattcctggacaaaaatcttagc

SEQ ID NO: 6862660 - DNA, 62 bp, Homo sapiens
catacataccactgctgtcttttccgagtggtattacaagaaagatttttgtggtgtgtttg

SEQ ID NO: 6862661 - DNA, 96 bp, Homo sapiens
tatccaccatgctctttggagtagaaaaaatcatgctgcaagaaatgtaatgaatgtgaagcatgtttattctattttatgaggcatggtagggtg

SEQ ID NO: 6862662 - DNA, 74 bp, Homo sapiens
ggcaaatacaagccttggaaatccattctgagtcacaaatctctctcaagaagtgggccaaggttgctgttgcc

SEQ ID NO: 6862663 - DNA, 59 bp, Homo sapiens
ccagggcccacggccagaataggtggccagcccccgcccagtgctggccctggctctgg

SEQ ID NO: 6862664 - DNA, 70 bp, Homo sapiens
gcacatagaagtgcctgacctagcctggagagtcagggaaagctttccatcgtcggtgcacttggattgc

SEQ ID NO: 6862665 - DNA, 76 bp, Homo sapiens
caacttgagaactcattgttttctccatttgcatttacaacttcatagagcctgagaggataatggggttaagatg

SEQ ID NO: 6862666 - DNA, 74 bp, Homo sapiens
gctgcatggccatcaggattttgtctcgttccttctacctggacttgccagctaaagcctggtgattgtgtggc

SEQ ID NO: 6862667 - DNA, 85 bp, Homo sapiens
caaaagtgcctttgtgggagctttgggattcaggcaggaagttactaaaacttgttgctacccaagacctaggaaggttgatttg

SEQ ID NO: 6862668 - DNA, 68 bp, Homo sapiens
gcacctgtgaggggcgcctgggtcccagtgcggcgactctgcactggcctaagcgcctcagccggtgt

SEQ ID NO: 6862669 - DNA, 87 bp, Homo sapiens
aagcactggggtctccccaaaggaatatactattttgccagtacgttgtgcagcactgagcacttggtatatttcccccggctgctt

SEQ ID NO: 6862670 - DNA, 64 bp, Homo sapiens
gcagggctccaggctcacagcatcccaggaaggcttcagggaacaggtgggctttgggccaggc

SEQ ID NO: 6862671 - DNA, 71 bp, Homo sapiens
tgcaagttttcctggacactcatagaaattgttgagcagcaaatactttctaggtgttcacagagcatgca

SEQ ID NO: 6862672 - DNA, 59 bp, Homo sapiens
gttttctctggttttgttaggtgccaaagtggccccctgggcaaatgccagagacaagc

SEQ ID NO: 6862673 - DNA, 58 bp, Homo sapiens
cctcagccagaaagtatgttagggagagtcttctccttcttcttcttttttgctgagg

SEQ ID NO: 6862674 - DNA, 59 bp, Homo sapiens
tttctgggactggggagattctgttattctgttcttcagctcctctaaaagcccaggaa

SEQ ID NO: 6862675 - DNA, 78 bp, Homo sapiens
cttgctttaggaaacagtagcctttgctcacacagaaccttgatcaaaggccagcaaagctactctccatgaagcagg

SEQ ID NO: 6862676 - DNA, 64 bp, Homo sapiens
ctaagagaaatagttgcatgtttcttttgagatgttgaacaaatactgctgctattccttttag

SEQ ID NO: 6862677 - DNA, 81 bp, Homo sapiens
ccttaggatgaaggtgtttgagtcttcttttgaccacaaggaagctaaaaggctcagacagattttgacacttgcctaggg

SEQ ID NO: 6862678 - DNA, 74 bp, Homo sapiens
aggaggaggtgtggatgcttaatgacccaacaggagatgtgaccccttgggaggcttccagaccttgctttcct

SEQ ID NO: 6862679 - DNA, 65 bp, Homo sapiens
gggctttaccatctgccacagatatggcagtagctataaatgaattgggaaggtatttcaggccc

SEQ ID NO: 6862680 - DNA, 73 bp, Homo sapiens
cctgagacctccattctccctgccaaagctgcctccgcctttgggggtagaggggtggtagaagggttttagg

SEQ ID NO: 6862681 - DNA, 56 bp, Homo sapiens
caaggctgcactgttgccatagcctcctacccgttacctgccacattgcagacttg

SEQ ID NO: 6862682 - DNA, 61 bp, Homo sapiens
gaagagactttgcagtgtccctaggattcagtagtctctcagtaaatggtaaagtctcttc

SEQ ID NO: 6862683 - DNA, 106 bp, Homo sapiens
gcaggaaatgaccctgaggaaagccacttgatgtcattctttgaatgttctgctgtcagctcccaaaactgtcaggaatgaggtcgtaagtgtctccttcagctgc

SEQ ID NO: 6862684 - DNA, 55 bp, Homo sapiens
ctatctcgtgataggttttatgtggttacttgaccaaaaagacaaaacgagttgg

SEQ ID NO: 6862685 - DNA, 107 bp, Homo sapiens
agatgcatgagatctgttgttggatatccaggtagcttcggaaactagtttcagcatatgaaggaactggttatgttacctatgtcactagaaagttctttgcttct

SEQ ID NO: 6862686 - DNA, 67 bp, Homo sapiens
tgcacactgtgctctgtaagggtggtggtagtggtggtggctttatccgcttgacccttactgtgca

SEQ ID NO: 6862687 - DNA, 96 bp, Homo sapiens
acatactgaacagttattggtgaagttctttagatgtttagaggaagaaaatattttttaaactacttccatctagagatcccaatgtttagttgt

SEQ ID NO: 6862688 - DNA, 56 bp, Homo sapiens
gtgtcaggttggttttcagagaacagaaatgacagttctatgaaatcaacttgaac

SEQ ID NO: 6862689 - DNA, 66 bp, Homo sapiens
ttggtgttgaagttgggccactgtggggaaagaaatgagtggtccagaagatattcaaccagccaa

SEQ ID NO: 6862690 - DNA, 70 bp, Homo sapiens
tctgttgcagtttctggatgccttctttttccattaaagaaagcatttatgtccagagaagtgctttaga

SEQ ID NO: 6862691 - DNA, 57 bp, Homo sapiens
gtctcaaatctcactctgcatttctcttatagggacacctgtgagtggatttagggc

SEQ ID NO: 6862692 - DNA, 69 bp, Homo sapiens
agagcctccagtttttttctgaactttgaaagtcagtaccaaagagtcagaactgaatggaaggacact

SEQ ID NO: 6862693 - DNA, 66 bp, Homo sapiens
gataaggtctggctccttggcctggcattcgaggccctccaggctctggaccctgccagccttatc

SEQ ID NO: 6862694 - DNA, 71 bp, Homo sapiens
tacttgggtggtggggagagttcagagatcttttatcaccaaatttgatgactctgccaccagccactgta

SEQ ID NO: 6862695 - DNA, 63 bp, Homo sapiens
ctgatgtgttgcaactgctgatgagacccttgaaatgaagtatctcttaattgctcacattag

SEQ ID NO: 6862696 - DNA, 57 bp, Homo sapiens
ggagaaggaaaatggggaggttaaggaccctacacctaaacctttagatcattctcc

SEQ ID NO: 6862697 - DNA, 56 bp, Homo sapiens
cttcacaaacaccagaatggctattatcaaaaagatgataacaagtgttggtgagg

SEQ ID NO: 6862698 - DNA, 71 bp, Homo sapiens
tggaagcatgttgattttcgctggggtcctccctaattccccctggccctgttaatgtcaacctgcctcta

SEQ ID NO: 6862699 - DNA, 82 bp, Homo sapiens
tgttattttcataaaaagcaaggggcttagacagtgactatcataactgaatggaatcatccctgctttaagaaaggtaaca

SEQ ID NO: 6862700 - DNA, 86 bp, Homo sapiens
ggaaaaagttggctcttatgcttgtgtaagaatagtcgtagtcactttattcatatttgttacagcttaaaaaagccaacttatcc

SEQ ID NO: 6862701 - DNA, 130 bp, Homo sapiens
cagctttaattaccaagctcttatggaagctgagggaattggcattaactctgtttcaatttgtacttttgcaaatgagatgtagttacatgacaatgattcacttctgtgaggtgtcaaaaataaactg

SEQ ID NO: 6862702 - DNA, 92 bp, Homo sapiens
ggtctttgatggtgctgagagtaaggaaatgggagatctccaccatcctcatggagtccttcacgtcctgcttattggcaaatatcaggact

SEQ ID NO: 6862703 - DNA, 61 bp, Homo sapiens
tccgtggggatggaggtggacaggaaatagcattcctgtctatcaagacatcttcaattga

SEQ ID NO: 6862704 - DNA, 65 bp, Homo sapiens
gaggtggctgggagtagggaatgctccctttaggctgcaaaggtcacctctcccatgcttacctc

SEQ ID NO: 6862705 - DNA, 65 bp, Homo sapiens
tacatggatatttggtagaaacaaggtgaatttgccttgatagaatttgtgccaagtagccagtg

SEQ ID NO: 6862706 - DNA, 59 bp, Homo sapiens
ctgtcattgagtcgtcagagtcttccgcatacctgttggaggcctctcattcatgtcag

SEQ ID NO: 6862707 - DNA, 123 bp, Homo sapiens
tactacatctgtatgataaagtgtgatagcagaaaaactaaaataaggatgtgacattctatgtatggaccttttctgtctttctttgacacatttatatttatagaaatagcttatgtagta

SEQ ID NO: 6862708 - DNA, 80 bp, Homo sapiens
gcggggctgggtcgtggccagcttcgcccctgggtctgaagacctctgggcggcccaggccaaccttgccctgccgccgc

SEQ ID NO: 6862709 - DNA, 74 bp, Homo sapiens
ctgtgtaatcgtggttatgtggccctgtgtctgcttttgtatgacatgaacctaccataatgatttgcccatag

SEQ ID NO: 6862710 - DNA, 69 bp, Homo sapiens
gctctgtccagcgtgcacagaaagttctagaaagaacgagtacttctgagtgtcgctggttgaagatgc

SEQ ID NO: 6862711 - DNA, 74 bp, Homo sapiens
gtggatcctggggtggtgacctcgtcccaaatggtcagggacaaccagggaggctttactgcctcaggactcac

SEQ ID NO: 6862712 - DNA, 70 bp, Homo sapiens
ttggttcttctgcttctgggatgatggagtaggcctactttttcctattcctcccagtaagtacaactaa

SEQ ID NO: 6862713 - DNA, 79 bp, Homo sapiens
acagatggtcccactgcccccactctgagaaaagccctctggctgtttggatgagggtggtggcgatgaggacatttgt

SEQ ID NO: 6862714 - DNA, 58 bp, Homo sapiens
gggagaaagacgtaggctgggaggctaggccagtctcgccttttcacgtttttctgcc

SEQ ID NO: 6862715 - DNA, 121 bp, Homo sapiens
aagtgagcactaagggctctgagtagacctctggcttagagaccattggcttttccctgacaagtccagatgaagtctctctgggctcagttcacgatctgcatccttccttttctcactt

SEQ ID NO: 6862716 - DNA, 57 bp, Homo sapiens
tactctgtttagccatcaccattgtaaagaatctctagtgggagaggcaacagagta

SEQ ID NO: 6862717 - DNA, 56 bp, Homo sapiens
ttgagacggagttttgctcttgttgctcaggctggagtgcaatggctcagtctcag

SEQ ID NO: 6862718 - DNA, 113 bp, Homo sapiens
gggaatctgggagccctaaggggcagctcttccctcttcttgtaggcaggactcaggttctcactgcagcttaagggaggggttgcctgtgtgatcgctgaccctggagtctc

SEQ ID NO: 6862719 - DNA, 74 bp, Homo sapiens
gagttacagtgcagcttataaagcatcaatgaggaagtgcattgacctctattgtgactggctgttaaaaactt

SEQ ID NO: 6862720 - DNA, 96 bp, Homo sapiens
agtgcacctcatagaagcttttaatagtctttatatttactaaagaataggactaactatggaactatgaagatgagctggaaatgacaggtgact

SEQ ID NO: 6862721 - DNA, 58 bp, Homo sapiens
tttaattaggaaatgggcagggcctcattctgtgcccctaaatgtttcgctaattaga

SEQ ID NO: 6862722 - DNA, 57 bp, Homo sapiens
atgtgtgcaatgctattttggcttttaaaattaagtcaggaaagaaaacgtacatat

SEQ ID NO: 6862723 - DNA, 60 bp, Homo sapiens
gccaaaaatgtcagaaaacatggagtgtcccagaccttcacccagattggcatttcaggc

SEQ ID NO: 6862724 - DNA, 87 bp, Homo sapiens
tcaactgcttctgcacctgtgcaggtttacaaaaaatttttgccaaattgaatggaagatttgaaacacatagacagaggtagttga

SEQ ID NO: 6862725 - DNA, 56 bp, Homo sapiens
tcatggcaagtttttctctcattatttcaattagtgatttttgaagccagccatga

SEQ ID NO: 6862726 - DNA, 90 bp, Homo sapiens
gactctgacttctggttgtgttacgttctgtggtgccaatgagacaggaacagaaaggcctttagagcaaacgccacctacagcagagtc

SEQ ID NO: 6862727 - DNA, 57 bp, Homo sapiens
ggacttcctaatgggctgctgctgggcctgccgtctcagcagatagcgggagagttt

SEQ ID NO: 6862728 - DNA, 85 bp, Homo sapiens
cctgtagcttcaggaaatatctcctggcagaggtgacgcatcttttgtcaactcaccagtaaatatacccatgaaagcctacagg

SEQ ID NO: 6862729 - DNA, 59 bp, Homo sapiens
actcctaacccaacctctcaccaaaagacagcctggtgagcagaataagggttgagagt

SEQ ID NO: 6862730 - DNA, 89 bp, Homo sapiens
caatgtctaccaatatagccactattcctgagctagatttccacaaaacattccacgatttcccttaatggtggttgagtgatacattg

SEQ ID NO: 6862731 - DNA, 76 bp, Homo sapiens
ccctcctgcccctccaccccatcaggataggagaggcctctcgtgagggccctggaggtgctcagcccagggaggg

SEQ ID NO: 6862732 - DNA, 57 bp, Homo sapiens
cacacatggctgccagggaggtcagcgaatataatgtttactctgggtgcctgtgtg

SEQ ID NO: 6862733 - DNA, 67 bp, Homo sapiens
ctctgctttcttgcgcagatgtgagttaggagctgctcaggccactatgtggaaagaattgcatgag

SEQ ID NO: 6862734 - DNA, 112 bp, Homo sapiens
ctgcagttttgcaagtctagcaagaactggctttcatttcaagcacgtctcaaggatggagacgtttagaggggaaagcacatttgcaaaaaaggaaagaccaaaactccag

SEQ ID NO: 6862735 - DNA, 72 bp, Homo sapiens
gatggtggtagaagcactatgtgaacttcattgtcctgaagctatacagggaattgctgtctggtcatcatc

SEQ ID NO: 6862736 - DNA, 59 bp, Homo sapiens
ttgaagccctgtctcctgtacttctagaatgtgactgcatttggagacagggtctttaa

SEQ ID NO: 6862737 - DNA, 74 bp, Homo sapiens
tcccttgcaattcatactgttctcatttgatctcttctctgacccctggaattactggcagtttgtgtagggga

SEQ ID NO: 6862738 - DNA, 58 bp, Homo sapiens
tcctctggctctttccctaggaagtgttatagcttcccaagtactaaagtgccaagga

SEQ ID NO: 6862739 - DNA, 58 bp, Homo sapiens
aggcactgaagaactctttttggaaatcctataagatataacagtttttcaagtgttt

SEQ ID NO: 6862740 - DNA, 59 bp, Homo sapiens
agggagccatggagggttgtgggcagagagggcctcccccatccactgagtggttccct

SEQ ID NO: 6862741 - DNA, 96 bp, Homo sapiens
gatctccctgctggtcaggggatggggctcaggggccctctccagaaggtgactgtgccagctcccctccccagacctctgcagatgaacaggatt

SEQ ID NO: 6862742 - DNA, 71 bp, Homo sapiens
tgtctcttgacctctggggagaccaggaggagtagccacacgtgtcaggggtccccagggcatcaggagca

SEQ ID NO: 6862743 - DNA, 69 bp, Homo sapiens
ttcttgatgatttgcagagggagtgttattagggagctaacacttaaaccaaaatgtaattatcaggga

SEQ ID NO: 6862744 - DNA, 63 bp, Homo sapiens
taaaagtaaaatcaccatctctttgtgggtttcttttcacaatgaggcattgatttgcttttg

SEQ ID NO: 6862745 - DNA, 104 bp, Homo sapiens
ttgagacaagagtcttgctctgtcacccaggctggagtgcagtggctcgatctcggctcactgcaagctccacctcccgggttcatgccattctcctgcctcag

SEQ ID NO: 6862746 - DNA, 71 bp, Homo sapiens
caggtgaagtgggactgggttgcaagacctggtgcggcttttctccacggtgcagcctgtcccttctcctg

SEQ ID NO: 6862747 - DNA, 79 bp, Homo sapiens
gggaaatgttgaacctgtatgtgatctcaggctcacactcatgttgtgggtctgtctgcctcaggagatgcggtttgcc

SEQ ID NO: 6862748 - DNA, 56 bp, Homo sapiens
ttcagattttttaataggtaatgtggttacctgaagttgctattaaagaatctggg

SEQ ID NO: 6862749 - DNA, 79 bp, Homo sapiens
aagtgggaatattatttaaaccatgtactgctttattttgctggagcatttgatatgtttaaaaagtgtcagaccattt

SEQ ID NO: 6862750 - DNA, 63 bp, Homo sapiens
tggtgggagttatttacaaaagatgtatttcatttgttactgtgtgtgtaacaactcctatta

SEQ ID NO: 6862751 - DNA, 56 bp, Homo sapiens
agacaatgcaagcagggagtggggaaaattatccttcccttctcctgcattggtct

SEQ ID NO: 6862752 - DNA, 60 bp, Homo sapiens
tcatttggtcctcccaacaagcctgtgaggtacacatagtaaaatggagggaccaggtga

SEQ ID NO: 6862753 - DNA, 99 bp, Homo sapiens
tcagtggggggcttttgttgcaggtggtgatgacagaagacaggtgcaggcagtgaccatgatcaccacttgacagccctgagagtgacctccaactga

SEQ ID NO: 6862754 - DNA, 55 bp, Homo sapiens
gcaggtgtcctgggctggcagtactgcccacctgctgccccaggcctgcacctgc

SEQ ID NO: 6862755 - DNA, 124 bp, Homo sapiens
ctggggtctgttctgaacaagatgaacagtatgcaacatgattatgatgcaatatgctcctagtttttcccaatgtggatacaatctcatttaaatcaacaatgccatcaggagcagatttcag

SEQ ID NO: 6862756 - DNA, 77 bp, Homo sapiens
agcccctattaatcagatataaactgttcattgactgtgcgagctcaactgcactgtgtggaaatttgtgaggggct

SEQ ID NO: 6862757 - DNA, 60 bp, Homo sapiens
tagccagcacctacccatcctgagtctcggactcctggctcaggggaggtggggtagcta

SEQ ID NO: 6862758 - DNA, 71 bp, Homo sapiens
cgccgggctcggggagctgcagagctcgaaggaaccacgaggtggcgcgctagcactgcgttcgcccggcg

SEQ ID NO: 6862759 - DNA, 62 bp, Homo sapiens
tcagtagatattctggtgaaacctttggaaagttctctaaatggtacaggatatctctttga

SEQ ID NO: 6862760 - DNA, 84 bp, Homo sapiens
agtgaggttgaatatctttatgttggtaaaatcttctttctcttgatgcgccatcatcaagaatgtacagccaataaagtcact

SEQ ID NO: 6862761 - DNA, 72 bp, Homo sapiens
tggagaagcttaggaggatgatgaacatcataccagtggtggtgttcagtgtcaaacctcttaatggtgcca

SEQ ID NO: 6862762 - DNA, 82 bp, Homo sapiens
cccaattgatttgagaagcagatccaaaccatgtccttattccaagatggtcaaggatactgttcatctacaagtctgtggg

SEQ ID NO: 6862763 - DNA, 56 bp, Homo sapiens
atgatacacctaggagtgggaggggaggcctctttggatattacctggtttatcat

SEQ ID NO: 6862764 - DNA, 72 bp, Homo sapiens
actgtgagctcctggaggatagtgactgggagaggacgacccctcccaactactctcaggcagctttgcagt

SEQ ID NO: 6862765 - DNA, 87 bp, Homo sapiens
gaggattgcttgagcccaggagttggaggctgcagtgagctatgactgtgccactgcactccagcccgggcaataaagtgaggtctc

SEQ ID NO: 6862766 - DNA, 66 bp, Homo sapiens
cagattgggtgagatgatttcatcctcagctccaagggtgattcttaattagcttaagtcaatcag

SEQ ID NO: 6862767 - DNA, 120 bp, Homo sapiens
ttttcagagaatattatgggtttacaaagaaaattaggcatttttttatctaataatgtaaatattaagaagatggtccatctattttctataaatgtattaatgttccaacactgaaaa

SEQ ID NO: 6862768 - DNA, 57 bp, Homo sapiens
ggtgttgggctcactggtcctttctgtataagcacagtagggcctgcagctcaagct

SEQ ID NO: 6862769 - DNA, 56 bp, Homo sapiens
aacactgtcagcctttgatggacaaaagctggacaaagtcaatctctgatggtgtt

SEQ ID NO: 6862770 - DNA, 63 bp, Homo sapiens
ttatctgctcttgaaaatgttgagtttgtagccaacatttgaaaatcaagaatcttcaggtaa

SEQ ID NO: 6862771 - DNA, 75 bp, Homo sapiens
ggctcagtgaggggcagagggcctggccacatgaggagccagtgctgtgggcaggcccgggtctgagtgctggct

SEQ ID NO: 6862772 - DNA, 77 bp, Homo sapiens
tgagaagcactgtgcatctagtctcaggcttcagagagaattccctttctagtctatggctagatagttgtcactca

SEQ ID NO: 6862773 - DNA, 95 bp, Homo sapiens
tgtgagtgcatgtatgtatgtgtgtatgtgcctatatctatgtaacaagtatgtataatacatatacacatcatctatataagtaacaactcata

SEQ ID NO: 6862774 - DNA, 59 bp, Homo sapiens
tagtgtagcagggaagatgatcagaatatcagagaaggtgtttttctctcttgccacta

SEQ ID NO: 6862775 - DNA, 79 bp, Homo sapiens
ggtcagctccctttcttgacatctcaagagctggcttcagccccaggacacagttcttagcaggtgtctttgagctacc

SEQ ID NO: 6862776 - DNA, 79 bp, Homo sapiens
ttaagtacaagtttcagtatgattcctccagtagccgaccaaaggcggattttaaactaagaaacacacctgtatttag

SEQ ID NO: 6862777 - DNA, 77 bp, Homo sapiens
ctcactgaatcaagatgtatcgactctattcatgtctgcggacatctttgaatcctttacatctgagactcagtggg

SEQ ID NO: 6862778 - DNA, 65 bp, Homo sapiens
aggaagagggtaggatctagcatgcaggccatagcttgctgaaccctgccctctaataaattcct

SEQ ID NO: 6862779 - DNA, 98 bp, Homo sapiens
gagattagtttattttacagactaaacagcctaaaactttctttcttcccactattattccttgaggaaataggctgcaagctgtattttctggtctc

SEQ ID NO: 6862780 - DNA, 60 bp, Homo sapiens
gggcactggcttcagggggaaagtcctaaattggggctggatctcctgcaggcaggaccc

SEQ ID NO: 6862781 - DNA, 104 bp, Homo sapiens
gtgatggaggtggtggagagacaggccagaggtggggcagccctccgcctcagggttccccattgctccctggctagtctcctgcttcctatgacctttgtcac

SEQ ID NO: 6862782 - DNA, 65 bp, Homo sapiens
cacaggaccaattcacattccagatttgctgcaacctgggatatggggatttcattggttctgtg

SEQ ID NO: 6862783 - DNA, 55 bp, Homo sapiens
tgtgtctggataggtaatggatcggcgaattggtcatctcttacctacagacacg

SEQ ID NO: 6862784 - DNA, 61 bp, Homo sapiens
actttatgacaccctttagtgatggatttctacgctttcagtgatttgggtgtcagaaagt

SEQ ID NO: 6862785 - DNA, 78 bp, Homo sapiens
gtgggcagggccctgggcagcacagctctgacccagagtcaggtctctgggccagcaattgctgctcagttgacccac

SEQ ID NO: 6862786 - DNA, 103 bp, Homo sapiens
agagaaagaaaaatagcaaccaatgcacatcactctgaagaaaagctgggcctgcagttttctgaataagcaggatgattggtgcctctaattttctgtctct

SEQ ID NO: 6862787 - DNA, 71 bp, Homo sapiens
tgtcaaaatggagaggacattaagtgtttgctaatatatttgactttagtttccttggattcaatttggca

SEQ ID NO: 6862788 - DNA, 105 bp, Homo sapiens
tctcacttgatttccacaattgttgctgtaacgatggactactgaggagagaaacttaatttctctggcagatcttcccacgtttaagcaacatgttcatggaga

SEQ ID NO: 6862789 - DNA, 65 bp, Homo sapiens
tagaaaaggtattggctggaagccgagagacctgatgtgatcctggctctcccaatacctttctg

SEQ ID NO: 6862790 - DNA, 92 bp, Homo sapiens
ggtaatgcattttccttcttgtaatgatctgcctgaaacaaacatttagccttactcgtggaatgtcaaaactagaaggaactgtagtgatc

SEQ ID NO: 6862791 - DNA, 83 bp, Homo sapiens
aagtgttataatctggttttattaagagcaggaaacccttcacatgcatgctgttcttgttattgaccacgaataaaaccctt

SEQ ID NO: 6862792 - DNA, 101 bp, Homo sapiens
gggaccacacacagatccccgatttcagtaaggataataaacagacctacgtggagtgagggtgtgatattttcttattgaagttgctgtgtttttgtgcc

SEQ ID NO: 6862793 - DNA, 55 bp, Homo sapiens
ttccttttcttctaccacatgtcttgaacattcacatgggttaaagaagatggaa

SEQ ID NO: 6862794 - DNA, 80 bp, Homo sapiens
tggtagaggtgaggcaggagggttgagcagggtctaggacctccaggctgaggagctcagactctggcctgatgatacca

SEQ ID NO: 6862795 - DNA, 102 bp, Homo sapiens
agtagctgggactataggtgtgcgccaccatgccgggataatttttgtatttttaatagagatggggtttcatcatgttggccaaactggtctcaagctgct

SEQ ID NO: 6862796 - DNA, 59 bp, Homo sapiens
ccttgggagtggtgaccacagctcagggcctgggttggatcctggtggctgccctaggg

SEQ ID NO: 6862797 - DNA, 59 bp, Homo sapiens
atggcagaaaggcatgtgggcccagctgtctaactctagtccactgctctttctgctgt

SEQ ID NO: 6862798 - DNA, 104 bp, Homo sapiens
tggtttgatgagtcttgtgggttgtttacagtctgtcttgggctttaaggaagtcacctgtttgctggagtgaagtctggcagcttgagggcttgttatggcca

SEQ ID NO: 6862799 - DNA, 77 bp, Homo sapiens
atcaagatggtgttgcagaaaaggcacctctgggaccacagcttgggacatgcatactgctgccaacgccacttgat

SEQ ID NO: 6862800 - DNA, 76 bp, Homo sapiens
cttcctccttaaccctgggaggcagctcagttctgggttgggcttccataatgtcatgacctccacagggaggaag

SEQ ID NO: 6862801 - DNA, 62 bp, Homo sapiens
actgaacgccgccgtcaggagagctgaggggacccgacggccctggcggaggcgggagaggt

SEQ ID NO: 6862802 - DNA, 113 bp, Homo sapiens
agggcaatgacaaatgtggagaatgatacagaggtctggttacttcttagccaatgacacagaatcacaattgagaaaacacagagtttattcattcccattgtgcatgccct

SEQ ID NO: 6862803 - DNA, 68 bp, Homo sapiens
agcaacctgccagtcactcagtggcctccaaccagagaaaacaacctgccaagttggcagccgttgct

SEQ ID NO: 6862804 - DNA, 82 bp, Homo sapiens
ccttctcgttgctgcagctatgtaacagtgccatggagggagttccctgttctttgcactgtgcaagcagaagccgagaggg

SEQ ID NO: 6862805 - DNA, 62 bp, Homo sapiens
atttttgaaggttaatggaactgaaaaccccactttataagttcctaataacctgaagaaat

SEQ ID NO: 6862806 - DNA, 57 bp, Homo sapiens
gctttcaatataatgagaaatggctttaaaaagctgtaatattcattctatgaaagc

SEQ ID NO: 6862807 - DNA, 56 bp, Homo sapiens
aatcctggctgcgttggccagcacccccttctgtgctcatccttgctgctagggtt

SEQ ID NO: 6862808 - DNA, 73 bp, Homo sapiens
gctgtcctaattatggcacatttttactttctaggttctgtgatttacagagtggtctggctatgtggacagc

SEQ ID NO: 6862809 - DNA, 62 bp, Homo sapiens
aactctgcctggaggtaacaggatgatctcccagaaagctccgtaaccgatcagagcaagtt

SEQ ID NO: 6862810 - DNA, 74 bp, Homo sapiens
ctgtgtgacacagtagcaagtacatatcagctgttaagaaacaaagatcttgctttcctactggagacatatgg

SEQ ID NO: 6862811 - DNA, 70 bp, Homo sapiens
gcatggctgaacactcagtgactaccactgcactttgttgtagtttcagcattagagatgccagccctgt

SEQ ID NO: 6862812 - DNA, 76 bp, Homo sapiens
ccaggtactttctccccctcccactgtcagctggattccctcagtgatgtgaggtgtgagagggaaagccccttgg

SEQ ID NO: 6862813 - DNA, 56 bp, Homo sapiens
caggcatgattggtacttcaacccaggtctctctgactcttaagtccagtctcctg

SEQ ID NO: 6862814 - DNA, 65 bp, Homo sapiens
tgaggaggcagtctttctgttctcagagctcaaacaccgtgctgggagaaccactgctctcttca

SEQ ID NO: 6862815 - DNA, 91 bp, Homo sapiens
ggagattatctcattctcgttgtaatgacctatcagttgaacccagccaagaagaagcggtggtcacaaacaatgactatggatttttttc

SEQ ID NO: 6862816 - DNA, 85 bp, Homo sapiens
gaggtgattcttaaaatactgtggagtgttgaaaaaatatctcagtgtgattatgggttttaacactcagcactatctctacctc

SEQ ID NO: 6862817 - DNA, 55 bp, Homo sapiens
tactgaggttgagaagctgctctagttttaagttggactggcattaaactcagta

SEQ ID NO: 6862818 - DNA, 64 bp, Homo sapiens
acctgaatccaaactcaacaattcaatgccttttgtttcagggaattttggtttggattttggt

SEQ ID NO: 6862819 - DNA, 66 bp, Homo sapiens
agatacatggaacgtcaaacctgggcccttctcccaatgcccctggaattgattactctatggtct

SEQ ID NO: 6862820 - DNA, 56 bp, Homo sapiens
atgatgaggtcccaagatctcacaggctttgctgtgtgctggggacagctcatcat

SEQ ID NO: 6862821 - DNA, 73 bp, Homo sapiens
aggctggagtgcagtggcgtgatctcggctcactgcaagctctgcgtcccgggttcacgccattctcctgcct

SEQ ID NO: 6862822 - DNA, 68 bp, Homo sapiens
tactgtttggtgaggaacaactcctgtgactatgtaaacatcagacataatttcttgaccatgcagta

SEQ ID NO: 6862823 - DNA, 63 bp, Homo sapiens
cactgagctgatagaattccagttagaaagcaaagaaacttggcattttagttagcttcagtg

SEQ ID NO: 6862824 - DNA, 57 bp, Homo sapiens
agttcctgaacttcttaatgacttaagttttcttgaacattaaggtattcagtgact

SEQ ID NO: 6862825 - DNA, 60 bp, Homo sapiens
ggccagtctcattttcttctgggttaccaaggctataaacaagggagagtgggaatggcc

SEQ ID NO: 6862826 - DNA, 76 bp, Homo sapiens
ggattacatgtagctggcagaaagctttgcccgttggtgacataacacctgggagttgttctgcagttagtggtct

SEQ ID NO: 6862827 - DNA, 71 bp, Homo sapiens
cttccatgagtcaatgtatttaacagcattttgtaaattacatagaattacataaatacatgaattggagg

SEQ ID NO: 6862828 - DNA, 72 bp, Homo sapiens
tttctgtgaatggccatgacaaggtactatgttttttgactcttttgtttaaatgtggcatatatacagaag

SEQ ID NO: 6862829 - DNA, 70 bp, Homo sapiens
aggagcagaatttaatgtgcagggagtgggtgactattaaattcagtgactgcagcaaaactttgctcct

SEQ ID NO: 6862830 - DNA, 87 bp, Homo sapiens
tattgacttctactgtgtagctttccttcatctttcccttcttccccatgcaaagaaagatgaagaacatgagcacactgtacaata

SEQ ID NO: 6862831 - DNA, 66 bp, Homo sapiens
gccgcactgtttcactactgggcagtgaaatcagattgtacactagtggcagcagtatttataggc

SEQ ID NO: 6862832 - DNA, 61 bp, Homo sapiens
tcctgtgaccagcttccatgctgagtcctgcttttagcataaggtcaggtgtggtccaaga

SEQ ID NO: 6862833 - DNA, 88 bp, Homo sapiens
ggagggcttcaggaaggctctgtggctgcgtaggtctggcacccggtgctgcctgttgtggggccacgtgagacttccacagctttcc

SEQ ID NO: 6862834 - DNA, 78 bp, Homo sapiens
agcaagagtgagctcgcatgcatgtgatttaggtgacgttggtgacagaatatttggcatgcgtctcctacatctgtt

SEQ ID NO: 6862835 - DNA, 65 bp, Homo sapiens
cccttgcaatctccagtcctagtctcttgcttgtcccacaggtagaagggtaggtgtggggaggg

SEQ ID NO: 6862836 - DNA, 75 bp, Homo sapiens
tgtgataaagcgtgttgctagacatggtcaagagttaacttgaaatgttcatatttagttcacgctcaatgcata

SEQ ID NO: 6862837 - DNA, 67 bp, Homo sapiens
tttgttgggcttggctgccaagaagaaggagataaacatcaccatcatcaaacagctgctcaagaaa

SEQ ID NO: 6862838 - DNA, 102 bp, Homo sapiens
tattaacatgcacattagcatcatctcattggttcttcctgctgctccaccttaggggcagcagtaggagctaatcttattgctcccatgcgcataataatg

SEQ ID NO: 6862839 - DNA, 123 bp, Homo sapiens
gatctggagtctgtcaggtttgggttctaattacagtgacagttgctatgatcaagtacaactttcttgactcacagtgtcttcatttgtataatggagctaacaactgatttgcagaggatt

SEQ ID NO: 6862840 - DNA, 107 bp, Homo sapiens
gggacagggtttttgctgcccggggcctagtctacctcggcacgcttttctctgaaggagacacgcacttgcacgacgtgggcctctgtgcagctctactttgtcct

SEQ ID NO: 6862841 - DNA, 57 bp, Homo sapiens
gctggcaatgtctgtctgtagtgtattcttaacaatacagattagcacaatgcaggc

SEQ ID NO: 6862842 - DNA, 63 bp, Homo sapiens
ggcggaggtggagcaccaagggcgcttggaagcggcctcttatctggctcctgcacctctgcc

SEQ ID NO: 6862843 - DNA, 64 bp, Homo sapiens
ctgagtcacagtagatcatcacttattattgttcccactttagagatgaggaactgaggctcag

SEQ ID NO: 6862844 - DNA, 71 bp, Homo sapiens
gggtgcaaaggatcatgtggtcattcctgagaaggatatcctcagatgatactgcatgggtccgtgtgccc

SEQ ID NO: 6862845 - DNA, 91 bp, Homo sapiens
aactaactgcattattcatatgtgccttttaggttgagtgtttgttatgctacatttacttatcaaaagtcagtgaaatgtttgtctagtt

SEQ ID NO: 6862846 - DNA, 113 bp, Homo sapiens
cttcgagttatttcattctccttctcttccccttagtttcctttaagagtgataaaaatggaaaagggggctgaggtggaggaaggagaccttttgtcctgaaatgaatgagg

SEQ ID NO: 6862847 - DNA, 55 bp, Homo sapiens
ctgtgaattaagtattgttatccacgatttacagataataaacttaaggtcacag

SEQ ID NO: 6862848 - DNA, 56 bp, Homo sapiens
agactcatggtaagggtagaaaccggcatctccacatgtctaccctctcagagtct

SEQ ID NO: 6862849 - DNA, 97 bp, Homo sapiens
tgaggcagaagaatcacttgaacccaggaggcagaggcatgagccaagaccatgccactgcacttcagcctgggtgacagagtgagactctgtctca

SEQ ID NO: 6862850 - DNA, 79 bp, Homo sapiens
ggttaacagtcactgacaagagagaagaactttgataattgctctaggtttttttctgattgctctgaaatatttagct

SEQ ID NO: 6862851 - DNA, 67 bp, Homo sapiens
tgtcacatgatctgataatcatccactagtgagtctgtgggtgatgagtatcagagcagtaatgaca

SEQ ID NO: 6862852 - DNA, 72 bp, Homo sapiens
gacaaaattgaaacaatgagcttttacacactgatggtaaaaacagcagtttgaaaaacattgttttaagtc

SEQ ID NO: 6862853 - DNA, 59 bp, Homo sapiens
tcccatcgtctcctggatgatatgcaatgtcctgcagtcacagggagatggtgacagga

SEQ ID NO: 6862854 - DNA, 58 bp, Homo sapiens
tctattgccatgtggaagggggagcagatgcattctgcattcctcacagggcagaaga

SEQ ID NO: 6862855 - DNA, 61 bp, Homo sapiens
aacttactttcctattaatggttgctcagaatacataatgccagagagagggaagtgggtt

SEQ ID NO: 6862856 - DNA, 58 bp, Homo sapiens
gggtttatatcacagctttggcacttactgggtgtctgtgagcaacatatgtaaactc

SEQ ID NO: 6862857 - DNA, 81 bp, Homo sapiens
tggatccagcgtgatggggcctcctgccacccaggccctgctgcctatccccaggtgtccaggtggcctctgctgcttcca

SEQ ID NO: 6862858 - DNA, 56 bp, Homo sapiens
tcctggcaaagcaagttatgaactgcctctgcaaaatgacccctgttctgccagga

SEQ ID NO: 6862859 - DNA, 62 bp, Homo sapiens
cctctgtgtcttggtttcaagatttatttaaaaatcatagaatggtaattaggacacagggg

SEQ ID NO: 6862860 - DNA, 80 bp, Homo sapiens
ttttcagagatgtgacaaaccaagaggacttggccacaaggcctcagttttctgtggtttcaaatttactcatctgagaa

SEQ ID NO: 6862861 - DNA, 80 bp, Homo sapiens
ggggccgtctgtgagccaaggagcaaagcctcaggagaaaccagtcctgctgacaccttgctcttggacttccagtcccc

SEQ ID NO: 6862862 - DNA, 76 bp, Homo sapiens
gcttgaacccgggaagtggaggttggttacagtgagccaagatggcatcactgcactccagcctgggtgacaaagc

SEQ ID NO: 6862863 - DNA, 63 bp, Homo sapiens
tgcactcgaaggtcacttttattcctgagattctgtgaaggtctcgattggcaaatgagtgtg

SEQ ID NO: 6862864 - DNA, 55 bp, Homo sapiens
cagtgaaatctttcctcctgaagtgacatacatcactttagcttacgtttcattg

SEQ ID NO: 6862865 - DNA, 71 bp, Homo sapiens
ccatgaatgttaaacagcttttatattcactaggaaaatattgtggtgtttaatgggctgtttatttcagg

SEQ ID NO: 6862866 - DNA, 80 bp, Homo sapiens
ggaatctgtgctctatgagatcctcctcacctgttcagctcaaggagagaagcaggtgtagggctctttgtacagactct

SEQ ID NO: 6862867 - DNA, 124 bp, Homo sapiens
taggacctccatggttccagagtctaaggtcttccatgttttctctgacacctatgctgatccatcccattgtaggatgtgccaggaaagaaaggatttttagcacctggcaacctgggtccta

SEQ ID NO: 6862868 - DNA, 119 bp, Homo sapiens
ctcagatgtgcagtccaatttaagaaccaccaaggccttaaagctctctccagcattcaacttcaagctgctgggggacaacaaagagccatggaggatcttcttgacagcaccctgag

SEQ ID NO: 6862869 - DNA, 72 bp, Homo sapiens
gaggctggagctgggccaggcatttgctgggtccccaggccatctggctccatgctccgcttcttgtgcctc

SEQ ID NO: 6862870 - DNA, 77 bp, Homo sapiens
gtgggccgtgtcatctgcgggtggcactgccctcggtgggcgggtgggccgtgtcatctgcgggtggcactgcccgc

SEQ ID NO: 6862871 - DNA, 58 bp, Homo sapiens
ttgagtgctctgggttttgctgatgaaaatcttttcagaagtgaaatggagtattcaa

SEQ ID NO: 6862872 - DNA, 60 bp, Homo sapiens
aacctgctttctcagagaagggaaaaatagctccctaacaaagcactgaaaagtatggtt

SEQ ID NO: 6862873 - DNA, 65 bp, Homo sapiens
ttaaagggctggccacatgatttggtaagggcaaagctgaactactttaaagccaggccctttga

SEQ ID NO: 6862874 - DNA, 76 bp, Homo sapiens
tccaaagttcacagttttagaaaatagatagtcttcattatctgtgtttagtttttaattaattgtttgttttgga

SEQ ID NO: 6862875 - DNA, 59 bp, Homo sapiens
ccagggctgctgtgggactccaagggctaactcaaggagagtccctaacacaggcctgg

SEQ ID NO: 6862876 - DNA, 64 bp, Homo sapiens
gcattctttttaggaggttcctgttataaataaccacaaaataacttaccttagtgaaggatgc

SEQ ID NO: 6862877 - DNA, 80 bp, Homo sapiens
tctgaagagtatgaattaagttcactgtttggacttgtgcaggaatgcttagtcccacagtgaagttcatgatattccga

SEQ ID NO: 6862878 - DNA, 125 bp, Homo sapiens
ctactgtaatattgaggaaattgagaaaggtgttcaaagtttagtgaaataaatttttattggttaaaaatagtaaatgagtaaagcggtgtcacagaatgcctttctgcatcagagctgcagtg

SEQ ID NO: 6862879 - DNA, 69 bp, Homo sapiens
gggtggaggtgggttttgagataattgcaatctttatcgtttgaagcctcaagacacctgcctttcccc

SEQ ID NO: 6862880 - DNA, 63 bp, Homo sapiens
tgtacctcgaacttggtctttgatgtggattttgagctactatcaggccacagttcaggtata

SEQ ID NO: 6862881 - DNA, 59 bp, Homo sapiens
ttctgttcagcgttggcgttagggttggcgaggccttccccactgtgtgcctggcagga

SEQ ID NO: 6862882 - DNA, 111 bp, Homo sapiens
gaacaccgagtttctattggttttacacctgttaactctaagacagaaatgatttagctttgacatggttgtgcttctttcttaaactgtagggtacttggtcatatgttc

SEQ ID NO: 6862883 - DNA, 60 bp, Homo sapiens
ggattagtcttactcgtccaattaaaataagacacatcttggaggacagagactatatct

SEQ ID NO: 6862884 - DNA, 57 bp, Homo sapiens
cctaataacagtgtctgtggttaaaggtgttcactgtatgcctggcactgttctagg

SEQ ID NO: 6862885 - DNA, 73 bp, Homo sapiens
gaggcctaacagtcaaatgtctatcttcttctcatcaccaagaagtgatgctacgactttgacatagtgtctc

SEQ ID NO: 6862886 - DNA, 77 bp, Homo sapiens
tggcagagctgggatttgtactgggaagtctggctccaaacttcgtaccattaaccagtatactctcctgctttcca

SEQ ID NO: 6862887 - DNA, 86 bp, Homo sapiens
gaagcatcagtttagatgatggtaaaaagaagttttctataatgcagagaatttgggttactctcattttaatcctgattgtcttc

SEQ ID NO: 6862888 - DNA, 55 bp, Homo sapiens
ggcctgggccttgcctgagaccatgcagatggcatggcagaacacctcgcccgcc

SEQ ID NO: 6862889 - DNA, 61 bp, Homo sapiens
gaagcgcaggcaggacaaggggtgtagaagatgcagtcagctttggtttcctcctgccttc

SEQ ID NO: 6862890 - DNA, 80 bp, Homo sapiens
tggcatattgctgagtgaccaataaatattttctgaataaataatgagagtaaacatgctgtgtactcagcactgagcca

SEQ ID NO: 6862891 - DNA, 65 bp, Homo sapiens
cccagtgtctgggcctgcagggtggcctctgaggcccagggccctggaagagcctgggcatgggg

SEQ ID NO: 6862892 - DNA, 61 bp, Homo sapiens
gtggtgtttgttaactcccatggtgcaaataccgccaccatggctgatttcaagctaccac

SEQ ID NO: 6862893 - DNA, 64 bp, Homo sapiens
aggtccctgggagacagagtattggaatctaacattcaagtcgtgcttgtctgcctagaggctt

SEQ ID NO: 6862894 - DNA, 57 bp, Homo sapiens
taggtgctgcccacgcctgggtctttgcgtttttaagggaaaggctgctgctacctg

SEQ ID NO: 6862895 - DNA, 64 bp, Homo sapiens
gcgcaggtctgggttgatggcctgggtgatctcacgcattaggcattggaaggtcagcttgtgc

SEQ ID NO: 6862896 - DNA, 129 bp, Homo sapiens
attgctgcagggcgtcgtgtgaggactgagttgctaggggcacagttctcagaagcagggtgggcagtgagcatgccctgcaggagctgctgtcctgctcatcttctctgccacacagttgccctgcat

SEQ ID NO: 6862897 - DNA, 90 bp, Homo sapiens
cattgattggtccaagagaagccattatgctattagttgtctatctattctgtctatatcagcttctagcatcggctttgaccatcattg

SEQ ID NO: 6862898 - DNA, 76 bp, Homo sapiens
aaaagtgcattgacacatatggttgctgcagtgaagcaaagctcactacctgtagcccatatccaataaatctttt

SEQ ID NO: 6862899 - DNA, 58 bp, Homo sapiens
tttactgtatgctgctaggagcctggctctttcccaggcacctggatgtagcagtgaa

SEQ ID NO: 6862900 - DNA, 97 bp, Homo sapiens
ggtttaatggcaagtggttgtgaaggactgaatgaaaatgtctaccttctgggaaatgactttggattgggtccctcccaccccttctattcaaatc

SEQ ID NO: 6862901 - DNA, 63 bp, Homo sapiens
tgcatgctggcctcagaaaaatgggtttactaaacacctgtgacccttgatggttgacgtgca

SEQ ID NO: 6862902 - DNA, 58 bp, Homo sapiens
tagggaaatatagatttagggctgaaaactgatcccagcttttttcattatttccttg

SEQ ID NO: 6862903 - DNA, 69 bp, Homo sapiens
ctgaaatgactggctaactttgctgataaacttcctgacagcaataactcaaagccatttatgcttcag

SEQ ID NO: 6862904 - DNA, 67 bp, Homo sapiens
gacaggtcacctctcatcacatgctacgtgacagttacctgtagtgtgcaggggggggaagcaggtc

SEQ ID NO: 6862905 - DNA, 64 bp, Homo sapiens
tgcacatctgtcctgtctgcttttaatttggaagcaccagttttaatttagcggcaggactgta

SEQ ID NO: 6862906 - DNA, 62 bp, Homo sapiens
ggttattgccactcaaatccagctttagaatttgtagttctaaccctttgagtggtaccacc

SEQ ID NO: 6862907 - DNA, 77 bp, Homo sapiens
ctaaagtgtttgccatgcaacagaatccagatttcagtcttttaaaatctaattctgttctgtggagcctcctttgg

SEQ ID NO: 6862908 - DNA, 75 bp, Homo sapiens
ttttactgacttaatatagattggctatggaattgacccaaggtttacattatagtctatattgtgaaagtaaaa

SEQ ID NO: 6862909 - DNA, 59 bp, Homo sapiens
ctgaggctcagagaggtccacatacttgtttaagtgttaaagggggcttctgagcccag

SEQ ID NO: 6862910 - DNA, 92 bp, Homo sapiens
gcttaatgactctttgtgcatcttggaccatcagctcctcctggattttcattaatcccaggggcaatggcttagaccacaatcattattgc

SEQ ID NO: 6862911 - DNA, 99 bp, Homo sapiens
tggctctaaatcaactgggcacagtggctcacgcctgtaatcccagaactttgggaggcagaggcaggtgggtcacttgagtccacgagtttgagacca

SEQ ID NO: 6862912 - DNA, 84 bp, Homo sapiens
gaataattgccatttatactgcaagtcactgcctctttacaatgcagtgaccaaaaaaaggcaggtagactctggtacttattc

SEQ ID NO: 6862913 - DNA, 62 bp, Homo sapiens
gcgtgtgcgcctggcaggcgggcggcgaaaagacgtccagggcagccgcgggtgcgcacagc

SEQ ID NO: 6862914 - DNA, 57 bp, Homo sapiens
agccaaggactcagtggtaggcgtggaatggctttgcgaaatccctgattcttggtt

SEQ ID NO: 6862915 - DNA, 79 bp, Homo sapiens
tctccacatgtcctcagcttccttcctccgcctttgtgctgtggaataagaaaggaaattgagggacgcatgaaggaga

SEQ ID NO: 6862916 - DNA, 80 bp, Homo sapiens
ctgggccgatacctagttccctttggggcctttctcctcccttggtgtaggccagcttccagaggggcagggtagctcag

SEQ ID NO: 6862917 - DNA, 99 bp, Homo sapiens
gccaggggcgccctggtggccaaaggcttgttggacggcggggcgcacgccgtgcgtcccgctggagacaacctgaggtctccgagctggtgccccggc

SEQ ID NO: 6862918 - DNA, 129 bp, Homo sapiens
gggtgaatattggccttgttcctttagcccagctcaaggacttattcatgcctgtagtctaccaccatgaattaggtctggtattgagtcttggaagcatggggtttgggttaataaggcatattcccc

SEQ ID NO: 6862919 - DNA, 127 bp, Homo sapiens
ttttctgcttgttaggttgtcggaattttgcttttgtggacctttcctatcaccttttcctgcctcatggttgtagtgttccagaagcaaacaagattcccttgttgaatcttgatttagtagaaag

SEQ ID NO: 6862920 - DNA, 101 bp, Homo sapiens
ggttcattgtatcatcactttaattttaaaataagaattagcttcccttataaaacacatggaggtaggctagttagtatttacaaaagaaacagtgtccc

SEQ ID NO: 6862921 - DNA, 66 bp, Homo sapiens
ggggaaaggtgcctcttacaaggcttaggttttcgcagcagagcctgttaggcacctgtgttcttc

SEQ ID NO: 6862922 - DNA, 100 bp, Homo sapiens
gttggtgtacaaatatctgagttctgctttcagttcttctgggtgtatataagtacctagcagtggaattgcagaatcatatggtaatgctgcatttaac

SEQ ID NO: 6862923 - DNA, 57 bp, Homo sapiens
gaatcctaatttgctgaatgcttagttttgcctcaatgagcatccagtcatgggatc

SEQ ID NO: 6862924 - DNA, 67 bp, Homo sapiens
tgagtaagagaatgtctggtgctcaagaaatataaatgcttaaccttgaaacacagatttcttacca

SEQ ID NO: 6862925 - DNA, 61 bp, Homo sapiens
tccttggatgccatctcgatctgcattcactccatctcatgcaatcttgtggtttcaagga

SEQ ID NO: 6862926 - DNA, 86 bp, Homo sapiens
agtaacagatgggcatcatgatcagtaaccaatcacatcacttcttttaaagtctgtcagtgactggtcaccaggcatctgttatt

SEQ ID NO: 6862927 - DNA, 85 bp, Homo sapiens
ttgcatgatttgcatttcctgtactgtttgagcttcaatgagctctaagcgccacgtatgaggaaaccactgccaagtaatgcaa

SEQ ID NO: 6862928 - DNA, 55 bp, Homo sapiens
cagtcacagtttcttttctgataaagatcttttgtctcaaaggaatctgtctctg

SEQ ID NO: 6862929 - DNA, 55 bp, Homo sapiens
ggacctggcttctataccaccaggtgtcttgcacccatgatgtctgaagtcatcc

SEQ ID NO: 6862930 - DNA, 100 bp, Homo sapiens
ctacacaaatgattgagtaagtggcttggtcttagaatcagattacttggacttgaattctgccgctgccacttactagcttaatttaaccatttggagg

SEQ ID NO: 6862931 - DNA, 78 bp, Homo sapiens
aagcagtccagccttcaatcttagtgacacatcttcttctgctgagcaccactatcttgtagggcatggcagttgctt

SEQ ID NO: 6862932 - DNA, 62 bp, Homo sapiens
cctccagagaccagctgaatgccagatgccagttgacatcacctttcacctgtcctggcagg

SEQ ID NO: 6862933 - DNA, 83 bp, Homo sapiens
gatgcttatactatcaacttttttggtgataatgaagaggtctatgccttttacatgttagaaaaggctgttgataaaagctc

SEQ ID NO: 6862934 - DNA, 63 bp, Homo sapiens
ggggatgggtttggtagtcattcaattgctatcttgccctgtgaagacacataacctctctcc

SEQ ID NO: 6862935 - DNA, 59 bp, Homo sapiens
ggtggggctgggagaggcccctctgtggagctcggaacagtcgctttccttgcccctcc

SEQ ID NO: 6862936 - DNA, 61 bp, Homo sapiens
agaggcagctgaagcccaggcagaacccaaagatggttccccagaggctccagcttcccct

SEQ ID NO: 6862937 - DNA, 87 bp, Homo sapiens
ttgagttttctggtccttgcagctaaactaggtaaacagcaggatttcatttttgtttgtttgttttgtttaggccaagatttttaa

SEQ ID NO: 6862938 - DNA, 130 bp, Homo sapiens
tcttgggtaccaggaaagcccatgtctgaagtgctggcaggaatatgagctgctgcagtgtttttctctctattgatgcctcagagttgctattctcagcatttgggatctgcttttcggaatactcagg

SEQ ID NO: 6862939 - DNA, 103 bp, Homo sapiens
tgaattggcagctgcagaatgtttgaatcaaagctgaagttttcaaagagaatgactatgggattctgcagttttgattttaatatcctgaaaatgcaaatca

SEQ ID NO: 6862940 - DNA, 57 bp, Homo sapiens
cctctcctctgggcctcccctctgcctggcagcgggttggcagcaccagaggagggg

SEQ ID NO: 6862941 - DNA, 80 bp, Homo sapiens
ccagaatgtttgataagagctgctgaaactgacaataaaaccttgcagatttttaagtagtagctcattgtcacaactgg

SEQ ID NO: 6862942 - DNA, 68 bp, Homo sapiens
ggcactaagttggtgttaattagtgaaaattatctaatgcaagctcattttaacattagcttaaagcc

SEQ ID NO: 6862943 - DNA, 61 bp, Homo sapiens
gtgtttttgctttttacaaaagggtcaggaattttgatcccaaaggtccgagcgggaatat

SEQ ID NO: 6862944 - DNA, 61 bp, Homo sapiens
actcaaatttgtcaactgaagctaagaagatcagctaggcaaatagaagataagtgtgggt

SEQ ID NO: 6862945 - DNA, 72 bp, Homo sapiens
gggcctgtgcctgccccactcctcagcacggtggtgccccgtgcactggagaggctggggaggcaggggccc

SEQ ID NO: 6862946 - DNA, 70 bp, Homo sapiens
tggttagtggtagtaaacctatagctttgagaaaatatttttaaagtctatcagttactaatcattttca

SEQ ID NO: 6862947 - DNA, 78 bp, Homo sapiens
gatcatctttcatctctattatttgacagcatatatttcatcttatgtagtagaatcatatggatgagggtttttttc

SEQ ID NO: 6862948 - DNA, 59 bp, Homo sapiens
gtccccttgatacactgatgatgtgcccacttagcattacaagtgtttgagaggtggac

SEQ ID NO: 6862949 - DNA, 58 bp, Homo sapiens
tctggatgttaagacaggggaacaaccgcaagttccccattttcatgttaactcctgg

SEQ ID NO: 6862950 - DNA, 93 bp, Homo sapiens
agtggttaggaacacacagaggctccagagatagactgcctggattcagattgtactcatgtcctctacgagctgtgtgaccctggaccaact

SEQ ID NO: 6862951 - DNA, 88 bp, Homo sapiens
ggctcacatattgatgtcgtccttgaggatagatcttggtaaggggtcaccctcaaaagctcttcctgcagggaccttgttgtgggct

SEQ ID NO: 6862952 - DNA, 74 bp, Homo sapiens
aagcttggcattcaacccagccttctgccaggatggttctgcctggcagcaaaaagcctggttgaattaagctt

SEQ ID NO: 6862953 - DNA, 81 bp, Homo sapiens
gtggtaagaattaaaacctaggaagcagtttcaacagccacaaacgcatacaaacacttcttaggtcttaagtcagttcac

SEQ ID NO: 6862954 - DNA, 73 bp, Homo sapiens
gtttctttgtgggaatgttacaatgggttataagaaaaatattacagcctttaaccatttcttccaaggaaat

SEQ ID NO: 6862955 - DNA, 59 bp, Homo sapiens
tgttttgttagcactctgggaactgttagtctttcactacccagaagcttaacagagca

SEQ ID NO: 6862956 - DNA, 61 bp, Homo sapiens
aattgctagtcagctcaaggtagttgtgaataacttgctactgctgtgatctgatgtaatt

SEQ ID NO: 6862957 - DNA, 68 bp, Homo sapiens
ttggttatgtccaggtgtgagatgatcactgcttctaaagctagaaagtgccacaactggacaaccaa

SEQ ID NO: 6862958 - DNA, 98 bp, Homo sapiens
gtgattcctcagccagagcaacctctctatgccaagtacaggcactgctcagggagaaggagagtgctgaacggcaagggtgcaggtggagggatggc

SEQ ID NO: 6862959 - DNA, 85 bp, Homo sapiens
gaagcgcttgaacctgggaggcggaagttgcagtgagctgagatcgtgccactgcactccagcctcagtgacaaagcgacacttc

SEQ ID NO: 6862960 - DNA, 77 bp, Homo sapiens
agatgcagaaaaactaagtgatttctctaagatgacatggccacccggagattctatcctcagtgtttctgacatct

SEQ ID NO: 6862961 - DNA, 125 bp, Homo sapiens
tccttcctgccttgtatcttatgacccagggttggccctgtgggagcccaggcagatatgtaagccttaattgactcatttctgtctcctacaggctccctggccatgaaggtctgcaggaagga

SEQ ID NO: 6862962 - DNA, 55 bp, Homo sapiens
gttcaaatctcaggacttcagaggccactgagttccactatctggggtgctgagc

SEQ ID NO: 6862963 - DNA, 86 bp, Homo sapiens
ccttttagaatactagatgtcccaagtgtgccatgccaaacccttttgctttgaatgccctggacttctagtattcaatgaagagg

SEQ ID NO: 6862964 - DNA, 75 bp, Homo sapiens
tacactgctctctgttctttgtcactgggaacggaatagacttttcccaggatctgagggcagagagtatccgta

SEQ ID NO: 6862965 - DNA, 95 bp, Homo sapiens
agcagtaaggagcatcggctgagtctgaggggagagctgggtgctccttgcacctccctggccctggcaggtctctttgctgatcttgtgctgct

SEQ ID NO: 6862966 - DNA, 62 bp, Homo sapiens
tctttgtggcgggcttaaatactgatcctacaaaaggagctaaaattaggctgtcatatgga

SEQ ID NO: 6862967 - DNA, 97 bp, Homo sapiens
gtgtttatgtgccccaaaattgctatgtcaaaacctactccttcatgtgatgatattaggaggtgggacatttgggtggcaattaggtcatgaacac

SEQ ID NO: 6862968 - DNA, 65 bp, Homo sapiens
tgctaagtactttgaagggttaatatggaaattcctataggaaacttgctgtaaagttctaggca

SEQ ID NO: 6862969 - DNA, 81 bp, Homo sapiens
tttgatctcactggcaagactacaggtgatgttctgttttttcaatcaggaggcacatgtttgtctgtctgtgatgttaga

SEQ ID NO: 6862970 - DNA, 92 bp, Homo sapiens
ttcttcttcattgctgtcttcacttcctggtttctcaaagtatagataagtggattcagaaagggagtgaagatggtatagaaaacggagag

SEQ ID NO: 6862971 - DNA, 130 bp, Homo sapiens
ccacaggccacttgtccattcttgccacctttcacatgttccctagttaggcccctgtggtatcccccagccagcgcagtgtaggtggggggcgtgtgttcatgtcagtagatatgtctgtggccgccag

SEQ ID NO: 6862972 - DNA, 68 bp, Homo sapiens
tggctacccagagcctcaccctgtgcacagaggagtgtgtcaaaactggggcaggttctggtcagcca

SEQ ID NO: 6862973 - DNA, 61 bp, Homo sapiens
gacaggagccagggagggtctggtatagaacaattgtgcgaagaaacttctggctgttttc

SEQ ID NO: 6862974 - DNA, 72 bp, Homo sapiens
tgagggcgggtgttttacccttgcagagacattttcttgaattctggagggcccacatccacaatgccctca

SEQ ID NO: 6862975 - DNA, 57 bp, Homo sapiens
tgggttggtcagcataagatggccaggaaggtggaaatcaggactgctggcaatcta

SEQ ID NO: 6862976 - DNA, 59 bp, Homo sapiens
ggtagagggaaatggaggaaagagacattaaaaggaaaatgtcaccatttccaaatgcc

SEQ ID NO: 6862977 - DNA, 62 bp, Homo sapiens
tgctgaaatatttatgggtaaggggtcacgatgtctgcaacttactcacaaatggtttagca

SEQ ID NO: 6862978 - DNA, 66 bp, Homo sapiens
ctgacctctctgtagtggagtctcctgtcctggtctgaccagagtgagacccaggtgctgggtcag

SEQ ID NO: 6862979 - DNA, 68 bp, Homo sapiens
ggtgactggccctgcctcactcaacctggggtgggactagcgtgtgtgtagaaagggccctggtggcc

SEQ ID NO: 6862980 - DNA, 57 bp, Homo sapiens
tcagaataaacatgggcatgggttgcttcttgctgccactgtccatgttgttcctga

SEQ ID NO: 6862981 - DNA, 55 bp, Homo sapiens
ctctgcccccagctggtgcttggctcccagtcttaggctgagttagggggaggag

SEQ ID NO: 6862982 - DNA, 103 bp, Homo sapiens
tttgacttacaatttagtcagtgtggaaccaaataacctaaagttagcagtgccaaatgcctttggttgaatgtgtcttcatataaagacttatttgttcaaa

SEQ ID NO: 6862983 - DNA, 100 bp, Homo sapiens
agggatagggaaggcattgtttttgagaatgttctgggagtggctgaaggactgtactggcagagcacccaaggagcatttggactgtcttctcatctct

SEQ ID NO: 6862984 - DNA, 76 bp, Homo sapiens
gctagtagggggtaggggagaatttcaactcaggtggctggactccaagagccatcctctctccatcccactgtgc

SEQ ID NO: 6862985 - DNA, 58 bp, Homo sapiens
cttcagggcatattattggctctcgataaaaggcaaatagtaatgataagccttgaag

SEQ ID NO: 6862986 - DNA, 73 bp, Homo sapiens
cttcttacttctgtattttataatttagagtttagacacattttggattacatgaaatgcagaagaggagagg

SEQ ID NO: 6862987 - DNA, 60 bp, Homo sapiens
ggcactgacactagcatggcactggccacgtgccaggaaatgaactgtgtgttttgtgct

SEQ ID NO: 6862988 - DNA, 74 bp, Homo sapiens
agtgcccttcacaattctgatggtttcccagtttcttcttgaactaaagctcacagagttgaactttatgcact

SEQ ID NO: 6862989 - DNA, 67 bp, Homo sapiens
cattttcaagggcagggaaatcatttcagttaggaaccttagatggtgtccccagcctttgaagatg

SEQ ID NO: 6862990 - DNA, 84 bp, Homo sapiens
tcagcatctcaaacatctttgaccatagaaacttcattcgtcttggaggactaatgttgtacagatatatttgggtaatgctga

SEQ ID NO: 6862991 - DNA, 61 bp, Homo sapiens
acagcatgcccagactgagctaaatggaaaaagactacttggaaagtgtgtgtgtgtgtgt

SEQ ID NO: 6862992 - DNA, 68 bp, Homo sapiens
gtaaggatatatttcagagcttctagggctatatccatttcctactttcctcttaaattgtctcttgc

SEQ ID NO: 6862993 - DNA, 74 bp, Homo sapiens
gggatctcaagcctgcctgtggacaccctggagggacccccaatcctcccatacctatgggccaggcatgaccc

SEQ ID NO: 6862994 - DNA, 68 bp, Homo sapiens
agtgcttaatgtattttacttcacatgaaagcccaataactctgtgaagtaagtactattaagattct

SEQ ID NO: 6862995 - DNA, 57 bp, Homo sapiens
tcacaagagctggactgtcttttctgatgctgttgttttcacatccagcttatgtgg

SEQ ID NO: 6862996 - DNA, 124 bp, Homo sapiens
aggggatttcatgcgacggtcagggaccagagctggtgcatattcagaaaatgcaggcaaattctctgttagtttcttcatatgtcaggagtactccttcctcttatgtttgtttttttcccct

SEQ ID NO: 6862997 - DNA, 60 bp, Homo sapiens
ttcccagagataagacgtcttattcctttcacttagagggtgtgtgtatgtctcagggaa

SEQ ID NO: 6862998 - DNA, 75 bp, Homo sapiens
tatgttaaataggtcaggggtggggcccaggagttgtacttttaacgagcaccctcctgtgattcatttaacata

SEQ ID NO: 6862999 - DNA, 119 bp, Homo sapiens
tttccataaagtggaagattgtagcccttttcaaaatatgtcaagggaaaaagaagcagtccctgtactgctccactcccaattgcatgtacctgaggagctccagaaccacttggaaa

SEQ ID NO: 6863000 - DNA, 81 bp, Homo sapiens
aaatatggcattttgtaggcagggcagttagaagctgacatgaacccagcatctacctccaccctatatattatcatattt

SEQ ID NO: 6863001 - DNA, 72 bp, Homo sapiens
cctttggggtcctcaacacccggctgtccccagacttgtgtccagggaagatagtgttgagggccctcaagg

SEQ ID NO: 6863002 - DNA, 72 bp, Homo sapiens
gcctgaacaggaaagaaatgagaacaccaattctcacagaggtggtactttcagattttttctgtggatggt

SEQ ID NO: 6863003 - DNA, 72 bp, Homo sapiens
tcacttttccttcacgttgtgttctctgtttccttttccttgtggaagtcacagggtacacaaggattgtga

SEQ ID NO: 6863004 - DNA, 56 bp, Homo sapiens
tcctaggccccacctcccatgattctgactcggggagtctgaggtggggcctagga

SEQ ID NO: 6863005 - DNA, 88 bp, Homo sapiens
tcagacattttccaaagaaagccaggcatgcttggacagtgggatctggccactgtcagcatccagcgcctggtgctctgaagtctga

SEQ ID NO: 6863006 - DNA, 61 bp, Homo sapiens
ttttgtctttgatgtacatcagttggacacttttgtctctgatgtatatcagagaacggaa

SEQ ID NO: 6863007 - DNA, 64 bp, Homo sapiens
agttctgtaggtcagaatggaagagtctgctcaaaaggctaagattgaagtattgaccagagct

SEQ ID NO: 6863008 - DNA, 63 bp, Homo sapiens
tatttcccagggagcaacaagccaggcaatagctggctgatgccacagcttccctggaaaatg

SEQ ID NO: 6863009 - DNA, 104 bp, Homo sapiens
catgaataccttgccttgttatagtatttcagttcctcttgtgaccagtgtcatagcatgggtttataagttaactggagttagggatgctatctttggtcatg

SEQ ID NO: 6863010 - DNA, 76 bp, Homo sapiens
gagattgtctcctagagcctccagagggagagtgaccctgctgtcaccttgatgatggcctagcaaaactgatttt

SEQ ID NO: 6863011 - DNA, 60 bp, Homo sapiens
tgattctgcttgcctggacagcgttaggcctgtttccaggcctgaggcaagtggtggtca

SEQ ID NO: 6863012 - DNA, 88 bp, Homo sapiens
gaaaacccagccctcagccaagctctgtgcttaattatttctgtcagtcacctgtcagcagaagtggtgcactcacctttggcttttc

SEQ ID NO: 6863013 - DNA, 103 bp, Homo sapiens
tattccttcaatttttaattcttttctgcttgagagaattgctgttggtgtctcaattggtgctcagcattttcttaatgtaggtgagttatttggaagaata

SEQ ID NO: 6863014 - DNA, 58 bp, Homo sapiens
ccatactcagttatgcttatcctgtgaaaggagccataggctgcatgcatgagtgtgg

SEQ ID NO: 6863015 - DNA, 114 bp, Homo sapiens
atgagtttctgttccgtgcagtgagttgcatcctaactgatagtgggtttcactgaaggtctcagcaaggatgtgagcgcagactgcataactttgggggaatgagaggctggt

SEQ ID NO: 6863016 - DNA, 117 bp, Homo sapiens
ttctggtgaaggaagtgctcagggaacatttacagtaatcgagtgttgtggcagcaatatcccatgtcacagtatagagttattttggcagtttcgtgagcctttcattcctctgaa

SEQ ID NO: 6863017 - DNA, 68 bp, Homo sapiens
gggagacagcaggtgcttgggaaaggccgagctctgggctttcctttcccaagccttgcttccctccc

SEQ ID NO: 6863018 - DNA, 55 bp, Homo sapiens
gctcaggtagatggggttgtccaccacccgctggccagcctgcatcatctgcagc

SEQ ID NO: 6863019 - DNA, 55 bp, Homo sapiens
ggctttcttgttaaatgtccattattcaagcctgtggacatcttcttgggaggct

SEQ ID NO: 6863020 - DNA, 56 bp, Homo sapiens
tgtcttcaatgcattctcttgtttaaggaattaaaggagaatgcatttgaaaagca

SEQ ID NO: 6863021 - DNA, 93 bp, Homo sapiens
tgttagtctacataccattatttgtgttcaagattagttctagtggttgctaattttacttttaatacttgaagcaatgtaatgtgatttaca

SEQ ID NO: 6863022 - DNA, 69 bp, Homo sapiens
attgttgatttcatagtatatacatgaaagatattcatttcatggagaaaattaagaagtcacagcaat

SEQ ID NO: 6863023 - DNA, 55 bp, Homo sapiens
ccaggacaagctcttgtttcatggtttttgtagagcccctaacagtttgtcatgg

SEQ ID NO: 6863024 - DNA, 90 bp, Homo sapiens
ggaacttctgttttcaaagctgctacttagtgtccatacagtcccaggctggagagcactggtagcagttaagttaggaaaagaggttct

SEQ ID NO: 6863025 - DNA, 56 bp, Homo sapiens
gctgcagacctctgaggtccatgctgattcttctctccaggcctctggtctgctgt

SEQ ID NO: 6863026 - DNA, 55 bp, Homo sapiens
gatgccagcaggtgcaaatgccctggggcagggcagtgcttggcacagctgggtc

SEQ ID NO: 6863027 - DNA, 56 bp, Homo sapiens
cccaggcagtctggctctaaagcctattccctttccactaagccaggctgcctcgg

SEQ ID NO: 6863028 - DNA, 69 bp, Homo sapiens
aagaagctggcagcaggagagtaatagcggtcatctggaatagattgtatcgcttttttctgtcttctt

SEQ ID NO: 6863029 - DNA, 81 bp, Homo sapiens
gactgtgcctctgggtgaccaaggagcagccaagatagcagagagatggtcgtagccttggaggatccatcaggggcagtc

SEQ ID NO: 6863030 - DNA, 129 bp, Homo sapiens
gcaaactgacctgtgctgcctacacactaactttcctgggcctggggcctgcacaggctgaatggtccttgagccttcactctgcatctgagcggtcttgggcccgctgagtggcagtggcaggaagtc

SEQ ID NO: 6863031 - DNA, 68 bp, Homo sapiens
gagtggctgtttataggtgggtatggggttcttatcattgggtgaaagtatctcctaggcagctgatc

SEQ ID NO: 6863032 - DNA, 88 bp, Homo sapiens
gaggcagtggagagatggtaaccctggggctgcattactaaggcagcttttatgcacataagggtcactgtttcttgctctctgcctt

SEQ ID NO: 6863033 - DNA, 58 bp, Homo sapiens
ggaacagcgtggggctctcctggcccctctccacaccacgcagatgcccctcctttcc

SEQ ID NO: 6863034 - DNA, 56 bp, Homo sapiens
tgtctgtaaccattttcaacagtataatccagctgtctttgaatgggctgtagaca

SEQ ID NO: 6863035 - DNA, 62 bp, Homo sapiens
gttactgaacttctctgagcctcagtgttctcctctgcattgacctgctctgaaattcaaac

SEQ ID NO: 6863036 - DNA, 73 bp, Homo sapiens
gctccaggctctgggccgggcaccagcctctgggaaaatggagggggtggtggtgagggctcggacaaggagc

SEQ ID NO: 6863037 - DNA, 60 bp, Homo sapiens
gagctggtccaattatgaactgttgtcttgacaactgggaaggactgattggatcatttt

SEQ ID NO: 6863038 - DNA, 70 bp, Homo sapiens
tgggaaaatcagagaccggtcaagtcatgcctccaagaagggcttgaccagggtgggctttgtggtccca

SEQ ID NO: 6863039 - DNA, 68 bp, Homo sapiens
tcccaagccccaccttcggctgactctaaggagaaccacagggtcaggcctcaaggtgggctcaggga

SEQ ID NO: 6863040 - DNA, 117 bp, Homo sapiens
gtgaggaactgggcatgcagtaaatgggtaagaacagtgacagccaacatttatttaacttctgtatgaagatgttggcttcagtgctttacctagaagatgccattgaaccctcac

SEQ ID NO: 6863041 - DNA, 63 bp, Homo sapiens
gtgccctgtgggtatctgatggctgctaattatctcagtggaccttacagtacctatagatac

SEQ ID NO: 6863042 - DNA, 55 bp, Homo sapiens
taggttgagttaggttttggtttgcttacaaaggcactggagccatctcagccta

SEQ ID NO: 6863043 - DNA, 63 bp, Homo sapiens
ccagttttgttttgttttcagccaaggatttggtttcctttgttaaaggcaaaacaagcacgg

SEQ ID NO: 6863044 - DNA, 73 bp, Homo sapiens
cagatgcttaaatgtcattggtctgttttaaagtaattctatttgatctctgtgaaacagatggaagtatttg

SEQ ID NO: 6863045 - DNA, 57 bp, Homo sapiens
cagccctggcagctttcagggtgactggccagaccagaagccaagttgtgggggttg

SEQ ID NO: 6863046 - DNA, 65 bp, Homo sapiens
aggcatggcactgagcagcttcttttaagaacataatttgtagccaggcgcagtggcttatgcct

SEQ ID NO: 6863047 - DNA, 86 bp, Homo sapiens
gggggtacctattacatgcctgagtctgtggtgtacctgagatagtacaattagcagcagccactattctggcattaggtggcctc

SEQ ID NO: 6863048 - DNA, 73 bp, Homo sapiens
atgtgcctacgaagtaataagccaggcttggtacaattgtgaaaggctgtcctctcttgctcagtgggcatat

SEQ ID NO: 6863049 - DNA, 85 bp, Homo sapiens
agaacaacactgaaggggaattatcacagtttctggtgactaaaatcactcagtttttgctgtctggttcatccctgaggtttct

SEQ ID NO: 6863050 - DNA, 82 bp, Homo sapiens
atgaagaaccactcttctaggcgatcttctatgttgttctcattataaaacacatgaagattcaactggatgtggttttcat

SEQ ID NO: 6863051 - DNA, 99 bp, Homo sapiens
gcagtaacactggacattagctgtgccataggcagcgtggccagcacatgaggacacttttcacatggttatctgccttggcgtgatcctccaaactgc

SEQ ID NO: 6863052 - DNA, 86 bp, Homo sapiens
gcaattcccacatgtcagagggccatctctatcttcagagaagacactttgaaataaggctcttctgaaatttgacatggaaatgt

SEQ ID NO: 6863053 - DNA, 64 bp, Homo sapiens
ggatctatttgttgtgtctagttcaatactatagagttgggttggtcagatgctgagtggatct

SEQ ID NO: 6863054 - DNA, 70 bp, Homo sapiens
tgtggacgtgaccttatttggaaatagggtttttgcagacgtaatcaacttaagatgaggtcatgctata

SEQ ID NO: 6863055 - DNA, 70 bp, Homo sapiens
cccttatctctgcaagatatgacttccatttgctattgaagtggagctaaggtatcttttaggaaaaggg

SEQ ID NO: 6863056 - DNA, 56 bp, Homo sapiens
agcagctgccagagagagttcctttcaaaaagttcctgactctgtcttgtgctgct

SEQ ID NO: 6863057 - DNA, 57 bp, Homo sapiens
actttgccccaggtctcatgactagcaaaccccagagctaagatctgaggctaaagt

SEQ ID NO: 6863058 - DNA, 57 bp, Homo sapiens
tcccagccttatctcccctggctcctcaacaggaacccagtcctagtgaagctggga

SEQ ID NO: 6863059 - DNA, 70 bp, Homo sapiens
tgagagaagggattctaatgaaatgagccccaagttcaatttgaatttcttattgggagaccttttctca

SEQ ID NO: 6863060 - DNA, 82 bp, Homo sapiens
acagcttaaaacaggactgtgtccagaacaaaggggtagattaagttatctctaaaattcccggccaactgtttaatgctgt

SEQ ID NO: 6863061 - DNA, 78 bp, Homo sapiens
gaaatacaaacagtaaataatgcatgttgattggttactatgtgccaggaatatgctaagtatttacatgattatttc

SEQ ID NO: 6863062 - DNA, 127 bp, Homo sapiens
atgtaaccttcacactgctggtttgttgattggcctattttggaagacttcttagccaaggtccagttgccagaatggccaagtcttcatatctgaattagcatttgtattctcccataggtcacat

SEQ ID NO: 6863063 - DNA, 88 bp, Homo sapiens
gaaggcctttggaagtaaaagattttataggaacaaggaatcaagaaggatgacagaatttgtttcttgagatcttcccctggccttc

SEQ ID NO: 6863064 - DNA, 113 bp, Homo sapiens
tctccttattttcagaatgatgatagtaatggtatttaattatagagttgctggcaaattaaatgagagtaacacatggttagtacacaatatagttattatttataagggga

SEQ ID NO: 6863065 - DNA, 76 bp, Homo sapiens
gcacgtgtaacccctgaactcgcatatgactccagcccacaggcacgctcaatgtgggttcgagttacacacatgc

SEQ ID NO: 6863066 - DNA, 62 bp, Homo sapiens
gcaacccagctctagttatgccagggagtctctcaactccactcaggtgcttaagttgctgc

SEQ ID NO: 6863067 - DNA, 58 bp, Homo sapiens
gaactgtttggttttcgagtaaatgctgcatattagaggacttgaaagcagagagttt

SEQ ID NO: 6863068 - DNA, 80 bp, Homo sapiens
agaggggtgggagctattactgtaacgaacaagtgttggtcttatcacctgctgctattctaatacgctcttgccttttt

SEQ ID NO: 6863069 - DNA, 60 bp, Homo sapiens
ttaccatgttttgttgatgctggacagtcttatccagagtatgcaggaaaatatgagtga

SEQ ID NO: 6863070 - DNA, 56 bp, Homo sapiens
ctgccacgtaccatttcttagggtccttttcatctccagactggcctatgtggtag

SEQ ID NO: 6863071 - DNA, 129 bp, Homo sapiens
agccatctgtcagcactgtagccacttggcgtggcatggggtcctgggctgctggggcctcccctcctaatacctgccttgtccccaggtcctctgccgtccacaggtcaggcagggctgctgaggcct

SEQ ID NO: 6863072 - DNA, 55 bp, Homo sapiens
aggcattttgttcaagatgacagcatgatgtcaaaatatgaatccagaaatgcct

SEQ ID NO: 6863073 - DNA, 68 bp, Homo sapiens
gcagaagctggcttgcatgctaaggagcttgtcctgagtttcctaacacagtgtaagcaagcatctgc

SEQ ID NO: 6863074 - DNA, 66 bp, Homo sapiens
ggaagacatggctgttgtgaggatcaaatggaaggatccatgagtgcttagaacagtcctgggtcc

SEQ ID NO: 6863075 - DNA, 56 bp, Homo sapiens
ggccaggctggccagcaccttctgaaattgctctcaggcagctggaaggcctggct

SEQ ID NO: 6863076 - DNA, 108 bp, Homo sapiens
ccatggaacttggtaatttggagggcagcagagggcaagggaaactcagcaatgagatcattcctacatttgcctcactccccgcttcccttcaagccttacctatgg

SEQ ID NO: 6863077 - DNA, 70 bp, Homo sapiens
ggacagcccaaggcatgggcactttctcatggttgcagcacagggtggtgtgtgcttagggctagggtcc

SEQ ID NO: 6863078 - DNA, 69 bp, Homo sapiens
gagtaaggccatgcttgagttgaaggctctgaaatcttcagacctcactgaggtcgtggtttatggctc

SEQ ID NO: 6863079 - DNA, 125 bp, Homo sapiens
ctcgcctctgtatttctatgtatgtgtgtgtacttatgtcatttaaatgtttgtatatgtgtacgtgtatacatttggtgcatatttactaacctaacctatttccatgcatagcacatagtgag

SEQ ID NO: 6863080 - DNA, 61 bp, Homo sapiens
ggcatcagtatggccatagggttgttggagctggcttccatgctaggccatattggttgct

SEQ ID NO: 6863081 - DNA, 82 bp, Homo sapiens
ttcctgcaggctttttggttgacttaaatgtgggctttggggcagggcagcaacacgagtgagctaaagaggccagcaggag

SEQ ID NO: 6863082 - DNA, 96 bp, Homo sapiens
tccaatattcataccacagaggaaatgactttcttaggtttgtcccaaattgagagagtttgcgttttctcttcttgccttttatgactgaatgga

SEQ ID NO: 6863083 - DNA, 62 bp, Homo sapiens
gaccctttacaagtacacctaacagctggactaagagtgtgtagcagcatttgggaggggtc

SEQ ID NO: 6863084 - DNA, 82 bp, Homo sapiens
ggagtgttgtctgagagccagtgtggtatctgaagaacgtgagttctaaagtcaggacaacctgttttcagacacccacttt

SEQ ID NO: 6863085 - DNA, 83 bp, Homo sapiens
tgcacccagcctgattttgataattatatcacttgtttttgaaaatacacaaggaaatatgtagatatcaagaggcatatgta

SEQ ID NO: 6863086 - DNA, 67 bp, Homo sapiens
cttgactggacacaggaatcaccttggatgcttgtcaacaatgcgtattcctgtattccagtcttag

SEQ ID NO: 6863087 - DNA, 56 bp, Homo sapiens
tcctggcttttcttggctcatcatgtaccaactgactgtaatcagattggccagga

SEQ ID NO: 6863088 - DNA, 104 bp, Homo sapiens
ccagtggcctcctttaaattgcatttgtatcatatgtatcttagagaattgtggatcttttggtaaataaagtataggaaatggaatctgaagggacacgctgg

SEQ ID NO: 6863089 - DNA, 59 bp, Homo sapiens
gccaaattccttgaaaggtggggagcaccagtgacctctataaatctttggaatttggc

SEQ ID NO: 6863090 - DNA, 56 bp, Homo sapiens
ctgcacagctgggcaagatatatctagaaaaggaaattagtttctcagatgtgcgg

SEQ ID NO: 6863091 - DNA, 124 bp, Homo sapiens
ttacaggatgaggatgcaaccagatgagtgtaaataacctgaggtctataatttattaagtgctcaacaaatagtagtaattgttatcttatttatgtatgcttattttctctcagatatgtaa

SEQ ID NO: 6863092 - DNA, 130 bp, Homo sapiens
ggtgacctggctgtcaattggtacaggtctgtccagttcctgtcctggatctgcccagttagttgggaaagactcaggacaggagccctagaccttcaaatcttaggtattgatctcttcccagggcagc

SEQ ID NO: 6863093 - DNA, 63 bp, Homo sapiens
gacatgaatgaagactttacaatgcaaggatgctcatgtgctattgtcaagttcatttatttc

SEQ ID NO: 6863094 - DNA, 55 bp, Homo sapiens
ctgggcataatggacaggtctgggcaagtcagccaagacgtgagtcattgtttag

SEQ ID NO: 6863095 - DNA, 57 bp, Homo sapiens
ctctgtagcctgtaagagagcagcaaagaggaatgagttgctcaggtatagacaggg

SEQ ID NO: 6863096 - DNA, 77 bp, Homo sapiens
acttacagcaattagagtggcgagtgatttacactcgtttctttaaggtgtaaattgccacttattgctcagtaagt

SEQ ID NO: 6863097 - DNA, 87 bp, Homo sapiens
agatgtgcaacaatgtgaaggtgcttaatgccactgaactgtatactaaaagtggttaaaatggtaaattttatgttatgtatattt

SEQ ID NO: 6863098 - DNA, 69 bp, Homo sapiens
ccttcagagtcacattttctactactgtacggttaaacatcgtctgtgggaggaaaggtgatgtatggg

SEQ ID NO: 6863099 - DNA, 129 bp, Homo sapiens
cctgtttgcaaaatgatatttcagtaggaagagggccagagtctgtgtagatactaagacttactgtttatggagtaatctttacaactttggtccaaactcttgtgaggtaggtttttacagatgagg

SEQ ID NO: 6863100 - DNA, 55 bp, Homo sapiens
ctccagaaagcagccagatgaacatgaagttatgttcattgaactatttgtggag

SEQ ID NO: 6863101 - DNA, 61 bp, Homo sapiens
tggtctggggtcagctgggcctttgcctgctgtttggtgcccagtgcaggcccgcaggtta

SEQ ID NO: 6863102 - DNA, 75 bp, Homo sapiens
aatgtgccaagagggaagtcacctggaggtgctgtgtgttatcagacctcgttttccttttgtcatgtgcacatt

SEQ ID NO: 6863103 - DNA, 62 bp, Homo sapiens
ggcagtaatcttcgaatggtagccatgattaacatttttgggtatcagtaggatattctgcc

SEQ ID NO: 6863104 - DNA, 71 bp, Homo sapiens
tgcagaaaaacatttaaagaaatattgtgcaatctccccagtttggcacaattttcctttaagtgtatgca

SEQ ID NO: 6863105 - DNA, 83 bp, Homo sapiens
gactctgagggtgttcctgactaggagggctaaggtttgtgatctaaccttagccctcctggtcagtgaggccaaagaaagtc

SEQ ID NO: 6863106 - DNA, 67 bp, Homo sapiens
tagccacctcttggctggtttgcagtgctgtggattttctggacagccatgcaaatgagcttggtta

SEQ ID NO: 6863107 - DNA, 60 bp, Homo sapiens
caggaatgtgagggttccctgcctgaaaagttagtaaggcagaggagatctcatgtcctg

SEQ ID NO: 6863108 - DNA, 78 bp, Homo sapiens
tgccttggtagtgattaatagtacaggttcttagatttagaccatttaggctctttatcagttaactcttgccaggta

SEQ ID NO: 6863109 - DNA, 72 bp, Homo sapiens
gcttgaacttcttagaagtgggctataattaggaaggttttgattctgggctcatttctttaagtttctagc

SEQ ID NO: 6863110 - DNA, 74 bp, Homo sapiens
gtatcagttgaagacaagtgataagagaagactaatgtttctactcatgtacaaaggtactttgatgttgatac

SEQ ID NO: 6863111 - DNA, 85 bp, Homo sapiens
gaattattttgagttaaaggcagttgaggaaaagccgatgagatttctaccctttcccaatctgcctaaaaatggaacataattt

SEQ ID NO: 6863112 - DNA, 87 bp, Homo sapiens
gttgtatgattaaacaagttattatttactgagtgcttagaatagttcctggcacatagttagtgctatatgtgtttagtaaataac

SEQ ID NO: 6863113 - DNA, 58 bp, Homo sapiens
cctctgggcaggtagcagcagctttaatcatttaggccagatgcttccatcccggagg

SEQ ID NO: 6863114 - DNA, 66 bp, Homo sapiens
tcaaattgaaattctttgtggtccatcactgttaacactgctggcctggaaggaatttcagtgaga

SEQ ID NO: 6863115 - DNA, 62 bp, Homo sapiens
gactgcatataggcttcttgcattgagaggactcttctatacacagggatctagatggagtc

SEQ ID NO: 6863116 - DNA, 67 bp, Homo sapiens
ggcctgtgtttttaactctaggagtcatgatctgaatgtgaaattccaagggctacaaacacagacc

SEQ ID NO: 6863117 - DNA, 74 bp, Homo sapiens
gtagatttttacccaggggctgagcagaggttctgcttctggttgtacttctgtttctgcttctggttgtgtac

SEQ ID NO: 6863118 - DNA, 80 bp, Homo sapiens
tagtaagttctcaaaaaatgttatctggtgctgttctatgatgtatcaagattatggcagataacaatttgaccttgcta

SEQ ID NO: 6863119 - DNA, 65 bp, Homo sapiens
gatttgagctacaatacctcctgtttattgattcacagatagacaaggtgataatagcttctgtc

SEQ ID NO: 6863120 - DNA, 58 bp, Homo sapiens
tcactgcagcctcgacttccctggcttccgtcagcctcgacttccctggcttgcgtga

SEQ ID NO: 6863121 - DNA, 108 bp, Homo sapiens
tatgtcattaatacttatgctcttttacgtaccaaattataatactggggctttgaatacatattttctgagacaacatctagtttggtggatggaggggatggcata

SEQ ID NO: 6863122 - DNA, 86 bp, Homo sapiens
atatacagagaggtccagttttatgaatgcttattagatggaattttataagtctaatgcagtatcagaatagcaaatatgtgtat

SEQ ID NO: 6863123 - DNA, 90 bp, Homo sapiens
tgacttgcagcagcctatggtactctcttgtctgcaaattttctgccctgattaattacaaagagtgccagagtgtgttgacgttagtta

SEQ ID NO: 6863124 - DNA, 80 bp, Homo sapiens
gcaattttagaggtcacagaacagagggttttagaattagaaatgattttagattccatgttctttcattctttaattgc

SEQ ID NO: 6863125 - DNA, 99 bp, Homo sapiens
gtacagcctcagagtctcaggtttcccaggtgccctatagattctcccagagtcccaagggcagtgggaaagcctgctcctctctcccaggggccttgc

SEQ ID NO: 6863126 - DNA, 65 bp, Homo sapiens
tcaggaccaagcaaagtttctttgctaggcaaaactccaactggaaggaaaagcttggtctctga

SEQ ID NO: 6863127 - DNA, 56 bp, Homo sapiens
tccagggccacagaggatgctaaagttataagatagaaggactctgtgtccctgga

SEQ ID NO: 6863128 - DNA, 72 bp, Homo sapiens
ttcagtccatcaggcgtggcatagttcaaattaccaagtcagcatgaaaagtcccactctaaatggactgaa

SEQ ID NO: 6863129 - DNA, 99 bp, Homo sapiens
ctccccgctccaactctagcccaacccccgtcgacgcccccttctacgctacgtggctagggatctagaccaggactgggagcctgaggggtggggcag

SEQ ID NO: 6863130 - DNA, 68 bp, Homo sapiens
tctaaacactaagtcttgatgctcatttttgtgttcacattggaaaaatatctggatttaggttttga

SEQ ID NO: 6863131 - DNA, 114 bp, Homo sapiens
aaggaaatgtgcttggtgcctccatttctgttatacctttctcaggagctgataattggaaatgttttaagagaggttataattagggcttgggggcttcatgtatagtttttt

SEQ ID NO: 6863132 - DNA, 65 bp, Homo sapiens
cttgttggtttatgttctttagaattagcacagcttatgttttattctgataaataagcagcaag

SEQ ID NO: 6863133 - DNA, 57 bp, Homo sapiens
gtaacccggccagtgtctagactcttcattcaggaatcacacgtttggccaggatgc

SEQ ID NO: 6863134 - DNA, 86 bp, Homo sapiens
gagtctcactctgttgcctaggctggagtgcagtgacatgaactctgctcactgcgacctccgcctcccaggttcaagtgattctc

SEQ ID NO: 6863135 - DNA, 74 bp, Homo sapiens
ctgccaggtgtgagcagaaaccatgagtacttgggaaagagaggcaggtaccaggtagctgctgatactgggag

SEQ ID NO: 6863136 - DNA, 65 bp, Homo sapiens
ccaaacagactgtcggaaacactgtgggttaatttactgccatgtggcctgcagctctggtttgg

SEQ ID NO: 6863137 - DNA, 63 bp, Homo sapiens
tgatgaaattttaattatacctctaattcaaggatagagggagaggagaattggatttcgtta

SEQ ID NO: 6863138 - DNA, 113 bp, Homo sapiens
tgcagagctattgtttttctaatctcattgtggagctaagagagagattgtgtttaaggtttccttcgtaataggttttcttgctccaggaaggatgcgtgacagactctgca

SEQ ID NO: 6863139 - DNA, 55 bp, Homo sapiens
tgggatgaaaggttgtagattatccctgtggtaactgcactgatttatcatccca

SEQ ID NO: 6863140 - DNA, 104 bp, Homo sapiens
attgaagtttgttattttcttcattaaaaagccttgccttctatatttcagcttcttctgggcaatttgttttaatgagggtgactgtcatagagagtttcagt

SEQ ID NO: 6863141 - DNA, 57 bp, Homo sapiens
gtgtgtgcatgcgtgtatgcacatgtgtatgttatgtgcatatataagtgcatacac

SEQ ID NO: 6863142 - DNA, 111 bp, Homo sapiens
gcaacacttgccaccaggaaggcgttgagtgccaattccacacccaatacccccaggtagaggaagtcttgggccttggggtttgcagtctagtttcctggtagtgtctgt

SEQ ID NO: 6863143 - DNA, 55 bp, Homo sapiens
ttatctgtcatcaggcagacagatcttctgaacctaatgtctaagtgatagatag

SEQ ID NO: 6863144 - DNA, 72 bp, Homo sapiens
gccccagatatatgcaaacaagcccaaagtcactggaagaagtagactatttcttttgcataggtttggggc

SEQ ID NO: 6863145 - DNA, 79 bp, Homo sapiens
ttggctttacctccattctttcagtgtctcatgttttcttaattctgaacatgagaaagagaatggacttgagagtgaa

SEQ ID NO: 6863146 - DNA, 69 bp, Homo sapiens
gaatatatgatctaagtttcagagggcataaattattttattttgtgtttgacttaggtacattaattc

SEQ ID NO: 6863147 - DNA, 76 bp, Homo sapiens
cagggatgcgaggcacaatcagcaccccacacatgaatccaagactgaatgagggctgctgctgtgagcgtccctg

SEQ ID NO: 6863148 - DNA, 66 bp, Homo sapiens
agcctctgactgtcagcaaggtaagcattctgcatatacttccacttgccttgcttaacagaggct

SEQ ID NO: 6863149 - DNA, 61 bp, Homo sapiens
gttccctggaacatcatggtctatcagccactaatttagatcctgtaaaagtccagggcac

SEQ ID NO: 6863150 - DNA, 59 bp, Homo sapiens
ttctacattgtgaagttctttatcctacctgtgtatccctagggctttacagagtggag

SEQ ID NO: 6863151 - DNA, 130 bp, Homo sapiens
gcagaacattatgaattggaagttgtaacactaatgtagtcatagatgttggagtgaaaattgtaacaatgccacattaagtgtatgcattttctttattacacatctaaattcagaaatattaaaatgt

SEQ ID NO: 6863152 - DNA, 61 bp, Homo sapiens
gttactggcatctaatgggtagaagtcaggcatgctgctaatatcctgcaatgcacagaac

SEQ ID NO: 6863153 - DNA, 73 bp, Homo sapiens
tcagatattacgaatgttagattgcatctcagtgttaaatcttcactgatagatgtacgtatgtaaatcatga

SEQ ID NO: 6863154 - DNA, 57 bp, Homo sapiens
tattgcttttgattcaaggcagatttctgttatctctctttggagaaagatgcaata

SEQ ID NO: 6863155 - DNA, 55 bp, Homo sapiens
actagctttcctgccatgtcctgcggccaagcgttgggggagctgggaagctggt

SEQ ID NO: 6863156 - DNA, 92 bp, Homo sapiens
agttttttcttcatatttcaattgttcaaaaatatcttctgcaaagctgatgtctgttttgtaaagggcatttgcacagtgaggaaggagct

SEQ ID NO: 6863157 - DNA, 66 bp, Homo sapiens
gttatttgggagttttaaaagaaacattccaacagaggagttgttctaaagagattttaaaataat

SEQ ID NO: 6863158 - DNA, 102 bp, Homo sapiens
ggcagtttacctaaaattatgcgtgaaaccattctcaggtacactatgaatatcaaaggtgtatttctagatatggtattcctgcatttgtgtaatacaccc

SEQ ID NO: 6863159 - DNA, 58 bp, Homo sapiens
tcttctgagacatcatacttttagggataaattcctaaaagtggaattgctcaattga

SEQ ID NO: 6863160 - DNA, 61 bp, Homo sapiens
gctatctaccaactcccattattataggtgtgaagccagtggtgggagccttggggatggt

SEQ ID NO: 6863161 - DNA, 58 bp, Homo sapiens
aaccaggacaatttgaatagaaaccattattatggacattcttgatttgatcctggtt

SEQ ID NO: 6863162 - DNA, 79 bp, Homo sapiens
ccagggctcaccctctgtggtggatgttaagctgctctgcattaaccatgtgcacctcatccaccagaccttgccctgg

SEQ ID NO: 6863163 - DNA, 56 bp, Homo sapiens
cttgcatgcaaaaaaatctgcattgcaaaaaaacctgcattgcttgcagctgcaag

SEQ ID NO: 6863164 - DNA, 76 bp, Homo sapiens
tgggttggtgcaaaactagttgcggtttctggcatttaaagaatgggaaaaccgcaattacttttgcgtcaaccta

SEQ ID NO: 6863165 - DNA, 58 bp, Homo sapiens
atatcctatacactaaccccaggagtttaggtcttattcccagggtcttatgggatgt

SEQ ID NO: 6863166 - DNA, 99 bp, Homo sapiens
tcatggctttgagagagtagcctctttggatggaaaatgtattcctggtgtctaggccattttcattaatatttaaaaagtacttcctccccaccatga

SEQ ID NO: 6863167 - DNA, 57 bp, Homo sapiens
aacattgcagatggcacagaagcctgggagctcctttttcctagcctttctgctgtt

SEQ ID NO: 6863168 - DNA, 88 bp, Homo sapiens
cacaacttggtcatcagtctgtatttcaaattgttagtcatatacatttgttattttttaatgcagtctgagacatagtgaaaatgtg

SEQ ID NO: 6863169 - DNA, 62 bp, Homo sapiens
ttgaaccaaaggatccttccgttgtcatctatcaaagtggacaatttcaccttttggttcaa

SEQ ID NO: 6863170 - DNA, 57 bp, Homo sapiens
gcccttgagtgagtgagtaatgagaatcaccatagcctctaactcttcatttagggt

SEQ ID NO: 6863171 - DNA, 61 bp, Homo sapiens
gtggctgagcctgatagctgtctcctgtatcatgcagctgagaaaggcaggctcaccccgc

SEQ ID NO: 6863172 - DNA, 69 bp, Homo sapiens
agcagtgctgccatagtcatgggtatccacagggttaaaggtctcaagactgatcgcagtggaactgct

SEQ ID NO: 6863173 - DNA, 98 bp, Homo sapiens
tacacttcaaaatgttggtaaaatgtatatattttggtgtgacattgtgacagttaaggtatacattcagccttttctcaggcatattgaaaatggta

SEQ ID NO: 6863174 - DNA, 71 bp, Homo sapiens
gtagagacggggttttactatgttgcccaggcaggtcttgatctgggctcaagtgatgctcctgtctcagc

SEQ ID NO: 6863175 - DNA, 70 bp, Homo sapiens
ttgacatgatgcatcctgtcaaaggaccacttacaaagttggaaggttcatttatgatgtaacatgtcaa

SEQ ID NO: 6863176 - DNA, 95 bp, Homo sapiens
gggagtgagagaggaagactcaaagcactggggaaagcctgctatgaaaatgccaggcctttcttggggcttagaccgtcaacctaatcctagcc

SEQ ID NO: 6863177 - DNA, 79 bp, Homo sapiens
ctcagatgtgttggatggaaaaatattctactgggctacaatatttccaaaagtccttccaggtctaatatcctttgag

SEQ ID NO: 6863178 - DNA, 83 bp, Homo sapiens
aggacagtgcctaacatatgtaaaggtctttgagttcttcaggaataaatggcactttataaatgttaaactacaagtttcct

SEQ ID NO: 6863179 - DNA, 61 bp, Homo sapiens
gctttagctcaagtacacatgtgcttttccttgaggcaaccattgtacttcagtgtgaagc

SEQ ID NO: 6863180 - DNA, 70 bp, Homo sapiens
ggtcaattttcctcaagcctctggaaggcatttctatttgtaccgcttctttggcatgaggagaatggct

SEQ ID NO: 6863181 - DNA, 57 bp, Homo sapiens
gtcaagtttatccgctcattcatcattcacacctcagatgaagcgggtttccttgat

SEQ ID NO: 6863182 - DNA, 98 bp, Homo sapiens
gctgatcttttccaaaaaggtttacagaaaatgtgttttaacttattgccatgaacaaatggaggcaacctacatttttttgaatttttgagattagt

SEQ ID NO: 6863183 - DNA, 63 bp, Homo sapiens
ctactgcatgcattgaattctagggtgcaatgataacttctaggaccaacatagcagcagtgg

SEQ ID NO: 6863184 - DNA, 107 bp, Homo sapiens
gttgagggtagagggcttaacagctgttatataacttacaacctgttgacatgtagaagacaacagatttattttgtatagctttgggggctcttactataatcgat

SEQ ID NO: 6863185 - DNA, 56 bp, Homo sapiens
gtcgtaggggaaaagcttaggcttgataaaggagacctgggccaaattccctggac

SEQ ID NO: 6863186 - DNA, 99 bp, Homo sapiens
tctagataccttactactttcattcatctgacttgccaagactttgcaatgccaatgtttagatgtatgatatcatgagaagtagtataggtgtttgga

SEQ ID NO: 6863187 - DNA, 72 bp, Homo sapiens
tgagcaggcaatggatataaaagagataagaacagatgaaccaatctcagtgttatctatctgccttctaca

SEQ ID NO: 6863188 - DNA, 81 bp, Homo sapiens
ccaaagaaacacacggcctgtgacttctggtcatatcgaatcactgatattccctgatgtacactggcatatttctcttgg

SEQ ID NO: 6863189 - DNA, 56 bp, Homo sapiens
ctgaagtggacaaatggagtgggtgcatagaagttgtaactctgagtccacttaag

SEQ ID NO: 6863190 - DNA, 55 bp, Homo sapiens
tgtgtccttccagtttttcctgctaatacaggttggtgcttttaggaaggacaca

SEQ ID NO: 6863191 - DNA, 85 bp, Homo sapiens
aggaacacagcccccaaagaacagaccaaaaaaggatattggtgcatcttgcacatatccaggtttctttggttttgttttacct

SEQ ID NO: 6863192 - DNA, 65 bp, Homo sapiens
ccacagcaggactggagccgcctgagtgtccctccgacccatctccctggcaggtccagctgtgg

SEQ ID NO: 6863193 - DNA, 120 bp, Homo sapiens
agccctgccgtgagcgaggcggcgcaggaggtgcattccagatgttactgaaaggctgtgaggtagctgactcagatgcagctggatttgagtcctggcagcaccacttactggctggct

SEQ ID NO: 6863194 - DNA, 88 bp, Homo sapiens
aaaatttagttttattgaccagtgcagccactgtgcccacgaggggactggtgcacacagcctgctgcactcaagaaacgatgatttt

SEQ ID NO: 6863195 - DNA, 105 bp, Homo sapiens
aagcagaatgaaaatgtcacccttattttccctttgggttagagaatgtccctttatcttctccactggaactcaggagaatggagggtatcatcaaatttgctt

SEQ ID NO: 6863196 - DNA, 79 bp, Homo sapiens
taccagctagctaggtcctgagcatccattcaatcgctagtgatgaagagtggctgtatcagtcaacccttgctgtgta

SEQ ID NO: 6863197 - DNA, 73 bp, Homo sapiens
aaagtactttgaggagtctaatatggattttaacttagtcaccacggtgatcctgttagcaccttcaaacttt

SEQ ID NO: 6863198 - DNA, 76 bp, Homo sapiens
tttcatttatgagctgaaccatgaaacttgcccttatctactattggtttcccagtggtacagtttatataggaaa

SEQ ID NO: 6863199 - DNA, 84 bp, Homo sapiens
atatgtgtgatttcctgtgcgcccttaggcagggcagggaaggggagcatggcccaggcgtatgggagatcatggactgcatat

SEQ ID NO: 6863200 - DNA, 82 bp, Homo sapiens
ataattgagacaacaccaaatgctagtgtggatgaggagaaactggattacacatacaatgcttttcgggttgtaaaattgt

SEQ ID NO: 6863201 - DNA, 73 bp, Homo sapiens
agcaggttagctttgtttatcaaggggcaatcctcctgagctttgtctccagaaagaaaaagcaatgcctact

SEQ ID NO: 6863202 - DNA, 85 bp, Homo sapiens
tatgatgttgaactgatctgcagaaagctgagatgattaatcggcttaattcacaaagttttctgtttatctgtccaatttcata

SEQ ID NO: 6863203 - DNA, 71 bp, Homo sapiens
gagaaaattgtggtgaagcattgagaagtcactagaagctctgaacgtgactccattcttcacactttctc

SEQ ID NO: 6863204 - DNA, 61 bp, Homo sapiens
ggtctggtggcgacaggctaacgtagagctggctgcttttatgagaatgcgccacttgacc

SEQ ID NO: 6863205 - DNA, 58 bp, Homo sapiens
agggctcagaacaatgagtgtaggttggcatcaaccaccttcatattctctgatacct

SEQ ID NO: 6863206 - DNA, 76 bp, Homo sapiens
gagccaccgaatcagaaacttgggggaagggggcccagcaatttgttttagccgccctccaggtgattccgtgctc

SEQ ID NO: 6863207 - DNA, 67 bp, Homo sapiens
acacccaacactgttatactgttatttgtttaaatttaaaacgtggcatgtggcaatgttgggatgt

SEQ ID NO: 6863208 - DNA, 75 bp, Homo sapiens
tggccatgccaggattaggacccagctggaccaacttgcaccacagtccagctctacccgaccctggtgctgccg

SEQ ID NO: 6863209 - DNA, 85 bp, Homo sapiens
gggaaagggactaatatttgtaaggcagaggtaccactaggccagggcactgtgctgggcacctctcccagattgttccattccc

SEQ ID NO: 6863210 - DNA, 69 bp, Homo sapiens
ggaaaggtttaagtaggatttgtagctggagaaactctttctaaacaagcctaatacttttgcttctcc

SEQ ID NO: 6863211 - DNA, 77 bp, Homo sapiens
agggggccccagtgggctcagggaagcttggcctggtgtccccaccagccttgtgctgaggccactggggagcctct

SEQ ID NO: 6863212 - DNA, 81 bp, Homo sapiens
ccaggtcctttgtccacatatgttgtttctgatttttttcatgagataagaaagggtcatatgtggaattgaaagtcctgg

SEQ ID NO: 6863213 - DNA, 64 bp, Homo sapiens
ttggtcaggcatgtggcgcatgctattcctgagcaggtcgggcagctggtgcttgcctggctaa

SEQ ID NO: 6863214 - DNA, 80 bp, Homo sapiens
ccaggatgcccgagggtggggagaagcagctcagatggcgtcactgtgttgccttcccccagccgatgggatttttgtgg

SEQ ID NO: 6863215 - DNA, 78 bp, Homo sapiens
gttttctgggtaccagttctactcacctcgccccatggcttaggaccagaggagcaagttgtgtgtggaatggaaagc

SEQ ID NO: 6863216 - DNA, 92 bp, Homo sapiens
aggctggagggaaggattagatatgatgcatgtaaacattcataatatgcctggatgtagtagatgctcaataaatattttcctttttgttt

SEQ ID NO: 6863217 - DNA, 77 bp, Homo sapiens
gtagttgttcgtagcacgtagtttcttatcagtgagtaggactgagagttcaagtggctgctgcaaatgagcactat

SEQ ID NO: 6863218 - DNA, 58 bp, Homo sapiens
gcctgagaggctgaggttgcagtgagctgaaatcacgatactgcacttcagcctgggc

SEQ ID NO: 6863219 - DNA, 82 bp, Homo sapiens
gactcactgctccggtctcatctttcagcgtcgagatgcgtccgctcagaagactgcagggaagggacaccgagcaggcgtc

SEQ ID NO: 6863220 - DNA, 81 bp, Homo sapiens
aagtgaactgtctgaggcctgaagcagcagagtggcttgaccagagcagcctgcagagggagggccttatttagttcactt

SEQ ID NO: 6863221 - DNA, 73 bp, Homo sapiens
atggaggagtaaaactggaatgaaatttacgatgcttaaaggccattgttagtacatttgagaactctaacgt

SEQ ID NO: 6863222 - DNA, 71 bp, Homo sapiens
cagtgtagcaagaggaatttctggaaggaggccaaatttggcttcggatcatttctcttcaacacacactg

SEQ ID NO: 6863223 - DNA, 57 bp, Homo sapiens
gttaggtagaggcacatttcagatttagactaaggtgcaaatggctttctacttaat

SEQ ID NO: 6863224 - DNA, 59 bp, Homo sapiens
caggctgtgagttttgtctcagacttaattttatctctgacagatttaactcataaatg

SEQ ID NO: 6863225 - DNA, 79 bp, Homo sapiens
cctgcagtgtaagtgcttatgtgcagtggatagtcattataaaatctgagggttgtgcaagcactgtggcactcgcagg

SEQ ID NO: 6863226 - DNA, 60 bp, Homo sapiens
ggaaagggtttttaatttgctctctaaaccatgtgatgtaggcagcaattcaccctatcc

SEQ ID NO: 6863227 - DNA, 64 bp, Homo sapiens
atattgcctaggtgaatagaataactttctccatcccactcctattattttgcctaggttatgt

SEQ ID NO: 6863228 - DNA, 62 bp, Homo sapiens
agccatattttttctctgcatgtggccttttttgatgtcttatgtttctagaaaataaggct

SEQ ID NO: 6863229 - DNA, 60 bp, Homo sapiens
ctcctactgcattacaattctgctctatgtttgctagcacatgcatgttgtgtagggggg

SEQ ID NO: 6863230 - DNA, 76 bp, Homo sapiens
ggaggctgaggtaggaggatcgcttgagcccgggagtaggaggctccagtgaactatgttcgtgccacagcactcc

SEQ ID NO: 6863231 - DNA, 85 bp, Homo sapiens
cctggggatctgaatcaagtgcttcaactagtgtggtcccatagaccaggacttcaaaagctgacattcattccaatcacctagg

SEQ ID NO: 6863232 - DNA, 58 bp, Homo sapiens
gcaggctgccaaggctggggaggacaaggttccctcttgagttctttaaaagctgggc

SEQ ID NO: 6863233 - DNA, 68 bp, Homo sapiens
ggtcatggcctttttatctcaccaagtgtggtgcctgctccttcacatgcttggagaaggctatgacc

SEQ ID NO: 6863234 - DNA, 74 bp, Homo sapiens
acaggtctgaggctatccacgcacatgggcttgacctacattaggtcaagaattgatgtggtttttaaacctgt

SEQ ID NO: 6863235 - DNA, 56 bp, Homo sapiens
gggccgggcactgagttatctgctgcaaacagttctatggctctgattctgagccc

SEQ ID NO: 6863236 - DNA, 68 bp, Homo sapiens
tgcacagcacaggaggccgatgctcatggcagatgctgcatgacggaggggtcttctgtatctgtgca

SEQ ID NO: 6863237 - DNA, 81 bp, Homo sapiens
atctaattatgtaatcagttttagtttgggaattatttttgagtaatgatgtaattctaagactgaagaaagttaagggat

SEQ ID NO: 6863238 - DNA, 66 bp, Homo sapiens
atcatgcagggccttttagattatggtgagattttgtttaagagtaatggaaggccactgaaaggt

SEQ ID NO: 6863239 - DNA, 66 bp, Homo sapiens
tcctgtgccactcggcaaatatttgaagaaaaagaatgcttgctgggccaatggcaatttcaagga

SEQ ID NO: 6863240 - DNA, 58 bp, Homo sapiens
gtagagcagagactaagacagagactgtgcattcccctctgtctctccactgccctgc

SEQ ID NO: 6863241 - DNA, 80 bp, Homo sapiens
agtgcctgttctctgctccaggaacagagctgctgctctacaagcagccttgtgactccggggtctctgggagcaggact

SEQ ID NO: 6863242 - DNA, 55 bp, Homo sapiens
cctgtgtcctaatccatcaggccctacccccaggacctcatggcgggggcatggg

SEQ ID NO: 6863243 - DNA, 56 bp, Homo sapiens
gttagaaggagccaaatcagaaccttcaggtgagggcctaatgatttcctactaac

SEQ ID NO: 6863244 - DNA, 56 bp, Homo sapiens
gcatgggagccaactctgagggtggtgagattgccaagcctcacagacttccatgt

SEQ ID NO: 6863245 - DNA, 96 bp, Homo sapiens
aacagtaatgtaccagcctggctcagttaggtcagaaacagatcaaaaagcagaaaagtcggctgtttcctaactgagctgctttgcttagctgtt

SEQ ID NO: 6863246 - DNA, 67 bp, Homo sapiens
aacttgtacttactggacctagaagaatatagttttctattatggcagcattcagtatgttcaggtt

SEQ ID NO: 6863247 - DNA, 67 bp, Homo sapiens
gccggctgccttgggggttgtcattacatgctaggcatgagatgatgcaggccccaaggtagggagc

SEQ ID NO: 6863248 - DNA, 74 bp, Homo sapiens
tatagttaacataggcttaggggtttggaaaatcttgaggaagaccagagcagaagcctaggctgtgaactatg

SEQ ID NO: 6863249 - DNA, 71 bp, Homo sapiens
gttctcagcgtgggaggcagagagatcctgttatgatataaggtggatcatgttgcctcactgtttagaac

SEQ ID NO: 6863250 - DNA, 101 bp, Homo sapiens
tgaggcaggagaatcgctcgaacctgtgaggtggaggttgcagtgagctgagatcgtgtcactgcactccagcctgggcaacagagtgagaccctgtctca

SEQ ID NO: 6863251 - DNA, 64 bp, Homo sapiens
gtttctccatagtattattaaactagggggctcatcagtttacaacagtagctatggatgagac

SEQ ID NO: 6863252 - DNA, 77 bp, Homo sapiens
tctgttccctcaggcagagctgtggagctcttcatcattaaggccttctttgcagcctgcctctcagcctgggcaga

SEQ ID NO: 6863253 - DNA, 78 bp, Homo sapiens
gctggcattctaccttggtaggtccatatgttaaattaagttcaacctcataattgtccctgcagttaggatatcagt

SEQ ID NO: 6863254 - DNA, 62 bp, Homo sapiens
tttgcaggcctctagggaggagcgtggggggttggacttcatcctctactgagccatgcaga

SEQ ID NO: 6863255 - DNA, 58 bp, Homo sapiens
gcaggatgggagcttcactttgtctcagttgttctggcaaagagaagcctcaccttgt

SEQ ID NO: 6863256 - DNA, 62 bp, Homo sapiens
gcacctggtacacacctccaatgggtacaacactgacccaggataatctgtgtatctgatgc

SEQ ID NO: 6863257 - DNA, 76 bp, Homo sapiens
gccaatgaagggtttggagcagcacagtggtcaggcagaccaagctgactcccagctgtttccccttcacagtggc

SEQ ID NO: 6863258 - DNA, 76 bp, Homo sapiens
tctgcattccttgagttccctgtgccctgcccctcgtgagtgtccagtccctgccaggcaaattaaggaatgcaga

SEQ ID NO: 6863259 - DNA, 99 bp, Homo sapiens
acattatacatataatgagtcagaaatgatcgttattcatttacaggctctccagttagagtgaaatactgtcgtttttaggtcattgtataatgatgt

SEQ ID NO: 6863260 - DNA, 90 bp, Homo sapiens
ctgagagcgcccaattctgcaccccagactgagtcatgacctcctgccaggctgactctgactggagtgagagaggggcagtgccctggg

SEQ ID NO: 6863261 - DNA, 57 bp, Homo sapiens
cacttgatggaagagcagaagagaactaacccactccctcaagctcttctataagtg

SEQ ID NO: 6863262 - DNA, 56 bp, Homo sapiens
gtgcagccaccatacagcagaagctagtagccaagcatttgaaatgtggctgatgc

SEQ ID NO: 6863263 - DNA, 70 bp, Homo sapiens
accaaatgctgacggctgcctgcttcaaaccctgccacatcagcagggagggagcacagcggcatttggt

SEQ ID NO: 6863264 - DNA, 70 bp, Homo sapiens
tcttcttacaaggcttgtgaattttttgttggaaatggtgacatgccatcacaaagctttgataagcaga

SEQ ID NO: 6863265 - DNA, 57 bp, Homo sapiens
tacagctgcaagggtttctgggagaaaatatttttgactgagcacattgctgctgtg

SEQ ID NO: 6863266 - DNA, 80 bp, Homo sapiens
ctgtccttgcaaagtatttttgtctagcgtctctagttggatacaacagtgatatcaagacagacagttactgaggatgg

SEQ ID NO: 6863267 - DNA, 62 bp, Homo sapiens
gtttaaggtggaagatgtgctttttgtatataaaaaagcacatctcaaacttcatctcaaac

SEQ ID NO: 6863268 - DNA, 69 bp, Homo sapiens
gggtggaggcagagagcagagaggtagaggctgctgcttttcagaccttaaattcttctgtcctcactc

SEQ ID NO: 6863269 - DNA, 74 bp, Homo sapiens
gccagctgtgggtgtaggagtgaggagaggcacagggcatgcagtgcctcctggccctgggcctggaagctggc

SEQ ID NO: 6863270 - DNA, 84 bp, Homo sapiens
gtcaagtactgtggtaacacttcattgctaagaacaaggtatttccttcacctttcagagttaatgagtctatcagtgctagat

SEQ ID NO: 6863271 - DNA, 79 bp, Homo sapiens
ttcagaaagctggtagtgctgcactgcaaatcagtaaggaccaatccatctgggcttgcactgcagcgagaccactgag

SEQ ID NO: 6863272 - DNA, 79 bp, Homo sapiens
ggaagacctgatgaccttgctactgttctttgctagagttggtttgattttggcaaccttggccaggtactcagaatcc

SEQ ID NO: 6863273 - DNA, 75 bp, Homo sapiens
ggccagggtgagcatgtggtccagggtcaggggctgtcaaaagaaaacgaccctgtgtcacagtggcctgtggcc

SEQ ID NO: 6863274 - DNA, 69 bp, Homo sapiens
tagtgtgctgacttttatatgcatagcatatgtagtatatttatatgatacatttagaagtacatatta

SEQ ID NO: 6863275 - DNA, 130 bp, Homo sapiens
gtgcaagggtagactgggccactgggcagtttccagagtccctcttcacatcccaaatggcaaaggcccatttgtctctaggaagtgagggtttggggacatgtcccacccaacccagaaccacaaatcc

SEQ ID NO: 6863276 - DNA, 83 bp, Homo sapiens
ttaacagattgtaatatggtttttctagagcatacattggtaatatagcttttgctctagaaaaccaatattacatgagttaa

SEQ ID NO: 6863277 - DNA, 61 bp, Homo sapiens
gtttggacagaaatacatcttcacttgagtaaaaggttcaagagtttaattttgtctagac

SEQ ID NO: 6863278 - DNA, 59 bp, Homo sapiens
ctgctaccctagagctcactctctcggcttgcgtggcccagcgagctttgggctggcag

SEQ ID NO: 6863279 - DNA, 96 bp, Homo sapiens
gaatttttggagtttccaggctttggtatggttttggtgtttacttacttactatttttttaagccatgctgttttgcctgggatttccttaattc

SEQ ID NO: 6863280 - DNA, 116 bp, Homo sapiens
ctgaaatttgggggcttcgatcttggcactgactggctctgtgatctatgatttggtacaaatcactaaaaagatcctggagccagactcccaggatgtggatccggtcatttcag

SEQ ID NO: 6863281 - DNA, 70 bp, Homo sapiens
tgtaattaatgtaaggatctcctggattatctgggtaggacccaaatccagtgggtcctcatgagagaca

SEQ ID NO: 6863282 - DNA, 70 bp, Homo sapiens
gctcaagagagatgcagttcttaagatgggaagatattccaaatgccaagactagtatctctttaagagt

SEQ ID NO: 6863283 - DNA, 122 bp, Homo sapiens
ggaggcctcgggtggccgcctgcgcgcccgggatgtactgcgccttcaccaagcggccctcagccgggctgtcggggggtgagggggcggcgggcggcgcagcgggctcgggtgccgcctcc

SEQ ID NO: 6863284 - DNA, 56 bp, Homo sapiens
cagtgagagtatttgtgctaagagctgtggatttgggagcagtaagactctcactg

SEQ ID NO: 6863285 - DNA, 81 bp, Homo sapiens
cccgtgatttagttatttgtactatttgcatcatggagctttacccatagctcatccaaggtcacataacttgtcaaaggg

SEQ ID NO: 6863286 - DNA, 118 bp, Homo sapiens
ttttagctgaaatggttgcttagaatattaagtttgtgactcacatgaaaccagcatataagtgaatgcttcataagtggtttatatgcttgatcatttttcgtaatttagctcaaga

SEQ ID NO: 6863287 - DNA, 72 bp, Homo sapiens
gacaaaatgaaaatgggtgagatttgtatagtacataatgtctaaaatgcagatctactggtaaatcatgtc

SEQ ID NO: 6863288 - DNA, 74 bp, Homo sapiens
gaaatggtgaggggtaagtaaaggaattgcaggaataaaaatgaccacctgcaaaagttagcccttcccatctc

SEQ ID NO: 6863289 - DNA, 58 bp, Homo sapiens
ttgtcaatgcccagattaatcacaggacagatactcaggaagatttggtcattgataa

SEQ ID NO: 6863290 - DNA, 66 bp, Homo sapiens
tgttttgacatacatgaaaatgcagcttccataagaaatggagacaacaatcatgtgtgaagaaca

SEQ ID NO: 6863291 - DNA, 65 bp, Homo sapiens
cattgattatcatctgaaggcgccgctcaaatgttcactgaagttgtgtttcatgtgatacaatg

SEQ ID NO: 6863292 - DNA, 68 bp, Homo sapiens
ggactgactcttctgtaaattcagaaatgtctccatgctctgatgtttctcatccagagagtcagtcc

SEQ ID NO: 6863293 - DNA, 70 bp, Homo sapiens
tcacatttaagcttcaaagaacatattggaaatgagcttttcagtatgaaagttgtggttgcttatgtga

SEQ ID NO: 6863294 - DNA, 79 bp, Homo sapiens
tcagacatcatgagttcctgctttgcaaagcggagagagagcagctgtgcagtgcatgtcggaactcatttctgtagga

SEQ ID NO: 6863295 - DNA, 68 bp, Homo sapiens
cccttacactgtagacccctggaagaaaagaggaggtgggattcctttcagggaagtgtgcagaaggg

SEQ ID NO: 6863296 - DNA, 63 bp, Homo sapiens
gagaggcaccttcacacctgattcacagagatgtcactgaggctcagagagagggtgccactt

SEQ ID NO: 6863297 - DNA, 60 bp, Homo sapiens
tagcccagccactgatttgcaaccagtgggcacctgctgcaagttcagaaggttgggctg

SEQ ID NO: 6863298 - DNA, 63 bp, Homo sapiens
ctcaagcacgagcgcccctccggagcgctccagagccactccggaggggcgctcatgcttgag

SEQ ID NO: 6863299 - DNA, 56 bp, Homo sapiens
gggttgacggctatggcaggagcacaaggagagctcgctgccttgggagtggacct

SEQ ID NO: 6863300 - DNA, 62 bp, Homo sapiens
ccatgtggctagcgtgcctgcaagtgctccttcgcactcagtccagaagcttggtgatatgg

SEQ ID NO: 6863301 - DNA, 73 bp, Homo sapiens
agtaccaccaaacaatttgcatttccttagggagtaattttcctacaggacaaatagcagttgtcaaaggact

SEQ ID NO: 6863302 - DNA, 56 bp, Homo sapiens
tcatggggtgacagaagggaggagaagtcctgcttccctgtgtcagtgccccctga

SEQ ID NO: 6863303 - DNA, 103 bp, Homo sapiens
agcagaccaactttgttgtaaatatttagataaaaatgggctttagagcagccacatctgaagacccacaaggctgaatgttacacagggtatgtattctgct

SEQ ID NO: 6863304 - DNA, 80 bp, Homo sapiens
gcagtcctttcagatagtctgagatatatggccaaaaaaatatctgcggcagtgacatagcaggctacctggaacaatgc

SEQ ID NO: 6863305 - DNA, 55 bp, Homo sapiens
ttgcagcttcttgcatcagaaaatcagatagagcctctctggcaagaagctgcag

SEQ ID NO: 6863306 - DNA, 82 bp, Homo sapiens
catccaatcatgaaatattcaccacccacttcctgtgtgccaagcactgaggctgggctgagggtatagagagataaagatg

SEQ ID NO: 6863307 - DNA, 60 bp, Homo sapiens
gcaagtgtacatatcagaattgtatagctagttgaatttgcacaaactgagtacacttgt

SEQ ID NO: 6863308 - DNA, 83 bp, Homo sapiens
ttgacctcatctctgtgagatttgtattaaggaaaacttcacagaagaagtgacgtttaattcgggtcttaagaatgagttaa

SEQ ID NO: 6863309 - DNA, 100 bp, Homo sapiens
gaggcaggagaatcgcttgaacctgggaggcagaggttgcagtgagctgagactgagccattgcactcctgcctgggcaacaagagcgaaattctgtctc

SEQ ID NO: 6863310 - DNA, 61 bp, Homo sapiens
cctgggactctcacattgctcacttagctggagcaacaggtgagaaaacgagggttgcagg

SEQ ID NO: 6863311 - DNA, 60 bp, Homo sapiens
gagcttggcctcttgaacgtgggccacaataattcagcccacatcatttcaggcaggttc

SEQ ID NO: 6863312 - DNA, 75 bp, Homo sapiens
ttctgtgacagtggtcacttgtagtttcaaatgacattttgctggctgcaataagactatttttatcctcaagaa

SEQ ID NO: 6863313 - DNA, 72 bp, Homo sapiens
ctgaagtttgaatgcatggcttagatctaccaaaatacattggtacatctataacatggatttaggaattag

SEQ ID NO: 6863314 - DNA, 70 bp, Homo sapiens
tattgatcagttctgcaagcgtttatcaaaaatttattctatggcagtcgctgtgtgcagactgaaaatg

SEQ ID NO: 6863315 - DNA, 64 bp, Homo sapiens
tgaatcaccatgtccgagtttgttccattatgtatgatggctcatgtttggggatgatgaatca

SEQ ID NO: 6863316 - DNA, 70 bp, Homo sapiens
ctggatcagtcttttggcttactttgaccagaaggatctggtgaaaagtgatgccaggagtctggtccag

SEQ ID NO: 6863317 - DNA, 59 bp, Homo sapiens
ttttagttactgcagtagcaaagagattcatgagtttagcctattgcacatagctgaag

SEQ ID NO: 6863318 - DNA, 60 bp, Homo sapiens
gctcttcagatggccagttgtccccttcaggatcctgggatgggaccatgtacgtctagc

SEQ ID NO: 6863319 - DNA, 57 bp, Homo sapiens
gagtgggtgggtctgtcatgttgaccctaccttaaggtgcccagaccccaccctctt

SEQ ID NO: 6863320 - DNA, 56 bp, Homo sapiens
gctatgccatgctatttcatcatgtgaccttcacccagctgaagatgcatggcagc

SEQ ID NO: 6863321 - DNA, 84 bp, Homo sapiens
ctgatcatggggatgtagaagatggcaactgcactgatgtgagagacacaggtaccaaaagcctttttctgctcctctggggag

SEQ ID NO: 6863322 - DNA, 75 bp, Homo sapiens
tatcctacacaagaaagaaggaggtacaagccaaagatctttctctttataaatctctctttattcttggggata

SEQ ID NO: 6863323 - DNA, 56 bp, Homo sapiens
ttccattgtttctgtcttcacttccttttacctgggagaagctgatactgatggaa

SEQ ID NO: 6863324 - DNA, 77 bp, Homo sapiens
gcagaagagggcccatagatcgtcagcttgcagcctctggtttaaagcaaaatcgcatctggggccagctcaactgc

SEQ ID NO: 6863325 - DNA, 69 bp, Homo sapiens
gggtcggcctggtggcagaatctaggggacccagtcctagggtaccagagcctcaacacaggtcctccc

SEQ ID NO: 6863326 - DNA, 124 bp, Homo sapiens
ctgaaaacaccaaaattctcaaatgcatgcaactactgaaaggcatgggaaaaggatgtgtcatcatcaatctgtcactcttccccatagcctacactttgctgctgtctgagtttgctttcag

SEQ ID NO: 6863327 - DNA, 74 bp, Homo sapiens
caatttctttctctatttttattagttaggtctataaaaagaccagaacatcttgaagattgggaaagcatttg

SEQ ID NO: 6863328 - DNA, 128 bp, Homo sapiens
ccccgcttgctcccaagactcttgttgtcctgcttcaccgtccccacagtaaccaggccctgctgccgtcaatggaggcgagggggcgggagacagcagtgacgtcaaagcggaagaagggggcgggg

SEQ ID NO: 6863329 - DNA, 69 bp, Homo sapiens
tacgaagctgcctttgcatcactttaaaactgtaaatatgcccttgaaacatgcaaagaggcttttgtg

SEQ ID NO: 6863330 - DNA, 103 bp, Homo sapiens
tctcaagaatgactgccagggcttcagttctgaccatcttcattccagagagcaggaaagaagcagaatagaggcccttcccagctctgtcagctctttaaga

SEQ ID NO: 6863331 - DNA, 67 bp, Homo sapiens
gtgacttgatgtgcccagaaagaagggggtctagggccgccactaatctgatatatccccaagttac

SEQ ID NO: 6863332 - DNA, 69 bp, Homo sapiens
ggctgtggggccgggtacagtgacagacctgagaccccatcagcgctgacaccataggccccaagagcc

SEQ ID NO: 6863333 - DNA, 81 bp, Homo sapiens
tttttaagtagtatagtgaatattttggtgtatttgacaacctggatatatcgaagtgcttcatagtactaggcttaaaaa

SEQ ID NO: 6863334 - DNA, 106 bp, Homo sapiens
cagagccgaggggccctgtccccagctctccagcaacccagtcatcctgagagggctgcttcctggggaatgctcggaggactcggtgtcccctcagaggtctctg

SEQ ID NO: 6863335 - DNA, 74 bp, Homo sapiens
accagacatggtcattgctctcaagttgctggcattctaatggcagcagaaatagaagtcaatgatagctgtgt

SEQ ID NO: 6863336 - DNA, 70 bp, Homo sapiens
cctaagtagctaggattacaggcgtgcaccaccgcacctggccaatttttgtatttttagtagcgacagg

SEQ ID NO: 6863337 - DNA, 86 bp, Homo sapiens
atttgtgggtggaagtgaagcagcagtcatgcctatgctctgactgtcaggagaagggctagtgggcactgttgcagctcacaggt

SEQ ID NO: 6863338 - DNA, 61 bp, Homo sapiens
gttctaagggctggaggatacatcagagagcaagatagccttccctctgcctttgtagagc

SEQ ID NO: 6863339 - DNA, 82 bp, Homo sapiens
gaatgggctcttgtgggcctagaaacaagggggaattactagtttaattcactaaatttctgggccattccgtagcccattt

SEQ ID NO: 6863340 - DNA, 96 bp, Homo sapiens
atagttttgaagagtgctacaaaataacgtggctgttgaaagaaatgctttttgcccaatttctttctggccacggttttgagaaaagaaaactat

SEQ ID NO: 6863341 - DNA, 56 bp, Homo sapiens
agctgttgtctgcaggagaagcaagtatttctcccctattcaaagcaacagcagct

SEQ ID NO: 6863342 - DNA, 68 bp, Homo sapiens
tgtatatacacactcccatgttctgggtatgtgcacacatgtcctcatgtgctgagtgtgtatataca

SEQ ID NO: 6863343 - DNA, 60 bp, Homo sapiens
gccgtggggagagagggtgcgtcccggcagtcccgcacgacgggccccgcctcccctggt

SEQ ID NO: 6863344 - DNA, 76 bp, Homo sapiens
atgttgctgagccagacatctcaggcttttgatgggtcctctggttccatccagtctggggtgctgcatgccgcat

SEQ ID NO: 6863345 - DNA, 57 bp, Homo sapiens
gggcagctctcacagcagccaagccaaatttgtttagtatacatgagttagctgctt

SEQ ID NO: 6863346 - DNA, 75 bp, Homo sapiens
ataactagttctgccattcagtgtcacatgtctgtgtctgattttatgacctcctaagtgacagaattcggttat

SEQ ID NO: 6863347 - DNA, 77 bp, Homo sapiens
tgtatcttattgctgttgccagataactttgctttttctttgagtctccatgtcttacatgcagtttatgagagaca

SEQ ID NO: 6863348 - DNA, 63 bp, Homo sapiens
gggcgggagagggtgagaacgagaatgttaatcctaggcagcctctctgacttctccccgcct

SEQ ID NO: 6863349 - DNA, 71 bp, Homo sapiens
ggttcttggccacttgctggatggcgtccaccagggtcatgtccttgtggatcatcaggtaggccaggacc

SEQ ID NO: 6863350 - DNA, 62 bp, Homo sapiens
gccctttggcaagtcaggaagttgacattgatctattcatcaacacccctttgcttgctggc

SEQ ID NO: 6863351 - DNA, 61 bp, Homo sapiens
gcacattctagaagagcttcacttgtcactctatacaggaatgatctgttttagaatttgt

SEQ ID NO: 6863352 - DNA, 66 bp, Homo sapiens
gggcatgagcaggccagtgtgcttcccaggcaggtcgtagggaaaccagcgctggcctcagtgcct

SEQ ID NO: 6863353 - DNA, 68 bp, Homo sapiens
gccaggggccggggtctgccgcggccaccgggggagagggagcatctggcagaccctgcctccgacgt

SEQ ID NO: 6863354 - DNA, 76 bp, Homo sapiens
ggtgacatccgccttacatgatactgaatgtgggagtcaggactcaagctgattgtcaggtaaggaaggattcact

SEQ ID NO: 6863355 - DNA, 57 bp, Homo sapiens
attttcaaagtctttatcttttttcgtttgataggaatgggtcgggaagttgagaat

SEQ ID NO: 6863356 - DNA, 63 bp, Homo sapiens
ctggcagggatggtggaggttgcaagttggaggttggcttcacccatcatctcctctaaccag

SEQ ID NO: 6863357 - DNA, 89 bp, Homo sapiens
ggagaattgcttgaacccaggaggcggaaggtacagtgagctgagatcacgccattgcactccagctctgggcgacagagcaagactcc

SEQ ID NO: 6863358 - DNA, 65 bp, Homo sapiens
aacatctagtaattcagttttcagatcgttacgagtttgagttttacctgtattactggcatgtt

SEQ ID NO: 6863359 - DNA, 76 bp, Homo sapiens
ttataattcatgaaatagcacttaagtagtactgcttggacagttactgcttgttagctgtatttgctgaatttaa

SEQ ID NO: 6863360 - DNA, 59 bp, Homo sapiens
ttgcactttacagggtaacatagatcttatgatactaggttacagttgttaagttgcaa

SEQ ID NO: 6863361 - DNA, 103 bp, Homo sapiens
ctggttgtctgtcccctcattagactgtgggctccttgagggcagggaactggaattgctgttcgtcattgacccccagcctagtgaaggatctgatgctcag

SEQ ID NO: 6863362 - DNA, 74 bp, Homo sapiens
tgtggtcccagcctgtctgtctccaaagctgagctcttactcatcttccaaggctggagaggagaggggctgta

SEQ ID NO: 6863363 - DNA, 79 bp, Homo sapiens
gtgagccatgcctaagtatttctggcctgtgaaaggaacacagtttcagagccagggcagaaaaaccatgtgtgctcac

SEQ ID NO: 6863364 - DNA, 73 bp, Homo sapiens
cagagagatgtattctgagaggcagagcttgtgagtgaatacttatatgcatttctaagaaaacatacgactg

SEQ ID NO: 6863365 - DNA, 78 bp, Homo sapiens
tgcctgctcaatacacactcttcttgaacttggagtacgcaagtagcaacagaaaataggagtgcaggtagcagagca

SEQ ID NO: 6863366 - DNA, 56 bp, Homo sapiens
atgccaagctctatccctgaccaatcagatcagctctgagggtggggcccaggcat

SEQ ID NO: 6863367 - DNA, 86 bp, Homo sapiens
agcccagcctcaatcactgacctgcagatgcatgagcctaataaatgattattgtttgaggtcactgatatttgaggtgatttgtt

SEQ ID NO: 6863368 - DNA, 67 bp, Homo sapiens
gaagccagtcttaggagaaactacagaattgtaggccttttctgtcttattctcctgacattaattc

SEQ ID NO: 6863369 - DNA, 56 bp, Homo sapiens
tcagcaaaactgtacctttgtgttactggcagaaaaggctatcaaagttttgctga

SEQ ID NO: 6863370 - DNA, 124 bp, Homo sapiens
caggttttgagcatggaataaggaatggagaggggagatgatgagatcactgctatctttgttctatataacctccacttctacccatagttctttttctttttccatacataaccagaatttg

SEQ ID NO: 6863371 - DNA, 94 bp, Homo sapiens
caatgttaatgggcagaaaatgttcccttgcacttttgaaccacaaagaggcattgtggcacagaaagatgaagggcatgacacctaaacattg

SEQ ID NO: 6863372 - DNA, 59 bp, Homo sapiens
ggacctgtgggcagaacctagtgcagaaaatgagctgtgagggaaggagcccagggtcc

SEQ ID NO: 6863373 - DNA, 77 bp, Homo sapiens
gatctttaatggagctaatttagcagtagaaagtgttacaaatttccattcctcaaaggtagcccattagccaggtc

SEQ ID NO: 6863374 - DNA, 68 bp, Homo sapiens
ttgtttaggcaattagtaacgcagaaacagcattactgcttttctcagttactagctgtggtaagcag

SEQ ID NO: 6863375 - DNA, 68 bp, Homo sapiens
tttttactgacctccaatcccactcattctgactagtggattctagtgggctttggggtctctaagaa

SEQ ID NO: 6863376 - DNA, 66 bp, Homo sapiens
ctggtgtgcaggaggtaacatagcaaaataattcatttttccttctgatgccccttgcagttctag

SEQ ID NO: 6863377 - DNA, 71 bp, Homo sapiens
ggtccaggaaggaaagggtgtggagacagaactatcctttccaatcagtccctttcttttcctaccagacc

SEQ ID NO: 6863378 - DNA, 55 bp, Homo sapiens
tgtataggaagtgtagtgcttggaatcgagttttacggcattttactttctgaca

SEQ ID NO: 6863379 - DNA, 72 bp, Homo sapiens
tagagcggaaccgcaggaagcccttgcttatctttcacttctgaggctcccatttcctggggttccattgtg

SEQ ID NO: 6863380 - DNA, 67 bp, Homo sapiens
ccttgaagatgtggacccagccaggctgtggcctcccctgcccagcctcccttctccatattgtagg

SEQ ID NO: 6863381 - DNA, 129 bp, Homo sapiens
ctcatctttgaatgcggtggatctaagcatgttgaccgagaactatccatggaagagggcagacaccctgcctggcacatagtactctttcaatacatggtagctattcttattagcataggtggtgag

SEQ ID NO: 6863382 - DNA, 66 bp, Homo sapiens
tggccagaggcacagcttcttttaatattcaggttgttagtatttggcgaagcctgcctctttcca

SEQ ID NO: 6863383 - DNA, 64 bp, Homo sapiens
acagcccaggactccagtgggcttgcgtcgccataacaacagacggctccgagtcttgggctgt

SEQ ID NO: 6863384 - DNA, 63 bp, Homo sapiens
gtcctgggcatgcagggctttctctttcactggatgggtgacagcatggtgtctgttcagggc

SEQ ID NO: 6863385 - DNA, 101 bp, Homo sapiens
ttttgctgttaaatattgcagagaatatcttgtacatctaagtagaaaagagatttttgctataagaattatattactctgtgcaggtttggctagcaaaa

SEQ ID NO: 6863386 - DNA, 127 bp, Homo sapiens
agcatatactcttaactaaaattgattttctcctgtagtaaacattttcatattttctggtagctcaggatgttttgaatatatttgctatgtttagggaatttccaatcttaatataagtgttgct

SEQ ID NO: 6863387 - DNA, 79 bp, Homo sapiens
tgcatccatatggataggtttcaagaatgcaaaccttcatttgtctgcaagtgttactggaacctgtccaaaggctgca

SEQ ID NO: 6863388 - DNA, 79 bp, Homo sapiens
gctgaaatacaaattggaggaaattgcttttgtgggaaaacatttcctctcctcagtggatttctcttttgtgttctgc

SEQ ID NO: 6863389 - DNA, 77 bp, Homo sapiens
ggtgtgggtcagctttattaatggatcttcatggtaagatggaaccagccagaaatgatgaggtgttgaactatacc

SEQ ID NO: 6863390 - DNA, 59 bp, Homo sapiens
gcagagcaggaaggaagtcagggaataaacaccattacctttcttttctcctgccctgc

SEQ ID NO: 6863391 - DNA, 65 bp, Homo sapiens
gaagcttaacagtactaaagaagagaagttggcaaactcgttctttctgaatacagttgagtttc

SEQ ID NO: 6863392 - DNA, 57 bp, Homo sapiens
gtcccggggctcgaaggcagaggctcccctaggtgtgccctgcctgaccccggctac

SEQ ID NO: 6863393 - DNA, 67 bp, Homo sapiens
gtgcttgttactctctgaaatgcctggggctgcagcagtcacaggaatgaacagggaaagaggatac

SEQ ID NO: 6863394 - DNA, 87 bp, Homo sapiens
tctcaggctgtcgtcctctagagggaagcactttctgttgtctgaaagaaaagaaagtgcttccttttagagggttaccgtttgaga

SEQ ID NO: 6863395 - DNA, 62 bp, Homo sapiens
gtttcaatattgagaaccagcatgttttcagagatcaatgaaaataatttcagtgttgaaat

SEQ ID NO: 6863396 - DNA, 68 bp, Homo sapiens
gagtctgtgcttgctgaaaggcatttagaggtcccttctgggtgccacacagcatgcttggtgaactc

SEQ ID NO: 6863397 - DNA, 103 bp, Homo sapiens
gcttgcaaaccaggctggagatggcaccttccccagagctcaggaattctgggtgaggattgagtgtggggaatgtcatgagatttagcctgctcctgtaggc

SEQ ID NO: 6863398 - DNA, 64 bp, Homo sapiens
cttccttctcactagcagcgccctccctgcctgcacaggaggtgctgtgaggttgagaaggaag

SEQ ID NO: 6863399 - DNA, 92 bp, Homo sapiens
aaggatagttctaagtcataggatgtttgtttgaagacataaaatgtaacttgattgttagaaaacaggcgcttactaagaaaaatatcctt

SEQ ID NO: 6863400 - DNA, 57 bp, Homo sapiens
cttggtgtccatagtatgtgtctggctttagtttgttccaggtctgtggtcaccagg

SEQ ID NO: 6863401 - DNA, 94 bp, Homo sapiens
caacccattttgaggacttcttaatgggaaatgaatggtttcaaagagtattgtccatctccacattaatgctgatttatcaaaatgtcagttg

SEQ ID NO: 6863402 - DNA, 89 bp, Homo sapiens
tcctaacagaagcttggctgtgtccacatttttattcatcaaagcaggggtctccagtgaagtgtggacgtcaccaatgggctttagga

SEQ ID NO: 6863403 - DNA, 77 bp, Homo sapiens
caccttgggcaggaaggcccacctgtcctgtggctgtggccatagcactcagtgtgggtctccccaaccagaaggtg

SEQ ID NO: 6863404 - DNA, 55 bp, Homo sapiens
gagacagatgctgctggagcatttgaaatatgaagtgtgcagtggccatcttctc

SEQ ID NO: 6863405 - DNA, 82 bp, Homo sapiens
tctggaccaatcagcgtgctgtcatgatgtagtggaccattatgttgatctgcaggatgttaggatgatcaggatttctaga

SEQ ID NO: 6863406 - DNA, 77 bp, Homo sapiens
ggcagagaactcagttatgctgctacccagtttctgacctacagaaactgtgagctagtaaataggtgttttaagcc

SEQ ID NO: 6863407 - DNA, 63 bp, Homo sapiens
cgcgctgcagacagcggaggcctgggccatattccaggagcagaccgtagtcctgcaggtgcg

SEQ ID NO: 6863408 - DNA, 81 bp, Homo sapiens
gataactgcttgtgaactctttgaacagtgaggctaacaagtttgtcctagacctcaagaaggaagacaagtcagttgctc

SEQ ID NO: 6863409 - DNA, 66 bp, Homo sapiens
tgcaggctctgagtgaagggggcctcctcattggagtgtgcaggggcctcctcattggagtgtgca

SEQ ID NO: 6863410 - DNA, 79 bp, Homo sapiens
gaaaaaaaattctggttcaatactaaacttctttaagatttactgagggtgtttaatattagaacaactgttttggttc

SEQ ID NO: 6863411 - DNA, 56 bp, Homo sapiens
atggtgatcagcccttgtatctttcaccaataagaaaacagggctctggacgccat

SEQ ID NO: 6863412 - DNA, 55 bp, Homo sapiens
gtttctccacaccctgggaaggctccgcgagtgccccatgggtgcctgggggttc

SEQ ID NO: 6863413 - DNA, 67 bp, Homo sapiens
caccatgactggttgagagaggcaggaagaaaggaggaagtgttctgttttagcacttgttatggtg

SEQ ID NO: 6863414 - DNA, 61 bp, Homo sapiens
aactctcttgggagtacctggagtaagacaataagctcctgctattcaacaagaggaagtt

SEQ ID NO: 6863415 - DNA, 63 bp, Homo sapiens
tgtttgaagtaaatgattaaaagaggaggaagttaccacattctggaagatttacttgagaca

SEQ ID NO: 6863416 - DNA, 63 bp, Homo sapiens
ccatccagaaacttccatccccatctgcagttgggtttggccttgagaaagtggtctgggtgg

SEQ ID NO: 6863417 - DNA, 55 bp, Homo sapiens
ctgctttaatccctgcctggaagagctcatccatgaccaggtggaactgaggtag

SEQ ID NO: 6863418 - DNA, 99 bp, Homo sapiens
tcaaaaatttgcatgcattgtaatagatgccagacattaacgactatgccagacatatgcatttcttcctggatggctgttacaatatagcaaggatga

SEQ ID NO: 6863419 - DNA, 64 bp, Homo sapiens
tatctactacctagctcttgataactgtgcccatttataggcatggcagactagagtatagatg

SEQ ID NO: 6863420 - DNA, 84 bp, Homo sapiens
aacagtaggccataaacatgcattacaattgcatagtattattgatattattgtcaggtgatgtgtgtaggagtctcaattgtt

SEQ ID NO: 6863421 - DNA, 59 bp, Homo sapiens
gcagtggtccttacttcccagctacctggccctaggataatgaggaggaggactattgc

SEQ ID NO: 6863422 - DNA, 57 bp, Homo sapiens
aaggcctagtaagctaatgtcaccccctttaactgaacacaattcttgcttggcctt

SEQ ID NO: 6863423 - DNA, 91 bp, Homo sapiens
tagtcttcttgtataaacacttaatgagcacaagatgcccatttataaatgaagggcatcttgctgttatgtttatgtattaaaagggcta

SEQ ID NO: 6863424 - DNA, 113 bp, Homo sapiens
cacctctgtgactcttcctggtcagaagtcacttgggaagcaaagcctacagtatatgagtgggttaggtcttcccaagtgtgtctgcttcacgtggaagagtagtcaatgtg

SEQ ID NO: 6863425 - DNA, 63 bp, Homo sapiens
ccattgtgcacctccagggctggcgattataaggaaaccaagagtgtctaggaggtcacaagg

SEQ ID NO: 6863426 - DNA, 83 bp, Homo sapiens
ggaccccagcggagctgcgccgggacacgggaccgcccggctggccgggacaagcccgctggcgcagccctcggcctggggcc

SEQ ID NO: 6863427 - DNA, 72 bp, Homo sapiens
tctgctttcagcaaaagccagcataagctcatttacccaggtgtgactgaagcggttggttttgcaatcaga

SEQ ID NO: 6863428 - DNA, 96 bp, Homo sapiens
ctttaccttgcctaagtctgcagtcacttgtagaatgggaatcatgaaagcccttgcctcataggtagttgtgagaatgacttagtgtaagtgaag

SEQ ID NO: 6863429 - DNA, 81 bp, Homo sapiens
gattttcccaacattttatggcaatttgtttcatttgccgcaggcccgtaacgatgcaaattgccataaagtgggataatc

SEQ ID NO: 6863430 - DNA, 68 bp, Homo sapiens
gctgctcaaaaccagccctcaggtcagatactccagggatgagtgtttacattgaagcttgtagcagc

SEQ ID NO: 6863431 - DNA, 117 bp, Homo sapiens
catgcccaactctggggccacttagctccctttctcctccccttgccttctgaccctgaatgcacaaaggtggaaggaggaagcaggaaaattaggccgttcctaagagaaagcatg

SEQ ID NO: 6863432 - DNA, 84 bp, Homo sapiens
ctgggccttggggaccacactgggagctggaatgggagaagctgaaacaatttcctcacccactccctgtcaccttaggctggg

SEQ ID NO: 6863433 - DNA, 56 bp, Homo sapiens
cctcacagagcacacaagaattgcagcacatcctgcagaagtaggctctgtgtagg

SEQ ID NO: 6863434 - DNA, 63 bp, Homo sapiens
tgtgatctgaatcaatagaataactcatcattactctgagttgcgaggcaagatttagacaca

SEQ ID NO: 6863435 - DNA, 104 bp, Homo sapiens
ggagaaaattcaaacaatttagtgtagcattcagagtcaactctgtctttatcttctatctcttacggtggctctgtttgttaactagactggtcttattctcc

SEQ ID NO: 6863436 - DNA, 82 bp, Homo sapiens
ccacgttttagtttctctgtcaaatggaaacttatcctgtcagatgactgtaaggattggtgatattacagaatgtacgtgg

SEQ ID NO: 6863437 - DNA, 61 bp, Homo sapiens
tcaggatccatagactcccaaaggcctccacagataaacttgagaatctcatggaccctga

SEQ ID NO: 6863438 - DNA, 61 bp, Homo sapiens
ctaggttccattctgaaggtgtcatgttgcctgcactggtaattgggcaatttaggactag

SEQ ID NO: 6863439 - DNA, 59 bp, Homo sapiens
gggcagtggcaccgctggctctggccacactggacccgccattgctcgtgccatcaccc

SEQ ID NO: 6863440 - DNA, 104 bp, Homo sapiens
tgtataaaagctttcccacattcattacactcataaggtttctctctagtatgaattttctggtgtgtaatgaagtttttcttgtggctgaaggcttttctgca

SEQ ID NO: 6863441 - DNA, 61 bp, Homo sapiens
tgcaggtgctgtgtcaagagagctgtctcattgttgagatcttgctgtacggctacttgca

SEQ ID NO: 6863442 - DNA, 62 bp, Homo sapiens
tttctgcagcagactcagtgtggagccgtcagccagcagcacttagtctctgggtacggaaa

SEQ ID NO: 6863443 - DNA, 58 bp, Homo sapiens
gagctcaaggccatgtaggaggcatgcggcgttgcagcagtcagtcaggcctgggttc

SEQ ID NO: 6863444 - DNA, 78 bp, Homo sapiens
gcttggtcactgttattttgaaaggtttctcaggtcggttccctagggcaagctgatgtgatagtgaaaaacccaggc

SEQ ID NO: 6863445 - DNA, 87 bp, Homo sapiens
gttgggcaacttgagtttaactgtctcttcttccagtggccaagtccaaattctgaaagcacagttctgaccatgtccctgtccaac

SEQ ID NO: 6863446 - DNA, 123 bp, Homo sapiens
gatacggcacaagttttggagatgtaatcgcctgaaagcatccaactttgattagagagtctgagctctcatagtaacacagattggtagtgcttctcaattcattttctgaaactgtttatc

SEQ ID NO: 6863447 - DNA, 100 bp, Homo sapiens
gtaaaagtcctaagtagtgcagacggagtatcttgtacataaggagtgcttccttcagcaaaaatgtattgatgtccagtctgagccagggactgtgtgc

SEQ ID NO: 6863448 - DNA, 78 bp, Homo sapiens
atgacttagtcaaatcattctgtttctctctgcttccaatcaaaacatagagaaatagaatgacttgactaaggccat

SEQ ID NO: 6863449 - DNA, 103 bp, Homo sapiens
gggggtgcgggaagcctgcgggccagcgccgcgagtcccacctgctgcgtcctagaccggctcctcggcgctctggacctggctctcggttcctgccgcctcc

SEQ ID NO: 6863450 - DNA, 61 bp, Homo sapiens
gtgaagcacatgggcgttgggtttgctcatcacaagctgcctgctgctgatgctgtttcac

SEQ ID NO: 6863451 - DNA, 87 bp, Homo sapiens
gcccccttggggcccacagaggcaccaccaggcccccaaagacccatttctctgtctccagctgtggtccctctgtcctcatggtgc

SEQ ID NO: 6863452 - DNA, 70 bp, Homo sapiens
tacttttaaaattcacaggtatagcaggctttgtgactgtggtgtcctgtggtctttacaagctaaagta

SEQ ID NO: 6863453 - DNA, 64 bp, Homo sapiens
ctgacgctttcctagttggtcccagcactgagcagaactgtgctagagaagcagggaagcacag

SEQ ID NO: 6863454 - DNA, 118 bp, Homo sapiens
gggcggggcggggcggggctggggtcctggccctggaatagggcaggtgttctctgaggagctgcttctgttcctgtcctaagggccaatggcctcagcacctctccgattccctccc

SEQ ID NO: 6863455 - DNA, 103 bp, Homo sapiens
gatggtactggggccagaaacagggggatgactgcattgaaattttttgccttgatttcagcaagaaatcttcagtgttctccctggagcctggttcaccatc

SEQ ID NO: 6863456 - DNA, 80 bp, Homo sapiens
aaatgatttttttctgtgggacttcaatgcaatgaggtagaaatgactaccgtattaggattcacagacttctttcattt

SEQ ID NO: 6863457 - DNA, 84 bp, Homo sapiens
ttacacatttggattacatagcttctaccacccgaatgctaataaagggttttgacagtatatatagtctaaaagcttgcgtga

SEQ ID NO: 6863458 - DNA, 81 bp, Homo sapiens
caagtaaacattttattgacaataggcaactgaggagaaaattaaccctttttatagttaattgtaagtggaagttgcttg

SEQ ID NO: 6863459 - DNA, 74 bp, Homo sapiens
cttaatgacgtgtgccaagtccctttggctagataattattcataggtcccagggattaggacatggatgtaag

SEQ ID NO: 6863460 - DNA, 60 bp, Homo sapiens
gtggtcatgtgctctttcatagtgaccatgccaccgtgaactctccaggcaaatgatcac

SEQ ID NO: 6863461 - DNA, 77 bp, Homo sapiens
cctgtgaaatctgagtcatttatagctaaccttgaatgtattgttattcacaattagaagtagataaatttcacagg

SEQ ID NO: 6863462 - DNA, 84 bp, Homo sapiens
cagatatctttatagcaatgccccactccttggttccaattttctgtattaggctgttcttgtgttgttataaagaaatatctg

SEQ ID NO: 6863463 - DNA, 77 bp, Homo sapiens
catggttctgcaggctgtacaagaagcatggcaccagcatctgcttctggtgaggcctcaggaagcttacaatcatg

SEQ ID NO: 6863464 - DNA, 78 bp, Homo sapiens
tgaactgcagaatattctgattttctgtgaattaacatgaagttaattcacatttagacatcaggtagcaagccttca

SEQ ID NO: 6863465 - DNA, 60 bp, Homo sapiens
tctctggctgcctggcagctctgggcacatgttcaacagcccatgggaggggccaagaga

SEQ ID NO: 6863466 - DNA, 72 bp, Homo sapiens
gtactggatcctgcactgagtggagtcagtcctgctcttccctgctcactccttctgaggcaggtcttgagc

SEQ ID NO: 6863467 - DNA, 95 bp, Homo sapiens
agtaccttgattttggacttctggcttccagaactgagcaacaataactttctgttgaagccgtccagttttgaagccacccagtctgtggtgct

SEQ ID NO: 6863468 - DNA, 78 bp, Homo sapiens
gttttctaacactgtgaaaaggcttcttgattggaaaaaagttatgaatcagtgatgtaacaaacagagttagaagac

SEQ ID NO: 6863469 - DNA, 120 bp, Homo sapiens
tttcttttctggtagggagatacaaaaagggagatgaggtagatttaataataaaagtactgaaggtctctgactcagcctcttttcctattcctaaacatgccaaaataaatgaggaaa

SEQ ID NO: 6863470 - DNA, 60 bp, Homo sapiens
ttgagaatttctaggcctgtgctacactttgtgctcaagtaaacattctagagattccag

SEQ ID NO: 6863471 - DNA, 59 bp, Homo sapiens
gcgtttgttcactaattcagctggggaacccttgccatctggactgaggagacagtcgc

SEQ ID NO: 6863472 - DNA, 81 bp, Homo sapiens
agcagagcgtttctaagcacatgtgagtgtttctacctgtggaatggcacactttatgtagccttggagtttagatttgct

SEQ ID NO: 6863473 - DNA, 66 bp, Homo sapiens
tcattcagattggttaccactttaaatcttttctgatagagagatagaagggtaaaccatgcgtga

SEQ ID NO: 6863474 - DNA, 56 bp, Homo sapiens
ctgtggccctgtgatctggcacttgggaccctcctggtgtgcccaaggggtggcag

SEQ ID NO: 6863475 - DNA, 55 bp, Homo sapiens
ggcgccctccacccacagcggctccacggcgttggggcagcgctggtagagcgcc

SEQ ID NO: 6863476 - DNA, 76 bp, Homo sapiens
agtaattgtcttctccttcctggcaatttgttttattatacctatgaatatgccaacatggagaggatgtattgct

SEQ ID NO: 6863477 - DNA, 76 bp, Homo sapiens
gctgactttcattggcttccaagatccgattgttacatattcagaattttggggagctaatttttgatgtgtcggt

SEQ ID NO: 6863478 - DNA, 61 bp, Homo sapiens
ttaaagagaactcaatgaatgaatatgtgaatgaatgcatgagtcagtgagttctccttga

SEQ ID NO: 6863479 - DNA, 99 bp, Homo sapiens
cggcacatccgccctttggcacgtggtgtgtgtgaattacgcgtgtcctgatgcagcacacagtgactcgcacctcagtgtgaccaggtttctgtgttg

SEQ ID NO: 6863480 - DNA, 76 bp, Homo sapiens
gggccccaggccacaggtggaattaagaaatctgggaaaccatgaactgttccttatgcctgaggcaatggtgccc

SEQ ID NO: 6863481 - DNA, 64 bp, Homo sapiens
agatgtaaggttcagagtatgtgaagagctaaggatttcttgacattctgctgcatttttatct

SEQ ID NO: 6863482 - DNA, 57 bp, Homo sapiens
gagctccctggaggttcagatacagagaatgtataggagcccatactcaaggagctc

SEQ ID NO: 6863483 - DNA, 67 bp, Homo sapiens
agtgtttgagacacatttcacttatctctgaatactaagtaaaaaagaagtgaggtggtttgacatt

SEQ ID NO: 6863484 - DNA, 84 bp, Homo sapiens
tacatgtcaaggataggctaagtgaattacatgtatttttaaggctattgtgccttagtgacatgtattcttcatggcactgta

SEQ ID NO: 6863485 - DNA, 60 bp, Homo sapiens
cagagcacaggctcaccattgtttccggagacccccacgggaacaccctgagctggcctg

SEQ ID NO: 6863486 - DNA, 67 bp, Homo sapiens
gacctcatctgaacatatgcaaagactttatttccaaataagactacatgcgtaggttcgaggggtt

SEQ ID NO: 6863487 - DNA, 60 bp, Homo sapiens
cacctgtgactctctgcctctcgttccacaagtagggcaggccagaaatgtcagggagtg

SEQ ID NO: 6863488 - DNA, 78 bp, Homo sapiens
tgtgtgtgtattgaagacaagggcaggggttccagacctccctgcatttgagccccatgccctctcttagcatacaca

SEQ ID NO: 6863489 - DNA, 62 bp, Homo sapiens
gcccaaggtcacatgcctaaacagggacacaaacctgaggcctttaggtcctgtgcctgggt

SEQ ID NO: 6863490 - DNA, 86 bp, Homo sapiens
cagaaattggcgaagatgcttactgcaatatttttacaagggctatcttacaaaattgaggccagtatgccatcttccagtttgtg

SEQ ID NO: 6863491 - DNA, 55 bp, Homo sapiens
tccttcaaagagtatttcctgagcactttgtgccaggcagtagctattgaagtga

SEQ ID NO: 6863492 - DNA, 65 bp, Homo sapiens
tttgcacagagctcgcatttggcagcagtaacgattactgcagctgaacctagagtctgtgcgga

SEQ ID NO: 6863493 - DNA, 82 bp, Homo sapiens
ggacaatgtggattctttagcccagaaagttaaatacctccaactttggcagtcctgaccttctgggtagagaatatagttc

SEQ ID NO: 6863494 - DNA, 61 bp, Homo sapiens
tatcttttagagtactgagtgaagcaatggcctgcattccttcagcagtcctctagagata

SEQ ID NO: 6863495 - DNA, 55 bp, Homo sapiens
gtctggctttgctcagatgctgcttgagcagcatcttgaagggtaaaccaaggac

SEQ ID NO: 6863496 - DNA, 57 bp, Homo sapiens
agagcaagggggcaggatcacacttggggatcccacaggccacagtgcccttgcttt

SEQ ID NO: 6863497 - DNA, 81 bp, Homo sapiens
gggcatgcagaattccttctaccagctggatacctctcatacactgagacactggattcttgtagtgaagtccacatgccc

SEQ ID NO: 6863498 - DNA, 74 bp, Homo sapiens
gacacctgcactagaagtcagttgaaaccagactcatcatctttcctctgtatttattcttctggtgttttgtt

SEQ ID NO: 6863499 - DNA, 61 bp, Homo sapiens
tgcaagtagcattttcaaaatgtatctctgatggtgatttttagaatatgctgcataggca

SEQ ID NO: 6863500 - DNA, 89 bp, Homo sapiens
ttaaagctgtaaactttccccaagtgaatgtttggtagcagtgttctatctctgcgaccactatgccctgttcacttttacggttttaa

SEQ ID NO: 6863501 - DNA, 68 bp, Homo sapiens
tgagccaggttaagacaggagcatatctgttttgctcactagaataaaatgtctgacctgggacctca

SEQ ID NO: 6863502 - DNA, 89 bp, Homo sapiens
ggagtcttgctctgttgcccaggcttggagggcagtggcatgatctcggctcactgcaacctctgcctcccaggttcaagcgattctcc

SEQ ID NO: 6863503 - DNA, 61 bp, Homo sapiens
aagatcgaataattgcattctataatagggaagtctgttgtctttgtggttggttggtctt

SEQ ID NO: 6863504 - DNA, 62 bp, Homo sapiens
tttgtttcatgactgatgttgttgaatctatgatgaatcaataaatacagttatgggtcaaa

SEQ ID NO: 6863505 - DNA, 74 bp, Homo sapiens
agcaggaaggggcctagcctggattaaagctgcagcttgtgtgactcttcctacagctgtgcctctctcctgct

SEQ ID NO: 6863506 - DNA, 56 bp, Homo sapiens
gtcagcagtggcagctcccggggacctgcagccccccctcggccctgccagctgac

SEQ ID NO: 6863507 - DNA, 104 bp, Homo sapiens
gctagtaaaataaacaccccgattctcatttgtgtgcaattcagaatattacccagatgttgggatgaatacaatgggatcatctgtgggaaaagcacattagc

SEQ ID NO: 6863508 - DNA, 65 bp, Homo sapiens
aatctggccttatcacaaagctagagagacccaaaattctctttgggaaacttaggggtcagatt

SEQ ID NO: 6863509 - DNA, 64 bp, Homo sapiens
ctgtggcccctcatgtcagtccctgcccagtgcttgttcactggtgaggaagtgagggccagag

SEQ ID NO: 6863510 - DNA, 81 bp, Homo sapiens
cccataattagtcatgttatgcatatgaagtttccaaaataaatagagaaaaatgcacaacagtggctgccttgagctggg

SEQ ID NO: 6863511 - DNA, 61 bp, Homo sapiens
ctgcaggacagggaggagcaaggtttgacaaaactaccctgtgtgacttccctaacctcag

SEQ ID NO: 6863512 - DNA, 75 bp, Homo sapiens
ataaatattgcttgatttgatttggcacagccatcattcttatgctctgctggttccgaattaggccatagatat

SEQ ID NO: 6863513 - DNA, 59 bp, Homo sapiens
ttgtttacttgtctggcattatgtagttttatcctacacatgtacagattagtatttag

SEQ ID NO: 6863514 - DNA, 55 bp, Homo sapiens
ccctgtcaccctcttgggaagcatgaggaaaagactaaccaagaattggcaaggg

SEQ ID NO: 6863515 - DNA, 99 bp, Homo sapiens
tcctcttgaagttactctaaaatgttgacagatgtgaaagtgagcattatcgaatgcttagttttacatttgcattcagatctgttgtttcaatgggga

SEQ ID NO: 6863516 - DNA, 94 bp, Homo sapiens
caagggatggaggcatcctctagaagctggaaaaggcaagaaacggattcttttctagaagctccaggaggaatgcagctctgttgacaccttg

SEQ ID NO: 6863517 - DNA, 68 bp, Homo sapiens
ctgacttggctgcataaaacagacccttataataccaggtcacatgtatatgcagcacagcttgtcag

SEQ ID NO: 6863518 - DNA, 56 bp, Homo sapiens
gttaagtgagggcttttgagtccaatatattggacttgtattctgtctttattagc

SEQ ID NO: 6863519 - DNA, 109 bp, Homo sapiens
gacttcaccaagactgcacagcacaggtggctccaagttagagcctgaactcacggttcttgcctcttgaagctggaggcatttggctgtgataggttggggtggtgtc

SEQ ID NO: 6863520 - DNA, 115 bp, Homo sapiens
cctgtctgactgattcctcctccagtgctttctccatttctccttttactctcttcagtgctgccgaagtttaaggtggaagtggtggaacccaaggagttatcaacggtgcagg

SEQ ID NO: 6863521 - DNA, 70 bp, Homo sapiens
gcagcaacgagctctccttctttcatttgtgatctgaaatttcatttagtgtgggagtgctttaagctgt

SEQ ID NO: 6863522 - DNA, 76 bp, Homo sapiens
tcaccttgaagtgtctcttgtaaaagataactccctgcattgtagaaatgtctttgacaagagaggattagggtga

SEQ ID NO: 6863523 - DNA, 58 bp, Homo sapiens
agagcatggcttttttctctgtttcagatcattctggtataaagtataagcttgtttt

SEQ ID NO: 6863524 - DNA, 72 bp, Homo sapiens
aaggagcagattggtaagatcattgcctctgggaagttagtggggaaaaaaatggtcttatgaaactacctt

SEQ ID NO: 6863525 - DNA, 56 bp, Homo sapiens
catcaaaatcacttgtgccattagtgaacattaactagcaggagcgaattttgatg

SEQ ID NO: 6863526 - DNA, 57 bp, Homo sapiens
ggggagttttaacaacagtactgcaaaaattaagttatgctctgtctaaaacttccc

SEQ ID NO: 6863527 - DNA, 79 bp, Homo sapiens
gagatggataacatagcatggcctgtgacactttgtaagtgctgcaaaaagtcatattcttgttccttcaatccatttt

SEQ ID NO: 6863528 - DNA, 57 bp, Homo sapiens
tgtaggaatgtttttaagttggctgtttttccccagtctactcttactgtttctaca

SEQ ID NO: 6863529 - DNA, 59 bp, Homo sapiens
ctgccatctgagccaaaagtgccttctttaaaattcccactgtggggttcaactggcag

SEQ ID NO: 6863530 - DNA, 76 bp, Homo sapiens
tctctgtcagaatggggtaaataaattaggatttggctaaatctctggttgttttgctcccatgttgtggcctaga

SEQ ID NO: 6863531 - DNA, 64 bp, Homo sapiens
tataagaccgcagaacaaatggagctgtggacagtagctcacattttatatctctggtttcatg

SEQ ID NO: 6863532 - DNA, 96 bp, Homo sapiens
tctttgtggatccatctctgaatggcttgttcattggtacctgtaaggagttacaatgcagagcccaagagcaagccatgaagacattcctgaaga

SEQ ID NO: 6863533 - DNA, 66 bp, Homo sapiens
ggcctcccgggatgcagaaggagccatgcttgcgtggacagcctgcgagatgtcttctgcgaggcc

SEQ ID NO: 6863534 - DNA, 63 bp, Homo sapiens
ttattcctcctttctgctcagcctttaatagatacatctttgggttatcgagcagaagagtaa

SEQ ID NO: 6863535 - DNA, 95 bp, Homo sapiens
caaagtgtgattcaagttccatatcacagcagacgaagagtcattcagctccagtttacggactgctggggtattttacacttgagtgcattttg

SEQ ID NO: 6863536 - DNA, 101 bp, Homo sapiens
aagatcttagatcttctaagtagaattttttaggttgttgttttatgttaaatagttgcaactttagaaaaatctataaaatgtgaggaggaaaaggtttt

SEQ ID NO: 6863537 - DNA, 66 bp, Homo sapiens
tgtaatcccagctactcgggaggctgagacaggagaattgtttgaacctgagtggcggaggttgca

SEQ ID NO: 6863538 - DNA, 67 bp, Homo sapiens
aaggcagcaggatttggtgactgaagtggctgagtaggaggcaagaaatcaccaaactcctggcttt

SEQ ID NO: 6863539 - DNA, 78 bp, Homo sapiens
gtgtccccatgaaaacagcctcctgtgataagaggcaacttgattattaaggtttctgttttttccttattggatcac

SEQ ID NO: 6863540 - DNA, 129 bp, Homo sapiens
agataggactttgatatattcttcattctgtgacttgatgggtagcctttcaatagcagttttaatacaaggtactgttaatatattttctgccattaggttgaggtggagagttctatggttctgttt

SEQ ID NO: 6863541 - DNA, 71 bp, Homo sapiens
ggcttctcttggctctgatggggatcaggagcaagcttcaagctcagaacctctaacagagccccagagcc

SEQ ID NO: 6863542 - DNA, 57 bp, Homo sapiens
ctctgtcctcacagcctttttgcagttcaacaaacacaggccctgccagggacggag

SEQ ID NO: 6863543 - DNA, 62 bp, Homo sapiens
ggttcatctgtgaaatggaatgagagtgaaatggaatgacactcaccacagagcagggaacc

SEQ ID NO: 6863544 - DNA, 65 bp, Homo sapiens
gtcacgcctgtatggttaattttcctgagtgagcgcctggcttggtaaggaccagcaggcgtgat

SEQ ID NO: 6863545 - DNA, 93 bp, Homo sapiens
gctttttttacacttgatgatacgtggttggtgtaaattctcaaaaacagcaaaatgtgaacatgtacagcgatcagtgtcattagctaaagt

SEQ ID NO: 6863546 - DNA, 76 bp, Homo sapiens
catcaagcctgtgtttctgctagtctcatgtgccacaaggtaacaggccaggcttggaagaacagtggcatcgatg

SEQ ID NO: 6863547 - DNA, 72 bp, Homo sapiens
tctggccaaccctcaagttgtatggaccactatacctttcaccctatacagttgagggagattggttccagg

SEQ ID NO: 6863548 - DNA, 73 bp, Homo sapiens
ctgtcatttgtgcaatgtagatgaacctagaggacacaatgttaggtaaaataaaccaggcacagaaagacag

SEQ ID NO: 6863549 - DNA, 95 bp, Homo sapiens
agagcatacacatccatgttgtaatgttcctcattgacacataattttaattataaggaaggaacaattaacgacaatggactttgaactgttct

SEQ ID NO: 6863550 - DNA, 64 bp, Homo sapiens
gtaatctctgctacttgggaggctgaggcaggagaattgcttgaacccaggaagtggaggctgc

SEQ ID NO: 6863551 - DNA, 78 bp, Homo sapiens
tgagcaactgcaggacagggccggaggccagccagatgccagcaactcagaggcacctgccttggcctgcatttctta

SEQ ID NO: 6863552 - DNA, 62 bp, Homo sapiens
agctcctgggggttccaagcaggagctccctctcctgtgtcctttctaatgcccagagagct

SEQ ID NO: 6863553 - DNA, 56 bp, Homo sapiens
gggagctgtgtgcctggatggtctcactggggtgatgacccaagctcatggctccc

SEQ ID NO: 6863554 - DNA, 65 bp, Homo sapiens
acctgggaggcggagcttgcagtgagccgagatcgcccactgcactccagcactccagcctaggt

SEQ ID NO: 6863555 - DNA, 119 bp, Homo sapiens
gttgtagactagttaattgtgctgtgtcaatcaatttcttggtttgataatacgctttagttatgcatgttaccattgaggggaagctgggtgacaggcacaagggacttctctgcaac

SEQ ID NO: 6863556 - DNA, 75 bp, Homo sapiens
gcctcagccacaaacctgagctctgtgtggcttgggtggaggtcccatcctgggcacagactcctgggctggggc

SEQ ID NO: 6863557 - DNA, 59 bp, Homo sapiens
gactgagcttctgcaacactggcaaggctttgccctcctaacagtgtcagaagacagtt

SEQ ID NO: 6863558 - DNA, 58 bp, Homo sapiens
ggacaggcaggtgatttccagagaattttccacagctctgtaagcaacctgaatgtcc

SEQ ID NO: 6863559 - DNA, 72 bp, Homo sapiens
gacagagcagaacatttcacagtatcttgtagtaaaagcaaaaactgtaaatgtttctcatgataagatgtc

SEQ ID NO: 6863560 - DNA, 71 bp, Homo sapiens
taaacagtcgtcttaatagtattcagctccaagaaagaaaagatgcaaggaatacgctgagatgaagtttg

SEQ ID NO: 6863561 - DNA, 69 bp, Homo sapiens
tattgatacccagatatactttatgttagggtttctccaccttggcactattaatatttgggtaagata

SEQ ID NO: 6863562 - DNA, 66 bp, Homo sapiens
aggccttgtattaatttgtttttcagattgagtctctgttactagcaatttattacatccgggtct

SEQ ID NO: 6863563 - DNA, 70 bp, Homo sapiens
cactaggttgaccaggctggtcttgaactcctggcctcaagccatcctcccacctcagcctcccaaagtg

SEQ ID NO: 6863564 - DNA, 130 bp, Homo sapiens
aaccttcaactataaagagtttgtttaactagaggcaggaagagctgattttcccttgaaatgcatggaaaattcattcatttttgtttgttttaaacttttaaaaatctggagttattaagggctgttt

SEQ ID NO: 6863565 - DNA, 62 bp, Homo sapiens
agtggctgctatgatcaggacaactaacgtggttgaactagaatggatcttaggaagtcact

SEQ ID NO: 6863566 - DNA, 58 bp, Homo sapiens
acaggcaagaggaaagcaagtaagaatgctttctgagctgctgtttctctctttctgt

SEQ ID NO: 6863567 - DNA, 66 bp, Homo sapiens
cattttgtctacaaaaagtgtacagacttagaattaagttctgcaacagttttctgtggtgaaatg

SEQ ID NO: 6863568 - DNA, 95 bp, Homo sapiens
gcaatcattttgtatctccagccaggaacacaatgccaagtttggaggagccaagcttggcattgtgttcctggctggagatacaaaatgattgc

SEQ ID NO: 6863569 - DNA, 69 bp, Homo sapiens
tcccctggtgaccctgaggatgcaccagcagggctcctgcttgctgtggcatctcagggagctagaaga

SEQ ID NO: 6863570 - DNA, 64 bp, Homo sapiens
ggcatgtggtcatctaactaaattttctttgattttttggagaagggtgtgggtgttacaggct

SEQ ID NO: 6863571 - DNA, 61 bp, Homo sapiens
ggtggatttatgctgagaaacaggcaacctaagccttcattatcaatgcatgaaatcagcc

SEQ ID NO: 6863572 - DNA, 56 bp, Homo sapiens
actggtctagaagggagaagacttagaatctgtttttggttctgcaataggctagt

SEQ ID NO: 6863573 - DNA, 86 bp, Homo sapiens
ttttgtcattgtacttttgtctaccctgattccagccattgtggaacttagatgtttgggtctacgtagaaagaacaatgagggaa

SEQ ID NO: 6863574 - DNA, 75 bp, Homo sapiens
cgtctgcatcagcctggcttcctgcacagtgtctgcgccggtgcacaccttagaggggagctgcgccatcagatg

SEQ ID NO: 6863575 - DNA, 74 bp, Homo sapiens
gtgcagagagcacatgagaggaaatcaaaacctgttcttcttagattttatttaccttatgtcctccactgcac

SEQ ID NO: 6863576 - DNA, 107 bp, Homo sapiens
tgttttatttaatgaggataaagatttctttagctcatcagatcatctttggtgacagaaccaggataaatggctgaagaaatagtttataaacagaccttgaaacg

SEQ ID NO: 6863577 - DNA, 128 bp, Homo sapiens
ctccgacgctaacccgctgctcccagcctccgcttcctgttttcgagggattagctaggactgtgcaacaccagtctccgctctcggagtcggcacgggggctggtgggtggcgggatgaactcgggg

SEQ ID NO: 6863578 - DNA, 56 bp, Homo sapiens
cggctatcagccagaggcctcacttcacttgcaagcaggcctcttcatgacagctg

SEQ ID NO: 6863579 - DNA, 130 bp, Homo sapiens
cttccctcccctcacaccttttacattctcttcccattgtctctggaatgtgttttgggtgggtgggtgtgggaggagattgaagaatgaagatggatgaaaggctgtgttccccaggagaggctgttag

SEQ ID NO: 6863580 - DNA, 98 bp, Homo sapiens
aggtatacttgacagtgagctctgattagtataatttatcactgttttgcacagagatgatattattctagcccagagcaaacacatttaatgtgctt

SEQ ID NO: 6863581 - DNA, 67 bp, Homo sapiens
ctcctggggtgctgatgaagatgtagccttcctttgaagctagtcattcagatcagctctacagggg

SEQ ID NO: 6863582 - DNA, 65 bp, Homo sapiens
gatgctgtgtgctaggatatgtttttagagtttcatctctaaaggcaactgaaagtagacagctc

SEQ ID NO: 6863583 - DNA, 71 bp, Homo sapiens
cttccagtagtatcattctcattcggaatacattaaattccattctatatgcagaataatctaattgggag

SEQ ID NO: 6863584 - DNA, 111 bp, Homo sapiens
tgaccggatggaccgcggcctgagagcctctcccagcggtctcattgtcacagtggtcctgctacaggggattagaagttccagttttgctcgaggtcaccctccaggtta

SEQ ID NO: 6863585 - DNA, 69 bp, Homo sapiens
gtgtgtaccatgaggacccctgtgtcacaggtgccaataataaatgactcagaaccctcgatggaccac

SEQ ID NO: 6863586 - DNA, 90 bp, Homo sapiens
tacaggagggaagtcagtaggagaaaggttgaatcaaagttttcccccctttggggaaacagctgcactgctgatgtcccttgccttgta

SEQ ID NO: 6863587 - DNA, 61 bp, Homo sapiens
gttttgcccatggcttttccaataaatgaaggcactattgggaaaagggcgatggcttggc

SEQ ID NO: 6863588 - DNA, 84 bp, Homo sapiens
tttgacctgtttccttttttggcttttgctttatattcatagtagagtgttagtagctctcaagataagaaagaacaggttaag

SEQ ID NO: 6863589 - DNA, 66 bp, Homo sapiens
cctcagttttcaggtctgtacaatgggatgtgaacaaaaatacctcccttgctaaagactgtgagg

SEQ ID NO: 6863590 - DNA, 98 bp, Homo sapiens
ggtagaggcaaaatggatgtatgcacaagaggctagaaaagagccatattgcattttgatcttctttttctgcattcgttcatgttatttcctctgcc

SEQ ID NO: 6863591 - DNA, 70 bp, Homo sapiens
ttgtggtgggacttctgcttccctcagccttttcagagtgggtggggaagaaccgggattcccattttag

SEQ ID NO: 6863592 - DNA, 108 bp, Homo sapiens
cttgtgagatggtttggtggtgagagtggggaggcaggggaagtgcgcagagagaccatcgcttccctctgctccttggtccatgacacaacatctatttctcagaag

SEQ ID NO: 6863593 - DNA, 104 bp, Homo sapiens
cctatgtaaacatcattaggactaggttctctattgcccccaaagatatattttagtatctcctgcaaagttagagctgaattttatgactctgttttcatggg

SEQ ID NO: 6863594 - DNA, 99 bp, Homo sapiens
gaggcaggaggatcgcttgaacccaggaggcagaggttgcactgagcccagatcgcgccattgcactccagcctgggcaacagagtgagactccgtctc

SEQ ID NO: 6863595 - DNA, 92 bp, Homo sapiens
ataggcagctgggcgagagggaatgtagcagagctaaaattgccctagactagtgatgcaaagatttatctttctccaaatccactgcttat

SEQ ID NO: 6863596 - DNA, 129 bp, Homo sapiens
tcatttctccaatcatgggagtgagggaaggatgtaggaaaggctgtttcatcaggactcattagggagggtgtcagtccagaggcagccacagcagagctttccttgtcttcaacctgggccaaatga

SEQ ID NO: 6863597 - DNA, 73 bp, Homo sapiens
tactttaatcttttttcagttttccaggtagccggtcactatgagccaccaaggaaattgagaccataaagtg

SEQ ID NO: 6863598 - DNA, 71 bp, Homo sapiens
atggctacacctattcctttatgtacagtgatggctgctttcacagtacaaaggcagaattgggtagttgt

SEQ ID NO: 6863599 - DNA, 59 bp, Homo sapiens
cctccctggtggctctggtctagcccctggtttaatcctaggattggggctaggggagg

SEQ ID NO: 6863600 - DNA, 65 bp, Homo sapiens
gcccagaaagactgcctaacaggccactacacaatatccactctgtttggcttggtattcagggc

SEQ ID NO: 6863601 - DNA, 80 bp, Homo sapiens
atgccaggtacaggggtagggtatgggcattagaataaacacataaatgaaaatacacgattccttcctcatgtacgcat

SEQ ID NO: 6863602 - DNA, 56 bp, Homo sapiens
ccagcttaaaaccatttatttagcttatgattttgctggatgtcaaattaggctgg

SEQ ID NO: 6863603 - DNA, 76 bp, Homo sapiens
tgagctttcctatcatcctccagtggtttattcatttatttatttattaaactgttggcacagaaaggaaagttca

SEQ ID NO: 6863604 - DNA, 59 bp, Homo sapiens
ctctagattacttctgatacctaattcaatgtaaatgctgtgtcagtagttgtctaggg

SEQ ID NO: 6863605 - DNA, 69 bp, Homo sapiens
aatggattgcgtaaatgaaatgcaaaatgatccacggtgatggattgtctgaatatgtatgtatccatt

SEQ ID NO: 6863606 - DNA, 57 bp, Homo sapiens
gcttaggaaggaagagcctcagattgaagtgcagatctgagaaatccttggccaggc

SEQ ID NO: 6863607 - DNA, 71 bp, Homo sapiens
gagaaccaggagctgtttgtgacaggctgtggcagctgcctagaaaagcagagacaagcttctgggaactc

SEQ ID NO: 6863608 - DNA, 79 bp, Homo sapiens
tttcttaggtttaggcaaactcattgtcagaaatattatgaacgtatttgagcagtttgtgctgaacgctatacagaaa

SEQ ID NO: 6863609 - DNA, 55 bp, Homo sapiens
tcagagaagcttaagctgtaatcaaactgctattacagtagctgaggttctcagg

SEQ ID NO: 6863610 - DNA, 73 bp, Homo sapiens
gggaggctggcctggtgcccccaagccagctgctccaaggagcagctttctccggggcctgctccctcttccc

SEQ ID NO: 6863611 - DNA, 85 bp, Homo sapiens
gtatgaaatttcttccaagcaacaactaatttacatattgaagcctaaatgtgtgggaggagtggttcttgcaagaatatcttac

SEQ ID NO: 6863612 - DNA, 70 bp, Homo sapiens
cggtggtcccaagagggtggcaagaacccccactaattttttctctctctagcttcttgaggcttggccg

SEQ ID NO: 6863613 - DNA, 90 bp, Homo sapiens
taggcagataacacaaataggttatgtgcttcaactgagcctactgcagtaggcagtggtaggaacttagatgaacacatgccctgccta

SEQ ID NO: 6863614 - DNA, 55 bp, Homo sapiens
gcctttggctctgtctgacctgggttctaattcttactcagtacgtggccaaggc

SEQ ID NO: 6863615 - DNA, 62 bp, Homo sapiens
agagtaaaggttggaatgaaaggtgtggtcaggggccattccaggcagaacaatcatgctct

SEQ ID NO: 6863616 - DNA, 57 bp, Homo sapiens
aggctgacttctagtaaagacctggaccttcctatggtcagctcttagaggtcgctt

SEQ ID NO: 6863617 - DNA, 72 bp, Homo sapiens
agcatggcttactttcagggagtatggcttctatatcaattatccatctcagagtttagagctgagccatct

SEQ ID NO: 6863618 - DNA, 56 bp, Homo sapiens
gctgtttgagagaacttctccagatggcttctagctggtttatttctcacaacagc

SEQ ID NO: 6863619 - DNA, 74 bp, Homo sapiens
cttttccattaacacctgtacgtggcacgcaatagacactcaatgtgtgacgagtgcatatgtggatggattag

SEQ ID NO: 6863620 - DNA, 64 bp, Homo sapiens
ttgcgtcaggcaaacctttctagagaatatcagttttattttagaaagaatagcctggctgcaa

SEQ ID NO: 6863621 - DNA, 92 bp, Homo sapiens
ggttccaagagggtctggaagcttctgagatgctctcagacctcacctgagggctgcctggtttagtgctgactccagaacccctgggggcc

SEQ ID NO: 6863622 - DNA, 61 bp, Homo sapiens
catctcagatccatcactggattttctagattttgtctagatttgtgtttgggatgagatg

SEQ ID NO: 6863623 - DNA, 55 bp, Homo sapiens
tcattgagcggttcttaacccatctctgcactggtgggacctctgccctcaatgg

SEQ ID NO: 6863624 - DNA, 80 bp, Homo sapiens
catgattttgcacaacacagggactcccaggagaagagcaagggagctattcaatctgcctttccctgtctgtgtttatg

SEQ ID NO: 6863625 - DNA, 59 bp, Homo sapiens
catcgacagccaagtcttctatttcagaatattgatttatttcgctttggcttttgatg

SEQ ID NO: 6863626 - DNA, 58 bp, Homo sapiens
gggctcatgtgtagcctcattgtcctcttgtaaaggggggataggcagccatgagccc

SEQ ID NO: 6863627 - DNA, 69 bp, Homo sapiens
ggtcccacagccagtaaggaaagacccagacctcccaggctcccttcctttattggctgcctgtggact

SEQ ID NO: 6863628 - DNA, 83 bp, Homo sapiens
gggaaaaaaggtagacccggagcacctgagccaatggggcctggccccaggcagggacgtgctctggtcctgaatcatttccc

SEQ ID NO: 6863629 - DNA, 84 bp, Homo sapiens
tttcaagagggttctagttcttaggaacagacaggaaaatggtgacaggtaattggttcctgggaggctggcacattctggaga

SEQ ID NO: 6863630 - DNA, 72 bp, Homo sapiens
aggcccgtgaatggacactccatcctgttgttacttggcaccagggagggtgtgcttcaagcagtggagcct

SEQ ID NO: 6863631 - DNA, 61 bp, Homo sapiens
ggcagcaggatatggtggagagagcgagtcttctgagttaaatcctggcattcttgcagcc

SEQ ID NO: 6863632 - DNA, 61 bp, Homo sapiens
tgggaaagtaattgtcatcctttcgaaaacacgaccttgaaagggttgctaacttgtccta

SEQ ID NO: 6863633 - DNA, 92 bp, Homo sapiens
gttgacttaaggtggcttcatagatatctatttcttattcaataattgtggctaaaagatatgctgtgacctggggccacacctaaattaac

SEQ ID NO: 6863634 - DNA, 78 bp, Homo sapiens
gggctggtttctacctgcatctccaggaggtggctgtcccttcagtgagcaggctgggagcagctgggaacacagccc

SEQ ID NO: 6863635 - DNA, 57 bp, Homo sapiens
ctccagagacacttctcatgattgttcaacttttggttctgtgaggtgtctctgtag

SEQ ID NO: 6863636 - DNA, 55 bp, Homo sapiens
agctctttaatcttagccccaggcttttcatctgtgggtgtgatgatgaatagct

SEQ ID NO: 6863637 - DNA, 71 bp, Homo sapiens
caagctaaactcagaacatgagaattagcattagaagatgtggttttgaatctcagttctgtgtaaccttg

SEQ ID NO: 6863638 - DNA, 71 bp, Homo sapiens
gactcggagcagtgatgggaggacgtcaattttgcaagggcagcattatttgacgctcttactgctcagtc

SEQ ID NO: 6863639 - DNA, 59 bp, Homo sapiens
ctgtggtcagctactggtcatctaagcagctactcttttgcagattggctgactgtcag

SEQ ID NO: 6863640 - DNA, 71 bp, Homo sapiens
cattctatttcacttgtgaagtcctttgcaatttgaattctaaaaagagaaatcacaagagagataaagtg

SEQ ID NO: 6863641 - DNA, 123 bp, Homo sapiens
ccccccttcactgtctttataaaatttatattctagttgtaagagacagatataaagcaaaataagcaaaatatgttttatactgaaatgtgcaatgaatggaaataaagcaggaggggtggg

SEQ ID NO: 6863642 - DNA, 65 bp, Homo sapiens
attcagcactgaaattcttcacatattaattgatcaaacgatgcatgtagtatcagtgcttgagt

SEQ ID NO: 6863643 - DNA, 64 bp, Homo sapiens
tcaggaattcctgggagacattttaaaaataccgatggctgggttctgttcccggggattctga

SEQ ID NO: 6863644 - DNA, 93 bp, Homo sapiens
ggtttgttaagggttagaatcacagtgccttcgtaaatttttcttagatggaggtgaaggtatgagtagatttattctgaaggtagacaaacc

SEQ ID NO: 6863645 - DNA, 65 bp, Homo sapiens
cagtgttgaggtcttcaggatcaggctctgggtcttcagaaaccgggtccagatcttcaggattg

SEQ ID NO: 6863646 - DNA, 101 bp, Homo sapiens
tgttgtaagttaagacttgttttgtgtgcctttcttcccaagtagatgtacagccatgcatcacttagatggggatcatcacgtgagtttttgttgcagca

SEQ ID NO: 6863647 - DNA, 91 bp, Homo sapiens
cacttctgggggagttgcatcctgttctaggtttgggacactggagttctaatatttttaaggacacaaaagatgactcttctagcatgtg

SEQ ID NO: 6863648 - DNA, 59 bp, Homo sapiens
tttgtcatggtagctgaaggatgtctcaatcagcaacatctggaaagttacttgagaaa

SEQ ID NO: 6863649 - DNA, 70 bp, Homo sapiens
tacaacacctgatattatctctttcaagacaaaatgtctttctagaaatagagatagagttggccttgtg

SEQ ID NO: 6863650 - DNA, 63 bp, Homo sapiens
gcagctatctgatctgacaaggtctggcttccaggagccatgtgggattttggtgtctgttgc

SEQ ID NO: 6863651 - DNA, 130 bp, Homo sapiens
tctagctatgtcttttaaactgctgccagatatgttcttccttttgtaccttctgaaatctgtataacctggggttcaacaaggctgtcaaaagtttcaagaactgatctgatgaactacattaaagcta

SEQ ID NO: 6863652 - DNA, 58 bp, Homo sapiens
ggcagcatctcatatcttcaggtctggatccctgaggcactcacatctgggagctgcc

SEQ ID NO: 6863653 - DNA, 89 bp, Homo sapiens
tcaagagattttgaaaatcctgaatactgtattcctcttttggggtttcccaatgaacattattgtattaaggattcaagtactcctga

SEQ ID NO: 6863654 - DNA, 67 bp, Homo sapiens
tcttagctgttccctcactgcagtcactgcaagcagcctggtgcagtccaaagggagcagagctgga

SEQ ID NO: 6863655 - DNA, 100 bp, Homo sapiens
ctgctaccccttagtggagaggcagcagagtttgggagatggtattacctgtccttatcatctcagactctgcagtcattctgtttgtttgggtttgcag

SEQ ID NO: 6863656 - DNA, 80 bp, Homo sapiens
ctgcagcctaggtgcagctgggccacagggacccggtgagggtggggactgtgcggggccagcctgcagcccaggtgcag

SEQ ID NO: 6863657 - DNA, 87 bp, Homo sapiens
gacaacggtgatatcaagacataagtgctatgacattgtttagcatagaataggtgataaacaacttatgttattgagaattctgtc

SEQ ID NO: 6863658 - DNA, 61 bp, Homo sapiens
caggtgttgcagttgaagactggtaagtttgccaatcagatcttccaacactgacaccatg

SEQ ID NO: 6863659 - DNA, 74 bp, Homo sapiens
gcaaatgaatgtaaaattgcctacaagacagaataggtcagagaaggcaattttatggttcttttttcattggc

SEQ ID NO: 6863660 - DNA, 77 bp, Homo sapiens
agaggctgatttcactcttcaggattgaaacgctctggtagaaaagttgtggagcaatctttaaggactcagtctct

SEQ ID NO: 6863661 - DNA, 85 bp, Homo sapiens
catttattatttgactctcttccacaataacattggttctgcttcagtttgtgttgagactgagggagtcagctatctacaaatg

SEQ ID NO: 6863662 - DNA, 108 bp, Homo sapiens
ggaacctgcatcccctcatttactcctcagagcagctctgtgcctggagacttgaaagatgagggaagccaggcccagagatgctagtgagtggggtggcagggatcc

SEQ ID NO: 6863663 - DNA, 80 bp, Homo sapiens
ggagacttttagggatgatttgggccttcagggattcctttgaaatacaggagagggccacagctcaattaaaagtcacc

SEQ ID NO: 6863664 - DNA, 57 bp, Homo sapiens
aagtattagacagcctgtgggcgtaagatcttgtagcccactgttgtcctagtactt

SEQ ID NO: 6863665 - DNA, 61 bp, Homo sapiens
gccagtactttgtgcaacaaatgtaatagtaaataaattttatttgttgaaggtgcttggc

SEQ ID NO: 6863666 - DNA, 55 bp, Homo sapiens
tgggaggcagaagttgactggaggtgacacaggtgttcagtgaactctaccccca

SEQ ID NO: 6863667 - DNA, 55 bp, Homo sapiens
tgggaatttagacttgtatgagctctcctatctcgtttcaagtcagcaattctca

SEQ ID NO: 6863668 - DNA, 60 bp, Homo sapiens
aaatattggccagacaatctgatgagtggacactattccagttcaaattggccaatattt

SEQ ID NO: 6863669 - DNA, 86 bp, Homo sapiens
ttctgggttattcttagggaaagttagaatgatatcaacgatattttctgtctttgaattcaaactgttcaaaagaatgttcagaa

SEQ ID NO: 6863670 - DNA, 127 bp, Homo sapiens
ttccctgcctgagagagctctgggctttttctaagaacataacagaagctgtgtgggggagaacctcaaagctgggctaggtttgtttcagaaagagcagagagtatatatgtaaaagagcagggaa

SEQ ID NO: 6863671 - DNA, 77 bp, Homo sapiens
tcaggtggaataaccttacttattacatgggtcttctctgagttcagttttaagtttaggttcttcttttaccttga

SEQ ID NO: 6863672 - DNA, 124 bp, Homo sapiens
tgccatgtccagctcagcaaagtggcaaaggtttcactagggtatggcttctcatgatgcagtaccctgcacacagaacctcatagcctctctaaacgtctttacactctggctgggactggca

SEQ ID NO: 6863673 - DNA, 86 bp, Homo sapiens
agagtcccttgaacccaggaggctgaggctgcagtgagccaagattgcctcactgcactccagcctgggcaagagcatgagactct

SEQ ID NO: 6863674 - DNA, 71 bp, Homo sapiens
ttgtcccaaagcgttcagtaatgttttcttattttatctctttaagcaatactaagtgacttttgggatga

SEQ ID NO: 6863675 - DNA, 89 bp, Homo sapiens
tttaaaagttcatggaagccagatttcactcttaattgagtttagttgagaaacatgagatgtggtttctgtttctgtgaattgctaga

SEQ ID NO: 6863676 - DNA, 56 bp, Homo sapiens
gggtctggcctccgggcaggtgggatccatccaccctggactcgaggcccgagccc

SEQ ID NO: 6863677 - DNA, 62 bp, Homo sapiens
agtcagttagcgtaatcactgggggccttgccgggcctacagcagagctacactaactttct

SEQ ID NO: 6863678 - DNA, 63 bp, Homo sapiens
tcaggggactggttgctttcttgcctgacctagaatgctggtggggaaacagcacacttttga

SEQ ID NO: 6863679 - DNA, 111 bp, Homo sapiens
tctgctttgggtcacctcacctgaggactacatctcaccttccaggacacgcaggcaatggctagtgtcttggtgaggtgtggggctccctgaactggcctctgctgcagg

SEQ ID NO: 6863680 - DNA, 59 bp, Homo sapiens
ttttctccctccatgaccttactgataagaagtggccatcccggtaatggaggggaaag

SEQ ID NO: 6863681 - DNA, 89 bp, Homo sapiens
attatgatttgctagggaagaccaataatcacacaaataaaagtcgaatttgcaaatgtggttagggctttgaaggggaggaccatagt

SEQ ID NO: 6863682 - DNA, 64 bp, Homo sapiens
caaatgctcagcattcaagtgtgtgcatgtacacacacacacacacatgcatgcttgccatttg

SEQ ID NO: 6863683 - DNA, 65 bp, Homo sapiens
cgtagatgagggtactgaggttcagttggtgatagggaaagaaaccagccctttatcctcctatg

SEQ ID NO: 6863684 - DNA, 122 bp, Homo sapiens
gcttccatgagaacttcttcccagaacttctacagagcctgggggcgcagaaaccgggtcctggacgctggtcctccttgccttcagatcctgatgggggttggagggggttgcactggagc

SEQ ID NO: 6863685 - DNA, 64 bp, Homo sapiens
gctgggctgtcccaaccccatcccctgggagtttcagcacaggatgcactgggactggccaggc

SEQ ID NO: 6863686 - DNA, 57 bp, Homo sapiens
ggcagtctagctaggatgtcacccacaggaggggatacaaaccttgcaggacatgtt

SEQ ID NO: 6863687 - DNA, 67 bp, Homo sapiens
cagtagtggtctatcactggagtgcagtggggagaaacaaagcaaaacacagctgaggaccaaactg

SEQ ID NO: 6863688 - DNA, 65 bp, Homo sapiens
gacccatttactaaatgctctggagagcttcaagatctgaatcaggcccagagcaggaaagggtt

SEQ ID NO: 6863689 - DNA, 76 bp, Homo sapiens
tttacacctgtgtctgtggaatagcgaatgaatattcccatcattgtccgactccacagacatctccttgtgtaaa

SEQ ID NO: 6863690 - DNA, 101 bp, Homo sapiens
ccctcaggctctcaccttgtttcaaagctcagccctccaatgaagagcttcctcagctgttcggttctttaggagactctgacttaggcatgagggcaggg

SEQ ID NO: 6863691 - DNA, 63 bp, Homo sapiens
tcccaagcttggggtgggcaatgtaggcaagtcgatcgagcttgtggctgacaccctttggga

SEQ ID NO: 6863692 - DNA, 64 bp, Homo sapiens
tttgttcctgccagctctctaaaggggaatgcttatggccctgggaagagctgacaggagggag

SEQ ID NO: 6863693 - DNA, 59 bp, Homo sapiens
ggtccttcagtaggttccagacgtgggtgtgtgatagtgtcaggaacacctgaatgatt

SEQ ID NO: 6863694 - DNA, 61 bp, Homo sapiens
tatattctcatgctgcctatatctgtttgggaactggagagaaggcagtcattggaatata

SEQ ID NO: 6863695 - DNA, 82 bp, Homo sapiens
cacaccatttatttcaataaatacattgatagcttgaattggtgccattcttttccattaaggtgtcaatgtatttggtgtg

SEQ ID NO: 6863696 - DNA, 83 bp, Homo sapiens
ctgtcttctctgtatgttttaaatcggaatgtttcaaaatgtcctgaaatcattactcctgtaaaattgtccagatgaaacgg

SEQ ID NO: 6863697 - DNA, 57 bp, Homo sapiens
tcctgggagtaaaagctgccctgaagagggaatttatggcagcctcatttcccagga

SEQ ID NO: 6863698 - DNA, 63 bp, Homo sapiens
tagtttctagagataactcaaccatctgaatttttcaatagatggctgatcactgggaaactg

SEQ ID NO: 6863699 - DNA, 56 bp, Homo sapiens
cagatgaggccacacggggtgggcaccctgtgcctgcccagcgcctggcccatctg

SEQ ID NO: 6863700 - DNA, 77 bp, Homo sapiens
ttcattttggttggaattaggcaggtggtacctgaagcccttctacatacatttgttctgatttcaaaaggaatgag

SEQ ID NO: 6863701 - DNA, 65 bp, Homo sapiens
acattatcctgcttttaagcctcaaattatggccaacccagccattagtgaaggaaggatgatgt

SEQ ID NO: 6863702 - DNA, 66 bp, Homo sapiens
atttcaccttgtaagcaaatggaaggctttgagtaacatgatcgcaagcaggctgcagggtgaaat

SEQ ID NO: 6863703 - DNA, 71 bp, Homo sapiens
acatccactagaatgacagagttggcaggaatgtggagcaactggaactctcatgcattcctagtgggagt

SEQ ID NO: 6863704 - DNA, 77 bp, Homo sapiens
ttagtcacctctgtacaaatggcagttgagttcagttctcactgaactcttttcccttttgtaatagttattactga

SEQ ID NO: 6863705 - DNA, 65 bp, Homo sapiens
gagatagcactcccacacctgctgactgttgactctgtgtgggcagggcatgaggtgtgcttctc

SEQ ID NO: 6863706 - DNA, 86 bp, Homo sapiens
ctagaacggaatgtattgtttggaggaaatgaaagatgatttaccatcataaacttgttgcttttaattaatcattgctcttttgg

SEQ ID NO: 6863707 - DNA, 81 bp, Homo sapiens
aaccattaacataggaagctggtttttgtttgttttactgttgttttaatacagtttagaaaatctgtttcttcaatggtt

SEQ ID NO: 6863708 - DNA, 95 bp, Homo sapiens
atcatttccaaggtgttcaggttttcccattttagcatcctgcaaaagacatccactttgcagttgatggggtcttagaatcctttaaacatggt

SEQ ID NO: 6863709 - DNA, 73 bp, Homo sapiens
ggggtgatttccttgaggccacagtatcagaacagtaaaatctgttgtgaaatgtccatcaaccagacaccct

SEQ ID NO: 6863710 - DNA, 56 bp, Homo sapiens
tgaatcacggtgttattaaagctcgaccatctggttcagcagcaactgttgattca

SEQ ID NO: 6863711 - DNA, 65 bp, Homo sapiens
gaggcctcttctttgttaacctctgtacctgtgttttgtctctgctcgttttcagagaagacctc

SEQ ID NO: 6863712 - DNA, 66 bp, Homo sapiens
gagccatgtgaaattgccaatatttgactgtcttcgatctacaaagctggtcatttctaatggttc

SEQ ID NO: 6863713 - DNA, 63 bp, Homo sapiens
cactaaccatattcacactatgcccagtgtgtgtgctgtgctgtgtgtgtgtgtgtgtgtgtg

SEQ ID NO: 6863714 - DNA, 102 bp, Homo sapiens
tctcctttttgaaattccttttcttttatggttactttaattctgttcacttttgtgagcaatgactttgaaatcatgactcggaaaggtcagagaaagaga

SEQ ID NO: 6863715 - DNA, 92 bp, Homo sapiens
gagtttgggtcagagtagtgtgttaatgaggacaagttttgagggtgaatctcataaacattattcattattcattattcttatccacagtc

SEQ ID NO: 6863716 - DNA, 88 bp, Homo sapiens
gcattagattcttataggagtgcaaactttattgtgaccttcacatgtgagggatctaggttgtgcactccttataagaatctaatgc

SEQ ID NO: 6863717 - DNA, 67 bp, Homo sapiens
attggcagtaagactctttcttttacccttggtgtcacaagggcatttggggaattttgctgttagt

SEQ ID NO: 6863718 - DNA, 70 bp, Homo sapiens
catcattggagtctactttctctccttttttgcctactcagcagaaagggatgaggtagctgctatcatg

SEQ ID NO: 6863719 - DNA, 73 bp, Homo sapiens
agcctcttgggcccaaaggagtcttggaccaagctgggaagttggtcaatcttgcctctggcgtctaaaggct

SEQ ID NO: 6863720 - DNA, 71 bp, Homo sapiens
gcattgcttctctcttctggtcctaatcccccctgtggggaaactgaggccagagaggggaccagccttgc

SEQ ID NO: 6863721 - DNA, 70 bp, Homo sapiens
gttgttttttgtctttcaagttttgctccagggcagagttcccaaaagtagagctcaaggcaaaaataat

SEQ ID NO: 6863722 - DNA, 66 bp, Homo sapiens
cttggcaagagatggcccaggggtctgtgcccaagaccccggtctcctgggctttggcttgttggg

SEQ ID NO: 6863723 - DNA, 55 bp, Homo sapiens
tagataggggtcatctcaagaaggaccataaaagccttcttgagacctcagtctg

SEQ ID NO: 6863724 - DNA, 60 bp, Homo sapiens
tcctgcagcatccgtcgtctgtatcatatgatggtcctcgataccaggatgttgcagaga

SEQ ID NO: 6863725 - DNA, 83 bp, Homo sapiens
tgcttctctcatattccttctttgagaataagcacataatgatatatttgcttgaaagtgggaaggaacaaatgagggaagta

SEQ ID NO: 6863726 - DNA, 73 bp, Homo sapiens
tgagccctagcaggacagagcccagactgtgtgctccctgcagcacagtgcccctatgccagctaggagctca

SEQ ID NO: 6863727 - DNA, 102 bp, Homo sapiens
tatgtggataacagatgcacattctcatcagcaaccagtcacatcacttcttccaatgtctgtctgttggtgctgggtcatggtgcatttcttatcagtata

SEQ ID NO: 6863728 - DNA, 67 bp, Homo sapiens
ttgtgctggtggaatggcagagggaacttcacaggaaccttagtgttcttttacctcaaagccacag

SEQ ID NO: 6863729 - DNA, 62 bp, Homo sapiens
agatatatgtgggttactgggaatgcgtgatggtgaagtcacagatgacccacatggtgtct

SEQ ID NO: 6863730 - DNA, 74 bp, Homo sapiens
ggagtgttcagtttttttaaaaaagtataatggaaagccattggagagttttaagaagggaaacaccatgatcc

SEQ ID NO: 6863731 - DNA, 72 bp, Homo sapiens
ttgagatggagtctcgctgtgttccccaggctggtcctgaacccctgggcccaagagagtctccaacctcag

SEQ ID NO: 6863732 - DNA, 94 bp, Homo sapiens
ggtccttcctcaggtccgaatcagaaactttggagaatggcactactgtttaacgagaccttcaagtaattctgatggctagagtttgaggacc

SEQ ID NO: 6863733 - DNA, 84 bp, Homo sapiens
tacttctgtgggtgtttgtgttgatgaggatttgagccattttatgtacaggtcttcattcaacaaatattcattttccaggtg

SEQ ID NO: 6863734 - DNA, 99 bp, Homo sapiens
atagaattaaatatttgaacagggcttgtgacaactttaatttagttgaaaggaactgaaaacttaatgtgtgtacaggattttgtgggagcgttctgt

SEQ ID NO: 6863735 - DNA, 56 bp, Homo sapiens
ctctgagagagctggtgagcacccccaagccccttgcatcactctctctctcaggg

SEQ ID NO: 6863736 - DNA, 80 bp, Homo sapiens
ttccaacatggctcatgagagatttggggatttatttaaccgcctttatccaggcaaatctcctagtgaccttgttggga

SEQ ID NO: 6863737 - DNA, 76 bp, Homo sapiens
gtctattgtggctgctcactgaaggaccctgtcacattctagagcagggtttgttggtgtagcccgagttacggac

SEQ ID NO: 6863738 - DNA, 72 bp, Homo sapiens
tacggagaggtgggcagtcatgaaatctagagagatgttctctggagttttttctgtctgtgccttagtgta

SEQ ID NO: 6863739 - DNA, 81 bp, Homo sapiens
gggatgtgtagggaagtgaaatgtacaaccatgggtcatgccccaacaaggaaggtgcacgcttcctctacctgctctccc

SEQ ID NO: 6863740 - DNA, 77 bp, Homo sapiens
tctgggtctaattattgtcctgtgtaattcaatgggaattctcacagtgaattacatagacgtgaatccagcccaga

SEQ ID NO: 6863741 - DNA, 73 bp, Homo sapiens
gtggagtgcagggtatgtggaagcagacagttgaggcctcagcactgcccttacatgccctgcatgctcccac

SEQ ID NO: 6863742 - DNA, 113 bp, Homo sapiens
ttttttgggttttattttgtatttggcagctacttccccagtgcctacagtggtgccccatgctccataagcctgggggaatatttgttgaatgaatgaatgagtgcaagaaa

SEQ ID NO: 6863743 - DNA, 73 bp, Homo sapiens
agtggcagtactttatcacatggaatcagctagtgtttacttgaacaattctgtggatgggagttctgctatt

SEQ ID NO: 6863744 - DNA, 87 bp, Homo sapiens
gtcggatgaagatctgcagcctcaggatgaagatctgcagcctcaggatgaagatctgcagcctcaggcgacgctcttcagtgcgac

SEQ ID NO: 6863745 - DNA, 105 bp, Homo sapiens
ccctattttcaaataaggccacattctgaggctcagggagtatatgaattttgggtgacactgttcaaccccctagagttggggagagtggctgttggtctaggg

SEQ ID NO: 6863746 - DNA, 76 bp, Homo sapiens
gcctctctcattcttcagtggctttgttttgccagagacaagacagggctattttgacaggatggtcaggagaggc

SEQ ID NO: 6863747 - DNA, 56 bp, Homo sapiens
ggggaggtgtgcaggacacctcagtttgtcctgactcaggctgcctcaccctccct

SEQ ID NO: 6863748 - DNA, 58 bp, Homo sapiens
aaggatggagtgccagggtggaactaagcactccttagtcactttgctactctgcctt

SEQ ID NO: 6863749 - DNA, 55 bp, Homo sapiens
agactgaaggtctcagcatgtgaaaggtaccacccctcacaaggcctcttagtct

SEQ ID NO: 6863750 - DNA, 130 bp, Homo sapiens
aatcagtttatatcaaatattttgtatgatattttatgataacatgaaaagtgcttatgatataactaattttaagggctgcatttgatgtgtcataatatacaaaattcattttgaatctagatagatt

SEQ ID NO: 6863751 - DNA, 57 bp, Homo sapiens
gctccattcaagtagttacagtggtggcatgcacaattcctaactgcatgagtgggt

SEQ ID NO: 6863752 - DNA, 59 bp, Homo sapiens
caggaatgtttgtgctcctttagagatttgtaattaagaagaggcagaactcgttcttg

SEQ ID NO: 6863753 - DNA, 85 bp, Homo sapiens
gtccggtctttggcaaggttaacaccacagctgggacaaattcgaggtttgtgcctgttggtgtagacatagctacaagagggat

SEQ ID NO: 6863754 - DNA, 63 bp, Homo sapiens
gctaagaagtgtttgcccagccatatacattgaaacaaatatgcctgggtcttatttctaagc

SEQ ID NO: 6863755 - DNA, 55 bp, Homo sapiens
tctctagtgaagggctttccaatctttgtagttgggaaagaactgctgcttgaga

SEQ ID NO: 6863756 - DNA, 72 bp, Homo sapiens
ttggggagcctgtgggatgagatgtgtcagagaagaggccagggcaggaccatttcacacggggctttttga

SEQ ID NO: 6863757 - DNA, 68 bp, Homo sapiens
agtaggctgttttatgggccaatattagttccctattcccagtactgattacataaaacagttctatt

SEQ ID NO: 6863758 - DNA, 63 bp, Homo sapiens
cccaactttctgttacgtccccagagacctttttagggatttggaagacagggcaggaaaggg

SEQ ID NO: 6863759 - DNA, 64 bp, Homo sapiens
tcatacatgttgtgttcaaatggtggattctgaatttcagtatacttatgaatatcaggtatga

SEQ ID NO: 6863760 - DNA, 85 bp, Homo sapiens
cctccaagaccctaaggccgggcaaggtaggcaagaagataggtctctgcctctttcaggcctggcacactcagggggctggagg

SEQ ID NO: 6863761 - DNA, 79 bp, Homo sapiens
taagcaccaaggagccacatacaacctagaccttcacaaattaattcctattgctactggtctccttggcctctgctta

SEQ ID NO: 6863762 - DNA, 76 bp, Homo sapiens
gcctcaaatggaattatgcaaccaatgaccacgactttcccagacgctgttcacaggctgcataatgacgaagggc

SEQ ID NO: 6863763 - DNA, 61 bp, Homo sapiens
gagtcacacagcttggagttatggttcaaacttggatcacctggctctgagtttggtattc

SEQ ID NO: 6863764 - DNA, 57 bp, Homo sapiens
gctacccggaggctgaggcccttgagctgtgccatggcgtgttggatctggattggc

SEQ ID NO: 6863765 - DNA, 66 bp, Homo sapiens
tctcatttacacttcacaaatggaagtcaaaaaataccacctctattatggagatgtgaaaagaga

SEQ ID NO: 6863766 - DNA, 71 bp, Homo sapiens
ccacatccccgcggaaggcatctggatggaggaggagctgtcctcctccccaccaggcctgctgggattgg

SEQ ID NO: 6863767 - DNA, 79 bp, Homo sapiens
ggcatgattcacctttatttcattgggtttaccacttacagagcccaagtcaaccatgtaaagctatgaaatttatgtt

SEQ ID NO: 6863768 - DNA, 88 bp, Homo sapiens
tgctaaataattgtggaacagtattttaaaagctatctggcaataacatataaagtagctttagaatgatgcttttgcagtcacagca

SEQ ID NO: 6863769 - DNA, 88 bp, Homo sapiens
ccagcccagcctcagcacagcgtgtccctgcggatgccaaaggtcaccagacgcatgcaggataggttgagctctgagccagggctgg

SEQ ID NO: 6863770 - DNA, 77 bp, Homo sapiens
gagcctgatccctagctgtttctcctacatactatgtgatgacaggcattgtgaaggagcatgcagaggggtggttc

SEQ ID NO: 6863771 - DNA, 89 bp, Homo sapiens
tccatctgtttgtcttaaattaggactctagttctggaatcaagcttgagactctgagaacttagggcctaattttactttactgagga

SEQ ID NO: 6863772 - DNA, 71 bp, Homo sapiens
ccttgaacctgggaggcggaggttgtagtgagccaagatggcaccattgcactccagcctcccataatagg

SEQ ID NO: 6863773 - DNA, 69 bp, Homo sapiens
aacctgaaatttgaatggcttaacacaacgaaagtttcctttttgtgtgcataaattctgatgtaggtt

SEQ ID NO: 6863774 - DNA, 71 bp, Homo sapiens
gttccagcttataggtagatttaaaatttgtctggttggcaattggttgagtttatctaaagacctgggat

SEQ ID NO: 6863775 - DNA, 59 bp, Homo sapiens
cctgtttatccatgccaatccttgcaccctcttcagagttttagcatgaatgcagcagg

SEQ ID NO: 6863776 - DNA, 56 bp, Homo sapiens
tcccttgtcctcttcgtcactgaagaaccagtctgactgcagagaagacaaaagga

SEQ ID NO: 6863777 - DNA, 71 bp, Homo sapiens
tccccagcgcccaagcccaggctgccggtccggtctgggtgccaccgaggtcctggacttggccctgggga

SEQ ID NO: 6863778 - DNA, 55 bp, Homo sapiens
tgggaatgatagacacagtgaacggtccaagactgaaatgaaatctatcatctca

SEQ ID NO: 6863779 - DNA, 62 bp, Homo sapiens
ggagagagagattgtgtttattctgaactatggcataaattaatctggcaatttgtttctcc

SEQ ID NO: 6863780 - DNA, 58 bp, Homo sapiens
cagtgtgtggattgcccttgcaagctccttggccctgcgctctggcattccggcattg

SEQ ID NO: 6863781 - DNA, 80 bp, Homo sapiens
gccattgaatccttgcagaggtctcgcctctcccatgggcagggacccggtgctgaggccttggcagggagggtggtggc

SEQ ID NO: 6863782 - DNA, 88 bp, Homo sapiens
ccatgcatggagattttaatagtatatctagacactaatatctctaccctgaagttgttgctatgttattgttatcactatgtagtgg

SEQ ID NO: 6863783 - DNA, 60 bp, Homo sapiens
tgggggtgctatccttttgacataatctgaacctaattacttccaaaggacccacctcca

SEQ ID NO: 6863784 - DNA, 58 bp, Homo sapiens
ttgttatggagcatatctgcatcatttttatggttgatgatgtttgcttgagtaataa

SEQ ID NO: 6863785 - DNA, 93 bp, Homo sapiens
cctgagtcagggagaggttggggaggtgggctaaggactctctcgagctatgactgagagctctcctgtcccctccctgagccctgaggcagg

SEQ ID NO: 6863786 - DNA, 57 bp, Homo sapiens
tctgataatacctggcttctttcaggtctggaaagaggtgtcttgcttattgttaga

SEQ ID NO: 6863787 - DNA, 58 bp, Homo sapiens
ggaaggctccatacacaaagcaaaagggctacactttgatttctgaatggaacctttc

SEQ ID NO: 6863788 - DNA, 68 bp, Homo sapiens
tccattttctcttccggaggtgtgcactaaaatttgtactcttcctctatgggaactttgacagtgga

SEQ ID NO: 6863789 - DNA, 97 bp, Homo sapiens
tttgataaccaaaccatatttttgctaaaaggtgaaaagtgtatgcatatatacatatatgttactttttagtaaaaaatatggtttggttatcaaa

SEQ ID NO: 6863790 - DNA, 63 bp, Homo sapiens
tttctctcctccaaaccaaagagagcccttagtttaagctctcttcattttgtaggaaaggaa

SEQ ID NO: 6863791 - DNA, 59 bp, Homo sapiens
actttcacagtcctgactgagcggccttggataagccctcagtttccacactgtaaagt

SEQ ID NO: 6863792 - DNA, 82 bp, Homo sapiens
gccacagctttgggattctgtaaagataaaagatgcaccagagggattcctaaatgctttgtcttcatccttcgagctgggc

SEQ ID NO: 6863793 - DNA, 60 bp, Homo sapiens
caggcccagtgatcagggctctggagccagcagttctgggagtctagggtcctgggcctg

SEQ ID NO: 6863794 - DNA, 82 bp, Homo sapiens
gagtaaaaggatctgggctgcagtccagtctgagagatgccagcaaaggcttcctaggctaattcagtccagtaaatccctc

SEQ ID NO: 6863795 - DNA, 109 bp, Homo sapiens
ctctaacacattgtcactgagtgggctagagcattccaaactctttccctgtcgtttctccttaagatgcagaccagacttaggagcatagccctcagtcgcatcagag

SEQ ID NO: 6863796 - DNA, 64 bp, Homo sapiens
atgcctccaaaacatatgccctacttatgccgccgtagtatgagcaccagggcttttgagacat

SEQ ID NO: 6863797 - DNA, 59 bp, Homo sapiens
cttcacatgttggagtcctttgcttccagactagaggactgggactggaggatgtggag

SEQ ID NO: 6863798 - DNA, 88 bp, Homo sapiens
ttgatctcccgttgctgggtgcccaccggattgcctactatatactttgaataagcacgtctggagccccagtcaatgaggatttcaa

SEQ ID NO: 6863799 - DNA, 94 bp, Homo sapiens
gaatctgctcatgttctgtatattgaggttatagttggctcaaatatataaccatctgctatttctatattataaagaaatgaagtgcagattc

SEQ ID NO: 6863800 - DNA, 65 bp, Homo sapiens
ctattctggtttccggatctctaaaagtatttcagattttaggaagctgatggaactagaggtag

SEQ ID NO: 6863801 - DNA, 75 bp, Homo sapiens
ctccaaactcaagtcaatcaagggtgtaggcaagtgtaaccactgcatgcactatctagatgatgaactctggag

SEQ ID NO: 6863802 - DNA, 63 bp, Homo sapiens
aatttcacataaggctcattggccagagctgtcacctggccactcagagctgtatgggaggtt

SEQ ID NO: 6863803 - DNA, 59 bp, Homo sapiens
gctacttggtactcaatgtccagaataaactagaacaggttattgacctccaggctggc

SEQ ID NO: 6863804 - DNA, 56 bp, Homo sapiens
gaatgaactggatcagggtttctctaacaatgttggagaggaagtcaggtttattt

SEQ ID NO: 6863805 - DNA, 101 bp, Homo sapiens
gggttcctggcgggggagttgcagcctggccgtttcctggagggctgggactgcccagcccagccgagggcctggctgcagcgccaccttctaggcagccc

SEQ ID NO: 6863806 - DNA, 62 bp, Homo sapiens
tgtgttcattctgtgacatgcatgtagcatgatatgcatacagcatatacagaatgaacaca

SEQ ID NO: 6863807 - DNA, 59 bp, Homo sapiens
gggagtcagagaggtaatgggaactcactcattggttctcggcctactagttgattcct

SEQ ID NO: 6863808 - DNA, 79 bp, Homo sapiens
ccacttcgcggctgcgcactttggaatgcccccggttactgtggtaaccagggcagccgaggtgtgtcctcggggctgg

SEQ ID NO: 6863809 - DNA, 75 bp, Homo sapiens
cactaatggtgcaggagtgtgtctaatactcacccacggcctgcagtgagtatgaactttatttttgcacctgtg

SEQ ID NO: 6863810 - DNA, 105 bp, Homo sapiens
gtgtagggcatgggtgtggggtctctggctgctctgggtctgcccagctgcccttggagctaaagggatatcagagcagctgttaaccctttccctgttttaaac

SEQ ID NO: 6863811 - DNA, 63 bp, Homo sapiens
caagggctgggctagggaggcagttcccagagctctgctgtcccttcccaagcccagcctctg

SEQ ID NO: 6863812 - DNA, 118 bp, Homo sapiens
ttctgtatcaaggcacattagtatgacctattagatttccttgccagaaattgatgttgagcagtaggaggtaagtttgagaactagttattcacatactaatagcacaaatactgaa

SEQ ID NO: 6863813 - DNA, 69 bp, Homo sapiens
ggagttatacagtgcacaacctgtgcagccacacacagctggccccgtacatgtaatgtactgtcctcc

SEQ ID NO: 6863814 - DNA, 63 bp, Homo sapiens
cagccagcctctcaaccatgcagagccaattacttcaacatgggcccgtgagaggcagggctg

SEQ ID NO: 6863815 - DNA, 76 bp, Homo sapiens
gttttttataataatggtgatagggaggggtcccagggattccatttccagactgttcacattggcattaaagaac

SEQ ID NO: 6863816 - DNA, 57 bp, Homo sapiens
gattgcaaggcatatagttccccagtttgaggtgaggctgggcacctgtctgcagtt

SEQ ID NO: 6863817 - DNA, 59 bp, Homo sapiens
gtaggcaaggctgtggccctggtctagcatttcccatgcaggatttacagcctcgctgc

SEQ ID NO: 6863818 - DNA, 129 bp, Homo sapiens
gatacttttggtagaagcgttgtgtaaaatgtgtggagtaaaaagtttttgcagataatgtgtttgacataccatattattatattggatgagactttcttccacctgcagatgtttctctttgtcttc

SEQ ID NO: 6863819 - DNA, 85 bp, Homo sapiens
taaaggcattttgaatatacttacagctttgatctgcaacaaatcctacatggagaaagggaaattaatgtgagcaatgccttta

SEQ ID NO: 6863820 - DNA, 66 bp, Homo sapiens
tagcttgactgttttttgttcctgaaggggaaatctccctctgggcctggaagggcagtgcatcta

SEQ ID NO: 6863821 - DNA, 85 bp, Homo sapiens
ggggcagttaccgaaggccctgttttccctatttttcatgtgaataaacgggggctccggggctttattcatttaacctgactcc

SEQ ID NO: 6863822 - DNA, 94 bp, Homo sapiens
tgaggagtggcctcgacctgcctgtgactcgtcttgggccagtaggggacgccctggcctcaccagacgagcgcagccatgggcgaccgcctca

SEQ ID NO: 6863823 - DNA, 61 bp, Homo sapiens
gcccttattgtgtcttggtttatcttttgtcacctactaaagagcatggcaagaaaagggt

SEQ ID NO: 6863824 - DNA, 65 bp, Homo sapiens
agcactggggcagtgggcagtggttcccggcgtgcaccggggcagtggctgctgcctccagctct

SEQ ID NO: 6863825 - DNA, 62 bp, Homo sapiens
tctgtgtggctttagacaaaattctgaatcatctctgaactttgttttatagcacataagga

SEQ ID NO: 6863826 - DNA, 62 bp, Homo sapiens
ctcagagggtacaggtgaacccaggtttgacatttggcctcatttccgcctctctctttgag

SEQ ID NO: 6863827 - DNA, 71 bp, Homo sapiens
cagaaaagcgaagagaactgaagtttgatggtcgtttagataaggaactttcagaatcctatgcatttctg

SEQ ID NO: 6863828 - DNA, 74 bp, Homo sapiens
caggtagtagatgatagggccagaatttgaaatttaaatttatttctgatttgtaatgtcatcctatacttctg

SEQ ID NO: 6863829 - DNA, 78 bp, Homo sapiens
ctgcacatgctctgtgtggttggcctgatctataagagactaaataatgaccaggcttgctgctagagcactttgtag

SEQ ID NO: 6863830 - DNA, 58 bp, Homo sapiens
gctttcagcaactaaagtctggattgatttttgtggtctagatgtactgctgaagagt

SEQ ID NO: 6863831 - DNA, 57 bp, Homo sapiens
tgctattgtgaatagtgccacaataaacacatgtgtgcatgtgtctttacagtagca

SEQ ID NO: 6863832 - DNA, 63 bp, Homo sapiens
agctgccttccctctcattagggtatgacttataggaaggagtgactgataggggtggcagct

SEQ ID NO: 6863833 - DNA, 91 bp, Homo sapiens
ccttttcctctccataaatctgttatctgctgctgtggctcagatgcctcatcctgaggaaggtgcagagatttttggggtggtctcaagg

SEQ ID NO: 6863834 - DNA, 59 bp, Homo sapiens
ataaatgtggcacactagaggcatggcataagagacaaataactggtggccatagttat

SEQ ID NO: 6863835 - DNA, 77 bp, Homo sapiens
atggtagctgcagggatgaacatctggcctcctcaacgaactgcttgaggccagatgtcatgtcttatgcttctcat

SEQ ID NO: 6863836 - DNA, 66 bp, Homo sapiens
cctggtttctgtagggtagtagtggagatccagaaaatttgccatctccatccacttcagttcagg

SEQ ID NO: 6863837 - DNA, 129 bp, Homo sapiens
cacagcacccaccttcacgtcgatcacgctccctctgggttgccgatttctaccctcaaggctgtagcctcgagggaccaggggtagctgagatattaagtgcggatgagtgtttgaggcgggtgtgtg

SEQ ID NO: 6863838 - DNA, 86 bp, Homo sapiens
gcaagcaatttttgatcaggtttttctcaaatcaggtcaaattcatgcatgatgacctggtgggcagagccttcatcaacggctgc

SEQ ID NO: 6863839 - DNA, 64 bp, Homo sapiens
tctgcccagccagacccaaggttttcagaacactccttagcgtggactctgggtctggagcaga

SEQ ID NO: 6863840 - DNA, 80 bp, Homo sapiens
ttggaatttgggctcccaggaggaaggagggatgtgcggtttcaggaagctgtgcatcttcttcctggaggctgttctgg

SEQ ID NO: 6863841 - DNA, 75 bp, Homo sapiens
tagagatgctgattatttcttgctagctctgtgagagcaatttcaacaactatcaagaggtagcagtgactgcta

SEQ ID NO: 6863842 - DNA, 130 bp, Homo sapiens
cttcacctcagagagagtttaaagtcttatttcagacttagtgagttctaagttttgtacaagactgaggtacatcaactgtgtccgaggtaaaattttcttttaactttcctgagtatttgtgtggaag

SEQ ID NO: 6863843 - DNA, 79 bp, Homo sapiens
ctttcatggtatctctgtaaaagaaatcacaacgtatctgttactgttgcatgtttataacagatgaggactatgaggg

SEQ ID NO: 6863844 - DNA, 83 bp, Homo sapiens
ttgattgtttccgctccccgcgtggatgacgtcctccgcccttggatgtggagtcaggatcctggggatggatgccaactcaa

SEQ ID NO: 6863845 - DNA, 104 bp, Homo sapiens
ttaggaaagtgcctcacatagtaagcagtcagtaaatagtagctcttgttattcattcaacaagtattgataaaatgctcactatgtgccaggcactctcctag

SEQ ID NO: 6863846 - DNA, 110 bp, Homo sapiens
gttaaaaaaaattggctttgagatccgattctgatgttcatgggccaagtgaccttgaaaatgtcatttcaccctgtctgaatcgttctcatctgtaaaatagaattaac

SEQ ID NO: 6863847 - DNA, 85 bp, Homo sapiens
tctagcagatgaaggtgtatgctgtgggtcagggacattgaagcagaaacttggcccttctccagtcacctctccctgtgctaga

SEQ ID NO: 6863848 - DNA, 77 bp, Homo sapiens
gcaatggtggcaattcaaagacagcaccatcaacacactgcttggcttgcccttcctctggattgccttcattttgc

SEQ ID NO: 6863849 - DNA, 72 bp, Homo sapiens
ccgggcgtggtggcactcacctgtagtttcagctactctggaagctgaggctggagagtcacttgaacccgg

SEQ ID NO: 6863850 - DNA, 55 bp, Homo sapiens
gctcctgaccgtgactgcctgctcatcccatgcctggcagtgtcatggtaggagc

SEQ ID NO: 6863851 - DNA, 58 bp, Homo sapiens
aggtgatttctcaaagcactcagagcacaatatctgactttgcaaaaggaaatcacct

SEQ ID NO: 6863852 - DNA, 69 bp, Homo sapiens
tcaatatagtttcgtcaattgtaacaaatgtaccactgtggtgaagatgttaaaattgggggatgttga

SEQ ID NO: 6863853 - DNA, 69 bp, Homo sapiens
gtttggtgtcccatttatctagatgtcagatgcatcatggctttaactctctagaaaatggctacaaac

SEQ ID NO: 6863854 - DNA, 62 bp, Homo sapiens
gcagggcagccacaggccccctcaggatatagggaggaggccaatggaaggggctgccctgc

SEQ ID NO: 6863855 - DNA, 129 bp, Homo sapiens
aaaccgctttcacctttctctctttcttcccctctgagcctcaggacttctcactgcccatccagtttttagaacttgaaccacagaagctgccttagtggggagaaagtgctgggtttaagtcagttt

SEQ ID NO: 6863856 - DNA, 93 bp, Homo sapiens
ttcttgggtgaaaaatacatcctcagggttcggatgagaacaggtgttgcttgttcagtatctcaagcccagaaagatgaattaatccttgaa

SEQ ID NO: 6863857 - DNA, 81 bp, Homo sapiens
atatacttacttcctcacttacttttgtggtttggtagctttttctttacacatttaggaggtggggaagcacagagatat

SEQ ID NO: 6863858 - DNA, 60 bp, Homo sapiens
tgacattcagccaattactttctgctaatagatattgcagttatgtagagtgggatgtca

SEQ ID NO: 6863859 - DNA, 66 bp, Homo sapiens
ctgcagtccgaggcgcaccggcgctccttcggcggcacggaggaccgcctgtcgtgcttcgcgcag

SEQ ID NO: 6863860 - DNA, 55 bp, Homo sapiens
gcatctggcccttgaaaatgctgagcagagaaatgctagcagtagcgccaggtgc

SEQ ID NO: 6863861 - DNA, 62 bp, Homo sapiens
tggggctgagagcaaaccaagaatgatgcaagttcactgcagtttgccctttgctcactcca

SEQ ID NO: 6863862 - DNA, 65 bp, Homo sapiens
ggtggacagtctgtctgtcaagttcatctccatgttcttggaggttggcagatgcattggcctcc

SEQ ID NO: 6863863 - DNA, 85 bp, Homo sapiens
gcagaactcttgtttccagcaaatagtccattgttgacgtggtgatagggcaagtagtttgctgatggaaaaaagagaggtctgt

SEQ ID NO: 6863864 - DNA, 63 bp, Homo sapiens
ctgtaggccaccaaaagggaccttatttctctgacctcggtcacctcctggtcaggtgtgcag

SEQ ID NO: 6863865 - DNA, 99 bp, Homo sapiens
gtttctcacggtaattcattcaacacatatttgccaagcccttgctgagtattaaataccgagcgaggttttgcagatacagcagtgaacgaaagagac

SEQ ID NO: 6863866 - DNA, 55 bp, Homo sapiens
agctgaggcctgatttcgccgtggctgggggctggggccggagttgggcccggct

SEQ ID NO: 6863867 - DNA, 62 bp, Homo sapiens
gggccggctgcgctgtcctgaggatgccctaccgggctggccacagtgacacgggctggccc

SEQ ID NO: 6863868 - DNA, 94 bp, Homo sapiens
gtataggtgttcaggaagtcaaaatagagttctgtcttcaagtgagtttggggaaaggagagcattatttttcctttctggagatttccagtgc

SEQ ID NO: 6863869 - DNA, 91 bp, Homo sapiens
tctttggtcttctcccagggctgtggtgttctgggaagagctacacctgctgtctcacctctgccagaagccagggtctggagaagaaaga

SEQ ID NO: 6863870 - DNA, 78 bp, Homo sapiens
tgcctacgtttacatgtttttctcttacaggccacacagcatgtcctgtgggactggagaaatatggagaatgcagca

SEQ ID NO: 6863871 - DNA, 97 bp, Homo sapiens
tgtgttgggaaaatgtgcatatctcattaacttgcctagcatcaacctctgaacactgggataggtgatagactgtaaggttacctttctcaatgca

SEQ ID NO: 6863872 - DNA, 80 bp, Homo sapiens
gtatttgctgagtccttggttctcacaaggaataaaacatacacagtctccaccttcacagaactaagactcagcagtac

SEQ ID NO: 6863873 - DNA, 63 bp, Homo sapiens
ggccaggccaccgctgtgcgctttaaaagcatggttctttccatggcaccaggtggtggcccc

SEQ ID NO: 6863874 - DNA, 75 bp, Homo sapiens
agacactgtaaattgagtgcgtgaagctgtgagaataaacccatctcattagtcattgtgtcaattatagtatct

SEQ ID NO: 6863875 - DNA, 77 bp, Homo sapiens
atgctgccttgaacatcctaagtatctttgttgcatatatacctaggaatgcaattgctgggacacagggcatgcat

SEQ ID NO: 6863876 - DNA, 102 bp, Homo sapiens
tgagatggaggctcactctgttgccctggctggagtgcagtggccgcaacctcggctcactgcaacctccgcctcctgggttcaagtgattctcctgcctca

SEQ ID NO: 6863877 - DNA, 57 bp, Homo sapiens
cttgggaagaagaatgaggggtgatttgtttcaatcacataatccttcatccacagg

SEQ ID NO: 6863878 - DNA, 79 bp, Homo sapiens
agattgattcctacagagggctatgagggagactctgttccacttttctcttctagcttcttgtggtttgctgcaatct

SEQ ID NO: 6863879 - DNA, 61 bp, Homo sapiens
ccacaggttctggtaagctgttgcttctgaaaggaggtatgcatgttggctagtgctatgg

SEQ ID NO: 6863880 - DNA, 88 bp, Homo sapiens
aggagaagctgtttccttcttttagatttccactcttttattctgctgagagagggcatagaaaaagggaaaaaaaggaatttctcct

SEQ ID NO: 6863881 - DNA, 90 bp, Homo sapiens
gctggaatagccactttagagcaggtgcgcttgacaggatgaactgaacacacatattatctgctctaatgaagtgcacttattcttagc

SEQ ID NO: 6863882 - DNA, 58 bp, Homo sapiens
gcctctctctacccagtatgatgcttggattggcaatcaaaggatgtagagaagaagc

SEQ ID NO: 6863883 - DNA, 100 bp, Homo sapiens
gagtcctaaattcaccatgtatgctcatcttggttacattttacagcactttacatttgtaatcacttaatagctacactggggaagtcttttaggactc

SEQ ID NO: 6863884 - DNA, 60 bp, Homo sapiens
gttccctgaagaacctaattgtcgatgctagtgcatctaaacaggtgttctttagattac

SEQ ID NO: 6863885 - DNA, 56 bp, Homo sapiens
catacaagcgtgcatgtgcttgtgagtgtgtgtacatgcatgtgtgtgcttgtgtg

SEQ ID NO: 6863886 - DNA, 60 bp, Homo sapiens
gagctggcaatgacttgtgtatcaccctctttcaaaagaagcacaatcattgactatctt

SEQ ID NO: 6863887 - DNA, 59 bp, Homo sapiens
aactggtatttcccatgaatttgtatggtatagtacaagtaacagggataatagcagtt

SEQ ID NO: 6863888 - DNA, 74 bp, Homo sapiens
taaaacacttgctcaattcagttgcaatgtcaatcaatctgattgcattgttgatgagttgaataagtgtttta

SEQ ID NO: 6863889 - DNA, 111 bp, Homo sapiens
gctatggtaatgcagttcaattatacagtcagagggcctttgggggcaatttgaagacttcctggatgaacactctctcgactgattggttgcacctactgtttccgtagc

SEQ ID NO: 6863890 - DNA, 58 bp, Homo sapiens
atgtgttagtttgtgattatacagacttacaataagtgtgattatttgattaacatgt

SEQ ID NO: 6863891 - DNA, 110 bp, Homo sapiens
tatttgatagaagaggggattatattgctaatttgtataatgaaaattgcaaggaccaatttttcatgaggttacacagctggtattactttccctttaactatcaaata

SEQ ID NO: 6863892 - DNA, 71 bp, Homo sapiens
aggaggcctgggttacctactcgtggggaggggtccagactgttgcagagtaaggggtagccaggccccct

SEQ ID NO: 6863893 - DNA, 62 bp, Homo sapiens
atatgctcacttacagaactgccatgctgccccacaagctgagagcctgccagtgagtgtat

SEQ ID NO: 6863894 - DNA, 60 bp, Homo sapiens
tgttccattggagcactccacgactccccttttaaaagtggagccttttgttctgggaca

SEQ ID NO: 6863895 - DNA, 72 bp, Homo sapiens
agactacatccagggagatactggctgccaagctttcttcagcctcctaatttcctgtgaattacacagtct

SEQ ID NO: 6863896 - DNA, 92 bp, Homo sapiens
ccattgttctgtagcacatcttccttctgttttggcaaacaatcttatgacctggttgtcatggatggaagggatatcttacaacactatgg

SEQ ID NO: 6863897 - DNA, 101 bp, Homo sapiens
ttataggaaccttttgtaacctaaggcaggtgaacagggtggcaggctggctgaggtccagataccagcattgctttgggttatagtttatgttgttttaa

SEQ ID NO: 6863898 - DNA, 64 bp, Homo sapiens
tccgatgtataaactgccgggttcctacagtgtactgagcctgcagtgagtgcagaaggtcgga

SEQ ID NO: 6863899 - DNA, 87 bp, Homo sapiens
ggagaatcgcttgaatctgggaggcggaggttgtagtgagctgagatcacaccactgcactccagcctgatgacagagcgagactcc

SEQ ID NO: 6863900 - DNA, 77 bp, Homo sapiens
ggtccttctcggggtagacgccagctcggaggaacgaggccttccagctgtccacgtcttcctgggagtcacaggcc

SEQ ID NO: 6863901 - DNA, 76 bp, Homo sapiens
aacagttaattaatcagtctcatttagcagggagggagttcctatttctgttgaatagctgataagtttaactgtt

SEQ ID NO: 6863902 - DNA, 71 bp, Homo sapiens
catttttatatggggcttggcattttaacatctggaaaagttgtgaaatcaattagctgcagataaagatg

SEQ ID NO: 6863903 - DNA, 130 bp, Homo sapiens
gttacactgatggggcaggaactgaaggggctggggtcaccatacttcaccagaggaagcattgtttgggttaagagatggtaccacaggaggtcttcttagtggtcttcaatgtacccattactgtctc

SEQ ID NO: 6863904 - DNA, 61 bp, Homo sapiens
cccactgccttgtcaggcacagggccagatcctgcaccctgtgacgagcacggccagtggg

SEQ ID NO: 6863905 - DNA, 72 bp, Homo sapiens
tcttacttgtgcctttcatagcctcactatatagaaatctatggctcagaagaaaaggtaaacaggtccaga

SEQ ID NO: 6863906 - DNA, 67 bp, Homo sapiens
gctagacctgtttttgagtcacagggaattttagctagtgtccctgtgaatcagaagcaggtctagc

SEQ ID NO: 6863907 - DNA, 68 bp, Homo sapiens
gttgggtttctgccagagatttaaatcaggtttataaagagttacctgcctaaggcaagaaactggac

SEQ ID NO: 6863908 - DNA, 96 bp, Homo sapiens
ataaatactgatttttctactgcattttgtgctccctagggaaagacatctgaacatctttctatctctagcgcacagaagaaattacgtatttgt

SEQ ID NO: 6863909 - DNA, 68 bp, Homo sapiens
tgtctcagagtttctagtcaaatccactgtgtaccagaagtggattgattataagagattcatggtca

SEQ ID NO: 6863910 - DNA, 98 bp, Homo sapiens
acaatgtcttagacatctttctgaatcaggacacatagatctatctcactctttttaatggctgtgtggtaatttagtgtatgaatgtgtcttcatgt

SEQ ID NO: 6863911 - DNA, 69 bp, Homo sapiens
tgggagctcatctgttcccttgacttctctttttccagttctttggcaaggccacaggtgcagttctta

SEQ ID NO: 6863912 - DNA, 100 bp, Homo sapiens
gaggcacctagggaaggaaaatgcaggaggcgctcatcttcaggtggcaccgcaggaccctgagcatcagcgcctccttacattttgccctgggcatctc

SEQ ID NO: 6863913 - DNA, 59 bp, Homo sapiens
tcagttggggtaacttcagagcaccgtacaacctctgaatgattaaaacccggactaga

SEQ ID NO: 6863914 - DNA, 83 bp, Homo sapiens
tttccaacacagtaactcctgacccctcgcagtctgagaagtggtggtaagtagtggtgggtaagagttgaggtgttggtaaa

SEQ ID NO: 6863915 - DNA, 65 bp, Homo sapiens
ctctttgtctaccacagacatcgtctccatggaacctacaatatgtttctgaggtggacgaggag

SEQ ID NO: 6863916 - DNA, 86 bp, Homo sapiens
tgggagtcagaggcaagagaagccagctttcctcctcccaaaggaggaagatatggaagctgtgctctcaggcctctggaaaccca

SEQ ID NO: 6863917 - DNA, 99 bp, Homo sapiens
aagcaggcacccaggacacctgtttaaggaggggctcacgtgggcttctgcaagtgcggagtgagtgccccttaagtgttgcacctgggcacctgactt

SEQ ID NO: 6863918 - DNA, 72 bp, Homo sapiens
gtttgacattagtacttttacagcaggtgactcctcttgtcaaattgctctttaaaagtactgtattcaaat

SEQ ID NO: 6863919 - DNA, 108 bp, Homo sapiens
gcaatatttgtctggtttctttttctttaaatgaattctctgtagttccagtttccctactgcatgcaatgtgaagaaagctatgggaacgcaggctcaactcaatgc

SEQ ID NO: 6863920 - DNA, 77 bp, Homo sapiens
gaggccagcgtgggagtggggcatagaaggtattgccatttcttcaatatattctttcaccttcttcctgccgcctc

SEQ ID NO: 6863921 - DNA, 64 bp, Homo sapiens
ataaccttatcttgattcctcttttgttacttctgatgtgaaaactgaggcaggtaagagttat

SEQ ID NO: 6863922 - DNA, 66 bp, Homo sapiens
ggtggtcctgggccatcactgggacagactgaaaagggtggtctggcaggtgaggactcagccacc

SEQ ID NO: 6863923 - DNA, 73 bp, Homo sapiens
gttgagctctcctagccctgctgcctgaattagctgcaactgtgaggctgagaaggagtgggtgaggctaaac

SEQ ID NO: 6863924 - DNA, 75 bp, Homo sapiens
tctgttacttgaccctctgcagatcttcttcatgtatttttcagtgtctgagatttctgtaggcaagttagcagg

SEQ ID NO: 6863925 - DNA, 80 bp, Homo sapiens
gggtcagaacaaggcacaagctggctgtttatcaagtacctactttgtgctgggcagcacatgctctcttgttcagtcct

SEQ ID NO: 6863926 - DNA, 68 bp, Homo sapiens
cctcgcttgagcctttgcctgcgaacgaggtataatacccacctcgggggcttgaggatcaaatgagg

SEQ ID NO: 6863927 - DNA, 79 bp, Homo sapiens
gcatgtgctcgtggctgaatcatttgtgcatccaaagctgaggtccctggctgctgttgatttagtccaatgcatatgt

SEQ ID NO: 6863928 - DNA, 76 bp, Homo sapiens
ggaaaacagggcagagacatgcttcctgaaagcttccttgagccatcaagcagaggtgttcttttcctagttttct

SEQ ID NO: 6863929 - DNA, 69 bp, Homo sapiens
tgaagccaatgttgcctgggtttctgcttcatcctgtcagagataaaggaaccaaggaaccaaggctca

SEQ ID NO: 6863930 - DNA, 65 bp, Homo sapiens
tctgagagcatcactggggtacagagagaggcatgccaattcataggtacccttgatgctctaga

SEQ ID NO: 6863931 - DNA, 71 bp, Homo sapiens
ctatgtggaattcttcttagtatgccttttatctttctgaaaaggtttataactttggagaattttcttag

SEQ ID NO: 6863932 - DNA, 55 bp, Homo sapiens
aagctaagattacagatttgggtcaatggttatcccaaatctgcaatcttggctt

SEQ ID NO: 6863933 - DNA, 73 bp, Homo sapiens
acacaggtaatggttttggaagacttcatgtctgattaaattttaaattacttttagaacatctgccttgtgt

SEQ ID NO: 6863934 - DNA, 93 bp, Homo sapiens
ggccaggctggtctcaaactcctaaccttgtgatccacccaccttggcctcccaaagtgctgtgattacaggcatgagccaccacgcctggcc

SEQ ID NO: 6863935 - DNA, 81 bp, Homo sapiens
ctttctctcctttcctaatcccaatgacatttatgattcctataaagtcacagtttaggggatatgggaaaggtaaggtgg

SEQ ID NO: 6863936 - DNA, 75 bp, Homo sapiens
ctggacagtgttttcaatgcttctcattagccaatgagtaataaatgtacccagttttgagaagtatattgccag

SEQ ID NO: 6863937 - DNA, 69 bp, Homo sapiens
ggactgccgtctcggcctcttcagattttgagataggggtgtgagtagagctggggatccaggcaggac

SEQ ID NO: 6863938 - DNA, 69 bp, Homo sapiens
ggctcccggcgcgcgctcccctctgaccacctacggaatgacctcagagtgggagaatgtgccaaggcc

SEQ ID NO: 6863939 - DNA, 67 bp, Homo sapiens
gcagttacagagaataaggagcacttaatgcagaaccttgcagagttctgaattttattctctctgc

SEQ ID NO: 6863940 - DNA, 64 bp, Homo sapiens
gctccagcgaggctgggccggacttatttacaagtgcagtgacccctgtctcctcgctgggagc

SEQ ID NO: 6863941 - DNA, 93 bp, Homo sapiens
ggccaggatggtttctgtcacttgacctcgtgatccgccctccttggtctcccaaagtgctgggattacaggcgtgatccaccatacctggcc

SEQ ID NO: 6863942 - DNA, 80 bp, Homo sapiens
ctcacttaaggcagacaagtccagaactggcatctactcgtatttcagtctctggctgtgtctgacacattgtcagtgag

SEQ ID NO: 6863943 - DNA, 97 bp, Homo sapiens
ctgcttggtttaatatagtaattgtaagtgtcaggaagccacagggggagtgtggcttcctgagagagacagttcctgcactgaagctcataggcag

SEQ ID NO: 6863944 - DNA, 105 bp, Homo sapiens
cactcctgcgctctggactctgatcctgtcccaagagtgacagcagctgcagtatgtgtgccgctcaaaggacagggctggagtgcatgagaaaaactggacgtg

SEQ ID NO: 6863945 - DNA, 68 bp, Homo sapiens
aaaacatgaaattctagctgaacccggttatgctggtatatagtgggattattgtgatttcatgtttt

SEQ ID NO: 6863946 - DNA, 72 bp, Homo sapiens
aggttcttggggttccacaatgggaactgcttgtttggtttttcgcttcctcggctgggccccaggcttcct

SEQ ID NO: 6863947 - DNA, 59 bp, Homo sapiens
gagcacctggcagctaagtgctttgagatctttcagatgaaaagggctgtcagttgttc

SEQ ID NO: 6863948 - DNA, 57 bp, Homo sapiens
gttagcatgaatttgacctatcttttagagtgttcagattggttcactcatgttgac

SEQ ID NO: 6863949 - DNA, 70 bp, Homo sapiens
taaacagccttcagtccccagcaagctgtttagggaagaggcctggcagcagcaaggttggagctgttta

SEQ ID NO: 6863950 - DNA, 68 bp, Homo sapiens
agaatgacttgctttctgagtaaacatagcctagggaaatgttttcctgggagagcactctccattct

SEQ ID NO: 6863951 - DNA, 76 bp, Homo sapiens
aactgttaaactaagtcatagagtccctcaaggaaataacctcccttttaggactcagcatgccttggctgcagtt

SEQ ID NO: 6863952 - DNA, 62 bp, Homo sapiens
tgtcctttccactcattcacagtgaagagtttggttccacagtataatgtatggatggggca

SEQ ID NO: 6863953 - DNA, 124 bp, Homo sapiens
atgcagttgactgatctttgcattctttgacaactatagttccatctgctctatttagaaactaatgtaattacttaaactggagaagacagaactacttttgcagcaaagtcaaaacatgcat

SEQ ID NO: 6863954 - DNA, 64 bp, Homo sapiens
ctgctggtcctgagaatcctgtcctctactgagagaggccacagtgtctgggggccatcagcag

SEQ ID NO: 6863955 - DNA, 57 bp, Homo sapiens
tccccaactccctgacaccctagacccaagaatctggaggttttactgagttgagga

SEQ ID NO: 6863956 - DNA, 75 bp, Homo sapiens
ggtccattgtctgcatatcaaattactcctggttcctgaggtccaaggagttcagttggtggctgtgcgtggacc

SEQ ID NO: 6863957 - DNA, 64 bp, Homo sapiens
tgttagtggattgcagttggttgtggtgggagcatttacaccggagaaactggcaaaccctaca

SEQ ID NO: 6863958 - DNA, 55 bp, Homo sapiens
catatgttgcccggtacaaggaaatctgaaatccactgcccagagggcagcattg

SEQ ID NO: 6863959 - DNA, 82 bp, Homo sapiens
gcagttgtggcaaattatcattttcatagatttttgtatattcagtatattgaaatgaatgacagtgattatgccttactgt

SEQ ID NO: 6863960 - DNA, 58 bp, Homo sapiens
tagcccccaaaagtgcttatgatcaaaattagctggacaagatatattttggggggta

SEQ ID NO: 6863961 - DNA, 78 bp, Homo sapiens
ccacatcttgccagatgggtctcacagcccctggtcatctattgtccaggaagctgtgagattccaataagataatgg

SEQ ID NO: 6863962 - DNA, 83 bp, Homo sapiens
aaagctgtattttctatatataaatttgtagctggtagcagtgacctagactgcaggtaaatttgtggaggattccaagtttt

SEQ ID NO: 6863963 - DNA, 61 bp, Homo sapiens
ccgtgctatctccctctaactttgaccaataaatggacgaagttagagggagataacttgg

SEQ ID NO: 6863964 - DNA, 60 bp, Homo sapiens
acccagatcccaggggctacttcaggcccttctactaagctcctgaccctggctctgggt

SEQ ID NO: 6863965 - DNA, 71 bp, Homo sapiens
cagacagaagtgtctttttcattcattttcccttttaaagagtgtcaatgaaggaaagtgcctactgtctg

SEQ ID NO: 6863966 - DNA, 55 bp, Homo sapiens
ctgcagctccaggtgcaagtcatggtagagacaccaatgcgtgcatggggctcag

SEQ ID NO: 6863967 - DNA, 95 bp, Homo sapiens
cccaggtctggcatttaacaactgcttattgagtgactggtatgtgaaagacattacattattctttgataaatggcagatgagttagaccaggg

SEQ ID NO: 6863968 - DNA, 80 bp, Homo sapiens
ctctctgcccccactctcggtctaccccctccaaggagtccaaagacccaggggaggtcctcagggaaggggcaagggag

SEQ ID NO: 6863969 - DNA, 74 bp, Homo sapiens
aagcagggctttaagcggttttattccccttgggttgtaaaagtccagcctagaggctgctgagagccctgttt

SEQ ID NO: 6863970 - DNA, 70 bp, Homo sapiens
gcttatgctgctcatgctggggacagatgtgtgtccacacgagtgtaactgtatgggagagcaattaggc

SEQ ID NO: 6863971 - DNA, 76 bp, Homo sapiens
ccttcagtaaaatcaccaaaagcaggtggagaataaaaagtgtaacagccacttgaatggtgatgctactgagagg

SEQ ID NO: 6863972 - DNA, 60 bp, Homo sapiens
cctggccactcaggtgtggggcgggtctctcctcatttagctttcacctgcgtgcccagg

SEQ ID NO: 6863973 - DNA, 92 bp, Homo sapiens
gagacggtgtctcgctctgtggcccaggctggagtgcagtggcacaatcttggctcactgcaagctccgcctcccaggttcacaccattctc

SEQ ID NO: 6863974 - DNA, 61 bp, Homo sapiens
cgttcacctggagatcgttggggccaggagctctgctgcctgggctcaccgcctctttacg

SEQ ID NO: 6863975 - DNA, 80 bp, Homo sapiens
gggtcaaatgcttttaaacacgattgacgaaactatttttaaaaattaaaggtttccaagtggttgaaaagtatatgccc

SEQ ID NO: 6863976 - DNA, 59 bp, Homo sapiens
gttacagctctttggtgcattcaccttaactctaggacatttaccaaaggagttatgat

SEQ ID NO: 6863977 - DNA, 89 bp, Homo sapiens
gcgggaacatcaggatggatggacagacactggccttctggaaggttcaactccagcagggaagctgtgctgtttcacaaattggctgc

SEQ ID NO: 6863978 - DNA, 91 bp, Homo sapiens
tgtaactctttgcacaggggagttttatgcaacagacagaaactttctgagttgttctgattgcctgaagatgccctgttttagaggagca

SEQ ID NO: 6863979 - DNA, 62 bp, Homo sapiens
gagtccaggagacaaagatgactgctgaaattcatcacctgcagccacttctctccttcctc

SEQ ID NO: 6863980 - DNA, 80 bp, Homo sapiens
agccactacttaaaaccaagccacttttgtggttttcagatttttgaaaaacacaagtggcttggtcttaattagcagct

SEQ ID NO: 6863981 - DNA, 61 bp, Homo sapiens
cagtagtctttttcctcctagagaactcggtgaatcttttccagggagttaggctctgctg

SEQ ID NO: 6863982 - DNA, 78 bp, Homo sapiens
cttgcttttttgtgtcattttgttagcatgtttgttacagagctataattacatgcaggaaaatgcacagatctcaag

SEQ ID NO: 6863983 - DNA, 86 bp, Homo sapiens
ggcgtcccatggcatgccacatggacttcaaaccgagtgccctttctcccatgtggtttactcgtagtggcggttttacagatgcc

SEQ ID NO: 6863984 - DNA, 70 bp, Homo sapiens
gtctccccagggccctcttcatgtccgtgttcctcaggctgtagatgaaggggttcagcatgggggtgac

SEQ ID NO: 6863985 - DNA, 63 bp, Homo sapiens
atgaccagactctcagtggggttcatgctctttatcagctttcaccaactgcagggctggcat

SEQ ID NO: 6863986 - DNA, 87 bp, Homo sapiens
aattactgctatgaagcagccgctgaaacactttaatggccacaattaaacagtcccagaggctgacctttagacgtggcagtggtt

SEQ ID NO: 6863987 - DNA, 86 bp, Homo sapiens
gccaccttgctgcccatgaaaatgtagggatgcataaagccagtgtttaggtcattccttatgttgattcagggaggtcacttggc

SEQ ID NO: 6863988 - DNA, 56 bp, Homo sapiens
ctctgggctcagtctgcttggtcctgcagcccactgcgtggcggctgagcccgtag

SEQ ID NO: 6863989 - DNA, 88 bp, Homo sapiens
tcacgagcccaatactgcatgaggaactagtaaatgaatatcagatataagctaaatttctcaaggtgtcatgtatttgggagggtga

SEQ ID NO: 6863990 - DNA, 83 bp, Homo sapiens
gttttggggcctttgtctatttactttgccttcagctttatgcagttaaacttgaactttcagaaaatggcagggcctttcac

SEQ ID NO: 6863991 - DNA, 62 bp, Homo sapiens
ccttacccagcccatgcctacctcagggaggacaatcctagttgggcaggggtggggcaagg

SEQ ID NO: 6863992 - DNA, 64 bp, Homo sapiens
gcctaattcttccaaccattgcatagtcagcagtaaactatgcaagagggaaaaggaaataggc

SEQ ID NO: 6863993 - DNA, 79 bp, Homo sapiens
ttcagctcttaaaaaggcaagttttagttttctggaaagctaacatttttagaatacctctttccttgatgatgctgga

SEQ ID NO: 6863994 - DNA, 63 bp, Homo sapiens
tcagagcactggtgctaccttgtgactgacggtgatgagcatttctgtagcgcgtgttattga

SEQ ID NO: 6863995 - DNA, 58 bp, Homo sapiens
gagggtgtctcacgtgaaagtaaatcgctcatgtttgttctttttaaaagatgccctt

SEQ ID NO: 6863996 - DNA, 65 bp, Homo sapiens
catgaagccagaagaagactggcggacagtgagaaagaactgggctcagtaggtctgggttcatg

SEQ ID NO: 6863997 - DNA, 62 bp, Homo sapiens
ggagataatggagaggtgtcttatgaccatcttcataggtaagagacacatcacatttctcc

SEQ ID NO: 6863998 - DNA, 66 bp, Homo sapiens
ttgccatctggctgtttcaaatgtatagagtttgtgcttctatatataaatgacagcatatggaaa

SEQ ID NO: 6863999 - DNA, 72 bp, Homo sapiens
agaggctcgctgaggctgcacggctgcctgggagaggctcgctgaggctgcacggctgcctgggcggcctct

SEQ ID NO: 6864000 - DNA, 102 bp, Homo sapiens
ctgcagctgtcttggttcttccaatttcaaaatgtctttgaagaagtgacttagccacttcttcaaagacattttgaaattggaagcattaagaaactgtag

SEQ ID NO: 6864001 - DNA, 63 bp, Homo sapiens
gagaattgaatgcttaatttgatgaaatctgaggaaaagcattagaaggcattcctcattctt

SEQ ID NO: 6864002 - DNA, 77 bp, Homo sapiens
tgatattatctatacataattctaagccttctgaacattattatgtgacctggtgctgagtatgtaggatggtatca

SEQ ID NO: 6864003 - DNA, 59 bp, Homo sapiens
tggagagcactgtctcattttggaaaattatctatttctgaaatgtgcactgttttcca

SEQ ID NO: 6864004 - DNA, 85 bp, Homo sapiens
gtatttgattggtgtgaaagtaattgcggttttgccattatttttgaaggcaaaaatcacaattattttcgcaccaatctaatac

SEQ ID NO: 6864005 - DNA, 116 bp, Homo sapiens
tgtgggttccatttctttaacttgttagtacagtatacagagtgccttgaaagatctcatcttatacaaaattatctttattagtgcttgtatcactgtgttcataagtgctcaca

SEQ ID NO: 6864006 - DNA, 85 bp, Homo sapiens
caggcaagtctgctggcaagaaatatatatcttaggtttgtttcatttgaggatgtctgtattttgccttcgttctttaagtgtg

SEQ ID NO: 6864007 - DNA, 79 bp, Homo sapiens
caggtccagtaagacgtactattggtttatacctttttacataaattgtactacaccatagtactgagtacaccacctg

SEQ ID NO: 6864008 - DNA, 67 bp, Homo sapiens
aggtgtgcaggtgatgataaacagggcttgagcccagcctaatcaagcccatgcatcttcacaacct

SEQ ID NO: 6864009 - DNA, 98 bp, Homo sapiens
gtattcactaatcctggaaatttcaagcaaagtagctatctctctgtgtggagaaaagatgttaagttatttgaggttttcagcatgctgaagtttac

SEQ ID NO: 6864010 - DNA, 79 bp, Homo sapiens
aagtattaacagcaactgagggccttttttagaagggttttttatgttttgtaaaagggtccagtccttagttatactt

SEQ ID NO: 6864011 - DNA, 96 bp, Homo sapiens
acctgtttcactagtattcagagtattccatgaggttagcatgaaatgaccatgtccatttacaccagggaaattcagggtggctgtgggacaggt

SEQ ID NO: 6864012 - DNA, 78 bp, Homo sapiens
ggaaggattagatgatacaaatgaagggaatatgcttcatacatgctgggcccttcatgtattattttttgcctgtcc

SEQ ID NO: 6864013 - DNA, 100 bp, Homo sapiens
tgggtctttccatggctaactgctgtgacagctgccgtgttaagaatggcaggagcctctaaacagcaagctgtccagtgaaaggaggtgggaaggtcca

SEQ ID NO: 6864014 - DNA, 102 bp, Homo sapiens
gcctgcaaaccttccctcagacacagccccacgaagtctctgcccataacctaccgccaggcactttgtaaattgttgtgactcacgggaaccatctcaggc

SEQ ID NO: 6864015 - DNA, 86 bp, Homo sapiens
ggatagcagagacctgccactggcaatgcagggctctcagtggagtgtcctggcagactgtgagggcagggaggaatctgttgttt

SEQ ID NO: 6864016 - DNA, 67 bp, Homo sapiens
gaggaggaccaggcaaggtcagcaccttctgtgctacagagaggcccatgtgagtcttgtcctcttc

SEQ ID NO: 6864017 - DNA, 60 bp, Homo sapiens
actcccactcctggctcaccacagaggacgagttgctggtatcatcaggggtggcggagt

SEQ ID NO: 6864018 - DNA, 92 bp, Homo sapiens
gaaatatcccttttcctggggaagttcgtaggtgagctgctgctatcagctagcatttactccctaggctgttttgggagaaaggggttttc

SEQ ID NO: 6864019 - DNA, 62 bp, Homo sapiens
tggtttgaatcaatggctatttcgactgagtccattaaaacgtttggccttgaatcatatca

SEQ ID NO: 6864020 - DNA, 79 bp, Homo sapiens
ctgaggctggagttcagtggcatgatcttggctcactgcaacctccagctcccaggttcaagcgattctcctgcctcag

SEQ ID NO: 6864021 - DNA, 60 bp, Homo sapiens
tgcctgggaagcatggtgatggtattttgaaaaagggtaacatttacagttcctagagca

SEQ ID NO: 6864022 - DNA, 84 bp, Homo sapiens
atcattctgaacatttttaaggatactttaaggcattttagcttctgtatgtcaaagatgtctttgaaaatagttttttatggt

SEQ ID NO: 6864023 - DNA, 76 bp, Homo sapiens
ctctgaaagtttgcatagattaagcattcaaagtagatgtattgaaaaatggttatgtctatgtaagcatacaggg

SEQ ID NO: 6864024 - DNA, 57 bp, Homo sapiens
taaaggaacagaggactcatttctcttgagtgtgtgtgtgtgctcctgtgtcctttg

SEQ ID NO: 6864025 - DNA, 82 bp, Homo sapiens
acatatgtcacttcgtttttaaatttatgactacggaagtcatatggctatgtctaaacttagggatcgaacaggacaatgt

SEQ ID NO: 6864026 - DNA, 65 bp, Homo sapiens
ggtgcgtttatgtggctcatctttgggaagtaaatatgtaagaatttatagtcaataaacgtacc

SEQ ID NO: 6864027 - DNA, 67 bp, Homo sapiens
aacatcttgtctaatgtcagctaccaccacctcaatggggcacacctttggcatttagacaagagtt

SEQ ID NO: 6864028 - DNA, 76 bp, Homo sapiens
gggttataaccaatttaaatataaagactacaactaaatatgtatttctagatatggagagtggtactgttaacct

SEQ ID NO: 6864029 - DNA, 85 bp, Homo sapiens
atggtcgcttaacaagcctcagcatgctctgtgggctcagcgagtttgtggtgtcacccacagggctgctgatggcagccatcat

SEQ ID NO: 6864030 - DNA, 65 bp, Homo sapiens
gcccttaggtactacttattctcagcactttcaactagtccagtgagtgcctggtatataagggt

SEQ ID NO: 6864031 - DNA, 67 bp, Homo sapiens
caggaagtggtgttcttattgggactaatatgtgttatggccctagaaccagcagaagccactcctg

SEQ ID NO: 6864032 - DNA, 73 bp, Homo sapiens
gaatatcttaggagtgtgattctgggatatcttaatgcgatccaagatgttttagagtttgacttgatatatc

SEQ ID NO: 6864033 - DNA, 61 bp, Homo sapiens
gtcacaggcagtaactaggacctctaacagctgatcacagagcacttaggcaggcctgggc

SEQ ID NO: 6864034 - DNA, 75 bp, Homo sapiens
ttcttctccccaggctctctatgggaaagagacattcattttcttcttccagttataagagcttttcaagaagga

SEQ ID NO: 6864035 - DNA, 55 bp, Homo sapiens
gagtgctaatgcatgtcaagtactttgtacagaacgtggcaggtagtgagcagtc

SEQ ID NO: 6864036 - DNA, 58 bp, Homo sapiens
caaggctgggagaaagaaccctgagtgaggtagaaatgaccttcttttctgagccttg

SEQ ID NO: 6864037 - DNA, 94 bp, Homo sapiens
gaatgagctttgagactcactgccttagaaaatcatggaatattaaaagtttagtattggatataatctaggaagagtgctcttaatcttgttt

SEQ ID NO: 6864038 - DNA, 67 bp, Homo sapiens
ccagcccccctggagtcgctgggatggcctccgagagggagagcaggcctgactgtagggggcatgg

SEQ ID NO: 6864039 - DNA, 56 bp, Homo sapiens
ttgagatggagttttgctcttgttgcccaggctggagtgcaatggcaccatctcag

SEQ ID NO: 6864040 - DNA, 64 bp, Homo sapiens
cctggcttcagcattgccctctcccatttcctcgtattgaaataggtggcaagctgcagtcagg

SEQ ID NO: 6864041 - DNA, 67 bp, Homo sapiens
agctgagattatgctcttctcatggtgtaccatgcccaatgactgagcaagggcctaataagtagct

SEQ ID NO: 6864042 - DNA, 63 bp, Homo sapiens
gtgcgtggttctagatcctgtcgtccctccgcttgggggcacaacgggctgggacccatgcac

SEQ ID NO: 6864043 - DNA, 103 bp, Homo sapiens
ggtgcaaatacatttctttgaatcaaagttctatatcataataatttttctctattacagatagaggtgttgttgatatagaagtttgggatgaatgtgtacc

SEQ ID NO: 6864044 - DNA, 64 bp, Homo sapiens
tccatttctgaggatggcattattctgattaatttagtcagactgatcatctatcagatgagga

SEQ ID NO: 6864045 - DNA, 90 bp, Homo sapiens
tcggtgatgtattctgaggaaaggggagcggtgactctgcagtattgagccaatgtgccttcatcctccctgtctcttcacatctgctga

SEQ ID NO: 6864046 - DNA, 58 bp, Homo sapiens
tactaagtttgtctcatttgatcttcacaattctgtgaaaaaggtaggacagatagtg

SEQ ID NO: 6864047 - DNA, 61 bp, Homo sapiens
gaggtatgtcctgagagtttgactgcagtgggaattgtgacagtaacttgggatggacctt

SEQ ID NO: 6864048 - DNA, 57 bp, Homo sapiens
catgctgtagaatcctagggtggccagcaggacagccaggaaccagctacagtcttg

SEQ ID NO: 6864049 - DNA, 68 bp, Homo sapiens
atctgctgcctatggctaattctttactgaccaaaccttggtgatgtggtggtgccaatgcagcagat

SEQ ID NO: 6864050 - DNA, 95 bp, Homo sapiens
tcatctctcccttaggccagcccttagtcctgtcttctatacaaagcactaactggaaggaatcacttagcttggcctccagaggggacagatga

SEQ ID NO: 6864051 - DNA, 76 bp, Homo sapiens
tcttcaaaccatggcacaggaaggtggaacccaagcacaatggggcagcctccctgccctggttggagtttgagga

SEQ ID NO: 6864052 - DNA, 57 bp, Homo sapiens
ttgttgtgtgattatgcaaaatgagaggaaagatctggtcttccagtcacataacaa

SEQ ID NO: 6864053 - DNA, 81 bp, Homo sapiens
taccaggactctgtaaaacaatattgtattctcaaaagcaataaaaattataaggggttgcaagttatttatagcctggtg

SEQ ID NO: 6864054 - DNA, 62 bp, Homo sapiens
gaggctttctgagaatcactctgtctctgatgctgcagactaagagagttgtcagtagcttc

SEQ ID NO: 6864055 - DNA, 104 bp, Homo sapiens
gaattttattggttgtgtagtgttcattgtatggaatgggtgtattataatgtatttacctgatgttatacagttgaacatgtaaattgctttcaatgtttttc

SEQ ID NO: 6864056 - DNA, 79 bp, Homo sapiens
ggagggcgggggagagacgagcggctctggccccttaattgtacttcgggctcgtattgtctctcctttcgccacctcc

SEQ ID NO: 6864057 - DNA, 57 bp, Homo sapiens
tggttcagatatggagctgggatttgaatcctatcaccagactcagaagtttaacca

SEQ ID NO: 6864058 - DNA, 67 bp, Homo sapiens
aaacaaagcatcttgctatgcatagaacaattattataactgtgagtaattgcaatgtgttttgttt

SEQ ID NO: 6864059 - DNA, 67 bp, Homo sapiens
ctgaatttgccttatttcatgtaaaatttatgtcattcagtttttgacaatgagtttgaggcatcag

SEQ ID NO: 6864060 - DNA, 70 bp, Homo sapiens
gagatgatctctttcagctctggagcattctgactgtatttcaaagaacattgctgaatgagatcaaatc

SEQ ID NO: 6864061 - DNA, 69 bp, Homo sapiens
tcaagttctcagggccctggggtgcactgacaccatcaaggtagttcatcctgggaagtcccagcttga

SEQ ID NO: 6864062 - DNA, 72 bp, Homo sapiens
atggacatacgttttcatttctcttggatagatacctaggagtggaattgctgattgaaatagtatgtttat

SEQ ID NO: 6864063 - DNA, 64 bp, Homo sapiens
tttattgagcatctactatgaactgggcactgtgaaagacagtgcaagtgtagaaactaataag

SEQ ID NO: 6864064 - DNA, 75 bp, Homo sapiens
gcccctgttcctaatgtctactttagttcacacagtggataccactcggactacctggatattggaacaaatggt

SEQ ID NO: 6864065 - DNA, 73 bp, Homo sapiens
gtccttagcccagtgctgagggtgctgctggtcctgagacctaagccatactccactctgagctctgggaggc

SEQ ID NO: 6864066 - DNA, 70 bp, Homo sapiens
acagggtgcaaggaactcagacgatcctatgtttgcctcgagcagatcatttgaattctctagatcctgt

SEQ ID NO: 6864067 - DNA, 59 bp, Homo sapiens
agcgagagagagccagcagccaagtgcatcccctgtatcccagctggcttctccttgct

SEQ ID NO: 6864068 - DNA, 73 bp, Homo sapiens
gccgcacctgcctctgcggggggtggtttcccgggaaactccggagagcctgttctccctccagacacgcggt

SEQ ID NO: 6864069 - DNA, 60 bp, Homo sapiens
ggctctttagagttgagtttctatgagaactgagttcctgttccatctctcaactttgcc

SEQ ID NO: 6864070 - DNA, 55 bp, Homo sapiens
atgacatttatacagtgagctttttctaaatgacaagcagattgttagatgttat

SEQ ID NO: 6864071 - DNA, 55 bp, Homo sapiens
ggttctggctgtggattatcacaggctgtggcctgagagcagccatggtgaggcc

SEQ ID NO: 6864072 - DNA, 118 bp, Homo sapiens
taatgatgaaaaagggaagttaggcagtttcttaatagcaggggccaattgagagtaagagaaaaaaattggtagtgctattgaaagccctgtttcttccctcattctcaggtcatta

SEQ ID NO: 6864073 - DNA, 100 bp, Homo sapiens
tcagtttttcatgttccatgcattggtcagggtcttagggagtgattcattctagcagaactccctggattttaaggcagatgttccatttattaattga

SEQ ID NO: 6864074 - DNA, 75 bp, Homo sapiens
agcgcaaaggcgccgaacttcatgtggcggatctgtgtacgcaggacgctctcgctgaacttcttgctcttgcct

SEQ ID NO: 6864075 - DNA, 70 bp, Homo sapiens
gtcagggaggccagggacccagtcagcggggctctgcccttgagcagctgacgccctggctctcttggac

SEQ ID NO: 6864076 - DNA, 59 bp, Homo sapiens
tgcctagctgtgagcacccaggctgtgggatttacagccgggcgtccgccgctgacgta

SEQ ID NO: 6864077 - DNA, 68 bp, Homo sapiens
caggtagttatttcctactataaacaaacctttgaaatcagacttttttggtggagagaagctatttg

SEQ ID NO: 6864078 - DNA, 55 bp, Homo sapiens
ggtgactgcattccccaggtgcaatctttcagcatgtgacctgatgtagtacatt

SEQ ID NO: 6864079 - DNA, 81 bp, Homo sapiens
gcaaaaattaatgacgcagataataattgctatggccacaacaaagcgggagaattattgtttgaagttattgactaatgt

SEQ ID NO: 6864080 - DNA, 55 bp, Homo sapiens
ggcctcctctctctgtccccccagtgatggcactggaagggctctgaggacggct

SEQ ID NO: 6864081 - DNA, 121 bp, Homo sapiens
catcctagtctcagattgtgtgggccctgtatccaagtcccatctgttaaattttctagtaagtccctctgaaaagaagatgggaattgggctgggcgccagccatataatgattaagatg

SEQ ID NO: 6864082 - DNA, 58 bp, Homo sapiens
aggctccagcccaaggctgcaggactggaagccacagtccagcatgggcgggaagcct

SEQ ID NO: 6864083 - DNA, 62 bp, Homo sapiens
gcactgaagcaatatactgatatgattatattttggtaaccattgtcaatattgctggaggc

SEQ ID NO: 6864084 - DNA, 84 bp, Homo sapiens
tattaggctgaactacatgaagttgccgctttatagaacaaaaatggtctaaatattggcaatttcatatggttcaagctaata

SEQ ID NO: 6864085 - DNA, 68 bp, Homo sapiens
ccaaagggcatttgcttctctaagggagtctctttctccagaatagagcattaagtattgttgtttgg

SEQ ID NO: 6864086 - DNA, 70 bp, Homo sapiens
cctgatttaggtagctgtctaagtgtagcatgctgaaatgaacactaaatacagttgctgtagacttagg

SEQ ID NO: 6864087 - DNA, 76 bp, Homo sapiens
ggtccccacagggtcaagggtgctacaaggccagtctgtttgacctcggacttgtaagtctcatgatcctggtacc

SEQ ID NO: 6864088 - DNA, 80 bp, Homo sapiens
cagaggctgcagagaagagaaaaagtctctggaggaagcaaagaactcctgcacgtgggctctctgctcttcagcctttg

SEQ ID NO: 6864089 - DNA, 56 bp, Homo sapiens
tttcttatgttcacataattccaccttggtaaggtggtcccatgcaatatagggaa

SEQ ID NO: 6864090 - DNA, 66 bp, Homo sapiens
ccatttttaggattttttggttgttctcaaaggttgttcctttaaaactaaggaactgaaaaatgg

SEQ ID NO: 6864091 - DNA, 70 bp, Homo sapiens
aggagctctatctgggagttctttgtagtcaatacaaggaggaaagaaggcccccagcagatgtgctcct

SEQ ID NO: 6864092 - DNA, 79 bp, Homo sapiens
gatgctctgcattctgacttagttaatatgacctctgaaattgtaaatcacatgatgctatagtctgaatgtttgtgtc

SEQ ID NO: 6864093 - DNA, 58 bp, Homo sapiens
gaggccttagagcttttctagatttaaaatatgagccatgggaaagtctaagtgcctc

SEQ ID NO: 6864094 - DNA, 56 bp, Homo sapiens
ggtttgccaggaagcacagaataatggagttcagtgttactcaaggggcagtcacc

SEQ ID NO: 6864095 - DNA, 97 bp, Homo sapiens
gatattctggcatgtgggagggcactgagaacaggctgacttggctgaaagccaggcaggatgccccggtctagtgctttctcccagcagatgtgtc

SEQ ID NO: 6864096 - DNA, 81 bp, Homo sapiens
actgcctttcatgtctattattcagtgactggcataaattatatactgtatatactgtatattggacaaggaaaagaaagt

SEQ ID NO: 6864097 - DNA, 55 bp, Homo sapiens
ttaaacatttttgatgatcgattcttatgtttgaatcgggtcagaatttgtttaa

SEQ ID NO: 6864098 - DNA, 61 bp, Homo sapiens
acatggcacaaccctgtctctactaaaaatacaaaaattagcagggcgtggtggcacatgt

SEQ ID NO: 6864099 - DNA, 65 bp, Homo sapiens
tggaattaccaggtcatatggtaaatctatgtttaacattataagaaattgccaacctgtttcca

SEQ ID NO: 6864100 - DNA, 107 bp, Homo sapiens
aggtggcgaaggctgtggccacaccatggtctcagatgctgaggcaggcctatgtgactgccagtgggtaggccatggtgagtggagaaaacaggcagttgtcccct

SEQ ID NO: 6864101 - DNA, 56 bp, Homo sapiens
ttgagaaggggagaagctaccaggatcttatttctttactcttttctcctttttgg

SEQ ID NO: 6864102 - DNA, 88 bp, Homo sapiens
ttggtatcagactaattatagagtcttggctgagaacaagaatataaatagtgttcttggtctctctcagtggctctgtagacaccaa

SEQ ID NO: 6864103 - DNA, 71 bp, Homo sapiens
tttacatttcattatggacgttaattttggaatgcttgtggctttcagtcttgatttttattgtgtgtaaa

SEQ ID NO: 6864104 - DNA, 74 bp, Homo sapiens
gcgtgttttgggaactggacttcctgctggaaagaactggtctctgcagcatcttggcggtccagcagagcagc

SEQ ID NO: 6864105 - DNA, 81 bp, Homo sapiens
gtcagtagtgcagaggctgggaaatgctgggacatgcacaagtgagccccatgagcacttctgtggcctctgcacagagac

SEQ ID NO: 6864106 - DNA, 109 bp, Homo sapiens
gatacatttatgttgtattttcatttcagcttgcttagtctccttctcattcaggtctgagagtgacttgctggttgaattcaatgaagttacttaatatatctgtgtt

SEQ ID NO: 6864107 - DNA, 60 bp, Homo sapiens
gtagctgtgcagaggtttggcttaagatccaaatactatagctcagccgggcacagtggc

SEQ ID NO: 6864108 - DNA, 59 bp, Homo sapiens
ctggcagcttagcactctggtttttatgtgtgaagccgtaatatttggtgagctgtgag

SEQ ID NO: 6864109 - DNA, 73 bp, Homo sapiens
cttggttatttttgattctgtggattcttgattgtaacatttaatgaaatatctaaagtgttaaatagctggg

SEQ ID NO: 6864110 - DNA, 70 bp, Homo sapiens
tgaagagtcttgttctctttctccactcagcccagatctgtcagtgggagaatgaataagggcctcttca

SEQ ID NO: 6864111 - DNA, 79 bp, Homo sapiens
cagcatttgaatgagattgctgtaacttctagtccctaacttggtgctttggattttacagggatcccataaatgtctg

SEQ ID NO: 6864112 - DNA, 116 bp, Homo sapiens
acccgtgtgacaccaattccatcttccaggacaccagggtagtattctgtgcaatgaaagtaatttactaaatggtcctctggtgtcgtggaagagtgaattcattttgcacaggt

SEQ ID NO: 6864113 - DNA, 65 bp, Homo sapiens
taggcttcttgcttccaaatgcattgttatccagtaagattatgctttgccagagcaaaagtcta

SEQ ID NO: 6864114 - DNA, 79 bp, Homo sapiens
ggacggtgcaggctaagtgagctggctaggagttcgggtgcctggcttctctccctggcactcagacctgcacccatcc

SEQ ID NO: 6864115 - DNA, 58 bp, Homo sapiens
agtaatgtcccttaaatgtggttttattctttcttactgtgagttaagggacatcatt

SEQ ID NO: 6864116 - DNA, 75 bp, Homo sapiens
tcgtgtgacagaagcaaggtctgtcagtatattcaaaatatatgttatattttaatcttgttttctgttttatga

SEQ ID NO: 6864117 - DNA, 107 bp, Homo sapiens
agggccctgtgggcacatttctgcatctcagagctaggtggtctccatggtctctttagctctgtggatctttttaagctgaaaccctgtgataaccctagggcctt

SEQ ID NO: 6864118 - DNA, 72 bp, Homo sapiens
gggataggaactttgaaagtcatttcttctaagtagcaaagctgcttgttgaattgcattttccattatctt

SEQ ID NO: 6864119 - DNA, 65 bp, Homo sapiens
agccaggatggggagcagatagaatcagagagacctagattttaatcatgcttctatgtcctact

SEQ ID NO: 6864120 - DNA, 84 bp, Homo sapiens
ctgcaatattcatgtgatttgaggtacataaatccagtttcagctatctatgtatccttaaggtcctagtcatgaacaacgtag

SEQ ID NO: 6864121 - DNA, 130 bp, Homo sapiens
ggagctcagatgtcagacagcaggaggaataaaaatgctacttgtgaaaacccaggctgtaggtaaaacttactcttttgttggttgcactggtgggttgggactttctcctgaactggccttgaaatcc

SEQ ID NO: 6864122 - DNA, 71 bp, Homo sapiens
gcattagttcttagcagacacagccaccaccgggaattgtttggtcctgcttgctgcttaagaaaatctgc

SEQ ID NO: 6864123 - DNA, 64 bp, Homo sapiens
aacagaaagaggatgcagatctcatttttatttggaggatgcagatcacatttttctgtctgtt

SEQ ID NO: 6864124 - DNA, 58 bp, Homo sapiens
tttgcttgcattgtccctggtgaagccattgaaaagctttactgctttctgcagcaga

SEQ ID NO: 6864125 - DNA, 83 bp, Homo sapiens
gggtgaaggaaatcgtggcggtgcctggccctgggttaggcgctctctttcccggcgaggccaccgtggtttccgagctgccc

SEQ ID NO: 6864126 - DNA, 65 bp, Homo sapiens
tctgggctggttgtgcttgctttgactggcagaatacagcagaagcaatgctgagccagttctga

SEQ ID NO: 6864127 - DNA, 89 bp, Homo sapiens
tctatttcaagctaggaaatgtggacttaattctaaaagctatgagacacctctcacaagctcaaggattagtagacttgaattataga

SEQ ID NO: 6864128 - DNA, 66 bp, Homo sapiens
tcctacatttgttcaaataagctgagaaatccttggtactcagtatgtctactggacaaagttgga

SEQ ID NO: 6864129 - DNA, 129 bp, Homo sapiens
tagacatgcaattggcctaacaggcagatgagttaatttattggtttttagcagtgagttgcattaatgacattactgatgaaaactaataaattaactcatctaccttgtaagccaactccacaccta

SEQ ID NO: 6864130 - DNA, 98 bp, Homo sapiens
tcaagtgtggtttactatcttgcagaggccagcaaccacagtaaattggaagatcctgggtatttctggtgctcagagcaagaatggttcatatttgg

SEQ ID NO: 6864131 - DNA, 72 bp, Homo sapiens
tgggaactatgctcactacctgggggacagaatcatttgtacaccacctctcagtgacatgccgtttaccca

SEQ ID NO: 6864132 - DNA, 95 bp, Homo sapiens
ggattgcataccttgtctgaagtcacacagatgcaaaaggaaggactagaaactgaccctgggcatcttttgtgactcaggcgaatgttctttcc

SEQ ID NO: 6864133 - DNA, 79 bp, Homo sapiens
ggggttagtaggtaattggtagaaggaaaagggaggtctggaaagtcctcagcctcacacagttatctcttcatacctc

SEQ ID NO: 6864134 - DNA, 84 bp, Homo sapiens
tattaaggtcacacgtggagattctgggcaattacagatagtgccttctcctcccacagaaatctccatgtcagacatgtagta

SEQ ID NO: 6864135 - DNA, 84 bp, Homo sapiens
tagcctttcttcccatgatcacccgtgcacagatgaggaggctgagctggtctgagcatggccggtccatggtgggctaggctg

SEQ ID NO: 6864136 - DNA, 59 bp, Homo sapiens
tggtggaaggcagagctacacctctttctctcttataggcctgttctttgtctttccca

SEQ ID NO: 6864137 - DNA, 64 bp, Homo sapiens
ttcaagagtagataggtgccatgaagaaggaattcaacatgggctgaaaatctgcaaacttgag

SEQ ID NO: 6864138 - DNA, 78 bp, Homo sapiens
gattttatctttggttgcactgcaggtgttcagctctccagattcgccacatctgttaccaaccgatagtcaagaatc

SEQ ID NO: 6864139 - DNA, 90 bp, Homo sapiens
atgagccagatggcctgaggtggcatcctagctctattgctaaccagcggtgttgccttgggcatgccacttcccttcctcatgcctcat

SEQ ID NO: 6864140 - DNA, 77 bp, Homo sapiens
atacagattggactttcacatagcaaaggagagcctaggttatggaattttctttgcaaatgtgaatgtcattgtat

SEQ ID NO: 6864141 - DNA, 69 bp, Homo sapiens
gaggcggaagggttgcttgagcccaggagttcgagaccagcctgggcaacatagggagacccctgtctc

SEQ ID NO: 6864142 - DNA, 59 bp, Homo sapiens
tctttccatgcctctatttagaattcccttaatagttaagtgtgtgaggtgtggtagga

SEQ ID NO: 6864143 - DNA, 56 bp, Homo sapiens
gagcattgaggtgggtttctcttatgtaactccaagagcaataagacctcatgctc

SEQ ID NO: 6864144 - DNA, 59 bp, Homo sapiens
tgcccttccacctgctgtctgagctgtctcgcctcatgcagcccttcaggtgaggggca

SEQ ID NO: 6864145 - DNA, 105 bp, Homo sapiens
ggaaggtgcaacgtaagagcagacacaacctgagatgcccttgagatttaggagaacaggagggcgccctttctgttgtgacctgactcttaaaagaaatcttct

SEQ ID NO: 6864146 - DNA, 106 bp, Homo sapiens
tgtctacatagcaggaatgaaatagaagttaattaaattattactgaatgatcaagtgagagtattaatgtgaacttccaatttctttaccctattctagcagata

SEQ ID NO: 6864147 - DNA, 56 bp, Homo sapiens
tccagcagggaattagtagtctacgaaaagtgaccttgctgccttctttgcttgga

SEQ ID NO: 6864148 - DNA, 67 bp, Homo sapiens
gggtcttcgccgccgccataactgctccagaggaagaaaagaaagcgacgcggcacgcggagagccc

SEQ ID NO: 6864149 - DNA, 58 bp, Homo sapiens
ttcttactacatttgcaggctaactgttgaaaaaacagtattttgtttgtgggaagaa

SEQ ID NO: 6864150 - DNA, 55 bp, Homo sapiens
gtgcagaccttagttcaagccatcaggttagacttggcttagactgagttctcac

SEQ ID NO: 6864151 - DNA, 61 bp, Homo sapiens
ctcgtggagtgagtgtccagctcgtgccctcctgtgccgagtagacagccttgctcctgag

SEQ ID NO: 6864152 - DNA, 99 bp, Homo sapiens
agctcagcgtgggccccttatatgcactgggtgaggaaggagaagtttcttctaaacgcagccatttctctctttctttctctgtgcaccagcaaagct

SEQ ID NO: 6864153 - DNA, 70 bp, Homo sapiens
atatccaatgtgttccattgcatgtgccttttgctccagaggccaaaaatgcaaggacatgtaatgatgt

SEQ ID NO: 6864154 - DNA, 64 bp, Homo sapiens
gcatgcacaggctgtgggctggtttcagctcttctcctgcgaactagctaggcagcctgtcagc

SEQ ID NO: 6864155 - DNA, 61 bp, Homo sapiens
ccccttccaggaagcagaatcgggcctggtcaaaaaccatttattttccccaaggaagggg

SEQ ID NO: 6864156 - DNA, 73 bp, Homo sapiens
atgaccaggaaaaggcaagtctttcctgaatcacaatatgacaggtaaagtactgggttttatgcctggccat

SEQ ID NO: 6864157 - DNA, 58 bp, Homo sapiens
gccacccggtctggagccggcctcgtctgccagcgaacagccaactttagcgggtggc

SEQ ID NO: 6864158 - DNA, 67 bp, Homo sapiens
actgtgtgtgggagttagagtgtggtaatcaatcagtaagtcctcacctggcacattctaccacagt

SEQ ID NO: 6864159 - DNA, 63 bp, Homo sapiens
agatttcaggggatttgaaaacgggagtgttcttcggcttctgccttcagtcctctgacttct

SEQ ID NO: 6864160 - DNA, 77 bp, Homo sapiens
ggctggagtgcagtggcatgatgtgggctcatggcaacctctgcctcctgggctcaagtgatcctctcacctcagcc

SEQ ID NO: 6864161 - DNA, 86 bp, Homo sapiens
gtaaatgagaggaatgaggttaaggactttccaccatcaaccagaggaaattcactatctcataacgtccttccttctaattttac

SEQ ID NO: 6864162 - DNA, 106 bp, Homo sapiens
ctgtaactttagacccagattcaggcagtgtcccaggaagccacctgtgagtgtgtgcagcttctaggatctgccccaattttatctacaaagggtctaaatgcag

SEQ ID NO: 6864163 - DNA, 72 bp, Homo sapiens
cttttgagaagtgctgagtgattgcaaaggagcccagcctagctccttagcaggcattcaggaccttgtaag

SEQ ID NO: 6864164 - DNA, 72 bp, Homo sapiens
cactgtgttctatttatctatttctgaatgaccaaagaccaccggttgacccagttgtaaaagagctcagtg

SEQ ID NO: 6864165 - DNA, 56 bp, Homo sapiens
agttcatggagaggagaccgggaactaacagtccagacttcagcatctccggagct

SEQ ID NO: 6864166 - DNA, 55 bp, Homo sapiens
tttgcatatcctccaacacatggattttactgattcaattatggatgtgtgcaaa

SEQ ID NO: 6864167 - DNA, 73 bp, Homo sapiens
ttctgaaggtcagcagcttggtactgtgccgtatctaattttctcagcctgtcatgctgctgaaccttcagga

SEQ ID NO: 6864168 - DNA, 79 bp, Homo sapiens
cagtgatagttagtctggtatcagtgaatttgcaagttgatattcaaatcaaagtgaaaagtgctgatgactgtcactg

SEQ ID NO: 6864169 - DNA, 72 bp, Homo sapiens
tactaaattttcaggttttactctcctattgtagaaagtagcctgcctgggggactaaggccaaatctagtg

SEQ ID NO: 6864170 - DNA, 57 bp, Homo sapiens
tctggagattttacatctaatcatttatttataaatctgtagatggcagtctgcaga

SEQ ID NO: 6864171 - DNA, 88 bp, Homo sapiens
gacatttgcttgaacccaggaggcagaggctgcagtgagctgagactgtactactccactccatcctgggccacagagcaagactgtc

SEQ ID NO: 6864172 - DNA, 81 bp, Homo sapiens
cagtagattcatctgttcactcggcatgtatgtattcaatagctagtacatacatagcagggtagtagatcagtcagactg

SEQ ID NO: 6864173 - DNA, 85 bp, Homo sapiens
gaaagagcactggatagggggttagatgactaagcctgctgtgtgacttccagctggttgcttaacctctctgggctgcactttc

SEQ ID NO: 6864174 - DNA, 73 bp, Homo sapiens
gtcatttgctgcctcagtaggtgccggctggaggagctcccaggctggcactgctgaagtggcattccctgac

SEQ ID NO: 6864175 - DNA, 83 bp, Homo sapiens
ttgttgtgtttaacctcccccacctgaggacagtcttattttaaaataaggcttttgttcagcgtgggtgtattttataataa

SEQ ID NO: 6864176 - DNA, 78 bp, Homo sapiens
tcccggcagtgtctcctgggtctggcctaactaagctgggcttcggccaagctggccggcctccaggtggatttggga

SEQ ID NO: 6864177 - DNA, 91 bp, Homo sapiens
cctggtggggcccctcaggggctggttccagggcactgttgagggagcagggctcgctgccagcttcagggacggtggccccacgtccagg

SEQ ID NO: 6864178 - DNA, 102 bp, Homo sapiens
aagtgacgtggaaggatttgagtgtggtttctatgtggcaagatcaaaaattgtttttgataaacattttaggaactaacaagatgatgcttttacttgctt

SEQ ID NO: 6864179 - DNA, 68 bp, Homo sapiens
tgtgggtctggagtcacactcaggacagcgggctctgatttcctggagaactgattcgcgggtccaca

SEQ ID NO: 6864180 - DNA, 61 bp, Homo sapiens
tcacaggcctgatgccttggctgggacgattgaactcagctctggttcatgtggtctctgg

SEQ ID NO: 6864181 - DNA, 72 bp, Homo sapiens
gggctcgcttagattttcctctgacgcaacaatttacagaatccactgttgatttagggatctggggagcct

SEQ ID NO: 6864182 - DNA, 62 bp, Homo sapiens
gcaatggtttatattgtttttcatgcctacatagcatgagaaatttattacaagctaacagc

SEQ ID NO: 6864183 - DNA, 66 bp, Homo sapiens
ccctgatggcctatctggcagtcatcgtcctgaataaagactggaaagaaaaacaggccatgaggg

SEQ ID NO: 6864184 - DNA, 99 bp, Homo sapiens
tcgaactttatataggcaaacagttttctcatttagtgtttgttaatgcttgttctaaataacattttgaaagggaaattgtttggttatctattttga

SEQ ID NO: 6864185 - DNA, 88 bp, Homo sapiens
tggtcatttgcaagagataaatgtttcctttacctcattaattcacatctttcggcatagaaaatacgcattatccttgcagttacca

SEQ ID NO: 6864186 - DNA, 87 bp, Homo sapiens
ttccacattagttcattcagactttcagataatcaagatggtttttttaactcatcttcagagagttggaaagaattaataatagaa

SEQ ID NO: 6864187 - DNA, 63 bp, Homo sapiens
tctggcctcaggcgagctgcaacttggatccctactgactcagctgaagcagcctgggctgga

SEQ ID NO: 6864188 - DNA, 80 bp, Homo sapiens
ctccctagtgagatgaacccagtacctcagatggaaatgcagaaatcacccgtcttcttctgtgtcgctctcgctgggag

SEQ ID NO: 6864189 - DNA, 60 bp, Homo sapiens
gctctagctcccagggagcgtctgaaaatgccctggccagaatccctggggagctgcagc

SEQ ID NO: 6864190 - DNA, 77 bp, Homo sapiens
gtttagaagaagtgagatcaaaattggtattagagttaggctataactgctaccagcattgatctcatgcactaagc

SEQ ID NO: 6864191 - DNA, 117 bp, Homo sapiens
ggataaattaactggggaatatggataaattagatcttgcaacctgctgtgtggcttatttaatgttggcccacagttagtttgcatggctgatttgaagtttctttcctcaaatcc

SEQ ID NO: 6864192 - DNA, 64 bp, Homo sapiens
gcggctggctgtccaaactgggcccgcgtcctgaagtgaccccagcctgatctcggccagctgc

SEQ ID NO: 6864193 - DNA, 55 bp, Homo sapiens
tactcactctatggatctggaaacagtgaattttttctagatccagaaagtggta

SEQ ID NO: 6864194 - DNA, 66 bp, Homo sapiens
gccaggcttattccctgctgtctatccagagcctagaacagggctggcacacagtggatgcctggt

SEQ ID NO: 6864195 - DNA, 84 bp, Homo sapiens
gatttagtcattcttcctgggggtatgaattcacaagggcaagctttaaatgctgttgtgtacacgcctttaaatgattggttc

SEQ ID NO: 6864196 - DNA, 71 bp, Homo sapiens
gtggagataaagacagggcctggcaggggcaggatagatgctaatgccttgccactgctcttaatgtcggc

SEQ ID NO: 6864197 - DNA, 91 bp, Homo sapiens
gggatagactgtagcatcttgaaatataaagtcaatgtctttttattatgaatatatttcaacatgctgtattagcttgacagatcattct

SEQ ID NO: 6864198 - DNA, 62 bp, Homo sapiens
tgcagggggattgggcagattttcatactcatacatttcagtctgcactagtcatttctgta

SEQ ID NO: 6864199 - DNA, 57 bp, Homo sapiens
gagctagactgggctctgatgtaggtgccaagctataggttgggtccagatctgctc

SEQ ID NO: 6864200 - DNA, 69 bp, Homo sapiens
gatgtgataggcagcttgtttaggaggaaataatgtcgcgtacggagtgcctgagcatgtcttcaggtc

SEQ ID NO: 6864201 - DNA, 66 bp, Homo sapiens
agattctcaggccccacccagactaactgaaaaatcagaatctctgcagggagggcccagcaatct

SEQ ID NO: 6864202 - DNA, 70 bp, Homo sapiens
gcctctgacacgccgtgccctggacccgaaatgcccgccccactcctggagcctccggtgtgtgagaggc

SEQ ID NO: 6864203 - DNA, 58 bp, Homo sapiens
gagtgcagtggcgcgatctcggcttactaagaggccctgttatgagccactgtgactc

SEQ ID NO: 6864204 - DNA, 77 bp, Homo sapiens
gctaaggcaggatttgggaatttttaggtgtctttagtcaatagcatcttaagcttcatcaaccctgccacttgagc

SEQ ID NO: 6864205 - DNA, 85 bp, Homo sapiens
gtaagcagttgctttgctcccaagggcatatggtatctttgctccacagtgcctgggacacagcagatactcaataaatgcttgc

SEQ ID NO: 6864206 - DNA, 67 bp, Homo sapiens
agaacctggcacctgtgttttctggatgctgaccaggtgcgtctgatggaaccaggttccagggact

SEQ ID NO: 6864207 - DNA, 58 bp, Homo sapiens
ttggagttggggcttccttgcctgcttcacaggtcaggctgagctctcccagcttcag

SEQ ID NO: 6864208 - DNA, 57 bp, Homo sapiens
ggttacacagtgcacaagcagagtgattattgtctactcggcgttgtgctgtgtacc

SEQ ID NO: 6864209 - DNA, 55 bp, Homo sapiens
aagtctggagctcagacttgggagcctggtgttcctgggtttgaattctagtctt

SEQ ID NO: 6864210 - DNA, 83 bp, Homo sapiens
gtttgaggtatatgcattgatagaaaaacatggactaaaaaaaactcagtctgtatttatatattcattgtgaattctcaaac

SEQ ID NO: 6864211 - DNA, 93 bp, Homo sapiens
taggtccccatacattttctatgacattggttgtgtgccatctggctcatgactttccagcaatttcatggataaaagatgtataataatctg

SEQ ID NO: 6864212 - DNA, 85 bp, Homo sapiens
atcttgtcctcactggagactcagaaggggaagcattgggaaaccatgtatgtttcatttctggtttaaccaggcttttcaggat

SEQ ID NO: 6864213 - DNA, 80 bp, Homo sapiens
ttggaaatgtgtaaagcttttctttgttcagtgagtcttttcattatttaaaatagagagcagctttgcggttttctcaa

SEQ ID NO: 6864214 - DNA, 88 bp, Homo sapiens
tgtttcccctttccaaactataaagtggctatatggtagttttaataaactactgtgtgactgttattactgtttgctgttggaaata

SEQ ID NO: 6864215 - DNA, 129 bp, Homo sapiens
gaaggaaacacgagaccttggcatccctctcactcgaaggcatggcagggtttacacaattaggcttaattatgtcctgctctgctttcagtgagtgtgttccttgcaggtggagtctggctttccctc

SEQ ID NO: 6864216 - DNA, 68 bp, Homo sapiens
ctcctcccaggcctaggcagtataaaaaaaggtgttaaggggctgttaacaatagggctgggaaggag

SEQ ID NO: 6864217 - DNA, 72 bp, Homo sapiens
ctctgcttagccgcgacctcgcctcggcgtcactgcgcatgtgcgccagaggaacgctgcgcgcccgcagag

SEQ ID NO: 6864218 - DNA, 107 bp, Homo sapiens
gatagttatttgcattatggtcagtacttcacctgtcaagttcttagcgaatatgtcttaatatacagtgaaaagtagctaacacaacagtgcttatttaaactatc

SEQ ID NO: 6864219 - DNA, 62 bp, Homo sapiens
gagctacaaatccacaaggcactttatggcaattccaagaaggggctgaaaggtttgtgttc

SEQ ID NO: 6864220 - DNA, 63 bp, Homo sapiens
agaaaggtattgttccctagtttctaggcttgcttctagagaggttagtttgcagtactttct

SEQ ID NO: 6864221 - DNA, 62 bp, Homo sapiens
gtcatagcctcccttccttaggatccatgtgttgatgctgaggcctgtgttggggcagtgac

SEQ ID NO: 6864222 - DNA, 65 bp, Homo sapiens
ggcttactgtagaaggaaccaactagtctgattggcaaaagctgggaagagttttctgcagagcc

SEQ ID NO: 6864223 - DNA, 130 bp, Homo sapiens
atcccctgtggagtctccctgaggctgtcctcccctgcagacatggcattctgttcctgagggtggggaggagaaagcagtgatttgtgggtacaggggttctagccaggggggattatggggaggggat

SEQ ID NO: 6864224 - DNA, 129 bp, Homo sapiens
ttttggttaaatattgataactttgcacagcagaatgcagaatgttcattttgtgggtagatagcagacaactaacaggtagagtgaagctttttatattctgtgaaagtgcagaagtcatatatcata

SEQ ID NO: 6864225 - DNA, 100 bp, Homo sapiens
tggggagcgaatgaggcttctgggctggctttatgctgacaagggccttctgcactgtcagcccggccccagctcccagcaagtctcctttcgctcccca

SEQ ID NO: 6864226 - DNA, 64 bp, Homo sapiens
ggccttgggctggctgcagtatcaggccctgctggcacacagctgcaactggccaggccaggcc

SEQ ID NO: 6864227 - DNA, 60 bp, Homo sapiens
catgtgtcgtcaggtctgagagccgtggattcaaatcccactctggagctgatgcaggtg

SEQ ID NO: 6864228 - DNA, 59 bp, Homo sapiens
taagacacagaagttgctgttgggttttctggcatgagccctttggattctgtgtttta

SEQ ID NO: 6864229 - DNA, 73 bp, Homo sapiens
gccagctagaggctgcagtgcactatgagaacacctgtgaatagccactgcattccagcctgagtaacatggc

SEQ ID NO: 6864230 - DNA, 57 bp, Homo sapiens
tcaaatgaagacagttgacttgcgtctctacttaagttgacttgtgtctctatttgg

SEQ ID NO: 6864231 - DNA, 121 bp, Homo sapiens
catttcctgttacttggtggtagcctgctacaggcttcagtttctcttgagagcgggagctgtgtcttgtttctcctggtgcctgatatatagtaggtattccataaataagttgtgaatg

SEQ ID NO: 6864232 - DNA, 61 bp, Homo sapiens
gccctggctccagctgcctgtccttgtttaagatgatgggttgaggttggacccactgggc

SEQ ID NO: 6864233 - DNA, 106 bp, Homo sapiens
agtggctttctttttcttgccctgaagcagcaaatgatgggagaaatatgtgtttgtttctgttcttcagagtcagagctgcttcaggcataaaattcttagccct

SEQ ID NO: 6864234 - DNA, 80 bp, Homo sapiens
gcagatgttggctccagggcaccagcgtccccctggcatgcacgcggggaccagctgggtcctgttgtccggggacctgc

SEQ ID NO: 6864235 - DNA, 72 bp, Homo sapiens
cagcctgaggtttttcggtcttaactggaaagggacacaaagaggagagaccctggtaaacactccaggctg

SEQ ID NO: 6864236 - DNA, 83 bp, Homo sapiens
cattatattattctgaattattgtttaggaatgtttagactatattttttccagaggagtgattcagagggtatgttttagtg

SEQ ID NO: 6864237 - DNA, 56 bp, Homo sapiens
tctgctaacaatattgcagactttggaaatgtcccagaagctatatgttaagcaga

SEQ ID NO: 6864238 - DNA, 55 bp, Homo sapiens
cttagccctgagagttctgagccacccctgtggatgttcaagaaaaggggctaag

SEQ ID NO: 6864239 - DNA, 62 bp, Homo sapiens
tttcctgtgggttttctgtagaaatccctttttggattgtacagatgaacctcactctgaaa

SEQ ID NO: 6864240 - DNA, 68 bp, Homo sapiens
acagaggtctcagttatgtttaaaatgtgttaccaatggtgactatcatttaggcattactcttttgt

SEQ ID NO: 6864241 - DNA, 62 bp, Homo sapiens
actgtcaatagtgctgagcttgaaaaacctggtagagagcaaggggccaagcacgtgacagt

SEQ ID NO: 6864242 - DNA, 56 bp, Homo sapiens
tctgtattgagaaagccggacatggtttgcttttgctggctttttgctagtgcaga

SEQ ID NO: 6864243 - DNA, 101 bp, Homo sapiens
ggaaaatggaaaagtctggcattggagcagtccgcagaacaaggaaaaaacagctttgctttgcttggcccattgcttcagtatcttatagttggttttct

SEQ ID NO: 6864244 - DNA, 60 bp, Homo sapiens
ttagtgctagtttcacaacaagcaaaataaccatagtgtctcttgagaaataagcactaa

SEQ ID NO: 6864245 - DNA, 87 bp, Homo sapiens
agctgctcatcagaggagtcctgtgtcttccaggaaaagggctgacttagtattcctgatgcacacagtcatttacagtgagcagtt

SEQ ID NO: 6864246 - DNA, 78 bp, Homo sapiens
ctgtatatgagtgcttaaaacagaaaacattgtgaaatatggagcacagttgtgagactaagtacttaacgtattcag

SEQ ID NO: 6864247 - DNA, 66 bp, Homo sapiens
ctggcagccgtggagggcaggggtgctcctgggggctcggagacctctgctcccttcatggtccag

SEQ ID NO: 6864248 - DNA, 81 bp, Homo sapiens
caccaacagactaaatgacaggtaccatagtggggacatttttctggctcctggtacagtgcctgtcatttagaagtggtg

SEQ ID NO: 6864249 - DNA, 66 bp, Homo sapiens
ctgggagtactgggggatgtcacttactgtagaatagacagggagggacactgtcatgctcaccag

SEQ ID NO: 6864250 - DNA, 74 bp, Homo sapiens
gagtcagttgcaaacatcaggcacgcagcctgcacttgatgctggataacttgctgatgttgtattcctgactt

SEQ ID NO: 6864251 - DNA, 56 bp, Homo sapiens
gaaagctgtgaaatagtgctctaagagttgtcaagagctgtggttttacatctttt

SEQ ID NO: 6864252 - DNA, 74 bp, Homo sapiens
gtgacccgggaaacagtcccacggagaagccaggaccctgggccttctccctgggggctctttatgcaggtcac

SEQ ID NO: 6864253 - DNA, 62 bp, Homo sapiens
gaaggttgaagaggaagatgactagtggaatactaatagattctgaccctctttttactttt

SEQ ID NO: 6864254 - DNA, 61 bp, Homo sapiens
ttgacctcagtgagatgctcagcgaagtccaaaggctattgctgactgtcttctgagtcaa

SEQ ID NO: 6864255 - DNA, 59 bp, Homo sapiens
ggcctgagggtgggctctcagtggccctgttgctatcctgtggccccaccctcttggcc

SEQ ID NO: 6864256 - DNA, 58 bp, Homo sapiens
ccaagaccccaggtgtataaagatattctttttcagtcaggatattccaagggcttgg

SEQ ID NO: 6864257 - DNA, 59 bp, Homo sapiens
tcctctccagccacagaagctgctcctgcaaggagtgcaaacattttctcctggaagga

SEQ ID NO: 6864258 - DNA, 66 bp, Homo sapiens
tcatattcaaggggtaaggcaaaaccgcctatgaattggcatatttgtttatttctctgtttgtga

SEQ ID NO: 6864259 - DNA, 67 bp, Homo sapiens
ctgtgttgggctctgcgtcctggaacatcagttccctgtcctcaggaacacaggggcccatgcacgg

SEQ ID NO: 6864260 - DNA, 130 bp, Homo sapiens
ggcaaggtggccaggtgttcgtatccatacattggccaggctttggtggggggctgccccttgggagagcaaggcagttctcagccaaggcaatccccatgagggacacacctgtatgcctttgacagcc

SEQ ID NO: 6864261 - DNA, 60 bp, Homo sapiens
caattcattacattgcaaagactgagctcagaatggcttgtctgatgcttgatgcagttg

SEQ ID NO: 6864262 - DNA, 84 bp, Homo sapiens
aacactgggatcaaaattaaaccaacgtccagtttctagactgcctttagatattattaggaactcaggatttttctcagtgtt

SEQ ID NO: 6864263 - DNA, 67 bp, Homo sapiens
gagttccttctgcctcagcttggctttgaactacatttagcttacacaggcaggcagtggagtactc

SEQ ID NO: 6864264 - DNA, 56 bp, Homo sapiens
agggctcccgtgaggtgactgcagccagtttcttgtacatatcatggtagagtcct

SEQ ID NO: 6864265 - DNA, 72 bp, Homo sapiens
tgaagagactgtgttcaattaaaaagcttttgttgccaaggaatttttttagttgatacatatgctccttta

SEQ ID NO: 6864266 - DNA, 62 bp, Homo sapiens
tttgcaaacggccctgagtcccccagtttatgtcttaattcgcagccagggctgattgtaga

SEQ ID NO: 6864267 - DNA, 68 bp, Homo sapiens
tgaggcagtcatattttggtaaagaatttgtagactttgcagaggtctcttcaaaataatctggctca

SEQ ID NO: 6864268 - DNA, 64 bp, Homo sapiens
tgaaatatacatgaagtcggctgaatgcagacaaaattgcaccatttactgcatgaatatttca

SEQ ID NO: 6864269 - DNA, 101 bp, Homo sapiens
tgttgtgtgaaactgttatgttggccgctttaatgcaatttcacctcatttacatgaattttgatgttgcttagggatattcaatacaacagcacccaaca

SEQ ID NO: 6864270 - DNA, 87 bp, Homo sapiens
tctttttgtatgtgcacatgctctattttgagtagtctgaactgtttgacataccgaatatgtgagtattatgcatataggaataga

SEQ ID NO: 6864271 - DNA, 78 bp, Homo sapiens
cggtgaaacgcgcagctctggccgagggcggcccaggtccttggaagaccttgctgccctccggagcgcccctcactg

SEQ ID NO: 6864272 - DNA, 57 bp, Homo sapiens
tgaaagacacagaagttgcccaggtttagtcctaggcagcttacttggtctctttca

SEQ ID NO: 6864273 - DNA, 84 bp, Homo sapiens
ctggcatcagactgcatctgaaacatgggtcaacatatgtgcatgactgagcatgtttccttaggcctgcagctctgctgccag

SEQ ID NO: 6864274 - DNA, 99 bp, Homo sapiens
atgtatacatcaaccatggggatggctctgagaacctgagctagtatgtgtgattgcatctgggctccagtcagaccgtagatggtgggtcttgtgcat

SEQ ID NO: 6864275 - DNA, 57 bp, Homo sapiens
tagcagcatcctgtggtgatggtttatggagaacagtatggcctggggctgctgctg

SEQ ID NO: 6864276 - DNA, 67 bp, Homo sapiens
gatgtattttggaacacagacattagaacttcatgaagttttagctgttgattgttccccaagcatc

SEQ ID NO: 6864277 - DNA, 74 bp, Homo sapiens
tggcagttaagagatcattgctgcctttttctataattggatatttataataaagaagatagaatgagctgcca

SEQ ID NO: 6864278 - DNA, 130 bp, Homo sapiens
tgtagcaattttgtaattattatttggtttcccatgtaagtctgtctacagggagaatgatatgcaaatttggagtatgtcaggtctctgtgatggtaatttctcatggggaattaacaaattgcctgca

SEQ ID NO: 6864279 - DNA, 58 bp, Homo sapiens
caggtaggaaaagggtgtcaggtcttcctacaaagaagctccttcccttttcttcttg

SEQ ID NO: 6864280 - DNA, 77 bp, Homo sapiens
gtggcttggtcaggtggtggtgcttgttgtaggtgagaagttagttatacctgcagtggccactcctaatctcccac

SEQ ID NO: 6864281 - DNA, 59 bp, Homo sapiens
tattcatctttgtcttaggctgaattctctaaaaccagaccctgaggaaaagatgattg

SEQ ID NO: 6864282 - DNA, 73 bp, Homo sapiens
gtatgaattttcttttgaccacccctttcccctaccaggggaataatggctccatggcagaggcagtttgtac

SEQ ID NO: 6864283 - DNA, 93 bp, Homo sapiens
cttgagtctttcattcatttctctgtattcagtgcctagcatatgccaggctctcgtgtgggcactggataatataaaaatgaaggacttggg

SEQ ID NO: 6864284 - DNA, 77 bp, Homo sapiens
gcggctcctgccatcccacccggctcagcaccaaacccgagtgctgggaaggggttggggatgagcagaagagctgc

SEQ ID NO: 6864285 - DNA, 78 bp, Homo sapiens
gcagagtgtgtgtggggtcatacgatgactcttgataattagtcaaagagacagagccatgtttctacacaacttagc

SEQ ID NO: 6864286 - DNA, 96 bp, Homo sapiens
ataaatgccttgttgttatggctggtggagcatcatctaaaatagtgacatgatgggtttcaccactgtagcatcaaattcaaccctcacatttat

SEQ ID NO: 6864287 - DNA, 57 bp, Homo sapiens
gatgtgagggggaagaatgaagcagaaaaagactgtttcatgagattcctccacatc

SEQ ID NO: 6864288 - DNA, 70 bp, Homo sapiens
ttgccttcaaccattgggctaaagtctgtctttcatcctaaatcaaacgctacccagtggtggatggtaa

SEQ ID NO: 6864289 - DNA, 68 bp, Homo sapiens
cgtggatggcagtggccacctccttggagcacttaacacccagaccgatgtggccattgtagtccacg

SEQ ID NO: 6864290 - DNA, 82 bp, Homo sapiens
tataattttcttttattattttctacttggctcctagttttgcttgccaagtttggattatgaaaaagtggccaatgttgta

SEQ ID NO: 6864291 - DNA, 101 bp, Homo sapiens
actctaggatggagaataaagagtcttagtgccaggttttcagttcctgattccaaatcacctgaaactcaactttatctcctgccccctatcctatgagt

SEQ ID NO: 6864292 - DNA, 67 bp, Homo sapiens
ggctgatcaggtgcaaatgcatacctggctttttccatcaatggcttctgctttgccttgattagct

SEQ ID NO: 6864293 - DNA, 72 bp, Homo sapiens
gttatgagatttgggtcagtttagttttctaatgccaaagcaaagagacaaattgaccgcaagattcattgc

SEQ ID NO: 6864294 - DNA, 64 bp, Homo sapiens
gctgtgagcactgctgggtggattagctggcattccttctcctccattgagcggagtcgcaagc

SEQ ID NO: 6864295 - DNA, 100 bp, Homo sapiens
tgaggtggagaatcgcttgaaccctggaggtggaggttgcagggaaccaagattgcaccactgcactccaccctgggtgacagagcgagactctgtctca

SEQ ID NO: 6864296 - DNA, 80 bp, Homo sapiens
gcagagaaggtacatattataaaatacagctattttcttaagctaaatgtctgtgtttaaaatgtgtacataaactttgc

SEQ ID NO: 6864297 - DNA, 82 bp, Homo sapiens
agagagcaagcaagagagatagcttattgactgtaagtatccaattactcaaatgttattcattcttgtttaaatgttaact

SEQ ID NO: 6864298 - DNA, 76 bp, Homo sapiens
acctccaaattctttttgaaagggtgatttggcttgtgttcacaacagctgctttttcaaaatataattttcaggt

SEQ ID NO: 6864299 - DNA, 55 bp, Homo sapiens
tgtcctgtctctttcctaattgaatgccagttttagcgggagaggggcagtcaca

SEQ ID NO: 6864300 - DNA, 67 bp, Homo sapiens
ggttgaaaatgactttataccatgagaggacctttcagcttaaaaaatggtatgaagttgaacaatc

SEQ ID NO: 6864301 - DNA, 55 bp, Homo sapiens
tatgtaaggagccacagtgggggcaacttctgtcttttcaatggttctttatgtg

SEQ ID NO: 6864302 - DNA, 63 bp, Homo sapiens
gccttcaagagctgaagtggcttgctctggtcataaaactagagggcagcaagctctgaaggc

SEQ ID NO: 6864303 - DNA, 76 bp, Homo sapiens
tttttgcaagatgtattagttgtccagggctgcagtaacaaaataccacaaacttggtggattagtacagcaaaaa

SEQ ID NO: 6864304 - DNA, 66 bp, Homo sapiens
gtgttgatttctcttttgaagaggccttttctcacagagcccctggagagagagttccccctacac

SEQ ID NO: 6864305 - DNA, 63 bp, Homo sapiens
ttgcaggattgcagatttgattagatgttcaatactaatctcagtctcattcctttgaagcaa

SEQ ID NO: 6864306 - DNA, 73 bp, Homo sapiens
ccatgtgtgtcccttggaacctcagctctgactcgccacaggtcacatgctgaggggtctatggcatagctgg

SEQ ID NO: 6864307 - DNA, 58 bp, Homo sapiens
gctgctttgcagtagagtaatagccaaattagcaattttttctctgctacaaaggagc

SEQ ID NO: 6864308 - DNA, 68 bp, Homo sapiens
ggtgggtagaggccagggtgctgtgacactcttttacaatgcatattacaagctctgcctctcccacc

SEQ ID NO: 6864309 - DNA, 68 bp, Homo sapiens
gtgtcctggattcaacctttgcccagatatctttcttaattttggcatcacttgccatctagagacac

SEQ ID NO: 6864310 - DNA, 60 bp, Homo sapiens
gctcactctgagtgagaagtcctgggctagagtccccaggcaaggtctcctagagagagt

SEQ ID NO: 6864311 - DNA, 77 bp, Homo sapiens
actgctcccctccccactgtgttgcagtctagtgcttcaggagttgactgtaagtccacggatggactttgagcagt

SEQ ID NO: 6864312 - DNA, 68 bp, Homo sapiens
ggttgggcatgacattcctaatcacagtccctatacctgggattgagatgaagatagtgtcactcacc

SEQ ID NO: 6864313 - DNA, 79 bp, Homo sapiens
ttctccttatcctcaaaggtatttagatgcacatacatggtggcccatggtccagaaactgctgagataagaaagggaa

SEQ ID NO: 6864314 - DNA, 72 bp, Homo sapiens
acttttaaaacttctcatttttatggtgaaaaagtcataaatttattctgaatttgtgaagtttgaaagagt

SEQ ID NO: 6864315 - DNA, 73 bp, Homo sapiens
ggggcttcgcagacagcgagcggaggggcttccccgtaaggggcgggcttcgagggtcgcgtttggaaggcct

SEQ ID NO: 6864316 - DNA, 63 bp, Homo sapiens
tgctacagataatggcccagaacaaagatggcagctgctttgtaggggaacagatttgtggca

SEQ ID NO: 6864317 - DNA, 93 bp, Homo sapiens
cttcaccacttcaccactgtgcatcctgggaagtggcctcctcctttaaatagggatggaggtctccagggtgtgctctggaagtttgtgagg

SEQ ID NO: 6864318 - DNA, 71 bp, Homo sapiens
gtctccatccctgggtcagccctttcctgccatgaattcaggaaggcagaggcagctcagcagatggggac

SEQ ID NO: 6864319 - DNA, 77 bp, Homo sapiens
tggttagaacctctccacagagtaggggatgagggggcacaccccaggcacatccactctgtgagatctctgggcca

SEQ ID NO: 6864320 - DNA, 70 bp, Homo sapiens
ctgtcctgaaagcattaactccacttcccttcccagtggaagaggtgagaggatgtgacttttggctcag

SEQ ID NO: 6864321 - DNA, 69 bp, Homo sapiens
ttatttgaggagaatgcgcaccacatatatgtttcttttaatgtagtagtggtattattcctggaataa

SEQ ID NO: 6864322 - DNA, 75 bp, Homo sapiens
tgggagtgagaaattttcagcaagtagttatttgggatgatagtttttgacagctgcttgttgaaatccaaaccg

SEQ ID NO: 6864323 - DNA, 57 bp, Homo sapiens
ctctgctgttagtgtgaggtttgaggattttactttaaccacatggattagtcagag

SEQ ID NO: 6864324 - DNA, 82 bp, Homo sapiens
ggactctgtgttccttttcatgcattggaatcttcctagtcctcaacagggagcctaggagcaggcacaaggaaacatgtcc

SEQ ID NO: 6864325 - DNA, 80 bp, Homo sapiens
ggctcactcacatggctgttggcaggaggcctcagttgcttgtcgcattgggcccctccacatggctgcttgagtgtact

SEQ ID NO: 6864326 - DNA, 68 bp, Homo sapiens
ccagaggatgctggtcagcctcgcctaacctaatcacttatgggagaggagagactggctccaactgg

SEQ ID NO: 6864327 - DNA, 80 bp, Homo sapiens
cagggctgttttctgcaactctgttcatttaattcttccaaatctttcatggcccagcccaagtacagaaaagagccctg

SEQ ID NO: 6864328 - DNA, 62 bp, Homo sapiens
ggaggctgtgggagttgagagtctttgtagaattgcagggtactgcagcacccacagcagcc

SEQ ID NO: 6864329 - DNA, 56 bp, Homo sapiens
cccggagagcaggctggccgtgtcggagctgagctgggccggggagctctccaggg

SEQ ID NO: 6864330 - DNA, 108 bp, Homo sapiens
cctaaatggtctcagaaccatgatcttgtctttatttcatattccaacttaagtggtgtaatatgcttaacaatgggtggaataaatcagttctgagaagcactaagg

SEQ ID NO: 6864331 - DNA, 57 bp, Homo sapiens
agcacatcttttgggacccctgaggctctaatcaggcatctcagaattaagagtgct

SEQ ID NO: 6864332 - DNA, 57 bp, Homo sapiens
tctgagtcagattggcatgcttgcagaagtaaaacacttccatgtatttgaaacaga

SEQ ID NO: 6864333 - DNA, 76 bp, Homo sapiens
aacaaactacagggctcttccggagcagggagagtatcacactcatctttgtatccccagggtctggtacagtgtt

SEQ ID NO: 6864334 - DNA, 60 bp, Homo sapiens
gaggagagaacaagagtatcctgaggcggtctcctgcagtgctcatagctgttcctcctt

SEQ ID NO: 6864335 - DNA, 78 bp, Homo sapiens
attactattcaggtttaagtagtcttctttaagcagcccaggtatgaggaagaaactgagctctgacagactagtaat

SEQ ID NO: 6864336 - DNA, 68 bp, Homo sapiens
gtcagggcacagtgacagctcctgctcttcctggggcagtgcagatagagctgtagttctgctttgac

SEQ ID NO: 6864337 - DNA, 59 bp, Homo sapiens
gctgtcctggggagggagaatgatctggggtgagataatgctccttggctcaggacagt

SEQ ID NO: 6864338 - DNA, 81 bp, Homo sapiens
gactattccacaatgtctctatatctcataagatgctttacctaactgcagagtctcttccgtggagatgcttgggttgtc

SEQ ID NO: 6864339 - DNA, 60 bp, Homo sapiens
gatgggggccagggcctgctttggcaactccctgccagttcttgggtctgggcttccgtt

SEQ ID NO: 6864340 - DNA, 85 bp, Homo sapiens
gggttgggaggaagattcagtccccggttccccatgtcatctctgggatctggactggacatagtcttttggagccttctagcct

SEQ ID NO: 6864341 - DNA, 64 bp, Homo sapiens
aactgcattatcaccaagatgtaaccgaaccccctcggtttgtccctatgagtggtaatcagtt

SEQ ID NO: 6864342 - DNA, 66 bp, Homo sapiens
actgggtttaggccaggcaggcccaggcctggtttttggcctggcgccgggctgcctgtctttggt

SEQ ID NO: 6864343 - DNA, 61 bp, Homo sapiens
tgtcagcacatctgtaatcacagctaagctcctgctgtatgtgattttggtctgcgtgata

SEQ ID NO: 6864344 - DNA, 75 bp, Homo sapiens
atggtctctgagccttcctgtggccaccagcacattctgtgcagccccaggaccacatgggaggctcatggccat

SEQ ID NO: 6864345 - DNA, 83 bp, Homo sapiens
tgttaggttgtgcaaaagtgattgctggttttgccattaattttaatggcaaaaactgcagttacctttgtacaaacctaata

SEQ ID NO: 6864346 - DNA, 70 bp, Homo sapiens
gtacttggggtcgtatatctgtgggcccaggccgaaggcctggctgctctgatgagcgccctgactgtat

SEQ ID NO: 6864347 - DNA, 73 bp, Homo sapiens
gcttggtgggcaggtaggcaccagctacgtcttctatacctcctgtggtgggtgcctcactgtcacccagagc

SEQ ID NO: 6864348 - DNA, 69 bp, Homo sapiens
gactgtttactccatttgcatgtggcccttccccttaactggagctctaagcaatgctgtagttcagtc

SEQ ID NO: 6864349 - DNA, 106 bp, Homo sapiens
tcattaacttaaaagacgaacacaggtggcagagtatggtgattatatgctgtccctcataagctcacattcaaatctgccttctatcttttgtctgtgttaatga

SEQ ID NO: 6864350 - DNA, 105 bp, Homo sapiens
gccatgatttggtaatgggttttcaaaggaggcagagtagccaagctcttggcacaagagccagctgtactgcctgctcaggaaatcttctcattgctggctggc

SEQ ID NO: 6864351 - DNA, 79 bp, Homo sapiens
ctgctgcaccatcaggtgagaggcagaggacagcttcctccggagtgaggcttcttctctccatcatccagtccagcag

SEQ ID NO: 6864352 - DNA, 72 bp, Homo sapiens
ggattgctgaatcatatggtaattcttttttaattttttgaagagctgccatatgtttttaaattgtgatct

SEQ ID NO: 6864353 - DNA, 75 bp, Homo sapiens
ctatcccagtcccactagtgccaataccttgaccttcccatgagacgttaggaatctttgtggctgctgggatag

SEQ ID NO: 6864354 - DNA, 84 bp, Homo sapiens
gcactttctctgaggatacttctcatgggctctgagcaggcagtcctggacccgtggaaaagggggtagctttcctgagagtgt

SEQ ID NO: 6864355 - DNA, 70 bp, Homo sapiens
tctaacagaatcaaggctgcttcagactagtgacatctttgtcgaaggtaacgcagcttgaccctgtgga

SEQ ID NO: 6864356 - DNA, 130 bp, Homo sapiens
cactgggaaagacagactaaaacatcagcgcttctccctaaggtagagcacaggggtcccagtgaactgcgacttgggccaagctttgcaggagtgttgcatgtatacgtcttccacaaatgccacagtg

SEQ ID NO: 6864357 - DNA, 108 bp, Homo sapiens
atatatttaaaaaatatacctcttctgccagtgaaaataatgattatccctggaagggtaaattattataaaattcctgtgaaggatgaggctatgaattaaatttat

SEQ ID NO: 6864358 - DNA, 64 bp, Homo sapiens
tggagtccttcaatcttaagtcagcccagcaattcagttgtattgacctgatggaggccatccg

SEQ ID NO: 6864359 - DNA, 83 bp, Homo sapiens
ttttcctaacgttgtggctggcagcaaatcactggctgttttaggccttgtggtgtttgccagttaataacatattaggagag

SEQ ID NO: 6864360 - DNA, 69 bp, Homo sapiens
gggtccagagttgaagaggttagaaagttggcagaaacaactctagtaataaggcttgaactttgatcc

SEQ ID NO: 6864361 - DNA, 73 bp, Homo sapiens
gatgtaacagtgtcaggattacagatataagaatatattatatctgtaacagagactgacaaatgtacccatc

SEQ ID NO: 6864362 - DNA, 63 bp, Homo sapiens
atgtgtttcagagggtgtagactacaaaatgaaagagactgtagattacaaaatgaaatgcat

SEQ ID NO: 6864363 - DNA, 86 bp, Homo sapiens
gttgccctgcaccaagttctatacttccctgttttttcctgagagcttcttttcacaatccaggaagcaacttggtgggggacagc

SEQ ID NO: 6864364 - DNA, 110 bp, Homo sapiens
gagctcagggaaagcaaaaaaggaagtggggaatttgcctgacagaccccagtgagcaaaattagcatcagccacaggcaggaggttctccagttatttttcctctgctc

SEQ ID NO: 6864365 - DNA, 80 bp, Homo sapiens
attggggtgacagcggggcctgtgctggggagcctcacttcctccccacctgccggctgcctccgctatatctctctagt

SEQ ID NO: 6864366 - DNA, 72 bp, Homo sapiens
tatacccagagactagcacggtacaagttgtggggagatactcatgtgagttggcggactttgggtcaaata

SEQ ID NO: 6864367 - DNA, 67 bp, Homo sapiens
ggccttggttccaaagcaggcatctaaagggttccctgggctggctaaaggctttggagctgaggct

SEQ ID NO: 6864368 - DNA, 63 bp, Homo sapiens
gggtctcatgtgaccgctgtcactgtcttctatgggacactgttctgcatgtacctgaggccc

SEQ ID NO: 6864369 - DNA, 130 bp, Homo sapiens
gtcacggcttggtgtgataatgtatgtgttggtttgctgctggatgcgcttgatggttgcccctttggggcccaccaccagccccaccacgcggtagggcacccgcacacggatggtcacctggccgggc

SEQ ID NO: 6864370 - DNA, 66 bp, Homo sapiens
ggtctcagagtcctggggatgggagtggcctgagccgaaccacattcagtccaggcttggagtgcc

SEQ ID NO: 6864371 - DNA, 76 bp, Homo sapiens
gcacagcttgaatagttcttttatctgcttggtaccaaagccaaaatcctggtatacaagagcaatttaggggtgt

SEQ ID NO: 6864372 - DNA, 77 bp, Homo sapiens
caatttgggtaaacaagtgatacatctagtctataaacatatgttgatggtgttggtggtcacttttaagaaaattg

SEQ ID NO: 6864373 - DNA, 66 bp, Homo sapiens
gctgagatgcgggttccgggctcctgttcccctcggggaaggaggcaccctgagcctgccttcagc

SEQ ID NO: 6864374 - DNA, 110 bp, Homo sapiens
ttatattaaaacctatatatcagagattttttgtatataaaagatagttggaattaatttctccagcttaaagtgtacatagaattgtgctttgatttgctttaatataa

SEQ ID NO: 6864375 - DNA, 65 bp, Homo sapiens
ccctcagtccccttaggctttcagagcggccatagaggtggtggctggactcaggggactcaggg

SEQ ID NO: 6864376 - DNA, 76 bp, Homo sapiens
gacatggggctagaggcagggtctggatttgatctgatcctcagctctaagaccaggcccttgcaagtcccacctc

SEQ ID NO: 6864377 - DNA, 69 bp, Homo sapiens
tacattagctcatctatttattaataggagaaggaaagtaattctttgccagtaggtggtgcttttgta

SEQ ID NO: 6864378 - DNA, 55 bp, Homo sapiens
tgtataatcatatgtgggcactagggaccaggtcctgtgccaaatgtgttataca

SEQ ID NO: 6864379 - DNA, 65 bp, Homo sapiens
ttgctgtcccagaactaacttcagagacaacttccactcccctctgtacttagactggggcagaa

SEQ ID NO: 6864380 - DNA, 56 bp, Homo sapiens
gccaggctgggccaggcctgcagggtcacgactggagggtgtgggcccggccaggc

SEQ ID NO: 6864381 - DNA, 106 bp, Homo sapiens
ggacaccacactcccctcccctccctgatgccaaagaagcatggtactcagacattttaagggagggcattttctggggcatcaggggttaaagggttgtcagtcc

SEQ ID NO: 6864382 - DNA, 128 bp, Homo sapiens
ctgggctatttccttatagctggagcagcagtgggcatagcagggtctcaggagtcaggaggatccccactgtcaccctggctggactggaccgtggctcactcctcctagagggatatcaagcccag

SEQ ID NO: 6864383 - DNA, 76 bp, Homo sapiens
gtttgagcagtctacacatttctcttagagacaccataggatgggtttttgagatagagagttaggatttttaaac

SEQ ID NO: 6864384 - DNA, 55 bp, Homo sapiens
acagagcttaggatgactcccagtgattctcacttcctggtgtttacagctttgt

SEQ ID NO: 6864385 - DNA, 65 bp, Homo sapiens
cctggggctcctcctggcaggaggcctggccagccccgagcccttgagcctggaggagctctcgg

SEQ ID NO: 6864386 - DNA, 60 bp, Homo sapiens
tgggcagggcccatggctcaggtagggacaggtgtccaagccttgcaaggggcctcccca

SEQ ID NO: 6864387 - DNA, 57 bp, Homo sapiens
ttccaggggaagcagggaggagccaaataacaggcctttccagcatttccttgtgaa

SEQ ID NO: 6864388 - DNA, 63 bp, Homo sapiens
cagctgacttcttgatccaatgaccatcctttttcgtggtgcatcaaattctgaaattagctg

SEQ ID NO: 6864389 - DNA, 56 bp, Homo sapiens
gtcactgcgctgactgctacgatcattgggcaggcgtgcacaggcagtgtagtggc

SEQ ID NO: 6864390 - DNA, 94 bp, Homo sapiens
ggagcagcctcaggagttgaaggggatcctgtccctcccagaggaaagctcacgattggattggaacttctagcgactgcctgaggtgagcttc

SEQ ID NO: 6864391 - DNA, 71 bp, Homo sapiens
gctgcgagccgcgcgcgcacggggagccataggcttcggggtccaagcgcgtgtcgttttgggggagcagc

SEQ ID NO: 6864392 - DNA, 78 bp, Homo sapiens
cttcagttctgcagaaggcaagttctgatcacagatagaaatatagggtttctcaacatgctttctaacaggtagaag

SEQ ID NO: 6864393 - DNA, 70 bp, Homo sapiens
gtgttctacagcaggtgtctagagcttattcatcctacttagctgaactttatgcctgttgattagttac

SEQ ID NO: 6864394 - DNA, 60 bp, Homo sapiens
ggctggcaaaaaccttctctgaacccacacaccaagttcgtagttggtaggtgcccagcc

SEQ ID NO: 6864395 - DNA, 59 bp, Homo sapiens
gcaccagctctccaccaggtttctagccctgggcacacagagatgggtgaggcaggtgc

SEQ ID NO: 6864396 - DNA, 82 bp, Homo sapiens
ggcctctgaactgtgtctgttcaattctgtggaaatttatttaacaacactataatccaggcattggagagataatgaggcc

SEQ ID NO: 6864397 - DNA, 125 bp, Homo sapiens
ctcctttctgagaagtggttgaatgtttggggtacagggtgctagaagttctgaagttggtctcagggagacgaaagagtctggcactgtaccagccaaggtgcaaccatcttttggagagagag

SEQ ID NO: 6864398 - DNA, 70 bp, Homo sapiens
gatagttagcttcttgaaggaaaggggatccctcttcatctctctacatcccactttcgttagctacatc

SEQ ID NO: 6864399 - DNA, 99 bp, Homo sapiens
ggcttgcaacaatgttggtgtgaaatataatcattgaattgctttgttcttttttccaataaaaggtggaagctattgagtgttgttattaggcaagct

SEQ ID NO: 6864400 - DNA, 124 bp, Homo sapiens
agtggataatttctcccataacacttaccataacttttgctgagtgctgatcttttgatgaaggaccatgaagaggacagtattcaatatgagttctcacttgtcttaatccttttatcctgct

SEQ ID NO: 6864401 - DNA, 102 bp, Homo sapiens
gcaaagatttaaatgttggattgagcagtatttttttcctgtggaatgtctccagggaatctctgagtgtgttccaaattcaagccattgtaatctccttgc

SEQ ID NO: 6864402 - DNA, 66 bp, Homo sapiens
tgtgcacatggtaggtattgagtatgtgaattattgaacatgtactttagataaattatgtgcaca

SEQ ID NO: 6864403 - DNA, 83 bp, Homo sapiens
tgcttggcattagccgaggtgaggccagcagagggctgatgagccggggcttgccctctggcagccttggctggatgccagca

SEQ ID NO: 6864404 - DNA, 74 bp, Homo sapiens
tctggtggcattttccaacttggctgattgacacaactaaaagtgttagacataattgggagtatgtcattaga

SEQ ID NO: 6864405 - DNA, 123 bp, Homo sapiens
ctccagaagtggttgcctgcacctaactggggtctgtggacctggccagataattcctaaacatgggccaggctccgcatagaccccactttcagtttttcatcatcagagacctgtctggag

SEQ ID NO: 6864406 - DNA, 62 bp, Homo sapiens
tgaattccctgcaggcatcctcagtctctctaagtccaaaggtcagctctgcagggaaatta

SEQ ID NO: 6864407 - DNA, 67 bp, Homo sapiens
ttacagctatgtgtatacgtgtgtgtgtttgcttttagacatcatcgtgcacatacataagctttaa

SEQ ID NO: 6864408 - DNA, 81 bp, Homo sapiens
gtaggaatgtgagaagttactgagttgtctaaagtttgttcagatatactcctcaaggcatcggttgcttttcatatctac

SEQ ID NO: 6864409 - DNA, 81 bp, Homo sapiens
tgagtgactgtcttctcagtttctctaggatgtgacataattagttccattctagaagaacgagaaatataagttaattca

SEQ ID NO: 6864410 - DNA, 64 bp, Homo sapiens
tggagttcatccatgacagcttcggtttcctaattctcagaaaggtctgtcatgggtgactgca

SEQ ID NO: 6864411 - DNA, 62 bp, Homo sapiens
atggactgggctctagaaaggaaagaagcaggcgacagctttaaccctagtgctcagtgcat

SEQ ID NO: 6864412 - DNA, 87 bp, Homo sapiens
gtggtctgttattggaggaggcattggaggattctcctgagtgaaaacagccaggttataatcttcatgtcctctctaattcaccat

SEQ ID NO: 6864413 - DNA, 58 bp, Homo sapiens
acatctgggccttgctgttccagcgctgcgagggtgctgaggagggcacccggggggt

SEQ ID NO: 6864414 - DNA, 70 bp, Homo sapiens
gcaataggagaaggtcttgttcacttcctgccaaaagcagtgaaggtttacagggccccttcttctgtgt

SEQ ID NO: 6864415 - DNA, 69 bp, Homo sapiens
ctggaggctcttcaataggtcaatggtttaacaatatttagtacattcatcccatggaagagttctcag

SEQ ID NO: 6864416 - DNA, 88 bp, Homo sapiens
gtcttagagcctacccagcacctaggctgcctttactatctctgcaggtcagacacagtgctgggtgctgagtcctgtctctcaatgc

SEQ ID NO: 6864417 - DNA, 129 bp, Homo sapiens
agaaaatcatcttattttcataacactaaatgtatcatgtttgtctttgtgtgagggcaattagcaaaactagtgcaacttcacgtagagtacaattatatggaacatttgaaaataatgtctctttct

SEQ ID NO: 6864418 - DNA, 110 bp, Homo sapiens
cctttgaagttatttattggactgtgttaaacatgttcagtgacagttattgaggtttccttcagttcacaattgaaacatgttacgcattcccatacatggagaagagg

SEQ ID NO: 6864419 - DNA, 63 bp, Homo sapiens
tattgtgctcaccattacatccccatgacaaacatgtggcctgtacatggtagacgctcaatg

SEQ ID NO: 6864420 - DNA, 75 bp, Homo sapiens
ggatacagtgatgatcattgtaacatcatcagtcatagtgactcagggataagttcagtgacatcataaataacc

SEQ ID NO: 6864421 - DNA, 82 bp, Homo sapiens
gagcgacgatggctcctggaccgcctatgaagccggcgtctgtgacgatctggagcagcaggtggccaggggcaaccagctc

SEQ ID NO: 6864422 - DNA, 57 bp, Homo sapiens
ttgtgacagctccaccctggggaacaaggccaattcctccaaccagcagctgcataa

SEQ ID NO: 6864423 - DNA, 81 bp, Homo sapiens
tgacagagtctgagctgcagagtggggtggttgcctagcaacaacacctgtagcacattaagcagccagtcagctttgtca

SEQ ID NO: 6864424 - DNA, 93 bp, Homo sapiens
ttgtaaaaatctttgtataaaaggtttattgtaggtgtaaattttatgcattagattgcactttatagaaacttttgaaaaatattttggcaa

SEQ ID NO: 6864425 - DNA, 90 bp, Homo sapiens
cccagggagcgggctgctctgcagtgacccggggctctgtgtccacatcaggctgccatagggaactgcatgtggtcccttcccctgcgg

SEQ ID NO: 6864426 - DNA, 70 bp, Homo sapiens
cagtttgtaataccttccaacatcaagacattttagaactaaaattgactatgaagggtagtacttgctg

SEQ ID NO: 6864427 - DNA, 99 bp, Homo sapiens
gatgtaaaggcatgactccaatgaagtgtttagaagttttagtcctggaagagattggagaagtttggaatttcatgtttaagagttctagattatatc

SEQ ID NO: 6864428 - DNA, 70 bp, Homo sapiens
gcttgagccagggatgcagaggttgcagtgagcggagatcaagccactgcactccagcctgggctccagc

SEQ ID NO: 6864429 - DNA, 111 bp, Homo sapiens
tgccctttatggaatcaagtaaacaaagcagtagttttcaaatagttatttcagttcaaccacagagagctcagagaatttactgctgcctactccctttagagattagca

SEQ ID NO: 6864430 - DNA, 87 bp, Homo sapiens
ggagtctcactctgtcaccaggctggagtgcagtggtgcaatctcagctcactgcaacctccgcctgctgggttcaagtgattctcc

SEQ ID NO: 6864431 - DNA, 117 bp, Homo sapiens
tgcagaaaaatgagaggcaagaggccattctggaatgtaaagtttatgggccgtattgcaaatacaaatagcttctttactttctagaaataaataggtctgtgtctttcctttgca

SEQ ID NO: 6864432 - DNA, 76 bp, Homo sapiens
ggtcatttagtcatgtcttatcagtcctctctctgaaaaatacagatgatgataattgaaaggcacataagtttcc

SEQ ID NO: 6864433 - DNA, 129 bp, Homo sapiens
gaatttcacaagggactcataaggtgaataaactaagctctggcattgattatggaaagcagtggctgtatgatgtcagggttgctgtgatcagtccagccagaaattcacttttcagtgccttgattc

SEQ ID NO: 6864434 - DNA, 120 bp, Homo sapiens
ccatcgttattacagtgttgggtgagagaacctgtttatgttacctgcgacattatgagaaatgcagatgtaggaaaataaacgtatttggcttagtttcacaaagcaaatttaccatgg

SEQ ID NO: 6864435 - DNA, 72 bp, Homo sapiens
gttgctgcaaaagtaattgcaggttttgccatcgaaagtaatggcaaaaaccgcaatcacttttgcaccaac

SEQ ID NO: 6864436 - DNA, 68 bp, Homo sapiens
gggagggtggacaggcaggctgtcggggccggccgcgtgcccagagaaccttctgtgccactgttccc

SEQ ID NO: 6864437 - DNA, 98 bp, Homo sapiens
gtggctgggtcctgaatttctggcttgctggcttggtcccagctacagctgaggagatctatgtccagtagtaccccggggaagagggctcagcttac

SEQ ID NO: 6864438 - DNA, 63 bp, Homo sapiens
acccattacccatgaaagccatttgaggtttgttagcaaatagtggcctgattatgaatgggt

SEQ ID NO: 6864439 - DNA, 74 bp, Homo sapiens
gtcctcctaagttttctaatactagaataattttattagaccctgtcagtgttaggaaagagagagaaaaggac

SEQ ID NO: 6864440 - DNA, 57 bp, Homo sapiens
acaggagatgtacctgtttttgagaggatataataatcactcaaactactcttctgt

SEQ ID NO: 6864441 - DNA, 102 bp, Homo sapiens
gcaaaggatgaatttaaatattagaacaagtgataaaggggaggaagtgtgctacactcagccaatcttatctttattttctactttattattctgctttgc

SEQ ID NO: 6864442 - DNA, 86 bp, Homo sapiens
gcagctgaataaatagaagctattgaatttatagcatatttaaagcattgaatatcaggaattgaatggcttcagtttaaagctgt

SEQ ID NO: 6864443 - DNA, 76 bp, Homo sapiens
tctgctcaaagtgtgtgagcctgtcaggctctgcccagtatgccaagtctgcaggaccgcgtcacatttgaccaga

SEQ ID NO: 6864444 - DNA, 60 bp, Homo sapiens
aaaccctttggtgaagaaccagtcgtaacatttgactgttaattcaatcaacaggtgttt

SEQ ID NO: 6864445 - DNA, 59 bp, Homo sapiens
ggccctgtccccttcagttttgcagatgaggaaaccgaggctaaaagaggggcagtgcc

SEQ ID NO: 6864446 - DNA, 75 bp, Homo sapiens
gtgtgtttctgagcacttttattgcattcacacatctactagtttttgtacgaagagtgcctcagatcattacac

SEQ ID NO: 6864447 - DNA, 61 bp, Homo sapiens
cacagggcagagacctgggtgcagaggggaccctgccctcttcctcaggcctttccctgtg

SEQ ID NO: 6864448 - DNA, 67 bp, Homo sapiens
tcctgttaagagcttggacactcttcagtagtaatggggaatgagaattactgtttttataacagga

SEQ ID NO: 6864449 - DNA, 63 bp, Homo sapiens
gagtccggagctcagaagtgagtgagttccaggctggagctcacaggctttgactctcgcatc

SEQ ID NO: 6864450 - DNA, 76 bp, Homo sapiens
gttgaaagaataggcaagtgcattagaagagcatttgtgaacgagtatgcattctgcaatttgcctcttctgtgac

SEQ ID NO: 6864451 - DNA, 109 bp, Homo sapiens
ccaggttcttgcttcatcccagccatagtgggagccagcagcttgggggagcttctgttccatctgcttggctcttagcatgtggttgggacaagctttctgggcctgg

SEQ ID NO: 6864452 - DNA, 76 bp, Homo sapiens
gggctacctggctcctgtggtactcccagggcctgggccaggcggggaatgcgcacgggaactgctttttggaccc

SEQ ID NO: 6864453 - DNA, 61 bp, Homo sapiens
gctaaactgaagagcatattgcaaaactggagagttgagctctgatgcttttcagataggc

SEQ ID NO: 6864454 - DNA, 110 bp, Homo sapiens
ggaagcagaaaggtggttttagagtcactcagatgttaaagggctttttttgcaccaggaagccaagcctctagaagaccctatactcagtgacccacccgtcagcctcc

SEQ ID NO: 6864455 - DNA, 83 bp, Homo sapiens
gggtaaaatatttatttccatcttcattttagtctagtgataactatacaaatgtggacatggataatgaacaggttttaccc

SEQ ID NO: 6864456 - DNA, 91 bp, Homo sapiens
ctcctaccagtttacaagagctgatagtccacatgtcttcccaactctgttctgtgacatcaatattagtagcttgaaattggtgacggag

SEQ ID NO: 6864457 - DNA, 104 bp, Homo sapiens
gagtgtctggcaccaaatattcaacatgtaaccagcattcatctggtcactggcttccagatgagatgtgttgatgtggagtggtttgatgcctccaagacctc

SEQ ID NO: 6864458 - DNA, 75 bp, Homo sapiens
gatgaggaggttcactgttatgcgtaccactgtcactcaacacttgatttacaatgcagtgacctcctttaaatc

SEQ ID NO: 6864459 - DNA, 70 bp, Homo sapiens
tgtgtgctgaacagagtctgggcactgggaatgctgtggtgaacagattccctgacatccagagcacaca

SEQ ID NO: 6864460 - DNA, 61 bp, Homo sapiens
gtgtccttcttcctcatctcatttgctttgtgagcaattcatgggctgaggaaggggtcac

SEQ ID NO: 6864461 - DNA, 67 bp, Homo sapiens
ctcttcttttttgcataatctctgttagaaaagaaagggcccacggaaaaagtgcaaaagtgaggag

SEQ ID NO: 6864462 - DNA, 79 bp, Homo sapiens
tgacctctcctctgtttttagaacatcattaaggaagatcatttctttcactaatgattttgaaagaagtcgtgggtta

SEQ ID NO: 6864463 - DNA, 71 bp, Homo sapiens
ctcttcaaagcagcagaaagctggcccctggggtaattagcagagggcctattctttgctgcttgggacag

SEQ ID NO: 6864464 - DNA, 100 bp, Homo sapiens
aggaaattaatctctaagtctaaactgtgataggtttacacctgagcagcctcttgctgctcaggtcaggctataatgatttcgacttgatctatttctt

SEQ ID NO: 6864465 - DNA, 130 bp, Homo sapiens
cacaggcttgccatggaaagatctgggggaaatggtgctttgttaagtctgaaattggatgggttttaatttaagagcatagctccaaccctcacctctctctctaagcagaaaaatagttatgtttgtg

SEQ ID NO: 6864466 - DNA, 89 bp, Homo sapiens
gaaactgagacccacaggagttagtcagttgtggagatttaactgaaacccagattctcagatcccacattgaattctatttcagtttt

SEQ ID NO: 6864467 - DNA, 70 bp, Homo sapiens
ttggctgaagataagtgaagaggctgactagcaatggccactagcctacttctcttgcattctttatcga

SEQ ID NO: 6864468 - DNA, 69 bp, Homo sapiens
agggctcttcctttgcctctcagctgctcttccctggagggttgtgggggaggcaaggaaaggggccct

SEQ ID NO: 6864469 - DNA, 63 bp, Homo sapiens
gctgcagttcttctcctcaaggcctccaaaaaagcgtcatgagaaataaaggaactgtgcagc

SEQ ID NO: 6864470 - DNA, 78 bp, Homo sapiens
tgaaggatcagaataagttatgaaatgaaggtcaggaaccttttgtacatagtttcttatttggaatgatgttcttta

SEQ ID NO: 6864471 - DNA, 77 bp, Homo sapiens
tcagtggaacactaaaggtcagttagaagataatcagttgaagtgcttttaatctaatttttatattgattcattgg

SEQ ID NO: 6864472 - DNA, 82 bp, Homo sapiens
tttcctgagatgagaaagatggtgagagaaatttgaggtggaaaaatcaagggtttggttttggccatcttccatgtggaga

SEQ ID NO: 6864473 - DNA, 60 bp, Homo sapiens
gggataatgagatgagtaaactgtttggagatctgaaagcaggataattttattatgccc

SEQ ID NO: 6864474 - DNA, 86 bp, Homo sapiens
gagtcttgctctgttgcctaggctggaatgcagtggcgcaatcttggctcactgcaacctccgcctcatgggttcaagcaattctc

SEQ ID NO: 6864475 - DNA, 75 bp, Homo sapiens
tgcttttgtcacccaggctggagtgcagtggcgtgatctcagctcactgcaacctctgcctcccgggttcaagca

SEQ ID NO: 6864476 - DNA, 99 bp, Homo sapiens
ctttttccgggggttattttcatttttggctgtcctgctccaagttaaacagaggagaaacagcatcatatagtggaagaaactcagacctggggaagg

SEQ ID NO: 6864477 - DNA, 69 bp, Homo sapiens
tctaaatggtgaaatgatgggcttagaaggaagaaaccaaattttagtaccatcatttgcctctttagg

SEQ ID NO: 6864478 - DNA, 102 bp, Homo sapiens
gatggagaaggctctggctcatttcctcctgagaggcccccggtagagcagtccactgggcttctgaaggctcctcaggaaagtgcacagtttgtatttgtt

SEQ ID NO: 6864479 - DNA, 65 bp, Homo sapiens
tggaaacactcaagcttatattgtaaattaaattaaagcaatgcagtctttatgaggtgtttcca

SEQ ID NO: 6864480 - DNA, 73 bp, Homo sapiens
gtgcccaccagtttcttaggaaattttactggtctgggcgaagcccaggacttgggaattttcatggaggcac

SEQ ID NO: 6864481 - DNA, 71 bp, Homo sapiens
ctgagcgcaagggctgactacgctgtatttcacaaccgagccctagcgccagctcagcaccctacgctcag

SEQ ID NO: 6864482 - DNA, 94 bp, Homo sapiens
cctttatgcaaaagaagaattataggtgcagcagctaacaattattcataaatgtttgtgctgctgacttaagatattttctacaagtgaatgg

SEQ ID NO: 6864483 - DNA, 55 bp, Homo sapiens
gaggagactcctcgtgcagctactagatagagtagcagcagggcatgtcttactc

SEQ ID NO: 6864484 - DNA, 58 bp, Homo sapiens
gccgggacctgtttttcaaaaggcataatgttttttgctgtggatggcaggtccttgc

SEQ ID NO: 6864485 - DNA, 84 bp, Homo sapiens
acatatcattgtcacccaaagctcatagtttacattagggttcactctcggtgttgtacattctatgagttttgacaaatgtgt

SEQ ID NO: 6864486 - DNA, 79 bp, Homo sapiens
tgattccaggacagcatctagtacagtctagtcctcaggaaacagggactgaaattcaacatggatgaaacctgaatca

SEQ ID NO: 6864487 - DNA, 96 bp, Homo sapiens
ttgaaaaggaatggaaggcgtagtagatgtagattgaattttccctgatgtttataattatttgcaattactcatgtcattttcatccttttacaa

SEQ ID NO: 6864488 - DNA, 67 bp, Homo sapiens
ctccttaggggctatcaggaaatgtattttttgctgttttgaaagacattttgatacccctaccgag

SEQ ID NO: 6864489 - DNA, 68 bp, Homo sapiens
tggcagaaataccttattttgaaatagattgtggcaggacatgtaacaagaaataagttatttcccca

SEQ ID NO: 6864490 - DNA, 69 bp, Homo sapiens
agcagcacgggccagtcttctagaaagattgtctttccgacgcttcctgtaggcaggtccaaggctgtt

SEQ ID NO: 6864491 - DNA, 62 bp, Homo sapiens
catgcctctgttttagttgttgactggggttgaacaggaaggcagctttcaatagggttatg

SEQ ID NO: 6864492 - DNA, 58 bp, Homo sapiens
ttgtgttgagcggccaagaggatagtggtgccatttgctatgctttatgcttatataa

SEQ ID NO: 6864493 - DNA, 59 bp, Homo sapiens
gacaatgcagaagtacttgttcatcatgcttcagagggcaggtagctcttctgattgtc

SEQ ID NO: 6864494 - DNA, 57 bp, Homo sapiens
ctttgtgggggtttcttatcttcttgtagaggcttgaggtatgaaacctgcatttag

SEQ ID NO: 6864495 - DNA, 55 bp, Homo sapiens
gggctccagggcccgagtcgtcccgcccgggtacgccctcgcatcctgagagccc

SEQ ID NO: 6864496 - DNA, 79 bp, Homo sapiens
gcttagaacatctgaggccgggactatcaaaggtttctcaagaccccttaattcaggcctggcctttatgttcaagagc

SEQ ID NO: 6864497 - DNA, 88 bp, Homo sapiens
gctgagtgctatttttctcttttgctctctcactctctaaggtgtaaatagattgagtaaacagtttcttagaagaaaagttgtcagc

SEQ ID NO: 6864498 - DNA, 130 bp, Homo sapiens
gcatcagcatcactggggaactggttagaaatacaaatgtttgggctgcatcccagaccggctgacccagaaactctggggatgaggtccagtgatctgttttcacaagccctccaggggattctgatgc

SEQ ID NO: 6864499 - DNA, 90 bp, Homo sapiens
gagttagatctctactatgagtttaaggctaaaataggcatttcttactggacagctttaccttgatgatttatactgaagatctaactt

SEQ ID NO: 6864500 - DNA, 63 bp, Homo sapiens
tgtctgaattcaagaaattcaataactccaccccagtggctagttgggttacttgatggcaca

SEQ ID NO: 6864501 - DNA, 59 bp, Homo sapiens
ctgacctgagtggtacaaggcattttcttttgttttagaaacctattgctttaggttag

SEQ ID NO: 6864502 - DNA, 77 bp, Homo sapiens
gatgctgtgttactgagatccggcccctggaggagttttcttttacaatttcccctatgccatttcacacagacatt

SEQ ID NO: 6864503 - DNA, 64 bp, Homo sapiens
tggtttctgcttattcaaatgatctttccaattttgattgagaggattttgagaagcaaaacta

SEQ ID NO: 6864504 - DNA, 92 bp, Homo sapiens
attttctcactttatgaaccgagaatgtcagggagaaaaaagcatgtttcttaagtagaagctccctgtgcttcatctcattctgagaaaat

SEQ ID NO: 6864505 - DNA, 117 bp, Homo sapiens
gggaggagggaaggagaggctccctcagatgctaggtctgagcctggctccccagcaccctggaggcctggcttgccagccctggcgcctgcgcctgcccagctccagcccccaccc

SEQ ID NO: 6864506 - DNA, 89 bp, Homo sapiens
ttaaaatatatttctctcggtacagtttagtcatggttcagagcacccacagaagaacctttcctggctgaccgaggagacatttttaa

SEQ ID NO: 6864507 - DNA, 95 bp, Homo sapiens
caaggcctcctcggtgtctgggtcccctactgtcaacctcatagcccctgaggtcataaaagccaggggagtcagctgctggagatctggttttg

SEQ ID NO: 6864508 - DNA, 81 bp, Homo sapiens
tagcactgttatatttaacatctagggtattaacactagttggaaaactacatttgatgaaggtagatttgaaataggcta

SEQ ID NO: 6864509 - DNA, 82 bp, Homo sapiens
taaaggtaactgtcatcttgtaagcaatgtttcaaagtagattagagtctgaacattaagttttagatgtcaattatcttta

SEQ ID NO: 6864510 - DNA, 94 bp, Homo sapiens
tctagttctctgcttctctctcagactgcaagccttagaaattagactggctttctccatcctaagcagagggagtagaggtttgagaatttga

SEQ ID NO: 6864511 - DNA, 69 bp, Homo sapiens
atgcaggctgtaatctgaggctacaagttttagctaattcatcctggtggccttatcagcaggctgtgt

SEQ ID NO: 6864512 - DNA, 61 bp, Homo sapiens
gaagagagagccctggggtccgtggaactgcttgctgctagactccaggcatctttatttc

SEQ ID NO: 6864513 - DNA, 85 bp, Homo sapiens
ggggcaccatgtaaaaatgggatggtatgcttccaagactgatgctgttttaaagtttttgcacattctgactacattatgcctt

SEQ ID NO: 6864514 - DNA, 56 bp, Homo sapiens
gggctaaatgcagaaatgcagagaaagacctctgaccacacagttctgtctagtcc

SEQ ID NO: 6864515 - DNA, 129 bp, Homo sapiens
ggatgtgtacacgtgtggatgtggatatgtgctgtgtgcacgtatgtgtatatgtatgtgaatgtgtgtatgcatatatgtagatgtatgtgaatgtgtatatgtgtatatgtggatgtgtgtatatgt

SEQ ID NO: 6864516 - DNA, 57 bp, Homo sapiens
tggtcagcattcttcctataaacgggcgattgtacgctgtacaagaatgactgagca

SEQ ID NO: 6864517 - DNA, 65 bp, Homo sapiens
caattacagcagcctgtgttaacaaagctgcgtgatcaccagctttgggcaaaggcttgtgattg

SEQ ID NO: 6864518 - DNA, 57 bp, Homo sapiens
ccaggactcaattaacctcacttaaacaattttttggtgggaccagtgaagtcttgg

SEQ ID NO: 6864519 - DNA, 66 bp, Homo sapiens
aaacatatgccttcttttgtaacttattgttgtttcaagttacaagatctttgaaggcaagtgttt

SEQ ID NO: 6864520 - DNA, 65 bp, Homo sapiens
cacccctacctgagtcaggagtggagattagcccaaattaaagctctggtgactcaggagaggtg

SEQ ID NO: 6864521 - DNA, 83 bp, Homo sapiens
gcatgttcacaagcagtatggggatgtcagacagctctcttattctcactgatgtcctttgtatgcttgtacttgaactcagc

SEQ ID NO: 6864522 - DNA, 74 bp, Homo sapiens
agagatagggaactagacaaagagagaagaaatgtgaagcatctggctcacttagtctaggacactcagtctct

SEQ ID NO: 6864523 - DNA, 62 bp, Homo sapiens
cctaatttgacagcaatagaagatttatgtttgcatgaatgtctatgatcctttaagttggg

SEQ ID NO: 6864524 - DNA, 56 bp, Homo sapiens
cagtggttctcaatcaggaatggttttgaatattgcaggttaggtgggaatcactg

SEQ ID NO: 6864525 - DNA, 57 bp, Homo sapiens
cagttgaggtcaggtataatcaatgttccaatgggataattttgtcctgtctcactg

SEQ ID NO: 6864526 - DNA, 78 bp, Homo sapiens
tgggctgagtgcttcctgtgatattagccactgtgcagcactgggcagggttcatgttatcacaggtgcagaagtgca

SEQ ID NO: 6864527 - DNA, 67 bp, Homo sapiens
tgtcatttaggcaatgctctcaaatttggtataatcttacttaggcctgaagctttgcctagaaaca

SEQ ID NO: 6864528 - DNA, 128 bp, Homo sapiens
acagccaggaaatgaatgagagaagggatcatttatgcagtttgtgttctgctacccagtagcagtctgaacacttgctgttaataagtgtagccctcctgcctgatcatatattgcttcctttctgt

SEQ ID NO: 6864529 - DNA, 57 bp, Homo sapiens
tccatgcagtagaggcgctgggcagagagtcaaggcccagcagccatcgaccatgga

SEQ ID NO: 6864530 - DNA, 81 bp, Homo sapiens
ctgtttggaaagtgtgatttcaaggacttcaatctgtgaggctagcttcacatactttggaatcattgcttattcattcag

SEQ ID NO: 6864531 - DNA, 81 bp, Homo sapiens
ccctggccaggtggtgcctctgttcgcacaggtctggagaagtgcagcagcaccaggccccctgctgagattgagccaggg

SEQ ID NO: 6864532 - DNA, 81 bp, Homo sapiens
gcaacatccctgggggccctgaaatcagggttcagctaggctcctatgtgccctgagggtctgggttcccagtcctgttgc

SEQ ID NO: 6864533 - DNA, 73 bp, Homo sapiens
tcacccagcagggccagcactcctggcaggataagaactcatggtgccagaccaggcatggccagcagggtga

SEQ ID NO: 6864534 - DNA, 66 bp, Homo sapiens
gcatctggtccacattctcaaggctggttggagaagcctggagattatttggtccaatcttgatgc

SEQ ID NO: 6864535 - DNA, 66 bp, Homo sapiens
tcaccactgaaaaatatgttttggagaagacttcatctagttattctggctgttttacaggggtgg

SEQ ID NO: 6864536 - DNA, 65 bp, Homo sapiens
caagtcctaaatgtatttgttgctgaaacatgttctctttgtatcaagtgcattaatgggagttg

SEQ ID NO: 6864537 - DNA, 74 bp, Homo sapiens
aaggtcaggaggaaatacaaagatatttgggatctaattgaattaatatggccccagggtatttcttagacttt

SEQ ID NO: 6864538 - DNA, 68 bp, Homo sapiens
accttttcaagtcctttggaaggcctggggagtgataaatctgtagtgctcaggagggcttaaaaggt

SEQ ID NO: 6864539 - DNA, 105 bp, Homo sapiens
gactgaggtgccaccctgcagtttgcatggtgtgctctgaatcagtgactaacaacttgtgctgcttctctcatgacctgtatatgcagatctggcttcttgttc

SEQ ID NO: 6864540 - DNA, 116 bp, Homo sapiens
cataaattaaatacatctgtgctcattccaagtatgctattacagtgtcatctaaatctaatggtgaacaaaatagcacatattaagatgatattaatgttaaacttcaatttatg

SEQ ID NO: 6864541 - DNA, 60 bp, Homo sapiens
acaattgcaatagagaaaagagtccagtgtgaactgaactcatccttgatttgcagatgt

SEQ ID NO: 6864542 - DNA, 73 bp, Homo sapiens
ctgttctcctactttgcctttcatatagatttgtagatttttacaagtccgtaaagggcagatatgaagacag

SEQ ID NO: 6864543 - DNA, 71 bp, Homo sapiens
ctgtgcttaaagaacatactctgaataacataaatccttttaagcttattgagagctgttttatggcacag

SEQ ID NO: 6864544 - DNA, 74 bp, Homo sapiens
gagttgttgcttctgctgatattttgtgagggtttctttgcagcctcacaaaacaccagcagaagcaacaactt

SEQ ID NO: 6864545 - DNA, 125 bp, Homo sapiens
attttagttcctcagtttaacctacaactagtctctattactttgaccactggattattacgtaagaattttaatttacagtgttacttgatgtccactaggggggaccaaaccacgaacagaat

SEQ ID NO: 6864546 - DNA, 66 bp, Homo sapiens
aactgcaagctctttactgctagcttgaaaaatggggagctctagacactgtaaagaattgcagtt

SEQ ID NO: 6864547 - DNA, 76 bp, Homo sapiens
atgaaagtttcttcattaagatgtgaagtctgaagtgagatcacctgggttcatatcctggttctgaaactttcat

SEQ ID NO: 6864548 - DNA, 65 bp, Homo sapiens
caagcccaagggagcatctaaactcatctgctgatttctaaagcagaagacccttcccaggcttg

SEQ ID NO: 6864549 - DNA, 70 bp, Homo sapiens
cccggcccccgcctggcccattgcagggcagcacccagttgttatcgtggaggcccaggcggcagccggg

SEQ ID NO: 6864550 - DNA, 73 bp, Homo sapiens
ttatgcagtaattgtaaactgatttggaaaaaaaggaaatctaaatctgtgaagcgtttacattactgaatag

SEQ ID NO: 6864551 - DNA, 64 bp, Homo sapiens
gctcagcaatgtgatactgtgcaaggtgcccaatctctgtataccggtctcacatttgctaagt

SEQ ID NO: 6864552 - DNA, 59 bp, Homo sapiens
caaggctaagctttggctttctttgggatgtaccttaacgaggtaatcaattggtcttg

SEQ ID NO: 6864553 - DNA, 56 bp, Homo sapiens
gcctgccagccacagtggcagcctggtccccagagctgccgatcacctggcatagc

SEQ ID NO: 6864554 - DNA, 58 bp, Homo sapiens
tcagattaagtgctcaacagtgttagctgttgctgatattattagtctcttggtaaga

SEQ ID NO: 6864555 - DNA, 68 bp, Homo sapiens
tagtctccagccagaagctgctcccccactcaactcccccggagcttctgcttgctggcgggggtctg

SEQ ID NO: 6864556 - DNA, 81 bp, Homo sapiens
gttggaatctaagctttaggttttgcctgagatctgagttttaagctcagaattcagggatctagactgtgggttctgagc

SEQ ID NO: 6864557 - DNA, 65 bp, Homo sapiens
tgagctactaaatgcatttgtatttttgcagcatatactgtcttgtattttgcaattatggttca

SEQ ID NO: 6864558 - DNA, 78 bp, Homo sapiens
ggcccatcctgccctctaggctacagttccagcgctcacgacggagctggaactcaggatggaactcaggatgggact

SEQ ID NO: 6864559 - DNA, 62 bp, Homo sapiens
gctgttggaggttggcagagagcaggcatccagtgtgatcattgctaacatccatttaaagc

SEQ ID NO: 6864560 - DNA, 55 bp, Homo sapiens
tggaggccctcattgtagaagtatgtccttaaaatatttccgttatgagcttcca

SEQ ID NO: 6864561 - DNA, 76 bp, Homo sapiens
ggtacccaagtggctataggataaagtacaaatccttatttaatgtattattcatggtcttccacaattgggcttc

SEQ ID NO: 6864562 - DNA, 94 bp, Homo sapiens
taggaatattgagagtactgatgccttcagaattttagccccctgcccaagggcataacagtttggtagtatcaatgtactcataatattttta

SEQ ID NO: 6864563 - DNA, 74 bp, Homo sapiens
gcacttaccagagaggatccgccctcgaatggacacattaccagtgaaggggcatttcttgtcaatgtaggtgc

SEQ ID NO: 6864564 - DNA, 61 bp, Homo sapiens
acagacctgggcacagaaaggaccagttcagggagggcgtcctttctccacccaggtttgt

SEQ ID NO: 6864565 - DNA, 61 bp, Homo sapiens
aggccaaaaggaactttttgaaggtcacagggttccatctgcaaccttcattcctttgcct

SEQ ID NO: 6864566 - DNA, 66 bp, Homo sapiens
taatgtgtcaaatacatatgctctctctttgtccagtgcccagcacagagcctgtgttgacagttg

SEQ ID NO: 6864567 - DNA, 84 bp, Homo sapiens
gctcctgtgtagtcaaagacagatgacctcgcttgaggattttatagctcttggtggttttagatgcctttactgcatatgagc

SEQ ID NO: 6864568 - DNA, 70 bp, Homo sapiens
gtggggtaaatggggagaggttacagtaataataattcatgtaattggtaaaattcttcccattttacat

SEQ ID NO: 6864569 - DNA, 60 bp, Homo sapiens
cccttcatgtagctgtgtgtccaaggggacagagactttggaatagcttaaagtgagggg

SEQ ID NO: 6864570 - DNA, 58 bp, Homo sapiens
aaggcacaacacaagagggtgacacatgactgtgacactctttgtctgctgtgcactt

SEQ ID NO: 6864571 - DNA, 68 bp, Homo sapiens
tgcagttccagagaggcagtttccctgaaatagtgggacatttatacagtggctcttgtgggactgca

SEQ ID NO: 6864572 - DNA, 86 bp, Homo sapiens
atggtgagtccttggaaggcaggaaccctgtgtgcgcctgtttctgcagagcacagtgcagtttctgctaacagagggcctatcat

SEQ ID NO: 6864573 - DNA, 56 bp, Homo sapiens
tggcacctgaacttagaggtgtgagcgaatatctcactttgactgggaaggtgtca

SEQ ID NO: 6864574 - DNA, 62 bp, Homo sapiens
gctgggcatttgcaggtcaggcaccctcaggattccagggcccctgggaaggcagccccagc

SEQ ID NO: 6864575 - DNA, 69 bp, Homo sapiens
tgtgactattaggaggtgctcaaagtgttatttccagaaaacacacttctcccatctcctgttgtctca

SEQ ID NO: 6864576 - DNA, 56 bp, Homo sapiens
accgtgggcaatgggacctggatgcccgtggccaaccagggtccagctgccatggt

SEQ ID NO: 6864577 - DNA, 75 bp, Homo sapiens
agcaactgttcccaagataagattatgatttacaccagtacttcttaaaatgtgggtctgcggaatggtgttgct

SEQ ID NO: 6864578 - DNA, 60 bp, Homo sapiens
ctcagtgggcatagttctgaaatatgtgctctacactgtctcccaggtgtgcccagtggg

SEQ ID NO: 6864579 - DNA, 87 bp, Homo sapiens
gttttagaaatgcatgtgggaaatacaagctaaaatgctattggcatttttttctgattttccccagtcatatgtatttattagaat

SEQ ID NO: 6864580 - DNA, 75 bp, Homo sapiens
acttcacatataaatacaatatgtgttaaaggactaaatttctagtgtcacagtttgtactttatagtttgaagt

SEQ ID NO: 6864581 - DNA, 62 bp, Homo sapiens
gggcactgctggaggctccctgttctgccaactgctggattgcggggagttccagagtgtct

SEQ ID NO: 6864582 - DNA, 62 bp, Homo sapiens
agaactccagggcattgtctcctggggctatggttgtcctcagaagaacaaacctggagtct

SEQ ID NO: 6864583 - DNA, 62 bp, Homo sapiens
tgtcctgttcttgctgtgtcctcagtgcttagcatagtttccggcacacagtagggctggca

SEQ ID NO: 6864584 - DNA, 87 bp, Homo sapiens
tatttgaaaagccactttcattcatatactttagttcacatatttatgagaagcaatgtgttaatgaatgagttaaagttttaagta

SEQ ID NO: 6864585 - DNA, 57 bp, Homo sapiens
ggctggtcctttctctgtcctaattacaaattattagaagagaggatatgatcagcc

SEQ ID NO: 6864586 - DNA, 99 bp, Homo sapiens
gcttaagggaagtctgttagagggacttagagttgggattcaaacccaggcatggcagcctgcatttttcccactctgtctccctggctctcctggagt

SEQ ID NO: 6864587 - DNA, 56 bp, Homo sapiens
tagggattgattaccatggttgatatgtataatggagaactgtaattaatacccta

SEQ ID NO: 6864588 - DNA, 64 bp, Homo sapiens
gcagtggggtctgtcctcttctgggtgctcgtcagtcacttagatgaagtcacagaacccatgc

SEQ ID NO: 6864589 - DNA, 61 bp, Homo sapiens
gcagatggtgggggaggagtacatacggacgaatttgaatcacaatttcctcactatatgc

SEQ ID NO: 6864590 - DNA, 66 bp, Homo sapiens
tttatgtttgtttttgaaataaaggatttagtttaagattctaaattttagagaaacaaacgtagg

SEQ ID NO: 6864591 - DNA, 102 bp, Homo sapiens
cccaagtcaggtactcgaatggaggttgtccatggtgtgttcattttatttatgatgagtattacatggccaatctcctttcggtactcaattcttcttggg

SEQ ID NO: 6864592 - DNA, 90 bp, Homo sapiens
cagcctggctcagttctctggtaacctgttgagtgacagcatctttatatgctcattagacaggtatactttatacaacgcagccggctg

SEQ ID NO: 6864593 - DNA, 85 bp, Homo sapiens
caggatagaaggaggcatttcctatgggcagagaagacccccaggagggcttcactgggtaggacatgctgatccctagttcctg

SEQ ID NO: 6864594 - DNA, 72 bp, Homo sapiens
ggctcaggagaggggctaaaagtggtggcagtaggaagatagagaaaggccttgttttgcccctttctggcc

SEQ ID NO: 6864595 - DNA, 73 bp, Homo sapiens
ggagctagggccctaggagagcctgaagaggacccaggtgtgctccaggcccctgcctgggcctgctggcccc

SEQ ID NO: 6864596 - DNA, 58 bp, Homo sapiens
tctctgccagccaaagtcatcaccataagacactggttgggggcctggcaggcggagg

SEQ ID NO: 6864597 - DNA, 63 bp, Homo sapiens
caggaaaaagtgaccttggtagctagtctccaaagatggccaccaccaatacttgccttcctg

SEQ ID NO: 6864598 - DNA, 55 bp, Homo sapiens
tccccttctccagtcaaagagagagaatatagccctctggactgtcagacaggga

SEQ ID NO: 6864599 - DNA, 59 bp, Homo sapiens
tctgtttagaaatctcatgcatagattattggtcagattgcagagatatctgaagcaga

SEQ ID NO: 6864600 - DNA, 88 bp, Homo sapiens
gcaagccaagtctagattttgccactaaatactgttctttcctaccttaagacaatttggaaaggcagctggcaaattctagagctgc

SEQ ID NO: 6864601 - DNA, 56 bp, Homo sapiens
gcctttggagatgtcataggatcagcttctgggattccatgtacatttgctaaagc

SEQ ID NO: 6864602 - DNA, 77 bp, Homo sapiens
ggaactgtggtcctctcaactgaaggttgaatctacttccaagcttccttacctggttgttgacaggactcagttcc

SEQ ID NO: 6864603 - DNA, 89 bp, Homo sapiens
catgtggggaaggagcagacctaccaccgcgatgtgttgacggggagcccggagcataggcggtggtaggacccctcgttcttcacgtg

SEQ ID NO: 6864604 - DNA, 76 bp, Homo sapiens
cataagacccattttcctgataggcgccctgcccgtagaagaagagctgcagctttggcccagtcgggagggtatg

SEQ ID NO: 6864605 - DNA, 60 bp, Homo sapiens
gttaacaaggtgtagaggttttctctctgaaggtgtttaaattcctctaactttgctgac

SEQ ID NO: 6864606 - DNA, 76 bp, Homo sapiens
agcctgggtgtgtttggcggcagaggccctgctcttttcctctctggggagcagctgtccccaaagcttcctggct

SEQ ID NO: 6864607 - DNA, 73 bp, Homo sapiens
agatggctggagcctgttctgagaagccgggccttctgctctcctggcattgatcaggaggctccagatattt

SEQ ID NO: 6864608 - DNA, 60 bp, Homo sapiens
gcggcaccatcagacttctgggcaggcaagattacctgtgactctgtctgatggtctcgc

SEQ ID NO: 6864609 - DNA, 61 bp, Homo sapiens
ggcatttttctcctcataatgtttcctgaagcatgaaaggatccttgatcagaagagtgct

SEQ ID NO: 6864610 - DNA, 130 bp, Homo sapiens
actctattatttgtatctctgaagaatattgattgttgcatgttaattttaaatcctggcaccttactgaattttgttaatagtgaaggcagcatgcacactagtgaattgaatgcaatgttacctggat

SEQ ID NO: 6864611 - DNA, 70 bp, Homo sapiens
acagtaggaatagatgtagatacatgagcatacttcactctgctactataattattgctattcctactgt

SEQ ID NO: 6864612 - DNA, 62 bp, Homo sapiens
cactgaactccttgtttgtcctctaacgccacaaaaccaaggctaaagaaaggggcacagtg

SEQ ID NO: 6864613 - DNA, 65 bp, Homo sapiens
ctgtgacttttgccctgtaccagccagaggaagtaaatggctagagtagggggtgagggtggcag

SEQ ID NO: 6864614 - DNA, 121 bp, Homo sapiens
gctgtctgtctaaacgaagatcttttcctcgatgtccctaaagaaacagacatttgggtatagccaactgttagaagaatttagggggatagaggagagtcatcttacagaatgacagagc

SEQ ID NO: 6864615 - DNA, 93 bp, Homo sapiens
tgggcttgcaggccctggtgccaccagctccttgtgtgatgggggagtcaccttccctgagtgggctggtagtatcctgggtcatcttgtcca

SEQ ID NO: 6864616 - DNA, 83 bp, Homo sapiens
gcccacccagaacagcagggaaattccaagtcatcggtttctagttctccccatgcgtgtggtggccctgctttgtggtgagc

SEQ ID NO: 6864617 - DNA, 77 bp, Homo sapiens
gtgcttcccttcaaaacactagtttttgagcacttctacatcagcagctcaaaatgtaatgttctgaaacctggcac

SEQ ID NO: 6864618 - DNA, 61 bp, Homo sapiens
ctcccaggctggcaggcagcagtgctgaggacaagctcactgttgagagtcggtctggaag

SEQ ID NO: 6864619 - DNA, 64 bp, Homo sapiens
cagtcagatgtaagttggaagctggggcaaaaatatagggcagttgttgatgaagatctgactg

SEQ ID NO: 6864620 - DNA, 74 bp, Homo sapiens
tttgcactcttttttctcacaaaattttgtaacaagcgtatttattgcacgatagtgtgggctttggagtcaga

SEQ ID NO: 6864621 - DNA, 70 bp, Homo sapiens
ccgcagaccctttctgcatgcttatctcatcagattgaaactctgcactgcggtaaggtggaaattgtgg

SEQ ID NO: 6864622 - DNA, 84 bp, Homo sapiens
tatgcttgacattcaactttgatgattatgtcagtgactttcaggtttctatctaatgattcatcaagttgtatttcaactgtg

SEQ ID NO: 6864623 - DNA, 81 bp, Homo sapiens
tagggccactgaggggtcatggtgggagtcaaggaaatcaatatccaaacttctctcccaccattctcccttagtctcctg

SEQ ID NO: 6864624 - DNA, 119 bp, Homo sapiens
cctgacttcgcacaccagctgcagagggaattccagggtttctgtccaggcagtcactggtgcctccaggcctgggcaagaaggggcgtcctcctgggttggtgggctgtgagctcggg

SEQ ID NO: 6864625 - DNA, 95 bp, Homo sapiens
acctccaccctgggccttgatataagagctgtagcttcctagagccctaaggagggggagtagcaggcacagcctcaagaactggggtgggaggt

SEQ ID NO: 6864626 - DNA, 85 bp, Homo sapiens
ggggaggtggcagcacatgcttgagtgtgatgtggggagacagctcagccagcgggatccctggggcatgttctccacctcaccc

SEQ ID NO: 6864627 - DNA, 56 bp, Homo sapiens
atttcagccctgatcctcatcttatagctgaagcagttgaggcacagtggtgaaat

SEQ ID NO: 6864628 - DNA, 84 bp, Homo sapiens
atgtagatacgttatcacatgtatgtgtgtttagtgatacaaattgtttcatagacacagatctatatatgtgtatgtctatat

SEQ ID NO: 6864629 - DNA, 130 bp, Homo sapiens
tctctctgaaggtgaactctgggtgcacagctagaggatacagtggctgtgagctgggccctccaggtgaggtctggcctgcccattgccacagtgggcttgctggcatccaggggggctttctgggtga

SEQ ID NO: 6864630 - DNA, 74 bp, Homo sapiens
aggcatccgaggcagcatgcattgaccacatggatacactttgctatgctgtccactcttggtgtttaatgcct

SEQ ID NO: 6864631 - DNA, 116 bp, Homo sapiens
taggaggcatggagagcatataggatcctaagatgggctgtgatcctgttccatttgtatctgtgcctaacacagtcctgctcacttatttccttattttctaaccaaccctccta

SEQ ID NO: 6864632 - DNA, 89 bp, Homo sapiens
acagtcttgctctatcacccaggctggagtgcagtggtgcagtctcagctcactgtaacctccacctcctgggttcaagcgattctcgt

SEQ ID NO: 6864633 - DNA, 93 bp, Homo sapiens
ggtctcaccattcccatatcccctgacagcatgaccacagggtctggttccatgtgacccatcttcactgtgggaaatgggtggtgggtagcc

SEQ ID NO: 6864634 - DNA, 130 bp, Homo sapiens
atatttcttggtatttttcactgctctctccccagcaccaggcacatagtaggcactcagtagatagttgtccagtgaatggatgtgtactggatgtttgggactgtgctgagtcccttataggggatat

SEQ ID NO: 6864635 - DNA, 79 bp, Homo sapiens
cagtgagttctgctacttttgaaagtcatcaaagccaacttctccaggatgaaatatttcagagcagagtgccttcctg

SEQ ID NO: 6864636 - DNA, 63 bp, Homo sapiens
ggaagggctggctccgttaccttgaccttgtcaaagatggtgagggggtggagccaggccgcc

SEQ ID NO: 6864637 - DNA, 93 bp, Homo sapiens
ttggggccactgtgttgtacaatgccagggaacaccatttacatcatctttgagaatgggtccctctggagtagtacagttgcactgcttgga

SEQ ID NO: 6864638 - DNA, 91 bp, Homo sapiens
gccaggatggcctcaatctcctgacctcatgatccacctgccttggcctcccaaagtgctgggattataggcatgagccaccatgcctggc

SEQ ID NO: 6864639 - DNA, 58 bp, Homo sapiens
gggatgaggtagatgaacaagggcctcaggccaggcccatcatccctacctccgtccc

SEQ ID NO: 6864640 - DNA, 77 bp, Homo sapiens
gcttcaccctgagaaagtcacatgcattctcctgtgatctgcagcccatgcttgagtgtggtttctcaggtaggagc

SEQ ID NO: 6864641 - DNA, 93 bp, Homo sapiens
tgcatttaaattgttcatatatgagggcaaagtgaatagaatggcttggcctgtctcctcctttgttcttaaaatgataattctcttaatgta

SEQ ID NO: 6864642 - DNA, 78 bp, Homo sapiens
gaaacttttatgattaatcttgttttgtgttgacacaactaaggtaatgttaacatgttaagaaattagataagtttc

SEQ ID NO: 6864643 - DNA, 114 bp, Homo sapiens
ggaaactgctatagaatatgtgagcagcagcagaaacccagcaaagccaaggggaagaggtagccctggccttggccttttctgctcctctccctcccatagcaagagcattcc

SEQ ID NO: 6864644 - DNA, 78 bp, Homo sapiens
tgaatgggcagagatgggccagtgacgcaacacagtaaagtgtattttggttataggcatcgtctctaaacttatgta

SEQ ID NO: 6864645 - DNA, 60 bp, Homo sapiens
gtgggccaggtctgcggtcatttccaggcttgactggaggaggtccgcttccaggcttat

SEQ ID NO: 6864646 - DNA, 67 bp, Homo sapiens
acctgtaacatatagcatgttcttgataaatatttattaaatgaatgaaactatgtgttgtttaggt

SEQ ID NO: 6864647 - DNA, 88 bp, Homo sapiens
ccattcccccacgctgactgtgctccttgaggacagagcgcccttggttagaggcagatctgcaggagcagggcgtggagggtgatgg

SEQ ID NO: 6864648 - DNA, 56 bp, Homo sapiens
gtggggaggtaagatttgttaaactggaattaaaagaagacagtaaacttccccat

SEQ ID NO: 6864649 - DNA, 57 bp, Homo sapiens
gcaggttggtttcttctgaggcctctctcctggccttgcagatggccacctacttgc

SEQ ID NO: 6864650 - DNA, 119 bp, Homo sapiens
tcataagtttgtggtgagggttattaaatgaagtaattaatgtgcctggcagagaatacacatttgataaatgttggctattattattactgctattgttactatcacctgttagatga

SEQ ID NO: 6864651 - DNA, 61 bp, Homo sapiens
gtaatgaggcttgtggggtagggccaggcctactgccctaggaaattaggagacctcatac

SEQ ID NO: 6864652 - DNA, 79 bp, Homo sapiens
gatttaagtggttcttgcaagtgctctgtatctgaattcaggaagcagtgaatctggcaagaatttacaaacttaagtc

SEQ ID NO: 6864653 - DNA, 61 bp, Homo sapiens
catctactggggtgaggtggaagcttattggagagtgagtgccaatggaactccataggtg

SEQ ID NO: 6864654 - DNA, 69 bp, Homo sapiens
tttcaggaaagatggtatctcttcaatagagttgctaagctagtgagcagtcatccatttctccttaaa

SEQ ID NO: 6864655 - DNA, 74 bp, Homo sapiens
gactgaactggcaagtcctaaacacacacaaggcctggcaccaccagctacggtgttcagggctgctggcagtc

SEQ ID NO: 6864656 - DNA, 73 bp, Homo sapiens
ggaatggttatactcatttgacaacgttgttgtgaggatctgatgggtttctctgcaacatgtgtcaaattcc

SEQ ID NO: 6864657 - DNA, 68 bp, Homo sapiens
cctggaagagtctgcatatttatcatgagtctaaacaaggattagacttctaaatagcagcttctggg

SEQ ID NO: 6864658 - DNA, 75 bp, Homo sapiens
gctgcagctgctggtggctgaaagagagagagagagagagagacctcctcttaggccacttcccagagctgtggc

SEQ ID NO: 6864659 - DNA, 62 bp, Homo sapiens
ttctctcttacttgctcactctgatgaaacaagtaccatattggcaagcaactgagggagga

SEQ ID NO: 6864660 - DNA, 63 bp, Homo sapiens
ggattcccagctgtctgcatgaggagggggagtcagctgccctggcaggcagctggggtatcc

SEQ ID NO: 6864661 - DNA, 61 bp, Homo sapiens
gcttatatttgtttctagtggcagcaagttctgttttgctcacctgagaagaatagagggc

SEQ ID NO: 6864662 - DNA, 96 bp, Homo sapiens
gagaggagaattgcttaaacccggagtcggaggttgcagtgagccaagatcgcaccattgcactccagcctgggcgacagagcaagactctgtctc

SEQ ID NO: 6864663 - DNA, 72 bp, Homo sapiens
gatccaggttgttctatgcctcctatatgctcggtactgggtcatatacactgcatgtaatcagctttaatc

SEQ ID NO: 6864664 - DNA, 79 bp, Homo sapiens
taattataaagtgagatgaaaatatctgtgatttctaagagtgacagagtcatagatactgttcatgttacagtgatta

SEQ ID NO: 6864665 - DNA, 55 bp, Homo sapiens
tccaggacttgcctgtcctccctgagtttggatgggagagacacaagggcctgga

SEQ ID NO: 6864666 - DNA, 58 bp, Homo sapiens
gcatggagaagtgggaacaggtccttccaggcagcctggctcttccttctcatcatgt

SEQ ID NO: 6864667 - DNA, 124 bp, Homo sapiens
ggggaccctgggggctcaggatccagcaaggggcggcaggagtaaaggaggaaggaatgacaggtgcaaataccttcccaccaaagcccttgttgccctctggctcctccccagagctgtcccc

SEQ ID NO: 6864668 - DNA, 56 bp, Homo sapiens
ggcaaccatgtacaaagatgctgaggtaagaaagagctcagtgtattctgggtgct

SEQ ID NO: 6864669 - DNA, 57 bp, Homo sapiens
ggtgggagctgtttcacatgctgcagccagctaagcatcttcaacaggcattttacc

SEQ ID NO: 6864670 - DNA, 93 bp, Homo sapiens
ggccgggcgtggtggcttacgcctgtaatcccagcactttgggaggccgaggtgggtggatcacgaggtcaggagttcgagaccagcctggcc

SEQ ID NO: 6864671 - DNA, 66 bp, Homo sapiens
tcagtgggaaaggcagagttgttggaggcataacccaccagtgccttgaagtctgccttttaatga

SEQ ID NO: 6864672 - DNA, 64 bp, Homo sapiens
gttcttgtccaactgcctccagtttctatatgaaatgttggaaaggacagttgctgataggaac

SEQ ID NO: 6864673 - DNA, 62 bp, Homo sapiens
ggcgtgaattttgacatggagtactgtggcttgtattgcattgagattttaaaattcatgtc

SEQ ID NO: 6864674 - DNA, 62 bp, Homo sapiens
acctccggcattactcagaccagccatctaagcccatgttgctttggatgtgtgcctgaggt

SEQ ID NO: 6864675 - DNA, 64 bp, Homo sapiens
aggatgtaatgcactcccaaagatccaagggaagcccttggaatatgcaattgcatttcattct

SEQ ID NO: 6864676 - DNA, 64 bp, Homo sapiens
gtgaggactagtgggtttgtgcacagcctggagtctgcacaatagcttcccagtactttctcac

SEQ ID NO: 6864677 - DNA, 82 bp, Homo sapiens
tgattggggcatatgtgtttgtatagttgctggtatttcaggccaatgactgctttgacaaatgataccttgctttcaatca

SEQ ID NO: 6864678 - DNA, 60 bp, Homo sapiens
ggatatgttggtaggaaagaaagctgggtgacaacagcaacatttttcaattaacatccc

SEQ ID NO: 6864679 - DNA, 63 bp, Homo sapiens
tattgatcaggatccttttccacaaaaatgagacttactggaaaggctatttcagggtcagta

SEQ ID NO: 6864680 - DNA, 56 bp, Homo sapiens
tgctcaaatgtggacaactgataatgcccaaattttctttctgtctgctttgggca

SEQ ID NO: 6864681 - DNA, 96 bp, Homo sapiens
gctgctcagcctccttcacctggccttgaggaggccaccaagtcattcccaatttcttgctgctttaatgaggccagccgtgaacatccttgcagc

SEQ ID NO: 6864682 - DNA, 64 bp, Homo sapiens
tctctgggctcaggagcccggcaaaatgagtaccacgagcagccagggcaaccaagtccagaga

SEQ ID NO: 6864683 - DNA, 102 bp, Homo sapiens
gggtctcgtgccccgctgactgctgagcttctccagggcagagagcgacggcatcatctctgcatcccagggctcagcacacggctggcacatatgaggccc

SEQ ID NO: 6864684 - DNA, 73 bp, Homo sapiens
gaaggcaggagagtttggggaagggtcagagcttggaaaggctgctggaacttagcatgctctcctagtcttt

SEQ ID NO: 6864685 - DNA, 60 bp, Homo sapiens
ctctgcctgcaattcttattcagaaacagctatttgctgatgctcagaatgcaggtatag

SEQ ID NO: 6864686 - DNA, 68 bp, Homo sapiens
ttagtgatgggttgaagttaacagtgctgacaaagccttggtcactgatcccttcggcttgtcattaa

SEQ ID NO: 6864687 - DNA, 62 bp, Homo sapiens
ttgtgagtcttgcaggtcgctcacccttcagacctttaggctgaggcctgccagtctcagaa

SEQ ID NO: 6864688 - DNA, 60 bp, Homo sapiens
actgttatctgtagatatttgtatatagcttatggatacaattattctgcagatatttgt

SEQ ID NO: 6864689 - DNA, 83 bp, Homo sapiens
tgttgttcttgcttattatggactttgggaagaagtcaattagagaagttctttagccagtatcataatgagtaatgggaaca

SEQ ID NO: 6864690 - DNA, 57 bp, Homo sapiens
atgcctttatcaggaggtaaatgagttaatacacataaagcctttagatgatggtat

SEQ ID NO: 6864691 - DNA, 63 bp, Homo sapiens
aatcgagtggtgagaacacaacagaagtccaatttagattctgagtgttgtaaccatatgatt

SEQ ID NO: 6864692 - DNA, 84 bp, Homo sapiens
ctttgtggttttggaggggaagaccttggagcagttgcgaagatccatctaccatgttctggtttttccttggaagcctaaaag

SEQ ID NO: 6864693 - DNA, 79 bp, Homo sapiens
ctcagtgtctggttggctctacgtccaaggccactgccggctgcagagacgtggtgagggctgaggccagacagctgag

SEQ ID NO: 6864694 - DNA, 73 bp, Homo sapiens
gcctgtaagtaaaccacagtggtgggagcagtgctcgggacagtggacattgcacagccctgtggtgatgggc

SEQ ID NO: 6864695 - DNA, 63 bp, Homo sapiens
ttttttccggatgcccagaagttaggattattgaagccctatcctgctcctggttggaaagaa

SEQ ID NO: 6864696 - DNA, 77 bp, Homo sapiens
tcatcctgccagctggagccaaggtggactctccccatagactgggatgagtgccctggcccagctggacctggtgg

SEQ ID NO: 6864697 - DNA, 78 bp, Homo sapiens
ggacaatttccttatgctggtaatggttatttctgtgtactcttctgatgcggtgaattgactgtttctagtttgtct

SEQ ID NO: 6864698 - DNA, 76 bp, Homo sapiens
aggaggttgggacgtggaatactgagtgactagagaaatagactgaagtcatacactgttctgacaccaatattct

SEQ ID NO: 6864699 - DNA, 58 bp, Homo sapiens
gtgtgcttcctgtattgattccatgactcacggagcatgagctaagcagaaagcacac

SEQ ID NO: 6864700 - DNA, 63 bp, Homo sapiens
gaaatatgcaatttagaacagacttaggaaatccctaaggctttctaaatatgcagaaatttc

SEQ ID NO: 6864701 - DNA, 72 bp, Homo sapiens
gagggagctttcctgcaggtttcccccggacggaatgtgtttcgtcctgtgcacctgcctgcagagcccctc

SEQ ID NO: 6864702 - DNA, 83 bp, Homo sapiens
gcttgtgatttcactccatctttgctactggttttgacaacagggaatcatttaaagactttaggcagtgtagtgacgtgagc

SEQ ID NO: 6864703 - DNA, 60 bp, Homo sapiens
ctctgtgccagtctgcactcggctggagtaccagataatccttcccgagtctgtatggag

SEQ ID NO: 6864704 - DNA, 80 bp, Homo sapiens
gggtggtcccagatggcagtggggggctggggaactgggaggtcttgcagaggaacaactcctcactgcctctggcactc

SEQ ID NO: 6864705 - DNA, 82 bp, Homo sapiens
ttcaagtcctagtagaatcccttgcaatgtccctcctccctggaaggcaagaggagattctgctcccagaacaggccttgga

SEQ ID NO: 6864706 - DNA, 71 bp, Homo sapiens
atgtttcaactgttgtcatatggtcttaattatgttaaattagaggatctggctgacaacactagaaacat

SEQ ID NO: 6864707 - DNA, 108 bp, Homo sapiens
ttctctggggttgcaggtgactggcaggcggtattcctgatgtgatggggcagtgcatggcaccagcttcacagtataggtccctgagtagtcacgtacctttgagga

SEQ ID NO: 6864708 - DNA, 68 bp, Homo sapiens
tagacaatctcagcaaacacacacactggagacttactgagtgactcaatgttggctagaattgtcta

SEQ ID NO: 6864709 - DNA, 86 bp, Homo sapiens
tgatctcactccagtgattgttttaataactgagatttccatataaatatcctctgaatagttgaggcattactgtaatgagatta

SEQ ID NO: 6864710 - DNA, 58 bp, Homo sapiens
tctctcactctctctcaatatacaaatgtgtgtgtatattggtgggggcagagagaga

SEQ ID NO: 6864711 - DNA, 85 bp, Homo sapiens
agacacagctctgagctaaaatgtgtttttctcagccttaggtcatcgggctcagttgcatattttgtgttctctgtcttgttct

SEQ ID NO: 6864712 - DNA, 108 bp, Homo sapiens
ggtggattaaaaatataatctggaggaagaatgttttggctgggacccacacactttttttcaaaaagctttatgatctctcagctacaattcctcttgattttcacc

SEQ ID NO: 6864713 - DNA, 56 bp, Homo sapiens
agtggatccaacatgcttcctgggttgctgtcttccaagaggctgtggatcctact

SEQ ID NO: 6864714 - DNA, 57 bp, Homo sapiens
gagcatgtgatgggtgaagggaagaatcaaaatttcccaatagcactgtcatgtttc

SEQ ID NO: 6864715 - DNA, 83 bp, Homo sapiens
ctgaggaagcatggcagggcacagctctagttgacagatgttttaggtacaaatagaagttgggccattgctggctgtatcag

SEQ ID NO: 6864716 - DNA, 64 bp, Homo sapiens
acctctgaaggtttacatttcctcatttgaaaaatggaaataataaagtaaaccctcatggggt

SEQ ID NO: 6864717 - DNA, 65 bp, Homo sapiens
agctgctcttcatttccccccagcaaaacaagaggaaatggatggtggagatggtggagacagct

SEQ ID NO: 6864718 - DNA, 86 bp, Homo sapiens
gtgtgaaaagatgctctaaagtccagtcaactagcccacaaatcagtgggttcatctgcttgcttgagttattctctttgtcatac

SEQ ID NO: 6864719 - DNA, 59 bp, Homo sapiens
cttcctgagcaaggaactataggtatccttaatggagtccattaatctttgtcagggag

SEQ ID NO: 6864720 - DNA, 75 bp, Homo sapiens
atggtttactgatctttttggtcatcaagatcaggagtttaaaagatggtggtcagggtgaggagtggaatccat

SEQ ID NO: 6864721 - DNA, 61 bp, Homo sapiens
gagtgactcgatgactttcaaagatgtaaaagtaggtttacgtcatgacagcattttactc

SEQ ID NO: 6864722 - DNA, 58 bp, Homo sapiens
tagtttctcagggaggaaagaagatgagaataacatctctctctctccagggagatta

SEQ ID NO: 6864723 - DNA, 72 bp, Homo sapiens
catatatatgccatttaaaaatgaccaaatgacgtgctaaccatggttgtctttgggtggtagaattatatg

SEQ ID NO: 6864724 - DNA, 106 bp, Homo sapiens
gagagcaactgagacgggagggctggtgacagaagtgccatactgtggtccaccaaaaggtgggaaactgcagttcctgccaagcccttatcctgtagttcctctc

SEQ ID NO: 6864725 - DNA, 58 bp, Homo sapiens
atggcaggaaaatagtagaaatttatcaaatatgaaaactgcttccaattcctgccat

SEQ ID NO: 6864726 - DNA, 64 bp, Homo sapiens
cctgcctctggatgttcttctgcaattatggtgccagccatgctacaggaagacgtcaggcagg

SEQ ID NO: 6864727 - DNA, 55 bp, Homo sapiens
gggatgaatgcctggctcccccttctttccagccctagctcaggcccatcgtccc

SEQ ID NO: 6864728 - DNA, 66 bp, Homo sapiens
atgtagttctgcagatataaagaatttatgtgtgccattttattcttcactgtttcagaatgacgt

SEQ ID NO: 6864729 - DNA, 79 bp, Homo sapiens
acagaatgcagctgcagaaagcaagcaggttcaataaataaaatgtaaatgtgcagccctctgccagcacaagttctgt

SEQ ID NO: 6864730 - DNA, 60 bp, Homo sapiens
atttcttcctatctagttcctattcatatcaagatagcctgagcccaagtagggagaaat

SEQ ID NO: 6864731 - DNA, 55 bp, Homo sapiens
gagggatggtagttgacactgaagcaccacactttggattaactgatgttctctc

SEQ ID NO: 6864732 - DNA, 67 bp, Homo sapiens
gtcacacagttctcttgattatctggtcccttcaaggggttccacatacaaatggggtgctgttgat

SEQ ID NO: 6864733 - DNA, 80 bp, Homo sapiens
tttccgagtccttaaatatatgttgatactaattctgggtaaggtttattgcttatgggaacaatgtgaaggataggaag

SEQ ID NO: 6864734 - DNA, 81 bp, Homo sapiens
ggcacatagctactgatgacacacacaaatattgtaagttgataaggatgtctgaaatgttataagtggctacctgatgcc

SEQ ID NO: 6864735 - DNA, 78 bp, Homo sapiens
gttcctcactataggttttgcctactcttagattcaaacaagaaatctgaatgtaagactttaagaacctaaaggagc

SEQ ID NO: 6864736 - DNA, 72 bp, Homo sapiens
gtcagattggaacttgtaaatccttcttttttaagacaagccctaagaaggaacacaatgcttctgtgtgat

SEQ ID NO: 6864737 - DNA, 113 bp, Homo sapiens
atcttttaacacctctttggggcaggtaatggtggctctgctcttcaccctctggcaggtccttagagagcatcaccgttacccacttatctcacaaaggagtaagctgagat

SEQ ID NO: 6864738 - DNA, 58 bp, Homo sapiens
cagctctactgggcaccattcgtacagactgcagtgtgaattgtgccccttggtgttg

SEQ ID NO: 6864739 - DNA, 78 bp, Homo sapiens
ggtaattgcacaactgcttcacttcggttgcatagatagttaactgcgcacatttggtgtggtaattgggtagtggcc

SEQ ID NO: 6864740 - DNA, 58 bp, Homo sapiens
caccctgtgaaatccattagtagcctcactttatatactaggaaatcgaggcagggtg

SEQ ID NO: 6864741 - DNA, 104 bp, Homo sapiens
tgatgtgtgaaaaaattagagttcagagaaacaagaaagaatttccaaagtaatctttagaaatcaggtttttagaaagttccctctgatatttaagcatatta

SEQ ID NO: 6864742 - DNA, 57 bp, Homo sapiens
attgttttcctggctctgatgagtatttcatatggtcagttctgctagaaaaacagt

SEQ ID NO: 6864743 - DNA, 68 bp, Homo sapiens
ttgatttttctttaaacttattaattagagtcagcgtcttctctgattagcagtttagggaaatttga

SEQ ID NO: 6864744 - DNA, 61 bp, Homo sapiens
gcccgggttgtccgcgcgtccggccgcccctccgcggctgcggctctgcgggcagctgggc

SEQ ID NO: 6864745 - DNA, 67 bp, Homo sapiens
ttggaaaggtttatgagtttggaaggggtgtgacccatacctgttccattcatatcctattggctag

SEQ ID NO: 6864746 - DNA, 77 bp, Homo sapiens
catatgtgtatatatagagtgtgcatatttatgtgtgtgtttacacagatgtacactcatatataattgcacacatg

SEQ ID NO: 6864747 - DNA, 60 bp, Homo sapiens
cctcaggcagctgccttcagctggatgggaaacttcacttcaaccaggcagctcctgggg

SEQ ID NO: 6864748 - DNA, 83 bp, Homo sapiens
aagcagtgacattgtgtgcatttaaagtttcatatgtggctctcatgtgtggcttgaatacaaatgctcacagtgtttccctt

SEQ ID NO: 6864749 - DNA, 91 bp, Homo sapiens
gtaatggatcagattttggaggaattcaatgcatggtaattagtccatggcagctttgaatttcttgaaattaggaacattgattctttac

SEQ ID NO: 6864750 - DNA, 61 bp, Homo sapiens
tttggctactctcctgagaattgtagtagtccaactgctcatgtcttaattggagcccaga

SEQ ID NO: 6864751 - DNA, 81 bp, Homo sapiens
tactttgtttttgtcttttgcatttgttggaagctgattgaaaaagccttccacttagtggaagggcatgctacatttgtg

SEQ ID NO: 6864752 - DNA, 65 bp, Homo sapiens
gccatgtactttgtggtaatttgttacagtagtcctaggaaactactacaagtgagtacaaaggt

SEQ ID NO: 6864753 - DNA, 65 bp, Homo sapiens
ccaccagctgcctgcctcaggccgagtgctgaaggtcaaccagcattgcagagggggcacggtgg

SEQ ID NO: 6864754 - DNA, 56 bp, Homo sapiens
ggctttttgatgagagtcctctttaaaaggaaagaaatgcagtctcgtcaaaagcc

SEQ ID NO: 6864755 - DNA, 62 bp, Homo sapiens
catgagtgtgccagtctgatatggtgagataagcctgggacagatgtgctgccgcattcgtg

SEQ ID NO: 6864756 - DNA, 86 bp, Homo sapiens
ctgaaacaagcatagttcgggcatgtgtgctgtgaaaagctttttcatcaattggtatgtgtgttcattcgggcatgcttgttcag

SEQ ID NO: 6864757 - DNA, 89 bp, Homo sapiens
aggaggctgctggggttgtcccagggggctgtggtttgaggggactgtgctgtttcggcctcctggggaactcaggcccagctgcacct

SEQ ID NO: 6864758 - DNA, 66 bp, Homo sapiens
catacagtcactgtggtaccactgtcgacattacagttcatcccggtatcaaagtgactggatatg

SEQ ID NO: 6864759 - DNA, 63 bp, Homo sapiens
ctgagtgttaaacatgttcacagcatccctactggcaaaggtgctggcttgtctaatatacag

SEQ ID NO: 6864760 - DNA, 68 bp, Homo sapiens
gaagaaagggcacagggaaagagtgcacctaaacctacaggtgtgattacctctgtgccttgggcttc

SEQ ID NO: 6864761 - DNA, 66 bp, Homo sapiens
gacataaggggagccagccatccagaacctgggcagagacccatgtcctctgacttgccttgcgtc

SEQ ID NO: 6864762 - DNA, 62 bp, Homo sapiens
aacatccatgtttttaagattttatcttaggtaagtagaattggttggggaatgtggaagtt

SEQ ID NO: 6864763 - DNA, 89 bp, Homo sapiens
gctccctggctttgcacctgcttccctgcggcagtccttgagacagctcctcagaaagcccaggagaacagattaaaagctcccggagc

SEQ ID NO: 6864764 - DNA, 59 bp, Homo sapiens
gtgtacctggaatcacagaggctgagttcaaaggtcagcctctctgagtccagacccgc

SEQ ID NO: 6864765 - DNA, 73 bp, Homo sapiens
gccctcgagtctgcggagtttgcagagcgcgagccgtttaaatttagcgctttgggctgcctggagcgagggc

SEQ ID NO: 6864766 - DNA, 68 bp, Homo sapiens
ggttagacagagtatctatcaggagtataacttccactctgagtaatgtcctgtgatgcttaatgacc

SEQ ID NO: 6864767 - DNA, 130 bp, Homo sapiens
gtgtccagcacgtgggtggtcagtaggttgtccggaggctccgtgctgctgccctgggccaggagaaggaggccagggtgagcctctggagccctgtgcccgcctacccacaccaatcctgcgtccacac

SEQ ID NO: 6864768 - DNA, 94 bp, Homo sapiens
aaagtgcaaggttttagcattctctgtgtgcataaagttactttcttaatgtgctttatgtatgaatatagtagaagtttttaaccttaatttt

SEQ ID NO: 6864769 - DNA, 69 bp, Homo sapiens
cctctgggtctccctgaggctaaaccccttcagtgtctgaagtccggcttgccccaggcagtccagggg

SEQ ID NO: 6864770 - DNA, 90 bp, Homo sapiens
tctggaagcatcaacaatgtggaaatgcagttttaccatgtgagccacaagcagttaaatggctgcgttttccgatgtatttgtcccaga

SEQ ID NO: 6864771 - DNA, 68 bp, Homo sapiens
tcaggcaggtgttaaccctctgagcccctcagagcctctggggctcagcaacatgcacctggctctga

SEQ ID NO: 6864772 - DNA, 124 bp, Homo sapiens
cacctgcactttgtttggatttgcctctatacccactgcatttctctgatgtttttttctaccattctgtttggacagagcatcagatgaaatcaactgctgagagagggaagtgagtgctgtg

SEQ ID NO: 6864773 - DNA, 97 bp, Homo sapiens
ctactgtccatcctaaatgatttggctttgacaagagggcatcttcagatcccttttggagattaaattttgtcacagttttgtcatttcacagtag

SEQ ID NO: 6864774 - DNA, 69 bp, Homo sapiens
cttcagacaattagcacatcacgggggtgtatattttactccaaataccagatgggctaatgtgagaag

SEQ ID NO: 6864775 - DNA, 60 bp, Homo sapiens
tttgtgttgttggattagttaacgtttatgccatatgcttgacataatccatagtacaaa

SEQ ID NO: 6864776 - DNA, 115 bp, Homo sapiens
tttattgagcatcacctagatgtcaagaactatacattactcattgagtcacagaaacaactttgagtgataagtgtgattatcttcattttacagaaggttgaagttcaacaga

SEQ ID NO: 6864777 - DNA, 78 bp, Homo sapiens
ttggcctgttgtggcttcttcctctctgatgtgggacaagttccctcaggagctggataggaccacaatacaggttga

SEQ ID NO: 6864778 - DNA, 108 bp, Homo sapiens
gggtggaggggaagtagaccagaacaggaggccccagaaagttcaaggcacaggatctgtctctgtggaaggcttccctggggtcctctggtttcattgccactgccc

SEQ ID NO: 6864779 - DNA, 80 bp, Homo sapiens
tgtagcagagagcacataggatactttatggaaaagagaaaaaagcactttctgagaagtcttattgtgcctcttataca

SEQ ID NO: 6864780 - DNA, 122 bp, Homo sapiens
gccaaagaaattctctcctgagtgccttaccatacctaaataataagatctgttggccttgcaacagatacagattttattattcaggtatggtaaggccaacagatctaggaacaattggc

SEQ ID NO: 6864781 - DNA, 61 bp, Homo sapiens
ggtcctggtgggacaatggacattactactgggatataatgtttatcttccaaactaggct

SEQ ID NO: 6864782 - DNA, 63 bp, Homo sapiens
ttgatttggtatcttacatttgaagtacatggttctctctgtgcttgaaagatgcagaattaa

SEQ ID NO: 6864783 - DNA, 88 bp, Homo sapiens
ttctaggagatttacaaaggcttttaatgagttagagatggatgaaaaagccctttttgattcattaaaggtattcatctgattagaa

SEQ ID NO: 6864784 - DNA, 122 bp, Homo sapiens
ggaaaatattgccttaattattactctgagtggatcttcacctagtttcttacaagattgcttaagataagtgggttgagatggacagtgctgaggagtgtcataggtttttattgttttcc

SEQ ID NO: 6864785 - DNA, 74 bp, Homo sapiens
cagctccccagcctctgacaccacagtcgtccgggatcacgtgctgggcacagtcagggtgcaggggggagctg

SEQ ID NO: 6864786 - DNA, 69 bp, Homo sapiens
gcatcatgggagtgacagggccactggcaagactttttgccagtcagcctagttcttcttttaagatgc

SEQ ID NO: 6864787 - DNA, 56 bp, Homo sapiens
tctcctgccactgcttcccattgactgaacttgtcaggaagccagggtgcagggga

SEQ ID NO: 6864788 - DNA, 75 bp, Homo sapiens
gtatgtgctcagtaagtacatgaagaacaaatacataaataaatggatgaactggaatgtctctgtagcacatac

SEQ ID NO: 6864789 - DNA, 75 bp, Homo sapiens
tgataagtatacattctgagaaatgcattgtcaggcaatattgtccttgtctgaacatcatagagtgtacttaca

SEQ ID NO: 6864790 - DNA, 76 bp, Homo sapiens
ggctctcaggaagtttgttctggttgtgtgtatgggggcctcccactcagcatatggggccgcttggctgggagcc

SEQ ID NO: 6864791 - DNA, 58 bp, Homo sapiens
ctggaggttgggtccaggccaggatggagcccaggctcctggcatctgggccctccag

SEQ ID NO: 6864792 - DNA, 57 bp, Homo sapiens
gtagaactctcgctggatcagacttcctcatagagaggtctctggggggagtattgc

SEQ ID NO: 6864793 - DNA, 63 bp, Homo sapiens
tatttatgtttaggaaagtgctggccagctggaaataagagctctttctctaatttataagta

SEQ ID NO: 6864794 - DNA, 84 bp, Homo sapiens
cagcagtattttatgggacacagtttgcattgctaggaacaaaaatcacttgcagtgttatgttttctataatttacagagttg

SEQ ID NO: 6864795 - DNA, 71 bp, Homo sapiens
tggcatgtctctacactgacagtaggtgcattgctgcagaccggtgtgctgttgttcaggtagaagtgcta

SEQ ID NO: 6864796 - DNA, 76 bp, Homo sapiens
tcctgttctctgcgtgtgagcacactcgggccagcccttgctggaccaggtgtgcacaggcagcatctgaatggga

SEQ ID NO: 6864797 - DNA, 77 bp, Homo sapiens
gaaagtctgcctcttggccatctaccatctctgaaagctctggcttcaaaaatggtctttgagctgcaagaactttc

SEQ ID NO: 6864798 - DNA, 122 bp, Homo sapiens
ctattctatcaatgctacacataataggattaactgatattgaaaaacatcaggttatattttgattctatgatgtaagagatacacttgattttaattagttggcatttagtgataaatag

SEQ ID NO: 6864799 - DNA, 130 bp, Homo sapiens
ttggtgacaaaaggtaaagctttcccaccttccttctgtctcattcatctatccaggatgtttatacctgtagattagtgatatgtgactagaccaggattcggggatttgcaatgctgaccgttaaaaa

SEQ ID NO: 6864800 - DNA, 58 bp, Homo sapiens
tgattatatacctttctaggtgctgagaattcagcagtaaagaagatgaatgtgatca

SEQ ID NO: 6864801 - DNA, 85 bp, Homo sapiens
atactgttttgaaaagtgatgctgaagtcagattacttatgaatctgggctttattttgcatgaatgctttctcaaggcaagtat

SEQ ID NO: 6864802 - DNA, 76 bp, Homo sapiens
cctgagtcccggggaaagtccagggcagggagtatgggtacttgttcttcctctttagggctggccaggggccagg

SEQ ID NO: 6864803 - DNA, 62 bp, Homo sapiens
gtgggtgaaagggcgtgggggtgggagcctggcatcctcctctctgggccattttcttccac

SEQ ID NO: 6864804 - DNA, 65 bp, Homo sapiens
ctctaattgaatagttattctgctcatctctgagagattgagcaggcaaagtatcatatttagag

SEQ ID NO: 6864805 - DNA, 76 bp, Homo sapiens
gtgagttgttaagttacatattcttgggctataaaaagacaactgctatggtctgaatgtgtgctccaaaattcat

SEQ ID NO: 6864806 - DNA, 65 bp, Homo sapiens
ataattgctcaaaaattattgagtgttttgaattgggaatgaagtgatagggtttgggcaattat

SEQ ID NO: 6864807 - DNA, 130 bp, Homo sapiens
actgctttcctcctgaaataccaccttgtaaagatagagaaaatggtaagttataagtaaaagatgaatattaaaataatgccattgtctcatccagaaggtgggtcaggttttctgaattaaagtaagt

SEQ ID NO: 6864808 - DNA, 74 bp, Homo sapiens
aggaattgtctgcctttatcatctccttaggttgttccagtttttaaaggatagtgtaaacgctcttgattcct

SEQ ID NO: 6864809 - DNA, 92 bp, Homo sapiens
aggatcaggctggacagtcagaggttattgatcccgatttaagccaaatgttgctaaaacttgatctgtgaccttgcttaagccattgacct

SEQ ID NO: 6864810 - DNA, 100 bp, Homo sapiens
gaattgacttggcacctttgaagaaaatcagttgaccatagaagttagagtttatctctggattctgaggtgggtgcatttttaattggtgccatctttc

SEQ ID NO: 6864811 - DNA, 59 bp, Homo sapiens
tttggggacatttatcaactacttccaagtgaagagtgattgtatcagtgtctcccaaa

SEQ ID NO: 6864812 - DNA, 63 bp, Homo sapiens
ggttgtgacatgggtagcagggacatatgtctagtgacatagatttgctatgcatatctgacc

SEQ ID NO: 6864813 - DNA, 91 bp, Homo sapiens
ctattgctgcacaactcccaactccttaggaaagggctgtgcatggtaaagtcattcacacccaaattctaacagtagatgtcagcactag

SEQ ID NO: 6864814 - DNA, 83 bp, Homo sapiens
ggctcagagaagttaagcatgttccctgaggttgcacagcctaggccatcagcccagagagatgctgtagaccctgtggtgcc

SEQ ID NO: 6864815 - DNA, 86 bp, Homo sapiens
tgaagcaatcggtggactcaaaatgtgcttgacttctcccaatcttgagtacgcccacttactgagtctatagtgataacgtttta

SEQ ID NO: 6864816 - DNA, 76 bp, Homo sapiens
tcgcttgagcctgggaggcggaggttgcagtgagccgatgtggccccactgcacctcagcctgggcgacagagtga

SEQ ID NO: 6864817 - DNA, 82 bp, Homo sapiens
ttgtgtgctcagagaaagcaattaaaagggtgctggttcttcatgattcagagcctctaaaatttctatctagaacatgcaa

SEQ ID NO: 6864818 - DNA, 79 bp, Homo sapiens
ggggggataccttagagtgatctgcatgtaaaccttcacactgtatttatatgacagtatcattttaaaatgttgaccc

SEQ ID NO: 6864819 - DNA, 62 bp, Homo sapiens
cccgtccctgtgcgtcgcgagcgggctccggacagcgccagatgcgagcgcgccgggaaggg

SEQ ID NO: 6864820 - DNA, 68 bp, Homo sapiens
gtgagattgaaaggtctttaaattggtagtattgtatcactgcaaatttaatggtttttgagaatcat

SEQ ID NO: 6864821 - DNA, 82 bp, Homo sapiens
cagctggctgaaaagaaaatgtaagctaagtttttctaagcatttatcaaatgctcttagctgctgttctttgagagagttg

SEQ ID NO: 6864822 - DNA, 74 bp, Homo sapiens
tcatgcactagctaaataaccagttgcgctcatgtaccctgaagcaaattgtttagcctgacccatgtgtaaga

SEQ ID NO: 6864823 - DNA, 67 bp, Homo sapiens
tgtgggtctgacctcagagtcctagtaccaatgtctcctcggcatgagaaactgaggtttggccaca

SEQ ID NO: 6864824 - DNA, 118 bp, Homo sapiens
agcgactcttggggaccctccacctggggtcacacacagcctggcttcaagtcttggccacggcttaccagctgtgtgacctggggtgagatagctgggcttttcagcctgagtctct

SEQ ID NO: 6864825 - DNA, 56 bp, Homo sapiens
ggaaagcaccttgcgctgtactagtcacagcctagacagcagcaatctgtctttcc

SEQ ID NO: 6864826 - DNA, 98 bp, Homo sapiens
taattacaaataattaattaagtataattgtgctaagtgctatgaaggagaagaacaaggttagtatttggctaattaaatttggagctttgtaatta

SEQ ID NO: 6864827 - DNA, 65 bp, Homo sapiens
gccaggaaccgatgatcagaggggaatgcgtttgagctccgctctgaatagtatttgttctgagt

SEQ ID NO: 6864828 - DNA, 56 bp, Homo sapiens
ggatatgtagggcatatctacatactaaaatatgtagcactatgcactacacatct

SEQ ID NO: 6864829 - DNA, 58 bp, Homo sapiens
gagagctgggctgaaagtgttccttgaggtttgcctgagtttctctgagcctgctctc

SEQ ID NO: 6864830 - DNA, 65 bp, Homo sapiens
tacaagtggaaagaaggcggtatcactctctgcaatagaggtcactccaccttcttctctttgta

SEQ ID NO: 6864831 - DNA, 60 bp, Homo sapiens
ccttcctataaagaggagtcagggtcatctgagtgaaagaggcaggctttatatggaggg

SEQ ID NO: 6864832 - DNA, 61 bp, Homo sapiens
gctgctgttttcgagctttaaatgtgggttctttggcattagctttatttgaaataggagt

SEQ ID NO: 6864833 - DNA, 84 bp, Homo sapiens
taacatcctatctgttatttacccatctctgtgaaactgattatgagatttttcccaggtgactagcaggaagcaggtctgtta

SEQ ID NO: 6864834 - DNA, 67 bp, Homo sapiens
ggcaggtggcagggtgctcatcatgcacctcctctttgtgagtgcaagactatgaccctcccttgcc

SEQ ID NO: 6864835 - DNA, 80 bp, Homo sapiens
ctggtttgaggtttggattccatgctctccggggttcctgccagtcctggttgtgtgagggtccatcactgtagaatcag

SEQ ID NO: 6864836 - DNA, 101 bp, Homo sapiens
gggcatttgtttggtgtctcacgttgatgcaaatgcagccattgcagagtgagccccgctctgttactggatctccatttgctcaaaagagagcagtgtcc

SEQ ID NO: 6864837 - DNA, 64 bp, Homo sapiens
ccatcagcctggaaggcagcctggagagtgacggaattccacaggctgtggaccagctggatgg

SEQ ID NO: 6864838 - DNA, 60 bp, Homo sapiens
gcatgtatgctgatcaatctggggacataattttcatgataggctggttagtgtatctgt

SEQ ID NO: 6864839 - DNA, 59 bp, Homo sapiens
catgccaacaacaagcaatgagcacaaaggctgtgcgaaatgctgcatttgttggagtg

SEQ ID NO: 6864840 - DNA, 76 bp, Homo sapiens
tgtctgcattaggatatttgtaaagattttgaggttagtacatgttgtcaatttttttgtaaattttccacagaca

SEQ ID NO: 6864841 - DNA, 71 bp, Homo sapiens
agacaggatgacccttgtggcagaaaacagtttcagggagattgactctgaactgaagggtaaagatgttt

SEQ ID NO: 6864842 - DNA, 62 bp, Homo sapiens
ttgcaacctgtacttactaaatcctggtggaaaccacagtttggttgctacagtaaatgcaa

SEQ ID NO: 6864843 - DNA, 56 bp, Homo sapiens
actctgtgcctagctcagtatacctgaagaatgtaagctgggagggagcccagagt

SEQ ID NO: 6864844 - DNA, 98 bp, Homo sapiens
gtactttgggttaatttgcctggtttctccatgtctcattcttctcagttgtaaaatgtggatgacacttgtgagaaatcaaatgaaataactggtac

SEQ ID NO: 6864845 - DNA, 67 bp, Homo sapiens
caagtgggtgggtccgcttggttccggtggctttgtgcctgccagagaaaagtggatcttgaatttg

SEQ ID NO: 6864846 - DNA, 92 bp, Homo sapiens
acaacttgctaaagtaggtattattatttttcccggttttattgataaataaattgaggcacagagaagtaaagtatcatgcctaatgttgt

SEQ ID NO: 6864847 - DNA, 104 bp, Homo sapiens
gcataaatgaaaatggaagctgtagcagaatcagtgctacagagcactaaagagactgtgaagcatagattctgtagagatgcactttcgtttcatactttagc

SEQ ID NO: 6864848 - DNA, 70 bp, Homo sapiens
gggctggcgaagcagctgggaagaagtggctgtctgccactagctgtgacagctgcgtgttgccgggtcc

SEQ ID NO: 6864849 - DNA, 67 bp, Homo sapiens
atttggtattcagttggatttggatatattaggattacctgtcagtcacagttcaactagttcagat

SEQ ID NO: 6864850 - DNA, 57 bp, Homo sapiens
tctatgtgccctttgtgtgatgtgcaaattgctcatatcatatatagagcatgtagg

SEQ ID NO: 6864851 - DNA, 57 bp, Homo sapiens
ttggtcactaaatatctgcagcatgttttatgacatgcaccagagcagggtgcccaa

SEQ ID NO: 6864852 - DNA, 62 bp, Homo sapiens
cctggagtttgtaggtcatcactagagcgcacctgctcacctggctgcctacatgctgcagg

SEQ ID NO: 6864853 - DNA, 71 bp, Homo sapiens
agtaatattagcttatcacacaagctgcaaatgccctagtgaaagcagctgtcggaaagctaagtgttgct

SEQ ID NO: 6864854 - DNA, 62 bp, Homo sapiens
aggatgataaaattatggcactttgaatggtgacagacactgaggtttcattttatcgctct

SEQ ID NO: 6864855 - DNA, 55 bp, Homo sapiens
gtacctatgtgtatgacagcatttgtctgagaatgctttcttataacctaggagc

SEQ ID NO: 6864856 - DNA, 64 bp, Homo sapiens
tttcagtagcttgccaaatgtcacactattacccagctagtaagtggctctgccaggactgaaa

SEQ ID NO: 6864857 - DNA, 95 bp, Homo sapiens
cagcctgcatctattttagagtgactattggatcagaattccaatgaatctgaaacagtagattcacaaattaaactttaatgctttgaggattg

SEQ ID NO: 6864858 - DNA, 65 bp, Homo sapiens
agccatgccttttgtaaaagctggatctcttattaagaagatcatagcacaaaagtgacagggct

SEQ ID NO: 6864859 - DNA, 96 bp, Homo sapiens
actgtttccgagaatgagactgtcaagtggcaggaattaagagttggatttgcagctcctctagatctgccacttgaattccattttggggggagt

SEQ ID NO: 6864860 - DNA, 79 bp, Homo sapiens
tgcatcctgagggcttacccagtaaagggcttgatcttatagacaagaccagggtgggtacgttccagtcagctgtgca

SEQ ID NO: 6864861 - DNA, 60 bp, Homo sapiens
ggtcagctcatcttttcatggggagccacaggttcaaaagaaaatacaatgagcttgacc

SEQ ID NO: 6864862 - DNA, 62 bp, Homo sapiens
agtatatcacatgtagtaatggcaaatactgttttgtaaaaactttgctatatgtatgttct

SEQ ID NO: 6864863 - DNA, 108 bp, Homo sapiens
cccagggacactctgttaaggctgtaagcaatgagataatcatgggagcagtgaagcttttatgtcacttatttcatgtgccagcgtgtggtgtagtaaacccatggg

SEQ ID NO: 6864864 - DNA, 76 bp, Homo sapiens
tacatcgttgcatatcttacctaaaaacaggctgaattgtgtttgtctcttagtcttatatgtaaaaggagatgta

SEQ ID NO: 6864865 - DNA, 65 bp, Homo sapiens
gctcagtttagcatttaccgtgatgcctggcataaatgaggtatctgttatgggctgaattgcgt

SEQ ID NO: 6864866 - DNA, 129 bp, Homo sapiens
ggtgccccctgccggatagattgcatctaacgttttcctgggttgatgaaagccctgggtgctttgaaactggctggctctccagattcaggagggatgtggatgtttttgtctgcctctgccttagcc

SEQ ID NO: 6864867 - DNA, 66 bp, Homo sapiens
ttgttaagtgctactgaaattgctttttatcatccaaataagaagcagttcacaagtaaaatgcaa

SEQ ID NO: 6864868 - DNA, 85 bp, Homo sapiens
ctgacagattgttaagctacgtgaggctaccagagtgggcagaggacagtcccctgtcccaggcctcatgttgccacatcagcag

SEQ ID NO: 6864869 - DNA, 69 bp, Homo sapiens
aggaggaaatgacagatgagaataatccatttatgagatggaaacatattctgatgtgcattcaatcct

SEQ ID NO: 6864870 - DNA, 97 bp, Homo sapiens
aaataagcaatagtaattttggatacagatataagattgaggaggttaaacatatctctttagtcctaaatttgaattgaaatctttatttttattt

SEQ ID NO: 6864871 - DNA, 55 bp, Homo sapiens
aaacaccagtcccagtatacactgtaaaggtgtgtgcagaacagggagtgggttt

SEQ ID NO: 6864872 - DNA, 81 bp, Homo sapiens
ctgccagggccagccaggccctacaaacgtgtgttctggaaagcaaggaggagtctgtcctggacctggctggctttgcag

SEQ ID NO: 6864873 - DNA, 85 bp, Homo sapiens
acctggcaatctgttagaaatgcagacactcagtccccaccccacacctactgaatctgaatctgcatgttgacaagatccaggt

SEQ ID NO: 6864874 - DNA, 65 bp, Homo sapiens
aaagtatgttgttctcagctacttgggactcctctctcaagagaagctgcaagagcaacatcttt

SEQ ID NO: 6864875 - DNA, 61 bp, Homo sapiens
catttgggcacagtgagttgcctttagtccagcttggttgtctcacttcctgcccaccatg

SEQ ID NO: 6864876 - DNA, 64 bp, Homo sapiens
ttcaaagcaaaaagccaaggtcctcttcagatggtggaaactctgaggtggctcttgctttgaa

SEQ ID NO: 6864877 - DNA, 66 bp, Homo sapiens
ccagatttaacatctcaatttcacttgtaaagatctaatagaaagtagattggatgttaagactgg

SEQ ID NO: 6864878 - DNA, 67 bp, Homo sapiens
atgttccttttcatagatttggatatgtgaattaacatatattcactcctggtgagactagcagcat

SEQ ID NO: 6864879 - DNA, 57 bp, Homo sapiens
cggcttcttcatcaggtcagcatgggtataattctgtctaccagttgactggagctg

SEQ ID NO: 6864880 - DNA, 77 bp, Homo sapiens
tggggtgtccatgtttgttgcatgtcccagggtatgtgcatgtggagtctgacatgtgagcaagcgtgcggcccctg

SEQ ID NO: 6864881 - DNA, 66 bp, Homo sapiens
ttcaagtaatgagcaatattttgggaaagattattctcttcctcatgaattctcgtatcgcttgaa

SEQ ID NO: 6864882 - DNA, 77 bp, Homo sapiens
cctgaatgctggaggcactctcgacaagggtgggtactgtctgggcccacacctgcttgggtgtgcctctgcatggg

SEQ ID NO: 6864883 - DNA, 79 bp, Homo sapiens
ccccgccccacaggaagctggagacccttgacctgtcctacaaccggctggtgcacgtgccccgcttcctgccgcgggg

SEQ ID NO: 6864884 - DNA, 65 bp, Homo sapiens
cactaggctggagtgcagtggctccatctcagctcactgcaacctccgcctcccgggttcaagtg

SEQ ID NO: 6864885 - DNA, 58 bp, Homo sapiens
cttagaacactgagaaagtgatgaggatattctttttctaagagctcagtgttttaag

SEQ ID NO: 6864886 - DNA, 59 bp, Homo sapiens
tttatattgtaaaaatggttctgatgtctcctggcagcaatgcagaactacaatgtaaa

SEQ ID NO: 6864887 - DNA, 55 bp, Homo sapiens
gatggtgatggccctaagctgagatttttttgagttctagggtttggttatcatc

SEQ ID NO: 6864888 - DNA, 72 bp, Homo sapiens
ggtttacaaagcagttatagtatcttatttttcctcaagagccttgtgaggtaagagctattattgcaaacc

SEQ ID NO: 6864889 - DNA, 75 bp, Homo sapiens
gttggggaaaggcttgactagaagggagagtcacaagtgagttttctgggttggtgtcactgcctgcaccctgac

SEQ ID NO: 6864890 - DNA, 57 bp, Homo sapiens
cgccctgatccgccctccaccttcctctcctccaggttctgggccggagaaggggcg

SEQ ID NO: 6864891 - DNA, 82 bp, Homo sapiens
tgttcagcagcctttacacatgatttcagtttcaacaaggaagttaagcaaaagtcgagtgtgagcattgtggctttggaca

SEQ ID NO: 6864892 - DNA, 80 bp, Homo sapiens
agaggaatagacctttggtgccagccattaacttggaaacagaaaaggaaggtcattggtaccagctgtgtgttcacttt

SEQ ID NO: 6864893 - DNA, 76 bp, Homo sapiens
gttttagggcagcagctctcaaagtggtctggattctcctgtgagtcccaagatcctctcaggcgctgcataaggc

SEQ ID NO: 6864894 - DNA, 69 bp, Homo sapiens
ccgggcggtgcagggctcactcggctggcgtcccgggggatgggccaccaggagtctccgctggcccgg

SEQ ID NO: 6864895 - DNA, 90 bp, Homo sapiens
aatagaaatgggcagaaatgtaatgaaatggtacaactgtgattgctattattatgttttaatttttcgttcatggctttccaaactgtt

SEQ ID NO: 6864896 - DNA, 88 bp, Homo sapiens
gcaaggagataaggacagtatttgttacagcattagctgcttccatgttttggctggcttgtaataggaatttcacttgtttctttgt

SEQ ID NO: 6864897 - DNA, 89 bp, Homo sapiens
ccttagtctggtttaaaatgtgttttcactgaagattctctagcaaactagtagcatgtttaaagcagcatttgataacaagaaaaagg

SEQ ID NO: 6864898 - DNA, 87 bp, Homo sapiens
tttagcttagtcttggtcatttagcatttctctgcctaggtgctttttcacaaggacttcagaaaatgttgaatgtttctagttaaa

SEQ ID NO: 6864899 - DNA, 59 bp, Homo sapiens
gggtgattcacccagtttcattgtttaaaaagatgaaataacttttgggtgagttattt

SEQ ID NO: 6864900 - DNA, 56 bp, Homo sapiens
tgtggagaaggaacagcgagggaacaccagccctctacagccttccttcctccaca

SEQ ID NO: 6864901 - DNA, 64 bp, Homo sapiens
acggatatctgtgcgtatagcattgtactttatcaggtatgtacatatgtgtatatgtatctgt

SEQ ID NO: 6864902 - DNA, 61 bp, Homo sapiens
aggtagatatgctgctgctgtagtgaagttttaaatggacaagcagcccagtgctctgcct

SEQ ID NO: 6864903 - DNA, 58 bp, Homo sapiens
gtgagggatctgcttcccctctaactcacatggtttttgggaggcattggtccctcac

SEQ ID NO: 6864904 - DNA, 72 bp, Homo sapiens
tatgacacgcttagcagagtgacctgcgaccagtggggggtcaggacataaggtcattgttaagtcaccata

SEQ ID NO: 6864905 - DNA, 108 bp, Homo sapiens
tcactcgaacccaggaggcggaggttgcagtaagccgagattgcgctattgaactccagcctgggcgacagagcaagactccgtctccaaaaaacggaagagaagaga

SEQ ID NO: 6864906 - DNA, 81 bp, Homo sapiens
cttcctcggactgtgttcagcaccttaggtgaagaatcaatcgttctaaatcacagaaaagctgagcatcagatggagaag

SEQ ID NO: 6864907 - DNA, 77 bp, Homo sapiens
gtttaggttgttaaggaggccaataagaatacttaagtgcacactgaagttgtccttggctctttgataaatacaac

SEQ ID NO: 6864908 - DNA, 88 bp, Homo sapiens
ggacaggcacacgcaggctcttggtaaatgcgcggtgaattaaattgaactggatcatggtataaagagtctatctggtggcaagtcc

SEQ ID NO: 6864909 - DNA, 90 bp, Homo sapiens
cttccctgcgacccagagcatcactgtcctctccccgccaggaaaggggtgcggggtggggagaggggaggagtgggtcttggaggggag

SEQ ID NO: 6864910 - DNA, 55 bp, Homo sapiens
gggtctgagtctccgtgccaggacatcctccctggacaggacccccttcggaccc

SEQ ID NO: 6864911 - DNA, 126 bp, Homo sapiens
tctggtgccaagcatgtgctggaaaagccaacaggaaatgaaagctagctaatttgtaaaattttctcatgacttttatttctcaatgtatgctttcatcgatctcgcagagttcttggggctgga

SEQ ID NO: 6864912 - DNA, 63 bp, Homo sapiens
ctgtgctgttatacttagctggttatctgtgcagaccacactttgaccatgtgataggtatag

SEQ ID NO: 6864913 - DNA, 86 bp, Homo sapiens
cattagattctcataaggagcgcgaaacctagatccctcacgtgcaccgttcacaataggccttgtgctcctatgagaatctaatg

SEQ ID NO: 6864914 - DNA, 76 bp, Homo sapiens
acaagtaagaagggagctgagctgtgagcagcattctggggtgctgttggtgctagtctctctgaatcctgctagt

SEQ ID NO: 6864915 - DNA, 95 bp, Homo sapiens
gtgtgcaatcctgggtccctgggccggggcatggacattgctcaccaggcagccttcccatgacccctggcatccagggtccccagggctgccac

SEQ ID NO: 6864916 - DNA, 59 bp, Homo sapiens
gaaggcttaatggttctttttctcatttcaggtcaaaggtgagttacaattgagtcttc

SEQ ID NO: 6864917 - DNA, 107 bp, Homo sapiens
ccagctcattctgaagggccagggggactggaccgtcctgggtgacctacagtggccaatgacagtctcagttctgccgtgatgcccttgtgcaaccttgagcctgg

SEQ ID NO: 6864918 - DNA, 118 bp, Homo sapiens
gagctcaggaatatggggaagagactagtgataatgtttatgcttttactcaataaagataaaattacattaatattattacctaagcaagtctgtttccatgttcaggaaatggttt

SEQ ID NO: 6864919 - DNA, 66 bp, Homo sapiens
tgactctccttgcatttccaggttaccttttggggaggaatgtggcaatcttcaagttatgggtca

SEQ ID NO: 6864920 - DNA, 77 bp, Homo sapiens
agtcttactctgtaccagtagtgcccagggacatttgtttttcagaattcttggaaacattactggacagtgaggtt

SEQ ID NO: 6864921 - DNA, 73 bp, Homo sapiens
agcaagagcggaaaggccctgggatgctcagcagtggttgtggtccctagtgtcctgagggctgtgacttgct

SEQ ID NO: 6864922 - DNA, 75 bp, Homo sapiens
agggcaaggccttggctctctgtgtgctgaggctcagcagtcagccaggacataagagagccagtctgaaaccct

SEQ ID NO: 6864923 - DNA, 63 bp, Homo sapiens
atcggtgggttttcacatttgggtctggactgtttgttcagcttcagtgtcaggcccgtggat

SEQ ID NO: 6864924 - DNA, 67 bp, Homo sapiens
gaatagggagagaacgtaatctagtattaaatgtgttttaatggtggatgtctgttctgacctattt

SEQ ID NO: 6864925 - DNA, 76 bp, Homo sapiens
tttttgaacaagctggggttgtgatgccatttataagtgtaataccatttcaaaacaacactcaggtgtaagaaaa

SEQ ID NO: 6864926 - DNA, 106 bp, Homo sapiens
catctaacattgcttggagtgtttatttttaagtgcatatttttgttgtagagggaaagattatgatctctaccaatttaaactgtactttccgagcatatggatg

SEQ ID NO: 6864927 - DNA, 78 bp, Homo sapiens
cgggccctcggctgcccaggccctgccttggcatgtgtgtctccagagcgtgcccggccaggccatcccagccgcctg

SEQ ID NO: 6864928 - DNA, 58 bp, Homo sapiens
cttcagcatttctgccttcacaatttctgcttagggatgaggataagtaaagctgaag

SEQ ID NO: 6864929 - DNA, 62 bp, Homo sapiens
caggggctgtgggcggagcctcctgtgatgatgactgttgggggctgtgcccctgccgcttg

SEQ ID NO: 6864930 - DNA, 85 bp, Homo sapiens
agccctcaagtcccttgaagagtctttctttcccccttcttcttagaagggctgaaacacactttaagttaacttaggaatggtt

SEQ ID NO: 6864931 - DNA, 62 bp, Homo sapiens
ttcccatccatatggtgacaaggtgctctctgggttaacctcaaaccatgttggataaggaa

SEQ ID NO: 6864932 - DNA, 109 bp, Homo sapiens
ggacatctcaccagcatagtgggaggcacagctctggaataatgatgtgatgaaattacaacagtcattttccctgggtccctctcataagcaaagctgttgaaatgct

SEQ ID NO: 6864933 - DNA, 72 bp, Homo sapiens
ctatattgtgtctaaatgaaaagagatgcctgcttatttttagaggtatttcttattttattttgacattag

SEQ ID NO: 6864934 - DNA, 66 bp, Homo sapiens
tttcccacactgtcagaacagaaggcccagcaagcccgcttgagcacctccctgacagtggggaaa

SEQ ID NO: 6864935 - DNA, 58 bp, Homo sapiens
agacttgagcagggctgggctcagatctctttcaggggccggtgtcatggcttggtct

SEQ ID NO: 6864936 - DNA, 77 bp, Homo sapiens
ccccagcacatgcacctgtagagaagcccccaggtgttgcagagagcccctgagggagggtataggctgtgctgggg

SEQ ID NO: 6864937 - DNA, 55 bp, Homo sapiens
ggctactttgtttaagttgccatgggaagacggtggcagctattacaaggaagtc

SEQ ID NO: 6864938 - DNA, 86 bp, Homo sapiens
ctattcacatttgcttcctttactatagctttgtttcagtgtcacatagcactggagttcatggtaaagtcagcaattcaccatgg

SEQ ID NO: 6864939 - DNA, 71 bp, Homo sapiens
tttgttgactgtataaaatctggaagtggagccctggtcagttgccagtattttatataatctgtagcaag

SEQ ID NO: 6864940 - DNA, 93 bp, Homo sapiens
gccctggctggcttcctgacaagccccaggcttgttctctcccctggaaaggatgtctgctgctgtgggctaaagtctgtgtcagtgcagggc

SEQ ID NO: 6864941 - DNA, 67 bp, Homo sapiens
atctttactttcagtgctgagccgtgattgttcagggacggctaaacctcagactgaaagtttagat

SEQ ID NO: 6864942 - DNA, 59 bp, Homo sapiens
ttctaaggtgtaggagaggtggaaactgtagaagctgctgccatccttatagctgagaa

SEQ ID NO: 6864943 - DNA, 71 bp, Homo sapiens
tgttaaggaagcctatgggaataggctgagaaatttacaagtactgccttgtctcaattgtttctttctca

SEQ ID NO: 6864944 - DNA, 57 bp, Homo sapiens
gctcccagtggtcttgaaacagggacactaaactgatccctctgctacactgggagc

SEQ ID NO: 6864945 - DNA, 59 bp, Homo sapiens
gtgggggcgggtgcaggcgggcagctcggggagccccagcctgtgacagccgtcctcac

SEQ ID NO: 6864946 - DNA, 60 bp, Homo sapiens
tccaaggaagtcatttaaactgaccatttagctcagtagatagcaaataacttcctggga

SEQ ID NO: 6864947 - DNA, 88 bp, Homo sapiens
ggtcacttttaatgtcttcttttgggttcagacatgattacagagaaatttgggttttgtcctgatccatcagtgagataaagtggcc

SEQ ID NO: 6864948 - DNA, 60 bp, Homo sapiens
tacataataaggggcatggtgtcaatatagttgaaatatctgttgtgcctcttatatgta

SEQ ID NO: 6864949 - DNA, 122 bp, Homo sapiens
caatgtgctggccatggagacctcagttaattctacagggaactctggagctgggatggccctccagagctgtcctactgtgagagagctgggcctttgcatcccccatcagccagtcattg

SEQ ID NO: 6864950 - DNA, 62 bp, Homo sapiens
aggtgattagcttgaaatccttgggtaaaacatcccacagatcaataatactgagttcacct

SEQ ID NO: 6864951 - DNA, 78 bp, Homo sapiens
gacacggtcaaggctataatgttgctggaaacatgactaaacccttacttctgagcatgaattatttttacccgtgtc

SEQ ID NO: 6864952 - DNA, 56 bp, Homo sapiens
acagataaatttataggagtgttctaaggaagtcactgcttcaggcatttatctgt

SEQ ID NO: 6864953 - DNA, 55 bp, Homo sapiens
cagaagtggcatcattcaagagctggaagaccggtataggaatcagtcacatctg

SEQ ID NO: 6864954 - DNA, 59 bp, Homo sapiens
ggagggagcaagtaaggtaagagcggtgacaaccgtagttaccaatggcttctctttcc

SEQ ID NO: 6864955 - DNA, 57 bp, Homo sapiens
agttgagttctttgtcattcacagacaaaagcgtcctgactgaaatagaatttagct

SEQ ID NO: 6864956 - DNA, 87 bp, Homo sapiens
ccaccatgggccaagccagaaggcatgtgtttattgtcgtcttggctcaagacactgttctcacatgcttggctccccatagactgg

SEQ ID NO: 6864957 - DNA, 58 bp, Homo sapiens
cagagtggcactctgctggatgctgtacatcagtcagaagagcagctgtgccacactg

SEQ ID NO: 6864958 - DNA, 61 bp, Homo sapiens
ggtgaggagattgagcttggtaggtaaactactaacacaatgtaccatatctccaaacacc

SEQ ID NO: 6864959 - DNA, 96 bp, Homo sapiens
tagcttcagtggccctagacacatttaaccttctaagggatgttcccttaagaatatcccttaggaggttaaatgtgtctagggccactgaagcta

SEQ ID NO: 6864960 - DNA, 58 bp, Homo sapiens
ttgggttgaagggcgcttccttggccctcctatgtctgctaagtgtcctcagacccag

SEQ ID NO: 6864961 - DNA, 75 bp, Homo sapiens
ggtaaggccatggcccctggggctgggccttctgaggaagctctggcctcctccaccagggaacatgcccaaacc

SEQ ID NO: 6864962 - DNA, 115 bp, Homo sapiens
tccttgttaagggattatttttaccacagacacctaatagatgaattcacataaacgcatgtttgttgcaggattatgtgtaggggtgaaaagcctaagtgtactatgacaggga

SEQ ID NO: 6864963 - DNA, 80 bp, Homo sapiens
ctggtggtttgaatctttgatctttattgctaagtgagtatgagcttggcaagttggagcaagtgagttcagagtagtgg

SEQ ID NO: 6864964 - DNA, 86 bp, Homo sapiens
tgtgtgtgtgtgtgtgtttgtgtgtcgagaagcagagcgaaagaggacagagcactgagttagtacgcaaacattattggcacaca

SEQ ID NO: 6864965 - DNA, 78 bp, Homo sapiens
ttggcatgtgtaacagtgagggcagggactgtgtctattttacatatctttgtcactctactgtctataccatgttgg

SEQ ID NO: 6864966 - DNA, 90 bp, Homo sapiens
tttatgtgtttatttgctcagaaagtatttaagtccatatttttttgtcgaaactggaaattgtgctttgttaagtgtaaacaacataaa

SEQ ID NO: 6864967 - DNA, 64 bp, Homo sapiens
tttcaggcctctaaagggaaagcattaagatcctagtcttggctttctccttataggcctgaaa

SEQ ID NO: 6864968 - DNA, 69 bp, Homo sapiens
tttcaatgatgctgaaggtagcgtgtcaaaatatggagtacactacacgaagttttaagctcattgaaa

SEQ ID NO: 6864969 - DNA, 75 bp, Homo sapiens
tgcttttctttgttgttatcacatcatgggactcttgcacaatgcatgatggctctccattaacaagggtgagca

SEQ ID NO: 6864970 - DNA, 92 bp, Homo sapiens
ctcccagagctctgagctgccctccttggcctcccagggtggagattagaagacccttggggtgttggaggcagcccagtaggctgtggcag

SEQ ID NO: 6864971 - DNA, 63 bp, Homo sapiens
gtctaccactgcctccctgtccaagaaatgactgttgggaggggaagtggcagtgagtgaggc

SEQ ID NO: 6864972 - DNA, 63 bp, Homo sapiens
tttagcactaatcagctgtggctcaattaccaaatttcttggcccagaaaggaagtgcctaga

SEQ ID NO: 6864973 - DNA, 64 bp, Homo sapiens
tcagtttctgccaggatgtgttaaaattacttctaaaattttcacattcttttcagagacatgg

SEQ ID NO: 6864974 - DNA, 70 bp, Homo sapiens
cttgaacccaggaagtggaggttgcagtgagctgggattgcaccactgcactccagcctgggtgacagag

SEQ ID NO: 6864975 - DNA, 82 bp, Homo sapiens
cccccctgcttcctccttatttgggaccacctggtggccagcagaagaccaggggatctgatttaggatgggagccggaggg

SEQ ID NO: 6864976 - DNA, 86 bp, Homo sapiens
tattttttacttggcattttcttggaaacttcaaacatgtgcaaaacacatgtatcatgcagggtccatgaattagctggaaaata

SEQ ID NO: 6864977 - DNA, 63 bp, Homo sapiens
atcaaagtagtaggttttggactcataaagacctgggttccttcccaaatctactcctttgat

SEQ ID NO: 6864978 - DNA, 64 bp, Homo sapiens
cctttccttccatgttgggcaaaatgacaggtagtgtacatatttgatctgaaggagggagagg

SEQ ID NO: 6864979 - DNA, 65 bp, Homo sapiens
tggagacaggtctgtgaaccggaggttagtagatgggctctccaggtatgacatggctgtttcca

SEQ ID NO: 6864980 - DNA, 63 bp, Homo sapiens
gggtcatgctgctgtgttggagagggactggaaaaacactcgtgttcctacactgtaggatcc

SEQ ID NO: 6864981 - DNA, 116 bp, Homo sapiens
cattttggtggtcacaactggttggaaggtgctactgtcatttagtgggtggagccaacagatgctgctaaacaatgtacagtgtataggacaggacagttttccacaataaaatg

SEQ ID NO: 6864982 - DNA, 80 bp, Homo sapiens
ctggagtcttaggaaatctagcttagtcttggatatgtaatttggttacatgactttggttaagcttttccatgctctag

SEQ ID NO: 6864983 - DNA, 100 bp, Homo sapiens
cctcgtctactgcttcttaaaaatgtgtttatgcatttcgtatttgtacgtccttgagttaatgagcgttatacattttgtgggaagtagtactatgagg

SEQ ID NO: 6864984 - DNA, 55 bp, Homo sapiens
tttctctgttctctaactgtaatatattttaattacagatggaggaacagataga

SEQ ID NO: 6864985 - DNA, 61 bp, Homo sapiens
tctgcatcgaagggcttttggtttagcgcttcagagcacagccgggagccgttcggccaga

SEQ ID NO: 6864986 - DNA, 73 bp, Homo sapiens
ctaggctttcctagcacaatctgaggtcacccgagatgcggtttcagatggaggtttaggacagtgagcctgg

SEQ ID NO: 6864987 - DNA, 75 bp, Homo sapiens
ggttaccttaacgatgtcatgaatacttcatgaaatatgatgtttctaattttctgagattgttaggcactaact

SEQ ID NO: 6864988 - DNA, 57 bp, Homo sapiens
gggcttggtggagagaatgctgtgatcatgcgtcaaaaaattctaatcatctggtct

SEQ ID NO: 6864989 - DNA, 64 bp, Homo sapiens
gctgcttagaaccatatttaaagttatcccattacggaagagaaggaggtgtgtttctaggagc

SEQ ID NO: 6864990 - DNA, 74 bp, Homo sapiens
ggcttctgcctttctcccttctggaaggcactgaaggtttggctcagttcagaggcaggagaaggcttggagct

SEQ ID NO: 6864991 - DNA, 81 bp, Homo sapiens
ggatagagttgtcgtgaaagtttaatgaaattgcatgcaccccagcatgtaacagtagttactattcttacagctgtattt

SEQ ID NO: 6864992 - DNA, 72 bp, Homo sapiens
ctccagagcagtgtttgtgactttagattgtttacttttttgataacaatctgtgtaaaaaagcctatggag

SEQ ID NO: 6864993 - DNA, 69 bp, Homo sapiens
acacatgctcattggcactgttcctggtacagagctgtgcccagttggaggggccattttgagcagtgt

SEQ ID NO: 6864994 - DNA, 60 bp, Homo sapiens
tgaaacatgtatatattgtaggatggctaaatctagctaattcacatatacattgcttca

SEQ ID NO: 6864995 - DNA, 56 bp, Homo sapiens
gtggaggaggacttagacccatgtaaggcagggatttaaaatttagacctctccac

SEQ ID NO: 6864996 - DNA, 82 bp, Homo sapiens
aagattcaacactaggtagacatctaatgaagctgggttgccatcaatcagttcaaacaggtgtctggaatagctgtgtctt

SEQ ID NO: 6864997 - DNA, 57 bp, Homo sapiens
ctgggctgagctgtggaaactcccctgaaggggaatgcttcccacagcccagcccag

SEQ ID NO: 6864998 - DNA, 77 bp, Homo sapiens
tagatttctacctgcattttggctaaggttccattgaagacaacagaaaccatgcaagctgctagagcagagattta

SEQ ID NO: 6864999 - DNA, 107 bp, Homo sapiens
ggctctggattaattccctctggcagatgcatgacttttccctgcctttcttttgcatctcggaagcagggctccatttcactgccaggatggattttgccattgcc

SEQ ID NO: 6865000 - DNA, 129 bp, Homo sapiens
gtgactgttgcaatggactttagcgcctggcaggaagtgcctggctcacctccgctccagcaactgtggctgccactgctgatggaggaatgagagacacaacccacggccaggtttcagcacaggctc

SEQ ID NO: 6865001 - DNA, 76 bp, Homo sapiens
tgtatgcatctcctggagcacagggagcttgtcctgttctctgggggctgccctgtggtccagcaggtgcctgaca

SEQ ID NO: 6865002 - DNA, 58 bp, Homo sapiens
ctccagtgagcgcggggcatggtcttgccacttgcactgagccctggctcgcctggag

SEQ ID NO: 6865003 - DNA, 80 bp, Homo sapiens
gtgactggttgaaaccattaagtccccaagtctttgttgtgctgtcctcagcatggtggatttgtgattcagcttagcac

SEQ ID NO: 6865004 - DNA, 63 bp, Homo sapiens
gccttgggacggaggggtcacctggatgtcctgggcttcttgggccctccgtcctaaacaagc

SEQ ID NO: 6865005 - DNA, 77 bp, Homo sapiens
gtcctagcacccagggttggtggcttggaggcccagaagacatccctttgccctccccatgacccggtgctgggtgc

SEQ ID NO: 6865006 - DNA, 63 bp, Homo sapiens
ggctggcatttacacaatgcatttacctcttaaattccatgtgcgtggtgtttctcatcagcc

SEQ ID NO: 6865007 - DNA, 61 bp, Homo sapiens
gcgaggccagagttaaggagaacagctaggaaagagttgcagtcactaatgtggcactcgt

SEQ ID NO: 6865008 - DNA, 59 bp, Homo sapiens
gactgaaggtctaattcctgagtttgatcttcctggctttcaaggaaaggcctcatgtc

SEQ ID NO: 6865009 - DNA, 69 bp, Homo sapiens
gcatcctgtctgggcttgagtatttactatgtagtaggtgagtgaaaaaagcctgagatacttggaagt

SEQ ID NO: 6865010 - DNA, 61 bp, Homo sapiens
tggttcagtatgttacaaatgaggacgttatagcctaataatatcactacatgctggagca

SEQ ID NO: 6865011 - DNA, 127 bp, Homo sapiens
tcagacgtgaggcttccttcctgggttctttctggctgcgctagtccagaagaccagcaaacccgagatggtctgaggtggacgatggagcctgaatggagagcctggggcgtgagccagggtctgg

SEQ ID NO: 6865012 - DNA, 61 bp, Homo sapiens
gcagctggagccagccagacaccggccaagaggtggtcttggctacaagtccagtgcctgc

SEQ ID NO: 6865013 - DNA, 65 bp, Homo sapiens
cagaagtagaatctcaggtaggctatgggtaaacttggtaggctagctggcattctacattgctg

SEQ ID NO: 6865014 - DNA, 117 bp, Homo sapiens
gcaattcacattcactgcattcatagcccaaaagatcaaatatattatgccacagtccaagtgttcattgtaattgtgtgcacatgtatgggtgtgtgtgtgtgtgtgtgtgtgtgt

SEQ ID NO: 6865015 - DNA, 84 bp, Homo sapiens
cgcatctgcccctgggctggtctggcttagtcaggagggcagcccttggcccagggcacagacacatgcctgggaaggaaagcg

SEQ ID NO: 6865016 - DNA, 65 bp, Homo sapiens
tcctgcagagtcccactgatttgggccaacagtgctgtatttgcctatccttgggaaattcaggg

SEQ ID NO: 6865017 - DNA, 58 bp, Homo sapiens
ggaatgttctggtctggttcatcttggagccttggagctcatggggaccaagcattcc

SEQ ID NO: 6865018 - DNA, 63 bp, Homo sapiens
ccctcagccctctcatccccttgcccctttctgtggggtccagaatgagaatgggctccaggg

SEQ ID NO: 6865019 - DNA, 80 bp, Homo sapiens
gctccaacacagctattctttgtgtctgtccagatgagctgtccagatgagctgcacaaacacagagaatagatggcagc

SEQ ID NO: 6865020 - DNA, 59 bp, Homo sapiens
ggagaagataattttagttgttggtggccttaacttatggagaactcagtatcttttct

SEQ ID NO: 6865021 - DNA, 61 bp, Homo sapiens
gcacagagacaggagtgctcccagtgccaaaaggagaactggcttctgcttctgctcctgc

SEQ ID NO: 6865022 - DNA, 83 bp, Homo sapiens
cagggtagagatgaacagacacccgcatggctggctggctgcctctgaatccacccacctgctggttttgctctcctgctgtg

SEQ ID NO: 6865023 - DNA, 71 bp, Homo sapiens
ccagtgcccttcggtgtcactgaagctcagcccgcggacggcggtgtgtcagtgtgcaccgggaggcctgg

SEQ ID NO: 6865024 - DNA, 115 bp, Homo sapiens
gtggatttgggtctatgtcgtactacctcaaaacgtctccagtctctggctgtttgtgacttcccaggagctcatgaaaatagatcagaaattgtagaacattagactgagccac

SEQ ID NO: 6865025 - DNA, 100 bp, Homo sapiens
cactgtgtcaatagagaccatgtggggggcagaaacttctatgtctaattggcagtaacaagaagttctctccaccttgggtgttaatgaaagccaagtg

SEQ ID NO: 6865026 - DNA, 60 bp, Homo sapiens
gacagctttgaagagtgcaggtgagttattttacagaatgtgccttcctctgagcttgtc

SEQ ID NO: 6865027 - DNA, 82 bp, Homo sapiens
tgtgcgaagtctgtgatcattcttgatttaagtcggcagagttcgatttgataaacactaactgaacactcactgtgcaaca

SEQ ID NO: 6865028 - DNA, 80 bp, Homo sapiens
tcagcgtgccaggaagtggctgggctgggttggtggtctatcttacgcccaggctcgctccgtcacttccacatcgctga

SEQ ID NO: 6865029 - DNA, 93 bp, Homo sapiens
aggttctgtgattagctatgtgatttaaacaaggttggataagtttcttactgttgtaatacttagatcactgaatagtcttgttgagaatct

SEQ ID NO: 6865030 - DNA, 92 bp, Homo sapiens
ggtggctctttgccctgtctcactatgttaagtgaccaccaattactgtctgcacttaacacaggaggcaaggtaacctggagagcaccacc

SEQ ID NO: 6865031 - DNA, 63 bp, Homo sapiens
gggagttgtggttggcttctggaaggtgctccaggacggcatagatggcagccagctgctcct

SEQ ID NO: 6865032 - DNA, 76 bp, Homo sapiens
gggcatctgggagctagattcaataaagctgttctgaccatgaacttggaactggcccctttcattctggaagccc

SEQ ID NO: 6865033 - DNA, 89 bp, Homo sapiens
gaagatagtcaaagtgtatcagaagataaagctttttgtttcatttggaattaaaagtctataccttctgccgactatggctcacattc

SEQ ID NO: 6865034 - DNA, 75 bp, Homo sapiens
tttccttgtcaggcatttgaagcacttacaaaaattaaatgtatttataagtgtagtttcaaatgtttaaggaaa

SEQ ID NO: 6865035 - DNA, 58 bp, Homo sapiens
cccatttgtatagagccttatagtcacagtaaggactctgggctttactccaagtggg

SEQ ID NO: 6865036 - DNA, 60 bp, Homo sapiens
atgtctccatgcggtaatttatctaaaggcccgctataaattgtcgtaaggtggagatgt

SEQ ID NO: 6865037 - DNA, 86 bp, Homo sapiens
ataagggacttgagcatctgaggattttcctctgggagaaggaggtatcctggaggcaatcccctgaggatacttttctactttgt

SEQ ID NO: 6865038 - DNA, 55 bp, Homo sapiens
cggctcccgcgcgccgcctcgcgctcctccccagcccggctgtgcgtggaggctg

SEQ ID NO: 6865039 - DNA, 80 bp, Homo sapiens
tgttttattcatgtgagtgaaaggacagaaaattgtacttaatactgcacagatctgtcaccattcagcttgaattgata

SEQ ID NO: 6865040 - DNA, 77 bp, Homo sapiens
gcagtagggaattagaggcagtgaatggccaggttttttttaagagcctcatgctgcatctctgaggtcctatctgc

SEQ ID NO: 6865041 - DNA, 60 bp, Homo sapiens
cccatgtgtctcccctggaagtagaagtagaagctcttatgggaagcagaggcacgtggg

SEQ ID NO: 6865042 - DNA, 76 bp, Homo sapiens
ggttttatttgtggtacgtgagaactgggaaatatggaactctatttaacagatgctatgtctacctatacaaact

SEQ ID NO: 6865043 - DNA, 90 bp, Homo sapiens
caccttagattcctcattcactttgaaataaacgacttcaaaaagactgaatttggttaacctgcaaatgtgagtgacagtgtcaaggtg

SEQ ID NO: 6865044 - DNA, 96 bp, Homo sapiens
gcttaacatttgtttcttttgagtgtttttggttgcgtaattttaaaagttgggaatgctatagaaatatttaaattctattagaatgtccaaggc

SEQ ID NO: 6865045 - DNA, 72 bp, Homo sapiens
gtcattttatcagcacacgtcactagcttctcaagtgagactactctgaagtgatctgtgtttgaagaatgc

SEQ ID NO: 6865046 - DNA, 66 bp, Homo sapiens
catctagagaatgtcagtgatcaggtgtccactccatcatgtggctcagaggtttttctctggatg

SEQ ID NO: 6865047 - DNA, 88 bp, Homo sapiens
tcacttgggggcttgttagagatgcagagtctcaggccccaccccagacctgaatcacacactgcatttcaacaaggcccacaggtga

SEQ ID NO: 6865048 - DNA, 72 bp, Homo sapiens
tgattttcagcctgaattattgttagtatgtttaatacgtgtaaataggctaagagcatttgctgaagaaca

SEQ ID NO: 6865049 - DNA, 61 bp, Homo sapiens
gcccaagagagcgaaggttggcatgcagttccaactgcctttccactttgcttctctgggt

SEQ ID NO: 6865050 - DNA, 55 bp, Homo sapiens
cagatagcaaatgggtaagctaggactaacacctagtggtcttattgctgatctg

SEQ ID NO: 6865051 - DNA, 61 bp, Homo sapiens
ccatggagattaagaaaaaattgcagatctagaaacaatatgtgcaagggtggtctcctgg

SEQ ID NO: 6865052 - DNA, 57 bp, Homo sapiens
agaattgttctgtagcttggctgagacacaatcacactctgggctggagaacattct

SEQ ID NO: 6865053 - DNA, 118 bp, Homo sapiens
gcctgaagccggcccagttcttggctcagagctactgcgtctgcagcacagatctgtccctgagcacagctcgcaccagcttccctgcaggcctagagcccaagccctggcctcaggc

SEQ ID NO: 6865054 - DNA, 63 bp, Homo sapiens
atgctacactatttgctgagcaaggtataacttgctttgagtcagaggtaagagatgaagcat

SEQ ID NO: 6865055 - DNA, 81 bp, Homo sapiens
gtttcagcaaaacgggattgactgcgctttattgtttgtatttgcagttttaattgaagccagtcaatgttaagttataat

SEQ ID NO: 6865056 - DNA, 126 bp, Homo sapiens
atgtgccttaatcgttatattctttacattgtacatcagtcttttgcatacatattcgtattccccgcaagaatatgtgttgctagggagttggtgtctatgcctggtttagctttttgtccgcat

SEQ ID NO: 6865057 - DNA, 64 bp, Homo sapiens
tggagggttccaaatgtgaagtttctgttttcctctccatggagttagtatgcattaccctcca

SEQ ID NO: 6865058 - DNA, 56 bp, Homo sapiens
ccctggacaggaggccgtttccagcttccctggagcatggcagtccgtgttcaggg

SEQ ID NO: 6865059 - DNA, 83 bp, Homo sapiens
tttggatgactcttgcactgttctttccaaattccccaggtgtgaaaatttgagggattttaaatgaacaagtatcagccaaa

SEQ ID NO: 6865060 - DNA, 72 bp, Homo sapiens
tctctccttttctgttcaacatacttgtggccactttcccattagttaaagtctgaaatagagaaagaaaga

SEQ ID NO: 6865061 - DNA, 71 bp, Homo sapiens
gccactgtcctgtgcctgtgcttccagcacaaaatagacatgggccaaggacagggaacaggacaggaggc

SEQ ID NO: 6865062 - DNA, 57 bp, Homo sapiens
acatgttaaacatcatggaatgaagtcataaaactcagactgtggattttgacatgt

SEQ ID NO: 6865063 - DNA, 74 bp, Homo sapiens
tgatgctatcaactcatttgtttggctcagttgagcaaatattaactgagggccaaaggcactgagtaggcaca

SEQ ID NO: 6865064 - DNA, 72 bp, Homo sapiens
tatgatgtttagcttcacttttgttgatgcggtcacacagattttgcacagagggaggcataaaattttata

SEQ ID NO: 6865065 - DNA, 57 bp, Homo sapiens
tggtgagcgatgctgcatgttcctcccccaccagggtgcatcaaggtacgctctcca

SEQ ID NO: 6865066 - DNA, 67 bp, Homo sapiens
gaggtactttctggttcaggtgtcttttttgtatcaagggtaacttggaatcccagtagagcatctt

SEQ ID NO: 6865067 - DNA, 64 bp, Homo sapiens
gtgccaggcacaggaagcagcccccgagacacgttttcgctggaggtttctctgggcttggcat

SEQ ID NO: 6865068 - DNA, 59 bp, Homo sapiens
ctgttgaatttctcgtgtgttcctgggacccattaggaatgtaaatctagattttacag

SEQ ID NO: 6865069 - DNA, 67 bp, Homo sapiens
tgagtcttcagcatagcatatggctaagagatccagttcagagccagattgcctgctttggaactta

SEQ ID NO: 6865070 - DNA, 64 bp, Homo sapiens
gactgacaaacagcagggacttgaatggaagatgcttcttgttttgcccaagttgtattcggtc

SEQ ID NO: 6865071 - DNA, 65 bp, Homo sapiens
gcagtgggaggataaactccctcagcctcttacagtaggagctggagaattcttccttccactgt

SEQ ID NO: 6865072 - DNA, 97 bp, Homo sapiens
agtcatccttacatcagctggtatttgttagggagttgtcaggtgcaacttgcaaaaacatcttgtcaaatgtccacagctttcctgtgaggtgact

SEQ ID NO: 6865073 - DNA, 82 bp, Homo sapiens
gggttgtgggaggaatgaatgggcctagctagtgacttgaaatggcaaccagtctctgcctgcttcctagccttccaagccc

SEQ ID NO: 6865074 - DNA, 71 bp, Homo sapiens
tttcttctaagttggccctgctgggcgccatgcaaaagacacacaagccctagggcaggcattggaagaga

SEQ ID NO: 6865075 - DNA, 56 bp, Homo sapiens
taaaggagtgggaacaatgacatggtcaaagtgagaccattcttcctactcttcta

SEQ ID NO: 6865076 - DNA, 84 bp, Homo sapiens
gcacaatgcctagcacatggtcatcacttgataaatagcagctgctattattatgttaactggactgattttaggcagctgtgt

SEQ ID NO: 6865077 - DNA, 60 bp, Homo sapiens
ttcgacaggagctggagaagctcaggaaatgaatcacagatgtctccacttctgtgagaa

SEQ ID NO: 6865078 - DNA, 76 bp, Homo sapiens
tctcacctcagtgtgtgctgactcacacccatgccaggagagcagcttgggcagtgagcagcaccatgaggctaga

SEQ ID NO: 6865079 - DNA, 88 bp, Homo sapiens
aaatgctctttgtgtagactgggattctccctgatcaatgaagcagattgaaccagggaaccattcttgtcacatatgaagaaagttt

SEQ ID NO: 6865080 - DNA, 70 bp, Homo sapiens
gtgattacctgtgggtgggttggtttgagagggcttctcagagaatcaggacccactctacagttaacac

SEQ ID NO: 6865081 - DNA, 58 bp, Homo sapiens
agtgaattctccacccagtaggaaagaagagactgtctgtcttactggagaatccatt

SEQ ID NO: 6865082 - DNA, 55 bp, Homo sapiens
agacctttgctgcttcttatagttcctagttactataaacctagttgcataggct

SEQ ID NO: 6865083 - DNA, 64 bp, Homo sapiens
gacctggaatgaagggtccctcatctttctgtagagggaaaagcatgttcctgcattgaaggtc

SEQ ID NO: 6865084 - DNA, 76 bp, Homo sapiens
agtacggactacagcagctcttcacttactcctttccagggtaagggaaaggagaggcagagagcttagagaaact

SEQ ID NO: 6865085 - DNA, 118 bp, Homo sapiens
gcctttactaccactacatgcactcacttgttttctcagcactattagcctccactgacctcaaagggaagcatgtgtataagctgggcaggaggtaggcatgggccgtgttaaaggc

SEQ ID NO: 6865086 - DNA, 72 bp, Homo sapiens
gccatcctcagccagaaagtctgttagggagatagtcttccccttcttattcttctttttcgctgaggcagc

SEQ ID NO: 6865087 - DNA, 76 bp, Homo sapiens
tcacagggcagtcagttttaccaatctcagtgaagtggcacatcactgataggtgaactaaaattgattcttgtga

SEQ ID NO: 6865088 - DNA, 64 bp, Homo sapiens
gtgtaattttgtggtcctgtacttcagaagcctggagtccaaatttagatcagaaaatatatac

SEQ ID NO: 6865089 - DNA, 79 bp, Homo sapiens
gctgccaattcatgacacttctgaaacggaagttgtgattttaaaataactttctggaagccttgtcctaattggtagc

SEQ ID NO: 6865090 - DNA, 78 bp, Homo sapiens
gtagctggcacatagcaggtactcagttattgatgcatcatgtcccctttactgccttatatgctgtgtgtgagtagc

SEQ ID NO: 6865091 - DNA, 55 bp, Homo sapiens
ggtcacgggctgcggtgggggcgcgaggctcccggcgcccagtgcggttctgacc

SEQ ID NO: 6865092 - DNA, 68 bp, Homo sapiens
tgtatttagtcatggaatttccagaaccactggagtttagggaagaagcccatggccagtgagtcaca

SEQ ID NO: 6865093 - DNA, 55 bp, Homo sapiens
gctctgcaggtgaggcacttggctttctggaccccgagatcctcatctgtaaagt

SEQ ID NO: 6865094 - DNA, 67 bp, Homo sapiens
tctataggtcactcagtgagtcaacgactgagctatgattaacgttgacagctggtgagctgctagg

SEQ ID NO: 6865095 - DNA, 77 bp, Homo sapiens
tcacttgaacccgggaggaggaagttgcagtgagccaagatcgcgccattgcactccagcctgggcaacaagagtga

SEQ ID NO: 6865096 - DNA, 68 bp, Homo sapiens
atagatgagggaaaataaaattgcagtagattaagatttataggcaagtaattttctacctgatttgt

SEQ ID NO: 6865097 - DNA, 68 bp, Homo sapiens
tgctgaagtggcagccttagaaggagattaaactgatgccctaatcaaaggctgtgagcaacccagca

SEQ ID NO: 6865098 - DNA, 90 bp, Homo sapiens
ttatcatttcatttaatcctcacagcagctctgcgagatacatgactttatttatttatttttgctgtggtgattttaaaatgaggataa

SEQ ID NO: 6865099 - DNA, 66 bp, Homo sapiens
tggcagtgaaagacaattgggccagttgagattcacaactccagcctgaaaattttctttacgtca

SEQ ID NO: 6865100 - DNA, 58 bp, Homo sapiens
tgggaccttgaactctaagcaccgtatttccagtgtcccttttattgtcaaggttcca

SEQ ID NO: 6865101 - DNA, 62 bp, Homo sapiens
tgaagttatagaagatggagaagttccatatcagaaaaatgtcttcttcagcctatgcttca

SEQ ID NO: 6865102 - DNA, 58 bp, Homo sapiens
atttgattgcagttagttggatccccaagcttttaactacatttcactgcaattaagt

SEQ ID NO: 6865103 - DNA, 99 bp, Homo sapiens
gcccctcctgcttctcggtctgtgtgctttgggaagtgacttgtgggaagggagttctgagggtatttccaccagaggatcatagaagaaggaagaggc

SEQ ID NO: 6865104 - DNA, 56 bp, Homo sapiens
ccacgtgcatttgatacacataaaagtcatactgtgtgtgcacaaagagtacatgg

SEQ ID NO: 6865105 - DNA, 76 bp, Homo sapiens
caaaggaggcactgctgggcccctgtataagcactcgtaggcgttcaaagtgcagaggcccagcggttcttcattg

SEQ ID NO: 6865106 - DNA, 55 bp, Homo sapiens
cacatgtgtatatgtgagggggtggtctgggtgtctctataggtgtgtgtgtgtg

SEQ ID NO: 6865107 - DNA, 66 bp, Homo sapiens
tgttttgatttttccaaatacatttactgtatttgctgagtgcctactgtgtgtttggacaggata

SEQ ID NO: 6865108 - DNA, 87 bp, Homo sapiens
agatagattggaggtcttagaagaaaaatcatgtcagttgtgcaagtggacaaaacaatgatttcttcaaggtcctcatttttttct

SEQ ID NO: 6865109 - DNA, 65 bp, Homo sapiens
gcatggaataattgtttcacagaagagggaccttcttcagtcaggtaattgtttcattttattgc

SEQ ID NO: 6865110 - DNA, 72 bp, Homo sapiens
ttaaacaccacagcagtccctaaaacagaaaagattcccagagggggatatactgctgtcagtggtgtttag

SEQ ID NO: 6865111 - DNA, 55 bp, Homo sapiens
gtactttgttaccatagctccaggaaactaatggggaacaggactgacacagtgc

SEQ ID NO: 6865112 - DNA, 62 bp, Homo sapiens
ggggcctcagagaccagctagattttaaaataaggaaaaagctgggaattttctgaagcttt

SEQ ID NO: 6865113 - DNA, 103 bp, Homo sapiens
gccgtggagtggaaggtgaagcattctctgtagatggcttgagagatcaacaagggatatttgcattgcagtggtttacagggactgcttgctccaatttggc

SEQ ID NO: 6865114 - DNA, 59 bp, Homo sapiens
gttctggtcactagcagactcatttcattcaccccttggaatctgcccaggacttggac

SEQ ID NO: 6865115 - DNA, 89 bp, Homo sapiens
gtggaaactggaggcttttgttggtctttggtgttttcttaacaagagaacagcctcctagagaaacagcgaaagagccaggtttctgc

SEQ ID NO: 6865116 - DNA, 59 bp, Homo sapiens
tgtcagcagctgaggccttagatgagtcatagtcactgcaggagacacagctgctgcca

SEQ ID NO: 6865117 - DNA, 73 bp, Homo sapiens
gcaatttcggatgttgctgctgtagcaacagcgtacttagtgcttgtcacatacaggagcattccgaaattgt

SEQ ID NO: 6865118 - DNA, 60 bp, Homo sapiens
gttccaggctgctttattactctgttttggcctacagggaaacatttgggagcttaggac

SEQ ID NO: 6865119 - DNA, 64 bp, Homo sapiens
tcctgggacaccccaatatgaggtcagggagatgacaaggaacttcatgggtggaatgtcagga

SEQ ID NO: 6865120 - DNA, 78 bp, Homo sapiens
tctcattcagcagcacgggctgtttccatgcaaaaggggctccttagctgggtcaggggcctgggcctgctggataga

SEQ ID NO: 6865121 - DNA, 63 bp, Homo sapiens
catctgtttccagaatgtagctgctttgtatttgggagagctaactacctggaaatgtgactg

SEQ ID NO: 6865122 - DNA, 77 bp, Homo sapiens
tatgatattcctgggtagcctgtccaagatggcaactctcaaagcctacatctttgaatgcattgaggcatgtcata

SEQ ID NO: 6865123 - DNA, 88 bp, Homo sapiens
cctctactgctttagagtttacagtgtgcaatcccagaatattatagcagatattctttgaaagtctactatgtctaaggcagtgagg

SEQ ID NO: 6865124 - DNA, 90 bp, Homo sapiens
acaatgatttctaaacagaaccatgcatctgagtggtcaattattttataagaaggcactctgatggtttctgttcaataatcttcttgt

SEQ ID NO: 6865125 - DNA, 71 bp, Homo sapiens
ttagggtttctttttggatagctgatgaaacaaagttcctattgtttcatcctcaaaagagagggcccaga

SEQ ID NO: 6865126 - DNA, 56 bp, Homo sapiens
ttcctgaatcccaaggagagcttcagaaattgagccaggtctaaggacatcaggaa

SEQ ID NO: 6865127 - DNA, 72 bp, Homo sapiens
gatcaagtctgaggtttgtccatccttggtggcaggctagcttaaccatggattcacaaaccccatttgatt

SEQ ID NO: 6865128 - DNA, 81 bp, Homo sapiens
cctcttcccatttcttcctttctccttcaatgtatgccactcctaggcatcatgaagatgagaaagcatatgttaaagagg

SEQ ID NO: 6865129 - DNA, 63 bp, Homo sapiens
cagcaacaacaggactgtgaattgtttaacctctgtggttaaagctacagcttgagttgactg

SEQ ID NO: 6865130 - DNA, 59 bp, Homo sapiens
ggggagggacttggtctggggcccacagaaaggctggacaccagagtcatgtctccccc

SEQ ID NO: 6865131 - DNA, 58 bp, Homo sapiens
ccagggtcacaaataactgcagctccagcttcctgctgcagacatttgataactctgg

SEQ ID NO: 6865132 - DNA, 80 bp, Homo sapiens
tctaccatcaatgggcaatgcctggcccaactcagagccacaggtcctctggtcatgccaggtttgctgcagagaggaga

SEQ ID NO: 6865133 - DNA, 70 bp, Homo sapiens
gatttaacatgtcttgacttcatcttttctgtgggatgggaggcaaggtggagaatagataggttgggtt

SEQ ID NO: 6865134 - DNA, 58 bp, Homo sapiens
ttcaaatctctcctaatccactaatgaacctttattaaagtgggagagagaggttgaa

SEQ ID NO: 6865135 - DNA, 57 bp, Homo sapiens
ttggaagattgctgttctacagtttctcagtcagaagggctgtcagcagcttcacga

SEQ ID NO: 6865136 - DNA, 57 bp, Homo sapiens
ccgtgttcaccagatgcccctcgggcctgggctcccgggactctgtgatgagcatgg

SEQ ID NO: 6865137 - DNA, 55 bp, Homo sapiens
aaaggttttattctgagctctgggcccatattccaattgctttgtggaagccttt

SEQ ID NO: 6865138 - DNA, 66 bp, Homo sapiens
tgtctatctgagatgcaggtgggtggatgtggctccctgttacttcccttgcatttcatggtggca

SEQ ID NO: 6865139 - DNA, 83 bp, Homo sapiens
accagcaaggtgaaagcagtatcccttggggcctgaggcaggactacaggctccacggcaggatgctgtctgtcttgcttggt

SEQ ID NO: 6865140 - DNA, 60 bp, Homo sapiens
aacttggaaaccttgaagtagagaagtaacttccttttttaccactatgtttcacaagtt

SEQ ID NO: 6865141 - DNA, 114 bp, Homo sapiens
caaaaaaatgatgaaatcaaaatatagaaacaagggagaggattctgacatactagacaatgccagtaatgttgttctttgtttttccattttttgtttttgtttttgtttttg

SEQ ID NO: 6865142 - DNA, 75 bp, Homo sapiens
ctagaatcagtaggccaagcagctggcactgaccaaaagaagggcctaggctaggctgctggccactgaggctgg

SEQ ID NO: 6865143 - DNA, 127 bp, Homo sapiens
tatattagaatcactggggagctttaaaaaaatccatatctggactctaccccagagattttggtttaattggtccaggatggggtctatgcactgttttaaaagctccccaggtggatctaatgtg

SEQ ID NO: 6865144 - DNA, 87 bp, Homo sapiens
tgacagcttaactgtttcatgcccagtctgcatgagctacaatagcccctgccatacaatgctgtgcatgtaatggatgccctgtca

SEQ ID NO: 6865145 - DNA, 92 bp, Homo sapiens
cagaaggactgccgtgtacgtttctgtaaggacttaatgcaaattaggatttgtactttggggaaatgttgaaggataatggcgtccttgtg

SEQ ID NO: 6865146 - DNA, 60 bp, Homo sapiens
gttcaaactttcccacagtgactccagagaaaacttttctctgcaatttgtgggatgggc

SEQ ID NO: 6865147 - DNA, 98 bp, Homo sapiens
aaagtttggatttgtaattctaaatgcagagtaaatatttaattcttgatctaagagtgagaggttagttcagtaataagacttgctaatcccacttt

SEQ ID NO: 6865148 - DNA, 87 bp, Homo sapiens
gattaaggtttttaggcaatgctcatttcagtgatcaagaaggtcagccattcctttcaagtgagcgtagctgaatgggccatagtc

SEQ ID NO: 6865149 - DNA, 61 bp, Homo sapiens
agaactgtgaggtaggatatatgtgctcaggcatgtatgtatacaccccacataacgttct

SEQ ID NO: 6865150 - DNA, 55 bp, Homo sapiens
gtgagaagttgtaggagaattttgcaacactgtaaaacacttctacattttttgt

SEQ ID NO: 6865151 - DNA, 96 bp, Homo sapiens
cttctggtcctattgaggtggcctcttcttggcttccaggtggaagtaataatttatattagggagagaagccagctctataaaaagattcagaag

SEQ ID NO: 6865152 - DNA, 98 bp, Homo sapiens
gccaaaataagggaaggtggagatgctttccagtggggatctgctccaggattgtaggccccactcccagggtggcatctaaccaacccccatttggc

SEQ ID NO: 6865153 - DNA, 117 bp, Homo sapiens
gggagatgatgggagttttgatgaggccatgaggtagggtccttatgacaggattagtgtctttagaagaagagacatcagagggctcacatgatctctctttctccctcttctctc

SEQ ID NO: 6865154 - DNA, 125 bp, Homo sapiens
atggttctttgtgatctccctgatatagaaatacaggtatgcaaggacatgtgcactcataaagagtctatcttccttctttgcattcctgtgtgctttagccagaagagatgttttaggatggt

SEQ ID NO: 6865155 - DNA, 65 bp, Homo sapiens
agagagaagcaagatgctatttcctggatccaaatttcccaggacaaaacttcttgcatttctct

SEQ ID NO: 6865156 - DNA, 57 bp, Homo sapiens
gcggtcccgcgtaccctgccaccgccgccgcagaggttcgggcaggtgcggggccgc

SEQ ID NO: 6865157 - DNA, 55 bp, Homo sapiens
ctctgcagagcctccagcccaggagagaaccagggcaaaggggacatctgcatgg

SEQ ID NO: 6865158 - DNA, 73 bp, Homo sapiens
agggtgataaagtttaaaagggtgtttgcatcaagagtggttatttcaatttgccctgttaaattttcacctt

SEQ ID NO: 6865159 - DNA, 84 bp, Homo sapiens
tccctgaagcttcattccagccactgtgatgccagagattaatcaggagaagcatcacatcactagctggtaatgagaagggga

SEQ ID NO: 6865160 - DNA, 66 bp, Homo sapiens
tgttactgtgtacttaatctgtactggacaatggtgtatgtgcatggataaaagtatattataaca

SEQ ID NO: 6865161 - DNA, 73 bp, Homo sapiens
catttttggagaacttccactcattttcactttgaccatgcaaatgaacagtgggtgaggtaccctcaaaatg

SEQ ID NO: 6865162 - DNA, 58 bp, Homo sapiens
ttttatcttcctctgcctggtgatcgatcatcagcacaacgtacagagaaagatggaa

SEQ ID NO: 6865163 - DNA, 59 bp, Homo sapiens
gccctgcctccagggacccctcaggtgttctgagcccagagggttccatggagcatggt

SEQ ID NO: 6865164 - DNA, 74 bp, Homo sapiens
gtttaagaaggctgtttgctagacctttgccactcaaaatgtggttcaatgttttagagcagtgcttttcaaac

SEQ ID NO: 6865165 - DNA, 79 bp, Homo sapiens
gtagaatgatatgtgtgccatttcagcagtttagaggtatgaaactttgtgccttacctgagacacacaagttagctat

SEQ ID NO: 6865166 - DNA, 58 bp, Homo sapiens
ggaactggcagaggtaagactagaacactggtctcccatgtccctgtccagtgtttcc

SEQ ID NO: 6865167 - DNA, 67 bp, Homo sapiens
ttctgcaaatagtgaaacagatgggggatgaattgagctgtccctcacttcctcctaattcctagaa

SEQ ID NO: 6865168 - DNA, 65 bp, Homo sapiens
tgcttggaaatgcctggcttcctgaacctcttatttggttctttgcagaaggttttccacaagca

SEQ ID NO: 6865169 - DNA, 73 bp, Homo sapiens
gtgacagtgcacaggagaggaacctaacctagtataggagtaatggaaggcttcttctctatgtacaagtgac

SEQ ID NO: 6865170 - DNA, 96 bp, Homo sapiens
gattgacgagcttaatcagcgaatcaggaggaagccttgggcatcaatcattgtcagtgtgccttcttcctaacttctgatttgctgcttccagtt

SEQ ID NO: 6865171 - DNA, 89 bp, Homo sapiens
ccaggcctgcagcagggagcaggacacacgggcccagcaactccagccagcagctccagccctgcttcctgcctcagctgctggcttgg

SEQ ID NO: 6865172 - DNA, 63 bp, Homo sapiens
ggcctacacttcaaagggtgacttgatagaaaaagatatggaaaattagtttggagtgtggct

SEQ ID NO: 6865173 - DNA, 60 bp, Homo sapiens
tgcaagatcaaggtgttggcagaattgatttcattctgcagcagtgttccttggcttgca

SEQ ID NO: 6865174 - DNA, 92 bp, Homo sapiens
ccggaggggagcgcgtctagcctgggctccggcggcctcaggctgaggagggagcagcaagccgctcggagcccagccacggacccctgtgg

SEQ ID NO: 6865175 - DNA, 59 bp, Homo sapiens
gaaaacatgatttgcatgatttgtaattgtttaaatcatgagtctgcaaattatggatc

SEQ ID NO: 6865176 - DNA, 78 bp, Homo sapiens
gacagccctgacaggaggggcatgaaagacggtggctccctctctgtccctcctgtcccttcctctctggtgtctgtc

SEQ ID NO: 6865177 - DNA, 67 bp, Homo sapiens
ggagagaaaccctttgaatgcaatgaatgtggaaagaccttcagccacagttcatcgttcactcacc

SEQ ID NO: 6865178 - DNA, 81 bp, Homo sapiens
ccccattttcaaaatgttctttagtgctgcttttggattgttttggcaatgtagcagacattgtagaaatggaatttgggg

SEQ ID NO: 6865179 - DNA, 79 bp, Homo sapiens
caggactgagggattcagcgtggcctcaggcactttgcttccagttggtgtaagatgtcagctgagcaccttggttctg

SEQ ID NO: 6865180 - DNA, 88 bp, Homo sapiens
cagcttactctgcctgttgcattttccctccagaggtccaaatattatcacgtatggatatggaaatagcaatatggttggaaggttg

SEQ ID NO: 6865181 - DNA, 111 bp, Homo sapiens
gcagggcatggtagctgccgcctgtaatcccagcttctcaggagtctgaggcaggagaattgcttgaacctgggaggcggaggttgtagtgagccaagatcgtgccactgc

SEQ ID NO: 6865182 - DNA, 78 bp, Homo sapiens
atggattgggctctatgttctctgtcagacctgtgtggctttgctacatatccaggctgagaagatatccttttccat

SEQ ID NO: 6865183 - DNA, 97 bp, Homo sapiens
aggaaaagtgagtcttggagatcttatgtgacttgctcaagactatagttaggcagtggtccagctaagatttgaacccaagcagactcaatctcct

SEQ ID NO: 6865184 - DNA, 57 bp, Homo sapiens
taagaacttggcagcaagaaattgcctttaaagggaaaaccttgtggccagttttta

SEQ ID NO: 6865185 - DNA, 80 bp, Homo sapiens
ggagctgagagtcaggcacaggggaatgtctttttcccatgaaaaggcagcctctccctagttcttgtacccacatctcc

SEQ ID NO: 6865186 - DNA, 89 bp, Homo sapiens
gtgttatcaggtttatctcatagaaagaatgtgtaaaatttttcatgtacaaacataatcttttagcaatgagttaaaaaatttggcat

SEQ ID NO: 6865187 - DNA, 77 bp, Homo sapiens
caggtgtattactggcctgcggaagacttggatgtcccagcatggtagaaggccaggtccctgcagtgcaacgcttg

SEQ ID NO: 6865188 - DNA, 82 bp, Homo sapiens
tttgggaagatttcttcatgtgaaataagcagagggaatttgaactaaataactccattgcctactgaagaagctgcccaga

SEQ ID NO: 6865189 - DNA, 58 bp, Homo sapiens
tcccacaggcccagggcggaaactgttcccacagcagcaaggccctccggcctgggga

SEQ ID NO: 6865190 - DNA, 87 bp, Homo sapiens
agtgaattagaataagaatgtcaagcagaaggtctggaagctaccttgaaccacccttgaaatctcttgcatttcattcaaatcact

SEQ ID NO: 6865191 - DNA, 80 bp, Homo sapiens
agctcttgatccagaacagacctgcctgacctggggccactgtaccccacttggagccatggtgtgttcatcaggaagct

SEQ ID NO: 6865192 - DNA, 84 bp, Homo sapiens
actagccactgtgttgatctagcctgtgatgtggtatgtgaggatctcaggctgttgagagatgagcacaggcaaactgctggt

SEQ ID NO: 6865193 - DNA, 68 bp, Homo sapiens
aaggaaatacaacatgtattcattaggtggatatccactaaaccacggattcatgcattgtagtcctt

SEQ ID NO: 6865194 - DNA, 65 bp, Homo sapiens
caggacaagagggaatcgataactaaaataggtcacgagaagctggagaagccgtcttgtcgctg

SEQ ID NO: 6865195 - DNA, 67 bp, Homo sapiens
cttcccactagtatcacagagctggtcttaaactttgaccatttgatttctctgtgttggtgtgaag

SEQ ID NO: 6865196 - DNA, 81 bp, Homo sapiens
cttcatgcttattaccgggatcatcaagaatttattgcatcattagtttttaaaatattggtctcacttggtaagatgaag

SEQ ID NO: 6865197 - DNA, 60 bp, Homo sapiens
atgttggacttaacaaagggtgatgatgatcattattaatctttgctaagccacctacat

SEQ ID NO: 6865198 - DNA, 71 bp, Homo sapiens
gagtgtctagaatatctagaaagatcctaagcagagactgtgtgtggttcttggtagctgttctgtggctc

SEQ ID NO: 6865199 - DNA, 86 bp, Homo sapiens
caattctggaccacagtggggagtggctggtggtgtctgggtctgggatgccgtcttctatctgccttcagctgtggccagtgttg

SEQ ID NO: 6865200 - DNA, 71 bp, Homo sapiens
gcccggaacacggtggccatggtcaggtagcggccatgtcgcgggttgcacatggccatcatgttcttggc

SEQ ID NO: 6865201 - DNA, 76 bp, Homo sapiens
gcctcctcccgtggtgactgtgttgcccggatcctcagcagaggccgtgtgggcaacatggtcatggaaggaaggt

SEQ ID NO: 6865202 - DNA, 79 bp, Homo sapiens
cattgagtaaacaagtctaccattagaagcaggacttccttcttgatatacttggatggagacgatttgtttgaaaatg

SEQ ID NO: 6865203 - DNA, 81 bp, Homo sapiens
ctgtctggtttggtcttgaaactgggccagggagataagactctgcttcctggcttaggtttccagaacactctggtatgg

SEQ ID NO: 6865204 - DNA, 125 bp, Homo sapiens
ttgctttctttacagaataaacaactgaagtcctcatagactgactgcttgccttgacattccacagaaaaggcaagccattaatcatgaggtagtcacctgaactactcctcaaagatgagcaa

SEQ ID NO: 6865205 - DNA, 60 bp, Homo sapiens
atgagcaagagctatgtacagactggcatagaaaaagaaatgcaaatagctcttgatcat

SEQ ID NO: 6865206 - DNA, 93 bp, Homo sapiens
catccccctggctcaccgtgctccaggcagatgggccggcttcagagcttttgtgctgaaggcccctttgcctggaacgtctttgcctggatg

SEQ ID NO: 6865207 - DNA, 85 bp, Homo sapiens
gctcagggtgaattcagagagcaggctctgaatgggcccagtactcccattcatgtggggagccttctgtttggcagccctgagt

SEQ ID NO: 6865208 - DNA, 79 bp, Homo sapiens
ctgacataaattttcataaacaaattaaggcctggtccaaaaaattcaaatttcattttttcaggctgatttgtgttag

SEQ ID NO: 6865209 - DNA, 101 bp, Homo sapiens
ttcttctaggcacaatgatttactattcacagattcagtgttctctttgacttcatagaacataactattgtgaatagtaagaattgactgtgtataagaa

SEQ ID NO: 6865210 - DNA, 56 bp, Homo sapiens
tgctgtgtgtaccatgtatgtactcctctctgtatcctttatgtgtgtttgcagca

SEQ ID NO: 6865211 - DNA, 62 bp, Homo sapiens
gctaaatttaagcctttctcctcttagggcggaagccatgaggaccagagccttaatatagc

SEQ ID NO: 6865212 - DNA, 78 bp, Homo sapiens
gtctgttgtgtggtgaagcagagatgctaatcctggtccttcgtgagcatcgtcttcatctcacaaaaacatccagac

SEQ ID NO: 6865213 - DNA, 55 bp, Homo sapiens
ctgctgtaataggagcgttttgctgaaaaagaacagaaagccctatgtacagtgg

SEQ ID NO: 6865214 - DNA, 82 bp, Homo sapiens
ctgcaaggagctggagaaaatccatgtgtatgaggggctgagcagccctgtgtaccattcagttttttcctctattatggag

SEQ ID NO: 6865215 - DNA, 65 bp, Homo sapiens
gggcatgcctgagcctgccactcttgttggtttgacagctttgttggctctgctcagagcagtcc

SEQ ID NO: 6865216 - DNA, 68 bp, Homo sapiens
gacaggcagcagggcatagaggcacggaggctgcatggagatccctcactgcattgtccgctgtcttc

SEQ ID NO: 6865217 - DNA, 65 bp, Homo sapiens
agcaaaggacagcccatcctgggattttgctgaagcagttaaagaggaggctgtctctttcagct

SEQ ID NO: 6865218 - DNA, 96 bp, Homo sapiens
tggaggagcagtcaaagacatcttcaggttcatggtcatattcattatggtgtttgtggcctttatgattggaatgttcaacctctactcctacta

SEQ ID NO: 6865219 - DNA, 84 bp, Homo sapiens
gtcatgagtcactgcttggcacaggggacttatgtgtttgggaagccaggccacttatattcccactgtgctagagactcggat

SEQ ID NO: 6865220 - DNA, 59 bp, Homo sapiens
cactctgactggccctgcaggagagggtggctctttcccctggagacaaagacagggtg

SEQ ID NO: 6865221 - DNA, 73 bp, Homo sapiens
cttattaccagttacagcttatgtttgaagtcacaataaactcttcttcaaacatgaaagcttgatttttgag

SEQ ID NO: 6865222 - DNA, 75 bp, Homo sapiens
cctgggcttcagtggccagagatgatgcctgttagcatcatttagtggggcattggaatccgtgcgcagcccggg

SEQ ID NO: 6865223 - DNA, 63 bp, Homo sapiens
taaggtgtgaggatgtactgagataaattccatagaatttaccccagtgtattttcttccttg

SEQ ID NO: 6865224 - DNA, 103 bp, Homo sapiens
aggacttactcagtgcctggcacagagttgacccccactgtggacttgcacagcaaccacagaacctcagctttgagctcagagagccctgatgttgagttct

SEQ ID NO: 6865225 - DNA, 74 bp, Homo sapiens
tcactgaatgtgtccacaggtgtgagagaagggctggatgctgtgcctctctcacagttgcagggcagtagtgg

SEQ ID NO: 6865226 - DNA, 73 bp, Homo sapiens
cggcctgctcctggcatctctgcgtccttgccatgagatgtatgtcgggcagagattccaggaaaaatggctg

SEQ ID NO: 6865227 - DNA, 57 bp, Homo sapiens
taggtattaaatattaggatattcagagacctgagttataatgaatatttgaacctg

SEQ ID NO: 6865228 - DNA, 77 bp, Homo sapiens
gcatcgatattcctgggattgaactgcttccaagccagaaataatcctcaagctttcaaaactggaaaatcagatgc

SEQ ID NO: 6865229 - DNA, 88 bp, Homo sapiens
gaggacttgaagtcctcccgtgcgtctcgatgccaccagtttttgtttctttggtgaggaatcggttcacggtgaaacttcattcctc

SEQ ID NO: 6865230 - DNA, 62 bp, Homo sapiens
ggtcattcctgactgggaaggttgcttgacaagtcaggattgtgcctccagtcagaaggacc

SEQ ID NO: 6865231 - DNA, 56 bp, Homo sapiens
cccttgcacatttgtctttaatgaaggagaagttaaggaagatcattgtgtaaggg

SEQ ID NO: 6865232 - DNA, 73 bp, Homo sapiens
cttaacctcatttccttctttgtaaaatggaatttcttcagcagttactgtgagaagcaaataaggtgaatgg

SEQ ID NO: 6865233 - DNA, 91 bp, Homo sapiens
ttagttttgatagccaggaagaaaagtgttaaatttttacactaactctaggatgtgacatgtgctcatcttggctattctaaatgactag

SEQ ID NO: 6865234 - DNA, 63 bp, Homo sapiens
agggaggagtctaaggaaccattcagcaaatacttgctgaggatctactgtgggctcatcctt

SEQ ID NO: 6865235 - DNA, 80 bp, Homo sapiens
ggggtttgcatctttggttgcacattagaatcctcagacacacaggtactgtactgagttctttgcaaataacaagcccc

SEQ ID NO: 6865236 - DNA, 62 bp, Homo sapiens
gttgagtattccttatctgaaatgcttgggactagaagtgtttcagatttgggagtttcggc

SEQ ID NO: 6865237 - DNA, 59 bp, Homo sapiens
ggagggagtgaggctgaaaggcagaggtaaggagctgtgctagccaagcccatcccttt

SEQ ID NO: 6865238 - DNA, 92 bp, Homo sapiens
atctaaaatactatatgtagattgtaccaatgtcaatttcctagttttgatattgtactagggttacatgttacttatggagtaaactggat

SEQ ID NO: 6865239 - DNA, 87 bp, Homo sapiens
cccagtatatatgacaacttgctggtagcaaatgaatcttagaattaagacactgctaaacagtaaagatgattgttcagtattggg

SEQ ID NO: 6865240 - DNA, 82 bp, Homo sapiens
aggaaaggaagaggaaggtcccatcagaatttgggcaaaggctcatgtgttttggtggatcattcaagcaagtctgtttcct

SEQ ID NO: 6865241 - DNA, 55 bp, Homo sapiens
gtctttttctacgatagcgcctggctgcccctccaccaggtgggagaaagggcac

SEQ ID NO: 6865242 - DNA, 76 bp, Homo sapiens
ggctcagtggggtggaggagggcacaggtcattctggagcactggggggcctctcccttctcacgcatcaacagcc

SEQ ID NO: 6865243 - DNA, 88 bp, Homo sapiens
ggtgggaagtggcagtggggagggaggtgggtcccagggaacgtgggttaactttggggacacttctctttccccgtctctccccttc

SEQ ID NO: 6865244 - DNA, 59 bp, Homo sapiens
gtgtctataatgaaatgcacttgtgattctacacacacaggatgatttgatatgggcat

SEQ ID NO: 6865245 - DNA, 69 bp, Homo sapiens
tccacccaccctggcctggttcatgtgatgtcaaacactcaccaggagctaggacaggcatgggaagga

SEQ ID NO: 6865246 - DNA, 129 bp, Homo sapiens
cccctccccgtgtcataataaatctcacgttttctgccggctggaggcttggagcggtgaggtgacgttcatttcggccgcgtgaagttttctttcaaactgggattggtggggaggccgggggaaggg

SEQ ID NO: 6865247 - DNA, 81 bp, Homo sapiens
gggtagtgggttctagttgtgacactgccacaaactcactgtgagacagtggcagacactgtcgaagcctacccaacaccc

SEQ ID NO: 6865248 - DNA, 58 bp, Homo sapiens
gtttcattaagtataaaatgtggtgatttttcacacctacactaggactagatggaac

SEQ ID NO: 6865249 - DNA, 62 bp, Homo sapiens
ttggcagaatgggcagcttgagatattaaatgactatatttcaagcagtctgattttaacag

SEQ ID NO: 6865250 - DNA, 108 bp, Homo sapiens
cttctagatgaaactgagttgtgtctctcctggaagcacgtgtttgtggttgaggtgtaataggtaggtggttttaggcagagacatctttagtattgtatataggag

SEQ ID NO: 6865251 - DNA, 62 bp, Homo sapiens
gatgcccaggcccaaccatggatgattttgatttcactggccttgggtgtggcctgggaatc

SEQ ID NO: 6865252 - DNA, 63 bp, Homo sapiens
ctgagaggcacaaggcatttcggttaagttatattggccccaaagtacccttttgctactcag

SEQ ID NO: 6865253 - DNA, 99 bp, Homo sapiens
atctatagatcagcttttcaatgtgaattttgtccggccagcttttaactatcatctgaagcaggtggaaaattcttatcaggatataggtagatagat

SEQ ID NO: 6865254 - DNA, 73 bp, Homo sapiens
gcacatatcccgactactaactactgtagaaaggttaacccacctttctacacttcgtggtgtttttatgtgc

SEQ ID NO: 6865255 - DNA, 76 bp, Homo sapiens
ggaccaagcagcagccaagtctccaggagctccagtgactcagaggcctggagtctcttctgtagctacagggttc

SEQ ID NO: 6865256 - DNA, 77 bp, Homo sapiens
gtttaggcaagttgcttagtctgggtcctctatcttttgttgtgaagactcgatttcactagagtaactgtccaaac

SEQ ID NO: 6865257 - DNA, 60 bp, Homo sapiens
gctaaactggcattgctgcagaaagatgagatagagttgaaccagcaggtagagtttggt

SEQ ID NO: 6865258 - DNA, 76 bp, Homo sapiens
ctgcccatcttgaattgtagttcctcagctgtaaaatgaaggagctgattgaactgagcttcaagatcacttgcag

SEQ ID NO: 6865259 - DNA, 83 bp, Homo sapiens
taactgtattttaggtctcattctttgtatatgccttgacaattatgattgcttgattaaagaaagagcttttgtgctagtta

SEQ ID NO: 6865260 - DNA, 70 bp, Homo sapiens
gctgtgagtgagctgcctaggcacgagcctcaggccaccccatgcctgagcctgggcgtttatatacagc

SEQ ID NO: 6865261 - DNA, 109 bp, Homo sapiens
gggtggctgtccccatgggtcgccggcctccagcaaacagtcaccctcccagcctcgcgaggagcagggaaggagcctgcttgctagagccctggtcccggcagccccc

SEQ ID NO: 6865262 - DNA, 92 bp, Homo sapiens
gcaaggccactgtgcacaattccccttcccctgaggatagggcaggacccctcgggaatgagggtcttccagggaggagggagtgaccttgc

SEQ ID NO: 6865263 - DNA, 57 bp, Homo sapiens
ggcaggatctcggttcactgcaacctccgcctcctgggttcaagtgattctcctgcc

SEQ ID NO: 6865264 - DNA, 86 bp, Homo sapiens
gcgcatgggttggttcgattgtgatgcaagattgtgagaagtgaccacaggactcttgtcatcatcagttgtaaatatttgtgggt

SEQ ID NO: 6865265 - DNA, 74 bp, Homo sapiens
ggcatgccagtcatcttagttaatcttcatattcagttcatgaagcaaatatttctagagactggctatatgcc

SEQ ID NO: 6865266 - DNA, 67 bp, Homo sapiens
ctggttgtgctggcctggttagaaaggggtttctaggcagaggagcccctgggtttgtaacagctgg

SEQ ID NO: 6865267 - DNA, 87 bp, Homo sapiens
gagtagtaacagtaatgaaagctttcttctagttgtacagtaaagtctattttgctagcaggaggaggagtcactgtgaaattgctc

SEQ ID NO: 6865268 - DNA, 81 bp, Homo sapiens
gagaactatagaaacctggtctctcggtgagaataaatataccccagattttctaatataccatcaggcttctattttctc

SEQ ID NO: 6865269 - DNA, 104 bp, Homo sapiens
aagttacccaagatgggaatagagaatgaacaagagagagaactttgcccctggcaaggggcagttttgcaggctttgtaacccatcgtaaagggttagaactt

SEQ ID NO: 6865270 - DNA, 80 bp, Homo sapiens
ggtatagcagtcagaggtcttctaaaacagatgcacaatcttttatttattacagacctttttattgttacagctgtacc

SEQ ID NO: 6865271 - DNA, 67 bp, Homo sapiens
gagtggggcttaggaccttgtggcgcttctgtcagaagcctctgtggtctgtctaatgcacctgctc

SEQ ID NO: 6865272 - DNA, 55 bp, Homo sapiens
aggggaaagtagtttaatatgggagttctgctgattctcacaggggcttttctct

SEQ ID NO: 6865273 - DNA, 129 bp, Homo sapiens
tccttctgatagcatgttttagatacttattcctagcactgctttttctcctcactggtctgcctgtcactctttgagagctagaagcaataggactaggaagtggccacagagcttcctatggaaaaa

SEQ ID NO: 6865274 - DNA, 57 bp, Homo sapiens
gcccatcctgcggggagcagagggcatcagggtgcccttgagttggcccaggagggt

SEQ ID NO: 6865275 - DNA, 55 bp, Homo sapiens
tcaaaggaaacgtggtcctggccctcgagggggtgccagtccaaattccttatga

SEQ ID NO: 6865276 - DNA, 85 bp, Homo sapiens
tttctagatttattcatttatgtacttattcattcatttattcagcagctgtatgttatagttataaaatgaggagatctagggg

SEQ ID NO: 6865277 - DNA, 80 bp, Homo sapiens
tttttagaacagattctaggggtttacattatccatttaagaatagatggatttgcttttagaattgtgctttttaaaaa

SEQ ID NO: 6865278 - DNA, 68 bp, Homo sapiens
tgctgtgacccaaaaaagacctaaagtcttctggtctttcctttgcttggttatccttccccccagca

SEQ ID NO: 6865279 - DNA, 85 bp, Homo sapiens
tggacatgtttctgttgagtatatacctacaagtagaattgctgttgtaaggtagggatgtattcagctttagaagacactttca

SEQ ID NO: 6865280 - DNA, 101 bp, Homo sapiens
atatctgtgctaatctgtcctaacaattagcacagatattagtgatctgtgctaattggttaatatgtctgctaattgtttctcagaattagcacagatat

SEQ ID NO: 6865281 - DNA, 87 bp, Homo sapiens
catatgtgtgtttcaaattagcaactgtcttgaaaacatatggtactgtgtaatttcctgatgttagaactgaaaaatacagatgtg

SEQ ID NO: 6865282 - DNA, 83 bp, Homo sapiens
gttgcttagtaagtgtttatttataacgatctcttataacaagaattatggagacaggtgttcagtaaaccttggtgaatagc

SEQ ID NO: 6865283 - DNA, 56 bp, Homo sapiens
ctcatctcccacctgcgtgcaggaagtgaaaacctacaacaaaggatgggggtgag

SEQ ID NO: 6865284 - DNA, 66 bp, Homo sapiens
ggagagacctttgttattctaggagattgggagcgtaacattctaggcaggaacaagggtttgtcc

SEQ ID NO: 6865285 - DNA, 64 bp, Homo sapiens
tgaaactgtggaaaatccccagcaaccttaaatgagataggtgcaggtgattaatccagtttca

SEQ ID NO: 6865286 - DNA, 73 bp, Homo sapiens
tcaagactccaaagagttattttacccaatgaaagcaagtaagtacctcagggttgaaataattcagttttga

SEQ ID NO: 6865287 - DNA, 90 bp, Homo sapiens
cccggcgtgggaactggcagctgtaggatgcatgggtgtcaaccctgcctgccacgttcagctgtaaccagagccgcccacggagccggg

SEQ ID NO: 6865288 - DNA, 65 bp, Homo sapiens
gacttttggaaaagatgtaagctaaccaaggttggtaaattatttttatatccctttccagtttc

SEQ ID NO: 6865289 - DNA, 61 bp, Homo sapiens
ggcttggcctgataaatgcatggttcattctaagcccataccataaatttatcactaagtt

SEQ ID NO: 6865290 - DNA, 75 bp, Homo sapiens
cagggctcctaaacggaagattttttaaataaactgtgctcctcagaatatgacaagattttcctaggaaatctg

SEQ ID NO: 6865291 - DNA, 87 bp, Homo sapiens
ggactgggaaggcatgcatagtttttctagaagggtttttaagttcctccccacccagaggtcctgtgatgctgcacctcgctgtcc

SEQ ID NO: 6865292 - DNA, 55 bp, Homo sapiens
ggaactagaactggctttgggtccatagactaagtccagggcctctcctacttcc

SEQ ID NO: 6865293 - DNA, 61 bp, Homo sapiens
gtacagagaagcgaagcaggcccagaacccaagctctggctcctaatcggcttctttctac

SEQ ID NO: 6865294 - DNA, 102 bp, Homo sapiens
ccttatttttttctgcaagtaatacctggccttgatacagtagtacatttctgaccattgcttaactgtataaggcataggtaagctgtaggaaaactgagg

SEQ ID NO: 6865295 - DNA, 55 bp, Homo sapiens
aagtctgtttgagtgtcacactgtgaaatctccagtgagggctgcaggcggactt

SEQ ID NO: 6865296 - DNA, 63 bp, Homo sapiens
gcctcaccatcaggataaaatctcatcatcgatttagcatgtgagacagtgcctgatgtgagc

SEQ ID NO: 6865297 - DNA, 58 bp, Homo sapiens
tgggcctcaagatataagtaaaacagagtgaaatctgttccacagtcctgaggattca

SEQ ID NO: 6865298 - DNA, 79 bp, Homo sapiens
ggatctttatagaatgtttccaatgccttcttcatgaagaatgtcctacgtctgctgggtttggagacatataatgtcc

SEQ ID NO: 6865299 - DNA, 63 bp, Homo sapiens
tcaagtttgttattttaaagcttctttcaagggtttacctggaagctacagaaaataatttga

SEQ ID NO: 6865300 - DNA, 64 bp, Homo sapiens
aatgtgagggaaatcagtcagaattggcaatatctcacaatttcactgatttttccccagagtt

SEQ ID NO: 6865301 - DNA, 111 bp, Homo sapiens
tcaaaaatatgggggggaaatggtctactttagcaagataacagtaattttgttcattgtttatcaagaaatttgtgttatttgtggtgttccataactgcttcattttga

SEQ ID NO: 6865302 - DNA, 57 bp, Homo sapiens
cccgactctgggctgagccagggcccgaggctggccccaggcgctgcccggagcggg

SEQ ID NO: 6865303 - DNA, 75 bp, Homo sapiens
gaaggaaagcacagtccatttgtcatttttgacattcaaagtccagaaggtcctggtgaccatggagttcccttc

SEQ ID NO: 6865304 - DNA, 128 bp, Homo sapiens
gattggcataaattttctccaggcaatagctctagtgcgtggtttacagctagttaagcagatagcaaaaggtggctgacaaacctcgttacaatggtgcttgtcctctttttctgtttctgctaatt

SEQ ID NO: 6865305 - DNA, 55 bp, Homo sapiens
tgggcaaatgctttttagtcaatcctaggattctattctaagaggtcgtttctca

SEQ ID NO: 6865306 - DNA, 67 bp, Homo sapiens
tactggagtttttcaagaaactgtttaagttcactttaacttacagaagtattgagagatccaagtg

SEQ ID NO: 6865307 - DNA, 55 bp, Homo sapiens
ctagggtgtgcagattttgcctatagagtgtacaggcaagctcacatgactctag

SEQ ID NO: 6865308 - DNA, 102 bp, Homo sapiens
gttcctaaaagtgtctttgtagcaattttgctttttctgttggcttctgtaatgaaactgaagcttaggtacagaagttaagctataagacacagtagaaac

SEQ ID NO: 6865309 - DNA, 56 bp, Homo sapiens
aggcttagaaagggtaagtgactttctcaaacagagtgttacctagagctgggcct

SEQ ID NO: 6865310 - DNA, 84 bp, Homo sapiens
atacttatataggcttgactttgattaaatcaagcaaactatcagtttgtctttagtgaatgaagtcttcttttatatatgtgt

SEQ ID NO: 6865311 - DNA, 67 bp, Homo sapiens
ttccaggcatgtcagacataggcaaaatggctctaattgcctcacttttccttctgacgcttgagaa

SEQ ID NO: 6865312 - DNA, 97 bp, Homo sapiens
ggatcaaaggctctctgtggtggctgtcccattttatcttcccgtccacattgttttagggtgggaaggcctctgccactgacttgctgaatgaccc

SEQ ID NO: 6865313 - DNA, 66 bp, Homo sapiens
ggctttagtttctgaggattgaaagatgagataattacattctctttccttaaggaactcacagtc

SEQ ID NO: 6865314 - DNA, 85 bp, Homo sapiens
ttttgcatttaattaactgcatttttggttggagcaacagaacctaaatcgggctatcttaagcaaaaggcagtgtaatggaaag

SEQ ID NO: 6865315 - DNA, 65 bp, Homo sapiens
acgggagagtctggtagagcagcaagccctacttcctggagctgttgttgccacattgttatagt

SEQ ID NO: 6865316 - DNA, 130 bp, Homo sapiens
gcattcgttctctgtgctttgtttccatgtgtgctgtgagctcaagggtagagtgagtgtcctgctcatgtctggactgctcacagtacccagtgccaagctgagcacacagtagttatttgatttatgc

SEQ ID NO: 6865317 - DNA, 62 bp, Homo sapiens
tggacttcataatattgagcatgtttgctggagccacagcttaatcagtatgagcctatcca

SEQ ID NO: 6865318 - DNA, 94 bp, Homo sapiens
gggcacagtgctcagtttgctgtggctgcctgagtagtaataatcacagctacaactgcaggtgcgctcaggtgccaggcctgcgcactgtctc

SEQ ID NO: 6865319 - DNA, 63 bp, Homo sapiens
ggaggtcagtgaaaggggaaagccactgttttttaaagtgatttgactcttttattgttttcc

SEQ ID NO: 6865320 - DNA, 78 bp, Homo sapiens
cagaaagtagaacttccatattcttggtattttctaggggaagctggcccctggaagggaatggtggttgtatggttg

SEQ ID NO: 6865321 - DNA, 62 bp, Homo sapiens
ggctctggaggaaagggtgggccatggctttgaagccaggcaggcacacttcctccagggcc

SEQ ID NO: 6865322 - DNA, 73 bp, Homo sapiens
ttccttcctgacttttttcagccacagtgagtctctgagacctagttttggcagaaggaagtaccagagggag

SEQ ID NO: 6865323 - DNA, 75 bp, Homo sapiens
gggaagctggagctgggagtcctgggctgctgggtgacctctgcagacccctcctctctgggccttagcttctcc

SEQ ID NO: 6865324 - DNA, 78 bp, Homo sapiens
ttccaatttgtggtgagttaatattgtgcatgaccatacagagcttgccccatttgtgactcaccatcggagtttgaa

SEQ ID NO: 6865325 - DNA, 56 bp, Homo sapiens
agcagcagcagcagctggcagttagaaagtgctgaccagtcgccaggttgtgtgct

SEQ ID NO: 6865326 - DNA, 61 bp, Homo sapiens
tgacaatgcatgatggaattgccttcactatgttatgaaggtataattgtcattattgtta

SEQ ID NO: 6865327 - DNA, 55 bp, Homo sapiens
ggtggttcacgcctataatcccagcactttgggaggccgaggcaggtggatcacc

SEQ ID NO: 6865328 - DNA, 72 bp, Homo sapiens
gtaactgacatgtggaggctatttgcaatggaacttagactatctagtcttttgtagctaacacattcatac

SEQ ID NO: 6865329 - DNA, 86 bp, Homo sapiens
tgctactagtaggaatagaactaacagcccacattaccttcccctagaagtgattgggctggattaggactgttccagtttgagca

SEQ ID NO: 6865330 - DNA, 81 bp, Homo sapiens
tgaaattaaggaatttggaggcctctcctgcttgtccttcctccagggtatctgcatgatcctctttagattcttagttca

SEQ ID NO: 6865331 - DNA, 71 bp, Homo sapiens
ctccaccgtagtgctccaacattagtgtgcttttctaagtgggtaagttactgttgcagtatgccaaggag

SEQ ID NO: 6865332 - DNA, 75 bp, Homo sapiens
gcacgtgtctgtacagaatgcttggtaaggcatgggtgtaatcatgcgtatgtgtatgtctgtgtgggcatgtgt

SEQ ID NO: 6865333 - DNA, 79 bp, Homo sapiens
atcaaaggtggggagcagccttagcccctagcagaatgctggacaggggcttcccctgcttactcccactgtttttggt

SEQ ID NO: 6865334 - DNA, 65 bp, Homo sapiens
aacagtagggtacagccctggattcgcactgtgagttcagatcctggctctgccactcatttgtt

SEQ ID NO: 6865335 - DNA, 80 bp, Homo sapiens
gcttacccagccgtcctgcgggctggtaagaggcttcctactttaggaggcagctggcagcacccaggggctgggagagc

SEQ ID NO: 6865336 - DNA, 55 bp, Homo sapiens
gtaatgacaatagactatccacagctacctttgtggaacctaaaaatgtcattgc

SEQ ID NO: 6865337 - DNA, 67 bp, Homo sapiens
ttgacagcagaatccattcccagttaattattattttaatacttgatggtgtctgtcaaattgtcga

SEQ ID NO: 6865338 - DNA, 57 bp, Homo sapiens
aaggacaggctaacctgacattgaattgtatctttggaggcctgcagcactgtcctt

SEQ ID NO: 6865339 - DNA, 75 bp, Homo sapiens
ggcagtaaggggtgagggtgtgtcagcctgagttaaagaccaggatgtgagtggacacagtccttccaagctgcc

SEQ ID NO: 6865340 - DNA, 79 bp, Homo sapiens
ggtatctggcatgtgggctgcaactgtggatgatcgcctcggtgacaatgcatacctagcagctcagatgtcagatact

SEQ ID NO: 6865341 - DNA, 64 bp, Homo sapiens
agtgagtggcagtgaaggtcatagcattctcacaaaggaaagtgatagccacattgtagcaact

SEQ ID NO: 6865342 - DNA, 61 bp, Homo sapiens
gttgagcatgtaactacacagggcaaggactatgtcataagccctttgtgtacacattaac

SEQ ID NO: 6865343 - DNA, 56 bp, Homo sapiens
ctcagagcaatgaacatgcaaatgtatgcaaagcagtttcaggacttgctctgtag

SEQ ID NO: 6865344 - DNA, 79 bp, Homo sapiens
cactggtccatttggggagtgaagatggacaaatgggaatggtcctgagcggtcccattcatctccctagggaatcatg

SEQ ID NO: 6865345 - DNA, 57 bp, Homo sapiens
aggttgaccaggctggtcttgaactcctggcctcaagccatcctcccacctcagcct

SEQ ID NO: 6865346 - DNA, 130 bp, Homo sapiens
cctggtttgtcctttattactgtaagcatggcttttgatcaaaagaaatgaaagcattgacattttggtccattcattcattcattttaaaaggaggctgatgcttttgtgatgtaaagatgttccatgg

SEQ ID NO: 6865347 - DNA, 61 bp, Homo sapiens
aaggcacgctttctcaccttcaagcccagtccatgttcttaaagttgcagagagttgtctt

SEQ ID NO: 6865348 - DNA, 87 bp, Homo sapiens
tttccttctttttaaaggctgagtagaatcccattgtgtagatatttaatggctcaattttgaatcaccttggaagaagcaaggaaa

SEQ ID NO: 6865349 - DNA, 81 bp, Homo sapiens
ggcgtctcgctctgtcacccaggctggagtgcagtggcgtgatctcggctcactgcaaactccgcctcccgggttgacgcc

SEQ ID NO: 6865350 - DNA, 56 bp, Homo sapiens
tgggtactgttacatgtaggacttgacgattagtgttaacattattatggtgccta

SEQ ID NO: 6865351 - DNA, 80 bp, Homo sapiens
tgagagagaagtgggtgtcaccttgaagttgatttcattcactttaggaatctctaatactctcaaacaacttctctcca

SEQ ID NO: 6865352 - DNA, 91 bp, Homo sapiens
gtgcgctctcagagtcccactgagcatatgcagatgaggcctgtctgtatgcaaatgagcccgtctgtatgcagatgaggagagagggcat

SEQ ID NO: 6865353 - DNA, 57 bp, Homo sapiens
gaaaggagtcagtcttactgaactgagatcaaggtgtcacagtgctgcattcctttc

SEQ ID NO: 6865354 - DNA, 58 bp, Homo sapiens
ccttgtcaccaggtgcaagacacaacaggaccactgggggcacgctggcttgataggg

SEQ ID NO: 6865355 - DNA, 59 bp, Homo sapiens
ccccagaaggggacagagggtagagatatccagaaggtctccaccagcctctcctgggg

SEQ ID NO: 6865356 - DNA, 128 bp, Homo sapiens
caaatagaattgtactttgacaacccagacatcctcctaagagctacagcccagggttcatgagtaggcactgtgcatcctgttactctgtcatgcttttgatttcattgtcatctttgttttctttg

SEQ ID NO: 6865357 - DNA, 61 bp, Homo sapiens
acgttttgagtagatagccatatttgataagcaggttggatgcttctgttgcttaggaggt

SEQ ID NO: 6865358 - DNA, 77 bp, Homo sapiens
tttcctagtcacataaattatacaatttcagcttttcctttatctggatttgtgaaaagtgatcatggattagggaa

SEQ ID NO: 6865359 - DNA, 93 bp, Homo sapiens
ttgttactctgttgaacagttccagattgctaaaagtatcacctgcttcctgagtttagcaatttctaaaagtgttatatcatgagtatataa

SEQ ID NO: 6865360 - DNA, 66 bp, Homo sapiens
cagtgtcatggtttgttagcagcccgggatcgtccaggatgggcccaggctacaaattatgctctg

SEQ ID NO: 6865361 - DNA, 76 bp, Homo sapiens
ccctcaaagactcctgcctcctctgtttgctgcagtagccatcctgaagggcaagcaagcaggtagagctgatggg

SEQ ID NO: 6865362 - DNA, 75 bp, Homo sapiens
gctccacaggagagggtccattctttgccttttccaggttctggtggctggtggcattccttgacttgtggcagc

SEQ ID NO: 6865363 - DNA, 55 bp, Homo sapiens
aagcctgctgtatgatttcccttgtgtgttgacaagaagtcatatgaagcagctt

SEQ ID NO: 6865364 - DNA, 58 bp, Homo sapiens
gccagagctgagacacgagtcctgcctcttgggctcaaagtttaggtctcagactggc

SEQ ID NO: 6865365 - DNA, 62 bp, Homo sapiens
tgggtacccccttctgtgtctgtccacagtccctgtgtctttcctacaggaaggggttctcg

SEQ ID NO: 6865366 - DNA, 70 bp, Homo sapiens
cctaagcgtgcagggcctggagtggcacctctgcaagagtggcactgcccagcgtcttaggcacaaaagg

SEQ ID NO: 6865367 - DNA, 58 bp, Homo sapiens
ccccagtggttgcaacagcagaggcttattgcttgctgtgctgtgtgtctactgtggg

SEQ ID NO: 6865368 - DNA, 67 bp, Homo sapiens
ggccccaggtgaggggagctagcatgccttgggatatacattcagctggaagcgcctctcaactgcc

SEQ ID NO: 6865369 - DNA, 62 bp, Homo sapiens
ctggctgggctgaaccctcaggaggtgggcctactgtcctggacaacagcccctagagtcag

SEQ ID NO: 6865370 - DNA, 59 bp, Homo sapiens
aaatgctatactcaaagaaattcaatttgaattggaaatgaatgaggaggatggcattt

SEQ ID NO: 6865371 - DNA, 67 bp, Homo sapiens
gtccacttcccttggtgaccagcttggggtgccctagtattcacaggctggtctccgaggactggat

SEQ ID NO: 6865372 - DNA, 97 bp, Homo sapiens
agtttttatgggggccttatttgtgccatttcagtggtacttttcctaagtgcctctggcttctgcatcagtgggggaaaaaaccgtgacatgagct

SEQ ID NO: 6865373 - DNA, 94 bp, Homo sapiens
tctaaagcagttctattatctagtacaattttagcaagatgatttaaagaagtttgttgtgtagctgtagctttgcagtagaatctgctataga

SEQ ID NO: 6865374 - DNA, 56 bp, Homo sapiens
ggtaatgcttcctatatagcactctgattcaagagagctatttggcaagcatttct

SEQ ID NO: 6865375 - DNA, 120 bp, Homo sapiens
ctttcgatgcctgttctttagagttataaaggaaaggcctttgcatttggtttgtctctggaggcttttctggtatcaaatgcagtaaaggttttaaatgactctgaggcaaggtggaag

SEQ ID NO: 6865376 - DNA, 62 bp, Homo sapiens
ccttaaatgagatgttcagatatttggttactgcattgaataatatcaactttcatttaagg

SEQ ID NO: 6865377 - DNA, 65 bp, Homo sapiens
gtgacacctgccaagcctctaattcttcaccccgggaagagagaacaccctcggcatgggctcac

SEQ ID NO: 6865378 - DNA, 74 bp, Homo sapiens
tgatactgtcctgcaaaaatactcttctttctttcattaagcatttatagaaggatattacaaaggatttgtca

SEQ ID NO: 6865379 - DNA, 90 bp, Homo sapiens
gactggggtggaaggcctggatttaggttgtgagccaaatggaactgttaatatcaaacccaagaatcaggcagcttatcaccatcagtc

SEQ ID NO: 6865380 - DNA, 57 bp, Homo sapiens
cagggactacagccagccctccctgtggaagtctgggtggctggaggggtggccttg

SEQ ID NO: 6865381 - DNA, 78 bp, Homo sapiens
atgtctattagatacccaagtggatctgtctaatgggtatttagacagatccacttggatatctgtctcaatggacat

SEQ ID NO: 6865382 - DNA, 83 bp, Homo sapiens
acacgatgaaacagcacaattttcaggagtccacaattccagcgaggcgcgtggatgggaaattgtcacgttgtgaattgtgt

SEQ ID NO: 6865383 - DNA, 129 bp, Homo sapiens
ctgctttggggtctgctctgagaggcctggctgtgtgatggagcacagcagctttgttggcccccacctgggagctggcagaagagctggttcaactccgcagtggtagggcagcccccagctcagcag

SEQ ID NO: 6865384 - DNA, 103 bp, Homo sapiens
gagatggagctcaggttttttcctaagggatgcggctcaagggactgtgacttctaaaaattcctcttcagtgttaatcttgggagaagaaatccttcatctc

SEQ ID NO: 6865385 - DNA, 91 bp, Homo sapiens
tacaactattagactttgaaaagatgaggaacttgaacagttaacagaaactgagaagattctcactcttagttataagcagataaatgta

SEQ ID NO: 6865386 - DNA, 57 bp, Homo sapiens
ggaggggcagagagaaggaagcttgcacccactgtgcttttgaatttctgtcccttt

SEQ ID NO: 6865387 - DNA, 77 bp, Homo sapiens
ggattttagcaacttgcctcaaatcatggaagtaaaaggtgaagaacacctgaatttgaatgcaggtagctgagtcc

SEQ ID NO: 6865388 - DNA, 69 bp, Homo sapiens
taccctcatgaagctggcctggacttatatatttaattctaaatactccaagtggggttcatgactgta

SEQ ID NO: 6865389 - DNA, 76 bp, Homo sapiens
tgaaagtaaatttccttttcgtgatttgatgatattgatggttattgtcaaacttggtaagagaaatacagcttca

SEQ ID NO: 6865390 - DNA, 58 bp, Homo sapiens
gtaagtctgagtgtaattcacaatggttcctatttctgtgaactgcattacaggatac

SEQ ID NO: 6865391 - DNA, 94 bp, Homo sapiens
agaaatgacaaacaggtggacaatggaagaatctgacctgcattaagcacttactgtataccagtttcctccatgcccatctttgcttaattct

SEQ ID NO: 6865392 - DNA, 68 bp, Homo sapiens
gctctgcgctgcactcatctgcagtcggctgtgagttggctaggcagctctgctggtggtgccagggc

SEQ ID NO: 6865393 - DNA, 68 bp, Homo sapiens
ggtgggagtgggcacagttacggtctttgaaccccagcatggacatttaacaatctctacttctcatt

SEQ ID NO: 6865394 - DNA, 62 bp, Homo sapiens
tatatggctgtttcactagctgaaatctaaagtactgtttttagtcaattaacggccatata

SEQ ID NO: 6865395 - DNA, 88 bp, Homo sapiens
ggaaacggaagtagcagttctcacgttcctgggtagatgaagatggaggagagggcccagggctggtgggagatgctggactggttct

SEQ ID NO: 6865396 - DNA, 58 bp, Homo sapiens
gattaatgagggcctgcaacctcctcagtcttgtattagggaggagggttttcaaatc

SEQ ID NO: 6865397 - DNA, 69 bp, Homo sapiens
gggaaatacacttccaaactaagttggggaggtgctcccagatcatagtttttaagtgtacaatttcct

SEQ ID NO: 6865398 - DNA, 64 bp, Homo sapiens
gtttgaagcaccaaaggagaaaatgacttggtagattgtgcattttccactgggtgtttggaac

SEQ ID NO: 6865399 - DNA, 91 bp, Homo sapiens
cagaatcttgctctgtcacccaggctggagtgcagtggcacgatctcggctcactgcaaactctgcctcccgggttcaagcaattcttctg

SEQ ID NO: 6865400 - DNA, 55 bp, Homo sapiens
gcgaggcagaggggcagaggacaatggggacaggtcctctccatgatctgtttgt

SEQ ID NO: 6865401 - DNA, 70 bp, Homo sapiens
cctgcaaaggggaagtagcaccagaggtgggttgccattcccacccctcatcagttgcttcctacacagg

SEQ ID NO: 6865402 - DNA, 56 bp, Homo sapiens
tttcaagtagccctggctcccagagatggtcctgggacaattaagggcagctgaga

SEQ ID NO: 6865403 - DNA, 118 bp, Homo sapiens
gcagtgatggtgccaaagcaatagagggtaagactgttggtgccttagcatgaatcaagatagtggcaccaaacttgactagttatcactgtattctttgctatcacatactcactgt

SEQ ID NO: 6865404 - DNA, 71 bp, Homo sapiens
ggggctgctaattacgctggggcaggcggggcaaaccaggaccctgccaggcgagtctaggccatggcccc

SEQ ID NO: 6865405 - DNA, 106 bp, Homo sapiens
ttttgtcagattatttttgaaagatccttctcactgcagtgtaagcaatattaacactggaaatagggaggttttttagaaggctgttgaagtaatctaggcagaa

SEQ ID NO: 6865406 - DNA, 88 bp, Homo sapiens
gaaagcactagaacttataattattaagattgaaatgagaatcatgcttagtttcaaaaatttaagtctatagtcaccgggtgctctc

SEQ ID NO: 6865407 - DNA, 105 bp, Homo sapiens
gtgtctggaggcttctgtattagacagtgcaggtctcaacaattacttcaactagaacaaaaagtagaattgagtttcactgttcccttgcaaatttccagaagc

SEQ ID NO: 6865408 - DNA, 60 bp, Homo sapiens
tttgcagcaaggagagagcattcgcacttcattcttgggttatgcacacctagctgcaaa

SEQ ID NO: 6865409 - DNA, 79 bp, Homo sapiens
gttggcggcacggtaggttcattagtcaataaagcattgccacgcgttttattgaattgtaaccctattttgccctgat

SEQ ID NO: 6865410 - DNA, 82 bp, Homo sapiens
tacattctactttttcactccctttcccagtgtgtaatagattaaaaacaatgggttatctctgtgaagaacttggaatgta

SEQ ID NO: 6865411 - DNA, 64 bp, Homo sapiens
agaccagaaggaagtttattttagaagagatactgcctctctttctttctctttctctggtgct

SEQ ID NO: 6865412 - DNA, 60 bp, Homo sapiens
tcctttggcctaataatccttctcttaagagttccacactggttttattgaggccaagga

SEQ ID NO: 6865413 - DNA, 60 bp, Homo sapiens
gtgagtctattttgcttattctatgtaatattttatatggcaaataagagaaagatttat

SEQ ID NO: 6865414 - DNA, 71 bp, Homo sapiens
agctggaagtccaaggtcaaggtatcagcaggcttggtttcctctgaggcctctctccttggcttgcagtt

SEQ ID NO: 6865415 - DNA, 56 bp, Homo sapiens
tagtgtcaaacagggattagaaagctaatgctttccattctcatgaatggcagcta

SEQ ID NO: 6865416 - DNA, 55 bp, Homo sapiens
catttccactctgggagtcagatttgaggccctgatgtggctgccaggagaaatg

SEQ ID NO: 6865417 - DNA, 59 bp, Homo sapiens
cacccagcatggtgggtcaggccctggctttgaatactggcctcaccactagctgggtg

SEQ ID NO: 6865418 - DNA, 58 bp, Homo sapiens
ttgtcttatgctgcatagactattcacctcctaacttgaaggtctaatcataagacaa

SEQ ID NO: 6865419 - DNA, 75 bp, Homo sapiens
ttgagaagagggaaaggtgtgcaagttgggagctattattcgttccacaggacagccacgtttcagtcttctcag

SEQ ID NO: 6865420 - DNA, 129 bp, Homo sapiens
tgctcagtttggggtcccagaggctagccgacatattgtatgcaggacacatggaacatagtctagctcctaactccatctgcatttggtttctgtctggtaagctcatgtgtaattacagactcagga

SEQ ID NO: 6865421 - DNA, 90 bp, Homo sapiens
atcactgtcaatcttgttaaaatgcagattctgattcacttggcctggggtagggcctgagattctgtatttctgacaggggtcaatgat

SEQ ID NO: 6865422 - DNA, 68 bp, Homo sapiens
gagggacagcaacttgcccagtacccctctcccacccctgggtacctggctggactgtgctttccttc

SEQ ID NO: 6865423 - DNA, 73 bp, Homo sapiens
gggagctgacccagggtatccagagctgctcagaaagagggtgcatggaaaagcctctggggatgctgctccc

SEQ ID NO: 6865424 - DNA, 65 bp, Homo sapiens
cagattgctgggcctcttccctggatattctgattgaattgtttggagtggggccagtgaatttg

SEQ ID NO: 6865425 - DNA, 76 bp, Homo sapiens
tcaacaatggtatcacctcacagaattattttcaggaatgaaacagtgcctggcatggggtgttacttgttgttga

SEQ ID NO: 6865426 - DNA, 63 bp, Homo sapiens
ggtatgcctggctgatgaagattcaacagatgattcttgagttctttccgttaggtatgtacc

SEQ ID NO: 6865427 - DNA, 101 bp, Homo sapiens
gaattagttgggccaagatatgtgtatttccatcgatcagcagtgactctgcaagagagaaagctgatatgggactgtccagtgtcctgtccaaaagattc

SEQ ID NO: 6865428 - DNA, 65 bp, Homo sapiens
tggctctggtgacacacccttccttgcgttgtgagtgtgtaaggcaggtatggtaccaggcgccg

SEQ ID NO: 6865429 - DNA, 118 bp, Homo sapiens
gcaggttggtggcacatgtttttattgctgttctttaaatgaaggtcctgacactgcaagatgaactcagggatgcctcattcagagttacaccagtgctttactcccactcttctgt

SEQ ID NO: 6865430 - DNA, 66 bp, Homo sapiens
gaggcacagtcccgaggcaaggaaaacggacacagtgattccccgagtttctggacatggatcctc

SEQ ID NO: 6865431 - DNA, 76 bp, Homo sapiens
cgaaagctcaattgtgatgattgcacaagtgtataaatttactacaacttatgaatgtcattataatgtggtattg

SEQ ID NO: 6865432 - DNA, 62 bp, Homo sapiens
catctattgagctgtttttctggtagtatgctaggctgctatgctaggaggatactgagatg

SEQ ID NO: 6865433 - DNA, 65 bp, Homo sapiens
tcatttctatctatgcagcttctctctgcaccgatgcagaaactgtgcctgccagatagtaatga

SEQ ID NO: 6865434 - DNA, 71 bp, Homo sapiens
ttcacattcccaatggctccattttcatctccttaatcaggtgttaaaattcatggcttgggaaaagtggg

SEQ ID NO: 6865435 - DNA, 94 bp, Homo sapiens
agagagtcgcttgaacccgggaggctgagaggtcgcagtgggccaagattgcatcactgcgcttcagcctgggtgacagagcaagacttcatct

SEQ ID NO: 6865436 - DNA, 74 bp, Homo sapiens
ggatggggtaattctgtgtgaatctattaaggaaaagataacttcagtggaacacacagagtgggtcaaaagcc

SEQ ID NO: 6865437 - DNA, 76 bp, Homo sapiens
gagctggtgatcagctggaggattctgagtcctaaccataccctgtcatgactaaagccttcatggtcctagactc

SEQ ID NO: 6865438 - DNA, 129 bp, Homo sapiens
agaggtaagcaaagtcctgtattacctgcaagatggaaatggaaatgagtacatgataattgatgtatatatttctttcattctagagctgcagaaaatctagagggatttttaacagatgctgcttct

SEQ ID NO: 6865439 - DNA, 66 bp, Homo sapiens
cgcggcatcccatggtggtctctgccctccagaggctgccagtctaatgggaaacagcttgctgcg

SEQ ID NO: 6865440 - DNA, 57 bp, Homo sapiens
ggatgtgaatctgggctgagacagggcaatatagcttagtttcaccagggttctacc

SEQ ID NO: 6865441 - DNA, 65 bp, Homo sapiens
agtggaggctcagaaagaggagatgtttggcaagcctcccaaattcatttcattgtgtcttcact

SEQ ID NO: 6865442 - DNA, 122 bp, Homo sapiens
cctgtgcatgatccgagctaaggagtgggaccctgctggcttgacagaggcctgggagaagcagggcttagctccttctgtgcaccagccatccatcttctgtgctttggatcaggtaaggg

SEQ ID NO: 6865443 - DNA, 63 bp, Homo sapiens
ttctgtccctcctggcaccaaagtcacctatcataagtaacttgagtttcagaggggaaggaa

SEQ ID NO: 6865444 - DNA, 65 bp, Homo sapiens
agggctcagagtagttcggttttccagccctatgatgctttaatctctggatttctcttttccct

SEQ ID NO: 6865445 - DNA, 104 bp, Homo sapiens
caaatactgctctacactgaattacagttatatactgatttctgttgtaaattcttagagaagacagacatagaaattagtaacttgagtcagtagcggctttg

SEQ ID NO: 6865446 - DNA, 81 bp, Homo sapiens
cttaggctgcaatatgatgtctgagaaatgtaccagagagactcacctggaaatatcccagagaattaattgcagacacag

SEQ ID NO: 6865447 - DNA, 86 bp, Homo sapiens
ccctggccttggtgaggtagcagagacagtgaatgttcaacttctgagtaatttataggtaactctgcagcaacactaacacatgg

SEQ ID NO: 6865448 - DNA, 55 bp, Homo sapiens
gaagaatccatgctaatttacctgttttattatggggtagattatggggtccttc

SEQ ID NO: 6865449 - DNA, 130 bp, Homo sapiens
cctttctctggtggctaatgatgctgagcatctttctgtgtgcttactggtgttcagaagatgactgctgaacaaagacatggaggaggatgagggaggcagccatgcagttacctaggagcatttcagg

SEQ ID NO: 6865450 - DNA, 85 bp, Homo sapiens
tcaagttgctctcatgtcgagtgggtctctgttcccagtaaacactctagagcagcctgagtcactttatttctgagcattttga

SEQ ID NO: 6865451 - DNA, 61 bp, Homo sapiens
gacttatctgagagtcagatttcctgaacattaaaggacactgaagaatctcagatgtgtt

SEQ ID NO: 6865452 - DNA, 72 bp, Homo sapiens
ctgtgattcagaacaaagtttctctctgtgttttcaggtatccaagacaaacattgttatgataaattacag

SEQ ID NO: 6865453 - DNA, 63 bp, Homo sapiens
tctgggctgaaggctccccacaccacaggtcctgtgctgtgctggaaggaattttagttcaga

SEQ ID NO: 6865454 - DNA, 58 bp, Homo sapiens
gccaggccctgaggattcggcggggaagaaagctgggacctgtcctctcagggctggc

SEQ ID NO: 6865455 - DNA, 68 bp, Homo sapiens
tccagcaagaacattcgaactattttctcaaaaattgagagttcacagaatgttttgctttgcaagga

SEQ ID NO: 6865456 - DNA, 69 bp, Homo sapiens
ggaaatataatctaagtgttttcccagaaggtgaggaaacagattttgatgaacacttactatatttct

SEQ ID NO: 6865457 - DNA, 69 bp, Homo sapiens
gtctctgtacagtgggtgtagggaccagccacacagggtcggtgggtttttctccccgtgtgcagagat

SEQ ID NO: 6865458 - DNA, 69 bp, Homo sapiens
attgtatcccccaggtgtttaataatggatccatgtcaatcctaaaagaagtatctggtggactgcaat

SEQ ID NO: 6865459 - DNA, 130 bp, Homo sapiens
tcacctttgttcaaaatattatcttcactttctgctttactgactgtgccaggaagaacccagtagttctacagttgattaacactgagattttcctgacaccagttttcaggcttttgaacaccttaga

SEQ ID NO: 6865460 - DNA, 56 bp, Homo sapiens
tatttcctgtggatacttttagctttcttctgccaacgtatctataagtggaaata

SEQ ID NO: 6865461 - DNA, 61 bp, Homo sapiens
gctctgagatcattcactgtaaagatttttcaattgaatttagaggtaatagatccagagc

SEQ ID NO: 6865462 - DNA, 66 bp, Homo sapiens
ccagaagtcaggaatgagtcttacagggctgaaaataaaagtgttgacaggactagttccttctgg

SEQ ID NO: 6865463 - DNA, 72 bp, Homo sapiens
cattggctagaactcagtttcacagcctcatctagctgcaaaggaggctgggaaatggagtttggctttgtg

SEQ ID NO: 6865464 - DNA, 97 bp, Homo sapiens
gatttggctctctgtttgtctgttattggtgtataagaatgcttgtgattcttgcacattgattttgtatcctgagactttgctgaagttgcctatc

SEQ ID NO: 6865465 - DNA, 56 bp, Homo sapiens
aagtctaacctattccggtgttctctctcccatgagacaagccgttatatagactt

SEQ ID NO: 6865466 - DNA, 74 bp, Homo sapiens
caccactgccagatcattggattcacacatgctgaggcttcagtggctcaatgtgggttgaagatgcagtggtg

SEQ ID NO: 6865467 - DNA, 84 bp, Homo sapiens
ttctgatttcctacgtgatttatggtctggtggcgtcccaagatcatgtgcttttattccaccaaactgttagggccatcagga

SEQ ID NO: 6865468 - DNA, 82 bp, Homo sapiens
ggccagggaatcagggcccgggcttcctgggggtgtggggccttgtagcctcttggactgggccagacactgattccctgcc

SEQ ID NO: 6865469 - DNA, 55 bp, Homo sapiens
gagtcatttgggggcttcttgactttcatgtctggtgcctgaaatagaatgactc

SEQ ID NO: 6865470 - DNA, 64 bp, Homo sapiens
gaccccaaccctagagtctgaccagagacaccaactgttgagcctcagcctcagggctgggctc

SEQ ID NO: 6865471 - DNA, 95 bp, Homo sapiens
ggccgctcctggtgcaggctccacgttgttgtccaggctcacttcataaaaaacttcggagagagggaggcgggggtctgagcacagtgcgagcc

SEQ ID NO: 6865472 - DNA, 62 bp, Homo sapiens
ttctccagcacattttctttgattcagagctaataaaaatcaacaacaatgtgtttggggga

SEQ ID NO: 6865473 - DNA, 62 bp, Homo sapiens
gagggggagacctcctggaccactgagcaattaattcatttacattaggaagtttctccgtc

SEQ ID NO: 6865474 - DNA, 103 bp, Homo sapiens
ggacaaaacacacacacacacacacgtatccacatatgtatacatatgtacacaagtacatacttatgtgtatatgtgtgtgtgtgtgtgtgtgtgtgtgtcc

SEQ ID NO: 6865475 - DNA, 88 bp, Homo sapiens
gggtctgagggaagcaggggagtccactctatgcagacacttaattaatctgcaatgtgcacatcgtcttgccctttccctcccaccc

SEQ ID NO: 6865476 - DNA, 74 bp, Homo sapiens
gagaggacaggcaggcactcctaggaccatcatagcagcgacccagccctggtggccagtgcccctcccctctt

SEQ ID NO: 6865477 - DNA, 67 bp, Homo sapiens
ctgtcatgaagcctgctggatcaagcttatgctgttttcagtgaaagtgaatccagaggctttgcag

SEQ ID NO: 6865478 - DNA, 55 bp, Homo sapiens
ctgggagaatttgttgaaggatattcttacttttccttccttgaatgccttctag

SEQ ID NO: 6865479 - DNA, 68 bp, Homo sapiens
agcaacctgccagtcactcagtggcctccaaccagagaaaacaacctgccaagttggcagctgttgct

SEQ ID NO: 6865480 - DNA, 77 bp, Homo sapiens
gatgcaagcagtcccagacccagaaggtgggtgcacagggacagccaccctgatcggactcggagtgctttgccatc

SEQ ID NO: 6865481 - DNA, 102 bp, Homo sapiens
gcatcaatcacctgggtagatttgataaatacacttgcccaggattggggaagggagctgggcactggcgttttgttaaaccttcccaggtgattttgatgc

SEQ ID NO: 6865482 - DNA, 121 bp, Homo sapiens
aattctttaattgggactgtacctgcaagcattacacttctaaatgaagcctcaaaggctcatacaatggaatagtgagaaatgttgcagaagaagtcatctaaatatgccatgaggagtt

SEQ ID NO: 6865483 - DNA, 120 bp, Homo sapiens
aagggaaatcattttcatgaaattttatttgaatctggctagagaaaatgctcaccttcttccttgtgttttgcttatttgattaaatgtctttgatttctgtgatgtgtgaagtccctt

SEQ ID NO: 6865484 - DNA, 78 bp, Homo sapiens
aaagtaatgtataagtgggtttgtaatgtgcctaaaataataggtattatcattacagatcttccttggttttacttt

SEQ ID NO: 6865485 - DNA, 78 bp, Homo sapiens
gagaccccaacagtgggcttccagaacatcccaggaccatccttcttgctgtcttctctgaggtccctggccactctc

SEQ ID NO: 6865486 - DNA, 65 bp, Homo sapiens
tgtactttagaagaggcaattgaataagctaacaaaaatttttatgtagcattgcctcaagtata

SEQ ID NO: 6865487 - DNA, 71 bp, Homo sapiens
gcatctgtgaatttgatatacatgcctcccgtgttccttcatgtcagtgatatgcaagtttactagaatgc

SEQ ID NO: 6865488 - DNA, 55 bp, Homo sapiens
gtgaggcctacccccctgtgttttcttctgagagttttatagttttaggccttat

SEQ ID NO: 6865489 - DNA, 61 bp, Homo sapiens
tagtaggtgctgaataaatactagttagtatcctggctggtccaatactcagtaaaaactg

SEQ ID NO: 6865490 - DNA, 68 bp, Homo sapiens
gacgggagcgccgcccctgctggtgttggggtgccccctcctgccaccgggggtggcgatggcccgtt

SEQ ID NO: 6865491 - DNA, 81 bp, Homo sapiens
ctggagccaggctgactggttcaggtcccgctctgtcatctccaagtgtgtggtgggattctgaacctgtcttggcctcag

SEQ ID NO: 6865492 - DNA, 85 bp, Homo sapiens
attcacaaagttggagcactataatagagattttcaataatatatgttaaaagggtttttatgtgatgtcttgcaacttgtgaat

SEQ ID NO: 6865493 - DNA, 55 bp, Homo sapiens
aggctgggatttcatgttgaggcagaattgcttctgctttgggaattctcagtct

SEQ ID NO: 6865494 - DNA, 88 bp, Homo sapiens
gcattattatttatctttattttaaaatgtattataaatgtatttgtcagcaacatggtatgtattttaagagaagtaagtggtatgc

SEQ ID NO: 6865495 - DNA, 57 bp, Homo sapiens
ccgcctgcggcagagggtgggagcgggtgccggagcctgtgcttcagctggaggagg

SEQ ID NO: 6865496 - DNA, 55 bp, Homo sapiens
agaacagctgattccatgtcaaacatgttaagtgtttggtgctgacaggctgtct

SEQ ID NO: 6865497 - DNA, 57 bp, Homo sapiens
gacatttattggattttacgagctagtggatctgactcagaaagccgatcagatgtt

SEQ ID NO: 6865498 - DNA, 85 bp, Homo sapiens
ggtgtcaatctcagacaaatgggtacccgtgattgcaacagcgcctgcagcagctccaggttaccctcagtctcagaaggacatc

SEQ ID NO: 6865499 - DNA, 72 bp, Homo sapiens
gggcgggcagtgggtggctgcagcctgtccttacatggggctaaaggggcccagccacttagtgactcaccc

SEQ ID NO: 6865500 - DNA, 66 bp, Homo sapiens
ccctgttgcctgtgaacgctgagtcctccaccacaccatgaggtcagctgcactggtgtaattggg

SEQ ID NO: 6865501 - DNA, 71 bp, Homo sapiens
tgctgttctgattctgtcctgctcttgatggaaatgagttattcaagaggcaagattatcagggcatagca

SEQ ID NO: 6865502 - DNA, 66 bp, Homo sapiens
atcagaatttgctctgtaataatctggggtgatttaaatacactctattgtttcagaggcactggt

SEQ ID NO: 6865503 - DNA, 58 bp, Homo sapiens
gtttcacctccaaagaattgctcccagtgtaggagcagccctgaaatcgaggtgacac

SEQ ID NO: 6865504 - DNA, 72 bp, Homo sapiens
gggtgagagcaggcatgaaattggttatgaacaggtgaattgcatgactgattacccaagcctctctgtctc

SEQ ID NO: 6865505 - DNA, 114 bp, Homo sapiens
gaatatgtgcctccaaagatgtcataaaaatgtgggtaactgagggtgaagtgtgcatacatacacacatgcatttgccttatgaaagtgatctcttaggagtgtcaaatgttc

SEQ ID NO: 6865506 - DNA, 88 bp, Homo sapiens
agtagtatctgtgaaaacattttgtccacagtgggctgacatgaaataatatcaaatctcattgcctaaaacttttgtagatgttact

SEQ ID NO: 6865507 - DNA, 73 bp, Homo sapiens
ggtaacatagcatttacttttcagaaattaggtgaagtgtaactattttaaggagtaatgcttgtttgttgcc

SEQ ID NO: 6865508 - DNA, 78 bp, Homo sapiens
tcttttcagtgtctcagccccaactagagaaagacagacatctgttccctctgcatgggtgctcagacctagggagga

SEQ ID NO: 6865509 - DNA, 64 bp, Homo sapiens
cctcagacttctctttagtactaaatgtcataatgaaatgacattaaaatggagaattttgagg

SEQ ID NO: 6865510 - DNA, 69 bp, Homo sapiens
gataggagtgccccagattctagcagcaagaccctgttggcgacctctggcttctggggcctctgtttc

SEQ ID NO: 6865511 - DNA, 66 bp, Homo sapiens
tggcctcttaaggatgacacaatatcacctagctggaggctaggtatgcatctagtaagagtgtca

SEQ ID NO: 6865512 - DNA, 84 bp, Homo sapiens
gggaagagcaggttagggaggtggctttccagcagtagtgcagaagcaggactggaggcccctcccagtgaagcaggttctcct

SEQ ID NO: 6865513 - DNA, 82 bp, Homo sapiens
tgagcatttcaggattttggtatttgatgggggtcctggcaccaatcccctccagataccaaggaacaactgtacgtgttta

SEQ ID NO: 6865514 - DNA, 55 bp, Homo sapiens
aaagctgtgccatttttaccgattgtgtctcagttggaaatgagcgttcagcttt

SEQ ID NO: 6865515 - DNA, 56 bp, Homo sapiens
tcctgggagcatggtgccgtgagcccagcctggctgctggccgtgagctctcggga

SEQ ID NO: 6865516 - DNA, 59 bp, Homo sapiens
gacaggtaccggtcagactacggtgacacaggcggcgtgcggttagacaggtaccggtc

SEQ ID NO: 6865517 - DNA, 87 bp, Homo sapiens
gacacccagcctttttatgccctttttctgtcccaatgcttagcttcactgagcctggagacaaggacaaagggctggtgggatgtc

SEQ ID NO: 6865518 - DNA, 79 bp, Homo sapiens
atcctagcttccttctttaattcatgatatgtagtaaggaaattcacagtatctagaaatgagggtggacactggagat

SEQ ID NO: 6865519 - DNA, 60 bp, Homo sapiens
caacagacagctcacagctcagttctgcctcaacccatgtttagcttgggctgcctgttg

SEQ ID NO: 6865520 - DNA, 118 bp, Homo sapiens
gcctggggctcccagggagatgttaggatgaggggtgccgtcctctgctgcagctgctcttatgttcagattccagtttgtggctcccctctttctcatatccttggatgttccttgc

SEQ ID NO: 6865521 - DNA, 64 bp, Homo sapiens
ctatgttacaaagcagttagttgctaagggatcaagagacctgattagctgcactggaacatag

SEQ ID NO: 6865522 - DNA, 55 bp, Homo sapiens
gtctcctgccacactcagtcccactcaggagtgtccgtgaaggtggggaggggac

SEQ ID NO: 6865523 - DNA, 78 bp, Homo sapiens
actagatgaggaagccagggcattggccacccagtgacacagatactgaagcctcctggcctttgctcctcattcagt

SEQ ID NO: 6865524 - DNA, 77 bp, Homo sapiens
gaatgagtcatggtgattatttccatttttctttagtcattaatgaaactcgaaataatcacattcgtggctttgtc

SEQ ID NO: 6865525 - DNA, 55 bp, Homo sapiens
cgctgcctgcgccaccaccacgtccctgacgtgaaatatgggggcgcaggccgcg

SEQ ID NO: 6865526 - DNA, 59 bp, Homo sapiens
cctcacttagagcgtcattaagttagagaacaactcccacactctgctctaagatgagg

SEQ ID NO: 6865527 - DNA, 73 bp, Homo sapiens
gaaagaaattgaggctaagtaactgtccatgggcacatagctcatgagtttaaggtttaggcttaggtctttc

SEQ ID NO: 6865528 - DNA, 56 bp, Homo sapiens
gccttccctgtgcatgtctcctctcttttgaccaaacacatgacaacaggggaggc

SEQ ID NO: 6865529 - DNA, 75 bp, Homo sapiens
tgagaagagaggggttgcatggaaattatgtcacaagaatgcttggtcaattttcattgcattcagctctattca

SEQ ID NO: 6865530 - DNA, 128 bp, Homo sapiens
aaagctactaatgaatctctcttggtaaattattcacagacacatacatggggaagatgagcagaaaacactgcacttcactaatactgtgtggcaggataatttactggaaaattcatttgtgtttt

SEQ ID NO: 6865531 - DNA, 66 bp, Homo sapiens
ctgtcccaggtcctagatgaccaggggccaaggacatggtacttggtgtcagagagctgggatgag

SEQ ID NO: 6865532 - DNA, 61 bp, Homo sapiens
cccacggtcacctgaaggtcagaggctgagaagcaggaacgagttcatggggacctgtggg

SEQ ID NO: 6865533 - DNA, 85 bp, Homo sapiens
ccatgttcccttattctgtaggcatggaacagggagacggttgccttcatctcatacatgtttgcagaaagaaagtgggccaagg

SEQ ID NO: 6865534 - DNA, 74 bp, Homo sapiens
attccagtgattatcttaagaggttgtatgcagcagaaataaccatacttccttgtcaggtgcatcattgtaat

SEQ ID NO: 6865535 - DNA, 60 bp, Homo sapiens
gatgtgaactgaggctgagtgttggtggaagaaatacaggctcaggctcaggttcaggtt

SEQ ID NO: 6865536 - DNA, 87 bp, Homo sapiens
gagaattgtgttgtctgtgacacattcagaattaagagttggggatattttaatactataatttgaagtactatagtcatatttctc

SEQ ID NO: 6865537 - DNA, 107 bp, Homo sapiens
tctgttgttggcctgtgtctttccctctttcattctgtccttgtttggggccaccaaacttgaggcaatgaaggtgtaggttgagaaattacttgggctaccaaaga

SEQ ID NO: 6865538 - DNA, 85 bp, Homo sapiens
agcttaaaaattcagcaggcatgcaaaagggtctcagattgaagggacaaagtgatttccctgtagcctctgaataacttaagct

SEQ ID NO: 6865539 - DNA, 72 bp, Homo sapiens
cctggggcaccttggcacataatttgggaactccagttttggtgtttccattcatatgctgcttatcctagg

SEQ ID NO: 6865540 - DNA, 60 bp, Homo sapiens
agtaccttgttggccacgccctgtgccaggaactgggtgtacagaggtaactgaggcact

SEQ ID NO: 6865541 - DNA, 75 bp, Homo sapiens
ctttgaaaagcacatctcattgggtgcacacatgtttgcacacagacatggtttattttaatggtgtattcaaag

SEQ ID NO: 6865542 - DNA, 55 bp, Homo sapiens
ctcccagccaggcttggtggtgggcagatcccaagctgaacttgtttgctgggag

SEQ ID NO: 6865543 - DNA, 60 bp, Homo sapiens
gccaggggtgcccacccaaggagcctcttcacctgctcttccagggtgggcactgctggc

SEQ ID NO: 6865544 - DNA, 74 bp, Homo sapiens
ggatggaactgatcaggagtgccaagtcaaaagcagcagatcttaagccctcactggttgttcctttaacatcc

SEQ ID NO: 6865545 - DNA, 59 bp, Homo sapiens
tcaggatgaagtcagaggggtcagtagttcctgagctgacctttttaaacaaatcctga

SEQ ID NO: 6865546 - DNA, 76 bp, Homo sapiens
agtatatgtgcacatatgcatgtgtgtgtgtgtgtgtgtgtgtgtgtgtgtgtgtgtgtgtgtgtgtgtgtgtatt

SEQ ID NO: 6865547 - DNA, 79 bp, Homo sapiens
cctgggtgtattcattggcctgatcaacacaatgaccaaatctggtcacagtgcaggatcagttaatgactgtcctagg

SEQ ID NO: 6865548 - DNA, 130 bp, Homo sapiens
tgggtgagataaaaggttggccctttctgataatattgaaatggctgaagaagtgtggccaggggaagaaaagactggcctccttggctgttcattccattttattttatgtcaatcatttattcaacca

SEQ ID NO: 6865549 - DNA, 78 bp, Homo sapiens
ggcctaaccgctggtatctgtgaatgtgacattatctgaagataaggtctttgcaaatgctagagataaggtgaggtc

SEQ ID NO: 6865550 - DNA, 110 bp, Homo sapiens
ctccttggccatcattccgttcacaatcattccgttcacaacagggccatgctgcatctggggaaaggccggtgatcatgtgagcatgagtggtcatggtctataaggag

SEQ ID NO: 6865551 - DNA, 74 bp, Homo sapiens
gctgccaaacagggacaaattccctatttgcatgatattctcaagaaatcccaagggaaacactgtttaggagc

SEQ ID NO: 6865552 - DNA, 71 bp, Homo sapiens
ggtcaactttgttgagcttcttagaaatagtgatgtatagtgaatgtttctatctggatcaatagatgacc

SEQ ID NO: 6865553 - DNA, 127 bp, Homo sapiens
ggtcacatgcagctcctcccgcgccgtggggatctggtggtttctgtctgagttcctccccacttggggtctgagaccgtgggagcctctagcgtgcccagctcgggctgtctcactgtttgttacc

SEQ ID NO: 6865554 - DNA, 90 bp, Homo sapiens
gtactcagtatccaactcagttatcatgtgtccacaaacagtgttctagctgcctgtgttaacactgcatgataatggaaagctgagtgc

SEQ ID NO: 6865555 - DNA, 63 bp, Homo sapiens
ctgcatcttttcatttgccagctggtactgccatctgcgattccaggtacatggagaatgtgg

SEQ ID NO: 6865556 - DNA, 77 bp, Homo sapiens
taacatctacacctcagggtggcactcagcgcatctttatgaacatgctttgatgtattttgcaggtatatttgtta

SEQ ID NO: 6865557 - DNA, 75 bp, Homo sapiens
gtgggaggcttggggctggcttgccttgttcgggtccgcagcttggagtgaggggcacagctgtgggccttttgc

SEQ ID NO: 6865558 - DNA, 59 bp, Homo sapiens
ttccaacttgcttcttaaatgagtttttagatatagagcatttagaggggcaggaggaa

SEQ ID NO: 6865559 - DNA, 81 bp, Homo sapiens
tatcaagtggaggtagtagtttctaacatatagcattggttatgaggatcaagtgagaaaatgcatgccaaccacttaata

SEQ ID NO: 6865560 - DNA, 64 bp, Homo sapiens
ttggtgactccccaccatgatgtcaggagcaggttctagcccatcagtgagggggaatcactaa

SEQ ID NO: 6865561 - DNA, 74 bp, Homo sapiens
gtattggcagtatacatagcactactcaagaagccaaagaaacacttgtgcagtgctaagtgtcacatgtctgc

SEQ ID NO: 6865562 - DNA, 113 bp, Homo sapiens
gctgagattgtctctaggtcctcccttctgccagctggtgtccagggaagtgggtcctctggcctgcttcctgccagccagaatttcgaggaccttgtttctcccactgcagc

SEQ ID NO: 6865563 - DNA, 64 bp, Homo sapiens
cataaaaacagcagagctgtgccccttcacaatgggaataaggcctggctctgtgtttattatg

SEQ ID NO: 6865564 - DNA, 64 bp, Homo sapiens
ttgatttgtttaggttttggttgcataaagcctatttttcatgcaaaagacttgaacttttcaa

SEQ ID NO: 6865565 - DNA, 84 bp, Homo sapiens
gctttggggtggcaaatgatagagccgattatcactctgagaggaaagagaggagtggggctgtgtgcgtttgctagaccaagc

SEQ ID NO: 6865566 - DNA, 68 bp, Homo sapiens
ggttgaattttatgacaatattccaccatttttgacccatagaaatggcagtgtcataaggctcaacc

SEQ ID NO: 6865567 - DNA, 60 bp, Homo sapiens
ttactgttttcgttgattataaaggtaatacacacttggcgtaatgaatgtaaacagtaa

SEQ ID NO: 6865568 - DNA, 84 bp, Homo sapiens
gcgatattttatttctacattgagttttagcaactctaaaaaggctttgtaaaaattaactgtaggatggaataagatatttgc

SEQ ID NO: 6865569 - DNA, 94 bp, Homo sapiens
tcaagcatcaggaatggaaatggagtgtgcttgctttgtttgatctttcaagaaccagcacccaatatgtccattctgccatttcctgtcttgg

SEQ ID NO: 6865570 - DNA, 56 bp, Homo sapiens
agaggcagccttgaaaatggtcttgtatcccccaagtccacttccttcctgcttct

SEQ ID NO: 6865571 - DNA, 55 bp, Homo sapiens
gctggatcaagtccttcacccataccattcccaagggtttaaggatcaatccagc

SEQ ID NO: 6865572 - DNA, 93 bp, Homo sapiens
gagctgctgtgaaaattggagctcagaggaggcagcttaactcagtagcagagcagaaagcactgataagttgcttgctctcaatggcggctc

SEQ ID NO: 6865573 - DNA, 72 bp, Homo sapiens
gaggagttggtctgaggaacaccagcactgccttacagataatgtgggtgactgtttctgagaccaagactc

SEQ ID NO: 6865574 - DNA, 129 bp, Homo sapiens
gctttgttcttgaatggagctaattacagagttgtctgctgcaggatgggcactctgcagtcagtgtgtaaatagggacaattagagctcattttaagcagacatggcttccaaaaaaagaaacagagc

SEQ ID NO: 6865575 - DNA, 118 bp, Homo sapiens
gaggcataaatggtcaaataacttgctccagagagcacagtagacagggaactgagatttattcccaggctgtctggttgcagatgttatgctgttaatcactatgttttgctgcctc

SEQ ID NO: 6865576 - DNA, 107 bp, Homo sapiens
tctggtccaaggttacagggagtcagtgaaggagtcagaatcactacctgtggcctctaactcctgtctgctgctattccacttcttggtgctggtttgggaccaga

SEQ ID NO: 6865577 - DNA, 72 bp, Homo sapiens
aggagctctgggcagggcctcccacgcccagccccactatgcaccaggagacacctgccacccagagctcct

SEQ ID NO: 6865578 - DNA, 73 bp, Homo sapiens
tcttgggagactaaaggaggagttaatgagactctagagttattttatttcctcttttcacagcataccaggg

SEQ ID NO: 6865579 - DNA, 59 bp, Homo sapiens
tggtcttttcttgtgatatccttgccaggctttagtattaggatgtctcgaggagacta

SEQ ID NO: 6865580 - DNA, 95 bp, Homo sapiens
ggcaggatcctctggcccaggagagcaggcattgccctggtgggtgctgagcagtgtctgggctcccttggagctgctggcagttttgtcctgct

SEQ ID NO: 6865581 - DNA, 106 bp, Homo sapiens
gctgcttccaaaatggcaccttcttcctgcctcttcatatggagaaaggaacaaatgctgtgtcctcatgtggcagagagtggaaggggagaaagtgccaggcagc

SEQ ID NO: 6865582 - DNA, 89 bp, Homo sapiens
cgtcagccatgttttagaggggttctggctggatggaaggtgctgccgaatgacttccaagggcccttctaaaattctgtgagtccatg

SEQ ID NO: 6865583 - DNA, 61 bp, Homo sapiens
ggctgcagtaatagcagagtcttccatgcaaccatgcagataatttagctgttctgtggcc

SEQ ID NO: 6865584 - DNA, 76 bp, Homo sapiens
aagtgttaatggtagaatctgagtgtttgtattagagcatttactgtaaaaactcactcggatttgctatatgctt

SEQ ID NO: 6865585 - DNA, 79 bp, Homo sapiens
ctcttgttccaggcatggcttgggtcaatcagcactcatgactttgctgtgtgcctgagccgtgcctggctaactgggg

SEQ ID NO: 6865586 - DNA, 70 bp, Homo sapiens
gctgctttgaaagccatggcatgccaggatcacccttggtgaccaccagcagggccaggttgaaagcagt

SEQ ID NO: 6865587 - DNA, 58 bp, Homo sapiens
tcatacatcttgtatatctatctgatgattatcattggagtagtgattaagagtgtgg

SEQ ID NO: 6865588 - DNA, 84 bp, Homo sapiens
gatttattgtaaagtacttagcacagcactaggtacacattaggtgtactgataatgtctgctaaattactattacactgcttc

SEQ ID NO: 6865589 - DNA, 70 bp, Homo sapiens
tctgttccttcatatcttaggggtcctaattagtctcctgtaggtccctgcaaagctattcaggcataga

SEQ ID NO: 6865590 - DNA, 75 bp, Homo sapiens
gttcataggagcgcgggtcgagggaacggcgggaggcgcgttcgccgatgcccgggacccgggagggctcagagc

SEQ ID NO: 6865591 - DNA, 55 bp, Homo sapiens
gattctctgtgggaagtctgagtcaattatagggacatcaggctttgagagaatc

SEQ ID NO: 6865592 - DNA, 56 bp, Homo sapiens
tgataggttctcaatgaatgctgatgtatgaacaatggcatttcatttaaccatca

SEQ ID NO: 6865593 - DNA, 61 bp, Homo sapiens
ggcactcaccttaagattaccgtgggtattatttttagttccaggtctttaggtcagtgtc

SEQ ID NO: 6865594 - DNA, 59 bp, Homo sapiens
ggaatagtagttggggaatggctgatgtcatgtttcatttttcccaggaaaactattct

SEQ ID NO: 6865595 - DNA, 60 bp, Homo sapiens
ccttcttttctttacggtgtaggagttgtaaaatcaatttcatgtgaagaagagataagg

SEQ ID NO: 6865596 - DNA, 90 bp, Homo sapiens
ggtctacagactctagctcaagctacaggatcaaggttctacccacagaaggttggcatctgagctgtgtatggttctaaggcttagacc

SEQ ID NO: 6865597 - DNA, 60 bp, Homo sapiens
tagggctttgctcatcctaggtataaccaatgtgtgttcagcataggaggtaaagtcctg

SEQ ID NO: 6865598 - DNA, 105 bp, Homo sapiens
ttttgtttaaatgtttcagggcttcaactcatcatttaataaagtttttgagcacctattaagtggtgagtactgccaggcccaggaatacaaagataaacaaaa

SEQ ID NO: 6865599 - DNA, 68 bp, Homo sapiens
catctctggttcagtctctgtggaatgatacctggatattaggaattgcaggatgattggacacgatg

SEQ ID NO: 6865600 - DNA, 55 bp, Homo sapiens
tctgaatttatggcaaaacctggtttcctccccaggtttccccagcccctttaga

SEQ ID NO: 6865601 - DNA, 101 bp, Homo sapiens
tgaggcaggagaattgcttgaacccacggggtggaggttgcagtgagccgagatcatgccactgtactccagcctgggagacagaacaagactccgtctca

SEQ ID NO: 6865602 - DNA, 57 bp, Homo sapiens
gctgaccacaggtgggcttgctcacaaggctgtggtctgcaggtggatgtggtcagc

SEQ ID NO: 6865603 - DNA, 100 bp, Homo sapiens
aggggaggagatttcttgtctgccaagggtagtggaggcccctgcatctgtcatgcagatccatccagcactcttgccagatctagcgtgctgatccctt

SEQ ID NO: 6865604 - DNA, 57 bp, Homo sapiens
ggtcagtgcctatcatgtgggccttccagtccgggcagcccgtgagggcatctgacc

SEQ ID NO: 6865605 - DNA, 56 bp, Homo sapiens
tcagtgcaatcaaggtatgtttttgctaacctacacagacatattgatagcattga

SEQ ID NO: 6865606 - DNA, 89 bp, Homo sapiens
cagaagaacagtgcctgcctcagagcatcgcgcagagagcctagggcagctgggctgtgcttgatgttctcagtagttgttagcttctg

SEQ ID NO: 6865607 - DNA, 73 bp, Homo sapiens
tgactctgaataacatatttacctagcgatgacttctaaaagctcagctgcataacaaagtatgatggagtca

SEQ ID NO: 6865608 - DNA, 79 bp, Homo sapiens
tgtcccatccatcttaaccctcagcctcccacgactccatctgtagaggcaaccagtgttgagaaaaattgtgtggata

SEQ ID NO: 6865609 - DNA, 56 bp, Homo sapiens
cttctccttatatgtcccgttcattgagtatctggatggggatctggaggtggaag

SEQ ID NO: 6865610 - DNA, 59 bp, Homo sapiens
actgctttaaaaaagcaagcttttgagggtgtactttaaagcagcttaataaagtatgt

SEQ ID NO: 6865611 - DNA, 79 bp, Homo sapiens
ctgggccccggggcgtggggctggccttgcctgggggctacatccccagcgggtgctgtgtcagccctcgagggctcag

SEQ ID NO: 6865612 - DNA, 112 bp, Homo sapiens
gtgctcagggtcccgttgacgtagactttcaggccctccttggatttccatgtaaataggacatgagtccaataggggcctggaaaagagtgaagatcgccattctgagtac

SEQ ID NO: 6865613 - DNA, 57 bp, Homo sapiens
atgtaccagtgttgagaatgagagatctggtttcctctcttcttatggctggtagat

SEQ ID NO: 6865614 - DNA, 55 bp, Homo sapiens
cctgttagcatcttgggcccaggaaatccacaccctgaccttaagtgctgaaagg

SEQ ID NO: 6865615 - DNA, 78 bp, Homo sapiens
cagcattgaaggtgtggcaggcattctgaggctgggtctgtccagtttggggatatcctccagggctgtcttttgctg

SEQ ID NO: 6865616 - DNA, 68 bp, Homo sapiens
cctgtagtgatttagaattcaaatgtggctaatttataaaacaaccacatttcactgttcacagcagg

SEQ ID NO: 6865617 - DNA, 59 bp, Homo sapiens
tttctcttgcgatatgctacacctatggtcatagacagccagtgtaagtgcaagaggaa

SEQ ID NO: 6865618 - DNA, 69 bp, Homo sapiens
agggagaccacagtttcattcatgcaggtgctttctatagatttgtagtttaaattgtggattctttct

SEQ ID NO: 6865619 - DNA, 130 bp, Homo sapiens
agaagacttcagccgctgctcccgaagccactaagggcagggaggccaaagtgtgggcggctctgctcagaccattcgcgctttaggcccaccgctctgcgctcttggtaaggcggaggaggcagcttct

SEQ ID NO: 6865620 - DNA, 63 bp, Homo sapiens
cctcagctagaaagtctgttagggagatagttttcctcttcttattcgtcttttttgctgagg

SEQ ID NO: 6865621 - DNA, 119 bp, Homo sapiens
gagggttctgatggtttattcattcctgtaatacatattcattgaacacctactacatgccaggccccgtgctaggtgccaggaatactacaggagtagaaaaaacagacactactctt

SEQ ID NO: 6865622 - DNA, 129 bp, Homo sapiens
ctgcagctgtgactcccctcctctcattaatgcatgtcctggggtcttctcttcagaagctgaggcagcattcttcaagacagttctcctaattgatggaggagcactgggaggtgcacgttcaggcag

SEQ ID NO: 6865623 - DNA, 65 bp, Homo sapiens
cttagtaactctttttttaagtgtagcccatgtttcgctttgggttgtgtgaaaagattacaaag

SEQ ID NO: 6865624 - DNA, 87 bp, Homo sapiens
gcttgaacatatccttgtactatagtatttataagttttgttattattgttatgggtactagtattagtgatactgaatgtgtaggc

SEQ ID NO: 6865625 - DNA, 75 bp, Homo sapiens
ctcatcatttaacagtagtcttaatttcatgtacaaatgggcatttgtacatttggatgtgcttaagtgtgtgag

SEQ ID NO: 6865626 - DNA, 83 bp, Homo sapiens
gctgtcctttaaccttgtgtgtctagaatttcattttatcttttaggtttatgtagttgaagtgctataaagtaaaggatggc

SEQ ID NO: 6865627 - DNA, 61 bp, Homo sapiens
gtgcaaatttatatggtgactgctgaaggccttcgtaggcagtgtgtgtgtgagtttgtat

SEQ ID NO: 6865628 - DNA, 82 bp, Homo sapiens
cagcaataacaacttgattgtgtagcacaatcctggagcctgaacagccaaggatatgcacattcaaaaattgctaatgctg

SEQ ID NO: 6865629 - DNA, 73 bp, Homo sapiens
actaggacacatgccattgctttaaaattaagtagaaaaactgcttgggtgtatagtggcagcaaatccaagt

SEQ ID NO: 6865630 - DNA, 55 bp, Homo sapiens
tctattctagagggtagatggcgaatgataagatttgtttactctagagggtaga

SEQ ID NO: 6865631 - DNA, 67 bp, Homo sapiens
ggcaatggagctggtaaacagtgacatcctatattaatttgaggtcactgcttatcaccaggcagcc

SEQ ID NO: 6865632 - DNA, 62 bp, Homo sapiens
attaagatagtaaacattttctgctttgaaggccagacagtctctgttgctgctgttttaat

SEQ ID NO: 6865633 - DNA, 60 bp, Homo sapiens
tagtgcccagttaggttggagcacagttcttttggaacctgttcagaccaacttggactg

SEQ ID NO: 6865634 - DNA, 79 bp, Homo sapiens
tagtgagaaggattctagcgttttgtaatcaagtatgatattttattttggtttcagaaatgtatattttttatcacta

SEQ ID NO: 6865635 - DNA, 57 bp, Homo sapiens
gcgccgccgccgccgccacggggcaccatccccggctcggcctcacggtggcggtgc

SEQ ID NO: 6865636 - DNA, 73 bp, Homo sapiens
ggattgtttcagcatgaaacaattgagcccattgcctttgccctgggtcttgtgtttcctgtggaagccatct

SEQ ID NO: 6865637 - DNA, 93 bp, Homo sapiens
gccctagataggcagcagtggccttacagatgctgacagatgatctgattagatgcacagttgctgggtggcgtctggggccagtctattggc

SEQ ID NO: 6865638 - DNA, 58 bp, Homo sapiens
tccgtgctccttcctcatcctgtgcatccctctgatggtagaggaggaggcagcagga

SEQ ID NO: 6865639 - DNA, 69 bp, Homo sapiens
tagggctttgatggcattctcatattgcttcacagtggtaagagtataaatgatggaatcatagcttta

SEQ ID NO: 6865640 - DNA, 87 bp, Homo sapiens
taaatcagaacgtgcatggtgtaattctaatgctgcattgctgaaactgctgtagtgctgggctatctactgctacattctgatttg

SEQ ID NO: 6865641 - DNA, 70 bp, Homo sapiens
tgtggagggcctacagaaatgcttacaagacttgtcatgacttaagctgttctttagatatttttccaca

SEQ ID NO: 6865642 - DNA, 61 bp, Homo sapiens
ggtacagcccctcccctgacagatgaggcagctgcaacctctacagggtaaggggcttgcc

SEQ ID NO: 6865643 - DNA, 70 bp, Homo sapiens
ttctttagttctggaggttattaggagtctctattgatactctttatgacattccagcatccttaaggaa

SEQ ID NO: 6865644 - DNA, 65 bp, Homo sapiens
tgggggttgctggcattccttggcttgtggctgtatcatgccagtcttcaaggccagcatcttca

SEQ ID NO: 6865645 - DNA, 63 bp, Homo sapiens
ggctggaggtctgcagactacgcttcccaggctgccgtgcctgggctgccggcaggctctgcc

SEQ ID NO: 6865646 - DNA, 64 bp, Homo sapiens
tatcatagatttatcaacatgtaccattggcaggccctctgctggtactagagatattgtggta

SEQ ID NO: 6865647 - DNA, 57 bp, Homo sapiens
ccatgtacatgaacacggcggcaccataaaagagccccactaccgtgatgtgcgagg

SEQ ID NO: 6865648 - DNA, 56 bp, Homo sapiens
cagctttggcatctgactagccgtaagagcttctgggtggcagtgatgttaagttg

SEQ ID NO: 6865649 - DNA, 57 bp, Homo sapiens
gttttgcttctcatgttaagtgccaacattgcatctcttatgttggagaggcagggc

SEQ ID NO: 6865650 - DNA, 72 bp, Homo sapiens
agccctcaagttaaatggacttttaacctgtgccttggcatccgcatgtaatagtcacatttaagtttggct

SEQ ID NO: 6865651 - DNA, 86 bp, Homo sapiens
tctgtaaagcagtgttcaggatctgaggccagggagtttgactttgaccagagatactgtttgggagcctagcacatctttgtgga

SEQ ID NO: 6865652 - DNA, 86 bp, Homo sapiens
ggtttttaacaaatatcttcattatgttttgctgacagtaaaaattgtactcacaaaacatgagtgaagggaaaagtaaaaaagcc

SEQ ID NO: 6865653 - DNA, 84 bp, Homo sapiens
ggggctgctttgaggccaattatggtggtaatattttttagtttctctaggaaagttgtttcctaaggtctaaagagctgtccc

SEQ ID NO: 6865654 - DNA, 80 bp, Homo sapiens
gtggcatctcctcccctgcccatgaggagggtggtgctgagtaaaggtagcctctgcgggcaggagatggcagggaccat

SEQ ID NO: 6865655 - DNA, 77 bp, Homo sapiens
tttgctttcctcaggactttcaaatagaaatgttattaaatatttcctttttgtcagtgtttgcacttgaaggtaaa

SEQ ID NO: 6865656 - DNA, 83 bp, Homo sapiens
ggactttgcttcttggaattctgtggctgacccttttcactcttccctgattccgcagacaaagaaaccgtagaagcaagtcc

SEQ ID NO: 6865657 - DNA, 72 bp, Homo sapiens
tggctggaaaagacaaagctattttattggtcaccagctaaactaattccccttgtctttttcataatgcca

SEQ ID NO: 6865658 - DNA, 87 bp, Homo sapiens
atcagctgccagaaagcttccgcttcagtgctttgttgatactggtgtcagcaggacattaaaagcttgaagctttttacgtttgat

SEQ ID NO: 6865659 - DNA, 55 bp, Homo sapiens
aagtggtctagtctgaggattatttttcagtcgaatagcctctaggagactattt

SEQ ID NO: 6865660 - DNA, 57 bp, Homo sapiens
gctgctgtctggtctgagggctcatgctctctgtggtttgagagccgggcagtcagt

SEQ ID NO: 6865661 - DNA, 98 bp, Homo sapiens
gacatatccaagacatcctagccagcaggaatgatattcgaggagatgagtgatttcaacaccaaatgacatcatttttggcatgttgtggtaatgtc

SEQ ID NO: 6865662 - DNA, 79 bp, Homo sapiens
atgctcaggtgccttggctaattgttatctggttattatctatcaaggaacaattactaccaaggcctgtaggaggcat

SEQ ID NO: 6865663 - DNA, 61 bp, Homo sapiens
ggacacagggctcactctctctcctgctccctgggaggcggagaccagagccctgcttgcc

SEQ ID NO: 6865664 - DNA, 61 bp, Homo sapiens
gctaatagaacaataattgtaaacttcatgaaggggtatgtactagttattgttctgaagc

SEQ ID NO: 6865665 - DNA, 59 bp, Homo sapiens
ttttgaactgtggaagagtattctgcatctgcaggaattactcatctgtggtattgaag

SEQ ID NO: 6865666 - DNA, 71 bp, Homo sapiens
cacttgacacagaatttggctatcacatttcagtggattgtggggctgtggagtaattgtgtgtgtatgtg

SEQ ID NO: 6865667 - DNA, 80 bp, Homo sapiens
gagaatgttttcatcatcaaaatagtgaggtctattttaaatagtttggctaattaggtgctgattaaattgcattgctc

SEQ ID NO: 6865668 - DNA, 89 bp, Homo sapiens
ttaatggcatttactggcttacatgcctttctatctccactagagtactatttgcttgagggtagggccgtagggccatgtgttattaa

SEQ ID NO: 6865669 - DNA, 130 bp, Homo sapiens
gggaagcttttaggcatctgatcagagcgggagccagccgggggaccacagtgctggacaggtaacagacatttctcctactgcggtctgtcattctgtctccctttgtagcaagacctcaggggctcct

SEQ ID NO: 6865670 - DNA, 91 bp, Homo sapiens
gaaggaagacaccatgggacaggccagacaggagactgagaattctgaaaccttagtcctcatcttggcttggtccttacggtctaccatc

SEQ ID NO: 6865671 - DNA, 66 bp, Homo sapiens
gtccacagctggccagggcctctcgggcatgtgcctgccacttagtgccttccagttcagtggcac

SEQ ID NO: 6865672 - DNA, 74 bp, Homo sapiens
ccagctccgcaggcttgagggcaggcccagtcacctgcaggcagctgggtctggctgtgagccgggagagctgg

SEQ ID NO: 6865673 - DNA, 63 bp, Homo sapiens
attccagatggcttcaagtaagctgtcagttcacatctggcctcttgaattgccacctggaat

SEQ ID NO: 6865674 - DNA, 66 bp, Homo sapiens
tgtgcaatagcccatatgaaatgatttggtgatttcagtctcattcccaatgggtaaatgttcaca

SEQ ID NO: 6865675 - DNA, 73 bp, Homo sapiens
gtcatcttcgatacttcagggggctaaatcccagcaagaccttgctgaagttcttcccctaatgaagatagac

SEQ ID NO: 6865676 - DNA, 64 bp, Homo sapiens
gatctgggcagcacatcatcgtatccacctcatgcggtatgatgccaagtgctctacatagatt

SEQ ID NO: 6865677 - DNA, 68 bp, Homo sapiens
cacgatgccattcacttaggcacttgcttgttctagaaatatttattaagcactaggtgtggcaggtg

SEQ ID NO: 6865678 - DNA, 55 bp, Homo sapiens
tcagtttaatacccagatgccttccctgtgtccagtgtctgctctgggtatttga

SEQ ID NO: 6865679 - DNA, 67 bp, Homo sapiens
ggtaagtacaaagataaaatctcaccatcttgtgtaaggtgatggatgtgtatctttttatagtacc

SEQ ID NO: 6865680 - DNA, 72 bp, Homo sapiens
atctagagttcttgcttattctttccacaattcatggaaacatgagagattgaattaggagatttctaaggt

SEQ ID NO: 6865681 - DNA, 55 bp, Homo sapiens
ggaaaatactgattcatgccataataatcacatggaagagtcaggccaattttcc

SEQ ID NO: 6865682 - DNA, 64 bp, Homo sapiens
attcatgcaggattgtctccaattctggattgaccatccactggaagcaatcactgtagtgaat

SEQ ID NO: 6865683 - DNA, 64 bp, Homo sapiens
gtgtgatgaggaagtttacaaagcatctgtctgaaatggataattttgagaattttccacacat

SEQ ID NO: 6865684 - DNA, 65 bp, Homo sapiens
ggcaatggtttgatggacaaaatgaactgttagttctattgtcttttctcagatcagtcagtgcc

SEQ ID NO: 6865685 - DNA, 88 bp, Homo sapiens
gttcaccaagagaaccatgtgtttatttcagctcttgctaacagtgcaaaagctctgaaaaagaaaccatggtcatcttttcctgaac

SEQ ID NO: 6865686 - DNA, 68 bp, Homo sapiens
atcgttaatcttgtgtgtcaacttggctaggttacggtttccagtttggtgaaacacaagtttaagat

SEQ ID NO: 6865687 - DNA, 55 bp, Homo sapiens
tacagtggcaagtggatttccagattttaatctgcatccagaggtagccactgtg

SEQ ID NO: 6865688 - DNA, 65 bp, Homo sapiens
aaagtatgtgtaagtatgccaccttctggataacaagagggggtaaagatacttatatgtagttt

SEQ ID NO: 6865689 - DNA, 68 bp, Homo sapiens
tcctggttggcattacttcctcactgccatgatgtgtgataacaggtgtaaagtattcccaaccaggg

SEQ ID NO: 6865690 - DNA, 65 bp, Homo sapiens
ttagccctggcacaggttccaagggggtggaattagaacccatcgtggaacctaggcagagctgg

SEQ ID NO: 6865691 - DNA, 66 bp, Homo sapiens
ggttgaggacaggagccaagaacctcaggccaggctgcctggctggacttggtcctgttttgagct

SEQ ID NO: 6865692 - DNA, 57 bp, Homo sapiens
gtggaagaacaaagaagaatggttctttctggaacctctagtttgttctttgagcac

SEQ ID NO: 6865693 - DNA, 116 bp, Homo sapiens
ctagaagggccttacggggttggaatgggagactttagctgtggccagctcagactccacttgctgggctcccaggggctggacaagcaggtcttcctccccctgtaccctcctgg

SEQ ID NO: 6865694 - DNA, 75 bp, Homo sapiens
gagccagaaactgtggattcattaaattcagttttattctcttcagagtttaatgtttatagtttcattcagttc

SEQ ID NO: 6865695 - DNA, 85 bp, Homo sapiens
aaagtatctcataaaccattaatctcacaaggataaaataaaagataaagtattatccttggtctggtggagttggtggagcttt

SEQ ID NO: 6865696 - DNA, 56 bp, Homo sapiens
ggggcagagtctggactgttgtcttccagctccaagcacagcactccttttgttcc

SEQ ID NO: 6865697 - DNA, 59 bp, Homo sapiens
gcggtggcagggagaagccattggggatttgtcttgctggaaactctctctgccggagc

SEQ ID NO: 6865698 - DNA, 57 bp, Homo sapiens
cttccctcacagtgagtgggttccctgatgcgagaggccctacttgtttgagggaag

SEQ ID NO: 6865699 - DNA, 95 bp, Homo sapiens
ctttggttcttagcattaattttacatgcatttttcattctgaacttttaaacagttttgagaaacatatgagagatttgtgaacaggggcaagg

SEQ ID NO: 6865700 - DNA, 57 bp, Homo sapiens
ctcaggccaataagctccagcccccaccctcaatggcagctggaagaatggcctgag

SEQ ID NO: 6865701 - DNA, 78 bp, Homo sapiens
aatgtggaaatttgagaagaaatagtttgcaattgtgtttactttacaattggccaatgtttctcactgttcctcatt

SEQ ID NO: 6865702 - DNA, 109 bp, Homo sapiens
aaacaatgtgtcttttaggtagtaattaagagaacaatttggctgtatactccaaatcccccaattgtcctaattaattagatttatgcttggaaagatactaatgttt

SEQ ID NO: 6865703 - DNA, 67 bp, Homo sapiens
tgcctcctcaggctgcctggaagactctacacagatatggagaatccttgactcaggctgaggggca

SEQ ID NO: 6865704 - DNA, 63 bp, Homo sapiens
ctctcttggatggtataagaataatagatgaggaagctactattcacctttcatgcaggagag

SEQ ID NO: 6865705 - DNA, 89 bp, Homo sapiens
atgccttgaaaaatgattttgtagctgatgcagaagccgtctgcgtatggctgttctttgcatcagtcctcaataaaatccaagggcat

SEQ ID NO: 6865706 - DNA, 93 bp, Homo sapiens
ggcgcgggcggttggtatcgccagatcttttctatgaaacgcgcacccggcggagtatggatctgattaggggagccagcctcaccgcgagcc

SEQ ID NO: 6865707 - DNA, 55 bp, Homo sapiens
ctgggggcagcaagaagccatgttaggtgaaggaacaaggctgtttctccctcag

SEQ ID NO: 6865708 - DNA, 85 bp, Homo sapiens
gtgtgttaccacctttaatttacaatgttaattgggttattaatttcctaaatctacttttgtagataaagatgtgctaacatac

SEQ ID NO: 6865709 - DNA, 75 bp, Homo sapiens
ggtccagtcagggtgaatctcacaactcttatgtgtatgctggatcactaaaagtgtgtttttaccttctggacc

SEQ ID NO: 6865710 - DNA, 99 bp, Homo sapiens
ccatctgctgagggtgaggggcctgtggtgcgctatttcagacacctgcaggtagactggggtcagggatcagagagctccatatgctcagcctcctgg

SEQ ID NO: 6865711 - DNA, 64 bp, Homo sapiens
gtgtggctgtttagtgactttcccagtgtgctttgctggaaataaagagacaaatggcatatac

SEQ ID NO: 6865712 - DNA, 57 bp, Homo sapiens
caacaggctggccctgggggcccagggttattggggttccaggaacacagcctgatg

SEQ ID NO: 6865713 - DNA, 94 bp, Homo sapiens
tgaatggttacgatgattgttctctgtgcttttgagaggaaggactaagtcctgtgggtgaaagttacaggaaaacagatttcggaccaattta

SEQ ID NO: 6865714 - DNA, 64 bp, Homo sapiens
ggcatgagtcagcgtgctcagcctattattactgtaataatatttgtcatgctgatctatgacc

SEQ ID NO: 6865715 - DNA, 105 bp, Homo sapiens
tttctgatgggaacggaaggtgagctggtcttgagtgtagctgaatctagtggatgacaacttttcacaggctagctctttcttctcttctctgttttgcagaaa

SEQ ID NO: 6865716 - DNA, 82 bp, Homo sapiens
tgtgatagatagctgaccatgaattaagcatcttaatttctgagagtttaccactatttttggtctcacttatctttgtaca

SEQ ID NO: 6865717 - DNA, 75 bp, Homo sapiens
tctgagctgggtattttaagaaaggaaacaataggtttccacaagatgtttcttagaaatccaaatgagcctaga

SEQ ID NO: 6865718 - DNA, 63 bp, Homo sapiens
tcagtgttcgctcagggactccttaggcatcaactgtcaggttcccctggatggcgaaactga

SEQ ID NO: 6865719 - DNA, 100 bp, Homo sapiens
tgagacaaagtctcgttctgtcaccaggctagagtgcagtggcgcaatctcgactcattgcaacctctgccttctgggttcaagcgattcttctgcctca

SEQ ID NO: 6865720 - DNA, 68 bp, Homo sapiens
ctgtaatcccagctacctgggagactgagctgagagaatcactttaacccaggaggcggaggttgcag

SEQ ID NO: 6865721 - DNA, 75 bp, Homo sapiens
cacctgtgctgtctgatggtggcatggaggccgctgggctgaaagaggcctactgagaccacagacagtctggtg

SEQ ID NO: 6865722 - DNA, 66 bp, Homo sapiens
gaatggtggttaagcacagaatctggagcctggctgtctggttcaaacactggcttagccaatttc

SEQ ID NO: 6865723 - DNA, 101 bp, Homo sapiens
agcaagtttttgtttgtttgtttgttcgtttgttttaagtcaagctatcccaactagctgttattggccaaacagagttcaacagacatcatgaatgtgct

SEQ ID NO: 6865724 - DNA, 68 bp, Homo sapiens
taatcttttgattctagggctgtttcttactacctatttggcacagttgtgagaattcaataaggtta

SEQ ID NO: 6865725 - DNA, 59 bp, Homo sapiens
ttctctatctcatggaaaggcagtggtccgtggcattggctactttatgaggttgagga

SEQ ID NO: 6865726 - DNA, 56 bp, Homo sapiens
gcagctcacacagcaagttttggcaaaaaccaatgtcttacttctcgctgggctgc

SEQ ID NO: 6865727 - DNA, 64 bp, Homo sapiens
aatgtttcattcttgcccattgctcctattccctgttaagaatcaagggtaagagtggtatgtt

SEQ ID NO: 6865728 - DNA, 71 bp, Homo sapiens
agggatatctgggctgcagctcggggctcccctcagtcctccagctgccaccagatgttttctaaacccct

SEQ ID NO: 6865729 - DNA, 56 bp, Homo sapiens
agagatcagttaaaatctttttaggacactctctagttaggttgcttctgatttct

SEQ ID NO: 6865730 - DNA, 80 bp, Homo sapiens
tacagtatattgaaaagaattagagatatagcatgagaaatattttatttgaatcctggttcttcagtttaatatctgtg

SEQ ID NO: 6865731 - DNA, 78 bp, Homo sapiens
tcagcaccctgaggcacaggccacgtatacagcaggtggtccttggatgcttgtaggcctggcctcagaggagcatgg

SEQ ID NO: 6865732 - DNA, 86 bp, Homo sapiens
caggggcattgtggcctgtgtcccaccctcaggttactcactggagagtgtgacagaaagtggatgggacccgggacaggcccctg

SEQ ID NO: 6865733 - DNA, 65 bp, Homo sapiens
tcagagtgggtccacagaggtgacagtgggagtcctgctattttccttggtggacccagtcttga

SEQ ID NO: 6865734 - DNA, 91 bp, Homo sapiens
cgagacttaaagaggtctagcaacttgtctttgttgataagtggcaaagctaaaatcaaaacccagacaggctggacttcagagcccctcg

SEQ ID NO: 6865735 - DNA, 129 bp, Homo sapiens
gcccaggcccgtgttcaaagaaacgccttgcccagcccgatgcagccctgccctgagcatacgtgaatgctctgggcttacctgcttcctgctgcctggggccaaggtgtcctcactggctgtgctggc

SEQ ID NO: 6865736 - DNA, 62 bp, Homo sapiens
ctgcccttggaaccgcgtggtgaggcgacctcagcgaggcgagcagcattcggtagtggtag

SEQ ID NO: 6865737 - DNA, 59 bp, Homo sapiens
gatccggtgccagagtgggatcagttctctcagctctggtcccatcctggcttcatgtc

SEQ ID NO: 6865738 - DNA, 80 bp, Homo sapiens
agaactggaatcaggaactcaagtgcattgaggatctctctgcccctcagagctgcttcccagtttgtggtcccgattct

SEQ ID NO: 6865739 - DNA, 72 bp, Homo sapiens
gatgggtgtttctctgtcagtatggaaaggccccaccagcaaggtgggccagcctactgctagacccctatc

SEQ ID NO: 6865740 - DNA, 76 bp, Homo sapiens
acattctggtaaggctattgatgtgaaaaaataacaccatttgtgagacaacagtagcctttacaaggcattgtgt

SEQ ID NO: 6865741 - DNA, 89 bp, Homo sapiens
ttgtgtatggaaacaaggctgttggaaatggtttctatccctgtgagtgataggggctgaagttctttctctgcttttctgatgctcag

SEQ ID NO: 6865742 - DNA, 66 bp, Homo sapiens
ctcacgtttcagggaagccctctccacagttacaggcagaaagggtgggccactgagcagcgtgag

SEQ ID NO: 6865743 - DNA, 84 bp, Homo sapiens
cctcattttaagagttttgatttaatcatacctgcaaagtctcttttgtcttgtaagttaaattcacagattccagggatgagg

SEQ ID NO: 6865744 - DNA, 88 bp, Homo sapiens
ttccctaactgcctaagaagactcagaaattcaccaagaatcaaaggttttctttgaatttctgactgtctttgtcacagccagggga

SEQ ID NO: 6865745 - DNA, 58 bp, Homo sapiens
gtgtgtacactcagacacacatgtagcaaatatcttttctatatttgagtgtgcatgc

SEQ ID NO: 6865746 - DNA, 57 bp, Homo sapiens
catgggggctgaggctgctgtagccctcttttattgctagtctgcctccccaccgtg

SEQ ID NO: 6865747 - DNA, 62 bp, Homo sapiens
gtccctaccctcacgagacttcaagtctactgggacttgagtaagttgaagggaaggaagac

SEQ ID NO: 6865748 - DNA, 57 bp, Homo sapiens
atggcatttgtacaatttaggaataaggtcttaaccaaaagctattgtgcatgccat

SEQ ID NO: 6865749 - DNA, 79 bp, Homo sapiens
tgcataaacagttagatatgtgactagaatttaggatagtagtctagggttgtagatataaattttattgttatcagca

SEQ ID NO: 6865750 - DNA, 103 bp, Homo sapiens
ccagtgtttcccaaacttcttgtacaccagaatcatctagagttgcttttaaaatggcaaattcctgagccctactctagacgaggtgattttgggtcactgg

SEQ ID NO: 6865751 - DNA, 62 bp, Homo sapiens
ccaagtgcccctcattgtgttcatcatcccccaaggctgagcattacctgaggccactgtgg

SEQ ID NO: 6865752 - DNA, 122 bp, Homo sapiens
cactgccatttccatgtgcctgctactccctaacttcagcctggccctgccctcacttctgatggaggagctggagtccaggcaagtaagctggagagtgagggcgccaatggtctggtgtg

SEQ ID NO: 6865753 - DNA, 77 bp, Homo sapiens
cctgaagtattttctgagatgggtggggagctcaggaggaacgggcctccctccaaccttttcagacatccctcagg

SEQ ID NO: 6865754 - DNA, 75 bp, Homo sapiens
cttttgggctgctttggtacatagcaatacgaaaaggctatgtgcttttactccccagagtagcctcttcaagag

SEQ ID NO: 6865755 - DNA, 99 bp, Homo sapiens
catgccaaggggagagtggaaaggtgcacagaggtaaattgcatgtgtgtgtcacacacaggtgtttgttatactcagttatctcacacccatagcatg

SEQ ID NO: 6865756 - DNA, 60 bp, Homo sapiens
gactaagaaaagtgtgcagtccagttgatggcaattgcaacaggtagacttttcctagtt

SEQ ID NO: 6865757 - DNA, 86 bp, Homo sapiens
tcttaattcagggaggttgtagttggaggttgtatagcagatgcatgtgacagcaataactacttaagcataccctgagaatgaga

SEQ ID NO: 6865758 - DNA, 73 bp, Homo sapiens
ctgggacttcgggactcagaaaggtggcagcagaattgttgtggctcttgaggctctcgtgtgatggtctcag

SEQ ID NO: 6865759 - DNA, 73 bp, Homo sapiens
ttcatggtggagcagatttgcttttagattcttgcctcctcaataataacaaagccaagtcagtctactggaa

SEQ ID NO: 6865760 - DNA, 108 bp, Homo sapiens
gggctctattctgcatctttctcactctgtgatccaggctcactgagtcctcatcctttggactatcaccagtcattacagcaggcagaaggaggaatgtgatgactc

SEQ ID NO: 6865761 - DNA, 120 bp, Homo sapiens
ggagactagattagccattgtctgctctggtgcctgttttttccaaagtcattctagtacagagttactgcagagatgaatatggccttgggcaagtcatttagcttttctgtactctcc

SEQ ID NO: 6865762 - DNA, 56 bp, Homo sapiens
tgtagggttcacccagctacctccctttcccgagagttcaaatgggtagattcaca

SEQ ID NO: 6865763 - DNA, 64 bp, Homo sapiens
tccaggaggcagagaaaacttccgtctgtggctctctagcagcagtggaatgtctctgtttgga

SEQ ID NO: 6865764 - DNA, 57 bp, Homo sapiens
atgtcttcattctgtatgtccagttgtataccaaaaactggaagaagggaaggacat

SEQ ID NO: 6865765 - DNA, 111 bp, Homo sapiens
atgacctattataacaataatctgttataatacctaggctcttaatctagctctaagatgattgtggcttgagccagctatgtagcaagaggaattgtaaaaatgggtcat

SEQ ID NO: 6865766 - DNA, 58 bp, Homo sapiens
cggtctgatctggaaatagggcctcaatatgtgccgccagtgtttccgtcagtacacg

SEQ ID NO: 6865767 - DNA, 85 bp, Homo sapiens
ggcatctcaaggaaagtctggagaagaagaaactatttgtggcttaaaacttgttctctttatagggcttctctttgtggtagct

SEQ ID NO: 6865768 - DNA, 88 bp, Homo sapiens
gccagccaggacgcagcagctgcctgcaccttcccaaagctgaggtcaagggctctcagcagtgtgcaggtgtgctggccctcatggt

SEQ ID NO: 6865769 - DNA, 115 bp, Homo sapiens
ggcctcaaaggttccgctctcatgtcggcaagtgtgatttgaattttaaaacactgagctttgccggtggaagagttcccaagtttattccgacctacggaagcccaggaggacc

SEQ ID NO: 6865770 - DNA, 76 bp, Homo sapiens
ggcatctagaaactgtgggcagcttctgggaactgaactcagcttcctgccagtggcccacaaaaaaactagggcc

SEQ ID NO: 6865771 - DNA, 86 bp, Homo sapiens
caatatgtgaggactggactggtgtgcttttgttacatataatcatcctatagattcaagtattcagtttggataattacatgttg

SEQ ID NO: 6865772 - DNA, 63 bp, Homo sapiens
gggtctcaggacagttccctgcaaattccctcttctcggactttgtccaaactgtcctatccc

SEQ ID NO: 6865773 - DNA, 67 bp, Homo sapiens
acattacaatgatgggattcagccatgtcaattcatgtggttgtagttcattcattctcactgatgt

SEQ ID NO: 6865774 - DNA, 66 bp, Homo sapiens
gttattctttagcaacttggatttagccacttaaagaagtagcgagatctatgcctgaagacaaac

SEQ ID NO: 6865775 - DNA, 59 bp, Homo sapiens
ttgaggagggggtgagcaggaagaagggaacatgtcttcataattattccctgcctcaa

SEQ ID NO: 6865776 - DNA, 72 bp, Homo sapiens
tggcagaggagcccacccaggcaccttgtgcactcacagaaatctgggctctgggaaatggtcttcctgcca

SEQ ID NO: 6865777 - DNA, 64 bp, Homo sapiens
taatatcgaatttcatcctgtggtaaaataaaattaggctaccacagggtaaagttagatatta

SEQ ID NO: 6865778 - DNA, 82 bp, Homo sapiens
gggtccatttgtgttcctgtttctgcgtagtttgtagctcatattcagtgcagaaatggggagctcagcagaaagcaagccc

SEQ ID NO: 6865779 - DNA, 67 bp, Homo sapiens
ctgagcccagaagttagaggctgcaatgagccatgatagtgccattgcactctagtctgggtgacag

SEQ ID NO: 6865780 - DNA, 61 bp, Homo sapiens
gttctctgcctgagaacaattttctgattgcagaacagaaagctggagtcaagcagagtac

SEQ ID NO: 6865781 - DNA, 78 bp, Homo sapiens
aatgtaggggtctatcttattttatgccataaaaccagaaatgttacacaaaaataagatatggctgcttttagcatt

SEQ ID NO: 6865782 - DNA, 56 bp, Homo sapiens
ggagctgtcttgtcattttttagagtaaatattctagaaacacatgcaaacagtcc

SEQ ID NO: 6865783 - DNA, 89 bp, Homo sapiens
tgcttttcctcaatcagttttcagggtttctgtcctctaaatatgagaaattatttgaggattcatgaaaatagatttgagaaaaagca

SEQ ID NO: 6865784 - DNA, 81 bp, Homo sapiens
tcagccctgctctccctacctcctctctgctcttgggtggtggcagtcctattggcaggaaccgaggaggggcagggccga

SEQ ID NO: 6865785 - DNA, 58 bp, Homo sapiens
ctgcctagaaaaccaggctcctctgacagacgttgaacttggtatatgtctgggacag

SEQ ID NO: 6865786 - DNA, 88 bp, Homo sapiens
tgacttatccaggtagtggtcatgctggggagcttctaccaagtgacctccaggaactctcagcattgccaaccagattcctaggtca

SEQ ID NO: 6865787 - DNA, 89 bp, Homo sapiens
ccaccacagactcagcacatgacctcctttggaaagtgggtctttgagatgtaattatgaccagatgaggtcatgctgggttaaggtgg

SEQ ID NO: 6865788 - DNA, 67 bp, Homo sapiens
gttagtcagagagctgagatttgaacccaggcagttgggctccagagtccatgttcttgtctatgac

SEQ ID NO: 6865789 - DNA, 66 bp, Homo sapiens
ttctgtcccactggtctgtttgtctatccctgtgagaaccacagagctcaggcctttgagacagaa

SEQ ID NO: 6865790 - DNA, 55 bp, Homo sapiens
gagaggccctgtggtcccagctgaaacattgcagcagacccccagctagccactc

SEQ ID NO: 6865791 - DNA, 55 bp, Homo sapiens
gcaacttgtgactttcaacctgaatgctggccttcaggatgagtcatcaagctgc

SEQ ID NO: 6865792 - DNA, 60 bp, Homo sapiens
accttggcagaggtctgaggtttatctttcattccctgaacctcaagcaacaaccaaggt

SEQ ID NO: 6865793 - DNA, 57 bp, Homo sapiens
ctgtggccctgtggcttcagaacagagccccaccgtgctgtcagcctagggccagag

SEQ ID NO: 6865794 - DNA, 77 bp, Homo sapiens
gagattgtttttgtatctgtcatatagttttaagtggttgaagtttataggactttcttcagatgagatgcaatctc

SEQ ID NO: 6865795 - DNA, 84 bp, Homo sapiens
cctagattaggaagtagataggttgttctctgctgtcattgtttggacacagctctatttaccttatttattgttcctgctagg

SEQ ID NO: 6865796 - DNA, 82 bp, Homo sapiens
gctttcaagaacttccctgagactgggtaatttataaacaaaagaggtttaattgattcacagtctgtagggctggggaggc

SEQ ID NO: 6865797 - DNA, 68 bp, Homo sapiens
gtgggcacatagttttatggtcagaatcctagttatgtggatttttatttcttgtctatgtagccaac

SEQ ID NO: 6865798 - DNA, 57 bp, Homo sapiens
aggcagcatgctctgcttctaccaataaagcactgctaagggcaggggctgctgttt

SEQ ID NO: 6865799 - DNA, 84 bp, Homo sapiens
atcagtcaggagctctctgagtggctgtactttctgcttgtataaaaagggaagatgcccaacccagctttgcttcctgttggt

SEQ ID NO: 6865800 - DNA, 91 bp, Homo sapiens
ctcaggtccccaaatcatggtctttgttctgcactattgtctcagctaaatgtggattaatagacacaaccaagctgattttggattagag

SEQ ID NO: 6865801 - DNA, 56 bp, Homo sapiens
ggtgggggcatatcctatcctccctggcagcaggatagggtggggacgttctgact

SEQ ID NO: 6865802 - DNA, 73 bp, Homo sapiens
gtcctgcaagtcctgacagctcatttacagggtgttaagtgccagtgtttggcagtcagcatttgtagtatgc

SEQ ID NO: 6865803 - DNA, 77 bp, Homo sapiens
gcagcggaccctgagggagctgctggccttggagccgggtgtggcctaccagcacgccttcctctacatccgccagc

SEQ ID NO: 6865804 - DNA, 62 bp, Homo sapiens
ctcgacatggtggtggtttaattctggcgccaaacaccacaactggagccaccctgtgcgag

SEQ ID NO: 6865805 - DNA, 62 bp, Homo sapiens
gttatattgggcagggaagccagtgtttggatgggtattgggatttcctggcccatgggaac

SEQ ID NO: 6865806 - DNA, 72 bp, Homo sapiens
acacattatggacatgagtcaaggtgctgttgcgttttggctgcaagagtttggctcaagtctgtatcaggt

SEQ ID NO: 6865807 - DNA, 75 bp, Homo sapiens
ggatatgaggagtgggtggtggcagctgttcttaggtgtggttctagaaacctccatttattcactctcctatcc

SEQ ID NO: 6865808 - DNA, 61 bp, Homo sapiens
gcagaccgctgtgcccgtctcagtctggaaggaccaaggagatgagtgggcaccagcgtgc

SEQ ID NO: 6865809 - DNA, 56 bp, Homo sapiens
aatgaggccagtagaaggaagtggattccccactgcaacttgctgagggcctcatt

SEQ ID NO: 6865810 - DNA, 59 bp, Homo sapiens
attgaggcagcatagttcaggggctctaagaaaagtttctggaacaaggctgcttgggt

SEQ ID NO: 6865811 - DNA, 55 bp, Homo sapiens
actgctgatttagctttgtgggcccactaatggcattattgtccacatcagcagt

SEQ ID NO: 6865812 - DNA, 66 bp, Homo sapiens
ccataacttaatgaaggtattacaaaagcataaagccacagacgaatatttctcataaggttatgg

SEQ ID NO: 6865813 - DNA, 89 bp, Homo sapiens
ccaggactattttaaaagtctctctgagtaaaagtgacaaaatactgcatttcttaaaacttcagggagaaataatgaatctgttatgg

SEQ ID NO: 6865814 - DNA, 84 bp, Homo sapiens
tctctgactttatatggttgcttgtttatttacgatctgccaccaactagagtgtaataagggcaagggctttgttgtcagaga

SEQ ID NO: 6865815 - DNA, 78 bp, Homo sapiens
ggtagcatgtagtcagagtatgtcaatgttcttttccttggaaatacatcacttatgaaatattcttttgcatgagct

SEQ ID NO: 6865816 - DNA, 130 bp, Homo sapiens
cccgcgctctgggcgcgcgccgtctctggggtgcgcgggggtcctcaggcaggcgggggacgcgcgctccgcgccgggaagcagagactcgttggcttcgcagagcgagcggcgacgcccccgggccggg

SEQ ID NO: 6865817 - DNA, 86 bp, Homo sapiens
gtaatcaaactgcctttactagccatgtgtgagaagagctatttcttattctcttttaagcctctggcatagggaggaatgaatat

SEQ ID NO: 6865818 - DNA, 55 bp, Homo sapiens
gggagcttctcgcttggcagctggtttatggtacacttttgaaaagtaagctccc

SEQ ID NO: 6865819 - DNA, 69 bp, Homo sapiens
agtactgtgcagtgttgtaacccgaatactttgctggtatgtgaagtttttgaaatattgaacagtgct

SEQ ID NO: 6865820 - DNA, 84 bp, Homo sapiens
tggctcacgcctgtaatcccagctacttgggaggctgaggcaggagaatcgcttgaaccaggaggtggagattgcagtgagcca

SEQ ID NO: 6865821 - DNA, 119 bp, Homo sapiens
gccgggaaggcattaaaggaagggggattaatcaagtcaagcaagtaagagacatgtttactttgctcatattgagtttcttagttctctaattcacactaccttaaaaccttcaaggc

SEQ ID NO: 6865822 - DNA, 70 bp, Homo sapiens
tctgttggtttgctctgtgtttgtgaggcccgccaggcactgtggggggtaacacagggttaccatcaga

SEQ ID NO: 6865823 - DNA, 61 bp, Homo sapiens
agtgtctgcctgggaggagcatatctcatacccacagggagagtttctcaaggctgacatt

SEQ ID NO: 6865824 - DNA, 56 bp, Homo sapiens
gaatgttctgaggaatcagagaccattcagatatgatctttgtcctccaggagttc

SEQ ID NO: 6865825 - DNA, 81 bp, Homo sapiens
ccgctttccctctggaccacctcccgctgcgtttcctactcagagaaacagcaagggcggggtcaagacacgggatgacgg

SEQ ID NO: 6865826 - DNA, 71 bp, Homo sapiens
agataactcaaaatgcacctgctgaacccactgcatctctttcggtggcttccaggtgtgtcttggtttct

SEQ ID NO: 6865827 - DNA, 69 bp, Homo sapiens
atattccttggtagggacaactctgaggcatgtgctacattgtcacccagaggtccccactgggaatat

SEQ ID NO: 6865828 - DNA, 55 bp, Homo sapiens
cttctggaagcttttggagagaatccatttctttgcttttctcagcttctagcgg

SEQ ID NO: 6865829 - DNA, 78 bp, Homo sapiens
cttttgtagtcagtaacgtttcgtatcagttctttgcaatatatgtgagaatgggtggatgatgagtgactacagagg

SEQ ID NO: 6865830 - DNA, 101 bp, Homo sapiens
gtttttcataaattctcataaattgagattattagggtaatttaaatctggagtccgggttttacctaaaatagctcaatttagggcaatttaataaaaac

SEQ ID NO: 6865831 - DNA, 67 bp, Homo sapiens
agattctaaatgagatgtacataactcactgaaagcgccagtgggtatgttgatttcatttatgtct

SEQ ID NO: 6865832 - DNA, 69 bp, Homo sapiens
tgagggagctttttcatgtgtctatagcatgttctggatgtaatgggagtgaggcagagtctatcctca

SEQ ID NO: 6865833 - DNA, 65 bp, Homo sapiens
gtggcactgatagtttcactcttcttcttaagaaccttcagaagagtgaaaacaaaataggttac

SEQ ID NO: 6865834 - DNA, 129 bp, Homo sapiens
atttgggtgcagttcacttgctaggaaggaggaagccacccagctttgatagaccccaaacgcctagaatgagacggtttattcaccgcaggtgcttccctctggaaccttgctcacacacacctaagt

SEQ ID NO: 6865835 - DNA, 65 bp, Homo sapiens
gcttccaagctcacccacatggctgttagcaggcctctgcttctggctagctgtgggctggaagc

SEQ ID NO: 6865836 - DNA, 74 bp, Homo sapiens
ttaggtttcagacatactgagtttggggttcttgagacatagattccaaatggagatgtccacttggaagttag

SEQ ID NO: 6865837 - DNA, 106 bp, Homo sapiens
ttttccattgtcagtgtgatcctggttatgctcctccagattgtgagccgccaatatcatcaccaggaggaagtgttaatgatggattttagcttacggtagaaaa

SEQ ID NO: 6865838 - DNA, 129 bp, Homo sapiens
gcagctctccaaagacgcaccaaggctgacctgacttcctctgccctcagcccctcgcatcctgccactctgctgagatgctgctccacaggccagggcagccttgggagcgggtacacagagacttgc

SEQ ID NO: 6865839 - DNA, 56 bp, Homo sapiens
aaaataggaatgtggtcctgggaatttaattattcctacaataaaattcctgtttt

SEQ ID NO: 6865840 - DNA, 58 bp, Homo sapiens
gccaataactgccatttgcttttctgaatccatagttgcattaaaagcagttgttggt

SEQ ID NO: 6865841 - DNA, 77 bp, Homo sapiens
cctgcctgccaggccattcccagagttgctctgtcctggacagcttggcagctgtgaagtgcctcacacagtgcagg

SEQ ID NO: 6865842 - DNA, 55 bp, Homo sapiens
tgagaaagatgtctaggaaatatgcccatagtttctttcttgaacatgtttctca

SEQ ID NO: 6865843 - DNA, 56 bp, Homo sapiens
ggggttaccaaccagaacaactacatgggagctcctatgtatctgcttggttcctc

SEQ ID NO: 6865844 - DNA, 74 bp, Homo sapiens
gatagtggcgcattgtttacatggctgtgctgattgcagcagccactgtgcaggagcagtgtagataccgcatc

SEQ ID NO: 6865845 - DNA, 68 bp, Homo sapiens
cactgcagaggtggggtgcagagggcaccgtgcctttgttagttgtgccccaccgtctcctccatgtg

SEQ ID NO: 6865846 - DNA, 81 bp, Homo sapiens
gctggccagccctcgggttctgggagctctgaccttcaggattgctgaggccaaagcacagagctggaagggcaggcctgt

SEQ ID NO: 6865847 - DNA, 56 bp, Homo sapiens
actctcaatgtggttaatccaaaggaaaaacctgcatttgattagacactgggagt

SEQ ID NO: 6865848 - DNA, 90 bp, Homo sapiens
gcagtttatgagacaccttgagggctgagaccatgtttgtcttgtgggcaagacatgcataggagaagtctttataagtgagatgagtgt

SEQ ID NO: 6865849 - DNA, 129 bp, Homo sapiens
tgcacgatcctgcttcccagctggcccccctgctggccccactcctgggtgcatttctgattctgttctgagtctccagcctgcccagagtgggcaccagtagagctgatgggaagcgaggcatttgca

SEQ ID NO: 6865850 - DNA, 82 bp, Homo sapiens
ggtggaacccggagcgcacagggtctgggtattgtcagatgactgtcaagtccatgttagatgctggcgtttccttctcccc

SEQ ID NO: 6865851 - DNA, 103 bp, Homo sapiens
ttgagacggagtctcgctctgccgcccaggctggagtgcagtggcgcgatctcggctcactgcaagctccgcctcccgggttcacgccattctcctgcctcag

SEQ ID NO: 6865852 - DNA, 74 bp, Homo sapiens
aagtatatatatgtactggctaaagacctatccaaaagaggaaatatttctagaaagttcatgtgtttatactt

SEQ ID NO: 6865853 - DNA, 61 bp, Homo sapiens
cagcacagtgtagtaagtttggaacaagacacacctgaaatcaaatccctgctctgtgctg

SEQ ID NO: 6865854 - DNA, 61 bp, Homo sapiens
tcatctgggccatcagaggggctggaagtgttcagcttgtatgatatgtggcctgagatga

SEQ ID NO: 6865855 - DNA, 83 bp, Homo sapiens
ttcctgtccatttgtccattattatccttgagaggctaacatgttctagtctccaaggagaaatgggcaacagggcaaaggga

SEQ ID NO: 6865856 - DNA, 82 bp, Homo sapiens
gggctggatcttttctgcacaaattaatcagttaatgcatagaaagcattcaactagtgattgtgttataagagatctgctc

SEQ ID NO: 6865857 - DNA, 67 bp, Homo sapiens
ggaaggaggagcggaggcttgttgcttggacactgccaggctgctctgtgttctgttcctcttggtc

SEQ ID NO: 6865858 - DNA, 129 bp, Homo sapiens
tgatagtatttcattaagttttttgccaggagtaagtgagttaatgtgtctgacacaatgggtctggcacacaaggcctatgcatatattgattactgtttcagcctcagaactttaagaagtattaca

SEQ ID NO: 6865859 - DNA, 62 bp, Homo sapiens
gtttctgtgcatatgcatttatatacataattataatgtgtttttgtgtaaatgctagaaac

SEQ ID NO: 6865860 - DNA, 84 bp, Homo sapiens
tcacattctcatttccatgcctaagagcctgaagcttgaacaaagggcttcagttagtttcatgtgagccaaaatggaatgtga

SEQ ID NO: 6865861 - DNA, 56 bp, Homo sapiens
ggcagagcattcgatggacctggttattcatcatccatattccattgtgctttgtc

SEQ ID NO: 6865862 - DNA, 126 bp, Homo sapiens
aacattttattcagttaaattcaggcttgagtcatttagatcatcagtattttgaggtaaacaactcatttctgtaagactgatgatctaaatgactcaagactgaatttagctgaataaaatgtt

SEQ ID NO: 6865863 - DNA, 88 bp, Homo sapiens
tcaggattatgcaaggacttattacagtgtaaacatgcttgccattttggctgcctgtcaaacgtaatactattcttagtgatgctgg

SEQ ID NO: 6865864 - DNA, 129 bp, Homo sapiens
tgttcgcatttcctcgagactcttactgaattaatatgtctctggctagacattacagatttttgtaggaataaaatgatctggctcaggatatcattgggaaatgagttcagcaagtgccagattaca

SEQ ID NO: 6865865 - DNA, 67 bp, Homo sapiens
attcctctaaactgtgctgtaatctagagtttctcaactttggcactattgacattttgggcgggat

SEQ ID NO: 6865866 - DNA, 58 bp, Homo sapiens
gtcatttccctctcatctctattattacccaggtgaaaggagatcaaagggagagaac

SEQ ID NO: 6865867 - DNA, 66 bp, Homo sapiens
tgtattttaatagggcaataaatctgctttgggttgcaggatcactcagtgttctgttggaaagca

SEQ ID NO: 6865868 - DNA, 72 bp, Homo sapiens
cggaatctttctccagagctgcttatttgccaaatgaatataattggcataaagcctgcaggaaagatcttg

SEQ ID NO: 6865869 - DNA, 130 bp, Homo sapiens
ttcctgaaatactttatgtctcctccacaccatggagaacagttctgtgttggtgagaagcaagccaaggcagaagatggctcttgtgtggtgcagtttacaaaagagagacaaaatttgatagcagcca

SEQ ID NO: 6865870 - DNA, 58 bp, Homo sapiens
gtgcaggctagatccttcctacacctgggcttgtgggtgcaggaattggggctgtcac

SEQ ID NO: 6865871 - DNA, 76 bp, Homo sapiens
actgttctaggtgctagggacaaagcagtgaatataaaaaggcaaagtgttcaaagcattagcatctatggggagt

SEQ ID NO: 6865872 - DNA, 71 bp, Homo sapiens
cccccaaaccatcagtgagccccttgatgagcagggctcttgccacttcatcagggtggtcagtcgggggg

SEQ ID NO: 6865873 - DNA, 60 bp, Homo sapiens
agattagggtctgtgtctggcgtctaagaatcccacagcaccaacagccaccctgactct

SEQ ID NO: 6865874 - DNA, 79 bp, Homo sapiens
gccctatgatttttcagggagagaaatcacagctctatgccaggaggtgatttctaatcatctgaatgttgtaatgggc

SEQ ID NO: 6865875 - DNA, 83 bp, Homo sapiens
ttttgagcagcgtattgcatggaagctgaaaaagacacggttagtagccgtatgtctgggtttcttaatacgttctctcagaa

SEQ ID NO: 6865876 - DNA, 102 bp, Homo sapiens
ccttcagttttttgaagcagcatgtgtcaaacttgtgatgaatcagatttttatattcagaatcagaatcagttgacacagctgatgtcaatgctttgaggg

SEQ ID NO: 6865877 - DNA, 94 bp, Homo sapiens
ttttgaaatgagagtggacagtaatttcaaatcaatggggaaagaatcaaatcttcagcaaatggcttgagataattagctacacatttcagaa

SEQ ID NO: 6865878 - DNA, 78 bp, Homo sapiens
cctgcctgttcctggtgctgcaggtgtatcatccttaaatccaaaccacatgggcagagagtagaggcaacgggtagg

SEQ ID NO: 6865879 - DNA, 88 bp, Homo sapiens
agaagctttaggtgcttagctttttacatttaagtttatgattgatttttagttaattatggtgtgtggttaagggatcaaagctttt

SEQ ID NO: 6865880 - DNA, 59 bp, Homo sapiens
gatttcccagcaaaagctggtttccctcctccaaaaccagcttcctgcagtgggaggtc

SEQ ID NO: 6865881 - DNA, 67 bp, Homo sapiens
gtgtatacaatatgctgccatgtattattacaagatgaaaagataacatacttgcatgtgtatacac

SEQ ID NO: 6865882 - DNA, 68 bp, Homo sapiens
tgagtttgaggctggattgaagaaagggctgatggagttggcttattgagtttacagctttagaaaca

SEQ ID NO: 6865883 - DNA, 61 bp, Homo sapiens
gaagcatggagaccgtggtgatagttgccataggtgtgctggccaccatctttctggcttc

SEQ ID NO: 6865884 - DNA, 72 bp, Homo sapiens
aatccataacttgctttggagcccggcctcagagatttaaataaagtgccggagggaggcaagttgtgtttt

SEQ ID NO: 6865885 - DNA, 66 bp, Homo sapiens
gttttctctgtgttttgtccagtttttagttgtaatcagcaggattttgacatagcaagacaaaac

SEQ ID NO: 6865886 - DNA, 76 bp, Homo sapiens
ggtctgacaaagggtccttcttaatcatacatgaatttgtgtgcatgacaagtttaaatgtacccagtgtcaatcc

SEQ ID NO: 6865887 - DNA, 59 bp, Homo sapiens
ggacagcgtggctggtggagggaccctgcctggcaccggcttccaccatcactctgttt

SEQ ID NO: 6865888 - DNA, 82 bp, Homo sapiens
cattatctcctgtgggtcaccaataggcacaaagaagcagtctgttactaattggtagcctagtggttccaggaagttaatg

SEQ ID NO: 6865889 - DNA, 77 bp, Homo sapiens
ggttcaagaaaggtcattgattttcagtttgtccaacttttatttgttggaaggactggagtgatgactctcaagct

SEQ ID NO: 6865890 - DNA, 60 bp, Homo sapiens
tctgcagaaggaatcagctgagtttggagactattttgatatcctgattccctcttaaga

SEQ ID NO: 6865891 - DNA, 77 bp, Homo sapiens
tggtgcttcaatttatgacttttggggagtgggcaggacacaattcagcccataccagaagtggagttgctaaacca

SEQ ID NO: 6865892 - DNA, 74 bp, Homo sapiens
ataagatttcagggagggacaattgtcacctttgaagaatcaaagtgaccaatgggcttccctcagtattttgt

SEQ ID NO: 6865893 - DNA, 126 bp, Homo sapiens
gattttagatacttcaaccttaagttgatattatgtaactgtggttcagcagagataagagcaggagatttttttgggatcattatgcatagtgtacattggcttttggtgggggtacttagaatt

SEQ ID NO: 6865894 - DNA, 70 bp, Homo sapiens
ggacatgtgacccaagattgtcctggcatttaaccctgcccctgggatttgaatcttgagttgagtgacc

SEQ ID NO: 6865895 - DNA, 71 bp, Homo sapiens
ctctaggttgtgatcctccacacaatagcctcaatccgcttgtcaggactatgtgggagggacaaggagag

SEQ ID NO: 6865896 - DNA, 74 bp, Homo sapiens
ctggggtgaggtcaaggtcaagagacagagtagaaagacaattttagctttggctattttaatttcatactcag

SEQ ID NO: 6865897 - DNA, 70 bp, Homo sapiens
gggtcacatgcagtcactgagcagggacaccagatgctgggctggaccctctttatgctgcttgtgactc

SEQ ID NO: 6865898 - DNA, 55 bp, Homo sapiens
tgagcaggactcactgcagcctcaaattcctggggtcagcgatcctcctgcctca

SEQ ID NO: 6865899 - DNA, 61 bp, Homo sapiens
cctggagcccaaggcagtgagaggcaggaggtaaactgagtcccagctctgaggctcgagg

SEQ ID NO: 6865900 - DNA, 63 bp, Homo sapiens
tgataaggcaaatgtgttcttttagttcccgtcaggaggaaggatcagaacagtttgcattca

SEQ ID NO: 6865901 - DNA, 59 bp, Homo sapiens
ttgagtcattattccagtgtgttgaacatttgctattaaaatactgggcagtgacttga

SEQ ID NO: 6865902 - DNA, 121 bp, Homo sapiens
aatagtcattagtcaacttttgttgtgtcattgaaattctaaacggcttcacaggaatttaacaaatttaatttgagtcttggaagttttttacaacaaggatgaaaaaagattgattgtt

SEQ ID NO: 6865903 - DNA, 106 bp, Homo sapiens
gtccctgtgtggagtcagttctttatgggtgcctgcaggtgccggcttcacagtaagaaaactgtcagcttcgcctgaggtatgggcacagaggtgacgcagggat

SEQ ID NO: 6865904 - DNA, 83 bp, Homo sapiens
ttcataactatcagtcatgtgaaatttggcaggcccctagcccgttagtggccacagtcacatgattgattaccggttgggga

SEQ ID NO: 6865905 - DNA, 56 bp, Homo sapiens
agggctggtatgtccatgaaagtcccatggtggaaggactctcaggggctagccct

SEQ ID NO: 6865906 - DNA, 75 bp, Homo sapiens
aatcaggacatgttccttttcatctttgcctcccataattttctttggtagaggtcttatcaaacatgcttgatt

SEQ ID NO: 6865907 - DNA, 59 bp, Homo sapiens
gtcccaggcttatgtggagcttaattaatgttcattgagtgccatttgcttctggtgac

SEQ ID NO: 6865908 - DNA, 78 bp, Homo sapiens
gtgtatggcaattctaactctctccaccttcactgcctactcacagccgtgtgctggggaccagattagaccatggac

SEQ ID NO: 6865909 - DNA, 70 bp, Homo sapiens
catattgttgtagagatgggatcatagtatacatagtgttctgtacccaacatttttactccataatgtg

SEQ ID NO: 6865910 - DNA, 65 bp, Homo sapiens
aaccccagtactgtgactcagtgagggcccagttaggagattacaagacacagtgctgaagggtt

SEQ ID NO: 6865911 - DNA, 59 bp, Homo sapiens
gcggccgtggcctcagccctgcggaggacctcctgccgcaagtactgctgcctgtccgc

SEQ ID NO: 6865912 - DNA, 77 bp, Homo sapiens
ctttgctttctttcagttcatctgtgaagattaaattagctattattattctagttttacagatgagaaaagtgaag

SEQ ID NO: 6865913 - DNA, 60 bp, Homo sapiens
catctgcttggttcctccaagtgcacattatgcaagtgtatttggatagacagggagatg

SEQ ID NO: 6865914 - DNA, 66 bp, Homo sapiens
ccacttaaaaagaatgaactgtttatgaaagaaaccttttgaaagacagaatatttttgcctgtgg

SEQ ID NO: 6865915 - DNA, 111 bp, Homo sapiens
tcctgcttccagcctttccatgagggacactggatgctgccattggctccctgcattgccttatttcagcacctgtggctcatgctcgtggagctggggctggttgtgggg

SEQ ID NO: 6865916 - DNA, 59 bp, Homo sapiens
atcacacacttcagatgtaatttgttgcctgaagcaacaaaccactatcaaggtgtgat

SEQ ID NO: 6865917 - DNA, 80 bp, Homo sapiens
ggtagcagagagggagtcccaggcagccgagccggtagtgcccagcccagcctaccacagctcctggccctctgagcatc

SEQ ID NO: 6865918 - DNA, 77 bp, Homo sapiens
atgttttatgccaaggatcaatatgtatatttaatagaaattgggatatttaactattctttggcgatctgaaatat

SEQ ID NO: 6865919 - DNA, 67 bp, Homo sapiens
tgatgaatcttgggaattttccaggagtgacaagaaaattattactccctccttcccagcttcctca

SEQ ID NO: 6865920 - DNA, 67 bp, Homo sapiens
gtgtggcttgctctatgaagttctttggcaatatgcagaactggagtattcaaaaggcaagctatat

SEQ ID NO: 6865921 - DNA, 68 bp, Homo sapiens
gagaatgagtcagagctggctgaggtcttcgccttgattcatgaactcaacagctctcgacttatctt

SEQ ID NO: 6865922 - DNA, 59 bp, Homo sapiens
gcaggctcctgagaggcagaggctgcgggagtgcagctcttcagtcctcgggagtgtgc

SEQ ID NO: 6865923 - DNA, 80 bp, Homo sapiens
gtagactatcaaaagttctatgtaatgttttttgtattgctataaacaaatagtgcatgggaatttatatgacagcctgc

SEQ ID NO: 6865924 - DNA, 87 bp, Homo sapiens
tcaatctacatggggagaagcagcagacctgattttgaaattgaagaagggcaatttgaggacaggctgattgtatatcttggttga

SEQ ID NO: 6865925 - DNA, 130 bp, Homo sapiens
aggcagccatggccaggctgggctggaagggtaagggcgtgctctggactcgtggcacagctgctgggatgtgcgtgatggaccgggcctgcccgcttgcccaccccctgcccacactatgctgctgcct

SEQ ID NO: 6865926 - DNA, 129 bp, Homo sapiens
gaaccagcatcaggaagggaaagggagaattcagggatcaaactgtaaagagttcttgtagctttgagattcagactcgtttgcacacaaggcttttatgatttttctcctatttttctttctagcttt

SEQ ID NO: 6865927 - DNA, 77 bp, Homo sapiens
gatgtggtttaaataacatctcgtagtcaaaaaccattcattccctaagactatatctccagtgtttaagccacatt

SEQ ID NO: 6865928 - DNA, 74 bp, Homo sapiens
tcgcttctgtagtattcttttggtcacagaggtcagcttgattcagtgtgggaggaaactacagaaatgtgtga

SEQ ID NO: 6865929 - DNA, 61 bp, Homo sapiens
agtcgtacgttgaggcaaagaggctggtcctttgaaccctcttgccaatcagctacagatt

SEQ ID NO: 6865930 - DNA, 61 bp, Homo sapiens
gtgaagggctttggttccatttaaaaagtagaatactctaaaagtggtcacagtccttggc

SEQ ID NO: 6865931 - DNA, 70 bp, Homo sapiens
gctatactacatcacagccaagaagcggctagctgcagcagccaaagatttctctgggtgatgaggtggc

SEQ ID NO: 6865932 - DNA, 69 bp, Homo sapiens
gagaacgggaatagggaataggcagaactgagagtataatgacatctctgcttccctgttctctctctc

SEQ ID NO: 6865933 - DNA, 59 bp, Homo sapiens
ctgttgcctcttggcagtcaccaatctggggttcatatattctgcacaagagacaatag

SEQ ID NO: 6865934 - DNA, 59 bp, Homo sapiens
ctgaggtctgcagggctgtgcatacgatctgagccgtactgaaaggccaaggacttcag

SEQ ID NO: 6865935 - DNA, 71 bp, Homo sapiens
gagaatgaggcagcatcacttgtctccagcagatatgtctgctaagaaggtctgatctgatctcatgtctt

SEQ ID NO: 6865936 - DNA, 59 bp, Homo sapiens
ggagttggtggcccggaatctctctgggatttctggagttccctggagcctccaactcc

SEQ ID NO: 6865937 - DNA, 88 bp, Homo sapiens
tgaagaaatgcaggtgggtcagcattagcaatgactggttcttcattagcactagctatgaagcaaatgctgtaccctatcttcctca

SEQ ID NO: 6865938 - DNA, 57 bp, Homo sapiens
gggctgtttgcaggaggcgtcagtgtttagcaacgtggcctctctaccaggcagcct

SEQ ID NO: 6865939 - DNA, 106 bp, Homo sapiens
caggggagcttgttaaacacgcagctccctgggcttctccagacttgctgtatcagagcttctggggatggagcccagaaatttgcatgcttgacaagtttccctg

SEQ ID NO: 6865940 - DNA, 57 bp, Homo sapiens
acctgagggaaggcagtcagttggtttgtgtctatcgtggcctgccatcccttcggt

SEQ ID NO: 6865941 - DNA, 130 bp, Homo sapiens
agggagtgtctggagggaagagatgtcaggctgacctagactagatgtcctttattccagtgactgctattgtggatctggctctgtctggtctgctctggctaggatcatttcctctgagggtctcttt

SEQ ID NO: 6865942 - DNA, 62 bp, Homo sapiens
tcccctccaccagagcagctcctttgctcagtgaagagtaaagcagcgtgggtggggcagga

SEQ ID NO: 6865943 - DNA, 63 bp, Homo sapiens
tcacctgcacccagtcacctgcagggtttgatgctgcctccagggcagacggggagcatctga

SEQ ID NO: 6865944 - DNA, 66 bp, Homo sapiens
agcctaagacaagttgtactcaagcctgcctaatatccaaggctgtgctcttaacttttttgggct

SEQ ID NO: 6865945 - DNA, 58 bp, Homo sapiens
atgtaccaggaatgttttcaccactgtaaataatgccgcagtgggcatccttggacat

SEQ ID NO: 6865946 - DNA, 63 bp, Homo sapiens
ggcaagggttgaagataaataaggtagcaacgtctactttatatttttggccctaactatgcc

SEQ ID NO: 6865947 - DNA, 118 bp, Homo sapiens
gattgttgattaaaaaccatgtcacattcattgtgcttgtaaggtttctctccactatgaattacaaggtgtgaattttgaccttttaattacaaggtgtgaattttgaccaacggtc

SEQ ID NO: 6865948 - DNA, 79 bp, Homo sapiens
gggaaggggcggggctgtgagatctgtggtgtggtgctgaaggagctgctgcctcacagcctcatgcccagcccgtccc

SEQ ID NO: 6865949 - DNA, 65 bp, Homo sapiens
cttctttctattgatctaataaacatcacatagcacagtgatggttgaagaccagtggaaaagag

SEQ ID NO: 6865950 - DNA, 66 bp, Homo sapiens
gggggtagatatctttggggttccttttataagggcactaactcgcctcatgagggatctgccctc

SEQ ID NO: 6865951 - DNA, 60 bp, Homo sapiens
caaagaaccaggccaatggagagaattcagtggaagtttcagacatagcctgattctgtg

SEQ ID NO: 6865952 - DNA, 85 bp, Homo sapiens
tctattctgttctattggtctatgtgtctgcttttatgacagcaccatgctgttttagttactatagctttgtagtagattttga

SEQ ID NO: 6865953 - DNA, 120 bp, Homo sapiens
cctgacctcgtgatgtgcccgactcggcctcccaaagtgctaggattacaggcgtgaaccaccgtgcctggccaatttttgtatttttagtagagatggggttttatcatgttggccagg

SEQ ID NO: 6865954 - DNA, 70 bp, Homo sapiens
gggagaggccaggagagaggtctagtgaagttccttccggagctaccctgggaatctccctcactctgcc

SEQ ID NO: 6865955 - DNA, 67 bp, Homo sapiens
aagacattttgcaatgggtagcttagaatctggtatccaagaacagtgacccatttcagggtgtctt

SEQ ID NO: 6865956 - DNA, 73 bp, Homo sapiens
tcccacttagtttttcagaattctacacagcttttcctcatgaagatcaagtgtcattctgtgaatttaggga

SEQ ID NO: 6865957 - DNA, 126 bp, Homo sapiens
gaccagggcctctagcttggaaatggaggccattcctgccctggctctccactagtttaatcctttagattggcatgtcaggtagacacctgaatcctccctttttattcgtccctcaccctggtc

SEQ ID NO: 6865958 - DNA, 64 bp, Homo sapiens
tagcttcatgtattgtctctgcgttgttctattttaatagttgcatatggagacaataaagcta

SEQ ID NO: 6865959 - DNA, 79 bp, Homo sapiens
gtgtcagagcctcagttcagtttccatagttataagaagtggagataaactgtgaaaggcttaacatagcgtctgacac

SEQ ID NO: 6865960 - DNA, 76 bp, Homo sapiens
agggattatgaagttgagggaccctgcactgggggctgggggctctcttaggatccatcacacttccatagtccct

SEQ ID NO: 6865961 - DNA, 69 bp, Homo sapiens
tgcagttacacagccagggagggacagaagcagaatctgaacctctgcagcctggctgtgaagcctgca

SEQ ID NO: 6865962 - DNA, 71 bp, Homo sapiens
tgcttagagtattcttgtatttatagttttctctatgaagggaatgagtattctttataggattctgggca

SEQ ID NO: 6865963 - DNA, 66 bp, Homo sapiens
ctccttaatgtcttaaagtcgtgttacaagaacatcttgcagttcgtagttcagacagctagggag

SEQ ID NO: 6865964 - DNA, 72 bp, Homo sapiens
ggcactcactaatactcatattaaatgggttcaaataccaagtttgagtctcattaattatgaatgactgct

SEQ ID NO: 6865965 - DNA, 75 bp, Homo sapiens
aaaatagggagaagggagtgttttcttgatagtgcgctgtggcattgttcagagtagggctctgtgacctgtttt

SEQ ID NO: 6865966 - DNA, 63 bp, Homo sapiens
ccctcttctacattcttgagctgacctagaattagggttccccctttggcaatgagaacaggg

SEQ ID NO: 6865967 - DNA, 108 bp, Homo sapiens
tggagattctcagaggcattcccagcagctccatcatggcagcagcagtgaccattggggtcatcttgaaaccagatggactgtttgcagtctcagtgagagttctca

SEQ ID NO: 6865968 - DNA, 57 bp, Homo sapiens
cagcaatatacacagtctatgggagacattttctctatgggttaaagtaagttgttg

SEQ ID NO: 6865969 - DNA, 59 bp, Homo sapiens
agggcatggaaggaaaaagtcaggaggcaagatttctctttatttccagtccaggtcct

SEQ ID NO: 6865970 - DNA, 82 bp, Homo sapiens
gtgactgaatggagtttgaacaatttcctggggtacaatgcattatctcttcccgattttgtggcaaattcttcttaagcat

SEQ ID NO: 6865971 - DNA, 127 bp, Homo sapiens
atctgggtggaggcagggaggtggatagagtgagtgagtttctcctgtagtctggaggaaatccccagggcaggagaaagactcaccatactcacttttctattctaaccttgaaaatctcccagat

SEQ ID NO: 6865972 - DNA, 82 bp, Homo sapiens
taggtaacctcaagcagtgacgttatatctgaaaaaagtgactgaggttcacttttaagtaggcagcgtgctttgaggcctg

SEQ ID NO: 6865973 - DNA, 75 bp, Homo sapiens
tgtgcctgtcccgcattctggtcacatatgagccttctgctcttttgcaaagactgaattgatgggatgggctca

SEQ ID NO: 6865974 - DNA, 78 bp, Homo sapiens
ctgactcgaatgtagtatttggaaatgtaaaatgacttctattacattattacatttttgaaaactacttgaaagcag

SEQ ID NO: 6865975 - DNA, 67 bp, Homo sapiens
tgtgaccttgaccatttcccccaccattaagatcttggaggtcaaagggtgagatggcaggattgca

SEQ ID NO: 6865976 - DNA, 61 bp, Homo sapiens
tggggatgcagtcagagcccctgtgcggctttaccagcatacgacctcctattgcccccca

SEQ ID NO: 6865977 - DNA, 70 bp, Homo sapiens
tggcataatttcagtcttattttgttgatagctgttgagcattttgtcctgcagaataagttgagaacca

SEQ ID NO: 6865978 - DNA, 110 bp, Homo sapiens
ggggcacacaggatttcaatagaaattgcatgcctttttagatgtgcaaatgtttcattaagcgtatgaatatttgaagagatgtatgacactttgaaaactgtttcctc

SEQ ID NO: 6865979 - DNA, 56 bp, Homo sapiens
cctccccgtgtctgtctgcaccaggagcacctgggactgggaaggtcaaggggagg

SEQ ID NO: 6865980 - DNA, 55 bp, Homo sapiens
cagggtcctttgccaacacttggatggctcacagtccaggctggaaggggcgttg

SEQ ID NO: 6865981 - DNA, 84 bp, Homo sapiens
ctgaagaagaactgggcagtgggcaacaagagctggaaagaacctttccagcctttctactcactgagaaacaggcctcttcag

SEQ ID NO: 6865982 - DNA, 57 bp, Homo sapiens
gcttcagcccatatggactcactgaagagtcaccaaagagtccttatgggctgaggt

SEQ ID NO: 6865983 - DNA, 79 bp, Homo sapiens
atctccatgcgtgtaggaacagtgtctatcttatcagtatattccctctgtctagtagagtgtccaacacataggagat

SEQ ID NO: 6865984 - DNA, 63 bp, Homo sapiens
gctccatgctccatatggatattctttggaaacaaagcatttttgaaatggtaggattggggc

SEQ ID NO: 6865985 - DNA, 106 bp, Homo sapiens
gaagacatgtaaagaaataagaaagtgtgaccaatacttgggaggaaaaagcagtaaatagaaacttttgagtaggcttatattttggttttattagatagacttc

SEQ ID NO: 6865986 - DNA, 93 bp, Homo sapiens
tgtaaacaacattgaagcatggagatgaggcaaggaatagtactcactgaagttgaaatgactgcccacttcaaaatcttcattgtgtttaca

SEQ ID NO: 6865987 - DNA, 59 bp, Homo sapiens
ttatttgttttccatctgggactggcattcagagacccagagaggtaaaacagccttga

SEQ ID NO: 6865988 - DNA, 69 bp, Homo sapiens
gagcagacactgagcattttcctagctctctgctgacacagagcagtcgctgatgctagtgttcttttc

SEQ ID NO: 6865989 - DNA, 83 bp, Homo sapiens
ggtagcaggcaggcagaggagaatgatcttcccatttcatggcatggaagaaggaagaaatgctcttctatgcgccagctgcc

SEQ ID NO: 6865990 - DNA, 56 bp, Homo sapiens
gagttataacctagtttaactggatttagaaaactggttaaactaggctacaactc

SEQ ID NO: 6865991 - DNA, 79 bp, Homo sapiens
tggatatatgcatgttatcatttttcagtggatattttgctactgtgaagatcaagtgttggctaatgtatgtaattca

SEQ ID NO: 6865992 - DNA, 77 bp, Homo sapiens
ctgccatttactagcatgccagggaactatggatgagttagaactcattcccccataatggtattttaatgttgtag

SEQ ID NO: 6865993 - DNA, 61 bp, Homo sapiens
tcctcacaagcaagcacaggtagtgggctccaggagccgaggcagagctgttctgtgggga

SEQ ID NO: 6865994 - DNA, 56 bp, Homo sapiens
tgaagtatagcagatgttatttaattcaacctattaggtagatactgctatcttca

SEQ ID NO: 6865995 - DNA, 111 bp, Homo sapiens
tgatttctttctgtggccaactattcagcttaatatattaaaagccattattagaggtttttgaaagtccttcttgagttacaaatagttggatgaatgctttagaaatca

SEQ ID NO: 6865996 - DNA, 63 bp, Homo sapiens
agtgtcagtgtgagataatcttggagaacaggcattttaccaggaattattttacattttgct

SEQ ID NO: 6865997 - DNA, 61 bp, Homo sapiens
ggctgccaaagtcagacctaactccttcccaggaaattcttggctctgcttgtgagcagcc

SEQ ID NO: 6865998 - DNA, 66 bp, Homo sapiens
gattagatacatgactcacacattctgcagtcgtattttgcagtaaattgagagtcatgtttgatc

SEQ ID NO: 6865999 - DNA, 60 bp, Homo sapiens
gccgagcttgccccacgtcaagcacctgctcaggggaaaggggcgtggagcgggctcggt

SEQ ID NO: 6866000 - DNA, 99 bp, Homo sapiens
ttcaagagagtttccaattagttcagtcatgaccatggggtggaaccagtccgggcttcctcttctaatgattagatctgaaatgatgaagcctatgaa

SEQ ID NO: 6866001 - DNA, 71 bp, Homo sapiens
ggagcacgtggtggccgtggaggtagtccaggccttgtagcagctgcaccatgtaagtggccacgtcatcc

SEQ ID NO: 6866002 - DNA, 87 bp, Homo sapiens
tgctgttccaaactttttccttcagggcagtattttctgaaatctattaggctacttctagagggacaatcgttttggtaagcagca

SEQ ID NO: 6866003 - DNA, 84 bp, Homo sapiens
gggtgaaaagggggatttaatatctgttactggaagtatctggcttcagaagtggtattaattagatttcagtctttttcactc

SEQ ID NO: 6866004 - DNA, 130 bp, Homo sapiens
taaagaatcatgtgcacagttgttaaaatatacagattcctgggccccaccccgcagatacttgattgccagctccagggtatgggcctgagaatctgtcttttagggaagctttcagatgatgttgtga

SEQ ID NO: 6866005 - DNA, 99 bp, Homo sapiens
ttgctgtgttcagtgggttacttttggagaacatgatatgctctagggcccacatgttaccttgttctccaaaaatagcatttcctactcattaagcaa

SEQ ID NO: 6866006 - DNA, 74 bp, Homo sapiens
tctgagtggccctgagccctttgacagagtcccctttgggactacacgctgtcagacgtgcagggctggacgga

SEQ ID NO: 6866007 - DNA, 73 bp, Homo sapiens
tgcccacacgtccttcccacagatgctgtccagagtattgtacactgattgtagtctgtggtggcggttggca

SEQ ID NO: 6866008 - DNA, 58 bp, Homo sapiens
cagggtttttcacaagtcaaggatggcttgaccgacctgagatctgtaagggaccttg

SEQ ID NO: 6866009 - DNA, 62 bp, Homo sapiens
gtctggagttcttatatggaggctggctttcccccagagtgagcatcacaggagaaccaggc

SEQ ID NO: 6866010 - DNA, 71 bp, Homo sapiens
gctgtgaggtaacctcaaaggcaaagtcgttcaaatgactggttttccaggttacttcttaatggtacagc

SEQ ID NO: 6866011 - DNA, 104 bp, Homo sapiens
aacaaaaaagagaatatataattttttggccacatccttttgagtattggcttttaaaatttagaactttgtttgccaatttactaatatattaatattttgtt

SEQ ID NO: 6866012 - DNA, 74 bp, Homo sapiens
actgtacatcctggtttcagactttgttgtgaacacagatttcatttcaagttctgacagctagtaaactcagt

SEQ ID NO: 6866013 - DNA, 96 bp, Homo sapiens
gctacctcatgttgctccgggggactactgggaaactgctgatggaacttgagtcagtagaacacttgaccactgctccctacagctccatgaagc

SEQ ID NO: 6866014 - DNA, 56 bp, Homo sapiens
taagcattaactctgctgcaaggtctgtattttaactttgtgcagatgtgtgctta

SEQ ID NO: 6866015 - DNA, 123 bp, Homo sapiens
atgtgttaaaaatggcatttgttatcagtcctccaggtgttacatatgactcccagtcacacttagatgacagtatatgtgaaagatgcttaggagaggcaagagtctgaaaggccaacatat

SEQ ID NO: 6866016 - DNA, 77 bp, Homo sapiens
gggaaggagagggacttagtataaatgtctcagctagttaggtgtgggacaaggactagctccaatgtctcctgact

SEQ ID NO: 6866017 - DNA, 85 bp, Homo sapiens
acaggatacattcagtgagcatgccttctcagttctgtttcctcccaggagacacacacaggaggtggcaaagctgaacacctgt

SEQ ID NO: 6866018 - DNA, 71 bp, Homo sapiens
cttgctcttgtgtgctctgtggatctgagcaagctgcatttaagtttgacacacacagacacacatacaag

SEQ ID NO: 6866019 - DNA, 67 bp, Homo sapiens
ttaaggccattttaacttttttgttgagatgttaatgtcaacaaaacggttcaaatgaaggtcttga

SEQ ID NO: 6866020 - DNA, 62 bp, Homo sapiens
ttccccaggggctcctgcctttggattcaggccccccacagcgcaggagcttccctggggaa

SEQ ID NO: 6866021 - DNA, 71 bp, Homo sapiens
ttgtcattagctgagatggggagggctgcagaaagactaggttttgaatgcagaagccctattctggacag

SEQ ID NO: 6866022 - DNA, 94 bp, Homo sapiens
agttttgttatccacttgggcttagaaggtaagtgagctttttacccttgtagtcatttttacttatttttataagtacaatacctaacatact

SEQ ID NO: 6866023 - DNA, 82 bp, Homo sapiens
ggaaggaaagagaagtatgaaggcgagagcccactactagctcatggtagaggagtaaatttcgcctccactcctgccttcc

SEQ ID NO: 6866024 - DNA, 65 bp, Homo sapiens
gtcattacttaaacccagattattatagactgttctctaatttttctgtctggttttagagtggc

SEQ ID NO: 6866025 - DNA, 68 bp, Homo sapiens
tggagagaagaggccaagccagactgtgcagtcctgactgcatgatcctagtggggcctttctcttca

SEQ ID NO: 6866026 - DNA, 85 bp, Homo sapiens
atgcagtgctttgattatatgtaaatgatgacacaagatccccactcattgtgcatattaggtacatgctaattctcaccagcat

SEQ ID NO: 6866027 - DNA, 83 bp, Homo sapiens
gagttgacaggctccaagaagtcatctaaactgtccctcctgacaggaagccacagtgaacaggtgacttggatggtttactt

SEQ ID NO: 6866028 - DNA, 90 bp, Homo sapiens
ttttgacacagcaggcatttgatatatatttcttgattaaatgaaagattaaatgaataccatcttagatgtctgcatagtgctttaaag

SEQ ID NO: 6866029 - DNA, 61 bp, Homo sapiens
ctcaaggcacttttcctgagatgatgatttaaatttatcatgctctcctggggtccttgag

SEQ ID NO: 6866030 - DNA, 58 bp, Homo sapiens
tagtgactgaccagatagaagcctttctactaaggcttgcattttattttcagtcctg

SEQ ID NO: 6866031 - DNA, 59 bp, Homo sapiens
cattgtctggtaggaagtgggccggaacacattcgagtcattatcctctttagatattg

SEQ ID NO: 6866032 - DNA, 68 bp, Homo sapiens
cttacaagggagcctgagtgacaactccggaggccagccattgagagattaccacgcttcctgagagg

SEQ ID NO: 6866033 - DNA, 68 bp, Homo sapiens
gtttaatgttcatttagttctttcatgtccacttactgtggaaaagaatgactgagatgaatggtgac

SEQ ID NO: 6866034 - DNA, 70 bp, Homo sapiens
ctaaaggcctttcttatcagtagattctcctaagcatttatgagtgtaacaggatggaataggcctgggg

SEQ ID NO: 6866035 - DNA, 100 bp, Homo sapiens
gaatggaattgctgtttaggcaagtgtataagtgtctttcccattagcagtggcatgtaatacatttgcttgactatagaaaataaacaagtttccattt

SEQ ID NO: 6866036 - DNA, 68 bp, Homo sapiens
ggtatttaaggtgggagagcagcacttgcttcagggacacccaggagccttgggcgctctcccatccc

SEQ ID NO: 6866037 - DNA, 85 bp, Homo sapiens
atctgatgtcctgcaggctgatagaggattccattgcagacctgatctctatgtggaattggaaatcagcattgtagtttcaggt

SEQ ID NO: 6866038 - DNA, 90 bp, Homo sapiens
gcagatgaggaagccagaacatgaaggagcttggctattattataatatcatgcttaccattttcaaagcttccctgttcattaattagc

SEQ ID NO: 6866039 - DNA, 56 bp, Homo sapiens
cttggccgtttcactgggcagttaataatcaagttaattcccagaaacagcacaag

SEQ ID NO: 6866040 - DNA, 82 bp, Homo sapiens
ttttatttgggccactctgggcatcaccagcagctttattctccaaagtgtgactttgcagtgagctccttggcccacagaa

SEQ ID NO: 6866041 - DNA, 81 bp, Homo sapiens
gaattattttgatagctgttgccaatttccatggtgtaaatactcccaccgtggccagtttcaagctaccaacatgatgtc

SEQ ID NO: 6866042 - DNA, 59 bp, Homo sapiens
cagcagctcactcaggtggctctacagcatcataggcccactttcctggtgagcagctg

SEQ ID NO: 6866043 - DNA, 66 bp, Homo sapiens
tgaagggggtgctggtggtagagtggaatcggcttctaaatttactaagtacttgtatccctttta

SEQ ID NO: 6866044 - DNA, 85 bp, Homo sapiens
ggttttatattgagaaatgttttttaagctgaaaataaggtacaactttagcaacataagaaacattttgttcatggacaaggcc

SEQ ID NO: 6866045 - DNA, 64 bp, Homo sapiens
cgcctggccacctgggcctgggtcttgagggcaggccccagcttcaaccccgtggtggtcagcg

SEQ ID NO: 6866046 - DNA, 57 bp, Homo sapiens
gtgttcaaggttaagtgcttgcctaagatcacttagacagagctgggatttgaacac

SEQ ID NO: 6866047 - DNA, 74 bp, Homo sapiens
ggccaatgcccttttaacattgcactgctagtgacaggtgcagacagtagcacaatgtgaaaagagctctggcc

SEQ ID NO: 6866048 - DNA, 70 bp, Homo sapiens
gggtggcatggggagcagctagaacaatgcagatttatccacaatccctttctgctgttcaccaccaccc

SEQ ID NO: 6866049 - DNA, 90 bp, Homo sapiens
cacacaaaaagaccagaaggaaatgtgagcagtgggagaatgggtaagtttcattgttcctttccatttctgagtttctaattttctgtg

SEQ ID NO: 6866050 - DNA, 106 bp, Homo sapiens
atgaatgaaccatgaggacattatgctaagtggaataagccagtcataaaaagacaaacactgtgtgattccacttatatggggtacctagaatggtcaagttcat

SEQ ID NO: 6866051 - DNA, 59 bp, Homo sapiens
ccgaccctgggagcccagacccctcccagaaggtccggtcccctggcccccagcgtcgg

SEQ ID NO: 6866052 - DNA, 71 bp, Homo sapiens
agtttaagccctggatagagagaactgcagtaagatttcaacatgcttcttgaccttcagggtttttgact

SEQ ID NO: 6866053 - DNA, 56 bp, Homo sapiens
cggtgagcacattcggagtggctccttccccacccactgctgactgggcctcaccg

SEQ ID NO: 6866054 - DNA, 66 bp, Homo sapiens
aacaggattcaggttttccctcctgggatgttcaggggcgggaggagggaagcatctgattttgtt

SEQ ID NO: 6866055 - DNA, 63 bp, Homo sapiens
gttgcctttatcttgggccaagtttctatcctggaagaggaaagtaagagatgaagttgtaat

SEQ ID NO: 6866056 - DNA, 57 bp, Homo sapiens
gaagttcctcgtaggagtctctaactaacatgttcaagatcttaatgccaggaactc

SEQ ID NO: 6866057 - DNA, 96 bp, Homo sapiens
gcgggcgcgcggaactgggaatttggcgcttggagctgcggccccgcgcttcgcagtccgggagctcgtgcgcccaggtgccctgacgctgcccgc

SEQ ID NO: 6866058 - DNA, 58 bp, Homo sapiens
ccgattctcctaagaaccacgatgtgaggctgcacgattgtggacctgggacagttgg

SEQ ID NO: 6866059 - DNA, 65 bp, Homo sapiens
gcggctcatcccagatggctgtggggtcaagtacatccccattcgtggccctctggataagtggt

SEQ ID NO: 6866060 - DNA, 55 bp, Homo sapiens
tgtggagatgtgagcaaggggatacagatcatgttttccttccctttctctgaca

SEQ ID NO: 6866061 - DNA, 72 bp, Homo sapiens
gaggaacccagctggggttgccgactgaaacatctacacttggcctctccatgaagctgcttggacttcctc

SEQ ID NO: 6866062 - DNA, 124 bp, Homo sapiens
tcccctgcactgtcctcgccatgcacctgggagagcagagaaccctctttgtaaggcaaaccagcctcaagaggaggagactttgaaggctccggctgtatcttcaggactttgcagcaaggga

SEQ ID NO: 6866063 - DNA, 74 bp, Homo sapiens
cttccatgtatctgctgcacagattgccttttactcccaatatactggggtgctgttgcctggctgcacggaag

SEQ ID NO: 6866064 - DNA, 59 bp, Homo sapiens
gcctttattttcaacggagtgttgccataatttaagcaaatattctgaggaatgagggc

SEQ ID NO: 6866065 - DNA, 69 bp, Homo sapiens
attataaattcagcatccagtgtcctaaaggaaatctgtttcttctgacactgatgctgtaaggatagt

SEQ ID NO: 6866066 - DNA, 64 bp, Homo sapiens
gtcacagacaggtcaggaatttgattgtttaacattcctcagaatttatggccttcgtcttgat

SEQ ID NO: 6866067 - DNA, 67 bp, Homo sapiens
cctcgctgacctcagggatctctctggcctgcagctccgctgtgggcagggtctgaggccacagagg

SEQ ID NO: 6866068 - DNA, 73 bp, Homo sapiens
catagcgcaaccactgtgctgagcaaatccatctgtggagacaggggtaattagttcagcatatgctgctgtg

SEQ ID NO: 6866069 - DNA, 66 bp, Homo sapiens
ctttccagtttttgtctcttgtcctgtctagggaaaaacaaagaggcataaaatttatatgggaag

SEQ ID NO: 6866070 - DNA, 64 bp, Homo sapiens
gagctgtccaagatggtcgtaatatattgttcataataaccgtgcttggctagcttggcagctc

SEQ ID NO: 6866071 - DNA, 57 bp, Homo sapiens
atttagacaatctgttggtaaggtgtaaactatggacctgccatgaatgtcataaat

SEQ ID NO: 6866072 - DNA, 100 bp, Homo sapiens
gaggcaggagaattgcttgaacccgggaggcggaggttgcagtgagtcgagattgcaccattgcactccagccttggcaataaaagcaaaagtctgtctc

SEQ ID NO: 6866073 - DNA, 66 bp, Homo sapiens
acatttaagaaaatctctgcaaatcagtagcttactaccaagctaatggaacagagatgtcaatgt

SEQ ID NO: 6866074 - DNA, 122 bp, Homo sapiens
atgccgcccaaggctcgctgagaaatctggctccacacagtgggagaacccagggtcaggcttactgtgagtgaggccggcccagtctttcccgagccttcctcagggagacctgggggtat

SEQ ID NO: 6866075 - DNA, 55 bp, Homo sapiens
tgggcgccgtgactaaggctcctgtcagcgtctgcgtggagcccacggcgtccca

SEQ ID NO: 6866076 - DNA, 55 bp, Homo sapiens
gctccctgctgggagatgaccttatttcctgatgggtcccaggccagctgggagc

SEQ ID NO: 6866077 - DNA, 71 bp, Homo sapiens
agagatgtttagatgtttgtccaaggtcacacagctagtacctgctggagcagaaatttgaagccatgtct

SEQ ID NO: 6866078 - DNA, 64 bp, Homo sapiens
ttcactactgtggaacaactgatttagccaggctagaacatatgaattattctacattagtgaa

SEQ ID NO: 6866079 - DNA, 55 bp, Homo sapiens
ggaagcctaaagcccaggtctcctctctgagggaagctggtggctctagccttct

SEQ ID NO: 6866080 - DNA, 92 bp, Homo sapiens
ctggctgtaactgagatgctgctctgtaaagtgatgaggccggggaggccacatctgctctgggcagcactcgcagagctgttgcagcacag

SEQ ID NO: 6866081 - DNA, 105 bp, Homo sapiens
ctgcctgcttcccttactcttccaacaaggttctaagctctgaaataaatctggatatatcttctgctttttctatatttctactggggcctggaacagcagcag

SEQ ID NO: 6866082 - DNA, 65 bp, Homo sapiens
gcactgagggttggcgtcacaagtagaagcaccactttcagcccagcgcaaacaactggcagtgc

SEQ ID NO: 6866083 - DNA, 77 bp, Homo sapiens
tgcaaatgatctatcagttttgggggacatactgactcaatgaagatccagtgttgtctttcaaaatttcatttaca

SEQ ID NO: 6866084 - DNA, 100 bp, Homo sapiens
ctgcccaatctcttctccctgcatagttcaccgctgatacctgtttccccaacttcacttggtagcaaaggatgactatgtaccaggaattgacatgcag

SEQ ID NO: 6866085 - DNA, 68 bp, Homo sapiens
gctccagctccctgtctctggggtccatgcctgtcatggccaaagccacagcagaggaatgctcgggc

SEQ ID NO: 6866086 - DNA, 60 bp, Homo sapiens
ccctggcagctggaagttctatctttagtctgacctgaatctctccagttgctttcaggg

SEQ ID NO: 6866087 - DNA, 70 bp, Homo sapiens
atatcacagatgcagaaagagaaagagcttgaaatgggcttgaacacagttctttctgaatctgaagtat

SEQ ID NO: 6866088 - DNA, 64 bp, Homo sapiens
ttggttagtaactaagagaggcacccttggcaatttcacaaagtgtctaactggttacttctga

SEQ ID NO: 6866089 - DNA, 58 bp, Homo sapiens
ttcatcatctacaaccaggaccacaaactagggtgcctacatgggtgagactggtgaa

SEQ ID NO: 6866090 - DNA, 74 bp, Homo sapiens
cgggcccctgggggccggtctagggctggggaggctcaggccccctctccttgcacccgtcccgcaggagtctg

SEQ ID NO: 6866091 - DNA, 76 bp, Homo sapiens
tgttttccaaattagaagctgttagcaaaatatgtcactatatcattctgctgcctagtttatgaattggaagaca

SEQ ID NO: 6866092 - DNA, 96 bp, Homo sapiens
aaacagctttgacagaatttcttttgaggtggtccaaagactgttttctggaacataaaaagcatctatattccactgtgattttgttaactgttt

SEQ ID NO: 6866093 - DNA, 55 bp, Homo sapiens
ggtgaagcgtatttgtggagcttttaaaataggcccatagactctttagtttccc

SEQ ID NO: 6866094 - DNA, 60 bp, Homo sapiens
tatcgtttgtttgatttttctaaagcatgaaaaaggtacagaaatatcagagagatgata

SEQ ID NO: 6866095 - DNA, 55 bp, Homo sapiens
ggagtgccctgtgaactgtaaggaatttcagtcccttcattcacagaggcatatc

SEQ ID NO: 6866096 - DNA, 86 bp, Homo sapiens
tctggccccactgaaagcttgaaacctaagtcaggatgttaacagacaaggcttcccaattaacaggtatcaggcatcaggctaga

SEQ ID NO: 6866097 - DNA, 57 bp, Homo sapiens
tgaaccctgacctctggaaggagactgtattcaccaagtctccctatcaggaattca

SEQ ID NO: 6866098 - DNA, 59 bp, Homo sapiens
agcaggggcagggctggggatgcaagaaagcaggctgggtcccaggctgggctccagct

SEQ ID NO: 6866099 - DNA, 58 bp, Homo sapiens
ggctaatctcttcttaatgattacaaaatggacattaatcaggagctgaggtttagcc

SEQ ID NO: 6866100 - DNA, 68 bp, Homo sapiens
tgattctcactgaaaataattttgtcccatagaggagggtactaaaaaatgatcagtttggggagtca

SEQ ID NO: 6866101 - DNA, 64 bp, Homo sapiens
gagtgcagggcttttccactccagtgcttgcttttgagcctgggacccttagctcttggcattc

SEQ ID NO: 6866102 - DNA, 66 bp, Homo sapiens
ctggaggcattaattattaccagttttgaaaagaactttgcttggtgtgtacatttttgcttctgg

SEQ ID NO: 6866103 - DNA, 56 bp, Homo sapiens
ggtctcagcagttgctttgactcctgggtaatctgaatcacaaagctgccggggcc

SEQ ID NO: 6866104 - DNA, 58 bp, Homo sapiens
tagttcccaggtaaggagaaggcagctggcagatttagggcaggcctcttgggaatta

SEQ ID NO: 6866105 - DNA, 74 bp, Homo sapiens
gatttctggaattggatcctcactgtggtgtgacagaaccatggtcaagtttatgtgtgggtctactagaagtc

SEQ ID NO: 6866106 - DNA, 76 bp, Homo sapiens
ctggcttcctttctaaaatgatttctgctgtttccataactgaataacagcacagcaggatttgaaaggaagagag

SEQ ID NO: 6866107 - DNA, 64 bp, Homo sapiens
tgcagagcttcattgcataggcgtcttttagtggagaaaacagttactatggtgatgctttgta

SEQ ID NO: 6866108 - DNA, 129 bp, Homo sapiens
ggacttgccacggtccctggtcttggtgggctgggcgtggagctggaatgatgtgaggctctccaggggagcagggacacacactcatatatgcacagcctgcccaggctgtggggtgtggctcggtcc

SEQ ID NO: 6866109 - DNA, 63 bp, Homo sapiens
tccccacttcccaggcccctgccctggggattccaaagcagcggattgggatagtgcctggga

SEQ ID NO: 6866110 - DNA, 80 bp, Homo sapiens
cttgatggatggtgcctggcagggtcagctgcttggtgcaggttcctgtgcccatgtcatggtacgtgctgtccgctaag

SEQ ID NO: 6866111 - DNA, 92 bp, Homo sapiens
caggccactcactcagtccctggcacataataggtggccagtaaatggcagttcccattattgttagtgacagggtgaagactagaaccctg

SEQ ID NO: 6866112 - DNA, 68 bp, Homo sapiens
aggaagctgttctgaatcagtaagtatgattttttaacacaatgattcacaagcagcacttatttcct

SEQ ID NO: 6866113 - DNA, 72 bp, Homo sapiens
gcctgtgtggcaaggtgagaagtgggcagggtgaggagcggccaacccaccattgttttgcctggcataggt

SEQ ID NO: 6866114 - DNA, 57 bp, Homo sapiens
actccctggcaggtctttatctgacatcgtttggaaatggtgatctgccagtggagt

SEQ ID NO: 6866115 - DNA, 58 bp, Homo sapiens
aactgtgcctttcacttgcacttgactgaaaacacccagaagacagaaaggcacagtt

SEQ ID NO: 6866116 - DNA, 106 bp, Homo sapiens
tgcagattgtattttgcatagtgtgtaatgccaggggctgctattcacataggttataagaatgccaccccatggagttgtacggtgtgttgcctgcataactgca

SEQ ID NO: 6866117 - DNA, 80 bp, Homo sapiens
tcatagtgtgatggtttaaaagcctggatactatcattaaattgattaaatttgattctagctttgccatttaattgtga

SEQ ID NO: 6866118 - DNA, 73 bp, Homo sapiens
gctgctgtgagttttagcttgtgttgaatatcttgggaaaatgagcccagaacacaaagctgattccagtggc

SEQ ID NO: 6866119 - DNA, 109 bp, Homo sapiens
ttccctggagatggcagtgggggacggcggagcccgggccacactttcctcccgtaacttatcccagggaaagatgttgctgctccgccctcctcccttctcccgggag

SEQ ID NO: 6866120 - DNA, 79 bp, Homo sapiens
cctgcaggcccctgtgtcttcgtggaggggtttggggtggtggacccacagccttgagcgaggacaaggcctggctagg

SEQ ID NO: 6866121 - DNA, 81 bp, Homo sapiens
agagaatggagtttggggtcaaatactcacgggttccttcggttattagtttgggatttgctttgtagaggttcattctct

SEQ ID NO: 6866122 - DNA, 59 bp, Homo sapiens
cagggagtggggaatagtgtggtgtctcttgaatgccgcctggtttctccgcccccctg

SEQ ID NO: 6866123 - DNA, 130 bp, Homo sapiens
tcttctctgttccctggaaatctttctgaagtactgctcctaacccttggtccctggggtttctccccctcctgaggccagtgtgggagtagttctttggaaagctggcggggaatagcaatagtgaaga

SEQ ID NO: 6866124 - DNA, 55 bp, Homo sapiens
tcttaggttctggaggtcagaagtctgaaatcggttttctggtctggaatcaagg

SEQ ID NO: 6866125 - DNA, 79 bp, Homo sapiens
taagaggtaaggtatagtgaacaagagcaaggacctagaaacccaaccatcctgagttcaagttatgcctttaccctta

SEQ ID NO: 6866126 - DNA, 77 bp, Homo sapiens
agtaggtagaattgagttggaagtttaagaaaacccaatcaaggtcatcaatgagcagttcgacttcttccccaact

SEQ ID NO: 6866127 - DNA, 69 bp, Homo sapiens
tttaaaacaggcttgcaacatgttttcttaagtaatagctagaacaaatcgatggaagcctggcttaga

SEQ ID NO: 6866128 - DNA, 98 bp, Homo sapiens
gcatacagtgcttggaccagcacctgataggcagtaaactccaaatccttatttgctgttactcttattatgtggtccttcttgggctctcagtgtgc

SEQ ID NO: 6866129 - DNA, 76 bp, Homo sapiens
aattgagatgccctgcatgagtcctgcttaagtgtaaagaaattggtagtagatatggatgtagttcaactcagtt

SEQ ID NO: 6866130 - DNA, 70 bp, Homo sapiens
tggcctctggaggtggccagtggtgtggcagctacagtcttcatcattgaacacttcttcctggaggcca

SEQ ID NO: 6866131 - DNA, 73 bp, Homo sapiens
atgggggaaatattctgaaataggaaagcaaatggtgatttatcatgttccagatatcagatttttaccccgt

SEQ ID NO: 6866132 - DNA, 82 bp, Homo sapiens
tcagagcacttgtgatgtgctcagagatgatattaaatgttttatatcattttggccatgatacagacacatttgcctctga

SEQ ID NO: 6866133 - DNA, 56 bp, Homo sapiens
gcatgacagtcgaaaggttaacttctgagaagttacaactttcctgtgtcaaatgc

SEQ ID NO: 6866134 - DNA, 90 bp, Homo sapiens
tgccttttttttacatctgtatttctgctttctctagtacttcaactctgctaagaagttgctgggaagtggcaaatttgatgtggggca

SEQ ID NO: 6866135 - DNA, 68 bp, Homo sapiens
ataacaatagtggtagtgctggtcatagtgatgaagaagaaacaagagcagcagctaccacttgttat

SEQ ID NO: 6866136 - DNA, 57 bp, Homo sapiens
ttttaaggtgcttactgtgtgtgttgtatttcatttccacagtattcttccttaaaa

SEQ ID NO: 6866137 - DNA, 83 bp, Homo sapiens
actgtttcatgcatcatagaaggaactgggagatagcatggttaaacatctataccacagtttctcctactgagcaaattagt

SEQ ID NO: 6866138 - DNA, 60 bp, Homo sapiens
gccatggcctccttctcctggccacaggcatgctctgctcctgagccagggaggccatgc

SEQ ID NO: 6866139 - DNA, 87 bp, Homo sapiens
taccagactgctaggaatagctgttaaagtcaattttttatgtcaaaatgttttaaagctattcgtgaatagattaagcctctggta

SEQ ID NO: 6866140 - DNA, 93 bp, Homo sapiens
tagatggctctgaagatactcttcaggtcttgcagaccctccttcacccctgggacatatctcaagatctcaagatggccccagaaccctcta

SEQ ID NO: 6866141 - DNA, 55 bp, Homo sapiens
gcactcacttatttctaacagaagctaaaaagctgtctgagcgagaaagtagtgt

SEQ ID NO: 6866142 - DNA, 68 bp, Homo sapiens
ctttgttgtgcctgagtgcaccatagattacaaaaatgcaaagtgctgtagtcaggatacaaacaaag

SEQ ID NO: 6866143 - DNA, 55 bp, Homo sapiens
tcctcatctgtaccttggggtaaaaattcccacaccccaggggttgtggtgagga

SEQ ID NO: 6866144 - DNA, 55 bp, Homo sapiens
attcagctgtcaccagttcctagaatcagagttaaagctaggtgaccagctggat

SEQ ID NO: 6866145 - DNA, 55 bp, Homo sapiens
tggaacagaggatgtttgaaattcagaattcacttctgaattatgccttgttcta

SEQ ID NO: 6866146 - DNA, 55 bp, Homo sapiens
ggttagagggcatgcgatcttttcttacatgattatgatctcatgtgctgtgact

SEQ ID NO: 6866147 - DNA, 98 bp, Homo sapiens
gcagtataatcatcggaactcttgactttatgtcaacttgcctcagcgtggcctgctcaaggcagaagcatgcagtcaaggagagggtgattgtctgc

SEQ ID NO: 6866148 - DNA, 58 bp, Homo sapiens
acccaggctggaatgcagtggcgctatcttggctcactgcaacctccacctcccgggt

SEQ ID NO: 6866149 - DNA, 61 bp, Homo sapiens
ctttagtttgtaagagcaagagtccatcagcgggacatgtagttgaatatgcaaactgaag

SEQ ID NO: 6866150 - DNA, 72 bp, Homo sapiens
taagcattaggtggacaaatgaatgactgaacgagtgccaagtctcttttgttactttgccacccttactta

SEQ ID NO: 6866151 - DNA, 62 bp, Homo sapiens
gaatgacagtgagggaggcatttgaaatggaagccagtagaatgatcctacacatggaattc

SEQ ID NO: 6866152 - DNA, 108 bp, Homo sapiens
tgtcgtggttgttgaatttaagtcacaagtaatggttttataatagtgtaataatattttacagctcaaagctgttacattgtagtctgaagcacatgcaatcatgca

SEQ ID NO: 6866153 - DNA, 69 bp, Homo sapiens
agagagtcaagatcccaggagagtgagaagtgagtgaggaggttttcattgtcagctcttgacttctct

SEQ ID NO: 6866154 - DNA, 76 bp, Homo sapiens
gtggaagctttcaatttgtggcactgaatgatgatctacacagggcatccttcaaaggctacaattaaggatccac

SEQ ID NO: 6866155 - DNA, 60 bp, Homo sapiens
caggaggagagagatgctatgggattatctcctccaccccaacacattccttttcttctg

SEQ ID NO: 6866156 - DNA, 60 bp, Homo sapiens
tgagggcaaagtggtgctgagggcccatctaggtgttgatagcatacattttgcatctta

SEQ ID NO: 6866157 - DNA, 68 bp, Homo sapiens
tcaaacattgctaccagaggtttatttgccagagagcaggtaaacttcctgcagtagtcgaagtttga

SEQ ID NO: 6866158 - DNA, 61 bp, Homo sapiens
tcagaaagacgaaacagatgggacatcaaaggcggtcatcctgtaattttgtcttttctga

SEQ ID NO: 6866159 - DNA, 85 bp, Homo sapiens
gaaagtgtagcataatagtatttatttggaaaaagatccatttgatcattttatcctctgggaagctacaatgtctacatctttc

SEQ ID NO: 6866160 - DNA, 98 bp, Homo sapiens
ttgactcctagcagccatcaccagcatgaatgtgttcgtagggcctttgagtgtggcgattgtcatattctgttggataacaatgtattgggtgtcga

SEQ ID NO: 6866161 - DNA, 57 bp, Homo sapiens
tacatgtacctgtttgtttggggaggataggtttgctctccagggcaggaacatgta

SEQ ID NO: 6866162 - DNA, 86 bp, Homo sapiens
tttcgcttcctaaaggggtaatctaaggaattccagacttatgccacgatttagaatcccttgcattatccctttaaaaggtggga

SEQ ID NO: 6866163 - DNA, 68 bp, Homo sapiens
ctcagactctaccgaaccccctgtggcctgcggagacgaggagacggacgggtctggtggccaatgag

SEQ ID NO: 6866164 - DNA, 69 bp, Homo sapiens
atcatgaattcaacccactatatatcaaacagatttgttatcagtccagggttttgtgacattcatgat

SEQ ID NO: 6866165 - DNA, 57 bp, Homo sapiens
ttgcacctcatttcatttgggcttccccattagagccaagtggtgaaaatggggcaa

SEQ ID NO: 6866166 - DNA, 57 bp, Homo sapiens
ggggcagagggccctaggccaagcccaccctgggcaccagggacaatcctcttcccc

SEQ ID NO: 6866167 - DNA, 66 bp, Homo sapiens
ttctaaagtgcaatctgacagagaatgtggcaaaaatcaaacattaggatgttgtgcactctagag

SEQ ID NO: 6866168 - DNA, 61 bp, Homo sapiens
tggagcctgctctcttgcatttctgccattgccataggtagaatatgccttagcaagccca

SEQ ID NO: 6866169 - DNA, 61 bp, Homo sapiens
gagaggctgcatatgcacactgtctggttcacagtaagatgtccaaatatagtagctcttc

SEQ ID NO: 6866170 - DNA, 79 bp, Homo sapiens
tttctgaaaacctgtaggggactgttgcatccttcttcaatagagctgggtggctgaagcagtcttcggggaccaggag

SEQ ID NO: 6866171 - DNA, 65 bp, Homo sapiens
ttctggccaccggtctggtttgaatataaacagtgcctttcattacaggcagtttgtggttaggg

SEQ ID NO: 6866172 - DNA, 62 bp, Homo sapiens
gttcttctatctgagtggttattctttgtcattttggcaaagaatctcagaattagaaatac

SEQ ID NO: 6866173 - DNA, 64 bp, Homo sapiens
gtttaaccaagagcattgtgcacagagagaactcataactgtgtgtataagcggattgggaagc

SEQ ID NO: 6866174 - DNA, 129 bp, Homo sapiens
aagtattgataaataaagtactatgggacattagctttaatgagttggtaagatataataatcattttgtatatgatgcaatacattagagtgtaaaggtttgatatattacacataatttaagtcttt

SEQ ID NO: 6866175 - DNA, 62 bp, Homo sapiens
accaccctcagcagagctgaaaactggggcaattccccagaactcagtgtgtgggaggtggt

SEQ ID NO: 6866176 - DNA, 70 bp, Homo sapiens
cttccgggctctgtgactcgctgttgcagctgactggctgtaacagtgtgaggtctcaggcgcttggagg

SEQ ID NO: 6866177 - DNA, 84 bp, Homo sapiens
tctcaagactcctaaataaagcatttcccctgtgtgggcgacccctgggtcccatgtggggtcagtgtttgggtctctctgaga

SEQ ID NO: 6866178 - DNA, 62 bp, Homo sapiens
agggtacagtcaatgagtgagtgaatgaatgaattatacgctattgcaaatggctggtccct

SEQ ID NO: 6866179 - DNA, 73 bp, Homo sapiens
ttgggaactctccagggtattaatgatttattagtcttattaatatagctcactataccatggaggtttctaa

SEQ ID NO: 6866180 - DNA, 86 bp, Homo sapiens
tcatttatgtatatgtgtttatttttatactttgatctagcccaaaaacatttgaagtagacaataataagacatgtagaagatga

SEQ ID NO: 6866181 - DNA, 61 bp, Homo sapiens
gtctttgccctctctgcaagctagactcgctactggcccttcccagagtgggccaagagac

SEQ ID NO: 6866182 - DNA, 58 bp, Homo sapiens
ggtggctttgctctgtaggaccctccagggcagggtttgtgcagaagacaaagtggcc

SEQ ID NO: 6866183 - DNA, 66 bp, Homo sapiens
cttataaaggttaagaatgcattatgcatatttcccttaatatcgtaaaacattcttggctgtaag

SEQ ID NO: 6866184 - DNA, 55 bp, Homo sapiens
ggtaattacaggatctctctggcagtcttgggaagaggagaaacctgtgaatgct

SEQ ID NO: 6866185 - DNA, 70 bp, Homo sapiens
aaataggggctcagaggggttaagtgaccagctcaaggttgtgcagctgacaaactctgagcttagattt

SEQ ID NO: 6866186 - DNA, 58 bp, Homo sapiens
cagtttctcaggcctctcccagggccctgtggctccatgggacacagtttggaagctg

SEQ ID NO: 6866187 - DNA, 108 bp, Homo sapiens
agttataattgaattaatgatatgggcaagtgtgagacacacaaaattaacatttgaagaggcctggtttaattttgtcttttacatatttgtgtctccaattatact

SEQ ID NO: 6866188 - DNA, 59 bp, Homo sapiens
gctggaggctgggaagttaggcctggctttgcctgtctggactgtggcagcttgccagc

SEQ ID NO: 6866189 - DNA, 72 bp, Homo sapiens
attaatgaggcaggaaaggcgtatctgggaaataaaatcatcatctaagcatggcttttcttctttgttaat

SEQ ID NO: 6866190 - DNA, 64 bp, Homo sapiens
cctctacagggcatagcccaaagtcactggaaaagagaatctgggaagagtggtctgtggcagg

SEQ ID NO: 6866191 - DNA, 92 bp, Homo sapiens
gttctgtttttgcagctgctttatctgacttggcgctgggcttaatggctttgaggcagtgttgatcagatagggtggtgctatggtgggac

SEQ ID NO: 6866192 - DNA, 91 bp, Homo sapiens
gaggagaaacacacaagatctgtgaatagattgaagctttggtcaagaaatggaggttgtatgtttgatttgaaggtcttgagttctcctc

SEQ ID NO: 6866193 - DNA, 58 bp, Homo sapiens
tatgtgtgccccttttactctttgctttacgtaatctagaattttaggggtatatcta

SEQ ID NO: 6866194 - DNA, 61 bp, Homo sapiens
gcctgagcagggagctgggctgagctggtcttggaggcaggcttgtcctccctgctggggc

SEQ ID NO: 6866195 - DNA, 86 bp, Homo sapiens
ggtgccctatgaatttattattggctgtggggatattatatggagggaaatctaagtttcagtgataaaattaacaggctaacacc

SEQ ID NO: 6866196 - DNA, 78 bp, Homo sapiens
gcaatgggtagtgaaagggactttttaggaagattattctggatgagtggagagcctggagtccctgattaaatttgc

SEQ ID NO: 6866197 - DNA, 82 bp, Homo sapiens
gccaaatgctctgggtatttgctagttctccttttttgctctgtactctgtggatatggccttgatcctccagagcactggt

SEQ ID NO: 6866198 - DNA, 59 bp, Homo sapiens
tacctctcggggtctgtttgtgtgaaaactcaaagataaatatgactctgggtgaggtg

SEQ ID NO: 6866199 - DNA, 125 bp, Homo sapiens
gttttatttatagatattcaaatagacaagacaatgcattactaagaagagagaaaaagcaagaaggtaaacaatttcttcttggaattctatctgtctctgggtatgtgatccactagcaagac

SEQ ID NO: 6866200 - DNA, 63 bp, Homo sapiens
gggaggcatgctctgggggtcctccgagggacatctttcagcccctgctgagcctgccatccc

SEQ ID NO: 6866201 - DNA, 129 bp, Homo sapiens
agaaagggctaagagagaaaggccaggcttttgaagacattgtatacagacttagtcagctggacacttctctgctgggctgctgtcaagtccttcctgtcctattcctctcacaaccatgtcctctct

SEQ ID NO: 6866202 - DNA, 70 bp, Homo sapiens
acacagatcaggcgtttctctccaggctccaacacacatgctcagcctggatcaataagcctgactgtgt

SEQ ID NO: 6866203 - DNA, 97 bp, Homo sapiens
tttgaagaccaagttctgaacatggcccgcgatttggcaaatacttagtcattgaatgctgaagagcagggacatcttcagatcacttctctccaaa

SEQ ID NO: 6866204 - DNA, 69 bp, Homo sapiens
agtgggcagcttgtgctccagacagtcccaggtgctctgtgggtaccttggtgagtacacttgtctgct

SEQ ID NO: 6866205 - DNA, 110 bp, Homo sapiens
ggctgcaaggagcctttccagctgctgcccttggctgcaggtgggtggatgtgcctcccacctgtccgttggcttggctctctctggcagcagcgggtaggctcgtagcc

SEQ ID NO: 6866206 - DNA, 127 bp, Homo sapiens
ggtggaacaggaaggtgcaagacttcggcttcatgtttgagtggcggaggaagcatgtcaccctgaaggcagttggcagccactttgcaaccaagagagaagccaaccttggagtaaacctgatacc

SEQ ID NO: 6866207 - DNA, 62 bp, Homo sapiens
tctggtgacattatcattagaatagtgcatctataacttaactttttggtaaggttaccaga

SEQ ID NO: 6866208 - DNA, 80 bp, Homo sapiens
ggacattttacaactctggatgcacattttgaggtaactcaacagtgttgcaatctgaaaaactattttgtatcatgttc

SEQ ID NO: 6866209 - DNA, 66 bp, Homo sapiens
tgtgctgcctgtcttgattgaatggtacacctgggatcagagcatgtcatcagataggttagtaca

SEQ ID NO: 6866210 - DNA, 80 bp, Homo sapiens
gtacccactaaataaaggcttggaaactagagtgtgcagcaagtcctaaagctctgggtttctagatccctagtgggtgc

SEQ ID NO: 6866211 - DNA, 60 bp, Homo sapiens
gagaacctgtgactttcctctattttgttggtaattataagcaggaggcagtcacagctc

SEQ ID NO: 6866212 - DNA, 70 bp, Homo sapiens
tcctcttgtattggagttagtggggagtgtgtgtttctcctccactggcctgtcagtatatttagagtga

SEQ ID NO: 6866213 - DNA, 88 bp, Homo sapiens
aattttttcagcaggagcaggggagtggatgatggatttttattgaaccatctttgtcctctcccttaatcccgctcatgaagaaatt

SEQ ID NO: 6866214 - DNA, 76 bp, Homo sapiens
gtctatactctgatgagaataatgatctgctgtgggaaatacagcagatcaattgattgttcactcatatgtagat

SEQ ID NO: 6866215 - DNA, 119 bp, Homo sapiens
ttctctggcccaggctgaggccaagccacaagctgggaggacaacttggagctcaggcgtccaaccagggctgcaaattgcccctgcagggcccggccgagtctgaaggagccagagga

SEQ ID NO: 6866216 - DNA, 87 bp, Homo sapiens
tgggatagagaatggtgctgaaatggacctcaggaatagagtttactttctgaagctctcatttggcataaaccattctagtgctca

SEQ ID NO: 6866217 - DNA, 61 bp, Homo sapiens
tgactgtgttggaggacggtctggatttttttatgactttgttgttttccagcgaaagtca

SEQ ID NO: 6866218 - DNA, 71 bp, Homo sapiens
tcttataatctctattttaatgttagtgctggtcagttgtgcctacactccaaaagaaggagggtataaga

SEQ ID NO: 6866219 - DNA, 60 bp, Homo sapiens
gtaacactgtgcagtgtaatgctggtctttgaatagctcagcagtctttatagatgttac

SEQ ID NO: 6866220 - DNA, 76 bp, Homo sapiens
cagagctggtgagtaggtgggaaaggcagctgtgcggttggaagtagggctccttcaagcctgtcactgggttctg

SEQ ID NO: 6866221 - DNA, 62 bp, Homo sapiens
gcttactgttcctgttggtgctgaaagaatgctcgtaattgttaccaaacagtggacggagc

SEQ ID NO: 6866222 - DNA, 62 bp, Homo sapiens
ggaatgtgcgtactcagtgtcagcgtaagctgcaagagaaatggtgggtacgcactgattct

SEQ ID NO: 6866223 - DNA, 76 bp, Homo sapiens
ttccaaatgagagaatgctggagatttattttctacagaaaggtgtaaagtgaataggaagtattatttcagagaa

SEQ ID NO: 6866224 - DNA, 73 bp, Homo sapiens
ttgccactgaggggcatgtgtttacacatggctctaagcagatgaataaacaggtgcctcttcacatggatag

SEQ ID NO: 6866225 - DNA, 90 bp, Homo sapiens
aacacatactcgtgtgtatgaatatgtattttcatatgtgtgcacatatgtgagcaagtttatgtgtacatacatacatctatttgtgtt

SEQ ID NO: 6866226 - DNA, 62 bp, Homo sapiens
cagtagggggctggcagctggctctggggtcctaaaaccccagggaaggccatcttcaactg

SEQ ID NO: 6866227 - DNA, 127 bp, Homo sapiens
actttgcatctagaatcacctggagagctgatgaagaatgcggagtcccaggctcctggaggtgggaggggcctgggcctttgtgttttgaccaagtgccccaggtgattctgttaaagatcagagt

SEQ ID NO: 6866228 - DNA, 58 bp, Homo sapiens
gggctggactgcattgcctcgcttctggagggaaagatggcagtggaagtctcagcct

SEQ ID NO: 6866229 - DNA, 60 bp, Homo sapiens
gagtgtaactctgttgtgggtcatttgtgacaaacagtaaatgcatggcagatttaactt

SEQ ID NO: 6866230 - DNA, 64 bp, Homo sapiens
gcctgctgtgcccactcggggccagtgtccttggcagctggaacccgggtgggcagcggggggt

SEQ ID NO: 6866231 - DNA, 69 bp, Homo sapiens
ctattgcacaaacacagtcagacttcattagaacaagcatggaaatctgagatgtaacatgtgcatcag

SEQ ID NO: 6866232 - DNA, 56 bp, Homo sapiens
cctttctactccagagtaaagctacacccatatatgtaaatctggaagtggagggg

SEQ ID NO: 6866233 - DNA, 78 bp, Homo sapiens
tttttgtacctgaggggtgagggctgtagggaacacaactgtgtagggtctggagcttcctcatttacagtgcaagag

SEQ ID NO: 6866234 - DNA, 55 bp, Homo sapiens
atgtggacactgctggacggtcaaagatgcactttagaatgtccagtgttcatat

SEQ ID NO: 6866235 - DNA, 77 bp, Homo sapiens
aacaggaatagtggagcaacaagatagattgacactgtcaaatcctcatgcctatctttggttgactacatcctgtt

SEQ ID NO: 6866236 - DNA, 55 bp, Homo sapiens
tgacaaggttggagaggttcactcactttagagggatttacacacctgcctgtca

SEQ ID NO: 6866237 - DNA, 60 bp, Homo sapiens
tccgcacaggtcatgcccactgaatatcagccgaggttctctctgggaggacttgtgaga

SEQ ID NO: 6866238 - DNA, 81 bp, Homo sapiens
gggtcttagggtaggtaggtaaacaggactaatacactatattgtgtatctttaggcaagttacttaacctctctgggccc

SEQ ID NO: 6866239 - DNA, 110 bp, Homo sapiens
ttggaaagggctttttcatgcatctagaacatgctcatgtataaataaacaatatatttgacaactttcattgatttatgtttggcatgcagaagcagtgagttatccag

SEQ ID NO: 6866240 - DNA, 63 bp, Homo sapiens
tggagtcattattgccctcaattcaagtgtctgaaagcatgactgatgaaaggtaagactcca

SEQ ID NO: 6866241 - DNA, 73 bp, Homo sapiens
gccagcagttaaactgaaaggctcgttcacttgcaggagagctgggtgactcagggcgtcagtaacaactggc

SEQ ID NO: 6866242 - DNA, 62 bp, Homo sapiens
gcctgaggattgttggtgcttccaggcatataacccctgggatacatgagtgactttatggt

SEQ ID NO: 6866243 - DNA, 55 bp, Homo sapiens
tctgaggttttcatgttttctgtgacagcacaagagatccatggaagctctgggg

SEQ ID NO: 6866244 - DNA, 65 bp, Homo sapiens
tctgaagcagtgaaagagtgggacttggctgatttttcatgcttcagtgctaccttcaaatcaga

SEQ ID NO: 6866245 - DNA, 59 bp, Homo sapiens
aattttattagaaggcaaggggctaatggcagccaatcagtgttaatgctgataaaatt

SEQ ID NO: 6866246 - DNA, 71 bp, Homo sapiens
ggaatgccttttctgaggatcatttgatcgatcacccccttgaggatcaaatgatcctcaggtcaagttcc

SEQ ID NO: 6866247 - DNA, 85 bp, Homo sapiens
agtgtttcctttggtgttattgggagacatcacccggatattattaatcctcagtttgtttttccaaaatatcaagtctcacatt

SEQ ID NO: 6866248 - DNA, 62 bp, Homo sapiens
aaccagccaagacttgcatgtccatgcccatggaggcaggcccagcaactttggactgagtt

SEQ ID NO: 6866249 - DNA, 55 bp, Homo sapiens
ggaggatgagggtggtggtgttgggcacactttgcagggcctcacccacacctcc

SEQ ID NO: 6866250 - DNA, 63 bp, Homo sapiens
ttttctgtcagcaaagtgcaaataatgtaccccgtttcccttattgccttggctgccaggaaa

SEQ ID NO: 6866251 - DNA, 69 bp, Homo sapiens
ctgacagcagaccccagtgccatggaaggatcaagattctggccgaggacattgggcttctgttcttgg

SEQ ID NO: 6866252 - DNA, 83 bp, Homo sapiens
tttctgagcattgcttccctgttatttggcctctgtaccttgaacctaggttgacatcatgagcagaggacagttcttaggaa

SEQ ID NO: 6866253 - DNA, 75 bp, Homo sapiens
tcctgaaattctggttgtcacttgtgggtagaaacatatggtttacaaatgggttgatgattattatttcaagga

SEQ ID NO: 6866254 - DNA, 56 bp, Homo sapiens
cttctgctacccaagtcagatctaagtggtcatgatctgactctgtggaacagaag

SEQ ID NO: 6866255 - DNA, 79 bp, Homo sapiens
gtttcagacactctgtaaggcactaagcatatgtcagtgaaaagaattactacatctttgctcttatagagcttggaat

SEQ ID NO: 6866256 - DNA, 126 bp, Homo sapiens
gctttgggttccctgaggcgcaaccacaggcctatgtgtggggcgtcgggggacttgaggcttccttgtgatggtctcctgaggctgccacaccctctgtctctgtgtcactgggagcccctgagc

SEQ ID NO: 6866257 - DNA, 61 bp, Homo sapiens
cccagccaaaagcaagtttacctctacgttgaacagaaggagctagcagctttggctgtgg

SEQ ID NO: 6866258 - DNA, 95 bp, Homo sapiens
gaggataaatatatacatgggtttgtcaacagtggttggctttggagaaggacaattcttcctgttggatatgcttttgtaaatgttggatcctt

SEQ ID NO: 6866259 - DNA, 59 bp, Homo sapiens
tttatctgtatatctcaagtgttgatgtatgtgacactttgatagataatgcaggtaaa

SEQ ID NO: 6866260 - DNA, 68 bp, Homo sapiens
agctgagccagcagcaacaggacagactataattatgacaagttacatcctgttgtcctggctcagtt

SEQ ID NO: 6866261 - DNA, 56 bp, Homo sapiens
ctgggagctcccagtctgatggaggagacatggtccctgactctgggagctcccag

SEQ ID NO: 6866262 - DNA, 57 bp, Homo sapiens
ttgggcagtctggctgcagagtctgggttttattcactacctgtcctgactgcctgg

SEQ ID NO: 6866263 - DNA, 129 bp, Homo sapiens
ttaattttgttaagtgcctatatatatatgaaagcattggcaaaatgagcatttgaagaaatatttctatgtcatattactaatgctggccaatgatgtaaggtgttattaaagtatttttaattgata

SEQ ID NO: 6866264 - DNA, 63 bp, Homo sapiens
agaagtttgcaaaaaaccagagctatccaacagaaaaacagatgagctctggattaaatttct

SEQ ID NO: 6866265 - DNA, 62 bp, Homo sapiens
tcacacttagagcgaattgtttcataagtccaatatttttggaagttcgactttaactgtga

SEQ ID NO: 6866266 - DNA, 71 bp, Homo sapiens
atggcaaggtgatgaatgtctacaaataccgcaaatgggtgaagaattgagaccatatctcattctgtcat

SEQ ID NO: 6866267 - DNA, 112 bp, Homo sapiens
ggtgtgagactgttttgagcattttgtaaagctgattagaaagccaatgctttgccaaaatgaggagtaccaggttatctaagacagtttggcatttggctgaaattgcacc

SEQ ID NO: 6866268 - DNA, 59 bp, Homo sapiens
acccaggaggctgaggttgcagtgagccgagattgcgccactgcactccagctctgggt

SEQ ID NO: 6866269 - DNA, 66 bp, Homo sapiens
aggtgatctcatggcttgtaggaggtgagaagtagctctctttcagaaaggccagtgatatctcct

SEQ ID NO: 6866270 - DNA, 97 bp, Homo sapiens
ttgtccactctctcttccaactttctcctccggcttgctgtggctcaccgccccttcgaagttaggctgggggtaggaattgaggagtgggtgccga

SEQ ID NO: 6866271 - DNA, 61 bp, Homo sapiens
tactgtctctgctgcacaaattcatctctgcattgtagtgcaaaagcagccagagatggta

SEQ ID NO: 6866272 - DNA, 58 bp, Homo sapiens
aagggggcacagtcactgtaatatcaagcactgagctctgcaggaatttgcattcctt

SEQ ID NO: 6866273 - DNA, 60 bp, Homo sapiens
ggggctttcagggacccagaagcagaaaactctcagttctggaaatgttgctgaggcctc

SEQ ID NO: 6866274 - DNA, 56 bp, Homo sapiens
tatgtatatagcagaagtacatatgctacatagtatgaggtactagtatatacgta

SEQ ID NO: 6866275 - DNA, 55 bp, Homo sapiens
ttcagtacaatgtctgacacagtaggtttgaaatgaatctatgcattggactgaa

SEQ ID NO: 6866276 - DNA, 98 bp, Homo sapiens
taaagcccatagcagagtgaactttaccattttaagaacttttcatatgcgttaagaattcactggtagagtcaattctagtttttgatggagtttta

SEQ ID NO: 6866277 - DNA, 75 bp, Homo sapiens
cttcccagacctgtaggatcagaaattcagggggattggaccctgtagtctgtgttttattggcctgggtttgag

SEQ ID NO: 6866278 - DNA, 73 bp, Homo sapiens
taccgtagtgtcagggagtgataaatgctatgaagaaagatgaagtaatttctcaaatctctgagacttggta

SEQ ID NO: 6866279 - DNA, 60 bp, Homo sapiens
cctttaacctctttgaacctcagtgtgagtgtgctggcaaagaggagagagaggaagagg

SEQ ID NO: 6866280 - DNA, 59 bp, Homo sapiens
cttgtcactctggctccagagcatatctaaagcattatgctttgctgctccaggacagg

SEQ ID NO: 6866281 - DNA, 74 bp, Homo sapiens
gggggtagcttaagggcacgttgggctacttgaatggaaaatgcggtagcttggtggccctcctggctggaccc

SEQ ID NO: 6866282 - DNA, 90 bp, Homo sapiens
tctattattatgatgtcaatatttgaccatgtttgacctgtgaaagagtggaaggttgaagtggttcagtgtcatattaacgtataaaga

SEQ ID NO: 6866283 - DNA, 95 bp, Homo sapiens
taaataagcaaagaagaaattaatgtgccattactgatgctgtgcttaatttcaaatcatagtctggtcatctgattcttttatgccaatattta

SEQ ID NO: 6866284 - DNA, 55 bp, Homo sapiens
atgaagaaggaggtattgttcccctgaattatataggcatgccttcattcttcat

SEQ ID NO: 6866285 - DNA, 82 bp, Homo sapiens
ttgagtcccctctcgcttggctgaggtgagaaaaaatatcccatctgatccctcatgagagacagagaggggaaacactcag

SEQ ID NO: 6866286 - DNA, 76 bp, Homo sapiens
tctatgagctagaattagcttagctcatgtttataaagaactctgttatggatacaaagctagctaacgccatggg

SEQ ID NO: 6866287 - DNA, 64 bp, Homo sapiens
gtttagttgaagaaggggcagccctccaggtatagggcctatgccactcccttcccaactgggc

SEQ ID NO: 6866288 - DNA, 57 bp, Homo sapiens
ctctgtcagggccaggagaagaaagcacagttaactcagagcttggtgttggcagag

SEQ ID NO: 6866289 - DNA, 87 bp, Homo sapiens
gtctcaacatcatgtagtgtacactaaatgaatacaaactagcttttatgttagtttgattgaggtgtatatttatatgtgaaagac

SEQ ID NO: 6866290 - DNA, 79 bp, Homo sapiens
gagaagatgaggagaagggcacggagaaaagctgctgccttttttcattctaccctttctcactccttatcctcttctc

SEQ ID NO: 6866291 - DNA, 58 bp, Homo sapiens
gccagctgacaccttgattttgaccttgtgatacccagagctgaggatccagctgagc

SEQ ID NO: 6866292 - DNA, 71 bp, Homo sapiens
gcttgggcttaagggttggggatgtagatttaatttcacctacatctcttataaactctctgatcttgggc

SEQ ID NO: 6866293 - DNA, 95 bp, Homo sapiens
atgactaaaacacttttcctgccctcgaggagctcacagtctagtatgtctcatcccctactagactgaagctccttgaggacagggatggtcat

SEQ ID NO: 6866294 - DNA, 63 bp, Homo sapiens
tccagggtcccaggagctgctttcagaccagaagtttccatgagagggctggacccaaaggga

SEQ ID NO: 6866295 - DNA, 79 bp, Homo sapiens
ctcgcattcatgaaatgattgagaagtcttgtcaagtcctcactcattcatttgctctttaattcattcatggatggag

SEQ ID NO: 6866296 - DNA, 57 bp, Homo sapiens
acttctatgcacagagcttggaaacagacacatgttccaagggctttggcgtgaagt

SEQ ID NO: 6866297 - DNA, 119 bp, Homo sapiens
atataatttatagttatcagatcagggtaattcgcacatccaccatctcatatgtttatcatttctttatgttgagaatgtgcaatatccttccagctatttgaaactatatattgtat

SEQ ID NO: 6866298 - DNA, 55 bp, Homo sapiens
tacccacaactaattagtgaatttcagaattaaggaaaatcttagttgtgtggta

SEQ ID NO: 6866299 - DNA, 66 bp, Homo sapiens
ggaacagttgagatgatgtaccttggtgccacataaacaaggttagaaatcctgctccactattcc

SEQ ID NO: 6866300 - DNA, 89 bp, Homo sapiens
gtggaggagccttcttggggcagcctaagctgagcctctacccctatgagctgctcctggccgggctgctcctggatgaggtactccac

SEQ ID NO: 6866301 - DNA, 69 bp, Homo sapiens
acaaatgcagtttcatttgtagaatatacctcagacataagtgtattttgaaaatagactgtactttgt

SEQ ID NO: 6866302 - DNA, 112 bp, Homo sapiens
gtttaattgcaaacacaatctttgacttttatcatgggacctgaattttatgctgtgttcaaatgaatcagaaaacctaggtagagttcttgacggtgttctgtttttaagc

SEQ ID NO: 6866303 - DNA, 56 bp, Homo sapiens
atggtgagacaggatcaacccctctatctccaaatatagggggattatcttaccat

SEQ ID NO: 6866304 - DNA, 67 bp, Homo sapiens
cttttttggtatttctttctttgacagagtcactacaattatatctgtcacagaatgcctgaagaag

SEQ ID NO: 6866305 - DNA, 88 bp, Homo sapiens
gtgtgtttcctctttacaagtatgtttgcatttcagtcctgcaatgatagcacaggaactgggctcagcaaacatcgcctgtgcacac

SEQ ID NO: 6866306 - DNA, 109 bp, Homo sapiens
tggtaagctcagcacacataactgaatttctctttttacgtttttgcacctcagcctgtccaattgtgcaaagaaggggaggaggattaaatatgcaactgagtagcca

SEQ ID NO: 6866307 - DNA, 61 bp, Homo sapiens
actttggaggtcatagccaagaggcctgcaggcttctgggtcattctggcttgcctagagt

SEQ ID NO: 6866308 - DNA, 58 bp, Homo sapiens
cagcagcagcatcacctgagagctggatagaaacgcagcaagccaggccctgctgctg

SEQ ID NO: 6866309 - DNA, 88 bp, Homo sapiens
ggagaatcacttgaacccaggaggcgcaggttgcggtgagccgaggtcatgccattgcactccatcctgggcaatagagtgagactcc

SEQ ID NO: 6866310 - DNA, 55 bp, Homo sapiens
gtcactgggtgctgcgcctgtcactttgaattgttgagaggcaagggctcatgac

SEQ ID NO: 6866311 - DNA, 84 bp, Homo sapiens
gtgtttaaaagttattgatgcaggacaactttgcatatcaatacacaagcatttatttgatttgttttaatagctgtgaaatat

SEQ ID NO: 6866312 - DNA, 58 bp, Homo sapiens
ggtctacagttctgtcctagacttcgttcggctgatcgatgaaggagacaagctggcc

SEQ ID NO: 6866313 - DNA, 70 bp, Homo sapiens
atcacctgctccacctaccataagaggctgttgtgagaatcagcctcttatggtaggtggagcaggtgat

SEQ ID NO: 6866314 - DNA, 67 bp, Homo sapiens
gacagaggcaggcctggcaggtggccctgagcccccagggcctgctttccgagcctgcaggaaggtc

SEQ ID NO: 6866315 - DNA, 72 bp, Homo sapiens
tgaatgtgctattacacatttatttatgtagtgctaacaagataaatgtatgtgtaaaaagctagatattta

SEQ ID NO: 6866316 - DNA, 108 bp, Homo sapiens
actggagcaggatgacaatggagctgtgagactgatagggaagaggtgtttgcttctgctttgggtcctatttttttcatgccgaccatgttcagaaatggctcttgt

SEQ ID NO: 6866317 - DNA, 56 bp, Homo sapiens
caaagtcttggtgatcaactttttcacaacaaaacattgctgttgccaagattttg

SEQ ID NO: 6866318 - DNA, 99 bp, Homo sapiens
gtttagatcgcattgtcatgaatcttcttgctgcctgttttattataggtcttattatggactttaattctcaggtgcacatacaatgctttctatgac

SEQ ID NO: 6866319 - DNA, 89 bp, Homo sapiens
tttccatgtgcttcacctttgcagctccattttaatggctggacatgcttagcttctcagatggactgttagtacggccattatggaaa

SEQ ID NO: 6866320 - DNA, 58 bp, Homo sapiens
gggtagaggtaaactttgtatcatcagcatttaaggatgatcagatttaactgtatcc

SEQ ID NO: 6866321 - DNA, 61 bp, Homo sapiens
agtggccctcaggacaaggttacgctaggtacaccagtgtgctgtttccagaagggctgct

SEQ ID NO: 6866322 - DNA, 63 bp, Homo sapiens
gcttccagaccccagtccctcaggaaaacatcattaatccatgtgggattcatttggatcagc

SEQ ID NO: 6866323 - DNA, 57 bp, Homo sapiens
gcctgccctgcgggtggaggaggccatttggctggaatcacatgagctggggcaggc

SEQ ID NO: 6866324 - DNA, 94 bp, Homo sapiens
gaggaaaccatgccaggaagctggtgtgaggatgaaccgcaatccacacctgttttctcctcagcacagctgtctcctaaggcatggacacctc

SEQ ID NO: 6866325 - DNA, 70 bp, Homo sapiens
gcatgctgcatcaggccaattaagaatgaagtatacttacaaattttgcattgcctctgataaggtttgc

SEQ ID NO: 6866326 - DNA, 107 bp, Homo sapiens
gctaggtcatagaatgccttctgtgtgcatttgaaggtggccccttggggcagacatacgccacaaggacctcagatggatgaacagatcacaggatagacttcagc

SEQ ID NO: 6866327 - DNA, 116 bp, Homo sapiens
tccactctgcttaccttctggagctgcctggattcgctctgccccctataggggacttgtctttgagaatggtaagtggatcggcagagaaaggccaataggaagcaacagttgga

SEQ ID NO: 6866328 - DNA, 63 bp, Homo sapiens
ggcgctcagtgttgccccagagtgtccttccagtcactccagatggggcagcagctgaacgtc

SEQ ID NO: 6866329 - DNA, 76 bp, Homo sapiens
agaaatcccatcttttcagaagccattctggatttaaaagaatccagaatggcttctgaaaaggattgaaatttct

SEQ ID NO: 6866330 - DNA, 114 bp, Homo sapiens
ggcacttactaattttacaaactgaatgttgaactaggatctcttgattgatacataaagacatacatagatcatatatgattttattcaaagtagtataggaataaaaatgcc

SEQ ID NO: 6866331 - DNA, 67 bp, Homo sapiens
ggtaaccaatcctcatgttcaacaaccgcctccttgttaagaaaggtaatgtgaggaattgtagacc

SEQ ID NO: 6866332 - DNA, 76 bp, Homo sapiens
agcatctgattcagtaggtctagaataagacacaataagttacgtgtctaacaagtttctaggcaatgctgatgct

SEQ ID NO: 6866333 - DNA, 63 bp, Homo sapiens
gacagttgtacagaaggcactaaggtcaaataatatttgaccagtactattttttacaatgtc

SEQ ID NO: 6866334 - DNA, 82 bp, Homo sapiens
cagcatgtaattttagccaagatatgtcctgttactaagtatctcccaatgctttagtaaaacgtatttaggagaaatgttg

SEQ ID NO: 6866335 - DNA, 60 bp, Homo sapiens
caacctgacaaggttaatgaatacccaaatagctggaaaaaaattatgcctgtgaggttg

SEQ ID NO: 6866336 - DNA, 63 bp, Homo sapiens
gtcttgcaatttgcttccatggagttgatccttgaacctccatgaggaccaaattcgtaggac

SEQ ID NO: 6866337 - DNA, 87 bp, Homo sapiens
gttatacaaaacaaccacttcatctctacagaatcttattattggaatatatgattgtaagtttctatagagggtgggaagtataac

SEQ ID NO: 6866338 - DNA, 111 bp, Homo sapiens
ttagcaagaaatgataggctgtgatatatttggaccagagcattttatagtcattttcagtatatatagttctgtgagtttaatgtatctatactggacttttcttgttaa

SEQ ID NO: 6866339 - DNA, 57 bp, Homo sapiens
agtcagcaccccagcggggtcatctgtgccacaggtccctgttgacagtgctgtact

SEQ ID NO: 6866340 - DNA, 59 bp, Homo sapiens
gcacccagcaggaaagtgacgtttgagggtccccttctcaaccgcattgctgctggggc

SEQ ID NO: 6866341 - DNA, 59 bp, Homo sapiens
gtggcaagctgttggcagatagctctgcagaaataccagggccaggcagcagctgtcac

SEQ ID NO: 6866342 - DNA, 69 bp, Homo sapiens
gcaggttctcagaaaggatttgaaattcatttactattttaagagattcaaagatcttctgaaatctgt

SEQ ID NO: 6866343 - DNA, 112 bp, Homo sapiens
ctgttaattgatgtcaaagctgtgtctgctgggtctggcactcatgcggtaaagtgaaatttccaaacaagtccagaccccggcagctggtcctgagtttacaaggtgatag

SEQ ID NO: 6866344 - DNA, 63 bp, Homo sapiens
ttgcaaaacaggtagtgggctagatctggcttgcaggccacagtttgccaacacctactgcaa

SEQ ID NO: 6866345 - DNA, 63 bp, Homo sapiens
tgccagcctggcctgagtcttttctgtctcccagccgttaaaggttttaggaccaggcaggca

SEQ ID NO: 6866346 - DNA, 71 bp, Homo sapiens
cctttgacatgtccaggtggtcctgttgttggcatccctggctgcactggaccccaggatatggaaaaagg

SEQ ID NO: 6866347 - DNA, 76 bp, Homo sapiens
tgcctcagtgtggtttcttatttgcaggttgcttttaacaatatagatgctttcctggatagagaacatggaggca

SEQ ID NO: 6866348 - DNA, 65 bp, Homo sapiens
tttctgaatttactcaaggtcaacactatgaaacatcaatgactaaacagctgtaaattcagaga

SEQ ID NO: 6866349 - DNA, 62 bp, Homo sapiens
aattcatctggtagccacagtcattgcatttatttttgccagtggaaggtcccagaggaatt

SEQ ID NO: 6866350 - DNA, 57 bp, Homo sapiens
ccttctattgtactgaggaataaagctttaatttagagcatgtctcagtcaacaagg

SEQ ID NO: 6866351 - DNA, 109 bp, Homo sapiens
tctaccctttaaaaagttagctcacggtcttgaagttaaggtcaactataaacataagctatggacaagaattacaagatatgtgagaactagcacaatgaaagggaga

SEQ ID NO: 6866352 - DNA, 90 bp, Homo sapiens
tttctgctttgcaattctgttttcatctaatccgtcttcgactgcagtttgggggagaacaggggattagatagcaggccatcacagaaa

SEQ ID NO: 6866353 - DNA, 74 bp, Homo sapiens
ggttgaataatgaggattggcaaaactcagggatgtgctcacctccctagattatgaaatcccattgtctaatc

SEQ ID NO: 6866354 - DNA, 55 bp, Homo sapiens
taagaggttgcttggcagcataaggagacacttgagcttcaaagccatcctttta

SEQ ID NO: 6866355 - DNA, 62 bp, Homo sapiens
ggtcataccctgtaatctgaaacatgaaccaatttatggcttaaatactacagggcaagatt

SEQ ID NO: 6866356 - DNA, 74 bp, Homo sapiens
cctccccggcccctgtcctcgtgggcactgcaggatctcatttctgcccctgctgggcacagaggcttggtggg

SEQ ID NO: 6866357 - DNA, 65 bp, Homo sapiens
aggcattttctgtatggacagactttgttacctcaatatttagtgcatacagtgaatcttcgcct

SEQ ID NO: 6866358 - DNA, 59 bp, Homo sapiens
gcaggatgctgtattatgtgtatgaccttttcagtcatgtcctgcatagttgcttctgt

SEQ ID NO: 6866359 - DNA, 64 bp, Homo sapiens
ggtgtacgttcttctgaactttgaacgacacttttcaagtggtgctgattaagaactgtatacc

SEQ ID NO: 6866360 - DNA, 109 bp, Homo sapiens
tcgtcaacattactcgacagatgtggcaccgatctttagccagagaactctctggaaccatcaaagagatcctggggactgcccagtctgtaggccgtaatgttgatgg

SEQ ID NO: 6866361 - DNA, 63 bp, Homo sapiens
ggtaaattcacacctccggtttttctttagagcactgagagggattgtaggtgtagaaatgct

SEQ ID NO: 6866362 - DNA, 59 bp, Homo sapiens
gcgtactggtgtactggcgtgctggtggatctaaccccagagattgttacacagtaggc

SEQ ID NO: 6866363 - DNA, 76 bp, Homo sapiens
gcaaagggactggttgctaagcacagcttcactgggttccctggctgacaggctgtattagcatgccagactttgc

SEQ ID NO: 6866364 - DNA, 129 bp, Homo sapiens
tctccagcagttatagctgttttacatcttatttgcaacaaaagggaactctaattatcttcaaaaagagcataaaatggtgtgtcttgctgctgatgtaatgttgattcctgaatgctgctgatagga

SEQ ID NO: 6866365 - DNA, 67 bp, Homo sapiens
aggaagtgacggagcatggaacccagcccttaaaaactgtgctgttttcttctgtaccgtgccacct

SEQ ID NO: 6866366 - DNA, 65 bp, Homo sapiens
gcaagataatcttcaaagccatcatttcgacctgaggtcccctgaaagttctgaagagatcatgc

SEQ ID NO: 6866367 - DNA, 83 bp, Homo sapiens
aacaggagcaaagcttttcagagagttgcactgtcaaaagcactggcagcttgaatgcagtctttgaacagattgttgctgtt

SEQ ID NO: 6866368 - DNA, 62 bp, Homo sapiens
cactcaccgccttgcccggccgggcccaggtgcagatgaggccctcctggcaggcagtgatg

SEQ ID NO: 6866369 - DNA, 55 bp, Homo sapiens
gctgaggtggtgatggttcatctttatctgcctgtgtttctctgctcatctcagc

SEQ ID NO: 6866370 - DNA, 57 bp, Homo sapiens
tggggcctgtgacgggtccagagtcacagagctacggatcagcttcactgggcccca

SEQ ID NO: 6866371 - DNA, 77 bp, Homo sapiens
ttttgttttataggtcctgtgagatgtatgcattaaagaggttctgttttgatgtgtttccaggatttgtttcaaga

SEQ ID NO: 6866372 - DNA, 55 bp, Homo sapiens
ctgcggccccgacttcagcggttgggctaggctgtgctgactgtttgggtggcgg

SEQ ID NO: 6866373 - DNA, 83 bp, Homo sapiens
ggagtggagcctggtaaccgcgacttccccgccatgttctgtgtgttgctggctggagaagggtggttgacaaactccgaccc

SEQ ID NO: 6866374 - DNA, 80 bp, Homo sapiens
ggttggtttttggtgttagcttcactctcctaaaccctgcaacacaataggaagcttagtgaaaggaccacatattaacc

SEQ ID NO: 6866375 - DNA, 129 bp, Homo sapiens
atcatgtattttataagatatttttcttagtcatttctgtttcttcagtgcttagtacagtacttaacatgtagaatgcacttgataaatgttaactgacttgagaaattaggatcttataacattgat

SEQ ID NO: 6866376 - DNA, 67 bp, Homo sapiens
ggccatatatgattgtgaagattttaaacatactaagaaacattagtttcacattttacatgtggct

SEQ ID NO: 6866377 - DNA, 129 bp, Homo sapiens
agggaagaatcacttgggagcttttaaaaatacctttccaggaccccatattcactgaaccagaatctctggggattggagcctggggttcgagatttttgacaagttcctaaggcgattctgatttct

SEQ ID NO: 6866378 - DNA, 65 bp, Homo sapiens
ccacagtgcacttttgggggatgttagtatgatctaacattctcaaaagaggtgtaattcagtgg

SEQ ID NO: 6866379 - DNA, 61 bp, Homo sapiens
tattaagtcctaatggcagaagtctttgaaaaggcatttctggacttgggatcatttaata

SEQ ID NO: 6866380 - DNA, 64 bp, Homo sapiens
ttagactttaagctgggtgcagtagctggttgagattttgggactgccttacttagaggtctga

SEQ ID NO: 6866381 - DNA, 127 bp, Homo sapiens
cctatgctatgcctccgtttctctactaagggcagaatagagaagatggcttgggtcatcagccctttctactttcctatttgaggctatgagaggagaaaagtacaggcataccagagcaattagg

SEQ ID NO: 6866382 - DNA, 59 bp, Homo sapiens
taggctcttggaagacagtagtgaacaaaaccaacaaattattgccttaatggagctta

SEQ ID NO: 6866383 - DNA, 68 bp, Homo sapiens
atgtatattacaagtagactaactttcaggtagattggttcctggaggaatatctgtgtaaattacat

SEQ ID NO: 6866384 - DNA, 123 bp, Homo sapiens
agatcaaagtgcgagctttccttaatttgctaactgtatggtggttatgtaagagaatatccttgttcttaggaaatatatactaaactattaataggtaaaggaacatggtatacgtgatct

SEQ ID NO: 6866385 - DNA, 129 bp, Homo sapiens
gtgaacattatatgatttttagtatattgagtcagaaactagatgtattagagattcatgttaaatatgatacaaatctgataaaacataaagtttccttaagatgcttatcattcatcacctaaaaac

SEQ ID NO: 6866386 - DNA, 99 bp, Homo sapiens
aagaatctaatttggtctcctggttgagtcatccatttactccatggacacgtaagttctatttctggtggcaaatcaggacacttctttgcattactt

SEQ ID NO: 6866387 - DNA, 55 bp, Homo sapiens
gactattctcactagcttcacaggagcagggaccttgtgaagcaggagggtggtt

SEQ ID NO: 6866388 - DNA, 56 bp, Homo sapiens
tgccttgcgggcgtttctgttgtaagtggagggcagcagggccacgctccaaggca

SEQ ID NO: 6866389 - DNA, 64 bp, Homo sapiens
taagatcttcatcttcttacagccatcaatcttaggatggtttcaagaattgaagaggatttta

SEQ ID NO: 6866390 - DNA, 55 bp, Homo sapiens
gtgagtctcattctagtgtatcaaatcatgtttgaacatttctgggagaactcac

SEQ ID NO: 6866391 - DNA, 82 bp, Homo sapiens
gctatttgagattatggggtttgtcttgtgatgcagacattccaagtttacctgtttacagaaggcagacttccagagtagc

SEQ ID NO: 6866392 - DNA, 60 bp, Homo sapiens
gtgctggtgcacgctgcctacctggtgctcatccagaaggccagcgcagacaccgagcac

SEQ ID NO: 6866393 - DNA, 114 bp, Homo sapiens
cagaccacctctcaactgctactcaacctgtgtctctccttacaagactggtcacggttcctgctagtctgtacttatggcagagatgatgtgagggcatatgagatgtggctg

SEQ ID NO: 6866394 - DNA, 101 bp, Homo sapiens
agccatttgttcttagtttctgtgtctggttgggccagtaaagccctttcctcatccctctttctgcttatcactagagacagaaactaaaaactatggct

SEQ ID NO: 6866395 - DNA, 95 bp, Homo sapiens
ggttgctttgttccacctcagctgtgaacatgcacatggagtgacaccaatattttgccactctgtgcatgtccacggatgacttcaaaagcacc

SEQ ID NO: 6866396 - DNA, 77 bp, Homo sapiens
atggctcagtggccaatttccatctgtaaggcttcaaaccattaggtccaaagatggctgaattaggcctgtaccat

SEQ ID NO: 6866397 - DNA, 80 bp, Homo sapiens
gctgtaatgactgctgctttatagggcttccatgtccttagccacatgacaaggtttataaggcttgccatctatccagc

SEQ ID NO: 6866398 - DNA, 78 bp, Homo sapiens
catcaatgtactgaaggtggggccagaaaaatagtacttaattacagtactatgtttcttccttttcatacatctatg

SEQ ID NO: 6866399 - DNA, 102 bp, Homo sapiens
gaaacaatacctaggaaatatttgaacataggaagtcctttggcctactttgcttttggtgcttgtcttttcctgttttctgtttcttatctttattttttc

SEQ ID NO: 6866400 - DNA, 86 bp, Homo sapiens
accaccattgttcctgtgattctctgagttggcctaatgctttgaacgtgagaatggctcagataattcaaggggctctgggtggt

SEQ ID NO: 6866401 - DNA, 73 bp, Homo sapiens
gtgacaatttatagaatgtgactgggtggctactttacattaactagtcataaaatctgaagaagttggtcac

SEQ ID NO: 6866402 - DNA, 72 bp, Homo sapiens
agaatcagcctgagtttgcagcttaaagccaaaggatttgatacaatcactggcagctgccagggtggttct

SEQ ID NO: 6866403 - DNA, 58 bp, Homo sapiens
ggctcaagcagtctgcctgccttggcctctcaaagtgctaggattacaagcttgagcc

SEQ ID NO: 6866404 - DNA, 79 bp, Homo sapiens
tctgtttccctaatatgttctagttcctgagatgtgccagaaagtttcaccacacaggaaaattggaattaaaagcaga

SEQ ID NO: 6866405 - DNA, 60 bp, Homo sapiens
ctctgggcaggacgccaggcctgtgaaacctgctaaaacaggcctggtgagtatccaggg

SEQ ID NO: 6866406 - DNA, 115 bp, Homo sapiens
gggggcctgtgcagtcgtgattgttaatagaattcagaatatccgtttaagtttgctttcaaagttaaatagaaattctggctttttaaagtgtctttgaaatgaactggctttc

SEQ ID NO: 6866407 - DNA, 78 bp, Homo sapiens
gaagaaggtagaggacattgctaaataatgaatgaatggatgaatgaatatctttaacttgcagtatttaccttcttt

SEQ ID NO: 6866408 - DNA, 67 bp, Homo sapiens
catgctgggcatcatggacagcagaggtgaatctaagcatggtccctgccttcatggtgctcacgtg

SEQ ID NO: 6866409 - DNA, 78 bp, Homo sapiens
gtaggcaaattatggaacattgccctgggattttgaataaatatgcttcttatgtgtcagtgtctcataagtacttac

SEQ ID NO: 6866410 - DNA, 64 bp, Homo sapiens
gaggtgacttggcttttccatctctgcagcacaattgctgtgtgaccttaggcaagtcaacttc

SEQ ID NO: 6866411 - DNA, 66 bp, Homo sapiens
ggctctgggctgcgggcgcccctccaccccctggcagcttctggagggggccagcggcctgtagcc

SEQ ID NO: 6866412 - DNA, 72 bp, Homo sapiens
aggtggttagtggcagagcaggtgctggaactcaggcctctgcatttccagctctctccgcctcccccatct

SEQ ID NO: 6866413 - DNA, 75 bp, Homo sapiens
ctatccgagtctcagtttcttactctgtataacaagagttgttgtgaaggttgaagaaacttagtaaatcagtgg

SEQ ID NO: 6866414 - DNA, 63 bp, Homo sapiens
tgccaaaaataaaggaactgttttcccagttgagttgatggaaaataaatcttattcctggcg

SEQ ID NO: 6866415 - DNA, 56 bp, Homo sapiens
ggctcactttggggtcagctgggggaccatgcttctggtggctcatgtagtgggcc

SEQ ID NO: 6866416 - DNA, 89 bp, Homo sapiens
tgatgacttgaagactggaagcctgtgttgctctggcgatagacagttgagtttattggaagtgaacaccaggctttcaattcacatca

SEQ ID NO: 6866417 - DNA, 95 bp, Homo sapiens
ggccggggccgctgaggaggcttccgggaggcacggccgccgcagagatgaagaggttgtggccattcttgaggtcgacctcgcggtcccgggcc

SEQ ID NO: 6866418 - DNA, 92 bp, Homo sapiens
actgctacatggggagacatatatacatatatgtaggagtacacctatgtgtgcatgtgtgtgtatttataaatctctctccatgtagcagt

SEQ ID NO: 6866419 - DNA, 66 bp, Homo sapiens
caggaaaattgattaaagtccgtgcttcaagggccctgaaagcactttatgtcaatgtccttcctg

SEQ ID NO: 6866420 - DNA, 60 bp, Homo sapiens
gctgagtgaaatctttgggctttgttaaaaatgacagaacttggaacttttcacacaggc

SEQ ID NO: 6866421 - DNA, 58 bp, Homo sapiens
tttccttcctaaggtgaagcaatgattgaacaaggattgctgagctttggcaaggaag

SEQ ID NO: 6866422 - DNA, 86 bp, Homo sapiens
atgcttaacctattttggggttatagatccttatgtgcatttgatgaaaagtatggatctgtatccaaaaatacaaaacaaagcat

SEQ ID NO: 6866423 - DNA, 62 bp, Homo sapiens
ccaagtgaggtggggagggataggctggagcagatcagtggccttgatgcctcattccttgg

SEQ ID NO: 6866424 - DNA, 92 bp, Homo sapiens
cagccaggataccacgcaatgttttaagtttctttattcttatgtactatgacattacagaactgtcttgaaattttggtgtgattttgctg

SEQ ID NO: 6866425 - DNA, 79 bp, Homo sapiens
aaatggtggttgttttatgttactaaaatttggggtgacttgttacacagtgatgggtaatgggaacagacagctattt

SEQ ID NO: 6866426 - DNA, 77 bp, Homo sapiens
agaagcactgtgttttctgtgcagcttaatgagagggagcatatcatttcaggactctcacaggatgcagtgttact

SEQ ID NO: 6866427 - DNA, 69 bp, Homo sapiens
tcaggtctccactaaaaactttcacgtgctaagggttttattgtttgtggaggaagggtggggatatgg

SEQ ID NO: 6866428 - DNA, 90 bp, Homo sapiens
gccttgtatggtaatgctgattcaagccaccacatactgcagcattagaagtttagctgtgatttgggggttggatcagaactatgcagc

SEQ ID NO: 6866429 - DNA, 56 bp, Homo sapiens
aggctcctgcaggtgaggtgctccatgttgagcagccctagaatcctgcacagtct

SEQ ID NO: 6866430 - DNA, 76 bp, Homo sapiens
tcctgctgtacctttcaacgtgacacatttacctaacatccaaattcgagtaagtgaggcaaagtgagaggcagga

SEQ ID NO: 6866431 - DNA, 66 bp, Homo sapiens
ctcagctgctttgtctgtaaaatggaggtgatgacaccacctccagccttctcaaggctggctgag

SEQ ID NO: 6866432 - DNA, 76 bp, Homo sapiens
aggaagttggcaaggaggcagtgggacttgaatatccgagaaaagccggtttctcctctgttaccttgcaaatcct

SEQ ID NO: 6866433 - DNA, 114 bp, Homo sapiens
ccgccgtccgcgagcgtggtggccgagctggcagggggccccagatcactgcggttggtgacggccgagagcaggtggccgctggtgggctcggccccatcctcgcacaggtgg

SEQ ID NO: 6866434 - DNA, 118 bp, Homo sapiens
tctagttttttttcatatttaaggcagatattggttgttgatttaagacagatattatttgatatattggtaaagtggattaacatactattttctgaatccttatttgattattagg

SEQ ID NO: 6866435 - DNA, 56 bp, Homo sapiens
ggtcatcggaaataccagctgccgatcacatgcagtcttcattgtatttccagacc

SEQ ID NO: 6866436 - DNA, 129 bp, Homo sapiens
tcacgtcctgggaagggagctgtgctgcagaagtcctcccttggggccaccttggacatttatagagtcatagagaggtgtttcccaatgggcagagccctagtagccttgcaattctcctaaagggta

SEQ ID NO: 6866437 - DNA, 96 bp, Homo sapiens
actcctataaagcagagtttctcaacatcagcactattgatactttaggctgaataattctttgttgtgggaactgtcctatgcattgtaggatgt

SEQ ID NO: 6866438 - DNA, 67 bp, Homo sapiens
ttggagagaacagatgtgaaatgctaagccaaatgagtgtgtgagcttttcacatctgtccctttaa

SEQ ID NO: 6866439 - DNA, 55 bp, Homo sapiens
tgctagaagctgaaacctcttgatactgcatgtgtagagatgacgagctctagca

SEQ ID NO: 6866440 - DNA, 88 bp, Homo sapiens
gcccacccacctgtctgtccactcactgtggagtcgggctgacgcagctgcccttggcgtgtgtgtggctggacggggtgggtgtggc

SEQ ID NO: 6866441 - DNA, 79 bp, Homo sapiens
gatggtgcatgtagccatcaagatagcgtccatccattcctcatgtttgtgtctttgtggtacaagagctgcactggtc

SEQ ID NO: 6866442 - DNA, 93 bp, Homo sapiens
gcgattctactgtttggaggggagtaaagcctgcttttaatgcgcagcagaatgaaccagggctttggttcaaccaggcaattggaaggtcgc

SEQ ID NO: 6866443 - DNA, 92 bp, Homo sapiens
ggctgggggtaggaagtaatgtcatagagaaacagagggaccagactctctattccagctgttgttttatctcagattttctctcctatgct

SEQ ID NO: 6866444 - DNA, 62 bp, Homo sapiens
agccattcattgtgctctcagattctgtaggtcagagtccaagtgggacagcaaggatggct

SEQ ID NO: 6866445 - DNA, 79 bp, Homo sapiens
gtgactataaacagcctgcccaaattggcttaatcagatgcagccttgatcttgccaagggaaggatgtatatgatcac

SEQ ID NO: 6866446 - DNA, 71 bp, Homo sapiens
tatggcaccaaggcattcttgcaggtagggaacaaaaagtttaccacctcattattcctggcttgttcata

SEQ ID NO: 6866447 - DNA, 82 bp, Homo sapiens
tttggagaattgccttttgtgctacgagaggggatagatgtctagagcatctctcgactcacaagttttgcagttttccagg

SEQ ID NO: 6866448 - DNA, 80 bp, Homo sapiens
gcttgaagagagctaagggccttgtccactgcaagccagcaaggaatggagccaggacaaagctctgctgcctcccaggc

SEQ ID NO: 6866449 - DNA, 75 bp, Homo sapiens
gtatgtttgaagcaaagtggttgtcatcgtttctgtgatgttaatatttataggccactttgtgtcagtatgtgc

SEQ ID NO: 6866450 - DNA, 59 bp, Homo sapiens
ctactgtcaatgtgagccttgggaagcaggactagaaccagtgctcaatctgacagtgg

SEQ ID NO: 6866451 - DNA, 95 bp, Homo sapiens
aatgctcatatggggatgtcagatagaattggcctagcactaggtgatagaccttatgccaggccaattctatttgacatccccgtatgagtatt

SEQ ID NO: 6866452 - DNA, 71 bp, Homo sapiens
tcagatggtgactgagggggaaggacttcagactgggtgtgagggaggccctttgagcagatgacatttga

SEQ ID NO: 6866453 - DNA, 69 bp, Homo sapiens
tgcttcagactgcagattttgatgaatgtggaaaaattttcttggagctcttagggtcgttttggagca

SEQ ID NO: 6866454 - DNA, 67 bp, Homo sapiens
agattttcattttgcagggtgagatcatgagttctgattctcaactaatggtgcaagatgaggttct

SEQ ID NO: 6866455 - DNA, 113 bp, Homo sapiens
tccaggcagcatgaggaatgggaagagtgatggatgtgtggggctttccggggagtactttgaggagccctccatctgtgctcaggctgccctggttctctgcatgcactggg

SEQ ID NO: 6866456 - DNA, 89 bp, Homo sapiens
ttctgcttttgtaacatgaatgcagccataacactatgtaaatgagtgagtatggctgtgttcacataaaatttttttataaaatagga

SEQ ID NO: 6866457 - DNA, 115 bp, Homo sapiens
atacaatgcatgtgatacatgtctgtaagtgagattatatgtacgggatagtatgttctatatgtactctaagtcttatatacagatgcctttatctacagatgcctaattgtat

SEQ ID NO: 6866458 - DNA, 74 bp, Homo sapiens
cctttgtcctagagatccgggaggggaggtgtgcgccctgccctttaaagttgtggtcatgtctaggaggaagg

SEQ ID NO: 6866459 - DNA, 78 bp, Homo sapiens
ggccaggatttgcaatttaatgtgtcccaattaattcacttgaaaattagtaacactctgtttacgttgcctctggct

SEQ ID NO: 6866460 - DNA, 78 bp, Homo sapiens
ctcctggcattttcagcagactgcagttttctgagaatgtctgtgttttccagagcatgtctgctcagaatgtatgag

SEQ ID NO: 6866461 - DNA, 55 bp, Homo sapiens
cctgaaccccaaaacctctgaagtggggcaagccctacttaagtaggggattagg

SEQ ID NO: 6866462 - DNA, 72 bp, Homo sapiens
ctgagggtctgacaatgtgacttagccatcatcaaggtaagtgatgtctgaggacaaatgtcaagatctcag

SEQ ID NO: 6866463 - DNA, 60 bp, Homo sapiens
gcctataggctctccaagcccaggaccttcaatgaggtgggaagggagccagcctttggc

SEQ ID NO: 6866464 - DNA, 98 bp, Homo sapiens
tcagttctgggtgagtataggaaagggactaggacaagtgtcgaagtttgtggaaagacgctttccctttttattgctggctttaacagaaacactga

SEQ ID NO: 6866465 - DNA, 75 bp, Homo sapiens
gtttcacagatggggagacacggtttatttttattgtcacgggaaccttttgtctcctcattcttcagtgtctac

SEQ ID NO: 6866466 - DNA, 58 bp, Homo sapiens
ggggaagatttttaattagtaactttgcatatttttatgggaattaaaaattttcccc

SEQ ID NO: 6866467 - DNA, 55 bp, Homo sapiens
acctgtttaccctgggctcccctgacttgctccggggggaaagtggtgagcgggt

SEQ ID NO: 6866468 - DNA, 56 bp, Homo sapiens
cacacagctagtgacaggagaatgctagaaagttgattcatgcagtggttgctgtg

SEQ ID NO: 6866469 - DNA, 69 bp, Homo sapiens
cgcggctgtaacaaaataccttggattgggtgatttataaataatagaaaggtattttttgcagttctg

SEQ ID NO: 6866470 - DNA, 57 bp, Homo sapiens
tctagaacttctctaaaatgaaaagttttttaagcacttcagggtgagagttctagg

SEQ ID NO: 6866471 - DNA, 57 bp, Homo sapiens
aacacatggcaagagcaggaaatgggaagactaccttttttctggcagctatgtgtt

SEQ ID NO: 6866472 - DNA, 55 bp, Homo sapiens
cttgtttgataggaaggacaggtgttagtgaactctccttcagacgacaagcaag

SEQ ID NO: 6866473 - DNA, 115 bp, Homo sapiens
cttcagatatacgagtttctaccactcattggtcatttcttaactagagtgaacaaaattgttggctttttaaggaaattgcctgtctggtgggtaaagcgtatctatttgtaag

SEQ ID NO: 6866474 - DNA, 56 bp, Homo sapiens
cctgaggctccacctccagagactgtaattcaagaagtctggggtaggggcccagg

SEQ ID NO: 6866475 - DNA, 104 bp, Homo sapiens
gttgaacacttgacatgtggatagtgtgactgaggagttgaattttttattctatttaattttaattagtatacattttaaaaccacatctgacgagtgccagc

SEQ ID NO: 6866476 - DNA, 65 bp, Homo sapiens
gactgcctgtgatcagctgagttcaagtttcatcttttaaattagccgatcataggaaatgagtc

SEQ ID NO: 6866477 - DNA, 74 bp, Homo sapiens
atagttacagatttcacttttcttcctctacagaaattccgaggagttaaagtgtaaggaatttaagtaattgt

SEQ ID NO: 6866478 - DNA, 63 bp, Homo sapiens
agcgattctaattggagattaacatgtgtcctcatcacagttgaccttatttatggagtggct

SEQ ID NO: 6866479 - DNA, 55 bp, Homo sapiens
tgcttattaacatgtatatctcatatatgtgtgggagaaactctgggaatgagca

SEQ ID NO: 6866480 - DNA, 67 bp, Homo sapiens
ccagattctgaacgaggttatgatgacagagagaataagacatggtccctagaagttctgaatctgg

SEQ ID NO: 6866481 - DNA, 92 bp, Homo sapiens
gaaggcctgaagaagcatctaggtgactgacatacagggaattcatcccttatctttctgtcctagattctgagctcttttcatttgctttc

SEQ ID NO: 6866482 - DNA, 68 bp, Homo sapiens
agggaagggaaatgaaggaagctattgttcagtagtttacacttttgattcttattgttttcctctct

SEQ ID NO: 6866483 - DNA, 69 bp, Homo sapiens
ggtggctggagggactggcagggaggtggggcttgccctgagccttagcagggagtctgtccagccact

SEQ ID NO: 6866484 - DNA, 88 bp, Homo sapiens
ggctccacccctttctctttccccgacctcattgagggtctctttccttcacaggcttggttggggcgagggatgcggggtcattgct

SEQ ID NO: 6866485 - DNA, 64 bp, Homo sapiens
aggctttctctgtggtgaggagggtgcaatagaaaggcatctggtcgccccgtgggagcagcct

SEQ ID NO: 6866486 - DNA, 55 bp, Homo sapiens
aggacagcagttggtgaggttcttataattggtccctgaccattcagcttgtctt

SEQ ID NO: 6866487 - DNA, 128 bp, Homo sapiens
aagtgcattttcctgtcttgtcttattaaacagattggcttcgaaagttatattacagggttgctcagttaatacagtttccaagccagctattactgtttgtttagtcaggacagggtgatgtattt

SEQ ID NO: 6866488 - DNA, 76 bp, Homo sapiens
gttcagggtctcttcctcagtattgcatgaccaaatcctgattttgtttgtatgctgagaagaattgcctctggat

SEQ ID NO: 6866489 - DNA, 55 bp, Homo sapiens
tctgactcttggaaatagcctaacaatactttgaacggttatttgagggttaaga

SEQ ID NO: 6866490 - DNA, 60 bp, Homo sapiens
ctgaaggggaggttagagtacgaagagcattcacgctactgtctagacctcatcctacag

SEQ ID NO: 6866491 - DNA, 128 bp, Homo sapiens
ctcctcattcccgttataccttttctgttgatgttggctctaatctctgataaggaaaaattattatagggaattctagaagtccacaaagaccttagagatctgtagggtgtaaaaaagggaaggag

SEQ ID NO: 6866492 - DNA, 69 bp, Homo sapiens
tacatgatcagctaattagaattaggatcagattgagtggttctttttcaggactggttgactcgtgtg

SEQ ID NO: 6866493 - DNA, 83 bp, Homo sapiens
ggaatacttctggcagtggaggaagaaaactcacacacgtgagttgggactttatctccaagttgtgctaagtttagtgtttc

SEQ ID NO: 6866494 - DNA, 63 bp, Homo sapiens
aacggcacaaggcaacttttggggatgatgggaatattccacatctcaattgcggtggttgtt

SEQ ID NO: 6866495 - DNA, 61 bp, Homo sapiens
catacattgctcattcagtatctcaaacccagaaagatgagttactgacattgaatgtgtg

SEQ ID NO: 6866496 - DNA, 71 bp, Homo sapiens
ttaaggagctaggcaaagctcacggactgttggcaaatagacattttgtatttagcctgcctgttacttaa

SEQ ID NO: 6866497 - DNA, 61 bp, Homo sapiens
tggtttttgaggattaaatgacattgtagaaaaactacaaagtttggggtcctcaaaacca

SEQ ID NO: 6866498 - DNA, 68 bp, Homo sapiens
gttcctcgaagaagcctcctatgagtgcctggatgaggtcaggcttcttgggcttcattctgagcagc

SEQ ID NO: 6866499 - DNA, 129 bp, Homo sapiens
gctccctcatgttcttggcacagcagaagtgttctgcacatggtctctacggaggaaagctggtccccctggcccaggcagcacttcctccgtgagcccctgcagtttcctggtgtgtgcttggggagc

SEQ ID NO: 6866500 - DNA, 74 bp, Homo sapiens
cttttacttgacacaggggggcgctagaagatggcttgttcgctttcttttctgtaactcagtgtctagggaag

SEQ ID NO: 6866501 - DNA, 77 bp, Homo sapiens
gttttttatcctgtattcttctgaaatatgggcctgtttgtccccagttatgttcaataggatgcatgatataaaat

SEQ ID NO: 6866502 - DNA, 62 bp, Homo sapiens
ctctctctttgatatttttagccatcagataccttgtctgcaatgtgtgctcagagagtgag

SEQ ID NO: 6866503 - DNA, 64 bp, Homo sapiens
gatcaagttctgggtcaccctgcccagactgctgcagttcttttatcagggccccagaattatc

SEQ ID NO: 6866504 - DNA, 70 bp, Homo sapiens
atgtacacacacagagtatttagaaggggtgggaagatctactgtcctcgaagtacctgtgcaggaacat

SEQ ID NO: 6866505 - DNA, 62 bp, Homo sapiens
ccaggcccagggtactgaccaaacccttatgatggccagtcattttcacccatgaggtctgg

SEQ ID NO: 6866506 - DNA, 64 bp, Homo sapiens
gaggcaacttcctgtcctctccccgttatctccccaaccagaccgaggagaggaagctgtcctc

SEQ ID NO: 6866507 - DNA, 58 bp, Homo sapiens
gtcctgttactgaaatgcaccgtgcctcttccctctgacgcacgcgtttccgtgagac

SEQ ID NO: 6866508 - DNA, 103 bp, Homo sapiens
agcactataccaacaaatggaaggatttccaaggtaattttgagtataaacaatgtttgctttactcatcgactttgaaatcctaacacctgggtgaaatgct

SEQ ID NO: 6866509 - DNA, 56 bp, Homo sapiens
gatacacggagtggagactgtggtgataggtccagagatcacccgttctgcgtgtc

SEQ ID NO: 6866510 - DNA, 87 bp, Homo sapiens
ggtccagtcctggcatggagtggatggccccagagagcggagaggaccccgtgcctggggccatctcacccactgttgagacaggcc

SEQ ID NO: 6866511 - DNA, 79 bp, Homo sapiens
atggtcttgccaatattagctgtgtaactctggttggataaattgcttaaccttgttgagtttggctaaccaagaccat

SEQ ID NO: 6866512 - DNA, 129 bp, Homo sapiens
ctacaagatcaggcagttcctggactgttcgaccactgagaatgacctgtccctgtgtgagggcttcaatgaggccccaaagcagtgcaagtacaaccatggtctgagctccctgccttgaagacgttg

SEQ ID NO: 6866513 - DNA, 66 bp, Homo sapiens
gcaggtcttagagagatgttatggcaactcagttctctgggtccttgctaacttctatgagcctgc

SEQ ID NO: 6866514 - DNA, 100 bp, Homo sapiens
gtcaggactctgtattctattttcagggacaagtcttgtgtaagtcctcactgtgaaattcaacttgtctttgtaaaatagaaaaccagatttttgtaac

SEQ ID NO: 6866515 - DNA, 83 bp, Homo sapiens
ggagatgtgattgcattaaggatcttgagatgggggattatcccggattattcaggtggtcctaagtgccatcacaggtatcc

SEQ ID NO: 6866516 - DNA, 58 bp, Homo sapiens
agggtctgcagggatcttctggcatcgaagaaagagccagttatcttcagtagactct

SEQ ID NO: 6866517 - DNA, 61 bp, Homo sapiens
tcatttttcacacagggtcaccagaataccatcaattttttggtatcactgtcaaaagtga

SEQ ID NO: 6866518 - DNA, 56 bp, Homo sapiens
ggttccccgcagccttggtttatggttaaatattacagaggccccgtgggagagcc

SEQ ID NO: 6866519 - DNA, 55 bp, Homo sapiens
ttccccacccaaaagaactgttgttccccgttcacagttccacatggctggggag

SEQ ID NO: 6866520 - DNA, 58 bp, Homo sapiens
cagtatctatatcatagtgttgtttagaggattaaataatactgcatgtaaggtgctg

SEQ ID NO: 6866521 - DNA, 76 bp, Homo sapiens
acctacagcttttgaaaaattactggcagcttttctttcatcacagccagttctttcagcagagttgagtcagggt

SEQ ID NO: 6866522 - DNA, 78 bp, Homo sapiens
gggcattctccctctatgtgtgcctgcgtccagatttcttctccttatcaggacaatggtcatactggattagagccc

SEQ ID NO: 6866523 - DNA, 105 bp, Homo sapiens
actgcaaaatacttcagggctcaaaaccacctcttcaccctccttttgcaggtgagcatgagcctggattgaagtgggtggtaatgaactcttgaaggaagcagt

SEQ ID NO: 6866524 - DNA, 115 bp, Homo sapiens
gaggcatgggagggtgtgagctgtcatgcagacagggttgttttgtggtcttataaatgtggatgaaagccccgccttgtctgtaactttgacaactacagagtttctgtgtctc

SEQ ID NO: 6866525 - DNA, 55 bp, Homo sapiens
tgaaaacactttagtttaggtcagtctaggcctgaaaaccaggaagatgttctca

SEQ ID NO: 6866526 - DNA, 62 bp, Homo sapiens
tgccttgcacataatatacattcaatcagtgtttgttgaatgaataaatcaatgtgtgggca

SEQ ID NO: 6866527 - DNA, 60 bp, Homo sapiens
gggagtagaagtatttgtaaaaaggcagcaatgtttccataggatctgcttcatactgct

SEQ ID NO: 6866528 - DNA, 94 bp, Homo sapiens
cctgtctgagattgtgcagggaagtgcagggcctgcccagcaggatttccgttctgtgtgtgctgccctcaaaatgtctacacactcagatggg

SEQ ID NO: 6866529 - DNA, 96 bp, Homo sapiens
gttttttttaaaaagctgagttctcattgcatgagacagaaaacatacgcaagagaaaactgtgggttatctcagcaagagaatattagaaagaac

SEQ ID NO: 6866530 - DNA, 68 bp, Homo sapiens
gaggtggagttggcactgagctgtgattgcatcactgcactccagcctcagtgacagagccagacctt

SEQ ID NO: 6866531 - DNA, 70 bp, Homo sapiens
ttgtttctgttgtaggaacagcagcagtattggtatcgacagcacttgcttagtttgcaacagaggacaa

SEQ ID NO: 6866532 - DNA, 65 bp, Homo sapiens
gctagtcagtgggcatgtatgtatagttacttagatagatgttgcctaactgccctctgaaaagt

SEQ ID NO: 6866533 - DNA, 67 bp, Homo sapiens
ggctgcaggagtcccagaaggttttgttttgaaaactggggcctggctgggacccctgagggtggcc

SEQ ID NO: 6866534 - DNA, 128 bp, Homo sapiens
gggagtcttgcccaccctcaagctcgtgggttaggaaggggcttccctacatggccctacgtctgtgctagtctcagggtggcctctgtgctcctgcctacttcagcgactgtgggaacccatcttct

SEQ ID NO: 6866535 - DNA, 72 bp, Homo sapiens
ctcagaggcttcagaggaagtgcggccctgctgacactttgcttttgggcttctgtcctctggatctgtgag

SEQ ID NO: 6866536 - DNA, 59 bp, Homo sapiens
tgtttgtatgtatcaattatctgtctgcatgtacacatgcttgcatgtacatatacaca

SEQ ID NO: 6866537 - DNA, 57 bp, Homo sapiens
ggcaggggtggcaaagggtgggtcccagggccacaccatcgtttttaccttaatgcc

SEQ ID NO: 6866538 - DNA, 64 bp, Homo sapiens
gggcattattttggatgctgagatgatagtccttttgaccaggatgtctcaagtatccaagccc

SEQ ID NO: 6866539 - DNA, 90 bp, Homo sapiens
cagatgtttatttgccttttcagggtatgttctagatctgactgattttttaagtatttgacactaggtgccctgagcaaacaaaaactg

SEQ ID NO: 6866540 - DNA, 56 bp, Homo sapiens
ctgtgggagaggcacttgctacttccggggttggactccagcaacttctcccacag

SEQ ID NO: 6866541 - DNA, 89 bp, Homo sapiens
cctcttctgaactcctgcagctgataaatacagtctagtcctccatggtctcaacagctagtgtttgccagcgtagccttctagagagg

SEQ ID NO: 6866542 - DNA, 90 bp, Homo sapiens
agatatcattttttgaacagggagcattttgttgcataggtgttttggcaattgtgaaacactgcgataaaatcctttttcattggtact

SEQ ID NO: 6866543 - DNA, 108 bp, Homo sapiens
gcatgttgtgaacatgtttaatggtatttgttgaaaaactgtgacatataattgatattaagactttcagagagtgacatgagaagtagaagccatgatccaacatgc

SEQ ID NO: 6866544 - DNA, 69 bp, Homo sapiens
cacatttgctggctgaatgttggacacttacgtttattaaaggcatgaggttcaccattcagagatgtg

SEQ ID NO: 6866545 - DNA, 74 bp, Homo sapiens
atcgcatagaggtcctgctcaaaatgtagatttctgggtcctaaattaatctgctgagtcagacctctggggat

SEQ ID NO: 6866546 - DNA, 69 bp, Homo sapiens
agtgtcttcctatactgggagcatttatctatttataaggtttgatttcctaatttagggatagacatt

SEQ ID NO: 6866547 - DNA, 83 bp, Homo sapiens
aggaactgcagttagtgtatattgccttcaaacataacccaaaaattgtatttgaaaattaagcagtgatttgtagtggtcct

SEQ ID NO: 6866548 - DNA, 55 bp, Homo sapiens
ggccactccgctgctactggaaggtagatccgagccgagtacgcgcgcgtgcgcc

SEQ ID NO: 6866549 - DNA, 72 bp, Homo sapiens
ggaatctttcagagctccatcagggagtcaggaccttccttttccctgatgttttctctgcctttggattcc

SEQ ID NO: 6866550 - DNA, 79 bp, Homo sapiens
gggctgtggaatacggaggggagctttactgcaggttgcaccacttagcagtgggtgcctctcattatatccacatccc

SEQ ID NO: 6866551 - DNA, 84 bp, Homo sapiens
cagtggatcagagccaactaggagattaaggtagatcttaacaaagtcgctgttcctgaatgcctggctggctttgctgcactg

SEQ ID NO: 6866552 - DNA, 129 bp, Homo sapiens
tactcttgctgcttcaatgatataatgctttgctttaaggtttgcttatcttcgcctgtgaaaccacaggtgaagaattataaactaagggttttagccatgtattcaagaagggatttggcaaacaaa

SEQ ID NO: 6866553 - DNA, 62 bp, Homo sapiens
ggtacgggaacttgggcaagccccagctgtagcctactcagccttgcccagggtctcctgcc

SEQ ID NO: 6866554 - DNA, 87 bp, Homo sapiens
aagccctgttcttgctgacccagaatgttaatgaaataaaggcaactcagaaacagtgttctagggtgtggctaggaacaagggttt

SEQ ID NO: 6866555 - DNA, 64 bp, Homo sapiens
aggtggtatcatcacaatgcatctagcatccagccttcccagatgtacaggatggtgctcatct

SEQ ID NO: 6866556 - DNA, 102 bp, Homo sapiens
ggttaagagaaaagtgagatgttttcttgtcttatatttatttggctttgccacctattagctgaatgaacatggacaagttaataatactcctcctttact

SEQ ID NO: 6866557 - DNA, 67 bp, Homo sapiens
tcaggcagatggatgggcatttgttcagtcgtggtaatggacatggattatgttcccatctgtttgg

SEQ ID NO: 6866558 - DNA, 78 bp, Homo sapiens
tggaaataaatcatttagaggaatctgaaataaaattgtagcagttgatttatggcttctgtgaagaatttgttttca

SEQ ID NO: 6866559 - DNA, 63 bp, Homo sapiens
acagtggaagcatgatgctatcatctagtgacactcatcttgcagtatcatatttttactagt

SEQ ID NO: 6866560 - DNA, 86 bp, Homo sapiens
gctgtctcggggccaccactgggtgtgccgctgcctggccgggggcttatgcctcccatgccatactggccacccgggccctcagc

SEQ ID NO: 6866561 - DNA, 57 bp, Homo sapiens
gacaaagcgcctgctcgcgggccccttcaccatctcccggagacgggcgtctttgtc

SEQ ID NO: 6866562 - DNA, 70 bp, Homo sapiens
ggtcacacagctgcttgttagaatagcagtccccctgtgctactgctccctgcactctgcagccctgacc

SEQ ID NO: 6866563 - DNA, 79 bp, Homo sapiens
aggagaaactgtaaagcaggtgagtagaacagacagcatcaatccaggtctacatttctcctttttacattttttacct

SEQ ID NO: 6866564 - DNA, 55 bp, Homo sapiens
acagatctcaaagcctggaccccaccagagggaggtgttggctggccagatctgt

SEQ ID NO: 6866565 - DNA, 104 bp, Homo sapiens
cccgaagtgtgaccttccaggcccacagggtggctggcgctgcgcttcttcgtggcccgcgacagtgcggccaccttcatcggccagtggcgcactgatctggg

SEQ ID NO: 6866566 - DNA, 72 bp, Homo sapiens
gtactgagaggaacatcttatgcttctacctgtgtttgcaaagtgaagtctctaagactgtgccatcattac

SEQ ID NO: 6866567 - DNA, 125 bp, Homo sapiens
tcagtatctaatcaaatggggagcaaattactcatctatggctctgtcttttaagttgtttaggagaataatgaacttttagatagagtataggtaggaaatactgaaagccctgaaaatattga

SEQ ID NO: 6866568 - DNA, 109 bp, Homo sapiens
tctcttactaacagtatgaaaaatgtagattttagtgtcttattctctgttaaccaaaaggagatatagtaaatgctaaagctttgctttcattattataaggaagaga

SEQ ID NO: 6866569 - DNA, 82 bp, Homo sapiens
gcatcgaatacaagcatactcattccagactctcccggatcgtgcgtggcaggtggggatggggtgaggctgtggctggtgc

SEQ ID NO: 6866570 - DNA, 74 bp, Homo sapiens
cacctgatgcggtggtgcgtgtgatttgtcaaaagaaagccttctggatgctgttaagatgtacccttcaggtg

SEQ ID NO: 6866571 - DNA, 70 bp, Homo sapiens
tgaatccgggaggcggaggttgcagtgagtcaagattgggtcactgcactccagcctgagcgagacttca

SEQ ID NO: 6866572 - DNA, 62 bp, Homo sapiens
tccttcaatcacccagtggggaaaatgtgttataaaacactgccccctggagtattctggga

SEQ ID NO: 6866573 - DNA, 72 bp, Homo sapiens
ttggaagctgtggtcagggatgagagtgctggggatgtgtgtggaccagctgtaccctggctatgcttctga

SEQ ID NO: 6866574 - DNA, 75 bp, Homo sapiens
cggacgcagatgagcagcctggatgttgggcagcccaccccagagagcggcccagggtccctgctctctgtgctg

SEQ ID NO: 6866575 - DNA, 130 bp, Homo sapiens
tctgaggctccatggcttagccatgcaacttgggcagtggctgggcctctctgaggtttgtggttctcatcagcagaacagggagccggccatgctgaccgctgcctttgggctgagcttggaccgcagg

SEQ ID NO: 6866576 - DNA, 60 bp, Homo sapiens
cagatccttaggacaaccatccacagtgtgcagggcaaggaggatgtccccgagggcctg

SEQ ID NO: 6866577 - DNA, 74 bp, Homo sapiens
cttgcatgtgtgtgcctgtgtgtgcgtgtttgtgaaccaggacaagtgaacacaggggctcggctgggtgcagg

SEQ ID NO: 6866578 - DNA, 82 bp, Homo sapiens
ctattgttattatacagtcattttggctgctgtcttcattataactatgcaagccaagttggaagactgaataatgaattag

SEQ ID NO: 6866579 - DNA, 79 bp, Homo sapiens
tgtagctccaaacctgttatctataatcagtacactttactggatttaacagaataccaggttcaacttggaactgaca

SEQ ID NO: 6866580 - DNA, 120 bp, Homo sapiens
ttttatttcaggttaaaaaaagaaaaagactggtgtgttacatatatctcatgcttaggaatattagtgattttttctgttttgtgtgtggcatcttgtttttacggacccttgataaaa

SEQ ID NO: 6866581 - DNA, 60 bp, Homo sapiens
attgtcatctagagcagtgctggacaaagcacaatcctccagccaaatctggctgacagt

SEQ ID NO: 6866582 - DNA, 73 bp, Homo sapiens
gttattcaaggctgttttgtataaactggattgatgcataatcttaagttatgctggaatagctttttttaac

SEQ ID NO: 6866583 - DNA, 85 bp, Homo sapiens
atctccccatgtccagaagaacagtaattccaagtgcttatacataaattatgttaggcattaaaattatatatggtcggtagat

SEQ ID NO: 6866584 - DNA, 55 bp, Homo sapiens
atcagcgccacgaggaagcagctgaggggcagcaccttccaccagggccgctgat

SEQ ID NO: 6866585 - DNA, 60 bp, Homo sapiens
gaatagaatcaagaaaatgaggattcttcccttctgggaagcaatacttcttggttattc

SEQ ID NO: 6866586 - DNA, 57 bp, Homo sapiens
ctgatctaggttaggcctatatgttattggcctaacatataggccaatcaagattag

SEQ ID NO: 6866587 - DNA, 101 bp, Homo sapiens
aaccattttgccaaaaagttacacagatttcagtatcatcactctataagaaaactagactgatagtgtctaaatctgtgcccagtttctgtactttggtt

SEQ ID NO: 6866588 - DNA, 73 bp, Homo sapiens
agagccggtttgggcctcggccaaggacggggtgtcctggcccagcctgggtgtgaggcccatccgcggctct

SEQ ID NO: 6866589 - DNA, 123 bp, Homo sapiens
tgaaggctctcttgcctggcttcacaagctgacttagagcagttggcagctgtattcaccgctcaccatcaggatcactgttctcaactttcttcggcagccggaaagagataaacaccttca

SEQ ID NO: 6866590 - DNA, 112 bp, Homo sapiens
gatattaggtgggtgcaaaagttattgcaggttttgccattagaagcaattgaggtttatggccctcacttttaatggcaaaaactgaaattacttttgcaccaatattatc

SEQ ID NO: 6866591 - DNA, 89 bp, Homo sapiens
tgaatcattctgcttggctggaaataggttgagatgaatctgatttgtgtttgacttaataaaactccatttcacttagaatgtcttta

SEQ ID NO: 6866592 - DNA, 59 bp, Homo sapiens
actgatatacagagcattctttgatgttaaaacatcaaaaaatggcattgtattattgt

SEQ ID NO: 6866593 - DNA, 74 bp, Homo sapiens
tagaagtcaagtgttattattgtagcgttatcatcagtctgattcattgcagtagtaatagttgaaattgttta

SEQ ID NO: 6866594 - DNA, 67 bp, Homo sapiens
cccaattcagagccttgcttctcttgcctggatgcccaggcagcagccacaaggcctgagcattggg

SEQ ID NO: 6866595 - DNA, 64 bp, Homo sapiens
gtgcaccctgggatttccacagccacgtggattttaagccaaatccaggatgatcccatgacac

SEQ ID NO: 6866596 - DNA, 117 bp, Homo sapiens
agtcagttccatgtagattgagagactcttgggatatggttattggccagatgccatatatgttgtatatgaaactgggataactatagcagaggttgttttgaaaatgaattggct

SEQ ID NO: 6866597 - DNA, 58 bp, Homo sapiens
ttccactccacccctgcaaatcctgagctgcatgcagatggggcaggggtgggtggag

SEQ ID NO: 6866598 - DNA, 64 bp, Homo sapiens
ggggggctttacagggcgtcagttaaaactcattgcacactggaagggctttggaaagccttcc

SEQ ID NO: 6866599 - DNA, 69 bp, Homo sapiens
tgcagcaaataaagacaattatgtcctgtgtagtatataagatatatacaacattgctttgttgctgca

SEQ ID NO: 6866600 - DNA, 87 bp, Homo sapiens
tgggagaaggaagctgcctgggatgggaaatctgtccagttctgagggtggctttcctactaccagtgtacttccagtctaactcca

SEQ ID NO: 6866601 - DNA, 80 bp, Homo sapiens
ttcaccatttacttattgtgcgaagttgggcaaatagtgtaacttctgtttctcagtttcctcatatgtaaaaatgggaa

SEQ ID NO: 6866602 - DNA, 70 bp, Homo sapiens
ccttggggcctccccaagcagcagggattcaccagggaaccccgctcaggctgggtgaggctctggaagg

SEQ ID NO: 6866603 - DNA, 108 bp, Homo sapiens
gtttagctgaagctgagacagatttaggtagaagacttatattgctctcctctgagatcccattgaaagtcctatctaagggagatattctgctcttacagctttgac

SEQ ID NO: 6866604 - DNA, 83 bp, Homo sapiens
cacatgggaaggtcacagatgagggaagggccttcctagaacccctagggcgacgcttgcctcatctgtgaccttctgcagtg

SEQ ID NO: 6866605 - DNA, 73 bp, Homo sapiens
caacagaaatcaattttcccatggcttcagaagttgcgaagtccgagatcaaagtgaagttggtttcctgttg

SEQ ID NO: 6866606 - DNA, 63 bp, Homo sapiens
ttttcacaagggtccaactagtaaatatcttaggttttgtgggccagatggtccctgtgaaaa

SEQ ID NO: 6866607 - DNA, 109 bp, Homo sapiens
actgtattctttaaggggaatgattttggtgggggaatatatatatgtaaaggatttttcatgtgtctaatctactaatatccttttcttctttcttttaaaatatagt

SEQ ID NO: 6866608 - DNA, 58 bp, Homo sapiens
ggccttgtagcagagggatgcaccctgcagggtggaggtgggtgcctgccacggggcc

SEQ ID NO: 6866609 - DNA, 65 bp, Homo sapiens
gaagtcactattgagcattatttgcttcactgtacagaggaaggaactgatgctcaaagaatttc

SEQ ID NO: 6866610 - DNA, 80 bp, Homo sapiens
ccccccctgtgctgcctttcctagctgcggagaatgttttgaattcagactgacggccgaggcaagatcacggggcaggg

SEQ ID NO: 6866611 - DNA, 88 bp, Homo sapiens
aggtgcagtattttctgtgattctgaggttggctgaatagaatcgtagcatgtagcacaggaatccacagtcttgtacctctgtacct

SEQ ID NO: 6866612 - DNA, 61 bp, Homo sapiens
atgctgtcagtattatgtgcagtccattaccaaggcaaattatataacatgctgtcagtat

SEQ ID NO: 6866613 - DNA, 82 bp, Homo sapiens
tggtgtcctcagcatgtcctgttttggcttgctctcagtttcctagagactagcatagtggcttgcacatggtagacactca

SEQ ID NO: 6866614 - DNA, 82 bp, Homo sapiens
cagaatggttcatgtttgtgtattgctcatttagctttcgacgtcctttggaaagttgaggaataaacaggtggacaatttg

SEQ ID NO: 6866615 - DNA, 69 bp, Homo sapiens
acctgcaggagcagaagcctaaacccagccttcactccactgctggccaggaggctgcttctgacacgt

SEQ ID NO: 6866616 - DNA, 83 bp, Homo sapiens
tacatagaggttagtttttcagatctggaatcagttaaattatttactaagggcgccagtgtcagaaagattatcctctggta

SEQ ID NO: 6866617 - DNA, 56 bp, Homo sapiens
tcctccaagcagaggccctgaagtgactgcattttgagtctctgaaatttggaaga

SEQ ID NO: 6866618 - DNA, 74 bp, Homo sapiens
gtgattttttttaagaaactatggagaagaactggtatgaaactagagttcttcccttttctatggagaatcac

SEQ ID NO: 6866619 - DNA, 105 bp, Homo sapiens
ctgggaagaggcgctcctcacttcctagatgggatggcggccgggcgcagacgctcctcactttccagactgggcagccaggcagaggggctcctcacatcccag

SEQ ID NO: 6866620 - DNA, 78 bp, Homo sapiens
agaggaaattctgctcttaacataatgtagcttaaaagaaaatgctgcattttgtcaaagagtcagcgatgagcctct

SEQ ID NO: 6866621 - DNA, 72 bp, Homo sapiens
agatgagcaggtcacatgcagtagcagggattggtctggttaaaacgtgatcatcctgcctgtctctcatct

SEQ ID NO: 6866622 - DNA, 76 bp, Homo sapiens
aaggcatagttcttatccttcagcattctggaattccctcgatgaccacagggctgcaggatgaggctctgctctt

SEQ ID NO: 6866623 - DNA, 109 bp, Homo sapiens
gatgggaaaatgcagctttataggaaacactcatgtgttactctccatcagagaattcataatggacagaaaccatatgagtgtaagcaatgtcagaagtcctttagtc

SEQ ID NO: 6866624 - DNA, 69 bp, Homo sapiens
ggagagtagaaagtaaagtacgaatggttgactgagtacacacatctattttattatctactgaactcc

SEQ ID NO: 6866625 - DNA, 56 bp, Homo sapiens
ttctggatcagcatcatgagataatttgcttagggtatccaggatgttgatttgaa

SEQ ID NO: 6866626 - DNA, 67 bp, Homo sapiens
ggtcaagctggctgggagaggcacgaactgtactgaagctgtgtcttcccagcctgcttaagaaacc

SEQ ID NO: 6866627 - DNA, 79 bp, Homo sapiens
agcagcagctttcaacttgagtttttgtgatggaacaatagttaactatggctttcaaaggaactcggaggcagctcct

SEQ ID NO: 6866628 - DNA, 61 bp, Homo sapiens
gtatatgttcttgcactggaaagaactgcagaataatttttcctttggaagatgcatatac

SEQ ID NO: 6866629 - DNA, 82 bp, Homo sapiens
gctgggaaggcttgaagcccggagagaccatggggagcagaggcttctccccagctctgtgcttccactgagccaccccagc

SEQ ID NO: 6866630 - DNA, 66 bp, Homo sapiens
aagtggtggtatgaaccgagggaaaaggcgtccaaagaggccacgacttgctttcaaactccactt

SEQ ID NO: 6866631 - DNA, 60 bp, Homo sapiens
gggatatctggggactgaatttagagtgtttcccttttctatctactacttagatattcc

SEQ ID NO: 6866632 - DNA, 60 bp, Homo sapiens
tctttgaagtatcttaaatggtgaggaaactccaaaagacttctatttgagatttaaaga

SEQ ID NO: 6866633 - DNA, 81 bp, Homo sapiens
gtaggtggtaggtaagtggagtaggatttgaacccatgtctgtctgactccaactcccactcagcttcttaattacactgc

SEQ ID NO: 6866634 - DNA, 57 bp, Homo sapiens
gaacatagtaaatgtcacatttggaattggaacctccacctgtcccagtctgtgttc

SEQ ID NO: 6866635 - DNA, 62 bp, Homo sapiens
atgtaatttacgacctgctaaatctctgtcagctcatagttcacagatggcagttattacat

SEQ ID NO: 6866636 - DNA, 87 bp, Homo sapiens
gtttcttctccagctactctgaaccaattcgcaatgacatcaggaaggtttatgtgaaggctcagagtcatgtcaagcgtaggaaac

SEQ ID NO: 6866637 - DNA, 58 bp, Homo sapiens
ggtagccacaagttaactccaagttctccaaggggttctggaggcacctgtggagatc

SEQ ID NO: 6866638 - DNA, 58 bp, Homo sapiens
ggtagccataagttaattccaagttctccaaggggttctggaggcacctgtggagatc

SEQ ID NO: 6866639 - DNA, 94 bp, Homo sapiens
gccagaggtaagatattggagctttctgagatctttccaggtgtgtcctaaatatccaggaatagatcagagatttcccaatgtccctatgggc

SEQ ID NO: 6866640 - DNA, 84 bp, Homo sapiens
tttcctcctgcaagactcctcactttctctgggaaaaaaatttgggggaaagttgagaggatcttgatattattgtagtggaaa

SEQ ID NO: 6866641 - DNA, 81 bp, Homo sapiens
tcttcaaatcctacagtgtctggtcatttctgcccaagatacctttggtaatttaatttcagatatctgtctatttggaga

SEQ ID NO: 6866642 - DNA, 61 bp, Homo sapiens
cacaaagtctgcagctgctgtacatggacaagaagcccacaagcagctagaggaccttgtg

SEQ ID NO: 6866643 - DNA, 84 bp, Homo sapiens
tgagctacagtactaagactccacctagccatttaagacaatattacaaaatgaagctgggtataattttcagtagtgtagtca

SEQ ID NO: 6866644 - DNA, 96 bp, Homo sapiens
gtcctaaaaagccaaaaagatttactatctggccctttacagaaaaagtttgctgactcttcgtataggtgttaaagtaagttacaagagcaggac

SEQ ID NO: 6866645 - DNA, 57 bp, Homo sapiens
aggagacagtttggacgtgtagaatataaatttctactttggctagagttgtctctt

SEQ ID NO: 6866646 - DNA, 71 bp, Homo sapiens
gcatgagaccagtgagtaggccttagattggatgtgtccacatatcctctgagtcgctccctggatccagc

SEQ ID NO: 6866647 - DNA, 85 bp, Homo sapiens
tgagcacagtgccagctctgcagggcctggggtcactgagaactcaaccgatcctctgaccgctgcagggagtcactggtgctca

SEQ ID NO: 6866648 - DNA, 91 bp, Homo sapiens
ggaaattccttcatgggaaacaagcagatggccagtgtccagccctccaggaggacagacaggaggccacctgctcacccatgatggatct

SEQ ID NO: 6866649 - DNA, 89 bp, Homo sapiens
gcgccaccttcctcagcgctgctgtgcaccgagtcctgtaagccctataggccgctgctactgttcggcatgctgaaggaggactgcgc

SEQ ID NO: 6866650 - DNA, 63 bp, Homo sapiens
gggaatctcgcatttagttctcaactccctgccaggggaggaaactgtcctcccgaggtttcc

SEQ ID NO: 6866651 - DNA, 68 bp, Homo sapiens
ggacaagtggcccggtgtgttattgctccctcatcacaatgactatctagagtggggcaaacttgtcc

SEQ ID NO: 6866652 - DNA, 89 bp, Homo sapiens
tctctcctgatagcaacttggacaagccctgtgtgtccagatagaggtggtgacatgacacagggggcattctaggagttggggaggga

SEQ ID NO: 6866653 - DNA, 68 bp, Homo sapiens
attaaagtatgattggggattatttactccctttgaattctgtagaaatatccacatcatactatagt

SEQ ID NO: 6866654 - DNA, 92 bp, Homo sapiens
taactaaattgcctaaagttacatagctagtagatggggaagctgagatttaatttcagaaaacctgactctagaactggtagttgtagtta

SEQ ID NO: 6866655 - DNA, 67 bp, Homo sapiens
tcttgatctcttctagctctgaaattatggaaatgaatgattcagttcctagacagaggtttcaaga

SEQ ID NO: 6866656 - DNA, 108 bp, Homo sapiens
gagtctcagttggttcagggtcctggagcttgcagttttctgttgggtttcaaacgccaactttaaagaggaggcttgggttccactcttaatgctaataaaagactc

SEQ ID NO: 6866657 - DNA, 60 bp, Homo sapiens
gaggagctgcactgggagtttttccattcttggtggaggaaagatgagggcatgcttctc

SEQ ID NO: 6866658 - DNA, 88 bp, Homo sapiens
gttgcctggtacagaatctgttattgaataggtgctaccaattaatgttggtagcactgactttcatgacaggactgtaaccagtaac

SEQ ID NO: 6866659 - DNA, 92 bp, Homo sapiens
atgacacatatctggaatgatggtcatatgctaattcaggatttcctaattctaatgttcatatggctatgctatacttagagtagtggagt

SEQ ID NO: 6866660 - DNA, 61 bp, Homo sapiens
cttgaggagcttcagaggaatcttagcaaagccaagttcagttccccaaagcctcctagag

SEQ ID NO: 6866661 - DNA, 118 bp, Homo sapiens
ccatgggactcagtgccactgctcaaggtctccatggctgagcctgggggctcttacaacaggctccatgcccaaggtggcagttgtggaaccatcagagagggcacagagctcatgg

SEQ ID NO: 6866662 - DNA, 68 bp, Homo sapiens
agaagaggtgactgagtttcagtgtgagggatggatctacttcataatagttccttagtctcctctct

SEQ ID NO: 6866663 - DNA, 60 bp, Homo sapiens
gccaaaagtgtgtgaaggcaggcacataaatagttaagccacagtcacacatttgttggt

SEQ ID NO: 6866664 - DNA, 96 bp, Homo sapiens
ttaatttaatgcttaggtcatgttacatacctcatagactcaggaagatcctttttgggagaatgcaggatgtgctgatttagtagtagaaattaa

SEQ ID NO: 6866665 - DNA, 76 bp, Homo sapiens
agctttttgaagtggatagaggccctgctttgaagctgaaaatccaacttaaggctccctttgccacttgttagct

SEQ ID NO: 6866666 - DNA, 61 bp, Homo sapiens
ttcaggtgtctgcctctttgagttcgctgaaaagttggatcttacatatttagcacctgaa

SEQ ID NO: 6866667 - DNA, 86 bp, Homo sapiens
tcaggaccacagtggagattgcagattcagttctggcaaagtaggactttaagagaatcactggaattgttttttacaggttctga

SEQ ID NO: 6866668 - DNA, 72 bp, Homo sapiens
ccccaaatgctggtttcctctagatgttggagttccagtttctacgaaggtcaaccctaaagcacttggagg

SEQ ID NO: 6866669 - DNA, 57 bp, Homo sapiens
ctctcatgcaaaatttagttctttgtttctcagcttaaactggattttgatgagcag

SEQ ID NO: 6866670 - DNA, 69 bp, Homo sapiens
acaaagccaaagtcctagaaattcaacagaggcaaatccatgtagtattattaaggacatggactttgt

SEQ ID NO: 6866671 - DNA, 91 bp, Homo sapiens
tactttgtgcaatttggtataaacatggagtgcattctttaccttggcaatgtctgccctgagattgggctctatggtgccacaggaggta

SEQ ID NO: 6866672 - DNA, 56 bp, Homo sapiens
ctcggtggcctctcatgcaaggtagccacaggctctgggttcactgaggctctgag

SEQ ID NO: 6866673 - DNA, 80 bp, Homo sapiens
tttagggtgtgtcatgtatgtctatctacctgctcagtgacattgagcagagtgccccatcacaaggatacacctctgga

SEQ ID NO: 6866674 - DNA, 98 bp, Homo sapiens
gtggcagaaagtgtggtacttagaagttatgataataatagtgtcttactaaagtcatcaaagaactttcgtatgtattactattaaattttctctac

SEQ ID NO: 6866675 - DNA, 120 bp, Homo sapiens
aaaaggactgagaggcagcttcaggaactgagttgtatggtgatcccctcaacacaaagagttctccaccattgatataactcagtctctcatttggtctctgcttctctcattcctttt

SEQ ID NO: 6866676 - DNA, 129 bp, Homo sapiens
ggacattcactaagcccatcatgcatgttattagagagttggcagcattccagccaagcacataaagtgctggcaccagaatgactgcagactctcatgtccacagcagctgttaggtctgtgatgtcc

SEQ ID NO: 6866677 - DNA, 82 bp, Homo sapiens
tggtacctgaagagaggttttctgggtttctgtttctttattgaggacgaaacacacctggttaacctcttttccagtatca

SEQ ID NO: 6866678 - DNA, 88 bp, Homo sapiens
ggttaaacatggccgggtgctttggctcacgcctgtaatcccagcactttgggaggacaaggcaggcggatcacgaggtcaggagatc

SEQ ID NO: 6866679 - DNA, 105 bp, Homo sapiens
acattgagcaagattcacaataggagcatgcaaatattatgcgctactcatatcagtggtgcataatatttgcatgcttctattgtgaatgtcgactattaatgt

SEQ ID NO: 6866680 - DNA, 69 bp, Homo sapiens
ctttatacacagtatcaaatttcatcttcagaataaccttatgaggaagatatgttattgtgtttgaag

SEQ ID NO: 6866681 - DNA, 70 bp, Homo sapiens
ggtaggaggatcacctgaggtcaggagttcgagaccagcctgaccaacgtggtgaaaccccatctctact

SEQ ID NO: 6866682 - DNA, 66 bp, Homo sapiens
gggctctcccactgcaagcccaggctgctgtcccagctgcttataagatttgggagatacctgccc

SEQ ID NO: 6866683 - DNA, 65 bp, Homo sapiens
ccctcctaagccatgcaagccacaaggtgattttcttcccctatgtgatagctggttgtgggggg

SEQ ID NO: 6866684 - DNA, 123 bp, Homo sapiens
agatcatggttcagtttcttgcagataaatatttgagttctagtggctgcagattgaaggaataccattcatacttatcaaatgtaatttttagaaagatctcaagtattatctaccacatct

SEQ ID NO: 6866685 - DNA, 79 bp, Homo sapiens
ctcttcccaagccatcctctgagcactaggcatgacttcagagttatattaaggagcagcagggggtgggtggggaggg

SEQ ID NO: 6866686 - DNA, 72 bp, Homo sapiens
gttgctcagctccaggaggcacctttggaccatgttccatgcacgtggcccacgcctttggagctgtgcaat

SEQ ID NO: 6866687 - DNA, 83 bp, Homo sapiens
gggtctggctcctcaggaagtagcatgtgtcaagggaagatgtgtgacatggggaagaactttctagaggagttaccaggtcc

SEQ ID NO: 6866688 - DNA, 76 bp, Homo sapiens
ataggctccaagggggtgaatgtctgtctacatatcaacctatctagttaataggattcactcttttgctgtctgt

SEQ ID NO: 6866689 - DNA, 62 bp, Homo sapiens
agggccattgcaggctgaagtggcagacgctttgccatcaaataccagcctgaatgcgcttt

SEQ ID NO: 6866690 - DNA, 58 bp, Homo sapiens
acttctcttccccggaactctagcaactcaactggaaacatgcaccagggaagagagt

SEQ ID NO: 6866691 - DNA, 90 bp, Homo sapiens
aatgagcctgaatgggcaaggggtaaggacacttattttcctttggctgaattgaaggttcttcctccccatgtcccagaatggttcatt

SEQ ID NO: 6866692 - DNA, 66 bp, Homo sapiens
actgtttcattaagctgtggacttagtgaaataaggtggacttaagtccacacgtagtgaaacagt

SEQ ID NO: 6866693 - DNA, 78 bp, Homo sapiens
gccccagaaaggctcagattcccccaggccatcccccatcctgaggacaaggttttgggcccttttctgtttgcaggc

SEQ ID NO: 6866694 - DNA, 63 bp, Homo sapiens
ccatttcacccactgctttaggctgccagtctcttgtctgtctcttcagcagtggtgaggtgg

SEQ ID NO: 6866695 - DNA, 55 bp, Homo sapiens
tgtctgtctgttgattcagaaatgtggtttggaatttcttggtgaacagcagaca

SEQ ID NO: 6866696 - DNA, 59 bp, Homo sapiens
gtccctcacccagatgctcccagaacctgttctaaagaaatattagggagaacagggac

SEQ ID NO: 6866697 - DNA, 69 bp, Homo sapiens
agatagttttattgagcagcagtgcttctagaggcatcacaggatcctctgataattgttaaattattt

SEQ ID NO: 6866698 - DNA, 88 bp, Homo sapiens
agttcctgtcgcagtgttgagtggtggctgaaacaatggcagccactaatgttgatagctaagcacttacactggaagggtagggact

SEQ ID NO: 6866699 - DNA, 98 bp, Homo sapiens
tcccatgtgcctttaaggaatcattcttgatctcagccataaaattggaaagctgcataactgacaagatgatccctgaaggcagctgaaacatgggg

SEQ ID NO: 6866700 - DNA, 56 bp, Homo sapiens
tgtttcttacgtttttagaggcttcgtgacggagttatcagagacattgagaggca

SEQ ID NO: 6866701 - DNA, 99 bp, Homo sapiens
caattccttcatgcagattacgtaatcaggatgtatgattttccaagcagttcatgaatcctgaaaacttacgaagtgggtatgggaagaggggagttg

SEQ ID NO: 6866702 - DNA, 75 bp, Homo sapiens
agtcttggtatggtaaaaatatggacatgtttggaacatggaactgttactaatcttttctgctattttaaggct

SEQ ID NO: 6866703 - DNA, 57 bp, Homo sapiens
ctggaaagcagaggctgtagtgagctgagatggcaccactgcactccagccttccag

SEQ ID NO: 6866704 - DNA, 101 bp, Homo sapiens
accaagatacagcttgaagcaaggtgttatgccaacttgactgagctaagggatacccagatagctggcaaaacattatttctgagtgtgtctgttaaggt

SEQ ID NO: 6866705 - DNA, 57 bp, Homo sapiens
gctcagcttgggagcgcccggttctttttactactctgtctgcctccctttctgagt

SEQ ID NO: 6866706 - DNA, 59 bp, Homo sapiens
gctgtaggactgagaatgatttttaaaagaattttttagagaagatttaggttcacagc

SEQ ID NO: 6866707 - DNA, 130 bp, Homo sapiens
tgcagtgagtcgggtatttctagtatgcagaggaaatacactactaagcacagattgaaatatgtagggatctttttatttgttgttggttttgtgtcattttgccctatgagaaaggagaccatttgca

SEQ ID NO: 6866708 - DNA, 58 bp, Homo sapiens
tcaggctttttctcaacctcttgctgccaggtttgcattgaggtagggtgggggctga

SEQ ID NO: 6866709 - DNA, 73 bp, Homo sapiens
tgcagccctgagctcagctgggaccaatgtgttggtggaaattaatagcagcattgggctcagaaaggttgca

SEQ ID NO: 6866710 - DNA, 58 bp, Homo sapiens
gggggtctcactctgttgcccaggctggtcttgaactcctgggcttaagtgatcctcc

SEQ ID NO: 6866711 - DNA, 75 bp, Homo sapiens
tgatgtacaatgtcaggagcaatgataaatttgccagcaatctgaaatgtgtcaccttttgacttagtggatgca

SEQ ID NO: 6866712 - DNA, 60 bp, Homo sapiens
ctgcctgtttgttatgtcatggtaaaacattttttgttaccacaaaatatcgaacagaag

SEQ ID NO: 6866713 - DNA, 58 bp, Homo sapiens
ttttctggagctaaagtccactctgccagtatgcagagcagactggagtaccagggaa

SEQ ID NO: 6866714 - DNA, 65 bp, Homo sapiens
gaagcatctttcagtgctgtctgaagttgttcttcattcatcagatgggttttgaaggatgtttt

SEQ ID NO: 6866715 - DNA, 68 bp, Homo sapiens
tcacttattaactcataccattaatactttactttagctatgtttggtatgcatgagttaatgagtga

SEQ ID NO: 6866716 - DNA, 64 bp, Homo sapiens
tgcccttctctgacattactgtcagcattgcagtactgtgctgagtgtaatgatggcagaggca

SEQ ID NO: 6866717 - DNA, 72 bp, Homo sapiens
gatgtgagtggtagctgggattcagctctcaaggaatggagaataggaagcacttagctatccacccacatt

SEQ ID NO: 6866718 - DNA, 55 bp, Homo sapiens
tgcataaatcttggaagttgttgttccaccctcacatttatttccagattatgca

SEQ ID NO: 6866719 - DNA, 129 bp, Homo sapiens
ataatgtctaattaagacatctgttaaatgtctacaatattaatagaaggggttctaatagaactgtattggaattgtccatttaattaacctcgtgagcctttaatggatgtcttaaatagacatcat

SEQ ID NO: 6866720 - DNA, 64 bp, Homo sapiens
agaaaccacagtacccaggaaaatttaatttattttatggcattttccaaaggactgggtttct

SEQ ID NO: 6866721 - DNA, 112 bp, Homo sapiens
gagagttggtatattctgttggttatcacagtctggactcaggcatacctaaatctgagattcagtgttgcctttgtcttgatgtgtaatcttagacaaaatagcctctctt

SEQ ID NO: 6866722 - DNA, 55 bp, Homo sapiens
catgacatctgcttagtatgaatttgacgtaagaccttactaggtgagggtcatg

SEQ ID NO: 6866723 - DNA, 59 bp, Homo sapiens
aagagagaccatgggggacagggggaatggagtcccttaagtccctcatgtcatctctt

SEQ ID NO: 6866724 - DNA, 120 bp, Homo sapiens
gctgatattgtggtaatagtggttattgttattgttagaagcagtcacattattattgttagtgacaatattatttgacagtaataaagcacaagttaattagttgccatgacattcagc

SEQ ID NO: 6866725 - DNA, 88 bp, Homo sapiens
gaaaacctacaggaatctggctgagggagacagtgcggactaatatttcatttctccccactcctccctctgaggaatccaggacttc

SEQ ID NO: 6866726 - DNA, 64 bp, Homo sapiens
agtttacagacagacttcccaccctcagggtcatctgaggtattggccattgtctgttcagact

SEQ ID NO: 6866727 - DNA, 76 bp, Homo sapiens
cccctttgagaaattacttcagtgatggcacaggttttgccttcatccttctgtgacttctcaggttggctggggg

SEQ ID NO: 6866728 - DNA, 80 bp, Homo sapiens
ctgcagaagccaaattggcctttgtcatcaagatcagaggtatcaatggtgtgagcccaaaggtccaaaaggtgttgcag

SEQ ID NO: 6866729 - DNA, 55 bp, Homo sapiens
ggcttttaaacacctggggagtgggggaggtgcccactcctcagtcccagaggtc

SEQ ID NO: 6866730 - DNA, 63 bp, Homo sapiens
ggtcgccgtccgccgcctgggccgacaggagtcacctttgagcctgggcgcggacccgttgct

SEQ ID NO: 6866731 - DNA, 66 bp, Homo sapiens
ataagggatgggtgttgggctttatctgaattattatcttaaatgcccacaccatttattctttgt

SEQ ID NO: 6866732 - DNA, 64 bp, Homo sapiens
tgttacttctgaccccccagccccagcaaagcaggaagtggggcctgggtggagaggggtgaca

SEQ ID NO: 6866733 - DNA, 63 bp, Homo sapiens
tgaaatactttggctctttgttattaataacctgaacaatgaaagagcccaaagtagtattca

SEQ ID NO: 6866734 - DNA, 88 bp, Homo sapiens
ccttttttctgttctgtcacacactggtactttggcatttgttcagtgccaaacaaagttctgccaggctgtggcagcaaaggactgg

SEQ ID NO: 6866735 - DNA, 81 bp, Homo sapiens
agcttctagacgctgcctgcattccctggcacatgaccccttccttcgtctccaagcctgcagtgtagcatctacgaagct

SEQ ID NO: 6866736 - DNA, 61 bp, Homo sapiens
agggcctgggccagcaccctttgaggcccacaacagggcacacaggggagggccaggccct

SEQ ID NO: 6866737 - DNA, 89 bp, Homo sapiens
tcagattcctttgttcattcacccaggaaacatctcagagcagaggtctgggctcggatgtggtccaggagttggagagtcaaagctga

SEQ ID NO: 6866738 - DNA, 123 bp, Homo sapiens
ttttaaaagcgatgtaacttggcaggtgttaagctggtttcagtaatcttagcatctatttccttttccccagtgattttcaagtagctaaattagctgcctgccgggtccaggtttttgaag

SEQ ID NO: 6866739 - DNA, 71 bp, Homo sapiens
gtaagttagtgtgttatataccaagcttcttatagaagaggctatagagtgtttgtataatatacccttat

SEQ ID NO: 6866740 - DNA, 105 bp, Homo sapiens
aatgaacatagctgctctgaaagtttagtgctgaacatttgggacttgttttagatcgaaaagaatcccattcttcagatgaatcgataaagtgttattttcatt

SEQ ID NO: 6866741 - DNA, 113 bp, Homo sapiens
aaacccacacagccctgaccccctcgtgctctggctggtctcccggtcagcagcccctgagggccggcaggcaggccactgagctgtgggtgacacagggtagtccacggttt

SEQ ID NO: 6866742 - DNA, 68 bp, Homo sapiens
gacattagagattcttgtttgatgatatgctacacatccaattttgacaaggatttgttcctaatgtt

SEQ ID NO: 6866743 - DNA, 70 bp, Homo sapiens
tgcaaaaactgaggagagatcacgtggtgtctattataagaaagtttaggtgactcacttcaaacttgta

SEQ ID NO: 6866744 - DNA, 88 bp, Homo sapiens
ttagattttgtacagattacattaggatatatctatggagaaagtctgaagttttagtcaaaatgtagaaacatttgtacatatttaa

SEQ ID NO: 6866745 - DNA, 65 bp, Homo sapiens
gttttaatgtagaactgtcaggaccctgtgaaaataatgggtggtgacaggtttaggattaaaat

SEQ ID NO: 6866746 - DNA, 106 bp, Homo sapiens
gagaccacccgtgggcacgtggcttttgggattggagacctgctgccacagatctctgaagagtctggacctgctgggtctccccaagtgactctctgggggtctc

SEQ ID NO: 6866747 - DNA, 67 bp, Homo sapiens
ctgtataacagaactggcagcaggaaaggattttatttcctgctgagcatgttctgcccctacccag

SEQ ID NO: 6866748 - DNA, 76 bp, Homo sapiens
atactggctactggcccattgtcaacatgatgctctattgaattatggtggatcccagtgggtcctttatcagtat

SEQ ID NO: 6866749 - DNA, 59 bp, Homo sapiens
aagcatgagttacctgcttctaagcccaacttggccagtgggcaggtgtgcttatgctt

SEQ ID NO: 6866750 - DNA, 94 bp, Homo sapiens
tttgggactcatttacacaaagttagctcttgcagctgcaggctatgtgactgcctagcaagagtgggctttgtgggaattggagtgtcccaga

SEQ ID NO: 6866751 - DNA, 70 bp, Homo sapiens
ccccaaggatcttgcggcccgcagcgccctctgagtttatctagctgtccacaggccacagagcttgggg

SEQ ID NO: 6866752 - DNA, 62 bp, Homo sapiens
ctttgttcctcactggatcttttaaagtgcaaatcctagcaaatgaaacctgaggaagaaag

SEQ ID NO: 6866753 - DNA, 91 bp, Homo sapiens
cagtacaggtgttttgttgcttccttagttgactgtcttagttgcttccccaagctgcttccctagttgactgaggaagccgacactactg

SEQ ID NO: 6866754 - DNA, 78 bp, Homo sapiens
gcaactttaattgtattcatattaaacatatcaatgttagaactgatgtaatatgtttagcatgaatatgaaggttgc

SEQ ID NO: 6866755 - DNA, 75 bp, Homo sapiens
gcctcccaaagtgctaggattacaggcgttagccatggcacccggctgaattttagtaatttgaattatagaggc

SEQ ID NO: 6866756 - DNA, 61 bp, Homo sapiens
cacttcagctacaatcacatgatggagaaaattaagagttatgtgaattatgtgctaagtg

SEQ ID NO: 6866757 - DNA, 62 bp, Homo sapiens
ttctgatgcctgttcctgccagattgctgggcactgccctggagtgtgacgaggcattagag

SEQ ID NO: 6866758 - DNA, 59 bp, Homo sapiens
cactcatattggaacaagcttggggtggaagatttaggccgtgtgagcatgtgtgagtg

SEQ ID NO: 6866759 - DNA, 55 bp, Homo sapiens
tgctggagaggaaggtggggtcaaacctttgttgcccgcatcttcctctccagca

SEQ ID NO: 6866760 - DNA, 56 bp, Homo sapiens
gccagggcttctccctcacagcagctgcctcctactggagtcagaaatgccttggt

SEQ ID NO: 6866761 - DNA, 75 bp, Homo sapiens
cttcatgagcctgctgctttgagccttttatcctcttaacccctggctgaggacaggctcagcaggtgtataaag

SEQ ID NO: 6866762 - DNA, 76 bp, Homo sapiens
gttcccaaattaccttgtttgtgttttgtgggataacattcatcacacagaataattcacatggctctttgggtac

SEQ ID NO: 6866763 - DNA, 69 bp, Homo sapiens
catacatgcatgatacaaagttgccctacggagatagaagggggctgattttgtcacatagcaaggatg

SEQ ID NO: 6866764 - DNA, 58 bp, Homo sapiens
cacatgtttggcatgtcaccaagggttttgacccaccggctggcactccaagctagtg

SEQ ID NO: 6866765 - DNA, 57 bp, Homo sapiens
gaagacacaattggtgggtccacttggaaggatcaaggaccctaggttttgctcttc

SEQ ID NO: 6866766 - DNA, 59 bp, Homo sapiens
ttctggatcatgggaaagggatcagtatgcagtaacgtggtaaggttccagatctagaa

SEQ ID NO: 6866767 - DNA, 86 bp, Homo sapiens
agggaacatggagtctaatggactgactcagtgctgccagttataaaatgagaagccttgagcagttcacttggtctgtgtgacct

SEQ ID NO: 6866768 - DNA, 56 bp, Homo sapiens
gttcagtacctctaaactttgtagattcaaattctcaaagttgagaagtactaaat

SEQ ID NO: 6866769 - DNA, 101 bp, Homo sapiens
gggagcttgataaaaatgcagctacttgaatcctactccaggagattctgatcaaatcagtcaggggtgggatcaaggcattcacatttttaacacctccc

SEQ ID NO: 6866770 - DNA, 97 bp, Homo sapiens
gaactggggcccatcttgctgtacgttagactctccactctgctgcttgtcagcagtggggacttatgccagcatttacctatatgagcctcagttt

SEQ ID NO: 6866771 - DNA, 62 bp, Homo sapiens
ggaggtccatgtgaatgtggcctggagttttccttgtgctctgggtcagcacactggtctcc

SEQ ID NO: 6866772 - DNA, 61 bp, Homo sapiens
tggtttgcggctatcacacagccagctggagttcactctggtgctcagtgatgccagacca

SEQ ID NO: 6866773 - DNA, 58 bp, Homo sapiens
ctcctcactgatgggacatctgcatagaagccaagccttgttccaaggagttgagggg

SEQ ID NO: 6866774 - DNA, 58 bp, Homo sapiens
gaggctgcaggcaatgctgccccagacccaggggcgaagagtctttgcctggggcctt

SEQ ID NO: 6866775 - DNA, 55 bp, Homo sapiens
ctatctgtgagccagtccccttattttacaaatggggaaactgaggcacagacag

SEQ ID NO: 6866776 - DNA, 65 bp, Homo sapiens
tccctggcttctgggatgtgttgacagaaacgaaattgcaacctgacccagccagcccttgggga

SEQ ID NO: 6866777 - DNA, 78 bp, Homo sapiens
gccaccctctcttctcacatcttcttggctttatgatccttgcgtgtagtctttgagacggtggcaggaggggctggc

SEQ ID NO: 6866778 - DNA, 80 bp, Homo sapiens
ttttgtggacaaagactgggtttgattctgaaagctccagaacccagcccagagacaatgctcagtatatgtttgtagaa

SEQ ID NO: 6866779 - DNA, 72 bp, Homo sapiens
ctgggcgttgtggctcacacctgtattcctagcactttgggaggccaaggcaggtggatcgcttgaatccag

SEQ ID NO: 6866780 - DNA, 57 bp, Homo sapiens
gttgcaggaggatggctgcataacggcgaaccggggaggttgcctcctgcctgccac

SEQ ID NO: 6866781 - DNA, 76 bp, Homo sapiens
tagcctgcagtctgtccttccgactgtagctctctcattagaggagctgcaaggtgatgaaggcatcctgaggctg

SEQ ID NO: 6866782 - DNA, 80 bp, Homo sapiens
gtgtggcctggccggtatcccacctcctgcgtcagcctccgagtgaagaaggggttcaggtacttggcgtccagccacac

SEQ ID NO: 6866783 - DNA, 108 bp, Homo sapiens
cttggggctgccggtctggctgctgaggccaggtggtgaaagtgggccctgggcagcctgagggcagctctcacctctggccagcaaacttctagactgcaccttgag

SEQ ID NO: 6866784 - DNA, 60 bp, Homo sapiens
gagttacagtgggtttggggcccaggcaaaatctgcctctggttctttctcctgtgtgtc

SEQ ID NO: 6866785 - DNA, 86 bp, Homo sapiens
ttctttcttataattagaatcttatttggggaaggcaaaaatcaagtgtttattaaaggagattttgacttttggttaagagagaa

SEQ ID NO: 6866786 - DNA, 90 bp, Homo sapiens
gggaaggcaggcatctcagttcaggctccactgtcctcacccacagacatgggcaggcagcctctctgacagcagctctgcccaattccc

SEQ ID NO: 6866787 - DNA, 94 bp, Homo sapiens
ttatttggaaatgtatggttcaagttctaaggagttggggttttctagttctcttttaattgattcctagatgaattacattgcattcagataa

SEQ ID NO: 6866788 - DNA, 55 bp, Homo sapiens
gcgagacgggcccccggcgcctccggtcggtcagagagcggcggggcgcgtctgc

SEQ ID NO: 6866789 - DNA, 62 bp, Homo sapiens
tggagaaattcaacatttttaaaaaagtacttagaaattggtattgatgttgaatctcttta

SEQ ID NO: 6866790 - DNA, 57 bp, Homo sapiens
tttgagacaatattaacctatctttgccttcaggaaagaggacatatctgtctcaaa

SEQ ID NO: 6866791 - DNA, 60 bp, Homo sapiens
cctgcaagggcaactttgtgtggagaagcaggaccggagccacccagagccctttgcagg

SEQ ID NO: 6866792 - DNA, 77 bp, Homo sapiens
agcctcttctcttggccctctccacttgtagtccatgccgtagactgtgcaccctggacagtgtcacatagagtgct

SEQ ID NO: 6866793 - DNA, 73 bp, Homo sapiens
ttggcaatcagaaatcacttaatgaacgtaggttaaatcacgtaaatgaaagaatgattgactgaatgaccaa

SEQ ID NO: 6866794 - DNA, 76 bp, Homo sapiens
ctttgctgatggcattctgcatcagtggctcattgacagagtcatacattacatgtataatgctaattagctagag

SEQ ID NO: 6866795 - DNA, 74 bp, Homo sapiens
ttctcacagctgctctacaggttattttcctcttttacaggcgggaagaaatggcttcagagaggctgtgaagg

SEQ ID NO: 6866796 - DNA, 67 bp, Homo sapiens
ctgctaaaatggtatttttaaagattctgtggtattcataataattttgaaagcaccatttgagtag

SEQ ID NO: 6866797 - DNA, 57 bp, Homo sapiens
tgccatcagctgactccaaggtacacacagtcctgtatctggaactactgagtggca

SEQ ID NO: 6866798 - DNA, 67 bp, Homo sapiens
agtcattttctgcctgtaatctattcagcttctcgagtgctgaccaagtgcttggcagagaatggct

SEQ ID NO: 6866799 - DNA, 71 bp, Homo sapiens
gccctggcctggccatagggccctggtagcctctaggcggctggacagaagtggctgggcaggtcctgggc

SEQ ID NO: 6866800 - DNA, 69 bp, Homo sapiens
gtgggacaggtgtttatttagctttattgagcagctatgatatgccaacagctttagaaacactttcac

SEQ ID NO: 6866801 - DNA, 73 bp, Homo sapiens
tgaagcactttcaagatcttccaaaggatacatattttttgttgttgttcttatattgacttgggaggtttta

SEQ ID NO: 6866802 - DNA, 63 bp, Homo sapiens
ttttacaaggcagttattttcctaaagtgttacatatcaaggaaagttgagctgtctgtagga

SEQ ID NO: 6866803 - DNA, 57 bp, Homo sapiens
tgtttggagctctgcttccctggctttcctcttctaaaggccaagagcttgcaaaca

SEQ ID NO: 6866804 - DNA, 72 bp, Homo sapiens
ctttattcagaaattgtcagtgatatgatacagctaattaaggcatgcatggtgttaacagtttcattagag

SEQ ID NO: 6866805 - DNA, 71 bp, Homo sapiens
ctatgaggtggctattccggtccttatagaacaacaaacaacctgtgaggtatatattctggtccttatag

SEQ ID NO: 6866806 - DNA, 64 bp, Homo sapiens
ggccgggctggctcctctgtcctcacgggacttgggccctgatcttggaggggtcagccaggcc

SEQ ID NO: 6866807 - DNA, 101 bp, Homo sapiens
tccctatcattactctccctgcaccccttacatcagctctggtatcctggagttgggtgaaggagctgatgtaaggggtacagggagagtaaggataggga

SEQ ID NO: 6866808 - DNA, 81 bp, Homo sapiens
gaacagggcaggcttcagctgtttaataaatgtctgttgacctcaaccagatcgactgttaacagcagcatgctccagttc

SEQ ID NO: 6866809 - DNA, 71 bp, Homo sapiens
actcctatggtcaaggagaaacctgggagctaacctctactcctgtcttctcctcccaccagccatcgagt

SEQ ID NO: 6866810 - DNA, 77 bp, Homo sapiens
aggaaaagtcatttgtatataccctttattaaaaaattagacaataaaagtatgtgtgtatgaatggatctgatcct

SEQ ID NO: 6866811 - DNA, 66 bp, Homo sapiens
ttggggtggggcaggaacaaatcaaatgatggaatgtcatcttttgttgttcttccattgctccag

SEQ ID NO: 6866812 - DNA, 64 bp, Homo sapiens
gggtgggcggcgcgtgggccgcggctggttagagctgactcaagcctgtcctgcccgcccaccc

SEQ ID NO: 6866813 - DNA, 72 bp, Homo sapiens
tttcctttaatgttatcttccctttgatgatttatctgtttgatagagactccaaagaaggtaacaaggaaa

SEQ ID NO: 6866814 - DNA, 78 bp, Homo sapiens
ctgggctgcaatcctcagggcctcatggccggggtgcccaaggcatgggttctgaggccctgccaggtgctgccacgg

SEQ ID NO: 6866815 - DNA, 60 bp, Homo sapiens
ggggcctggggggcaggtggagggccgctgctgttttctctcactcatttcctaggtctt

SEQ ID NO: 6866816 - DNA, 56 bp, Homo sapiens
ttgtagagtacacaacacttggagcctgctatggcttgaatgtttgtcctctctaa

SEQ ID NO: 6866817 - DNA, 56 bp, Homo sapiens
ggtggatatgcaagtagctttcacactaggaattgtgaagcctgaggcatagcccc

SEQ ID NO: 6866818 - DNA, 58 bp, Homo sapiens
ccccttccctgcgacgcgggagccgcgggagccgtgagtctgcggaaagggagggtgg

SEQ ID NO: 6866819 - DNA, 89 bp, Homo sapiens
tctgtcctgggtgctgggtgttgggtactgaccgtctcctgcaaaggcgattgaagggtgaccagccatcctagtgtacccgggactga

SEQ ID NO: 6866820 - DNA, 80 bp, Homo sapiens
gcagcaggctaagacagggagggctctcagccgcttggatttctacacagctgcaagtccttccctctcttttctggtgc

SEQ ID NO: 6866821 - DNA, 87 bp, Homo sapiens
aaatactaaggcaaggtattgcattattacaaggtaagactagagggactagagacttacttttgatgcatgagtgtcttattgttt

SEQ ID NO: 6866822 - DNA, 59 bp, Homo sapiens
gctgactgagctggcttttcgtctcagagataaggtgagagatgcctgcattagtcagc

SEQ ID NO: 6866823 - DNA, 60 bp, Homo sapiens
gggcaactatgtaaattaggccttcccttgcgttcttgggagggtctgatgtggtggccc

SEQ ID NO: 6866824 - DNA, 58 bp, Homo sapiens
gaatgagttaatatttgcttggcatcatagtgagcattcagtaaatgttagctcattc

SEQ ID NO: 6866825 - DNA, 73 bp, Homo sapiens
tgcttaaaatgatgattattttaggtattcatagaaaatatctacatggaaaaagtgatgattattttaggca

SEQ ID NO: 6866826 - DNA, 85 bp, Homo sapiens
tgaggaaggtgtccaggaagcagagtcaggtccaaggactggggtgcctcctttcacctggccagactctgacccacctacctca

SEQ ID NO: 6866827 - DNA, 130 bp, Homo sapiens
ccattgaatgtggggtgctggactgttttatttgaccacttttgcctatatccagaagaatttgtttgttgtgtatgcaattgagtcatagaaaagaaacgtcctgttgttaaagttctcatagttttgg

SEQ ID NO: 6866828 - DNA, 90 bp, Homo sapiens
ttttactgtcagatttctcatcaccagctttaacaggaacctttggatggaaaccctgggagggagaaatcagagctgacccaagtagaa

SEQ ID NO: 6866829 - DNA, 81 bp, Homo sapiens
gcagggtctgctggaggttagttgcagaaggcagagccgtgtggcattggctctgctggtgatgacctcataacaccctgc

SEQ ID NO: 6866830 - DNA, 69 bp, Homo sapiens
gcattttactctaaaaagaagcagatctcctcagagaaaggactgattcaaatttagggcaagaaatgt

SEQ ID NO: 6866831 - DNA, 62 bp, Homo sapiens
gggagctgaggtaacagtgagtgtgcctgagtgggaattacccaccttgacttctagcttct

SEQ ID NO: 6866832 - DNA, 111 bp, Homo sapiens
tctgtaactatgtgttaaaatgtctgagttctctgattttaaatgaggcatgactgttcaaaggcaggtaatgtcttctgtggagacaggtatttagacgaacacttcaga

SEQ ID NO: 6866833 - DNA, 82 bp, Homo sapiens
gtgggggtggctgtcctgtgcattgtagggtattgagtggcacccctggcctctacacactagatgccaatagcacccccac

SEQ ID NO: 6866834 - DNA, 84 bp, Homo sapiens
agtaacaaggtggtcttggtatttaaactgtaggtggagaaacatacacgtaaacaacaaataccagattattttgcaaatgct

SEQ ID NO: 6866835 - DNA, 60 bp, Homo sapiens
acatgcctgtggacttacgagaatggtcactttccttttcatgtggacctagaggcctgt

SEQ ID NO: 6866836 - DNA, 64 bp, Homo sapiens
ccggaatgccggctgaccgcggccgtcggggggcgcggagggcggggtgggccgggcacgccgg

SEQ ID NO: 6866837 - DNA, 95 bp, Homo sapiens
actgtcaatgaaggaggatgtcagcagagtggaacattgtcatagataaagatcagtgaaaatgtgctctggctgaggtagggttttctggaagt

SEQ ID NO: 6866838 - DNA, 55 bp, Homo sapiens
cccagggctcaggctcccagtggggtctgcttcctacaactgcgtggccctgtgg

SEQ ID NO: 6866839 - DNA, 59 bp, Homo sapiens
aggattgtttggcttcaaaggctgttgggcccaagacgcattttgttttaaataatcct

SEQ ID NO: 6866840 - DNA, 76 bp, Homo sapiens
taactggatcatatatcagtactctccaagtgcccctcactggaagtgctaaactggagtgtgattctcagagtta

SEQ ID NO: 6866841 - DNA, 60 bp, Homo sapiens
caggcagccctgcaccaagtgtgggattgcccagcaccactggttttgcagaggcgcccg

SEQ ID NO: 6866842 - DNA, 82 bp, Homo sapiens
accgaacctaggtagtctgacgcagagcactgggtataaagccctgtgcatattgccagatacataagttttaggttcaggt

SEQ ID NO: 6866843 - DNA, 73 bp, Homo sapiens
ttgaggtcaggcttctgaaatctctgtgcgtgtgtggggtgcagctcatgagtttacagagcaaagactacag

SEQ ID NO: 6866844 - DNA, 95 bp, Homo sapiens
atctggttcggattttgatctgtacttagaattaaatatttttggttagtattgaaatggtagttccctgagtatttacagtcaagattccagat

SEQ ID NO: 6866845 - DNA, 72 bp, Homo sapiens
ctgtggctatgtggctgtgggaatggcctggaggtaggtagtggccagcacacaaggccttgtagaccacgg

SEQ ID NO: 6866846 - DNA, 79 bp, Homo sapiens
gtacatgggtgtgtccaggcgggagtcaaggatggtcaccaggatgaggaccccattgcccagtaggatcaccaggtac

SEQ ID NO: 6866847 - DNA, 112 bp, Homo sapiens
tcttccgggcttagtttaattcctcttgtgtttctcctcaatctcaccttacccttctttgtaacttgggacaggttggagagaagcaggcagataaactttccctagaaga

SEQ ID NO: 6866848 - DNA, 76 bp, Homo sapiens
ggcagccaggctgaggggcgagggaccctgtgtcctggacaggctccatggttctccctcagagcctgggatggcc

SEQ ID NO: 6866849 - DNA, 56 bp, Homo sapiens
gcgtccccgtggcgggagaggccacctcgtggtcgcgcgcccaggccgccgggagc

SEQ ID NO: 6866850 - DNA, 75 bp, Homo sapiens
cagcatctccacaatggggtggtcgggttgatctccacgcgctttttggccaccatgtagcccattagagagttg

SEQ ID NO: 6866851 - DNA, 60 bp, Homo sapiens
ggcaggtgctgggagcatctcaaacaggacaggcctgacctgggatctcttgcacctgcc

SEQ ID NO: 6866852 - DNA, 83 bp, Homo sapiens
gtaaatccatagtgttttacaacagaattacatggtaagcttctctgtactttaaatcaatgtagattcacaatgggtttcac

SEQ ID NO: 6866853 - DNA, 84 bp, Homo sapiens
gaaaacttctgaatgctatatgtagtacttgtgcttcaaattataaatggataagagtgtctcacagtagcattttgtgttttt

SEQ ID NO: 6866854 - DNA, 61 bp, Homo sapiens
ccctggtgccatagcctggcctccgaagctcctatagggtcccagtccctgagcaccaggg

SEQ ID NO: 6866855 - DNA, 72 bp, Homo sapiens
gcagggctgctgaaacttgtttgtacacctcgtgttgaattaaagtatgaattcagactcagcaactcctgc

SEQ ID NO: 6866856 - DNA, 83 bp, Homo sapiens
tttaactgtttcctgacactagggaccaattaagatgtataaattatgcatttaatagatgctccctgcctaaaagagttaaa

SEQ ID NO: 6866857 - DNA, 91 bp, Homo sapiens
cttagtactttctttacggtgttattgtaaagattctaagaaatacatgaaaagtttttagtgtagtcaccgtgggtccataagtactaag

SEQ ID NO: 6866858 - DNA, 88 bp, Homo sapiens
aggactaaaatgatcagggtggggctggctatcaaaatttaaaacttacatgtattttggtccagcagtcccacttccaggatctcct

SEQ ID NO: 6866859 - DNA, 60 bp, Homo sapiens
gggagagtgtgaggggagagggagagcctgcagggcaggtgagtcccccagggctctctc

SEQ ID NO: 6866860 - DNA, 75 bp, Homo sapiens
gtggtttctgggaaatataataaagtggttacccagattgtggaaagccactgtggggtgtttgccagcaactgt

SEQ ID NO: 6866861 - DNA, 81 bp, Homo sapiens
ctggggatcttgttaaaatgcagattgtcattcaggagggctggcctgtcctgggattctgcatttctaacaagttcccag

SEQ ID NO: 6866862 - DNA, 57 bp, Homo sapiens
tgaatgtttgttctgctgatgggttgaatcatctcttcacagttggccaggcattta

SEQ ID NO: 6866863 - DNA, 79 bp, Homo sapiens
ttttagtgtggcactgatgttcaatgtttcctatatttctctatttggacaaaattgaatacaggaaaatatactgaaa

SEQ ID NO: 6866864 - DNA, 63 bp, Homo sapiens
gcaaacaccagctcctgcagaacacaagccttaattaatttccagcaggaaatgagtgattgc

SEQ ID NO: 6866865 - DNA, 59 bp, Homo sapiens
gggcttcttgccatggggacggggctaccatgagcctagtcacaacattcaggagtccc

SEQ ID NO: 6866866 - DNA, 55 bp, Homo sapiens
agatgctgtaactggtataaatgcacagaatttatacactgcagaaccagcattt

SEQ ID NO: 6866867 - DNA, 82 bp, Homo sapiens
ttagattggtgcaaaagtaattgcggtttttgccattaaaagtaatgcggccaaaactgcagttacttttgcacccacctaa

SEQ ID NO: 6866868 - DNA, 64 bp, Homo sapiens
ttcctcagtgcccccatacggtaggtgacattatccttgtgtgatagcttaggacacagaggag

SEQ ID NO: 6866869 - DNA, 67 bp, Homo sapiens
ttgtcaaccatccaacagatatttatggagtgcatactaagtgcagggcactgttgggtgttgagga

SEQ ID NO: 6866870 - DNA, 56 bp, Homo sapiens
tggcacgttggattgggagttcgcgtcgtggatgtctcatacgtttccaggtgtca

SEQ ID NO: 6866871 - DNA, 88 bp, Homo sapiens
atgccacagtttatttctccatttacctacacatgggcatttgggttgtttttcattttgggtaatggagaaataaatctgctgacat

SEQ ID NO: 6866872 - DNA, 57 bp, Homo sapiens
agaggccctggcctgactcaatgttgccctggcaacagtagggcctggagggcctct

SEQ ID NO: 6866873 - DNA, 60 bp, Homo sapiens
cctacttcctgggcaatgttctgcttcccccaaactgaagcaggaggcccagagaggagg

SEQ ID NO: 6866874 - DNA, 66 bp, Homo sapiens
ggagctcgggaaatctgtgcgctcgaacttggctccgccaagaagctgggcaaggatccgggctcc

SEQ ID NO: 6866875 - DNA, 63 bp, Homo sapiens
gagagggaggtaggcagggcaccctggaccttctggcaccttccttcttgcctgcaccctctc

SEQ ID NO: 6866876 - DNA, 77 bp, Homo sapiens
acagtagtagactttggggttataatcatattgatgacaactgccatttattaaaattccaaggtatgccaagctgt

SEQ ID NO: 6866877 - DNA, 56 bp, Homo sapiens
tcagtggtgtgtatattttgtttgacattttaagcagaagaaagccacatgactga

SEQ ID NO: 6866878 - DNA, 76 bp, Homo sapiens
tcacctcttttacaccaaaaggcctacagggtgtggtcactgtttcttttgggtcattttggggtggaaatggtgg

SEQ ID NO: 6866879 - DNA, 66 bp, Homo sapiens
gggctaaaggcagtcagttgttttgaaatacaatagtactttcaggtctagacctgccataagtcc

SEQ ID NO: 6866880 - DNA, 76 bp, Homo sapiens
gccctcgcagtctccacagaaggcttgccgggaagcggcagatgctgctgctggaggcaggccttccctgcagggc

SEQ ID NO: 6866881 - DNA, 80 bp, Homo sapiens
gtttaaacccactgctcttcactgagataatcctagatgaatatcccaggggtatccatggagaagagggtgaatgtgac

SEQ ID NO: 6866882 - DNA, 67 bp, Homo sapiens
gttctacccaaggagctgttggaattttaaatcattttaggaaattgacacctgcttgattagtaac

SEQ ID NO: 6866883 - DNA, 69 bp, Homo sapiens
gagtcctccacccaaactcccttctcaaggtacaagggctgatcccgtaccagggatgggtagggactc

SEQ ID NO: 6866884 - DNA, 61 bp, Homo sapiens
aagattccctgaatggttcacctgtgcactgattacctcagatgatccattgagagaactt

SEQ ID NO: 6866885 - DNA, 88 bp, Homo sapiens
gcaggtttgctcacatgaaattttgtactgccacagctgacgtgggctcgactccattcactggcagacagaactcaggcacatctgc

SEQ ID NO: 6866886 - DNA, 83 bp, Homo sapiens
gaagagttggaaaaacaaatgccatatataaattctaagccatatgaggacgaggagtaatggcattttcttcctttttcctc

SEQ ID NO: 6866887 - DNA, 58 bp, Homo sapiens
cctagcaggaaggttcagggccctgcactgttggggctgctcagacatttgtgcaagg

SEQ ID NO: 6866888 - DNA, 62 bp, Homo sapiens
gcacagtgattgatttttactttctctagtataaaaagaaagtagacacatgttattgttgc

SEQ ID NO: 6866889 - DNA, 60 bp, Homo sapiens
ttctagaacattcatactccttagggtagtctggcctgaggtttttggatagttgtagga

SEQ ID NO: 6866890 - DNA, 71 bp, Homo sapiens
gggcattatcccagaaactatgtaagaaagtgacatctttcacgatcttttcatcctttctacttgagccc

SEQ ID NO: 6866891 - DNA, 57 bp, Homo sapiens
gcaagttactgttgctttggcaaagacacagcttcccaggtgcaagcagtaaattgc

SEQ ID NO: 6866892 - DNA, 61 bp, Homo sapiens
tgggattcagttaagggtcttgagatgggaagatcatcttggattacctgggtgggtctta

SEQ ID NO: 6866893 - DNA, 73 bp, Homo sapiens
ctatttatcttcatacctctagttcttcttttagtctctgacttacaggaggtgctaggtgtttattgagtag

SEQ ID NO: 6866894 - DNA, 65 bp, Homo sapiens
aaaactgaggctagattgctgttctttgggatgacttatcttaggatggattttagttttgtttt

SEQ ID NO: 6866895 - DNA, 67 bp, Homo sapiens
tgggggaaatagaaatgcttagaaaagcctggatgactttggttctgacgttcactatttctcacca

SEQ ID NO: 6866896 - DNA, 63 bp, Homo sapiens
aacaagaggaacactggacaatacttccatttgccttgttagtaccatgtgttccttctcgtt

SEQ ID NO: 6866897 - DNA, 83 bp, Homo sapiens
accttgggaagtttcaaatagattgaagccaagtaaatcagaatctctatggttgggattcaggcttcagtctttcttaaggt

SEQ ID NO: 6866898 - DNA, 58 bp, Homo sapiens
tcaggaaactacagttgaactagatccatatgtggctagaaaacatgtagctttctga

SEQ ID NO: 6866899 - DNA, 66 bp, Homo sapiens
cctgatgctaatgctttggcagtgggtcacagtgaccaacatcaagcattgccacattgggtcagg

SEQ ID NO: 6866900 - DNA, 101 bp, Homo sapiens
aggcttggggaatctggaacttgcctgctaaataaggtcgtggtggactctcagccattgggcaggtctatcaggctgcaggttcctacacacccacgcct

SEQ ID NO: 6866901 - DNA, 56 bp, Homo sapiens
atctcctacatgggaggagagaaagttttcctactcgccagtcccatacaggagat

SEQ ID NO: 6866902 - DNA, 82 bp, Homo sapiens
aggcatgaacttccacattctctgttacagataaagtttgtcccctttggcagagatgctggagctctttcttcttatgcct

SEQ ID NO: 6866903 - DNA, 90 bp, Homo sapiens
ggtaaaaatgattttctggtcacatgttattaaccataataaactaaatagaaaaatggtaagtggggaaagggctaggttattcatacc

SEQ ID NO: 6866904 - DNA, 76 bp, Homo sapiens
atgcattgttcccccacagaggtcttcacatggcaatgagaggaggcaaactcttgtgagaccttggaagaagtat

SEQ ID NO: 6866905 - DNA, 63 bp, Homo sapiens
cttcgtctagacagtttccaaaagagcctctttttagagccctcttttgtgtgctagatgggg

SEQ ID NO: 6866906 - DNA, 62 bp, Homo sapiens
ggaggagagatggggagtaagtaatttgttcaagtcgctgtattttgccacttctacctacc

SEQ ID NO: 6866907 - DNA, 72 bp, Homo sapiens
gatggaacaggtgtgggcagaattgaatctttaaacatgttaactgtttatgctcatctcatttgtcccttc

SEQ ID NO: 6866908 - DNA, 64 bp, Homo sapiens
gagcaatcaatgagcgaaagcttttacctatattattattgttatcgtttatttgaaattgctc

SEQ ID NO: 6866909 - DNA, 55 bp, Homo sapiens
ctcactcagtttttagttcatctgtgactaattccaggtgaagttggctggtggg

SEQ ID NO: 6866910 - DNA, 63 bp, Homo sapiens
gcctaaagcccactgggctgagggctggaaggacgagcctgacccaccagcccaggggcgggc

SEQ ID NO: 6866911 - DNA, 61 bp, Homo sapiens
ccctgaaatcctgtgctctgtgctgctggactaggtggtaaagagtgttggattctagtgg

SEQ ID NO: 6866912 - DNA, 58 bp, Homo sapiens
ctggcctcttaggacatcctctatgatcaactgcactggaggaagggacttgggccag

SEQ ID NO: 6866913 - DNA, 62 bp, Homo sapiens
aataggtttaggaaagcgtttttcttcaacttctatggagcacttgcttgctttgtcctatt

SEQ ID NO: 6866914 - DNA, 61 bp, Homo sapiens
gtttcttccctttagcatatagtagtttagtatgacttgtataccgtaaagggagagcagc

SEQ ID NO: 6866915 - DNA, 58 bp, Homo sapiens
ccagggttcagacagggtaatggtgaagaaattcccaagcaatgagtcagggcccagg

SEQ ID NO: 6866916 - DNA, 69 bp, Homo sapiens
ttctttttgcatctggtgaagaccagcagaggcaactctcaaactgttttcaccagattgcaatgagaa

SEQ ID NO: 6866917 - DNA, 97 bp, Homo sapiens
tatatgtagttcttagttacatccaaagttgaggtgcctgcagtattttcataagaaggcggatctgactttcagattggtggtgaggacacgtgta

SEQ ID NO: 6866918 - DNA, 65 bp, Homo sapiens
gcactccttgcgagaggtttaactggatgcgacacccccagtgtcagcctgggcaaggaacatgc

SEQ ID NO: 6866919 - DNA, 59 bp, Homo sapiens
gtcctcagctccaggcttgctcagcctgcaccttggctggcggcgtgtggactgaggac

SEQ ID NO: 6866920 - DNA, 56 bp, Homo sapiens
agcatcctgcctctcctcccaatggttctgtgatgttgggaaaatgaaaaggagct

SEQ ID NO: 6866921 - DNA, 56 bp, Homo sapiens
gtgaggctgggggcaatggtcagagtgtctgtagatactcaccctccccctctcac

SEQ ID NO: 6866922 - DNA, 116 bp, Homo sapiens
tgactgtttaccttccctcttccatggaggcagcaagatttttaaagcaaggtgagaaatcgctttgtctttgatcattttgactttgtggaattaaatgaccaggatgaaagtca

SEQ ID NO: 6866923 - DNA, 55 bp, Homo sapiens
ctcaccttccggctgctccctgcggacgggtgtggggagagaggagggaggggag

SEQ ID NO: 6866924 - DNA, 59 bp, Homo sapiens
gagagtagttatgaggcaagcagagctttgtaagtgcctgagtgctttggcttgctctc

SEQ ID NO: 6866925 - DNA, 63 bp, Homo sapiens
agtcacaataccgtgtgtcagtatgtgtttctccacagctatgataatttcggtatttgcact

SEQ ID NO: 6866926 - DNA, 60 bp, Homo sapiens
ttgccagggccagtgggggtgtcagaacttctcaggcaaacttgctcctgcccttggcaa

SEQ ID NO: 6866927 - DNA, 130 bp, Homo sapiens
tctgagagcctacgttttatatacatttatgtagttacggactatcaatccttcaattaactgctccactgccctaagcaattgttagtcagacacacctaaatgtacattaaaagggattgctcttagg

SEQ ID NO: 6866928 - DNA, 56 bp, Homo sapiens
ttgaggtaaagctactagttagttttgaaggtaatggagctaggcaagtgcctcag

SEQ ID NO: 6866929 - DNA, 98 bp, Homo sapiens
agagatgtttcaagagggaactaggtactgaaaaaggggaaaggtatcactttcaatcatttttacatagtcccaaaaccttgaaactaggtatctct

SEQ ID NO: 6866930 - DNA, 56 bp, Homo sapiens
ggtctgaggtttgggattcactagtaaactagctctgattccctaatcccagcacc

SEQ ID NO: 6866931 - DNA, 101 bp, Homo sapiens
gtggccgcgaagtggaggcacacgggaggtctgagagccgctttcccccagagactgggcggggcggctccgggccacggaagcagcctcgaaccagccgc

SEQ ID NO: 6866932 - DNA, 101 bp, Homo sapiens
cattctcctgcctcagtctcccgagtagctgggactacaggtgcccgccaccatgcccggctaatttttggtatttttagtagagacggggtttcaccgtg

SEQ ID NO: 6866933 - DNA, 59 bp, Homo sapiens
tgtgttatttggttattgtaattgggatttttcccattgcatttatcaaatatttaaca

SEQ ID NO: 6866934 - DNA, 82 bp, Homo sapiens
gggcgccattctgagcatgctacatgcagcaccttgtgtgttccccacagtgccctgtaagttgtgtgctctggttgtgccc

SEQ ID NO: 6866935 - DNA, 88 bp, Homo sapiens
ttgtgacatactaaactatccagttactgattctaagtccaacaaaaagagaggagagtaactgaagatatcaatttgggcttcacaa

SEQ ID NO: 6866936 - DNA, 125 bp, Homo sapiens
gtgagggctcatgccctgactcatagagagcatcttcttgctctgtcctcacagggtggaaggagcaaggtagctctctggggcttctttaataagggcactaatttgatttatgagggcctcac

SEQ ID NO: 6866937 - DNA, 85 bp, Homo sapiens
gacccatcaatcatgtagcactatttggtcattgattctatcattgatttagtgtttattgaacagtgctgtgggttgaattgtc

SEQ ID NO: 6866938 - DNA, 63 bp, Homo sapiens
taaaagctctgctgttggctaggtctagcaacctggataccaaaattcaatacactgctttta

SEQ ID NO: 6866939 - DNA, 88 bp, Homo sapiens
attgtgaaggaagatggaacatgatttgacaccatattgacaactaaaagtgattctagtcatgattctagttgtcttgctttggaat

SEQ ID NO: 6866940 - DNA, 69 bp, Homo sapiens
agactgtgttggcttttctcttgtacttttacaggaaaatgggaatctacaaaagaaggcttacagact

SEQ ID NO: 6866941 - DNA, 58 bp, Homo sapiens
ctcttagctgatgagaaaaaagatattacttcacagaaatctcaattcagactgagag

SEQ ID NO: 6866942 - DNA, 68 bp, Homo sapiens
ctcagtttctatggctgggctctgaggtcaggaatactaatggtaggatccctgctctggaaagtggg

SEQ ID NO: 6866943 - DNA, 62 bp, Homo sapiens
gtacattggcaactctcttagatattgcaatattcagctctaaagtggtggtgctaatgtat

SEQ ID NO: 6866944 - DNA, 62 bp, Homo sapiens
ctggttgtcagacatgatgccacatgttttgtgttcatcccaatgctgatagaatctgccag

SEQ ID NO: 6866945 - DNA, 66 bp, Homo sapiens
tcagtaacagagaactcaggtgttaggaggcattattgccagctgcctagagttttctgttactga

SEQ ID NO: 6866946 - DNA, 113 bp, Homo sapiens
agattcttccaaagcaatgctatgcatgcaacaattcttctataactctctttggagacagagcccagctgctgtggtaagggttagctgcatcttatggcttgggatcatct

SEQ ID NO: 6866947 - DNA, 111 bp, Homo sapiens
ggcaagactttccgtgtccatccttcctgatctgtcctcctcagagcccagtctcatcctgggtactcagttacgggaaagatgtcctggaggggtgaccacgtgtctgcc

SEQ ID NO: 6866948 - DNA, 91 bp, Homo sapiens
caagtatcaaaatgttaaaatgctgtgctatatctctgagtgtataatggaaacaacattcagcaaatatatatagatgttctactgcttg

SEQ ID NO: 6866949 - DNA, 103 bp, Homo sapiens
tcttactgtttcatgtgataccttgttcagatttcaaaatagttgtagacttatcctggtttaacagatgtgaaattttcaagagattactgacattcctaga

SEQ ID NO: 6866950 - DNA, 106 bp, Homo sapiens
gaagctgcaacacctttcggacctttgggctcagaccatcgatacctctgattctgataacaaacaccaatttgggttctgcaggtatatagaagttgccagcttt

SEQ ID NO: 6866951 - DNA, 85 bp, Homo sapiens
aatttagtattcatgacacaattttctgaccttcattcctacaaaggaaagcatgaatgtcaggagaattctgttttgctttgtt

SEQ ID NO: 6866952 - DNA, 95 bp, Homo sapiens
agttaaggctattttcacttcttttgtggctcttcagttgcttcaggccacctggatgtatacgtgcaggtcacaggcgatatgatggcttagct

SEQ ID NO: 6866953 - DNA, 75 bp, Homo sapiens
acagtcaaacaaattaacatatccatcaccttccatagttaccttttgtgtgtgtgtgtttgtttgtgtgtgtgt

SEQ ID NO: 6866954 - DNA, 62 bp, Homo sapiens
acagggaaaatgtcaggttacaagcaaaatatatttgcgtagacctttacatttttcactgt

SEQ ID NO: 6866955 - DNA, 60 bp, Homo sapiens
gcagatgctgtggtgatagaagttcctgacctagataaggatatcatatatggtttctgc

SEQ ID NO: 6866956 - DNA, 64 bp, Homo sapiens
caggttggggatctgtctatggcagtgcagaaattttcccagtcattacaagatttccaatttg

SEQ ID NO: 6866957 - DNA, 76 bp, Homo sapiens
attttttgctctatcttaaagactgcggaatttgaatggaaaattcaacaggaaagcactttacagagcagagagt

SEQ ID NO: 6866958 - DNA, 73 bp, Homo sapiens
ttacccaaatgccactgtttatgtcacttaatgttgagtgctttcattaagatattgagtggtaatttggtag

SEQ ID NO: 6866959 - DNA, 71 bp, Homo sapiens
aagtcatcacagctagtaagtggaggagccaggagttcagggctcaaactttactaagttgtgagtcattt

SEQ ID NO: 6866960 - DNA, 90 bp, Homo sapiens
gcttgaatcttctcttcatagccagtgattctgatgtactgaattgattacctatcttgcatcttgtcgtggtggatgatgattctaagc

SEQ ID NO: 6866961 - DNA, 59 bp, Homo sapiens
agccatcctccacagccttgatcacctgggccacaggggtggggagcagagaggaggct

SEQ ID NO: 6866962 - DNA, 87 bp, Homo sapiens
gcttcacctcttgggacatcagtttcttcatcagttaagcagggacaacactgcctgcctaggaagctgtgaaatcaggcatgaggt

SEQ ID NO: 6866963 - DNA, 77 bp, Homo sapiens
tcttataaggatacatcataggatttaggtccatctaggtaatctaggatggtctcatcttaagatccttaattaga

SEQ ID NO: 6866964 - DNA, 73 bp, Homo sapiens
gaaggatgattgaagaatgtgtctgatcattgtaaagattttcaaatacatggtcaatcaacttttgtccttt

SEQ ID NO: 6866965 - DNA, 98 bp, Homo sapiens
gagggagtttcgctctcgtagcccaggctgtagtgcagtggagcaatcttggctcactgcaacctctgcatcctgggttcaagtgattctcctccctc

SEQ ID NO: 6866966 - DNA, 86 bp, Homo sapiens
cagacaagtaacagttgctataatatcttcatttttcatagaataaacaaaaatgtagacctatagggacctcagtgattgtcatg

SEQ ID NO: 6866967 - DNA, 64 bp, Homo sapiens
acttgccagtcctctggtcccagaactggggtgagctgaaggtgaccagagactggggacaagt

SEQ ID NO: 6866968 - DNA, 62 bp, Homo sapiens
ctttattctgcaaattgccttgaaagaaatgtcaattaaagaaaggctgtttgttaataaag

SEQ ID NO: 6866969 - DNA, 78 bp, Homo sapiens
gcatggctgtcacctcattaaggtatttatgtcctggcagtgcctgaacttgaatgtaccttgaaggtgtaattgtgt

SEQ ID NO: 6866970 - DNA, 105 bp, Homo sapiens
tcagagacagagactaggattcattgcagttgagttgtgttaaagtaaaacttatagaacaaacttttagaattcctgctgccaatgtccaaagactgtccctga

SEQ ID NO: 6866971 - DNA, 80 bp, Homo sapiens
gacgctgaagcacagataattcaagtatcctggggagaaattggaagaaaggaaatttgaacttatctgtctgacagctc

SEQ ID NO: 6866972 - DNA, 61 bp, Homo sapiens
ctctgggaacacacgtcacttcatgctggaaaaagttgctgcacaaacttgtgtcccaggg

SEQ ID NO: 6866973 - DNA, 67 bp, Homo sapiens
gagattctctttggaagtttttcaaatgcttgacttatcaagagctgagaaacttgccaagcatctc

SEQ ID NO: 6866974 - DNA, 57 bp, Homo sapiens
cagtgcagacgtggagggggcacagctgggaattgcctcagatgtcttaaggcactg

SEQ ID NO: 6866975 - DNA, 82 bp, Homo sapiens
acctctagccctgcacagccggacccctgctgtgggcagaactcccaggctgggttgcaggctgtgccttaggcttcaaggt

SEQ ID NO: 6866976 - DNA, 55 bp, Homo sapiens
gctggtgattgcctcaggaggccttttatttctttctctgtggtccaatcccagc

SEQ ID NO: 6866977 - DNA, 81 bp, Homo sapiens
ggaaagacgcctctgagagcggtctgtggcttcacatttattattgatgcaggcttcagcagccctctcttgggcatttcc

SEQ ID NO: 6866978 - DNA, 95 bp, Homo sapiens
cccggaacggcaatctcctcacgtgtaaagtggagagagtgactgtcagtcacctggtcagtcagtcacactcactgaggtaggcctgtggtggg

SEQ ID NO: 6866979 - DNA, 86 bp, Homo sapiens
gggtccttgcagtccctgaggggtcattcctgaaaagaccgacgccatggcctgagtataggaggcccctcctgggttgctggccc

SEQ ID NO: 6866980 - DNA, 58 bp, Homo sapiens
cagtttctgttaccatatttgacagtgttaaagctgatatataaggcgatagaagttg

SEQ ID NO: 6866981 - DNA, 69 bp, Homo sapiens
gtaaattagacattaaatgccatttaatcagtcagataatgattaatgttagagtaatgtttgatgggc

SEQ ID NO: 6866982 - DNA, 62 bp, Homo sapiens
gttgtccagccaccctggaggcacgcggcgtcaggcctgaactgcacagtggctggatttac

SEQ ID NO: 6866983 - DNA, 67 bp, Homo sapiens
gaaacaatacttgtcctcactaccactgataaaaggcatgactgatggtgagggtaagtattgtttc

SEQ ID NO: 6866984 - DNA, 70 bp, Homo sapiens
cagttgacatgttcttgaaagtgacaggtcatctatcttaagctggttaccaagctctgcatgttaagtg

SEQ ID NO: 6866985 - DNA, 82 bp, Homo sapiens
gcaaggacagcatgagcctgtcctgtgcatgtgaatttaaattttccatatgtatacacaggctgtttagcttcatctttgc

SEQ ID NO: 6866986 - DNA, 58 bp, Homo sapiens
caaggctggagtacagtgcagtggtgtgatcatacctcattgtagcctccagttcttg

SEQ ID NO: 6866987 - DNA, 60 bp, Homo sapiens
agtgcaggaagatcggactcattagaactacaaacctgctgaactctggtcatcttcatt

SEQ ID NO: 6866988 - DNA, 80 bp, Homo sapiens
ttaccagcttttgtctaggctttttcttccatgttgtttctccttaataggcaagcacaaagtcaggacagagtaggtga

SEQ ID NO: 6866989 - DNA, 68 bp, Homo sapiens
atgctcagttgctttctgatttataccatacacgtgaatcaaagaatgtgactgaaatatttatgcat

SEQ ID NO: 6866990 - DNA, 97 bp, Homo sapiens
acgaaggaggaaaaggaaggaggtgtcagttggactgccccaaggcaacccttgagccatcaggacagctcaacacctcctctgttttcttctttgt

SEQ ID NO: 6866991 - DNA, 77 bp, Homo sapiens
tcttaaatcacatggcttctgtcttggaaattttacctttaaaagattatttaagacaggaaccaggaggcttggga

SEQ ID NO: 6866992 - DNA, 83 bp, Homo sapiens
agcttctgacttcaaatgagaactccaggcactagcaggcatgtttagtgcttaataaatttcagaaaagaagaatagaagtt

SEQ ID NO: 6866993 - DNA, 76 bp, Homo sapiens
tctcggggcctcagtttccccacctgtagaatgagggtaacagaggcctaggaatgggtaaattgggcacccgaga

SEQ ID NO: 6866994 - DNA, 56 bp, Homo sapiens
caccaggaaccccagacccacacttcatggttgcaggtagggaaggttcgctggtg

SEQ ID NO: 6866995 - DNA, 81 bp, Homo sapiens
tgtataggagtgtagggcttttatgtttgcaaaatgctttcacatgcattagttaacatatttggctgatattcccagaca

SEQ ID NO: 6866996 - DNA, 57 bp, Homo sapiens
gtgaccttatttggagatggtctttgcagatgattaaattaattaagatgaggtcac

SEQ ID NO: 6866997 - DNA, 86 bp, Homo sapiens
gtggtgaagtcctggatcttttcctgtcttcaacctttcccccaaccaggttaggaagacaggagtgggttaaatcattttattac

SEQ ID NO: 6866998 - DNA, 67 bp, Homo sapiens
ttctggagcagattcaagcagcaaatatttactgaacacttgctatgtgctggaaattgttctagga

SEQ ID NO: 6866999 - DNA, 112 bp, Homo sapiens
ttctggcctggggttaagccagtcctccctcacctcagtctgggcctcatcatgcccctcgcacatgacccagacccagagggaggcaggttgccctacccattttccagag

SEQ ID NO: 6867000 - DNA, 95 bp, Homo sapiens
ctgactcacaaacgaaaggttcttcttcagtagtcattagaaaaattgtgtttttgatttcttaagaggaacatttttgtgtcttcacacatcag

SEQ ID NO: 6867001 - DNA, 80 bp, Homo sapiens
gtggagtggctgtgcagtgtggggtaggcctgggcccaggcaggagcaaggccgcctccgcctgcccaccctcctctcac

SEQ ID NO: 6867002 - DNA, 83 bp, Homo sapiens
tatttcctacattagtacattgattcattatgtcatttctaaaagagggacaatattatgactcatgagcatggagggaaata

SEQ ID NO: 6867003 - DNA, 75 bp, Homo sapiens
catgctgaagagtgcacaggctatttgctgtaatattatttcaattccatggatctgtagcaatcttcagctatg

SEQ ID NO: 6867004 - DNA, 89 bp, Homo sapiens
gccttgaaactaaatgatggatttaaactttctaaaggagttccattttaatagtctatagagagttctgaaattatctttactcaggt

SEQ ID NO: 6867005 - DNA, 68 bp, Homo sapiens
gctctatgaacctgaatctcactcccaaagacttcttccttccccgtaagaacttatgtttatggagc

SEQ ID NO: 6867006 - DNA, 70 bp, Homo sapiens
gggagaaggaggactgtgctgtgccatatttgatgctattaaaagcagctcgcatagtttccatcattcc

SEQ ID NO: 6867007 - DNA, 67 bp, Homo sapiens
cttgccttgggtcaacctttgagtgtttgacactcacagtcattacaagggtctgactggagggaag

SEQ ID NO: 6867008 - DNA, 75 bp, Homo sapiens
ggtgggagtgtctgctgggcctggtctctgaggcaggcatgtgtctgcccagcaaggcagcagcagcttctgacc

SEQ ID NO: 6867009 - DNA, 97 bp, Homo sapiens
ctccctggtgttcagattcacattcaccattgcttctttcttacaagtttttaagatataggcaatttggaatctgtactcttggtgcaccgaggag

SEQ ID NO: 6867010 - DNA, 69 bp, Homo sapiens
acttcttatttgatatcttcacttgaaggtctaataggtatttcaagtttagtgtgttcaaatagaagt

SEQ ID NO: 6867011 - DNA, 56 bp, Homo sapiens
agaagtaggcagggctgtatcatcatcaccttgatagatgcagccaggtttattct

SEQ ID NO: 6867012 - DNA, 79 bp, Homo sapiens
ccagattgtctttccttggaggagtcctgttgctatctcggctggtctcctccatggagatggtatgtatcagtcatgg

SEQ ID NO: 6867013 - DNA, 71 bp, Homo sapiens
catgtgaaggacatttgtccatgattgggtcaaagtgtcatggttcatgagtgtcctttgaagtcagcatg

SEQ ID NO: 6867014 - DNA, 75 bp, Homo sapiens
ggccgttctgacacattactacatggatgagccttaagaacattatgcaaagtgagatgtcagtcacgaaaagcc

SEQ ID NO: 6867015 - DNA, 59 bp, Homo sapiens
gcagggttcagtgaggtgtactccgcatccaccaggagccgcacgtgctgggcccgggc

SEQ ID NO: 6867016 - DNA, 59 bp, Homo sapiens
tgtgtgcttatagtctagtagtaacaggagcagtttttacattgactgtgtgcatcaca

SEQ ID NO: 6867017 - DNA, 98 bp, Homo sapiens
taagcaatgaaggcaaagctccaagtgtggtgtttggcacatagctggtacacaatgaatgccatccatcagtatttgtggtttgttttaaatgttta

SEQ ID NO: 6867018 - DNA, 77 bp, Homo sapiens
agagctgataagtggcagagccagggttgggacacaggtgtgttcaaagccctttctgcttttacattccagactct

SEQ ID NO: 6867019 - DNA, 69 bp, Homo sapiens
tgggtgacatagttacttcaggctcatatgccattttctgggggccttataggagactttgtgagccca

SEQ ID NO: 6867020 - DNA, 73 bp, Homo sapiens
gaagtggacgctagtacttgaagtcactctatttaaatcttgcctgactttcttaactagctgttctgatttc

SEQ ID NO: 6867021 - DNA, 60 bp, Homo sapiens
tggctgaggggagggagatttttcttgttgtggacaaggcagtccctactccctgcacca

SEQ ID NO: 6867022 - DNA, 55 bp, Homo sapiens
caatgtactacaaagattgtcaaacccgggtggagtgtgatctttgagtataatg

SEQ ID NO: 6867023 - DNA, 90 bp, Homo sapiens
gtttgttttttgctgatctatctaggacttattcacgcagctatacttaagcagcaggtcagctggtgactgagttcagctgggacagat

SEQ ID NO: 6867024 - DNA, 56 bp, Homo sapiens
tacatacacaaatgctgaatggtggctaaaaatctcatcagcttctgtgtattgta

SEQ ID NO: 6867025 - DNA, 55 bp, Homo sapiens
accaggagacatgaccaatgagactagagagagtttggtgtcatttcctcctggt

SEQ ID NO: 6867026 - DNA, 58 bp, Homo sapiens
agctcggctgtggacatgtgagcacacacacactgtctcatatattccagctgcagct

SEQ ID NO: 6867027 - DNA, 61 bp, Homo sapiens
tgtgggctcaggtttaaagtgctttagccttgctagccagctgctgaaacctgagaaaata

SEQ ID NO: 6867028 - DNA, 56 bp, Homo sapiens
atttcctcccttgtcattgcttcagtgtgctcaaaagcaggtgtaaaggaggaaat

SEQ ID NO: 6867029 - DNA, 62 bp, Homo sapiens
agagaggtcatctcccatcagcaacctttacaaagatgctgatctggtagatgaaactcttt

SEQ ID NO: 6867030 - DNA, 58 bp, Homo sapiens
cattgcctcctcctgttagaatttgcagcagaatcctgtggcctgggaggaggaaatg

SEQ ID NO: 6867031 - DNA, 57 bp, Homo sapiens
ccaagtaagggctagcaattgtgcgcattgttgctgtggttgtttttcttattatgg

SEQ ID NO: 6867032 - DNA, 78 bp, Homo sapiens
ctctgacaatcaaagtcccagctgcttagagacaagagtcctgacctgaactggggtctttagaatttggattcagag

SEQ ID NO: 6867033 - DNA, 83 bp, Homo sapiens
gtccattaaagtaggctgagtatctagagtgcaaaataaagtcacaatttgtaagatattcagcttattgaaataatatgtac

SEQ ID NO: 6867034 - DNA, 76 bp, Homo sapiens
aaacagacaacacatgtgtatatgtgtgtgatatatatatgcatgttcatatatatgtgtatgtgtttgtctgttt

SEQ ID NO: 6867035 - DNA, 55 bp, Homo sapiens
taggtctcctggcctagagattgccaaactgcagcatagtcaccaaggaggcctg

SEQ ID NO: 6867036 - DNA, 64 bp, Homo sapiens
ggacttcttgggcctgcagggagctccaaacagatctccagcctccctgagcccaaggggctcc

SEQ ID NO: 6867037 - DNA, 85 bp, Homo sapiens
catctttgcccattttagcaattggaatctagttcatgaagtaagtgttgaacagtcttcatgctagaatggcactaagtagatg

SEQ ID NO: 6867038 - DNA, 72 bp, Homo sapiens
gagtctgggtggagggcgaggggcccagagggacttcccaggctccctgcctgtcctcagtcacccctgctc

SEQ ID NO: 6867039 - DNA, 58 bp, Homo sapiens
tcctcttcacatattccttgagctagaaagacttctatgtggcatgggtgggagtgga

SEQ ID NO: 6867040 - DNA, 59 bp, Homo sapiens
gagttcctcttttcctcatttaccctcctgaaacacagaagggggagcagactgaactc

SEQ ID NO: 6867041 - DNA, 83 bp, Homo sapiens
atttaagaattcaggagtgatgttggttaagtagtatgttatagcttaattaaactactgaatattagttctgaatactgaat

SEQ ID NO: 6867042 - DNA, 82 bp, Homo sapiens
gtttgaagcagccacagcaacaagtgcaattatcattcttacattcaatcagagattgtcctttcatgtggctatttcatgc

SEQ ID NO: 6867043 - DNA, 79 bp, Homo sapiens
gacttgctaattgccaagtttaatgaatgacttagttcttacctcactgggtctttctactgcacttggctggttggtc

SEQ ID NO: 6867044 - DNA, 84 bp, Homo sapiens
ttctaacatcctttggtatcttactagtatttagcataggaaactaacaaggaatacatggcagggagtcatctgatgttggaa

SEQ ID NO: 6867045 - DNA, 72 bp, Homo sapiens
gaccctaaagaatgtggcataaaagccaagcccattaggctaggcaagtggaccagaggtttattggaggtc

SEQ ID NO: 6867046 - DNA, 75 bp, Homo sapiens
catattataaattactgatatttggaaatttctaagagtatgtcacttagaaatgaatatgtagtggttaatgtg

SEQ ID NO: 6867047 - DNA, 73 bp, Homo sapiens
ggctggccaggctgggcacatgattgcaggagcctgtgtcctgcagcaaatggggcccgtcctggcagcagcc

SEQ ID NO: 6867048 - DNA, 107 bp, Homo sapiens
gaatatgaatggcagtaattaggtctctgagtttaggaccaggctgagcaaaggaaaggaagttcatgtctgggctagtgctcacaggccctgcacttcctttattc

SEQ ID NO: 6867049 - DNA, 70 bp, Homo sapiens
gcagttttttcaattggtttgtagtcctcaataattatatattaaattgctgtcaaaccagtaagactgc

SEQ ID NO: 6867050 - DNA, 68 bp, Homo sapiens
cagcctgacatggtttggcaaaagccactcatggtcgtctctgaggctccagccaggccagcagcttg

SEQ ID NO: 6867051 - DNA, 60 bp, Homo sapiens
gtggaggccaagtcactgacctgggggcaaagacatctgagttctcatcttggcttctat

SEQ ID NO: 6867052 - DNA, 68 bp, Homo sapiens
tagtgttaccataggtcagaacgttattgcaacaaatgtacaaaactatgatgactatggtgagattg

SEQ ID NO: 6867053 - DNA, 77 bp, Homo sapiens
gttattggaaacaattgctttcttcccaagacaggtcctaaactacactggggtagagacagtgtttccatctttgc

SEQ ID NO: 6867054 - DNA, 72 bp, Homo sapiens
tgacttgctgtagagaccacccataggcccctgtccctaagggcagtgttgtggttctctatgtatcagtca

SEQ ID NO: 6867055 - DNA, 66 bp, Homo sapiens
agaagaagttgaggcttccccaagggctgagggccccatagctctgggaagtcctttaccatatct

SEQ ID NO: 6867056 - DNA, 57 bp, Homo sapiens
ggagtctcacaatgttgcctaggctgatcttgaacacctgggctcaagtgagcctcc

SEQ ID NO: 6867057 - DNA, 80 bp, Homo sapiens
gtggtgaatcgcatgctctgccctgttccgctgcccctgagcagtgtctgaaccaccggggcattttaacgtcttcccac

SEQ ID NO: 6867058 - DNA, 79 bp, Homo sapiens
attacttttaatggaaatatgtttataccctccattctaatgtggtctggtgaaaaatggtttcatatataaaagtgat

SEQ ID NO: 6867059 - DNA, 66 bp, Homo sapiens
gaggagaagtacaaaggacatggaaacagccggcggggaggctgccatggatagctgtgcttcctc

SEQ ID NO: 6867060 - DNA, 55 bp, Homo sapiens
ctcacatgatggcctttttcattagaattcttttggaacgtaggaagtctgtgag

SEQ ID NO: 6867061 - DNA, 56 bp, Homo sapiens
ggtgaggggcgcctctgcccagccgcccctactgggaagtgaggagcccctctgcc

SEQ ID NO: 6867062 - DNA, 58 bp, Homo sapiens
gaaggggcttcccctcctttctcgctgggttgacgttcccagcgagtgaagccttttc

SEQ ID NO: 6867063 - DNA, 85 bp, Homo sapiens
cgtgccgcgtactcttcaaactgacagaacaaaagagccaaattccaaaattctggtctgaatgacttgttagttgtgctggatg

SEQ ID NO: 6867064 - DNA, 78 bp, Homo sapiens
gctctgaagctctaactactctgctcatgtttatatattcaagtatgtgagtgtgagacagagagagagagagagagc

SEQ ID NO: 6867065 - DNA, 61 bp, Homo sapiens
tctttgctccacactctagagacgaggaagggctcactcttggattttaatggatcaaaga

SEQ ID NO: 6867066 - DNA, 57 bp, Homo sapiens
gatgggatgcatggctgtggccagactcgcatcatggcctctgccattattcctttc

SEQ ID NO: 6867067 - DNA, 66 bp, Homo sapiens
tgctgaagtccaagagctccaaggatcagaagcgtggtcctgtttaagaattttaggacttcagca

SEQ ID NO: 6867068 - DNA, 84 bp, Homo sapiens
gccctggcccggttctgtttatggctctgcgtggggtttctgtagagcagctccagcagaaccagagacctgggaaaagggggc

SEQ ID NO: 6867069 - DNA, 85 bp, Homo sapiens
cctccaagcatgagggagagggcatctttccagtcacttttgaccagtgattgttttaaaaatgcctttacccctttgctagagg

SEQ ID NO: 6867070 - DNA, 100 bp, Homo sapiens
tcccaagggttccaggagctcagccgtgggcaggcccaggacactgagacctaagcctggtgctggtgcctgcctttgagcagggttggggccccaggga

SEQ ID NO: 6867071 - DNA, 94 bp, Homo sapiens
ataagtacctatttatcttttctatttgctgcaactatatgaaaatatatatggatataatcagactggaaaggactttgaaaatggtatttgt

SEQ ID NO: 6867072 - DNA, 69 bp, Homo sapiens
tcaatttagagttcagcatgactttgatatacaaagctgtcaagggcattatgagaactatggattaga

SEQ ID NO: 6867073 - DNA, 130 bp, Homo sapiens
tgtgtgaatgtgcagaaaaccaggatgttgctacttgattgacagttgactatgtacatataaaaacacagagttatggacttaatgcaggttaagcaaggtgtatttgatggcatgtatacatcataca

SEQ ID NO: 6867074 - DNA, 74 bp, Homo sapiens
agatgagttctttctattctattttaggttatttgtttgattagcaaatttggtggggcagagacgggccatct

SEQ ID NO: 6867075 - DNA, 79 bp, Homo sapiens
gggatgttatgtgtctggcatggaaagtgttacttgctttattatcttaacaatcctgtaagacaggtatcaatatccc

SEQ ID NO: 6867076 - DNA, 60 bp, Homo sapiens
gagaacatgtttagtgacagtctgaacttttgggacttgtgagcccattaaactgttctt

SEQ ID NO: 6867077 - DNA, 57 bp, Homo sapiens
atctgttcttgtgtcagtaattgttatctccttaaggagaactgagtaagaacaggt

SEQ ID NO: 6867078 - DNA, 66 bp, Homo sapiens
agagaatgggatgtttttaatcgtaagtaaattaataaattttgatgtcaaaatatcctgttctct

SEQ ID NO: 6867079 - DNA, 66 bp, Homo sapiens
gccgttctgattctaggcgttcctctcagtccttgagtgagtgaatatctaagtcagcattagggc

SEQ ID NO: 6867080 - DNA, 55 bp, Homo sapiens
actgcagcaaagcccgtgtctttgcaggagtaggagacacaggggttgctggggt

SEQ ID NO: 6867081 - DNA, 79 bp, Homo sapiens
ggtgcctcaacttttaaatttgataaagtgatttccactcattgatgtcaccagatttgttacattaaaaagtaggtcc

SEQ ID NO: 6867082 - DNA, 77 bp, Homo sapiens
caaccgtctgatgataagcagaaattatttgcagatcaagacaattgttctgcagtctggatgtcctcagatgactg

SEQ ID NO: 6867083 - DNA, 117 bp, Homo sapiens
ttctccgcattctgttttgttaatgtgcaagtcgaatggcattaatttggggttaaggaagttacaaaattcctgtcatttgcactttcattcttattaaaatcagtcaacactgaa

SEQ ID NO: 6867084 - DNA, 82 bp, Homo sapiens
agtgtatctgtgcatgcaaacatgaagagaaagagacttctatggcatctctttattttctttgctattgctttaatgcatt

SEQ ID NO: 6867085 - DNA, 58 bp, Homo sapiens
ttaaagataatgtatgaaatgtgtgttgcactgcatttgcacatagtattatctttaa

SEQ ID NO: 6867086 - DNA, 61 bp, Homo sapiens
gaattagagggcacttgaatgttttattgatagtccaatggcattccaagtcttctttttc

SEQ ID NO: 6867087 - DNA, 71 bp, Homo sapiens
cgttagacctcaataccaggcaccacgcaatacctggtgcattgtgtgaccactggaatagaggatgaatg

SEQ ID NO: 6867088 - DNA, 69 bp, Homo sapiens
gggtgggtggtggggcgtcgagctgaacgctggtctggacaggaaaggctcctgcttcatgtcccacct

SEQ ID NO: 6867089 - DNA, 58 bp, Homo sapiens
ttggaaaacttacacagagctgtgctgtgtccaaaatgctgttcagtaggttttccaa

SEQ ID NO: 6867090 - DNA, 67 bp, Homo sapiens
tatgaatattccgtgactcttttgggtcctttgtggcccttcagtcagtctggaaaacacattcatg

SEQ ID NO: 6867091 - DNA, 84 bp, Homo sapiens
agaggctctgaagccagtgtttgaagaatttgttcctgaagtacctcctgggggtaggctagaggcttctggcttcagggtcct

SEQ ID NO: 6867092 - DNA, 66 bp, Homo sapiens
agaaaggagagaatgagagtgtcgagtgggccttgacctcattcacaaagctggttccttctgtct

SEQ ID NO: 6867093 - DNA, 129 bp, Homo sapiens
cttactatattttgcatttccccagggtgtcaattttatgaaacaaagtgacgggatgatttctatcacttgagaagctgtgttaaaaaaatctgatgcactggcaacagcaaaaattgttatggtagg

SEQ ID NO: 6867094 - DNA, 57 bp, Homo sapiens
cctaagacctcaatcaatagtgttctcaaaggagaaagcaatgttagaggccttagg

SEQ ID NO: 6867095 - DNA, 62 bp, Homo sapiens
tgagtcagagaacacagaggtgatgtttgggactgttccacattataaatttgttttgacca

SEQ ID NO: 6867096 - DNA, 61 bp, Homo sapiens
ggacgttattgaatctttgttatagcaaggcattttgtaacagagttgtacagttacgtct

SEQ ID NO: 6867097 - DNA, 69 bp, Homo sapiens
gccatagcctgggccctgcctcttctctgcgctttgcagaaatcatattctcagtccttcagctgtggc

SEQ ID NO: 6867098 - DNA, 67 bp, Homo sapiens
cctgtcttccatttccctttagcctgagaatccttcaatctgatgtgaggactaaggctcagacagg

SEQ ID NO: 6867099 - DNA, 56 bp, Homo sapiens
gaggcctggcatgaatgggaaccgatgaagttcctcagtgtgtgacccatggcctc

SEQ ID NO: 6867100 - DNA, 97 bp, Homo sapiens
gcccgcccctaggggaggcagagggaagccccgaggaggcacccggcccgctggggcgcgctgcccggggctttagggctttttcttgtgggccggc

SEQ ID NO: 6867101 - DNA, 60 bp, Homo sapiens
ttcttagctccagcttcatgtttgtgagtaagcctaagacagaggctggtgagctgaggg

SEQ ID NO: 6867102 - DNA, 88 bp, Homo sapiens
gggtgttgtcagctgcctcccgccttggcttcagtagctcacccagcttacaggggagctgccctgggctggagatgggcatgcaccc

SEQ ID NO: 6867103 - DNA, 69 bp, Homo sapiens
gccccggcccgtgggccagcgggcagtctactcacgtgggcctccgcatggcccagcgccgccaagggc

SEQ ID NO: 6867104 - DNA, 60 bp, Homo sapiens
ggggtgctgagatcttccctcactggaataaggttctcagtgcagggcaactcagactcc

SEQ ID NO: 6867105 - DNA, 65 bp, Homo sapiens
gggaagggaggaacgggctttcctgcttccttaagacaggggcaatgagcttgacctcctggccc

SEQ ID NO: 6867106 - DNA, 85 bp, Homo sapiens
gcagtaaatgtacctttgtccagatggacatcaggcttcagtgccaatattgtacctctaacatatggacaagaacatttatggc

SEQ ID NO: 6867107 - DNA, 63 bp, Homo sapiens
cagtcagggaatgatgcacacagttgggttgtccctaaccttgttggtttcattcacctcttg

SEQ ID NO: 6867108 - DNA, 57 bp, Homo sapiens
gggctggggcagcagagccaaggctgctgctggtcagggctctgccccaccccgtcc

SEQ ID NO: 6867109 - DNA, 62 bp, Homo sapiens
tgagtcacctctcagaagccaccagcccaaaataggactattgcttgcggacaggtggctca

SEQ ID NO: 6867110 - DNA, 84 bp, Homo sapiens
tttcagcacaatgcaggctggtctgaccatccctcggccctggccagggggaggataatggacataggctacagcaggctggag

SEQ ID NO: 6867111 - DNA, 56 bp, Homo sapiens
ggcgctcttgtacctgtccctctcactccagagtggaaggtgctggtgagggtgtt

SEQ ID NO: 6867112 - DNA, 81 bp, Homo sapiens
tggaaaataggtagttttctgaaaattactttggttctctaaagtactaatgaatattttgcagaaaatgaacaccttcca

SEQ ID NO: 6867113 - DNA, 69 bp, Homo sapiens
ttccatgaaacacacacgcgcatactgtgttcaaggcagctatgtatttgtgtgttaaaacagaaggag

SEQ ID NO: 6867114 - DNA, 63 bp, Homo sapiens
gagctgtcagttcattagcacttccaactagagtgggaagaagcagagaactggataaagctc

SEQ ID NO: 6867115 - DNA, 73 bp, Homo sapiens
gtggcagacagcattgtaagaatgaagacctgggtggttatcagagtccatgttcttcagggcttgaggccat

SEQ ID NO: 6867116 - DNA, 82 bp, Homo sapiens
gtgtaacatacatagtgaacatttacagagcacttataccacatgccaggcactttgccaaatgctttacatgtgtttacgc

SEQ ID NO: 6867117 - DNA, 70 bp, Homo sapiens
tatcttggtcctggatgagacaggtagttttaaccgagacttttgtataaatctagggctgtaaaggatg

SEQ ID NO: 6867118 - DNA, 91 bp, Homo sapiens
accatacgtgttccatcaacatcttttttcctccctgtggcagagagattggctttacaaatagggagggagtgatgaaagatattttggt

SEQ ID NO: 6867119 - DNA, 56 bp, Homo sapiens
gtggaaggcattttccagcctcagggccatgcttctgagagaacaatgcctcctat

SEQ ID NO: 6867120 - DNA, 64 bp, Homo sapiens
tactcggggtggagagagcggtgcggggatttcaaggtctgtaccgccccccacatcccgggta

SEQ ID NO: 6867121 - DNA, 86 bp, Homo sapiens
aatgccctcacaggcatgctttatctgtgagaacctgagagcagaaaagctttggtaattaatttgataggttctggatgggtatt

SEQ ID NO: 6867122 - DNA, 101 bp, Homo sapiens
ttcatttagaattcatggtaacagaattctaaatgtaatttagaatttatagtaacagaattctaaatgtaatttagaatttatacatggagagagatgaa

SEQ ID NO: 6867123 - DNA, 83 bp, Homo sapiens
acctcaggggaccaaaatgtcctgcctacaaggcttatggtattaaggccacaaggggaggaattttggtctgttttatcggt

SEQ ID NO: 6867124 - DNA, 129 bp, Homo sapiens
gttttttggggatgctcaagatattttgctgttgactttctataaggccaaagaataataacatcagcttattattagagtgctttgagaaagttagccaaaacttcagcagaagaatgcccaggaaac

SEQ ID NO: 6867125 - DNA, 76 bp, Homo sapiens
ggcaaaaatgtctacagaatgttaatatttttaactccttgacaaatatgaatagtctgtggttcatttaaatgcc

SEQ ID NO: 6867126 - DNA, 55 bp, Homo sapiens
tcacaggagaatgtacttaccaattacaacattttgataaggcattcttatgtga

SEQ ID NO: 6867127 - DNA, 64 bp, Homo sapiens
ggtctggaccatggacgccgggcaagtcatccaagcaaagcccagtgaagttccaggatgggct

SEQ ID NO: 6867128 - DNA, 99 bp, Homo sapiens
gtgattatcccacctcagcctcccgaatagctggaattacaggtgcccatcaccacgcctgactaatttttgtattttttagtagagatggggtttcac

SEQ ID NO: 6867129 - DNA, 72 bp, Homo sapiens
tagtgtgataacagtgacctctcagcaccgtcaccgggcagggtgctcctgtggtcactgttttcagatctg

SEQ ID NO: 6867130 - DNA, 95 bp, Homo sapiens
gtacagactgtgcactgcacaagtccaaggtcaccattcacatagtctgcaatgtgattggcatcccttggagttgtgcagtgcacaacctgtgc

SEQ ID NO: 6867131 - DNA, 83 bp, Homo sapiens
gatatattttggttgctagagttgcactggacttacagaaaatcaaagtcacaaatcccctcagcaactgcctaaaaaatgtc

SEQ ID NO: 6867132 - DNA, 97 bp, Homo sapiens
tttataggtaggtctgtcttgctgctgggcttctgggaagagggaggctggtttcccttcaaggtggcctaaagtaagagaacttactgcctatgaa

SEQ ID NO: 6867133 - DNA, 70 bp, Homo sapiens
ggacactgttgagcaatgtacagtgtatggtgtgcttacctgtccactctagagcattgcttacaggttt

SEQ ID NO: 6867134 - DNA, 60 bp, Homo sapiens
ggtaggctggaaatccaaggaagagctgatgttgcagctgaagtctgaagccagtctgct

SEQ ID NO: 6867135 - DNA, 81 bp, Homo sapiens
gctgccctggccagatgctgaaagcaggagccctctgccaagcaggggctgaactcaagtcagctccgcctaaaggacagc

SEQ ID NO: 6867136 - DNA, 77 bp, Homo sapiens
ttaattgctctgtccagccagcaggtgttagccctcaagtgtgggcccaagggccggctgctgggcaggcaacttaa

SEQ ID NO: 6867137 - DNA, 72 bp, Homo sapiens
ggcaagcatgcagggacctggaaccgaaactcagcaaagagtgtcattccagggaccctcgcccagcaagcc

SEQ ID NO: 6867138 - DNA, 123 bp, Homo sapiens
cagcatcacctgggaacttgccagaaatacaagttcttgagccctattctagccctactgaatcagaaactctggggtaggggctggaaacatgtgtttttacaagcccaccaggtgattctg

SEQ ID NO: 6867139 - DNA, 77 bp, Homo sapiens
tgaatgactcttttgtttagacatttaaggaagaacctattggtgttcatttagcatgctaaacctgagtgttatca

SEQ ID NO: 6867140 - DNA, 79 bp, Homo sapiens
tccatatcagaaatcctgggcaaagtatgctgtctactctaagatatggtttagcagacctgtctaggcaagagatgga

SEQ ID NO: 6867141 - DNA, 129 bp, Homo sapiens
aaattttgtggtaattcagttttgaatagtcagaacagctaggagaaaaggtgttttcgtttattcttaaaaaggaacatttaaattcttatttgatcatttgaaagctatttttataccataaaactt

SEQ ID NO: 6867142 - DNA, 55 bp, Homo sapiens
aggtgtggaagctgggatagaatagagttagtactctctcacagtttccttgcct

SEQ ID NO: 6867143 - DNA, 66 bp, Homo sapiens
agcagataatggaagagactccaaatcatgcaggcctaaacatgagtatctctccatctatttgtt

SEQ ID NO: 6867144 - DNA, 73 bp, Homo sapiens
tacttggcttctctggggaccttacaaaccatagcctggttccatgttgatgtgggccccagtgaaatctgtg

SEQ ID NO: 6867145 - DNA, 94 bp, Homo sapiens
ggagcagaagaaagtgcaaagggctttatatcagtgtgtttacagtatgacacaattgactgttgtcccttatatctgcatttccttttacttt

SEQ ID NO: 6867146 - DNA, 59 bp, Homo sapiens
gttgccaggacagcgcggcccgagcagcaacggcagaagccgcaccgcgtcccggcggc

SEQ ID NO: 6867147 - DNA, 89 bp, Homo sapiens
gtcaaattaatgaatttattgtcttcgtggtgcctattactaggccagatcctggagtagggctataagagaataagacattttgtgac

SEQ ID NO: 6867148 - DNA, 56 bp, Homo sapiens
ggctgagcccgggtgctctaccccgcttcctggggactctgcttctgggatcagcc

SEQ ID NO: 6867149 - DNA, 62 bp, Homo sapiens
gcagtgcctggtttgaaagagcccttccatgggtctgccggaagagctgtcaggaaggctgc

SEQ ID NO: 6867150 - DNA, 64 bp, Homo sapiens
ggtgggggcggaggtgactttctgcagagctaaatgaagctgtggaagtcgcctctccttggcc

SEQ ID NO: 6867151 - DNA, 65 bp, Homo sapiens
agggatggaatgaatggcagatacatattcttctggttgaatgtagtcatttagctcacatttct

SEQ ID NO: 6867152 - DNA, 88 bp, Homo sapiens
ggagtctcactctgtggcccaggttggagtgcagtggtgtaatctcagcccactgcaacttctgcctcctgggttcaagtgattatcc

SEQ ID NO: 6867153 - DNA, 64 bp, Homo sapiens
tggaaatagcctaaaattgcctccctacccaacttggaggaggggcaatgatagtctggctcta

SEQ ID NO: 6867154 - DNA, 83 bp, Homo sapiens
attgtgggcacggcttttgagttgtgtcctaatgtgtctcagtaatggtgactgtgggcacgatttttgagttgtgtcctaat

SEQ ID NO: 6867155 - DNA, 75 bp, Homo sapiens
ggctgataagagttgcctgtggagccactagttttgtgatttttcagaacaggtttctctagaggcctctcagct

SEQ ID NO: 6867156 - DNA, 100 bp, Homo sapiens
cagtgctgcatgggttgtcactcatattcagtcactgatgcaggttgcacacagccctgagccctgtgtctaatatggctgatacccatgtatggcattg

SEQ ID NO: 6867157 - DNA, 85 bp, Homo sapiens
aacatttatttctctgggtctttactagatttcacataaacacacactgaaaacattagagatgccctagctgaagtactgtgtt

SEQ ID NO: 6867158 - DNA, 64 bp, Homo sapiens
agtgtccaaaagagccagccgggcgtggtggctcacgcctgtaatgccagcactttgggaggct

SEQ ID NO: 6867159 - DNA, 84 bp, Homo sapiens
tcttgcacttcaggtaggaagggccacaatgtctgtatacacagtgtgctatggtagaacagaaggcaccttctctaggcagga

SEQ ID NO: 6867160 - DNA, 69 bp, Homo sapiens
attcccaggggtcggcagcaaggcggtgaatgaatgaatcccaacaaaacctgtcaaccccatgggagt

SEQ ID NO: 6867161 - DNA, 101 bp, Homo sapiens
ttgtttattatcactgttattttaatttatcttgatttcaccagcatctgcactatgtctggtacacaaaaggtacaaaattagaatgggtgaataaatga

SEQ ID NO: 6867162 - DNA, 63 bp, Homo sapiens
tttcctttgggtattctcccttggggctaatgagttccattaggcttattacccaatgtgaga

SEQ ID NO: 6867163 - DNA, 67 bp, Homo sapiens
atattttttgaaataaggaagctcgaaatcagctggtggttatcttttgctttgttttaaaaaatgt

SEQ ID NO: 6867164 - DNA, 64 bp, Homo sapiens
tgcaatgccagtatagttaaggtcttaatgtcatccacattaaacaagggttactgagcatgca

SEQ ID NO: 6867165 - DNA, 56 bp, Homo sapiens
acccccgtctgggccactcctgcgtggcaggcacacaggtggctcctgctgggggt

SEQ ID NO: 6867166 - DNA, 66 bp, Homo sapiens
tcaaacagaaattgttcatgctgtcatggagaaggtattatccggatgaacgtgtttctgtgttga

SEQ ID NO: 6867167 - DNA, 68 bp, Homo sapiens
ttgtctgaagcccttcatgcacagtcattgacaaatatgatcctggatgatgaaggtgttttgggcag

SEQ ID NO: 6867168 - DNA, 66 bp, Homo sapiens
ttgtcctcatcattcaaagcagggtcactaccttcatcaaagacactgctctgacagtgaggccag

SEQ ID NO: 6867169 - DNA, 66 bp, Homo sapiens
tagtaaggcttatgatcagaaggttcaaagttctctactagatcatctgaaaatgggtctgtgcta

SEQ ID NO: 6867170 - DNA, 104 bp, Homo sapiens
ggattctggcctcctgcaggcatctttctgtccattcagcaggtgccacgtccccccacatatgcagggtgtccggaggatcactgacacgggggccaatgtcc

SEQ ID NO: 6867171 - DNA, 76 bp, Homo sapiens
agaaaaacagtgaagatttataaggaccttattagtatagtgagattaacctttggatctcttactctgtttttct

SEQ ID NO: 6867172 - DNA, 76 bp, Homo sapiens
agcatttagagttgagtattcattggtccagctcttcccatccagctttgtcacttatgccagctctggaagtgct

SEQ ID NO: 6867173 - DNA, 63 bp, Homo sapiens
gcttctgctggctgtgcaaaggcatggggaaatgctctgtgtgtgaacacagcccagcagtgc

SEQ ID NO: 6867174 - DNA, 86 bp, Homo sapiens
ggcctgacagctttgcttggggaagatgcactcagagcccactgaaacttgggatcctttctttccctgcaggggtttgccaggct

SEQ ID NO: 6867175 - DNA, 88 bp, Homo sapiens
caggcttttttatgaccacagaggaatttgaagaggcaggaacacaactgaaaaaaaatctcttccctttatggtatgtgaaggtgtg

SEQ ID NO: 6867176 - DNA, 83 bp, Homo sapiens
tatggcatctgttgagagtttcataatttccatgacaggcttatctttagtatgtagaaatctctgaacttaataatgccata

SEQ ID NO: 6867177 - DNA, 58 bp, Homo sapiens
aggcctggtgaatgaagtatctgaacctccaggtagatttttagtaagcacggagcct

SEQ ID NO: 6867178 - DNA, 66 bp, Homo sapiens
gttcttccttgggtaactgggtaaatggtggtgtttccctgagaccaggagacccagggaaggagc

SEQ ID NO: 6867179 - DNA, 95 bp, Homo sapiens
ccccaaccagcccgtgagcgaggacggctgagtccgcagtgtgcgccaccagggtggtccccagagtgtccttaagtcggttctcctcggtgggg

SEQ ID NO: 6867180 - DNA, 57 bp, Homo sapiens
gctctgaggctgggagcactctgcaaggtgatgggtcatgtttttagcatcaggagc

SEQ ID NO: 6867181 - DNA, 74 bp, Homo sapiens
gttgaatggctctgttttatgagtaccacactgacaaaggcataaatggcaccaaaagcagacgtattttcgac

SEQ ID NO: 6867182 - DNA, 56 bp, Homo sapiens
agggggctggagacacctcctcagggaagctttccttctggtgtcccacactccct

SEQ ID NO: 6867183 - DNA, 78 bp, Homo sapiens
gattccatgtatgacatctgtcttggagataatctatacttgaagatatgtcaaaaaagattatgtttcattggaatc

SEQ ID NO: 6867184 - DNA, 76 bp, Homo sapiens
cctctgctggctccctgacagcattttgtagctgtttgtaagtgacaactaaaggctgttgcagggaaacagaagg

SEQ ID NO: 6867185 - DNA, 75 bp, Homo sapiens
aagagctgtagaaataagcttagctttaggacacagttcagagcaaattcctgtgagccttgtttcttttatctt

SEQ ID NO: 6867186 - DNA, 56 bp, Homo sapiens
gagctggtggtgagaaagctctctcaaagcctgacaagtcatctcctctactgctt

SEQ ID NO: 6867187 - DNA, 60 bp, Homo sapiens
ggctgcctcagatttgctgactctgggaagctaggtcagcttgtgcgcatctgagcctcc

SEQ ID NO: 6867188 - DNA, 70 bp, Homo sapiens
gctcatatttagtgtttggagatcgggggcaacacaactccttggtttttggtttaacactatgtgtggc

SEQ ID NO: 6867189 - DNA, 57 bp, Homo sapiens
accctctctagacatttgtgatgagaaatgacattttgacatttgtcaagagaaggt

SEQ ID NO: 6867190 - DNA, 61 bp, Homo sapiens
tttacacggcattatcttcatgtcaagaaagacgtctttgagatgacatgcctgttgtagg

SEQ ID NO: 6867191 - DNA, 67 bp, Homo sapiens
ctaccttacctagaccagttacaatgcagatatctcctttctctgtatgaatatgttggggaggtgg

SEQ ID NO: 6867192 - DNA, 55 bp, Homo sapiens
aactagggcagatgaacagggggcacagtcctacctccagacatctagctcagtt

SEQ ID NO: 6867193 - DNA, 64 bp, Homo sapiens
ccagcttaatggtggtctttgcagaaaatgtatttttctagtataaaatgaccccatcaagagg

SEQ ID NO: 6867194 - DNA, 94 bp, Homo sapiens
cccttgagctccagcctggctatatccagtcccgctataacctgggcatcagctgcagggctcactgggaggctataacctggggctcactggg

SEQ ID NO: 6867195 - DNA, 62 bp, Homo sapiens
aggcagatcacttgaggccaggagttcaagaccagcctggccaacatagtgaaaccctgtct

SEQ ID NO: 6867196 - DNA, 79 bp, Homo sapiens
gagggcgcgtgccaggtgcctgcgggccgcggcgcaccgagagccttcacgaagctgggcagcctggccgctgccactc

SEQ ID NO: 6867197 - DNA, 70 bp, Homo sapiens
ctcttctggccgcctcctcacagcagcctgggagcattccctccacagcagacagggaggcggctgagag

SEQ ID NO: 6867198 - DNA, 115 bp, Homo sapiens
cctttctgttggtctctttggttttatctgcttcattagttgacatgatcatgtactcatttaacagatgtttatggagcatgtacaatggaccaggggcatcaaatgcaaaagg

SEQ ID NO: 6867199 - DNA, 77 bp, Homo sapiens
ggaaatcagaggcaacaactacttcctgacaaattcagttctctctctttcactgagtagatgttcttttgattact

SEQ ID NO: 6867200 - DNA, 64 bp, Homo sapiens
tagggaaaagtgacagtttacaattcttaatgggagccctaagaaacatgatacttttcctcta

SEQ ID NO: 6867201 - DNA, 61 bp, Homo sapiens
tccatcagattccctcctgagagctgatctcaacagggcataaggagagaggatctgagga

SEQ ID NO: 6867202 - DNA, 58 bp, Homo sapiens
gcaaggcagggagcagaaaacagagccacttgaaggctttctgtctgcgtctgtgtgc

SEQ ID NO: 6867203 - DNA, 72 bp, Homo sapiens
aaggccaaaaaagatctggtagctcttggtggacctcacagaacgtgagtcagccagagctgccatggcttt

SEQ ID NO: 6867204 - DNA, 72 bp, Homo sapiens
tgagctctcattaatattattccaaagttgattgaaaaaagtttcctgagaagagtactgttaagaggctca

SEQ ID NO: 6867205 - DNA, 57 bp, Homo sapiens
tgcacttttatatcactctggctatagcatatatgatggctggcggtgagaaatgca

SEQ ID NO: 6867206 - DNA, 64 bp, Homo sapiens
caggaagcacagtgaggagaccgcgcggcagagtcggccccatctgtgttctcctggcttcgtg

SEQ ID NO: 6867207 - DNA, 78 bp, Homo sapiens
agggacctgactgattcacatgaccatgatggaacttgaggaaaactattttgctggtctgaattactttcagcccct

SEQ ID NO: 6867208 - DNA, 125 bp, Homo sapiens
attaatggtgcgaaattaatttgaagttacagcaattttgtgcacaagtgcttttaattctaagctcaaatttgaagattgttgtgttgcctctgacctcagtttttaatctgtgcaccattaat

SEQ ID NO: 6867209 - DNA, 75 bp, Homo sapiens
gaacacctttttggtctgtagagtgactcttgtttaatgagactggacttgtggcttcagaaccaggagatgttc

SEQ ID NO: 6867210 - DNA, 130 bp, Homo sapiens
agtctcctggagactgaaggaagcatcaagatcaaaccagagaggcaaagttactggtatggagactctcacaggtaaccagcagagctcaaacttcctgcctctctttatggtgttgtctccattatct

SEQ ID NO: 6867211 - DNA, 60 bp, Homo sapiens
tcaagagtttccatgctctgtgctaattccctgaattgttatgcgggctggagcttttga

SEQ ID NO: 6867212 - DNA, 58 bp, Homo sapiens
gttatattccttggctaaggacaatttcactcttgttcataactcaaggtgatataat

SEQ ID NO: 6867213 - DNA, 56 bp, Homo sapiens
atgagcaattttagcatctccaagccagcactaaaggaaatactgaagttgttcat

SEQ ID NO: 6867214 - DNA, 72 bp, Homo sapiens
gtctttgtaactgtctattgagacagacaatttacatatgttaagtctccgtagatagtaaatgcaaacgac

SEQ ID NO: 6867215 - DNA, 78 bp, Homo sapiens
gtcccaggggacaagaagggaaagagtgtgtgttccccaggctggggtccagctctcacaccctcctcccactggggc

SEQ ID NO: 6867216 - DNA, 62 bp, Homo sapiens
gccactgagctctgatgagatttggggtttatttttctcagatgtcatttgaagttcatggt

SEQ ID NO: 6867217 - DNA, 77 bp, Homo sapiens
cccccaccttcatcactatgggcattatatttagggagtagttcttgggctggattttctggttgtggaagtggggg

SEQ ID NO: 6867218 - DNA, 58 bp, Homo sapiens
tcccatgtgttcctctagtctacgtacaacacataatatgtagataacgcagtaggga

SEQ ID NO: 6867219 - DNA, 59 bp, Homo sapiens
ttggggtggaagtgaggatcatcaggagagttactgtaagggacctgcactcatcccag

SEQ ID NO: 6867220 - DNA, 85 bp, Homo sapiens
tgggaagggctgtgcgacagtccctgggtagctcagtggctcaccacagacacagagctaccagggccgtactggtctcatccca

SEQ ID NO: 6867221 - DNA, 72 bp, Homo sapiens
gctgtcagtcacattgttacagatttctaagtcaattgtattccgatcagaaaatacagtctgcctgacagt

SEQ ID NO: 6867222 - DNA, 65 bp, Homo sapiens
cagaacagtcgcctgcatggatctgcttaccttaccgtccaaggtgtgtatgcaggtggcttctg

SEQ ID NO: 6867223 - DNA, 79 bp, Homo sapiens
tcagaagtgtgcagtaggacatttcatttgttcctgttttgtctctttgtgattgatagtgttttacttagacttctgg

SEQ ID NO: 6867224 - DNA, 67 bp, Homo sapiens
cagcagtactcccagaacaaaccctgcatgactcaaggttgttttctgggcagtgggcattctgttg

SEQ ID NO: 6867225 - DNA, 78 bp, Homo sapiens
aactcagaataaagatcctgcttttgcttctgtgatcataaagcaagcacaaggcaatggcaggatttcaacctggtt

SEQ ID NO: 6867226 - DNA, 78 bp, Homo sapiens
agatgggcagttaggaggccaggatgctgaccctagatttgctctaacatgctctgtggtcttggtgaccttccatct

SEQ ID NO: 6867227 - DNA, 60 bp, Homo sapiens
gttgtacatgcgtctgcaaggaaggccctgggccaggcagctgtcagaccagtgtgcaac

SEQ ID NO: 6867228 - DNA, 71 bp, Homo sapiens
ctgtctctgtctctgtttatccgagcagaacctggaaggggctggcaaggactaggcaacagatgggacag

SEQ ID NO: 6867229 - DNA, 86 bp, Homo sapiens
gccacagagtgtgcagaagacacaagacattgcctacaatccaaaggcatgtttatgccatttctgccatctgtttttggaccggc

SEQ ID NO: 6867230 - DNA, 92 bp, Homo sapiens
ggagcatctacaagcagaaggtgaggcgtccccaccatgggtctgctctgcagccctgcggatgtctcaccagcctgtatggggtgtgctcc

SEQ ID NO: 6867231 - DNA, 130 bp, Homo sapiens
ttggcttgtgttttgtgtgcttgttttctgcacagggatgcctcattttaagtgatgagttaaaccacacatcgcttgtgcttggggcccgactctcaggtgcaaccataagaatcttcaaacacaacag

SEQ ID NO: 6867232 - DNA, 80 bp, Homo sapiens
cctgcaccacaaggcttcagagcttgggagctgtgagtccttccattgctctgaaccagtttgctcttgtaggaagcagg

SEQ ID NO: 6867233 - DNA, 61 bp, Homo sapiens
ggggctggcatatgcagttgtacaccatggtgttttacaaagcacgagtgccatggacccc

SEQ ID NO: 6867234 - DNA, 58 bp, Homo sapiens
tagtggaactgtgtcatacaaatgcagcctgttgtattgaatgtacttgttctcacta

SEQ ID NO: 6867235 - DNA, 83 bp, Homo sapiens
gtgaagaaatccagtggtgaggtggggcttcagggacgtatcgtccagttgctctggctccatttccctatgtttgtctttac

SEQ ID NO: 6867236 - DNA, 55 bp, Homo sapiens
tgtatttgggtcacaagatgggaagaaaaattatcccttcttgggtcaaagtata

SEQ ID NO: 6867237 - DNA, 76 bp, Homo sapiens
cccctctctgaatccttgcccaggtgcattgcattgagccagcactagcacccagatagcaaggattagagagggg

SEQ ID NO: 6867238 - DNA, 56 bp, Homo sapiens
agccctgtgtgttctctgctcttcttctgccatgaactgcaaagacaggctgggct

SEQ ID NO: 6867239 - DNA, 78 bp, Homo sapiens
agcacagtctgcagggtgaacatgtgacatccatgcattaactatgattttcaaatgctcattgatgctactgtagtt

SEQ ID NO: 6867240 - DNA, 84 bp, Homo sapiens
tgaacagtgtttgttgtcatgattttactttgttcttgaccacattggtcccagagaaagtcaaggtcttcagccacggattca

SEQ ID NO: 6867241 - DNA, 62 bp, Homo sapiens
gctgaaatgtttaatttgggagtaaacatcaactttaaagcaaccaggtaaaatattttagt

SEQ ID NO: 6867242 - DNA, 83 bp, Homo sapiens
ctgtcttttaaagggagagtgcaaccgaaacaagcagggcattattgatactgatctttaaaagtgcaaatccagcttggcag

SEQ ID NO: 6867243 - DNA, 57 bp, Homo sapiens
aggggcgagcctgggttttgaagttcaaactagagtttaaatcacaactctgcccct

SEQ ID NO: 6867244 - DNA, 57 bp, Homo sapiens
agcaatggccagccactcctgatggcagcccaagcccagccccagtggctgccagct

SEQ ID NO: 6867245 - DNA, 91 bp, Homo sapiens
ggcccttgagcatttagtggcagtaatcaatgcagtgttccccctaatgatgagagacatctgcccttgattgccctaggttacaatggct

SEQ ID NO: 6867246 - DNA, 62 bp, Homo sapiens
attcagaagctattcttagttctaaggaatataatgaacttgagctttgagtcctactgaat

SEQ ID NO: 6867247 - DNA, 124 bp, Homo sapiens
ggtttcatggaaaatagagaattgcgtgttagaagtgccaggtaggcatacagagctgagaatgttcttcttcatctatctggccccttttatataagctcttaatatggtgaccatgagaacc

SEQ ID NO: 6867248 - DNA, 66 bp, Homo sapiens
cagggccgggggaggcaagagacatgccaagaacatatttgcatgacctagcctccttcagttttg

SEQ ID NO: 6867249 - DNA, 70 bp, Homo sapiens
cccagcctcagctttacttccacagtgcctagctcccaggaattctaaaagaagtaagattgaggatggg

SEQ ID NO: 6867250 - DNA, 68 bp, Homo sapiens
ggattgaagagaagctaaatagagaagataattcttcaatttagttttgcttttcaaaattaagttcc

SEQ ID NO: 6867251 - DNA, 57 bp, Homo sapiens
gtgcacacatacatgaacgctgcacacaggtgtgcacgctcacacacgtctgtgcac

SEQ ID NO: 6867252 - DNA, 117 bp, Homo sapiens
ggttactgctgaaggtgtcagggtgagggcggcctgggtgggctgcagcttcctcttgctcacagcctggacagttgcctggactaaggaagctgacatcttcaccatcccaatgcc

SEQ ID NO: 6867253 - DNA, 76 bp, Homo sapiens
tctttgttctgatggtaactttaattaagagctttgcaagtccctctgtgaagagttgctccattagaacttaaga

SEQ ID NO: 6867254 - DNA, 55 bp, Homo sapiens
gacagacacctggggggttgctacgtgagtaagcactttgagccctagtgtcttc

SEQ ID NO: 6867255 - DNA, 81 bp, Homo sapiens
gggggctatgggaagtgttagaagattttagggacagattttgaagagtctgaatctatactgcccagtgcagtagcccct

SEQ ID NO: 6867256 - DNA, 55 bp, Homo sapiens
cagggtgggcttccagtcacccgcacatatgcggggcactggccgcccatccctg

SEQ ID NO: 6867257 - DNA, 95 bp, Homo sapiens
aaccatttgaaattaaactaactagttagaaatgcttttcataattcttttgtgcagggtcctaattgttaaggagtagaattttaagtttggtt

SEQ ID NO: 6867258 - DNA, 62 bp, Homo sapiens
gtctgctttagtgtggtgttagagaaggccttgcttccctagtgtcatgctaaagtacaggc

SEQ ID NO: 6867259 - DNA, 63 bp, Homo sapiens
tgctgatgcagatttctactctgatgccgtggcagactcagagcattagaggtttgtatggca

SEQ ID NO: 6867260 - DNA, 55 bp, Homo sapiens
gtaatctcatggagattaggcaaatctgtatggctctaatttccatatgaattgc

SEQ ID NO: 6867261 - DNA, 64 bp, Homo sapiens
gcagccagagcatccatttttgtcacatatcatatggagagagaaggcttgctgtcaggcttgt

SEQ ID NO: 6867262 - DNA, 103 bp, Homo sapiens
gccctttctaccccaaacgtagtgcttcctgggacacctaactctatgcacagccctgagctggatgctggtttcccaggaagctcacagtttggggggaggc

SEQ ID NO: 6867263 - DNA, 80 bp, Homo sapiens
cttgtgcttctcctgacatgtctggaggaatgcagctcccgctgagtcttccccagagcatgagcaggactgagcagagg

SEQ ID NO: 6867264 - DNA, 61 bp, Homo sapiens
ctgaagcctagcctggcacttctgagttgcacgtcttcttagatttcaggctggcttgcgg

SEQ ID NO: 6867265 - DNA, 58 bp, Homo sapiens
taatgtacctccagatgttgtaccctgagaaggagacaacatcattcaggtagtatta

SEQ ID NO: 6867266 - DNA, 90 bp, Homo sapiens
tgttttccactttcaactgtacgcttcataagacattcattatttcccaagatgttcaaaaaagatacagtgaaagggcattgggaaata

SEQ ID NO: 6867267 - DNA, 129 bp, Homo sapiens
cccaagatcactttaggctctaattgtaggccagatattgtgctacccacattataacaaggatgacctttcctccattgcccactgggtagcatagtatcgggtgtacaattagagcctggagtgggg

SEQ ID NO: 6867268 - DNA, 83 bp, Homo sapiens
tcttggatgttgtgtatttgttttaatgtttagaacttgttcttttatttcagaacaatatgaacagaacacaatgttgaaga

SEQ ID NO: 6867269 - DNA, 80 bp, Homo sapiens
tcagcaggctttctccctcattgattacactcattcatctcagatggaggggtggtcgcgaagagcaaggaagggactga

SEQ ID NO: 6867270 - DNA, 71 bp, Homo sapiens
gaataactcaagtctattgataagtgcaggtttttactcacggcctgccaagctttcagatatgaggattc

SEQ ID NO: 6867271 - DNA, 112 bp, Homo sapiens
ctgaccgtgtgatggaggctggccttggcacttgggcagtgagcatttgcagtgcaatctcggtttgcatgttgtcattggcctgtgttaaggagcctttgcagatggacag

SEQ ID NO: 6867272 - DNA, 71 bp, Homo sapiens
tcattgaatatggggccatacaggatatttaactttcttttgtccatttgtaacaggctttaattcactga

SEQ ID NO: 6867273 - DNA, 100 bp, Homo sapiens
ttaaagattgacacagtagaaagttcactggtatattttgcattttaaatagcctgctaaaatgtaccgtgtgaactgcacaaatgctcttagtctttag

SEQ ID NO: 6867274 - DNA, 60 bp, Homo sapiens
cactgcaggggaccaaagtctgactccaaaaggaggcagaatgccaggtcttctgcagtg

SEQ ID NO: 6867275 - DNA, 62 bp, Homo sapiens
agaggccccaggtgagcatgcctgctgtagaattaagctgtatttctccaagggggccctct

SEQ ID NO: 6867276 - DNA, 97 bp, Homo sapiens
tctccttgacttattctatgaagcatatattttatatgttgtcataactatgagggcattttctaaaaatatgtgcaatgggatgagtaatgggaga

SEQ ID NO: 6867277 - DNA, 58 bp, Homo sapiens
gggttctttgtgctgaagaagccctaaggtggtccagggagatgccacaaagatgccc

SEQ ID NO: 6867278 - DNA, 106 bp, Homo sapiens
aaatctgttttccttcccgttagtctagttctgcccattggcattacctggatcaagtcgaatgaccaatgggcagagctagactgatgggaaggaaaacagattt

SEQ ID NO: 6867279 - DNA, 69 bp, Homo sapiens
gagctctaggaatctatatgccttatttgctactataacccagatactgtgtgcagagtcctaatgctc

SEQ ID NO: 6867280 - DNA, 109 bp, Homo sapiens
gctaaaagttaggtgattctattactaaaaaagaaggagagaacggaaatggagatacaaattagcagtctccactactttgtttttggtgctctcactacactttagc

SEQ ID NO: 6867281 - DNA, 66 bp, Homo sapiens
ccccagtgcgtagcatagttctgggtacgtattaggtgttcaggattataaactgtgcactgaagg

SEQ ID NO: 6867282 - DNA, 68 bp, Homo sapiens
tttcagatcctcattgttcccaaacatcaaagtatagaaaatgttttgagcatttgtggatactgaaa

SEQ ID NO: 6867283 - DNA, 57 bp, Homo sapiens
atctagaaagtgttgaagatcatgtgagggaaacgtgaactgtcacacacttctgat

SEQ ID NO: 6867284 - DNA, 55 bp, Homo sapiens
ttctcattcagtcttccttaatttcactgtgaatgataaaggaagaggaagggaa

SEQ ID NO: 6867285 - DNA, 62 bp, Homo sapiens
gttttggagaaaagagactgatttccttcagtgctggaaatcattgttgtcgttcctagaac

SEQ ID NO: 6867286 - DNA, 86 bp, Homo sapiens
gactccgctgcgctgaggcctggtagccgagccccaggggccacctctggcagcccgggaaaccaagcctgagcccagccatggtc

SEQ ID NO: 6867287 - DNA, 67 bp, Homo sapiens
tggagaacagggctgagtaacaggaataacactcaggtggttgtctgaactccagccctgctctcca

SEQ ID NO: 6867288 - DNA, 76 bp, Homo sapiens
gcatgaggacggggagcgtcggcctctcccactctgcggtggagtcgggggcgccgccgctcatctcacctcctgc

SEQ ID NO: 6867289 - DNA, 77 bp, Homo sapiens
atcttttgcaagaaaaacagctccactgaaaacttctttttaagtaagccagaattcattgagctgttcttgaggat

SEQ ID NO: 6867290 - DNA, 66 bp, Homo sapiens
agtgtttctggaatcagtgtttggccccaaagtctctggtttgtgcagagattcatagaaaagact

SEQ ID NO: 6867291 - DNA, 68 bp, Homo sapiens
ctgctgaggtccttgctcagactcacccctatccataagtctgagacaaagttgcctttacaaagcag

SEQ ID NO: 6867292 - DNA, 76 bp, Homo sapiens
gcctccagcatttttcaatagaattactgccttgtttaggaagaatctaattcttattatttaaagtgctgttggc

SEQ ID NO: 6867293 - DNA, 62 bp, Homo sapiens
aatgacccctaaaatttactgtcctcagcagcacaagcatgacaggaaatatgggggttgtt

SEQ ID NO: 6867294 - DNA, 90 bp, Homo sapiens
agagccttaaatagccctgaaagtacactgggacggtttgcgatggaattaaaattggaagtgaatatttttaggtgctcttgaagcttt

SEQ ID NO: 6867295 - DNA, 67 bp, Homo sapiens
agctgtgactgagtagcgctaaaaactatgctgaccaccagcatgctacagcatctctcatcaggct

SEQ ID NO: 6867296 - DNA, 90 bp, Homo sapiens
atccccctgtgtggacctatatttcacagaaagaagtggaatttcctcttcctgtgaaatataggtccatacaggagcatcatgggggat

SEQ ID NO: 6867297 - DNA, 77 bp, Homo sapiens
ggagggtgaagggggtgtgcagggcagaggggagactaccagctcctctctcttttttgaacccgctccacctctcc

SEQ ID NO: 6867298 - DNA, 71 bp, Homo sapiens
gttttgagcagagcagtaacaggagccaactttcattttaaaaggaatgctttgattgctgtgttcaatat

SEQ ID NO: 6867299 - DNA, 58 bp, Homo sapiens
aggctcagagagctgtgtccatataacactaagaaatggaatccaagttccctggcct

SEQ ID NO: 6867300 - DNA, 55 bp, Homo sapiens
gagcatgacaggagccgaattgcacggccagcaagggcgggctcatcacatgctc

SEQ ID NO: 6867301 - DNA, 86 bp, Homo sapiens
agggaatctgaagatgtaatttcaacggttgacaagttgcagcttctgtacttactactcctttgcaatttcatttttcattctct

SEQ ID NO: 6867302 - DNA, 67 bp, Homo sapiens
agcccacagatgtctcctttctgcttcccccagaaggccagacaggaccacatctcctccgtgggct

SEQ ID NO: 6867303 - DNA, 73 bp, Homo sapiens
gtacactcttgtctcttaccattcattcacagagtaatacccagtctgggaatggtaagagacaaaagtatac

SEQ ID NO: 6867304 - DNA, 62 bp, Homo sapiens
gtgttaatatatccccttggcagacatgaagaacaccagctccaagggaatgtgggcaatgc

SEQ ID NO: 6867305 - DNA, 55 bp, Homo sapiens
atgtggtaagggacttgtgaatgctgaagaagcatttattgaacactgactatgt

SEQ ID NO: 6867306 - DNA, 59 bp, Homo sapiens
gtctaaatgctgtgttttaacatagataacttatctgttgtattacacagatttcagat

SEQ ID NO: 6867307 - DNA, 72 bp, Homo sapiens
gggtaggggggcatcgcatctggcactgccagcacagactggaggtgcctggcgatgtctctgatcttatct

SEQ ID NO: 6867308 - DNA, 67 bp, Homo sapiens
gtgctgtcactggtaaatgcggtataccccgtcaatggagacaggtatgtattttaacctacagcac

SEQ ID NO: 6867309 - DNA, 62 bp, Homo sapiens
gtatcaagcccttttcaagatacaacaatactgaagggttctcgaagagggttaatatatac

SEQ ID NO: 6867310 - DNA, 58 bp, Homo sapiens
tagtctgattctagaatctggggtcttaaaaaaatgacgcctgggtccactcagacta

SEQ ID NO: 6867311 - DNA, 79 bp, Homo sapiens
gtttcctcattcctggtggcatcttgagacggtttggtaacatccaagctgtgcagatgttaccacggagcatggaggc

SEQ ID NO: 6867312 - DNA, 68 bp, Homo sapiens
tccccctggccagtttgctcaggcagtccatcccgagacagcaagagccagctgggcaagccggggga

SEQ ID NO: 6867313 - DNA, 66 bp, Homo sapiens
gcagcgatcttatgtctgaactttacaatggtatctatgttagaaagttctagaatgacttcctgt

SEQ ID NO: 6867314 - DNA, 62 bp, Homo sapiens
tccccttgggtgtttaatagatatatcagatctaatatgtctaataatgcatctcaaatgga

SEQ ID NO: 6867315 - DNA, 83 bp, Homo sapiens
aagaagttcttagcgggaatgttcagaagcttggttggtttgattgacaatagctctgtatgtctccttctcggtagctcctt

SEQ ID NO: 6867316 - DNA, 62 bp, Homo sapiens
ctgaaggcgcatgttggctagacaacaaagacagtggtgggagcagccaacatggcctttgg

SEQ ID NO: 6867317 - DNA, 96 bp, Homo sapiens
gtcctttctttccaagcaaagagataaccttttgggacaggggcgtaacacaccagctgtactgtgaggattaaatctttgcgctaggagagtgat

SEQ ID NO: 6867318 - DNA, 75 bp, Homo sapiens
ttgtcaggtacttttggagtattttcagtcttgaccaagtctgaagttagttatgcctaaaagattcctggacaa

SEQ ID NO: 6867319 - DNA, 81 bp, Homo sapiens
acaggtcacagttcagacatggtggagccaggattggagctgagaatccctgctctgtgctactttgaactctgtgcctgt

SEQ ID NO: 6867320 - DNA, 90 bp, Homo sapiens
catgaagcaacctcagagccttagttctcctagaatgcagagagaagcattctggaagccatgggaacaggagctcgaggctgcatcctg

SEQ ID NO: 6867321 - DNA, 58 bp, Homo sapiens
tctgttgctggtggccctggttatgctaacaagtagatagtgtagctgcagcagcaga

SEQ ID NO: 6867322 - DNA, 129 bp, Homo sapiens
atctctgaaggaaggtggatcttcttgagtccaggcttgggttctctgagttattctcctgtctcttggtttcatgggtcagaggacctcgtggccaaaggtctgacaaggtcattttctttttctttt

SEQ ID NO: 6867323 - DNA, 56 bp, Homo sapiens
ctagttctagatccctgaggaatcgcccacactgacttccacagtggttgaactag

SEQ ID NO: 6867324 - DNA, 64 bp, Homo sapiens
ctacttcttttgagttagagaatgactgagcctttaagtcagtttttacggtcacagggagaag

SEQ ID NO: 6867325 - DNA, 55 bp, Homo sapiens
aatccactttcagttaatatttaataaattatagttgattgattgggagaggatt

SEQ ID NO: 6867326 - DNA, 67 bp, Homo sapiens
gcagatggctgggctcgtccgcagagtttctgcttcagtaggactgcggtggggcccagtcatttgt

SEQ ID NO: 6867327 - DNA, 61 bp, Homo sapiens
tcccagtgcaggctcgcttgtgaggcctggggaaaggcacggaggaagggccgtacttgga

SEQ ID NO: 6867328 - DNA, 64 bp, Homo sapiens
ttcaaaatgtacagctgtctttcctcccatgaaagcccagggatggagttggtttacttttgaa

SEQ ID NO: 6867329 - DNA, 55 bp, Homo sapiens
ccctccagctcaaagcaaccggcaaagctaggcttttgttgagagactgagaggg

SEQ ID NO: 6867330 - DNA, 81 bp, Homo sapiens
ttgcctggacattagcacatatttagatcttgatgttctaactaatgaatgacagctaaggaatgtgtagcttcctggtaa

SEQ ID NO: 6867331 - DNA, 83 bp, Homo sapiens
attaggctggaccataggaaattgctattttttgtacgtcagagatggttaatgattggcagttggctgtggttcaacctaat

SEQ ID NO: 6867332 - DNA, 65 bp, Homo sapiens
gatagctgctactgagattgtccttagtacctatcccactggactctgacttagttatagctatt

SEQ ID NO: 6867333 - DNA, 58 bp, Homo sapiens
tggtttcctgatggacacttggttgggtagatactggtgtcccaaagattagaaatca

SEQ ID NO: 6867334 - DNA, 65 bp, Homo sapiens
cctgtcattttctcctgtcagccaagcacacacaggatgtgcagtcagcagtgggaggtaacggg

SEQ ID NO: 6867335 - DNA, 61 bp, Homo sapiens
gggcctcctgatgtatttttgtgagccgcccaccatcgcggtcaaacttgcaccagtgccc

SEQ ID NO: 6867336 - DNA, 73 bp, Homo sapiens
gattgctcaaataaacctattctgaaatgtatttgtcatgcgttgacatttctgctagaataggtgaccaatt

SEQ ID NO: 6867337 - DNA, 77 bp, Homo sapiens
cacatactgatcttaagtaacattattttatagaactgtttaaatgggtttaaatggtgttctttagatgaaatgtg

SEQ ID NO: 6867338 - DNA, 73 bp, Homo sapiens
cgcaggtggcagagccttgcggctttggagagaggtggagccttggtgaggttgggaggactgcctaactgcg

SEQ ID NO: 6867339 - DNA, 55 bp, Homo sapiens
tttagggctggaggtcttcaatggtatacaccatgaggtaaagatcagctttaaa

SEQ ID NO: 6867340 - DNA, 66 bp, Homo sapiens
ggctcatttcttctttccacaatgccaaatattgtttgtaaattgtataaggaagagaagaactcc

SEQ ID NO: 6867341 - DNA, 63 bp, Homo sapiens
gggccgtgagcagtggccagggtcctagtgcttatctgggatccacagtccagctttgagccc

SEQ ID NO: 6867342 - DNA, 55 bp, Homo sapiens
tagtagtggtggagccagcaacttgtgaggcagaatgtgctggcaactactattg

SEQ ID NO: 6867343 - DNA, 74 bp, Homo sapiens
ctcaagctggtgcagtgattgcagttcacttctcttccaaacaactggtgttctgctctgtgcacttgttcagg

SEQ ID NO: 6867344 - DNA, 61 bp, Homo sapiens
agcagaactgatgagacttgagggaagggtccagggcctgtattcagtcagagtcactgct

SEQ ID NO: 6867345 - DNA, 77 bp, Homo sapiens
caggagagaaaggctggtggtgtcatttggccatggagtggcaggaacacagatggtgccggcgtttcagactcctg

SEQ ID NO: 6867346 - DNA, 82 bp, Homo sapiens
aaggggattgaggccagtggttctctgtgtcccagaggtgtccctgggagatgtagtgtcactggactagagattcatcctt

SEQ ID NO: 6867347 - DNA, 79 bp, Homo sapiens
ctccacctgcgcaaccctcccagatgggcttgaggttggggtgtggccgggacccgggcggggaggggtaggggtggag

SEQ ID NO: 6867348 - DNA, 68 bp, Homo sapiens
tgaatacttactcactcagatatattttgcaaaaaagcatgaatgagaaacaggtgagataggattca

SEQ ID NO: 6867349 - DNA, 60 bp, Homo sapiens
atgagcagcattgctcctcttagaactcctgacttttgatttgaggatgtgattgttcgt

SEQ ID NO: 6867350 - DNA, 57 bp, Homo sapiens
aggctgtgaggcggaaaggactctccctcgctcagggcagggtcagcctttcagtct

SEQ ID NO: 6867351 - DNA, 67 bp, Homo sapiens
cccataggtctcttccagctttatcactcactaagggaaaggacgagggagcacgaaggaccatggg

SEQ ID NO: 6867352 - DNA, 78 bp, Homo sapiens
ggctgtttgtcctcctagttcctgccagttgttcctaacgccgtagcctggagggctctagagaggccatccaaatcc

SEQ ID NO: 6867353 - DNA, 61 bp, Homo sapiens
tatttgaagattcttctgatgtgatcacttttctagatacagtctcaggactcttcagatg

SEQ ID NO: 6867354 - DNA, 61 bp, Homo sapiens
gctactggctgaaaaagtccttttccttctcagctccacagctactttttcaggacagagt

SEQ ID NO: 6867355 - DNA, 66 bp, Homo sapiens
ttagctgttggcttacatctgttggactatttcaaatatctcccagcattgcctgcctattgctaa

SEQ ID NO: 6867356 - DNA, 79 bp, Homo sapiens
attgtgagcaaatccctgagttctaattcctatctctgcagaggagataggagccaggacttaacaactctatcataat

SEQ ID NO: 6867357 - DNA, 83 bp, Homo sapiens
ggcagtctggccccagcatcagtgctcttatgactcaacacaccacctgtctgggactgctcttgctggggtccaagcctgct

SEQ ID NO: 6867358 - DNA, 79 bp, Homo sapiens
gtcattccaaccaaatatctgctcaagcaatcagttgtgatagctgtaaatgtcaaccaggtattttggtctgaataac

SEQ ID NO: 6867359 - DNA, 55 bp, Homo sapiens
ccctgtgggtcttcggaggcccctgcaggaccaaggggcttggaggactcgaggg

SEQ ID NO: 6867360 - DNA, 58 bp, Homo sapiens
tggttacatcatcccattctgacatgtgaagacccagataggggaaaggacttaacca

SEQ ID NO: 6867361 - DNA, 70 bp, Homo sapiens
cctaacagtttatgagatatgctatgtttcctcttctgatatatggtatacaattatggactgttctagg

SEQ ID NO: 6867362 - DNA, 56 bp, Homo sapiens
gggcatggggtggtgggtgccccactgatatcctaggcccttaccacctcaggccc

SEQ ID NO: 6867363 - DNA, 86 bp, Homo sapiens
tctgagccttgaccacagctccctctctcacacagcttccttctttggtgagaaccacctggaggtgactgtggccatggctctga

SEQ ID NO: 6867364 - DNA, 67 bp, Homo sapiens
gtctgccttttgatctataactgtgtatgagttttgtcaaaacatagggagtcagggggaatcaggc

SEQ ID NO: 6867365 - DNA, 78 bp, Homo sapiens
acccagaatggtctttgagagaagttgattgaatgaaaagtgtacatgaatcagttctttaaaggatgatgtctgggt

SEQ ID NO: 6867366 - DNA, 70 bp, Homo sapiens
aaattgctgtgactgtgcagctagagcctctcaatattttcaatgctctagaactccagttaggcaattt

SEQ ID NO: 6867367 - DNA, 67 bp, Homo sapiens
tagtaagtcatggagctgggattgagcccagggcaatcagttccagagtccacagtcctgactacta

SEQ ID NO: 6867368 - DNA, 79 bp, Homo sapiens
gacaggcttagggagggtgctctgcccaggttccaatcctggttccactgcatatgagccttgtatctctgagcaagtt

SEQ ID NO: 6867369 - DNA, 79 bp, Homo sapiens
gtgtgcacatgtgtgtgcgagcgtgtgtgtgtgtggacttgctcacgcgggcacatatgctgtaagcacatgtgttcat

SEQ ID NO: 6867370 - DNA, 56 bp, Homo sapiens
ttttggcaagctgggagatattcttgataacccataacttccccaagctgccaagg

SEQ ID NO: 6867371 - DNA, 57 bp, Homo sapiens
cattctcacatctgccctgtgctgggacagcgagtcctcaccacacactgtggaatg

SEQ ID NO: 6867372 - DNA, 70 bp, Homo sapiens
gcccatctctagtccagtctcaaaatgctattttccctcttgagtgcagattgagtgaggctagctgggc

SEQ ID NO: 6867373 - DNA, 67 bp, Homo sapiens
ggtttgaacagctttggagaagtctggttctagttggtttcagttctctccagatgccgtttgaatc

SEQ ID NO: 6867374 - DNA, 129 bp, Homo sapiens
atttatgtttatgttaaaatttagaatttgcttcatgtagttttaaatactgtagataatagagttccgatgtgtcaaactttgattttagtgtttttagcgaaatgttttctttgacttgcataatat

SEQ ID NO: 6867375 - DNA, 82 bp, Homo sapiens
gggagatttcctgaagtcaaagatctaaacccaaaatctaaaaacatatgagtaaagagttttgcacttagggggattactc

SEQ ID NO: 6867376 - DNA, 79 bp, Homo sapiens
agaatccaagcctcatctgtgcccatgctggcattcagatatatctggacatggctatggtattgatgggtttgtttct

SEQ ID NO: 6867377 - DNA, 70 bp, Homo sapiens
ctcatgagtctgtcagagtcatcgtgggagggagaacctttgtaaacctgaagacagttttactcatgag

SEQ ID NO: 6867378 - DNA, 58 bp, Homo sapiens
gggctacagacatgctctaagctttactattgaaagttagtggagcttgttgtggctc

SEQ ID NO: 6867379 - DNA, 63 bp, Homo sapiens
tgagcagtgatgcgttttgtttcaaaagagaatcaccaacagaaagggattgctcattgctca

SEQ ID NO: 6867380 - DNA, 67 bp, Homo sapiens
gaatagatactcagaaatgctttcaccatcaagctggggtatgaaggctccatctgagtaggagttc

SEQ ID NO: 6867381 - DNA, 77 bp, Homo sapiens
ctttcaacaactccatgatgtacgattttttatgattcctgtttcactgagagtcaagatagcatggtggttgacag

SEQ ID NO: 6867382 - DNA, 78 bp, Homo sapiens
tgacaaattgtcctgtaatcaagccctaaagaatggactcttacctcttctggagggcctgatcacacacctttgtca

SEQ ID NO: 6867383 - DNA, 64 bp, Homo sapiens
cttggagaccagtgacattgctcacccttcccactgagcagcctgcagatattggtctctctgg

SEQ ID NO: 6867384 - DNA, 63 bp, Homo sapiens
gccaacttaatccattttaattcattgtgaaacctgcagtgcaaatgagatggattcaagggt

SEQ ID NO: 6867385 - DNA, 64 bp, Homo sapiens
ttgaggtcagggctcttccagtggctctggtccccaggatggtccaacacggggccctgctcag

SEQ ID NO: 6867386 - DNA, 81 bp, Homo sapiens
aagactcacttctcttaggccctgatccgaatccagattatgatggattgggcatggggatcagggcatgcagaagctctt

SEQ ID NO: 6867387 - DNA, 59 bp, Homo sapiens
tcctcctattctgcttacttaataagatctttgtgatacgtttagtgatgaatagggga

SEQ ID NO: 6867388 - DNA, 89 bp, Homo sapiens
gcttgctgtctactgtacttattttatgtcagcacagtgtataattgattgcacatacatgaaatatgtagcacactggacttccaagc

SEQ ID NO: 6867389 - DNA, 74 bp, Homo sapiens
gttgcctgtatctaaggtatatgaggaatcattgcaaagaacggtcttcagaaactttagaacttacccgcagc

SEQ ID NO: 6867390 - DNA, 74 bp, Homo sapiens
tgcagttcattgacttgaagaaaacaatgtcttaggaagattagcctggttttattgttcaaggcaatgaagca

SEQ ID NO: 6867391 - DNA, 92 bp, Homo sapiens
tcagcccacatgaaaagaagacagtgttcttcttcaaagctctgatggacgactttagagactgtttcaggaacactctgtctttttgctga

SEQ ID NO: 6867392 - DNA, 76 bp, Homo sapiens
ttagaatgagatatctgatgaaaatactctgattctcgacaagaatgtagagtatgtttcagatcgtcttttctgg

SEQ ID NO: 6867393 - DNA, 126 bp, Homo sapiens
ccagaaggcggtgaacacttggtcccaggaactctggagcacgccctggcccaggaaatacttcaccatcgtcccggctggagtgggctccagagttcctgggaccaggtgttcaccgccttctgg

SEQ ID NO: 6867394 - DNA, 105 bp, Homo sapiens
gcaactaaggcagtgcggtcacattgtttgagaatacagatgcaaaattacttgtgaatttacttgctcatttttccaaaggatgtaatctgtacacttagaagt

SEQ ID NO: 6867395 - DNA, 56 bp, Homo sapiens
ggacaattcagtgatttggggactgatctccatatcaagatgacctgatcctgtct

SEQ ID NO: 6867396 - DNA, 81 bp, Homo sapiens
gagagggagcagccaaggagtggccactgggtcacatggctccagcagggcccatgcccctccttctggcatttctctctc

SEQ ID NO: 6867397 - DNA, 85 bp, Homo sapiens
tatggaacatagtgagagggtgtgaacactggctgtgcaacctcagaaagggtctacctagtgttgacttctcttctttcacata

SEQ ID NO: 6867398 - DNA, 69 bp, Homo sapiens
ccaacaaattcagagaggttaaatatcttgtgaaaactcacagagatggcttttcagaggcagagttgg

SEQ ID NO: 6867399 - DNA, 119 bp, Homo sapiens
accatatatctatttgtttgtttcctgccttaggtgccaagagggcattaactctgtcttgttcactgctgaacacttaagtccctggcacttaaagttgttggcaatcgttaattggt

SEQ ID NO: 6867400 - DNA, 82 bp, Homo sapiens
gatttagtaggggcaccaggaagctgttatagcaaacacccaggtgatactgctacatacattctgttgcgcctgccaagtc

SEQ ID NO: 6867401 - DNA, 83 bp, Homo sapiens
tgagcctgttttgctgactcccacaggaagtggtgggccgagagcacagctacaggctttcctgtgcagcgtaaattggccca

SEQ ID NO: 6867402 - DNA, 78 bp, Homo sapiens
ctgagggattttttttgggaaaagtaaactttgccttacacttgggcatttgttgagttgccagctaacatctcttag

SEQ ID NO: 6867403 - DNA, 58 bp, Homo sapiens
tgccttaattttttataatctctgttgacctccaaaagagacctgtaaagttcaggca

SEQ ID NO: 6867404 - DNA, 69 bp, Homo sapiens
ccttcccacaaacgccacggccctgtccagtccccactgtgacatcgctgtgtctgttttttaggaagg

SEQ ID NO: 6867405 - DNA, 61 bp, Homo sapiens
ggaccatctctagccagagctttccacctctattactgatagctccaggctcctggggttc

SEQ ID NO: 6867406 - DNA, 111 bp, Homo sapiens
gtttttccaaagctctcagcccaattttgtttgtttgtttgtttttaatttctaacagctgttgaaacagacaagtaaatgtcttggatgctaagctctgctggataaaat

SEQ ID NO: 6867407 - DNA, 69 bp, Homo sapiens
tgatggttaaattggttatttatgttgtgtataaggtttgcaaggctacttaaccagcttgattcttca

SEQ ID NO: 6867408 - DNA, 61 bp, Homo sapiens
ggaggcagtgctgatggaagagacctgaagaaggaatctccatggaaccggggctgcttct

SEQ ID NO: 6867409 - DNA, 85 bp, Homo sapiens
gcttgctggtggagagccctggcagtctgggatggagcccctgtgagcccaagtccccaagcatgccaggcaagccaccataagc

SEQ ID NO: 6867410 - DNA, 92 bp, Homo sapiens
gggtagaagccgtttatttattcattcagcaagcatgtgcttagtgtaaggtgtgtctgaagttgagtagacatttagtggagggtaagccc

SEQ ID NO: 6867411 - DNA, 82 bp, Homo sapiens
gctagcggtggcgattaggagtccagatgtcttgggtatagccgtcgccccgggaaagtgggctctagacgcaggagttggc

SEQ ID NO: 6867412 - DNA, 80 bp, Homo sapiens
gaattaattggagaatcttgaagaagctaaatataatgtttacattgatgaagctaaatctaaggtttgtctagtaattc

SEQ ID NO: 6867413 - DNA, 66 bp, Homo sapiens
cctgttcaatgccctggcttcactcactattagcttcatgagagttggggcaggagcaagaatagg

SEQ ID NO: 6867414 - DNA, 56 bp, Homo sapiens
aagatgttattgtcttccttgctttgtagaagcaaaggaaagaaacaatggcactt

SEQ ID NO: 6867415 - DNA, 105 bp, Homo sapiens
tcactgtgcaaaagttcatgtctgtttatcaaggatttctggatgcctcctgctatctgtacatgtgccagaatctttgaagagagcattgtttttgtgcagtga

SEQ ID NO: 6867416 - DNA, 59 bp, Homo sapiens
gcttctcttgtccaagggcagggatgaaaaggaggaattcttgcttgatatagagaagt

SEQ ID NO: 6867417 - DNA, 107 bp, Homo sapiens
cggggcctgtgccagcctgtgggcaccgcagccactgccacctcggtgaacatccacaccggggcctgtgccagcctgtgggcaccacggctgggagcccacccccg

SEQ ID NO: 6867418 - DNA, 57 bp, Homo sapiens
gagaagcacaagataagggatcaggatttctgccaggttccaaggtctatgcttctt

SEQ ID NO: 6867419 - DNA, 80 bp, Homo sapiens
gaacctctacatccaggaaaggacagagtcttctttggcctgcaaggccccaattcttttctttaccagaatgagggttt

SEQ ID NO: 6867420 - DNA, 85 bp, Homo sapiens
tgctctccttcccttcccctcacggagacgcctctctgagctggggagtcttgtttgggatgtggatggaagggaaggctgggca

SEQ ID NO: 6867421 - DNA, 57 bp, Homo sapiens
ccaggtgaggagagtggcagcatggcacgcactccacctgctatttagaacgcctgg

SEQ ID NO: 6867422 - DNA, 69 bp, Homo sapiens
tagctgcctatgtgataagagagccagggaacagttaaacggttaaatatatttgtcctgtggcagctg

SEQ ID NO: 6867423 - DNA, 55 bp, Homo sapiens
gtggaagggtcacagcccctacctgaagacactggcctgggtatggcccttccat

SEQ ID NO: 6867424 - DNA, 59 bp, Homo sapiens
ggccaagcctcttccagctcctttctagtccttaatactgacagtaatgagaggctgcc

SEQ ID NO: 6867425 - DNA, 56 bp, Homo sapiens
agcctgagccctgtgactgctttgaggaggtcctctggctgtttgcagctcaagct

SEQ ID NO: 6867426 - DNA, 55 bp, Homo sapiens
ctgtccagtctttagcaagctggaaccttttggtttgctcctgagtactggctag

SEQ ID NO: 6867427 - DNA, 68 bp, Homo sapiens
tggaggacctgccctggggtctggagcagcaaaggcattgtgttcaaatcccaggagcatgaactcca

SEQ ID NO: 6867428 - DNA, 91 bp, Homo sapiens
ttttcttggctgttgttcatgcttgctgcctcattgttccaagatggctgacaaagaagcaagcatcacatcttcattcgggccagggaga

SEQ ID NO: 6867429 - DNA, 57 bp, Homo sapiens
ctcagcccagcccaggaccaggatggaagtcctggaaaccccctgggtggtgctgag

SEQ ID NO: 6867430 - DNA, 85 bp, Homo sapiens
gggtggtgtgtcttgggtttccatggtgtttcttgggtttctggagctggaatccagagggtagcaggattaggagtcactcccc

SEQ ID NO: 6867431 - DNA, 112 bp, Homo sapiens
agtcagaggagaggtgtggagtctataggacagagttccctgatggcccacaggactctgcagtccgaggcctccgggaagtggcctgttgaaccaggacaatcttgtgact

SEQ ID NO: 6867432 - DNA, 55 bp, Homo sapiens
ggccagagtttctgttgctggagggtggactgcacagcagtaggacctctgggcc

SEQ ID NO: 6867433 - DNA, 58 bp, Homo sapiens
caagccactcacaataactgtccttatcagtagggactgtttgtgtgagatgtgtttg

SEQ ID NO: 6867434 - DNA, 77 bp, Homo sapiens
gcttttagagatttgtctaatgagtgtgtacttttaaatatccaaaatgtacttctctttagcagaaaactaggggc

SEQ ID NO: 6867435 - DNA, 67 bp, Homo sapiens
tcactttaagcgggaggcagaggttgcagtgagccaatatcatgccactgcactccagcttgggtga

SEQ ID NO: 6867436 - DNA, 60 bp, Homo sapiens
gttaaatgcactattgaaagcttcacatttccctggaagatatttagtggtgcatttgac

SEQ ID NO: 6867437 - DNA, 62 bp, Homo sapiens
gctgccattatgggaacgagaagtctgggcagccagttcgaattccgttttataaggctggc

SEQ ID NO: 6867438 - DNA, 70 bp, Homo sapiens
tgtcacagaagctttgaaaacggattcctagacttaggaaccactgtcttctaaagatgattttgtgaca

SEQ ID NO: 6867439 - DNA, 101 bp, Homo sapiens
tttccagatagcatttagttgcctcaagattttttattgatacatctttccccatgattcaatgtttgtttttgatggtaagtgtattttatcttatgaag

SEQ ID NO: 6867440 - DNA, 89 bp, Homo sapiens
cactggatgctggcaggatttattggtgggaagttatggcaaacatcttgatggctttaaatctgtattcatagctagtatcttttgtg

SEQ ID NO: 6867441 - DNA, 65 bp, Homo sapiens
taagatctctgtttctgtggagtattgttggaggaggcagataacacaaagaaatgggcatttta

SEQ ID NO: 6867442 - DNA, 69 bp, Homo sapiens
gctttcactcatttgcagacgtcctctctgatgacagtgcagaggattcactgcagaagacatggaagt

SEQ ID NO: 6867443 - DNA, 63 bp, Homo sapiens
tgtggccagccacaggcatggtgttcggtcatccggaagaaaggtcctgtggctcagcccaca

SEQ ID NO: 6867444 - DNA, 84 bp, Homo sapiens
aacaaatagctttgcccagtattaaagcatcacactattaattagttctctgctaggtgtggtgtttcttgatagttatttgtt

SEQ ID NO: 6867445 - DNA, 59 bp, Homo sapiens
ctcccggcttttccactcagcctcagaaactctggaagaggtggaagtggcttcaggag

SEQ ID NO: 6867446 - DNA, 57 bp, Homo sapiens
gctgcagtagctgaatggcatttctccaaaggaaaaaaaaccatgtaggcactcagt

SEQ ID NO: 6867447 - DNA, 61 bp, Homo sapiens
tgcttttagccactgagcagaggtaaagataataggaatctgcagaaagcggcttgaagca

SEQ ID NO: 6867448 - DNA, 91 bp, Homo sapiens
atcagctgaagatcatgttaaaatatacattctgattctgtaggattagggtggatattttgcattccaaaagctcctagatgatgctgat

SEQ ID NO: 6867449 - DNA, 66 bp, Homo sapiens
gaggagggtgacaggacagagaaatgacctgctctgcaggtaaattttcacctgtcggttctcatc

SEQ ID NO: 6867450 - DNA, 82 bp, Homo sapiens
aactggaacaggacgcagatcaatcctgcggagattggagtattcagtcttgctcttgcatctgcttcttcctgtattagtt

SEQ ID NO: 6867451 - DNA, 57 bp, Homo sapiens
actttttacagggtgtataccacctgctggaagatgaggaggtagccaccaagaagt

SEQ ID NO: 6867452 - DNA, 59 bp, Homo sapiens
atagttccagcatctttggtaacctgaaactgagagtcattaaagtaagctggcactgt

SEQ ID NO: 6867453 - DNA, 57 bp, Homo sapiens
aagcatgcagactacccctaggtcttcgggcaaggagccagtagttctgtagagctt

SEQ ID NO: 6867454 - DNA, 74 bp, Homo sapiens
ggcagggctatggaggaggaggctgagaagctgcctattttgcaggcaatagcttttactcctccgaggaggtc

SEQ ID NO: 6867455 - DNA, 62 bp, Homo sapiens
ttctagaacaggcaaaaccaatcaatagtgacaaagccgatcactggttgcctggactgggg

SEQ ID NO: 6867456 - DNA, 63 bp, Homo sapiens
tttgtcagctgtataatgcaggtaactttatctaccttatagaattgtgcagcccttggcaga

SEQ ID NO: 6867457 - DNA, 86 bp, Homo sapiens
ctccaggcattttttacagatattgtacagttatagatgcaaatacaaatgtaattatagacttcagtgtctgttgatgtctgtag

SEQ ID NO: 6867458 - DNA, 112 bp, Homo sapiens
ccttttatgtactctaaagatgttttatcatagaagtgcaatttcaggaagagtcatatgctttgattctgagggagcattctgccagctgtcttcatggagtaagcaaagg

SEQ ID NO: 6867459 - DNA, 123 bp, Homo sapiens
gcccatccaaggctgagacggtcgggaatctcacacttctgtgttgcacactgccatctactgtgtctctgcagcaagtggagccccagactttatttatgatcccaggccttgatggtgggc

SEQ ID NO: 6867460 - DNA, 63 bp, Homo sapiens
cgtgacctcatttggaaacaggatctttgcacatgtaattagtcaagttaagataaggtcatg

SEQ ID NO: 6867461 - DNA, 62 bp, Homo sapiens
gtgccctcgtgtagttccaggtacactgatagtgacgtgtgcccagtgggtgcagggggtat

SEQ ID NO: 6867462 - DNA, 88 bp, Homo sapiens
cttttggcttttgaaatggcacccgtaataccaaagtgacataatactgcacttctgtaattcaaatgggtggccattgaggcaagag

SEQ ID NO: 6867463 - DNA, 75 bp, Homo sapiens
ggacagtggtgtcttaaaatcagaggatataggctcttgtttactccactgatttctaagattgcactactctct

SEQ ID NO: 6867464 - DNA, 55 bp, Homo sapiens
gggcactgtgctaggtgctgaggtcacaagggaaacagatttagtcgcagtcctc

SEQ ID NO: 6867465 - DNA, 55 bp, Homo sapiens
tgtcagggcaaagtcttctagaacccaacctggtaactgcacctttggcctgata

SEQ ID NO: 6867466 - DNA, 56 bp, Homo sapiens
tttggtcctgggcactgattaacttgacataaaagcagtgaaacaataggatcaaa

SEQ ID NO: 6867467 - DNA, 84 bp, Homo sapiens
cacaactgcaggggacactgttcacattttagtctatgcagcctctggtggccaaagattaaatgagaacacctttgctgtgtg

SEQ ID NO: 6867468 - DNA, 81 bp, Homo sapiens
agtattttttctatagatgtataacttgtggttatgaatattcttggtatttgctgccagtgtacacttaaagaaaatact

SEQ ID NO: 6867469 - DNA, 61 bp, Homo sapiens
agcatctgtaggaagtggaaagtctcagatgattcaggaggctaaggttctgccagaagct

SEQ ID NO: 6867470 - DNA, 65 bp, Homo sapiens
cccctggtgtccgcaacgggcagcgcgtcccggtcgggtcccgcatggtcagtggccagcagggg

SEQ ID NO: 6867471 - DNA, 122 bp, Homo sapiens
cctggctaactttttaaattgtttgtagagatggggtcttgctatgattcccaggctggtcttgaattcctgggctcaagtaatactcccatcttggcctcccaaagtgctgagtttacagg

SEQ ID NO: 6867472 - DNA, 75 bp, Homo sapiens
ttccctctttcctccaaccatttatctgggaagcaagttattggcaacccagagctgattgttggagccggggaa

SEQ ID NO: 6867473 - DNA, 84 bp, Homo sapiens
ctgactcatgggaaaattgggttaatttatggagttgattcattacacaagtctagaatgtgcaccaagctcccttgagatcag

SEQ ID NO: 6867474 - DNA, 55 bp, Homo sapiens
gggaggtctgtttgtagttcagattcttctcattccaggctcagcaggctctctc

SEQ ID NO: 6867475 - DNA, 65 bp, Homo sapiens
ctgctgagttttgcccatcattttctgtgttctgctatatgtggccacactgatcagatcagcag

SEQ ID NO: 6867476 - DNA, 55 bp, Homo sapiens
ggctggctggcttagcagaggagggaggcaatgtgccctcctggacggcctggcc

SEQ ID NO: 6867477 - DNA, 58 bp, Homo sapiens
gtgggcagttggtgattctcgtgtttctcacacacacatgagggtcccgcgtgtccac

SEQ ID NO: 6867478 - DNA, 64 bp, Homo sapiens
ctcggaagcaggcaacagtggcggatactgtgagtggcatgagtcctgtgacctgcatcctgag

SEQ ID NO: 6867479 - DNA, 56 bp, Homo sapiens
tctgtcaccatttgagccctggagtcttgtcctccatatctgctttatgtgagaga

SEQ ID NO: 6867480 - DNA, 119 bp, Homo sapiens
tggagcagggactgagggcgagcatggggccaggtgctgtcctgcacatgtctacgggggagaggctggaccacccaggatggctcttggttgcttgaaatccttaagttctagttcca

SEQ ID NO: 6867481 - DNA, 123 bp, Homo sapiens
attagtcatatagtaattaagattgcatatgatggcatgatttctatatttttaactatgattatatgctttagaaatgagtaaattagacactatagtgtgcatctttacatatatactaat

SEQ ID NO: 6867482 - DNA, 77 bp, Homo sapiens
gcacgaacgggatcttctccgagtcctgcagcagctgccagcggcggcccaggcgcttggagatctcggcgttgtgc

SEQ ID NO: 6867483 - DNA, 77 bp, Homo sapiens
gctgaggctccatgcctgtggcaatagttgcttcacatggcggcaactcttcttgcaatggggaacatggaggcagc

SEQ ID NO: 6867484 - DNA, 78 bp, Homo sapiens
tggcgtttgaaagcctttgtacacttccaaaaggtaaatggtccacttggtcagtgaaggagtctttgctgagcgcca

SEQ ID NO: 6867485 - DNA, 78 bp, Homo sapiens
tcaccctcaaatgcatgtaatgtagctgtgttaggaggtgattctcctccacggtctgaattattggcattaggctga

SEQ ID NO: 6867486 - DNA, 120 bp, Homo sapiens
gtcaggagccctgggtgcaatatttaaggaggccttcacttcagggcccccgcaaatgcagtgctggtgcctgggtgagggtctccttcaattttatgctagcctggtgctagttctgac

SEQ ID NO: 6867487 - DNA, 107 bp, Homo sapiens
gcccaagcacagcgctgagcataggacacagaggtgtgaggggccacaccttccacacccactcagcacctgcctgctgcctgctgcttgcctgctacatgctgggc

SEQ ID NO: 6867488 - DNA, 72 bp, Homo sapiens
gggaattggtgtggcagggggaagttttgatggtaaaacgagcaaagctttatcccttgcccatcgatgccc

SEQ ID NO: 6867489 - DNA, 55 bp, Homo sapiens
tgggtttgattctcagccaagggacaccagggctggtagagactgtcaggccaca

SEQ ID NO: 6867490 - DNA, 59 bp, Homo sapiens
gcctgcctagaattgcagctttgcagagtccactgggtgcttgggctgaattcacaggc

SEQ ID NO: 6867491 - DNA, 60 bp, Homo sapiens
ttcaacatttttgagtttaggttcctctcagaaatgctaggatgactcaatggatgtgaa

SEQ ID NO: 6867492 - DNA, 76 bp, Homo sapiens
tgctgttgtcactgctggttgcacagagctaggaactgacaagacatcagagcttctgacagctgctgcaaaagca

SEQ ID NO: 6867493 - DNA, 60 bp, Homo sapiens
ggagcttgcctaaggtccttcagtaagtcagtggcaaagctggagccacagtcaggttcc

SEQ ID NO: 6867494 - DNA, 65 bp, Homo sapiens
ttattcacacatgaatccctagtacctgctatatagtaggtgctcaatcattatgtaatgaatga

SEQ ID NO: 6867495 - DNA, 60 bp, Homo sapiens
tatctagatatttggataaatgcagttataaattcttgctttatcatttccgtctggata

SEQ ID NO: 6867496 - DNA, 74 bp, Homo sapiens
gcaatctgtaagaccccatgaaggtctgtcccatggaagggggagaatttcctttcattgtggtttcacagagc

SEQ ID NO: 6867497 - DNA, 70 bp, Homo sapiens
aaatgcagctgggcatgagaggggaggctcaggtactgcagctgtgaaacctctgctcgggcatgcgttt

SEQ ID NO: 6867498 - DNA, 81 bp, Homo sapiens
caaagaggtaatgattcctggatcttgtttctacctaggctaatgtggcctagggaaacagagtccacacatttcattttg

SEQ ID NO: 6867499 - DNA, 130 bp, Homo sapiens
atttaatgtgtatatttatcactctgggatcttgttcaatgaaagattgtgattcaatatgtttggagtagcgtctgaaatgctgtgtttctaacaggctcccaggtatactgatactgcgctattaaat

SEQ ID NO: 6867500 - DNA, 68 bp, Homo sapiens
gggtggaggatcttcaagcttaccctctttgatcactctaaggtagtggttcttaaaggtccccagtc

SEQ ID NO: 6867501 - DNA, 129 bp, Homo sapiens
tggaatggaaaagtgcaggcaaactagaagtttccaggatatgtctacattagatttttgttcatttgcaaagttagacacatccgtggaagcttcttatagtctgcctgtacttttcctttcattcca

SEQ ID NO: 6867502 - DNA, 56 bp, Homo sapiens
ggcttccagtgtgccctggtctctaaacaacaggcagaaattctcacactgaggcc

SEQ ID NO: 6867503 - DNA, 66 bp, Homo sapiens
taggcattagtaacccacacaacagtagattagtcagtaatgataggtgctaccgtgggatgctta

SEQ ID NO: 6867504 - DNA, 116 bp, Homo sapiens
tttgcaagttctttgtttggggttgtgaaattgaaagatagtgaagccagcctctctggagggaagaggtgagaggaggcatcgtgattgttttttaccatgctgagagcttcaga

SEQ ID NO: 6867505 - DNA, 62 bp, Homo sapiens
gaattctaccagggcaagaggggaaccagacagctgtcacctctaatgcccttgttcagttt

SEQ ID NO: 6867506 - DNA, 57 bp, Homo sapiens
gggcatagtgtaatcacagcactttgggaggccaaggtgggaggattgcttgagccc

SEQ ID NO: 6867507 - DNA, 60 bp, Homo sapiens
aatgaatgtgaaatttgatgagaaggattggctcctgctgcaaataaatttctgttcatt

SEQ ID NO: 6867508 - DNA, 72 bp, Homo sapiens
ggtctgtgcgaaatgtctctattgcctctggttaaggaccaggcacctgtattgaggcattagcaccaggct

SEQ ID NO: 6867509 - DNA, 109 bp, Homo sapiens
tccctttcccaccctgcctcccagaggctctgcagagattctgggctgaggaagctccctctctcagccttggccctcgccctgccaggagagcagggatggaaggggg

SEQ ID NO: 6867510 - DNA, 64 bp, Homo sapiens
tttgcaaattagccaccctgttttgaggaagccaaagggcttcatggggaggcccatttggaga

SEQ ID NO: 6867511 - DNA, 55 bp, Homo sapiens
gcaggggctctgggtgatgtgaggagcaacaggcaccctcctccacagcccctgc

SEQ ID NO: 6867512 - DNA, 75 bp, Homo sapiens
caggaggatgctccacttgattgttacagcagtaatgatgactgtaatgactgcagtgtggaatatattcttttg

SEQ ID NO: 6867513 - DNA, 77 bp, Homo sapiens
gtttctatgttcctttctttttctctctgcctcagaagaagctgggcaggtagcctagaggaggttgcggaagatgc

SEQ ID NO: 6867514 - DNA, 57 bp, Homo sapiens
cctgtcctgtactttgaggccctggagattttgagatatgcttgaagacaggacagg

SEQ ID NO: 6867515 - DNA, 61 bp, Homo sapiens
gaaagcttgcatgccaacagcttggtataccgatatatgagagtcttggcatgtggttttc

SEQ ID NO: 6867516 - DNA, 70 bp, Homo sapiens
tgcctggcacacagtatgatctaaagtaagtaattgttatcatttctcagttcctactgtttactaggta

SEQ ID NO: 6867517 - DNA, 63 bp, Homo sapiens
tcatttggaggggaactaatcccgtgacttctaggttatctcttagtttcttctctggaatga

SEQ ID NO: 6867518 - DNA, 60 bp, Homo sapiens
accccatgcatacacaggtcaggcaggtgcaggcatcacctggtcgcagtgcgtgtgggt

SEQ ID NO: 6867519 - DNA, 82 bp, Homo sapiens
tactaattattgattcaatttcattaatagatatagacctattcagaggatctatttcgcatataagttttggtaattggtg

SEQ ID NO: 6867520 - DNA, 63 bp, Homo sapiens
ctatacttattgggaggattgtgatttggactgaatggtgtcacagtgctcccaaagtttgag

SEQ ID NO: 6867521 - DNA, 85 bp, Homo sapiens
acaggctttctggacaggtcaaagcccatgatgacccataatgagagaagttggacactatggcttgacttgcaccggcacctgt

SEQ ID NO: 6867522 - DNA, 66 bp, Homo sapiens
tgtggttattactccctgtaggcatttcctgacttggagacgacatgttactcgagaatgactaca

SEQ ID NO: 6867523 - DNA, 72 bp, Homo sapiens
ggtgccagacagacaggagctcacaggcagctggtgccccgctgtcaaggaaaaagcctgtttatcttcacc

SEQ ID NO: 6867524 - DNA, 65 bp, Homo sapiens
gtgtgtcagcacttttccgaggcagagttagctggattctagctttgaagaaaaggttgttacac

SEQ ID NO: 6867525 - DNA, 62 bp, Homo sapiens
ttgctctgatctgtgccttaggcctgtgaaagagacagcgcctatttgtgaagacagcgtaa

SEQ ID NO: 6867526 - DNA, 75 bp, Homo sapiens
agtgaagcattagaaaagcagctgggaccttacctggcatgtagttggtgcccagcaagctttcaatgacccact

SEQ ID NO: 6867527 - DNA, 108 bp, Homo sapiens
gctttgtttttagtatttggtatgaaattggcaatagagaataaattgtatgcacttgcattatctcttctatatgctagctttctgttgaggtttgaagactttagc

SEQ ID NO: 6867528 - DNA, 77 bp, Homo sapiens
ggacctaggccttggacttgtgtttggtagaagaggtgctcttatttgctgggtcagaagccaggagcccaggtgcc

SEQ ID NO: 6867529 - DNA, 77 bp, Homo sapiens
ctatggctgttaggcactttctgtatgctagttactcttctcagaactgggggcacagaagtgaataatagaaacag

SEQ ID NO: 6867530 - DNA, 72 bp, Homo sapiens
aggttgcttattattaaaggaaagacaaagtgggactctttatgatgtcatgaccatgataactaagcacct

SEQ ID NO: 6867531 - DNA, 80 bp, Homo sapiens
agcatgtaaaggtctatgacagaaagacaagttttctatttactagaaggcaggtattgatgccacagcctttggatgtt

SEQ ID NO: 6867532 - DNA, 97 bp, Homo sapiens
tgtgtctgggactgcctgggggccagcctgtctctgctccagggtcccaggggtccctggcagagggggcaggtgcttggggaggactcaaggcata

SEQ ID NO: 6867533 - DNA, 79 bp, Homo sapiens
cactggccaggtagaggggacctagcggggagctccaacagtgtggatgctacaggattctccttatctgtgttcagtg

SEQ ID NO: 6867534 - DNA, 61 bp, Homo sapiens
tggcatctccgacagtcttgatgcgacttaacgcatggtaagaacccatcagagaaggcca

SEQ ID NO: 6867535 - DNA, 55 bp, Homo sapiens
gcaggaacttgggtgaagtcagcgctcagttttgattttatctttgaagttccgc

SEQ ID NO: 6867536 - DNA, 84 bp, Homo sapiens
tttttaaactgattgttggatgatagtgctgctggtaaattttgcaacccatattccactgcttttcagacagttatttaaaaa

SEQ ID NO: 6867537 - DNA, 92 bp, Homo sapiens
aaaatgtgttgtgtgtgtgctctggaggctagatttctgggtcaatcaaatacttgcaaactacctacagatgcatcactactaaatgtttt

SEQ ID NO: 6867538 - DNA, 56 bp, Homo sapiens
gaggtatttgatcctctgcagtgaaccataaaaaactagcgtgggatcagaatctt

SEQ ID NO: 6867539 - DNA, 63 bp, Homo sapiens
tgcctggagacgaggctggaccatcttgaaggaaaagagggtgacgtcagcctgctttaagca

SEQ ID NO: 6867540 - DNA, 129 bp, Homo sapiens
attaaccttatagttcacaattatgaaatatatgcaaactaagttgtttcctttttccctctaaatattctgggacaatgaggaacaactagtgattgacagatcataatttgataaataatggctaat

SEQ ID NO: 6867541 - DNA, 58 bp, Homo sapiens
gataactagaacagaatttggtacctggaagttgggtgctgatattgttttggtgatc

SEQ ID NO: 6867542 - DNA, 77 bp, Homo sapiens
gctagttaaaggacatcccacaggtttgattaaaactttgaagattaaatctgttctcatgtctgtatgaaactggc

SEQ ID NO: 6867543 - DNA, 94 bp, Homo sapiens
gtaaagaaagtccgtttcccttgtttacacagtgaatttactcaaggagcactgtcttcatgggtaaaacactggtggctttactgctctttac

SEQ ID NO: 6867544 - DNA, 64 bp, Homo sapiens
gggcgggcctgtcgtcccagcttccgctctccagcattttcctaatgctgctggggcgccgtcc

SEQ ID NO: 6867545 - DNA, 68 bp, Homo sapiens
gccagtctccctcagtcctctgggccggccgaagcccagacaccttcacaggatgatggagacttggc

SEQ ID NO: 6867546 - DNA, 59 bp, Homo sapiens
tggagggctcctcacattctctatgaaaatatataatagatgagatgaggggctttcca

SEQ ID NO: 6867547 - DNA, 60 bp, Homo sapiens
ttacttggcgtaataggcagaaactcctcattcctcttctgagctattactcccaagtaa

SEQ ID NO: 6867548 - DNA, 84 bp, Homo sapiens
caaccagggtacagcatgcactaagtatatgccaagcatggttgtcagcttggcatacacttagtgcgtgctgtaccttggttg

SEQ ID NO: 6867549 - DNA, 55 bp, Homo sapiens
gggaacctttgtgctccactgggttttcccagcagttgttggtgcacatcttccc

SEQ ID NO: 6867550 - DNA, 101 bp, Homo sapiens
taggcagtgtgaaatagcagacagaacaggctgtggatcaggagccttgggccccaactttccaacttcaccccagcttcatccctatgtcatcctgaatg

SEQ ID NO: 6867551 - DNA, 78 bp, Homo sapiens
tggcctctggccactttaagttaccagtggaaagagcccacctcttttcaagttgttgcattaaatgtctcaaggcta

SEQ ID NO: 6867552 - DNA, 69 bp, Homo sapiens
tcactcaaattaggatgacttgaggacggtttaataaagagactatttacaaagacatgctaggggtgg

SEQ ID NO: 6867553 - DNA, 80 bp, Homo sapiens
tcaaggcagcatgaaggagggaaagcagtgcttctctgctaccttgcttagaaatgctgctgaccctgctgctgccttgg

SEQ ID NO: 6867554 - DNA, 63 bp, Homo sapiens
agcatctggaacagcatgtgcagagacccagggccagggctgtcactggcatgttccggggct

SEQ ID NO: 6867555 - DNA, 59 bp, Homo sapiens
ttagcagttagagttgactgcaaggtcagaatgaacttgcagcatgacttagctgctaa

SEQ ID NO: 6867556 - DNA, 57 bp, Homo sapiens
tgagcatagcccttctagtgttgtagcatagtgcacagcctgttggtttactgctca

SEQ ID NO: 6867557 - DNA, 64 bp, Homo sapiens
ggcccagagctccctggcacctcttggacacgaatacacccctaaggatgctgacttctgggcc

SEQ ID NO: 6867558 - DNA, 60 bp, Homo sapiens
tttcagctagtagcaatgtatggattccatttggatcctgatccatacaaactgttgaaa

SEQ ID NO: 6867559 - DNA, 57 bp, Homo sapiens
actcatgagaacagagagtgaggtagtacattcttacattctgtatttttatagagt

SEQ ID NO: 6867560 - DNA, 85 bp, Homo sapiens
cggtggtgaggaaaggtgcctggagctaatgtgtatagataggagtatcattgtgccaccgggccaggcattccccacccagctg

SEQ ID NO: 6867561 - DNA, 57 bp, Homo sapiens
tgaaagttgcacataagagaataatcatctaaaagatattcttattgtgtactttta

SEQ ID NO: 6867562 - DNA, 55 bp, Homo sapiens
tcaggctgaccaggttttgctctgcaattatgtttaccaggagttggcagtctga

SEQ ID NO: 6867563 - DNA, 101 bp, Homo sapiens
caagggcacgtgatcccttcttgccctgaattcctcaggctgtggactccctgggaccacaagtttgaacttctaggaaagaagggactcaggtttttttg

SEQ ID NO: 6867564 - DNA, 71 bp, Homo sapiens
gttttctatgggttgggcagtaaatattccaaagaagaatggaaattgaaagaccaactgcatttgaagac

SEQ ID NO: 6867565 - DNA, 57 bp, Homo sapiens
gtgatcgtgagctgttccccagatatgcatagattctgggtacagttctgcagttac

SEQ ID NO: 6867566 - DNA, 62 bp, Homo sapiens
ggctggcacctgccctccgctggtcattcaggaactgcgggggctcctggtgctcaagcgcc

SEQ ID NO: 6867567 - DNA, 63 bp, Homo sapiens
atcagtgacctgttctttggcatccttctgaccactagattcatcagattttgggtcactgat

SEQ ID NO: 6867568 - DNA, 64 bp, Homo sapiens
ggtgttcaaatgaacacatgcatttactaaattgccacctgtgtctttgttccatttgaccacc

SEQ ID NO: 6867569 - DNA, 109 bp, Homo sapiens
ttaactgctgggaggctctatttcatcttatgtaaactacagataatacctactcacctcaagggtgtatcaagggtttatgtaagctaaatttgtagaaagcagttag

SEQ ID NO: 6867570 - DNA, 72 bp, Homo sapiens
tatgaaagggtatctcattgtgattttaatttacattttaaaattattagttaagttgggcatcttttcatg

SEQ ID NO: 6867571 - DNA, 82 bp, Homo sapiens
atgtaagtagtttatattcaatgattagtatcagttggccaagccagtctgtgcttgattatatgagtgtgtgtgtgtgcgt

SEQ ID NO: 6867572 - DNA, 89 bp, Homo sapiens
gagctgttttccagggctctgtagaagaagctgtccagctcctcacactgctgtgtttcttcttccctggagacctggagcagaggctt

SEQ ID NO: 6867573 - DNA, 73 bp, Homo sapiens
ctttcttaatatcttggccccaggattttaggataaagaccctctcctgatgttcaaggtatggtactgaaag

SEQ ID NO: 6867574 - DNA, 79 bp, Homo sapiens
catacatacatatgcatgtgtgtatatatagcacatgtttccatgatggcctctctgtacacacacgtgtgtatctatg

SEQ ID NO: 6867575 - DNA, 86 bp, Homo sapiens
tgggatacaaggactgacagtgattggcactgattcagcctggccgaggtgctctgaagaagccactcattagttcctgcctccca

SEQ ID NO: 6867576 - DNA, 79 bp, Homo sapiens
gaatgcaaggaactcaacacagtatttggtatagtaacaggccctgtatgctcgagctacagtgttgatcattacattc

SEQ ID NO: 6867577 - DNA, 127 bp, Homo sapiens
ttaataaggatgctttgaatgttcttatacaagtctttgcatggacatgtgttttcatttctcttggctacctatctgagaatacaattgttcagtaatagagtagatatatgtttaactttattag

SEQ ID NO: 6867578 - DNA, 97 bp, Homo sapiens
gggatgtgctgggcactgactgttagtgatgctcccacagtgtgagaaggccgggtcctcagtatggctgtcagtgtaaagttctattctgcatccc

SEQ ID NO: 6867579 - DNA, 55 bp, Homo sapiens
ttgtcggcatagaagttgaaggcattggtatattgcttcaagttatggttggcaa

SEQ ID NO: 6867580 - DNA, 99 bp, Homo sapiens
aagtgaatcagcactagcattttcttgatggttgactcaatgtataattaacaaatatacatagcagagtcaattaatcatagtgccattatgtcactt

SEQ ID NO: 6867581 - DNA, 72 bp, Homo sapiens
gagccgtgtctgggatagcagaagtatctccgtctctcccgtgtcagtacttctgtttctcaagcatgtctc

SEQ ID NO: 6867582 - DNA, 68 bp, Homo sapiens
tacatatggaatttggagattaggcattgagtcatttaactctctgtgcccatttaagtctttgtgta

SEQ ID NO: 6867583 - DNA, 60 bp, Homo sapiens
gagagagaggggcgagcaaacacaggttcattaatctgtagttcgtctgccttttctgtt

SEQ ID NO: 6867584 - DNA, 66 bp, Homo sapiens
caggccgtcctctcagaagtatttcctcactgcctcgaaaataaccctctggataggacaggcctg

SEQ ID NO: 6867585 - DNA, 79 bp, Homo sapiens
ttctcagaccacctatccccaagccaaggcctgaggagctccaggcttcatcctctaagcttagggatctcactgggaa

SEQ ID NO: 6867586 - DNA, 63 bp, Homo sapiens
tgtaacacttcagagtgccaaatgctttttaaaaaatagccctggctctgaaagagtgctgca

SEQ ID NO: 6867587 - DNA, 59 bp, Homo sapiens
ccatgctccatgtggtagattcctaaacagtcataaatctacctcttgaccaagtatgg

SEQ ID NO: 6867588 - DNA, 130 bp, Homo sapiens
tgagggttgtcaaggacactcaggcaggatttgacccaaaagagatgaaggtcctgactgtactccagtatggctgcagcataatcagattttcctctctctctgtcactgtctcagaaagcagccttca

SEQ ID NO: 6867589 - DNA, 81 bp, Homo sapiens
cacgctgccctgtgcatcaggtaagtgtaatatatagagaaaaatttcatgttaagtgacttgccagagtatgcagttgtg

SEQ ID NO: 6867590 - DNA, 75 bp, Homo sapiens
gtcagtcacatagtttagtgcctagtaaagttctggaagattgaacttgactagacaggttgtactattggctgc

SEQ ID NO: 6867591 - DNA, 57 bp, Homo sapiens
acaagatccagcttctacacagagctcacaagctagtgagctgtctgctgcttttgt

SEQ ID NO: 6867592 - DNA, 101 bp, Homo sapiens
gtgaaccctgatagtgtccacacaacaccaaagggcctgctggaaacatgaaaatgaaggcagtccccatttggtgttttgtgatagcaattaccaaaaac

SEQ ID NO: 6867593 - DNA, 57 bp, Homo sapiens
tgcacagatgctaggaggtgaaacgcagttagaaatgtgcagtttttatatctggca

SEQ ID NO: 6867594 - DNA, 66 bp, Homo sapiens
gtctttgatttagtgtatcaatgtgatattctttgggatatccacatgacctgaatctctttagac

SEQ ID NO: 6867595 - DNA, 100 bp, Homo sapiens
gggtggggaataaagggatgctggggaggagggagtgtgactgtactgaacatgacaaggggcaggggcagcaaagcttgttccttcctggctaccaccc

SEQ ID NO: 6867596 - DNA, 90 bp, Homo sapiens
gcatgctgtttctttcctgccagaaggttcctgctgcagctctcctgctagtttagcttagccttctggtttgagggatgagtcacatgt

SEQ ID NO: 6867597 - DNA, 57 bp, Homo sapiens
gtggagggtttgcaatgtgcagggtaatcctatctcctagcactgtatcctcttcat

SEQ ID NO: 6867598 - DNA, 82 bp, Homo sapiens
acccatctgtatttcacccatctgtggtgttattttaacctaaaattttgagatgttcctagatgcgtgggccagactgagt

SEQ ID NO: 6867599 - DNA, 60 bp, Homo sapiens
tgcagtttgcatgggagcctggacgttttctcttgttccgggccctactcaaagcttgca

SEQ ID NO: 6867600 - DNA, 76 bp, Homo sapiens
tggcatctcatttggccattccagtcacatgctcaaacccagagccaatgtgggagaggattagacaaggctgcca

SEQ ID NO: 6867601 - DNA, 92 bp, Homo sapiens
tattctctgccaacatcagaacttaagagtcttcatcacaaaaattattacatttattaggtgataattgatgaggctttggacagagcatg

SEQ ID NO: 6867602 - DNA, 81 bp, Homo sapiens
cccagctctgcaaggtgccagccttgccagtttctggactgtggtcgtcagcaaggctgttgctgctgcaaggaagctggg

SEQ ID NO: 6867603 - DNA, 55 bp, Homo sapiens
tctggaaggggatctgtggtcattccatccaggacaggccacctctcttcccagg

SEQ ID NO: 6867604 - DNA, 60 bp, Homo sapiens
aggctgagggccgaggagctgtgggttggttgcagggaccctggtatctggctctctcct

SEQ ID NO: 6867605 - DNA, 56 bp, Homo sapiens
tcctcagatataaatgagggtgcataatagcacccaattcatggcagatttgaaga

SEQ ID NO: 6867606 - DNA, 56 bp, Homo sapiens
cgctgcttatgagactggcacgtgccgtgtgtgacgtgtgggcctgtgaagcggcg

SEQ ID NO: 6867607 - DNA, 129 bp, Homo sapiens
gttgctcgggagcctgttggcaccttacaaggcctgagttctttggtgtgtgagagaagagtttgttgttgttgttggttttcacccactagagaactcagggtgcaacaactaggctaccttggggat

SEQ ID NO: 6867608 - DNA, 68 bp, Homo sapiens
caatttggctgcaggggagtagtggctgggattagccctgttctgctacttacttgcattttaagttg

SEQ ID NO: 6867609 - DNA, 72 bp, Homo sapiens
gggcttggggacctgggtttctcttgcaggggatgggcatgctctgggcaggagccctggactctgcagcct

SEQ ID NO: 6867610 - DNA, 61 bp, Homo sapiens
tgagtgccatctttgcccctattttagggataaggattctgaaatgtggagatggtaagta

SEQ ID NO: 6867611 - DNA, 64 bp, Homo sapiens
gatgtaaatgaattttgtctggaggaaataaaacaattctccttcaagaaggtacatttacatc

SEQ ID NO: 6867612 - DNA, 96 bp, Homo sapiens
ctgtgctttattttcattatcaagtttactgtgtggatgaataaagcaagacaagcaattgtgtctctatttaccagtgaggaaaatgaggctcag

SEQ ID NO: 6867613 - DNA, 66 bp, Homo sapiens
ggctggttcgttgagtctttcatcgttgagtgataccacctctgcagatggctcagtggggcagcc

SEQ ID NO: 6867614 - DNA, 57 bp, Homo sapiens
ttcaggctctacacttgacacacctgctgacaagtgtgtcataaaggagactatgga

SEQ ID NO: 6867615 - DNA, 68 bp, Homo sapiens
ctggttctgtctttgccaatctgggctcttatacgctccatggcagaatgagagggaaacatggccag

SEQ ID NO: 6867616 - DNA, 91 bp, Homo sapiens
ccctcagactcagtgtctattttccttgtgggttagcgaagtcagcttctgtctttgataatacacaagagaaagtcttttgaatttaggg

SEQ ID NO: 6867617 - DNA, 70 bp, Homo sapiens
cttttgaaatgtgtcatattcaaagtcaccagaagttttctgtttgaaggaattgaatacgtttttggag

SEQ ID NO: 6867618 - DNA, 65 bp, Homo sapiens
tagttcttggagggcgtgtttggctggacacatccatgctccatagttaaacctttagagaacta

SEQ ID NO: 6867619 - DNA, 74 bp, Homo sapiens
tgcttaagagaatgtcaggagtggattgtccctgtgactttaatggtaattcatctttgagacactttcaagta

SEQ ID NO: 6867620 - DNA, 119 bp, Homo sapiens
gctcttttctcatgccaatgtaagcagtcaatccctgttaaagaatagtgcccctattgctgaagtaataagtctgttgtttaattgggtatttgtcacagaggatggaaaaacagggt

SEQ ID NO: 6867621 - DNA, 62 bp, Homo sapiens
ggcagcttggcttccgctttactgtccttctggataagttgttctgtgggaagccagctgcc

SEQ ID NO: 6867622 - DNA, 103 bp, Homo sapiens
ttgagacacagtcttgctctgtcacccaggctggagtacagtggtgcaatctccactcactgcaacctctgcctcccaggttcaagcgattctccttcctcag

SEQ ID NO: 6867623 - DNA, 62 bp, Homo sapiens
gcgctcggggttatgtttgtgcaggaacaccagctcctgctgctacctggcccacgtgctgc

SEQ ID NO: 6867624 - DNA, 77 bp, Homo sapiens
tttctattgtaccttttctctcaaactggttttattttgacggatttagcttccctggagaaagctgcatatggaaa

SEQ ID NO: 6867625 - DNA, 55 bp, Homo sapiens
ttttgtttctctggagaaccctgacaccgataatagagtattccaggaaataaag

SEQ ID NO: 6867626 - DNA, 70 bp, Homo sapiens
aaaagagggataggaaacttaggtacactgtgcccatcagtgaccttgggaacctgttataaaatctttt

SEQ ID NO: 6867627 - DNA, 101 bp, Homo sapiens
tatcagtatcacggccagaaatctcagaaactggtggatttcatatttgcttatataaatacatttttgcttctagttctggaaatactgtgatcaagata

SEQ ID NO: 6867628 - DNA, 77 bp, Homo sapiens
ccagtggtttgcagccttccttgcagacaaccaggctccctgaggggcctctgcccagggcagggcttgcaggctgg

SEQ ID NO: 6867629 - DNA, 62 bp, Homo sapiens
agcaaattgttgatctacagtaagggctgagcagagcagatccttgagaacatcaatttgct

SEQ ID NO: 6867630 - DNA, 62 bp, Homo sapiens
ggcgctgtgttgttgccctctggtccccaaagagattatcgagggctgctgccagatatgcc

SEQ ID NO: 6867631 - DNA, 69 bp, Homo sapiens
tctgttccacagcacaaagccagtgtggctatttcatttagtttctcaggccacagctccctgtacaga

SEQ ID NO: 6867632 - DNA, 122 bp, Homo sapiens
tctcatccatggatcttagcctcttttggtggcagaatgtctcctgaaacttaagtatttccttgaacttcagtgttagacaagtttggaagaccacgagtctaaatttatggaaactgggg

SEQ ID NO: 6867633 - DNA, 85 bp, Homo sapiens
ccttcctccaagctctccagcaatatgtccttgctccctgcataagctgtcagagcagacaattgcctggatggatgatggatgg

SEQ ID NO: 6867634 - DNA, 86 bp, Homo sapiens
gctacagatagtgttatgcatgaagatcctgtatgtttttgtattaattacagaaatttatatcttggtgattatcttattgtagc

SEQ ID NO: 6867635 - DNA, 123 bp, Homo sapiens
atttttcctttctcatgttattgtctattttggggtgacaaggtgagaatagctccataaaatgagttgggaaatattcttgtcttgttttctctggaagagttggtataagattggaattat

SEQ ID NO: 6867636 - DNA, 70 bp, Homo sapiens
gagtggtcaagagattgaataataactgagtagcaataatactcagatgggttatgtcttttgactattt

SEQ ID NO: 6867637 - DNA, 62 bp, Homo sapiens
gttaagacagcattgctgagggcttcctgaggaacagtgaagttcagctaggttggagcaac

SEQ ID NO: 6867638 - DNA, 63 bp, Homo sapiens
ccaatatctgtcagccagtgagcacttgttctgtgatcatggctaatgcagtatattcaaagg

SEQ ID NO: 6867639 - DNA, 57 bp, Homo sapiens
gctagtgtccctgcagccagctgtgcgtactgagagctactgcaggaatcagctagc

SEQ ID NO: 6867640 - DNA, 91 bp, Homo sapiens
agtcagcgtatattttaagtgtttaaattatttgcagggatttttgacagtctaaaattgcatcttgagcacttgtgataatcgctgtgct

SEQ ID NO: 6867641 - DNA, 78 bp, Homo sapiens
ggagcttcagtctcaagtgctgctcacccaggccatgttcctgctgactctggtggtgaccgcagagctgtgggctcc

SEQ ID NO: 6867642 - DNA, 72 bp, Homo sapiens
gcctcaggctagctggctgtggattccatgccaagacacaccgcccagacacatctccagccagcaggaggc

SEQ ID NO: 6867643 - DNA, 70 bp, Homo sapiens
ggctgacatttggtgctgtgtgtcttggtcctgactgacaaaggcagcacagcaactgctcatgtcagcc

SEQ ID NO: 6867644 - DNA, 69 bp, Homo sapiens
tcttaatctccaggcatttcaagagactgacctgagtcttgagtatgaaatcctgcagaaaaagtaaga

SEQ ID NO: 6867645 - DNA, 57 bp, Homo sapiens
atgccagtgttccactcagagattcacatttaactaatctagagggggcctgggcat

SEQ ID NO: 6867646 - DNA, 79 bp, Homo sapiens
acttccttttagctttacctcatagatttgtttagaacctcaaataatgagcacgtttgtgctttgtaaactgtgaagt

SEQ ID NO: 6867647 - DNA, 66 bp, Homo sapiens
ttggcttctaaattagttcaatggatgatagaaatgttcttttgttgatggaattaatgatgctaa

SEQ ID NO: 6867648 - DNA, 82 bp, Homo sapiens
agatttagagtgtattcatctgctggtttttggcataaatattcattggttttgagctctcaggtgttggaactttaaatct

SEQ ID NO: 6867649 - DNA, 55 bp, Homo sapiens
aactggaatataatgtggtaggtgcagtagcagggtccacaaaattattttagtt

SEQ ID NO: 6867650 - DNA, 61 bp, Homo sapiens
agccaaggcagctagagctctgcagagcacgtgccttcttgctctcagctgcctgctggtt

SEQ ID NO: 6867651 - DNA, 95 bp, Homo sapiens
gaacagcacatgggggaagagagaagaatgatctttacaacatagccttagtcgagaacatatctgttttctaactccctctctctgggttgttc

SEQ ID NO: 6867652 - DNA, 65 bp, Homo sapiens
ctagggaaggacaacctcttccaaagactttgtttgctttgtgtgattggcatgtccttccctgg

SEQ ID NO: 6867653 - DNA, 57 bp, Homo sapiens
tgatgatggaggcttgtgcaagccatgataaggaaagcagaatagtctctgtcttca

SEQ ID NO: 6867654 - DNA, 99 bp, Homo sapiens
ggacttgtgggaatgatggaacagtggcagccacatggcagccgacaagtccgtggctccagtgctcatgccgttgacctggtctgtcctcgcaaggcc

SEQ ID NO: 6867655 - DNA, 64 bp, Homo sapiens
ggactgccctggagacagcagagtatgtggcacattccagccagctctctgtccagggaagtcc

SEQ ID NO: 6867656 - DNA, 95 bp, Homo sapiens
gctgtgaacgttgaactcccaccagtacagatggtagatgtagaaggagaagtcgtcatccccactgctgctggtgtaggagaggacgtagcggc

SEQ ID NO: 6867657 - DNA, 74 bp, Homo sapiens
tagctgaatataggcacaacagaaatttcccattaagcacggggtttttgtttgtttgtttgtcctttcagtta

SEQ ID NO: 6867658 - DNA, 64 bp, Homo sapiens
ctcactgtatttttgaatcattgtggtagaaatttattggaatcagatttaaaagtatggggag

SEQ ID NO: 6867659 - DNA, 62 bp, Homo sapiens
tctgggggtggtaggcacaggctggggtaattctcagaggtgccctggcatctttcccaaga

SEQ ID NO: 6867660 - DNA, 77 bp, Homo sapiens
tggggctggggaaagggatggctcccgcctcggggcagcatgggctggctggggaagcctcgcttttcccggaccca

SEQ ID NO: 6867661 - DNA, 91 bp, Homo sapiens
ggaagatgcagatgggcaggaatccctggatggcttcctcaaggagaagctacaggaaggatcttgctcaagagaaagagtctgattggcc

SEQ ID NO: 6867662 - DNA, 63 bp, Homo sapiens
ctggacatcagtgtgcctggctgggtcctagtggacaaggcctctgcttatgctgatgactgg

SEQ ID NO: 6867663 - DNA, 62 bp, Homo sapiens
gcacaggtggttagccacgattcgatggggtggcttcattccagagtgtgagcttgccgtgc

SEQ ID NO: 6867664 - DNA, 72 bp, Homo sapiens
tcatggttttgagcctattatgctgttagtatgatcagcattgccccacaatttaggctttcaaatgccaga

SEQ ID NO: 6867665 - DNA, 93 bp, Homo sapiens
cattgtgacctttggggaatgttaatgcacttctagctcatggaaaccccggaagccagtgtcgtgtgacatgagcccagccggattagaatg

SEQ ID NO: 6867666 - DNA, 71 bp, Homo sapiens
gttagctagcacaggtcttgttgccattttacattagaataaggtataaaagacttggtgtaatggctgac

SEQ ID NO: 6867667 - DNA, 61 bp, Homo sapiens
ccagaatgtgtgaaatttgatgtagtccttcttggcttcgttttttcctcagatgttctgg

SEQ ID NO: 6867668 - DNA, 56 bp, Homo sapiens
gcttggcactttctcagcagcctgggctaatccagtcctagccaaaagtcccaagt

SEQ ID NO: 6867669 - DNA, 55 bp, Homo sapiens
taggcacaagaccatgcaaaggccccacatggttattgagtagtggtcctgcctg

SEQ ID NO: 6867670 - DNA, 64 bp, Homo sapiens
ccggctcggcgaccaggctgaaactcatgtttgaatttagtgagccgtttgttcgttagtccgg

SEQ ID NO: 6867671 - DNA, 73 bp, Homo sapiens
ccccaccaggcactcacagggaagacagggaaggatcttgagaaagtttcctttgtgcaggccttgggaaggg

SEQ ID NO: 6867672 - DNA, 75 bp, Homo sapiens
aagcacgttctacatggttgctcagagggtcctcaataggactgaggcctaggagtccactgagataacctgctt

SEQ ID NO: 6867673 - DNA, 56 bp, Homo sapiens
ggtcccagccctggagccctggtcggggtagaggaccaggagttgggggtgggacc

SEQ ID NO: 6867674 - DNA, 71 bp, Homo sapiens
tctgaatagagagaggtcctttaaaaatgtcgttctggaatttggcaaattagtacctctctccattgagg

SEQ ID NO: 6867675 - DNA, 58 bp, Homo sapiens
ttctgtgacccagttcctggcacccagcaggcgctcggtggacggatgggtggcggaa

SEQ ID NO: 6867676 - DNA, 101 bp, Homo sapiens
gtaagaagaaatcctcagactcttattttgaagtaataattgaaaatttagtatcaaataatacatgtgatgagaatttggactggatttactgaacttac

SEQ ID NO: 6867677 - DNA, 88 bp, Homo sapiens
tggaaggtcttgcacctttcatcccccacaaggctgaggaacttgggctctgccctgtggacagtgagaagtgtcgaaggagttttca

SEQ ID NO: 6867678 - DNA, 61 bp, Homo sapiens
agtcctagacgtttgacaatgtattcaacgaatgtataacatgagtcttacgttaggcact

SEQ ID NO: 6867679 - DNA, 63 bp, Homo sapiens
ttgccaaggccagagccagcgataagtggcctcgcgggcgctgccagctctgtgctaaggcag

SEQ ID NO: 6867680 - DNA, 68 bp, Homo sapiens
gcggcccacctcctgggggacagcggcagggccccagggtccccaccttctgcctcagggaggtctgc

SEQ ID NO: 6867681 - DNA, 81 bp, Homo sapiens
ctgcatcgatgagtgcctctgagccacatgcgtttgttcaggtggatgggatgaggcagctcagggggaaattgagggcag

SEQ ID NO: 6867682 - DNA, 62 bp, Homo sapiens
ctgtggtggcactgtttcccacggaaggacagtgtgttttgatggggaaatggttccctcag

SEQ ID NO: 6867683 - DNA, 79 bp, Homo sapiens
tagttacttttgctctgagtccaaattctcctgcaggtgtcacccctcagcagagaatctcaggcacccagaagaacta

SEQ ID NO: 6867684 - DNA, 90 bp, Homo sapiens
gacctgagaaaaaacaactttgacccttgttcttaaaatgctttaaccttgaagttgcttgagacttaagaggtcatgttgctttaggtt

SEQ ID NO: 6867685 - DNA, 130 bp, Homo sapiens
tcctatcatactaaatgcatcttggaggctcaaaatatctattgtcctatctattgtatgagtgaatgtgtaaaatgagctttaattaggaagtataatgaggactttcgagatgaatggtagcatagga

SEQ ID NO: 6867686 - DNA, 72 bp, Homo sapiens
ggccaagcattttcctgaagttcaagatgccagtcatcttctgaagtcactgcttcttggagaatgtcagcc

SEQ ID NO: 6867687 - DNA, 62 bp, Homo sapiens
ggtgaaaactccctgtgtaactcccatggaataaactttgttattgacagaaagtgttcacc

SEQ ID NO: 6867688 - DNA, 77 bp, Homo sapiens
gtgactcgtagagctggccttttggtatgggtgtgaggctgccctgcaaggtccacctgctacataaactgagttac

SEQ ID NO: 6867689 - DNA, 56 bp, Homo sapiens
gcagcactggcaatagaatggacaactagaacttgtcccagctgggtcagtgctgc

SEQ ID NO: 6867690 - DNA, 81 bp, Homo sapiens
acagaaccttcccaatattccatttgggtcaggatgatatcacaatgattttgatttaatggataatgtagagtgttctgt

SEQ ID NO: 6867691 - DNA, 78 bp, Homo sapiens
ttggctttgcattctgggtgactacgtgatcaccatgattagtgatcaagtttatctcttaagacatgtaagagccaa

SEQ ID NO: 6867692 - DNA, 57 bp, Homo sapiens
ttacttttctgtcaaatatgccatagctactgcagtggtgtcctgagggataggtag

SEQ ID NO: 6867693 - DNA, 75 bp, Homo sapiens
cagagggtacccaggtggctctgacgggggttccagtggaaatgtctgtggggttcatgtgcctcttgccttctg

SEQ ID NO: 6867694 - DNA, 96 bp, Homo sapiens
ggccgcgttggcacgtcgggcattcccaggatgtgcgtgccgccggcgggcctgcctgtcgcagcagcctggggttttggacgccgcacgcgtgcc

SEQ ID NO: 6867695 - DNA, 77 bp, Homo sapiens
cgggatgtcacatgtctactgaggctttatgggacttgctatgtaggaccataagtgttggtggtatatggaagctg

SEQ ID NO: 6867696 - DNA, 114 bp, Homo sapiens
atctattattgctggcatttctttccccactgggctgttttttgagtggatgtcatactcatctcatacagaaggcatgtccatcatgctagagcagtgctgtcaatattagat

SEQ ID NO: 6867697 - DNA, 57 bp, Homo sapiens
tctgaggggttatcaagtgaaagtggaattagatttgttcttcatgatcctgtcaga

SEQ ID NO: 6867698 - DNA, 68 bp, Homo sapiens
agagcattggttcaaggttgtgcagctgggaaatggcctgtactcttctaccctgagaataatgctct

SEQ ID NO: 6867699 - DNA, 57 bp, Homo sapiens
gcggctccgaagccaggccgcgcatggtgatgcgcaccggcttgtctcggcagccgc

SEQ ID NO: 6867700 - DNA, 71 bp, Homo sapiens
cctgtggagctgagttcttcagccgggttctgaggacatcctgctcttggcaggaggggctcagccatggg

SEQ ID NO: 6867701 - DNA, 55 bp, Homo sapiens
tctacgaagccaccatggagacgaaagagccaatcgtctacacgggcagtgtaga

SEQ ID NO: 6867702 - DNA, 61 bp, Homo sapiens
gctccttctgaggactctaaagaggacgccttcctgcgtcttcctagcttcaggaggttgt

SEQ ID NO: 6867703 - DNA, 55 bp, Homo sapiens
tagcagtagcatttaacatatattgagtactcactctgtgtcaggtgctatgcta

SEQ ID NO: 6867704 - DNA, 60 bp, Homo sapiens
gcctagggatgacaaatattcttctcagattctagcagtagagttactgtcatcctaggt

SEQ ID NO: 6867705 - DNA, 75 bp, Homo sapiens
gccttggatggattcaatgttgcagatggaattaacttctcttgataccaactgttatattgaagggtaaagggc

SEQ ID NO: 6867706 - DNA, 61 bp, Homo sapiens
agggctgggcactgtgcaaggtattttaaatcttatatagcattgtacagcaaccaaccct

SEQ ID NO: 6867707 - DNA, 129 bp, Homo sapiens
ctttgttaggacttgggtttttatttagctctacatatgcgatcataggatgcagaagatatatcttctactggacacgtatatatagatgcttaaatgtggctatcccaaggttaggtaataataaag

SEQ ID NO: 6867708 - DNA, 82 bp, Homo sapiens
ggagagcagatgttggtgggggcgggagcatgggccttggagtcctgcagggcctggctcagaccccagttctgtctctgcc

SEQ ID NO: 6867709 - DNA, 76 bp, Homo sapiens
cacagtaaatacccggggctgtgatttttgtgactttggtcaatgggacgacaggctctgtggtagactggctgtg

SEQ ID NO: 6867710 - DNA, 125 bp, Homo sapiens
ggtggcaggaaaaatggtgggcacatttccagaatgacaaatgggagaagcaatcgtgacatctccaggtgggggaagcataggaggaagaggttgttctctcaggaagttgcctcctagcctcc

SEQ ID NO: 6867711 - DNA, 87 bp, Homo sapiens
tctcatgctgtgaccctctagagggaagcactttctcttgtctaaaagaaaagaaagcgcttctctttagaggattactctttgaga

SEQ ID NO: 6867712 - DNA, 102 bp, Homo sapiens
tttgcttctcaaactcactgttaatggaggactacaggacattcacatagactgagaaattttccactgtcattcataatgtgggttctattgagaagcaga

SEQ ID NO: 6867713 - DNA, 80 bp, Homo sapiens
acaattggaagttcatatggagtacttttttggattagtgtgaagtaaacgcaaatttgtgctgccttgaacctatttgt

SEQ ID NO: 6867714 - DNA, 66 bp, Homo sapiens
gccccttgagatcaggagctgttagggaggagctgcctctggccaatgttgtgatcacaagagggc

SEQ ID NO: 6867715 - DNA, 58 bp, Homo sapiens
actgaacgtggcagtggaaggctgggtggagacttctcccccagctcctgccatcagt

SEQ ID NO: 6867716 - DNA, 64 bp, Homo sapiens
agagagctgtatccccttaccagttctgtgacgtggctgggctggtttcatatacattctttct

SEQ ID NO: 6867717 - DNA, 72 bp, Homo sapiens
cccgaagtgccccatatggtagctgtattgtctgacttctccacacaactgtaagctccttatggggcaggg

SEQ ID NO: 6867718 - DNA, 90 bp, Homo sapiens
ttattgtctccatttatttaggaggaaactgaggtttgggaaggttagtcactttaccgaagtttcttcctaaaccagcggggacaataa

SEQ ID NO: 6867719 - DNA, 57 bp, Homo sapiens
ggaagatacatcatttataccttcagaattgtgtttgagggtggagagagtatcccc

SEQ ID NO: 6867720 - DNA, 61 bp, Homo sapiens
accacattctgccctttgaagagcccagagcaccatgggcagagctgggtatggatgtggt

SEQ ID NO: 6867721 - DNA, 96 bp, Homo sapiens
catgaattgctgaaacagcagccccgtagcctccagaaaggtgcaacgcattgcatctgggagacccttgcgggaagggttgtttctgcagtcctg

SEQ ID NO: 6867722 - DNA, 56 bp, Homo sapiens
ctcagctggcaattctggctccctcagtaagagtggctacagctagaacagctggg

SEQ ID NO: 6867723 - DNA, 75 bp, Homo sapiens
aaggaaaatgagctgcatgcaactgtttaaatatagaaaatgatgtttaggaagatgttgctggactccttcctt

SEQ ID NO: 6867724 - DNA, 60 bp, Homo sapiens
gtggggaaggaagtgcagactttaaaacaattaatggttttggtaactattcttctctgc

SEQ ID NO: 6867725 - DNA, 71 bp, Homo sapiens
ccctttcattccatcctgtcccccaggtgggaccccacgccctgaggtggaacagaggtgaagaggaaggg

SEQ ID NO: 6867726 - DNA, 69 bp, Homo sapiens
gcaggttgatcagggctgtatgttttttgagtaggggaacctagcttaaggcaggcccttgtctactgc

SEQ ID NO: 6867727 - DNA, 63 bp, Homo sapiens
cttccgtcgcgtccagggttttatccgtactcatcttgagccggcatctggatgtcatggaag

SEQ ID NO: 6867728 - DNA, 56 bp, Homo sapiens
tggacagagaggaaggccatttcacacagaggaaatgaaacctaaactttctgcca

SEQ ID NO: 6867729 - DNA, 86 bp, Homo sapiens
tgtgtcttgggtgaagcgtatgttttttaaaatcctcatttcacaaaataggaagttagtaaattatgtgcaaaattgaggaaaca

SEQ ID NO: 6867730 - DNA, 76 bp, Homo sapiens
ctggtgaattgtcccgtgccctgtgtatctatgagtcctgcagagatgacaaatcaggggacggggtcatgtctag

SEQ ID NO: 6867731 - DNA, 60 bp, Homo sapiens
agggggaatggagacagttttttggagactttggtttccaatcaattgttctacctgact

SEQ ID NO: 6867732 - DNA, 70 bp, Homo sapiens
aaggcttagagacagacagcagccagcgtcctatctctgcagctgctgttccctctgctctgaagctctt

SEQ ID NO: 6867733 - DNA, 70 bp, Homo sapiens
cggcggtgggggaaaggagcggttgcccacaaaccatccgagcacagggagccgctcagacccgacgccg

SEQ ID NO: 6867734 - DNA, 63 bp, Homo sapiens
gtggagtggcctggccctgagaacccacgaaatccattgtctggctaggaggggctattccac

SEQ ID NO: 6867735 - DNA, 61 bp, Homo sapiens
ttattttactgtttccctgctctcaagtgcttaagcatagacaggtgaaacagcaaggtaa

SEQ ID NO: 6867736 - DNA, 130 bp, Homo sapiens
ttcggaggctgctgcatggagatgatagctccctgaagacacgccgggaggggcagctgcccgcctgccagcacttctggctgtctgaagtgcttcgtttcagctccacgtgggtgtctttgttgtcaga

SEQ ID NO: 6867737 - DNA, 62 bp, Homo sapiens
gataatatttgacttggagggtctctgtctctctgatggaaatacctgaattagatattatc

SEQ ID NO: 6867738 - DNA, 81 bp, Homo sapiens
gcaaccactggaatgcaaactccactggagcaggagctttttcactgcttttttcaccagtgtcttgtatgtaggagttgc

SEQ ID NO: 6867739 - DNA, 69 bp, Homo sapiens
ccaggattgtggaagtcagtggttctgatggaagcgggagaaccagtggagcttgccacagagccttgg

SEQ ID NO: 6867740 - DNA, 65 bp, Homo sapiens
tgtatatgtctttataaatgtataatgtatttggtaatgtgcagtagcatgtaataaagacagca

SEQ ID NO: 6867741 - DNA, 67 bp, Homo sapiens
ccacccctacgttcctgcttcctgcctgtgagtatgttagggtgctgtcagcaggactgtggggtgg

SEQ ID NO: 6867742 - DNA, 66 bp, Homo sapiens
gtttagagggcatagttaaataggaggaaagtactttcaccagaattgcaaactgtgtcctacaac

SEQ ID NO: 6867743 - DNA, 98 bp, Homo sapiens
cattggactcacagttcctaggggcccttggctttaacagttggcttccttcatttttctctgttaatgctgtgctcctgtgacagtgagggccaatg

SEQ ID NO: 6867744 - DNA, 69 bp, Homo sapiens
gtgatggatgtcacttctaagataatgttataaaaagattgtcttctgtcttaggtgatctctcattat

SEQ ID NO: 6867745 - DNA, 56 bp, Homo sapiens
gagagtgtggagaggtagtagtgtggctaacccagtgctgaatctgccatattttc

SEQ ID NO: 6867746 - DNA, 61 bp, Homo sapiens
ctgccttctggttacaggctgattttattcttctggttgaacagtcacaaaaccaaggcag

SEQ ID NO: 6867747 - DNA, 110 bp, Homo sapiens
ggtgtttgttaactattctgtgaatctgggtcagttgtagcatgagaaatagagactcataacagttatgtgacttatccaggctcacataatcagcaggcgaattaacc

SEQ ID NO: 6867748 - DNA, 76 bp, Homo sapiens
agctgtgactccgtttgctggctatggtgtctccaggggctggcccctggcctggcacagagcggtggtcacagct

SEQ ID NO: 6867749 - DNA, 55 bp, Homo sapiens
tttactgcctagtttgcagaaagtgaaagcagtcttccttgattaggcagctgaa

SEQ ID NO: 6867750 - DNA, 80 bp, Homo sapiens
caccgggaaggagcctggcaatgctgcgtccttcttgacactgggtcaccttggggtggatttcaggctcctcacctgtg

SEQ ID NO: 6867751 - DNA, 71 bp, Homo sapiens
tttaagtgggaataaatgcttcagttactaacataagagaaaatgacactgtgcatctattgccatttaga

SEQ ID NO: 6867752 - DNA, 57 bp, Homo sapiens
ggaattcaccagaggttagaatattttatatgaaataatcttactctgctggactct

SEQ ID NO: 6867753 - DNA, 76 bp, Homo sapiens
gtgaaaatgtgtagtcattgatcaagaaatcccatttataggaatcccttcttgagaaataattaaacatgagcac

SEQ ID NO: 6867754 - DNA, 62 bp, Homo sapiens
ggacagtggtttaggtcaaggggaggcagcagatgctggaacctggcctgagctaccactcc

SEQ ID NO: 6867755 - DNA, 79 bp, Homo sapiens
aatggttagtttggaaggaggagcatctggatgtaatgaatttacatgtattgatttctcttcttccaaatatattgtt

SEQ ID NO: 6867756 - DNA, 58 bp, Homo sapiens
tgtgaagcgtgtgcaggggacagcagacatcagagctctcctgtaaatcacctccgca

SEQ ID NO: 6867757 - DNA, 62 bp, Homo sapiens
gccgaggccgcgcccgtccgcccgccgcccgagccgccgcccgccctggacgtggcctcggc

SEQ ID NO: 6867758 - DNA, 76 bp, Homo sapiens
ctgcctcccctcccactttagccagctctcagggggccccccaccaccctgagcactgagctggaattggaggcag

SEQ ID NO: 6867759 - DNA, 69 bp, Homo sapiens
ctagatggtctgaaaggcagcggaatcccaggggtgagcccagagtcttctgtttttcagcagctctag

SEQ ID NO: 6867760 - DNA, 125 bp, Homo sapiens
agactcacctggggaattaaaaaaaaaatacattgatgcctgggccccaccccagagattctgatagaattggtctggagtggacccagagcactaatattttcaaatgttcctcagctgagtct

SEQ ID NO: 6867761 - DNA, 81 bp, Homo sapiens
ggcaggcgttgggacagctgtggtagtgagggccactttattctgtgctacatgaagagaggctgtctgacaaagcttgcc

SEQ ID NO: 6867762 - DNA, 67 bp, Homo sapiens
cagctcacaagactccctcccctttggaagagtggccagagggcaaatgtgggtgtcttgagacctg

SEQ ID NO: 6867763 - DNA, 64 bp, Homo sapiens
ttatgcctgttaggcagcatcttacgcccagtgttctcccagatattctgcctaacaggtttaa

SEQ ID NO: 6867764 - DNA, 57 bp, Homo sapiens
caacttgttcttggtagatctatggtgccccagtggtccctgacagcgggcaagttg

SEQ ID NO: 6867765 - DNA, 63 bp, Homo sapiens
aggacttttctgacatatccagtctcagtgaaaggccactgtcactgtgatgttagagatcct

SEQ ID NO: 6867766 - DNA, 67 bp, Homo sapiens
gggcgcggcggtcagcgtgggagaggctgcaggccctgcacgcctctgcagctgccgggccgtgtcc

SEQ ID NO: 6867767 - DNA, 129 bp, Homo sapiens
gttgcccaggctataataaagcagagttttggccaggcacggtgaatcatgcctgtaatcccagcacttttgggaggctgaggcaggcagatcacttgaagtcaggagttcaagactagcctggccaac

SEQ ID NO: 6867768 - DNA, 59 bp, Homo sapiens
tgcagagaagagtatcttttcacacttgatctgtaaaatcaagttgcttattctgtgca

SEQ ID NO: 6867769 - DNA, 69 bp, Homo sapiens
atggagggaaaagtggagagccacagagttggcaaataatgctatcatcctctcctctcttcattctat

SEQ ID NO: 6867770 - DNA, 77 bp, Homo sapiens
tttgcttcttaataattaaacgccactgcattatgcagcatacctgctgccaggatgttgtttgagaatgaagcaaa

SEQ ID NO: 6867771 - DNA, 79 bp, Homo sapiens
tctattttttgctttggtttctatgcttttggggtcttaatctcccccaaaaagtcattttccagaccagtattataga

SEQ ID NO: 6867772 - DNA, 90 bp, Homo sapiens
acaacttcatgtagaggaaactgaagttctggaggggtaccagggtactcatctctttagtgtcagtctctctcatggactgtgagttgt

SEQ ID NO: 6867773 - DNA, 81 bp, Homo sapiens
tgctctctgtctctgcaagatgagaaatattatgggtgagattcaaaatgtttaaaaacttgtgctcaggggcactgagca

SEQ ID NO: 6867774 - DNA, 58 bp, Homo sapiens
gcaattctcaggaatttcatctgtggcttttgcaagctatatatgagctgagatttgt

SEQ ID NO: 6867775 - DNA, 88 bp, Homo sapiens
tcccgttgccttagcttttacaaggtgcagctggctgtgtgacaggtgaccttgtctagccactgtgagctgagtgaaggtactggga

SEQ ID NO: 6867776 - DNA, 56 bp, Homo sapiens
tcaaatgtgttggtatggcttttgaataaaagagttgtcccatactgacatattga

SEQ ID NO: 6867777 - DNA, 55 bp, Homo sapiens
tgccagtgaaacgtggtctcatcagtatctcaggctctgaccaaatcgcttggca

SEQ ID NO: 6867778 - DNA, 106 bp, Homo sapiens
tcatgggttggagcagtgtttagcagtgaagtgaagtgaagagatgaaaggagaaaattcatgaaacttttattcacttatacatgttaaagttcctaggccatga

SEQ ID NO: 6867779 - DNA, 59 bp, Homo sapiens
aggaagggaagagggctttggagtttgaagaacgacattccaagctcaactcccttcct

SEQ ID NO: 6867780 - DNA, 66 bp, Homo sapiens
ggaaacattgaagctgtgaaatcaaacaatttacacgagtgagaagttcagcatttggatgtttcc

SEQ ID NO: 6867781 - DNA, 56 bp, Homo sapiens
caggcttaaaagcagattttgagtcataaatattaaactctgccatttttggcctg

SEQ ID NO: 6867782 - DNA, 76 bp, Homo sapiens
tgttctttctgtcatggtgtactgctcccaaggtctcactccacccaactggctggtgcacatgaaagagaaggca

SEQ ID NO: 6867783 - DNA, 57 bp, Homo sapiens
ttaggtaaggatggtgacagtaatcaaatgccactactgtgtaccatctatacctgg

SEQ ID NO: 6867784 - DNA, 99 bp, Homo sapiens
agggtcaagtactgaaatctgtggtgataaaagcttaattcctattactctgtgaaaggctactgtcatcaattacattttaaacttgctgttaaccct

SEQ ID NO: 6867785 - DNA, 74 bp, Homo sapiens
gccagatttatcttcatgacctctgtgttttagatgaggtctcagagatagaggtcagaattttccctctaggt

SEQ ID NO: 6867786 - DNA, 78 bp, Homo sapiens
ggagaaagggggcggcagccagtggaaggatcgcatggagtctctaattccaaaggctgcaccttgcccccagtctcc

SEQ ID NO: 6867787 - DNA, 75 bp, Homo sapiens
taggatcttacgtaggtcaagccttatacagaaacctgggcagatcccagaggatatatggtttgtatgttccta

SEQ ID NO: 6867788 - DNA, 74 bp, Homo sapiens
tgatatgtacattgatattaaaaatataggatgctgacttttggattttatgtacaatgttaatgtaaatatca

SEQ ID NO: 6867789 - DNA, 71 bp, Homo sapiens
gtagaacatgatgttgcattgtactgaaaagccctctggcttcacatagcaatgtgagccttcaatttcac

SEQ ID NO: 6867790 - DNA, 69 bp, Homo sapiens
gaagtggcagtgtgcatctgtgtggcccagaaatggatggctagtgctaatgtacatgttggttatttt

SEQ ID NO: 6867791 - DNA, 58 bp, Homo sapiens
tcaggggaagaaagtcggggaaattattaaaagtgatgatcccttctccttcccttgg

SEQ ID NO: 6867792 - DNA, 79 bp, Homo sapiens
tggttgcaagtgaaagagagtttagtggtttcatcattgttgtagtaaaaccattgcatctttcttaatattttgacca

SEQ ID NO: 6867793 - DNA, 78 bp, Homo sapiens
atcctagaagcctttatactaaaggaatctgctgacataaatagtgtcaattcaacgggtagaagggtcttggaggat

SEQ ID NO: 6867794 - DNA, 60 bp, Homo sapiens
tctgcctctcggctgccgagttcccacaggctctgggagactgaggctgccagggtcaga

SEQ ID NO: 6867795 - DNA, 78 bp, Homo sapiens
gaggagagtaccattgggccgcaccagaactaatattaatgaatgccttacactacgcccaaatgcagtgctttcttc

SEQ ID NO: 6867796 - DNA, 67 bp, Homo sapiens
ttcttgagaacaaattcctggatactggcattagtgacaaagaagtgtcaggacagtttgccaagaa

SEQ ID NO: 6867797 - DNA, 108 bp, Homo sapiens
ccactctagaaaacacagccatctttatgctttgcttcctatattctatttggaacttaatataccaaaaacagaaaggccaggttggctggtattatggacctgtgg

SEQ ID NO: 6867798 - DNA, 60 bp, Homo sapiens
acagagtgtaatgagaatgcagttggttatgttcataccaattctcattacaatctttgt

SEQ ID NO: 6867799 - DNA, 65 bp, Homo sapiens
tcagggaagacttcttagaggaggtagcagttaagctagcccttaaagaataagtcttatcttga

SEQ ID NO: 6867800 - DNA, 73 bp, Homo sapiens
gagtcaaggcactgaatatccagtaaaataaaatagctttcttgtactgtctccagtagcctagttttgattc

SEQ ID NO: 6867801 - DNA, 61 bp, Homo sapiens
ccatttcttcatgtattgcattgtgtccttaggaaggagaatgtaattggcatgttagtgg

SEQ ID NO: 6867802 - DNA, 56 bp, Homo sapiens
gctccccaaggcggcagtcacagtggtgacgctggctgccatgacgcctggggagc

SEQ ID NO: 6867803 - DNA, 60 bp, Homo sapiens
tagctgtcagctgcaggcaggccaccccatcccatagaccttctcacagtatgacagcta

SEQ ID NO: 6867804 - DNA, 87 bp, Homo sapiens
ctactgcctaaggtcagaattccttccagaccctgtactctgtaggtggggaacagagtcttgagagaaaagagacaagggctgtgg

SEQ ID NO: 6867805 - DNA, 60 bp, Homo sapiens
gctggtgtgtgaacctagggacattatttcaccttatagagtctcagtttccacatctgt

SEQ ID NO: 6867806 - DNA, 85 bp, Homo sapiens
gggcgcggtggctcacgcctgtaatcccagcactttgggaggccgaggtgagtggatcacgaggtcaggagttcgagaccagcct

SEQ ID NO: 6867807 - DNA, 101 bp, Homo sapiens
gtggtaaaatatgcataacatggagtttgtcatttaaccatttttaagtatacagttcaatggcattaagtacgtttgcattgttgtgcaaccaacaccac

SEQ ID NO: 6867808 - DNA, 83 bp, Homo sapiens
cctgctttgctcaggggtctcccccattgtagggctcacagcctggcccccagaggggtgtagagatcactgagccaaccagg

SEQ ID NO: 6867809 - DNA, 56 bp, Homo sapiens
gcacccaggcttgggcagcaactgctgtgtgccattgttgtgctgggcttggctgc

SEQ ID NO: 6867810 - DNA, 87 bp, Homo sapiens
ctttgtggctcatggaacagtatgaatgcagaatgtagctttctccacttgtggactgctttgcatagctgccagaggcctccagag

SEQ ID NO: 6867811 - DNA, 56 bp, Homo sapiens
cctgcccaggccctaagttagggttcccatccatataacaaagacttctggtcagg

SEQ ID NO: 6867812 - DNA, 76 bp, Homo sapiens
tgcttcacgacaagattcaagttaagcatttctggcaaggtcttgtgcaattgacattgaatcagatcatgaggta

SEQ ID NO: 6867813 - DNA, 59 bp, Homo sapiens
ctctttcgaagcgtttttgtggccaaataaatgaaaaggcttggagtagcttgaaggag

SEQ ID NO: 6867814 - DNA, 64 bp, Homo sapiens
ttcagtttgccagtattttattgatgattttcacatcagtgttcatcaggggtattggcctgaa

SEQ ID NO: 6867815 - DNA, 80 bp, Homo sapiens
gattttgcttctcccagagaacagacagatgcaatgaagacacatcttatcaatgggttttgctttctcaagctaaagtc

SEQ ID NO: 6867816 - DNA, 67 bp, Homo sapiens
acagcttccaggggtgctttgaagggaaccttacgccagtaggcctttgagcttccctggaagacgt

SEQ ID NO: 6867817 - DNA, 55 bp, Homo sapiens
ctgcggttagccataacatatctacttgccaaacaagtggtttaggttaccgggg

SEQ ID NO: 6867818 - DNA, 118 bp, Homo sapiens
ctccttccagctttctgctctgccattactagaatgtgaacatcttgaaagtccagcctgcacagtttcatcctcagacttcacgttccatgtagcaggttagagaaagaggaaggag

SEQ ID NO: 6867819 - DNA, 63 bp, Homo sapiens
tggagagtggtttgggggacatcgaaggtggccttctcacctgctccccacgccagcttccca

SEQ ID NO: 6867820 - DNA, 77 bp, Homo sapiens
ggagtaggaagaacatttaggggctcaagattctcctcaaaccactgagatcacagcccccagatgccacctatttc

SEQ ID NO: 6867821 - DNA, 66 bp, Homo sapiens
agctgaatgccagcacttctgggcctcctagggccagagctcctcagcccagagggtgcgtcagct

SEQ ID NO: 6867822 - DNA, 104 bp, Homo sapiens
tgctttccttatatacatttatttactattaggttggtgcaaaagtaattgcaaaaacaataattacttttgtgcctacctaataacagatgctagggaaaaca

SEQ ID NO: 6867823 - DNA, 124 bp, Homo sapiens
tttcaaaacatttatccattttcataaaagatttcttaaaattcaagctaggttttcttcctttatttgaaaagggaatatggtaattttaggaatatgattatatatgcatatgtggaagaga

SEQ ID NO: 6867824 - DNA, 60 bp, Homo sapiens
gtggtaacatgactgtgcctccagcactggcctttgccaggctccttgttcatcatccat

SEQ ID NO: 6867825 - DNA, 85 bp, Homo sapiens
ctcaggctgtgaccctccagagggaagtactttctgttgtctgagagaaaagaaagtgcttccctttggactgtttcggtttgag

SEQ ID NO: 6867826 - DNA, 81 bp, Homo sapiens
tttattaaaccgtatacatgaagacattgctgagagagctaaaaccttgccgtgcttctgtgtgtgctctttgtttatgaa

SEQ ID NO: 6867827 - DNA, 64 bp, Homo sapiens
cgggtgcagggtctccagcagctgagctcccggagtgtcaagttgccggaggcttctgtgcctg

SEQ ID NO: 6867828 - DNA, 81 bp, Homo sapiens
gtgcccatccaaggccggcccatggtggccagcttgcacagcagggtggatggcagggccagtcatggggaaggagggcac

SEQ ID NO: 6867829 - DNA, 64 bp, Homo sapiens
tcagaattggacaatagaagcacggtggttatgtaccatagctctgttaacagtccagctttga

SEQ ID NO: 6867830 - DNA, 68 bp, Homo sapiens
attatagccctaaccctccatgtgactgtatttggaattcagtggggtcataagggtagggctctaat

SEQ ID NO: 6867831 - DNA, 87 bp, Homo sapiens
ctgtgtttccttcatgagtgagtatctcaagatacaggaaatggaaattgctggtatcttaggtcctcggctcagaaactggcacag

SEQ ID NO: 6867832 - DNA, 61 bp, Homo sapiens
cacagctggggaagctgaggccgtgtggctcacagtcctggccttggtggctttgctgatg

SEQ ID NO: 6867833 - DNA, 58 bp, Homo sapiens
acttaagagtatgaggagagccctggtttatgtcagctccagtcatagcctcttgagt

SEQ ID NO: 6867834 - DNA, 59 bp, Homo sapiens
tggcactggaatcgtagccttggttgtgaccctgatcagggaggcaggctccagggcca

SEQ ID NO: 6867835 - DNA, 64 bp, Homo sapiens
gaggcatgattttctccctggcaactgactagagtcaagattgaaggaggcgaaaattggtctc

SEQ ID NO: 6867836 - DNA, 58 bp, Homo sapiens
tttcttgttaaggtatttgcgtatttcactgaatatgtctctgaaccttagcaagaaa

SEQ ID NO: 6867837 - DNA, 86 bp, Homo sapiens
gtagagtttgagttgtgatcactgaaagcatcacaacttattactaacaatgtgtgcttcagtgtgtcattatttacagcctttac

SEQ ID NO: 6867838 - DNA, 97 bp, Homo sapiens
tccctcttgtcctgcacaagaggactaactgaactctaacgtcagaacggctgacgagcagttgattgtccttgcttgtgttgttgacaggggtggg

SEQ ID NO: 6867839 - DNA, 93 bp, Homo sapiens
gattttggaaagtgttgttttcattgagcacctgagtaacaaagacttgtctgccagacctgactcagtagaatctgagattgttccaaaatt

SEQ ID NO: 6867840 - DNA, 68 bp, Homo sapiens
gcatgggccccttctgagtgtggacccctgtgtgactacacatgtctcaagccagaaggctgcattgc

SEQ ID NO: 6867841 - DNA, 97 bp, Homo sapiens
tcctttaagtccttggcaatgatttcagagctggtgtctacagctgcatctgacatggtggggcacgccggtgatctgatgcaggggattaaaaaga

SEQ ID NO: 6867842 - DNA, 64 bp, Homo sapiens
ctgagccttttagagggtcatttttgtcccagctctcctctgaatgcccttcactcaaggccag

SEQ ID NO: 6867843 - DNA, 91 bp, Homo sapiens
tcaagtctatacatggttgctttgttgatgacattgtcctaatgctgccctttgtgttctcttatgtaaccttgttaccatggaaacttga

SEQ ID NO: 6867844 - DNA, 72 bp, Homo sapiens
ccccctgctccagtagccccatgtggttcggtccacaactgggcctcttccattggctctgaagtcaggggg

SEQ ID NO: 6867845 - DNA, 71 bp, Homo sapiens
tgatgggtgagaaatttgggctggaatgtggtcttcccgatgtgccagtgttcataattttacactcttca

SEQ ID NO: 6867846 - DNA, 107 bp, Homo sapiens
gagctctgatttcaagtgtaaggtttaaggtctataaatgtttgctagaggggagaataaggaagtagttataaacctatatacctctcacatcttctgcagagctc

SEQ ID NO: 6867847 - DNA, 61 bp, Homo sapiens
taggaacacacatgtgtagctgtctttcgtatctacctgaagtcacacaatggtgtttttg

SEQ ID NO: 6867848 - DNA, 69 bp, Homo sapiens
gtctgctttttagggattagtgtttgaggaggtttgcagctgctcagcacattcctaagggatgcagac

SEQ ID NO: 6867849 - DNA, 62 bp, Homo sapiens
ggctgtctctgtgactgccacccaaagaatctctcacctggaacagagatagaaagacagcc

SEQ ID NO: 6867850 - DNA, 59 bp, Homo sapiens
cctggagaccagaggatacttcatcttcagtccaagagtagttcctttggtcttcaagg

SEQ ID NO: 6867851 - DNA, 67 bp, Homo sapiens
ggtggggggatgtcgtgggtggcagctggggtcctggccagggccagccgcagcatccacacccacc

SEQ ID NO: 6867852 - DNA, 55 bp, Homo sapiens
tcaaagtgagttataaacatcttcaacattggaggataaactaaactcattttgg

SEQ ID NO: 6867853 - DNA, 57 bp, Homo sapiens
tctgtttgtccaacttgtcccgaagacatcaggtcctcggggttgggacaatgctga

SEQ ID NO: 6867854 - DNA, 68 bp, Homo sapiens
ctgtaattccagctacttgggaggctgaggcaggggaattgctccagcccaggtggcggaggttgcag

SEQ ID NO: 6867855 - DNA, 95 bp, Homo sapiens
atttctttgtaccatcttttcctctgcctccttggttaaagtgattactaaggagctacaaaggagtgaaaaaaatcaggtggtgtgtaaggggt

SEQ ID NO: 6867856 - DNA, 84 bp, Homo sapiens
gcatgtggttcctggcttcctgctcttgtcaagtaactagtggcctgattggagctggcagcccctttgggaaccgctgagtgc

SEQ ID NO: 6867857 - DNA, 91 bp, Homo sapiens
gttattttacaagtaattgctactttagaattctctttaagtatctggtcttcttttgaaatggattgaagtggcttattgattaaataac

SEQ ID NO: 6867858 - DNA, 126 bp, Homo sapiens
gacaaatagggaaatggtgaaagttctggtcatggctataaaagaagttttggtacttgggacattagcaaccacgaattctactattccttttatctctctagatttcaataaagcccatttgtc

SEQ ID NO: 6867859 - DNA, 70 bp, Homo sapiens
aaaactgtttaggaggcttatatgcatatttgttccttagctaatgacatctagacttctgcccagtttt

SEQ ID NO: 6867860 - DNA, 55 bp, Homo sapiens
tcaggacgatgatcatcttcataggattcccgacctgtgcctggctttgtcctga

SEQ ID NO: 6867861 - DNA, 75 bp, Homo sapiens
tacaatttatagattttgccctttaaggttttattgcttaatcacaatgaaagtagggtaaaatcacatgttgtg

SEQ ID NO: 6867862 - DNA, 58 bp, Homo sapiens
agtcaggtaggcatcccagggttcatctgtcactagatatggacctgtgcccatggct

SEQ ID NO: 6867863 - DNA, 56 bp, Homo sapiens
gaatggatgctggacaaaatgctgggagggagacctgttattccaggcattcattc

SEQ ID NO: 6867864 - DNA, 82 bp, Homo sapiens
gcaagaatgaatgtgtcccaaactagatgccactgggttttatactggatgtggttttggattattcatgctataaaaatgc

SEQ ID NO: 6867865 - DNA, 89 bp, Homo sapiens
tcatataactctgtttttttcatgcatttaataattgttcttgctgctgtgtctttatcttcttgtatgaaaaggaatagattgaatga

SEQ ID NO: 6867866 - DNA, 71 bp, Homo sapiens
tgcaaggctcagtaataagttggaataaatgtggaaacaagattcctctctttaagcttttacctgaggca

SEQ ID NO: 6867867 - DNA, 61 bp, Homo sapiens
gtaggggtcagtgcgatttcccactcccataacttggagcagtgacgggtactgacaatgc

SEQ ID NO: 6867868 - DNA, 70 bp, Homo sapiens
tctctggggtctagaaatactggtgtccttccagctcttgaaacactggtgccctttctggccccagaga

SEQ ID NO: 6867869 - DNA, 80 bp, Homo sapiens
ttccaaggtgacagggagtgatatagcagagacagagtctcctgtcacttctataaaagacttatcctgtggctttggaa

SEQ ID NO: 6867870 - DNA, 87 bp, Homo sapiens
gggaagttgtcctcaatgacctccatttcttgaatgacccgtggcccacctgctacctctgagatgagtcaggggacacaactttct

SEQ ID NO: 6867871 - DNA, 66 bp, Homo sapiens
gcattgctttcactgcaatagatgaatgtcatgaaaatgttcttctcttgtaatggaatcagatgt

SEQ ID NO: 6867872 - DNA, 77 bp, Homo sapiens
ggtggttcctgtccatgttaagccccttgctgcagagatgtgcttgtggctggggttgaagcctggctgtgagctcc

SEQ ID NO: 6867873 - DNA, 61 bp, Homo sapiens
gcaggagcctggctggcccacaggctggcagtggactggtctggccacccgaggcccctgc

SEQ ID NO: 6867874 - DNA, 65 bp, Homo sapiens
gcttttgtgagttgctgagctcagatggcccaaatgggtgggaaggctcagggaattcaggaagc

SEQ ID NO: 6867875 - DNA, 67 bp, Homo sapiens
cttcctttgtgaggtcctgtgggggctcacacatcctgtggcccttacatttctcctctgaagctag

SEQ ID NO: 6867876 - DNA, 83 bp, Homo sapiens
aggtactatgagtaagaatatttttttaaagtgtgctgtgaattctgaagaagacatgagagaaaagtattctgagggttcct

SEQ ID NO: 6867877 - DNA, 65 bp, Homo sapiens
gaatttcaggtacctgtgggatccccaagggagaggtccctttggataggggtagctgacaattt

SEQ ID NO: 6867878 - DNA, 90 bp, Homo sapiens
taccaggtaggaaggagaccacagctgtgatgggaacatgttgactctgtctcaggatggagtctatccagtgtcccaaattacttggta

SEQ ID NO: 6867879 - DNA, 107 bp, Homo sapiens
ggtggaggggcatctgagccaggcctcagagagtggcgggggaagttgggtggggaagtgtgcccttctcattcctctgaggctcatcctcttggtgcctctctttc

SEQ ID NO: 6867880 - DNA, 70 bp, Homo sapiens
attgatggaaggaagcagcagaaattgcctgagaattcttcatggataatgtctctgtttcccccacaat

SEQ ID NO: 6867881 - DNA, 62 bp, Homo sapiens
ggggaaagggaatagtcatttattcaatgaaccaatagttcttgagcatgtaccctttgcct

SEQ ID NO: 6867882 - DNA, 82 bp, Homo sapiens
ccagcagacagcctgagggaggcagtgcatgttctgagccagggcctcaggaggcctgcagctgccattctgcttctgttgg

SEQ ID NO: 6867883 - DNA, 57 bp, Homo sapiens
tttcagaggtgcttggaatgctgatggagttgaatcagcaagagggcctgactgaga

SEQ ID NO: 6867884 - DNA, 69 bp, Homo sapiens
gggctgactcaaccttgcaaaggctattgaatctcaggaagtagaattttgctttattgagttagacct

SEQ ID NO: 6867885 - DNA, 69 bp, Homo sapiens
cattttttcagagagcttttatgtccctgttagtagaatctagtgggcatagtttatctttctgaagtg

SEQ ID NO: 6867886 - DNA, 63 bp, Homo sapiens
ttaaatgttgtatggtgccttcagacggggccattaatctgtttttcacaaaacaatatttag

SEQ ID NO: 6867887 - DNA, 62 bp, Homo sapiens
ggtagcagaagtcaccccgccactgtaccctggcagggccaccgtgggtggcattctgtgcc

SEQ ID NO: 6867888 - DNA, 115 bp, Homo sapiens
gctggggatttgtaaccttaggcttgcttctcctccacagctctaaacaagcatgtgttaaggaaaagcaatctgatgtctgcctaaatataacaggtgaatattgtaccaaagc

SEQ ID NO: 6867889 - DNA, 64 bp, Homo sapiens
tcacttaccacagtgcatgacttctgaaagcagttattcaggggttatcagcactgggtcatga

SEQ ID NO: 6867890 - DNA, 79 bp, Homo sapiens
cagtataactatgacccttctggaactgcttctccacaaaccactacagagcaggcaattttggaaggtcagtatgctg

SEQ ID NO: 6867891 - DNA, 89 bp, Homo sapiens
ggccggctcttttgcatgcaggcccgcctgaatggggcgcctggaggctgcattgaggccgggctgtgtaaactgtagggtgcctcgcc

SEQ ID NO: 6867892 - DNA, 82 bp, Homo sapiens
gccccctgcagtcccaatctcacctcccgctcctggtgtccagattctgagccaggccgggcagggggtaggggaagggggc

SEQ ID NO: 6867893 - DNA, 77 bp, Homo sapiens
ttgcttggagttccctgagtctccctgagtctccaggcaggtggggagcagccgcgtctcagggcagctccaggtgg

SEQ ID NO: 6867894 - DNA, 83 bp, Homo sapiens
ctggagtggagggagggaggtgctggttcacggtcattctctgtaaccaattggcatcccctgagatctccagtccgctctgg

SEQ ID NO: 6867895 - DNA, 119 bp, Homo sapiens
agccggtcctggcttagcacatggtctggctattgtattggcttagcacatggtttggctattgtattagcacaatacaattgtctggttattgtattggcttagcacatgatctggtt

SEQ ID NO: 6867896 - DNA, 85 bp, Homo sapiens
agcactagctcagaggacatgatatttcaggaagactgaaaacacagactaaagaaaaattatgttgcatttctgaaagtgtgct

SEQ ID NO: 6867897 - DNA, 65 bp, Homo sapiens
gcctgttctgccctgagagccttctctgctaggaggtaggttgactgactcagggagaagggtgc

SEQ ID NO: 6867898 - DNA, 64 bp, Homo sapiens
gcatagcagcagtttgggatctttacagatttggagtttatcctatggctagcagatgctgtgt

SEQ ID NO: 6867899 - DNA, 77 bp, Homo sapiens
ccaatatatttccctgaaatttgaagaggaattggagattcctcctaagttgccaggaattatttagaaatgtgtgg

SEQ ID NO: 6867900 - DNA, 71 bp, Homo sapiens
ttctatacaacagtattgtgggccaggtaaatcatgctgttttctgctatcacactgatgttgatgtagaa

SEQ ID NO: 6867901 - DNA, 62 bp, Homo sapiens
tcttgcctgccctgtgtcataaaaggggagtcccttactgcattatcaaggggaaggtaaga

SEQ ID NO: 6867902 - DNA, 60 bp, Homo sapiens
cctgctccatgctcaccatcaggcagctggtggtccttcttgaagagtgagtgcagcagg

SEQ ID NO: 6867903 - DNA, 59 bp, Homo sapiens
cttcttgattgctttcaaaccagactttttatgtttgtggaagataaaggatcaaggag

SEQ ID NO: 6867904 - DNA, 84 bp, Homo sapiens
ttcctgtaccccttctaatcatcctgtcatgtggttagcattataatttctacttgacagatgagggaatggaggctcagagag

SEQ ID NO: 6867905 - DNA, 69 bp, Homo sapiens
gccttggatcaatactattaagatcatatgacttgacccataaatgatttatgtatgtgaaatcaaggc

SEQ ID NO: 6867906 - DNA, 82 bp, Homo sapiens
ggaatgtgagcagacatgatgtaagcagaggccttaaatgtgcataatttgcttttcttgtcatcttgtcttcttatgctcc

SEQ ID NO: 6867907 - DNA, 66 bp, Homo sapiens
caaggcttggggtgtttattgacaggcctagcccatgcagaacgctattcagaacactgggccttg

SEQ ID NO: 6867908 - DNA, 73 bp, Homo sapiens
tgtactttatcttgtggtgggccagttgggccagttacaaaggtctgtggctcagcacggggtcaggaataca

SEQ ID NO: 6867909 - DNA, 57 bp, Homo sapiens
gattcaggctggcaggcagaatttggccttggggctatagcctgccaactcctgatc

SEQ ID NO: 6867910 - DNA, 83 bp, Homo sapiens
agcttcctgtacagaaattcctactacatttcttttctcatgatgcacattatgtataggagttatctgttgtgtgggaggct

SEQ ID NO: 6867911 - DNA, 63 bp, Homo sapiens
ttctttcaccagtgaaacaggggttatactactcactgtttaataatattgttaagggaggaa

SEQ ID NO: 6867912 - DNA, 56 bp, Homo sapiens
ggtgtaactgagcatccacgtgtcacccatctgcctgacacgtgctgagttccact

SEQ ID NO: 6867913 - DNA, 91 bp, Homo sapiens
aaatgatgtgcacatgtgaaatttagaaatttcttttcataaggccttcttcccttaaggagtttcaaagcttccatgtgttatctcattt

SEQ ID NO: 6867914 - DNA, 125 bp, Homo sapiens
gagatgtatccataataagccctgtaacatttaaaccaacttgtaaatgcctttccaaaggcagtgctaccccggaagttggttggagaattgctgaatttgctactattggggaaaaacatgtt

SEQ ID NO: 6867915 - DNA, 67 bp, Homo sapiens
gtcatcttcagttcaaggtggaaggagaaacctgagtcctttgaccgtatcatattgacagcgtgac

SEQ ID NO: 6867916 - DNA, 58 bp, Homo sapiens
tctctcaagaacagacgccacgccttcatccaagtgtttgatttgttcattgaagaga

SEQ ID NO: 6867917 - DNA, 78 bp, Homo sapiens
gggtgaggtggaccagcatgtgatctgtcaggcagggctgctgcactgtggtcaccaggctggggccaacagacactc

SEQ ID NO: 6867918 - DNA, 109 bp, Homo sapiens
gtaggtatttgcttgttgaataaggaattgtatggttggttactctttacggtcaaagactctaactcatgccattgctgatggtatataataagccaggaataaatac

SEQ ID NO: 6867919 - DNA, 95 bp, Homo sapiens
gggctgatccctcccccagctctgctgggtcccggggccacagcgtcaggccggtgggggtggaggtagaggtgggagagcaggggagagagcct

SEQ ID NO: 6867920 - DNA, 73 bp, Homo sapiens
acagagtaggtgctgtcgactggcttcctgactactcacagaccacagtcttgccagtaccaatgccatctgt

SEQ ID NO: 6867921 - DNA, 85 bp, Homo sapiens
tactgagcccatactctgtgcagagaactgtgagttctctggatgtgagcagcttacagttcaatgacaaagacagggctgtgtg

SEQ ID NO: 6867922 - DNA, 60 bp, Homo sapiens
actgcctctgccaacgcccctgcactgggcagccctgggtacctggcttgggggaggagt

SEQ ID NO: 6867923 - DNA, 69 bp, Homo sapiens
tggaggggaggagacggagtgattagtgtcttctgaaaggcctgtggttacgcctgtttccaaactcca

SEQ ID NO: 6867924 - DNA, 83 bp, Homo sapiens
tattaggttggtgcaaaagtaattgcagttttgccattacttttaaatggcaaaactgcaattacttttgcaccaacctaata

SEQ ID NO: 6867925 - DNA, 58 bp, Homo sapiens
ccctgcccactgctggccaccacccccggctcccctcagggtggggcccagtgggggg

SEQ ID NO: 6867926 - DNA, 70 bp, Homo sapiens
catggaagctgaggaatggttcttttggttgtactgtctgtagcagacaatggaccaagcaccttccatg

SEQ ID NO: 6867927 - DNA, 62 bp, Homo sapiens
gatggggcaggcagcaggtagtgtgttgactcctgaattctacaaagctgtatagcctggtc

SEQ ID NO: 6867928 - DNA, 99 bp, Homo sapiens
cgagagatcactggtttctgctccagtgatgcaagtccccaactctgagtagctcaaatgatgtgcagcaccggagcctgaaactaagagaacatcttg

SEQ ID NO: 6867929 - DNA, 112 bp, Homo sapiens
atataccatgtggcattacttgcttttagcttgcggtgttttgcagttcaggatttagtgacattgaaagtaataactttgttcaagtgcaagtgatgcaatgtgtgtgtgt

SEQ ID NO: 6867930 - DNA, 67 bp, Homo sapiens
agacacaggctcagaagccagtggagcctttcagggtggggacctcactggttttagggtcacgtct

SEQ ID NO: 6867931 - DNA, 57 bp, Homo sapiens
cgctgcctccaggtgcagcaggatcccattgagctgctccatctgcagggcgtagcg

SEQ ID NO: 6867932 - DNA, 97 bp, Homo sapiens
tgagctgctaagaggtggcccagcctattttatggtactgtaaatattgcgaatttagagaaccaatgaatagtcttgctacctatgcattagctta

SEQ ID NO: 6867933 - DNA, 90 bp, Homo sapiens
ggggcaggctgggcaggagaaggctgcacacggaacctcagtgagtccccatggcctgcctcctcctggtgccacccaaccgcctgcccc

SEQ ID NO: 6867934 - DNA, 76 bp, Homo sapiens
ttcattgcagactaacaatctcaaaagaatagattggtgctcgactgaactgtgtcctgagatgtttctaaatgaa

SEQ ID NO: 6867935 - DNA, 66 bp, Homo sapiens
ttaattttatgacagtgtattttaggaataaatgcattccccaaaggggcactgacatataattag

SEQ ID NO: 6867936 - DNA, 74 bp, Homo sapiens
tctttaaaagccttggtcatctggttccctgaccctaaatgattgagaggaatcagagcagaggctgttagagg

SEQ ID NO: 6867937 - DNA, 102 bp, Homo sapiens
cctaagcctagcgccctcacctgttcaacagcaataatcaggcctgtcttgcctacctcactagattattgcaagcagtgaagggacgtgaacaggctctgg

SEQ ID NO: 6867938 - DNA, 83 bp, Homo sapiens
ggaaaagttttcctgtgctcaggtcttttatgaattataaataaccattcactttggaagatagcacatcataaaattttttt

SEQ ID NO: 6867939 - DNA, 77 bp, Homo sapiens
agttcccaaacagaaattccagagatgtcttaaacattgtggtcatcattgagataggtggaatctctttggtgact

SEQ ID NO: 6867940 - DNA, 101 bp, Homo sapiens
gggactctgactatcacccctgctctgcagtggatttggctctcagcactcccaggctgggagctggatgccctgccctggcagcatgactcagactgccc

SEQ ID NO: 6867941 - DNA, 81 bp, Homo sapiens
tggttgatttctttccccatctcctaccattgagttagggttctggtttaggcttctggtgggagcatgactgaaatgcca

SEQ ID NO: 6867942 - DNA, 71 bp, Homo sapiens
tacaaggattcactgttgggtggaagatttgctgggaacaagggttatttttgcagccacagtgccttgta

SEQ ID NO: 6867943 - DNA, 62 bp, Homo sapiens
acctcctcttgccaagacatactgcatcactatttctgttctctgtggcagcatgatgaggt

SEQ ID NO: 6867944 - DNA, 73 bp, Homo sapiens
gcaagtttcaaacggtgcagcagtttgttcagcttccactgaagggagcatagaaagctatactgaaatatgc

SEQ ID NO: 6867945 - DNA, 69 bp, Homo sapiens
agtgtgtgtgtgtgtgtgtgtgtgtgtgtgtgtgtatttatgcagatgatgtagacagacagtgacact

SEQ ID NO: 6867946 - DNA, 75 bp, Homo sapiens
aaatgtaagaagggataaaagcagatttcacagattcttcagcgctttgaaaataggctgcatctccttccgttt

SEQ ID NO: 6867947 - DNA, 68 bp, Homo sapiens
gcttctacacatgagtgagaacatgcagtgttcaactgtcagcctctcagttcattgttcttagatgc

SEQ ID NO: 6867948 - DNA, 84 bp, Homo sapiens
attgcctcaggttcatggccagctcagagcactcagttactgacaggcatgtgtgtggacgagcgtggcccatctgggtgcgat

SEQ ID NO: 6867949 - DNA, 124 bp, Homo sapiens
ggggagctgggtgaccgggtggaggtagcgggtgggtgatgggccctttttggaatcagaaaatgttgttggaaggcaccctccatcactcacccagctagcggcccttggagcccatctccct

SEQ ID NO: 6867950 - DNA, 84 bp, Homo sapiens
ccctaaagtgttatgaatgatctcttaaaagattttaatgactccatcagtcatgatctagtaggaaatggcacattcaaaggg

SEQ ID NO: 6867951 - DNA, 103 bp, Homo sapiens
ttttccccctacatgtgcttaatttgcaggaagtttaacatctgtgaagctgctcatctgacggccccagagattaaagtctgtttattggcataggggagag

SEQ ID NO: 6867952 - DNA, 79 bp, Homo sapiens
gtggcaagttagggagcagttaaaatgattccttgttaccacagggctgacatatttggtgctctaatgacttagctgt

SEQ ID NO: 6867953 - DNA, 67 bp, Homo sapiens
aggatgactcctgagatttctggcaattggtatttattcagcagatcagagactgtaggagcagcct

SEQ ID NO: 6867954 - DNA, 66 bp, Homo sapiens
ggtactggaagtggccctaggaagcagaacctcaggatggtattattgaaggatcacttctgtacc

SEQ ID NO: 6867955 - DNA, 64 bp, Homo sapiens
tttggtcctaagctgctctctagcatgatgatcctagctttaaagagggaaacagcaggctaag

SEQ ID NO: 6867956 - DNA, 84 bp, Homo sapiens
ctccgcctgtgctctgcagggccttttagcatcttctcatctggtgggaggaatgcaggcccttggaagtacgaatgcagggag

SEQ ID NO: 6867957 - DNA, 119 bp, Homo sapiens
tccttccgagttgggccctgggccacttctcctaggagccccttcctctgggtccacactgggtgctagcgaggtgtttctaggactgtttccccagcaggctctcagctctttcggga

SEQ ID NO: 6867958 - DNA, 57 bp, Homo sapiens
cagggagtctggttgtctaagattttttctggcctttcagcaaccacagattctttg

SEQ ID NO: 6867959 - DNA, 65 bp, Homo sapiens
gattatggagacaggcagctagtgggtcagtgaactagattctgtatgtctgctctctaattgtc

SEQ ID NO: 6867960 - DNA, 108 bp, Homo sapiens
gtggtgatagtttgtgggcagttaacagtggtggagggctgtcctgtgcattgtagcaagtttagcaggatccctggcctccgcccacttagatgccattagcaccac

SEQ ID NO: 6867961 - DNA, 77 bp, Homo sapiens
cagagagttccacccgtgtgtccaaggccacaatagctaatccatgatggagctggaattggacccagggctctctg

SEQ ID NO: 6867962 - DNA, 65 bp, Homo sapiens
cctgttgagacagtttcctttcagtgattctttctgcataactttaagaggcagtctccaacagg

SEQ ID NO: 6867963 - DNA, 58 bp, Homo sapiens
tgcaaatatttccttatagccagagcttgagtgtgcaggggtaaaaggcagtgttgca

SEQ ID NO: 6867964 - DNA, 65 bp, Homo sapiens
tgtgcagttgtggacatgacaacttaagattaataaaaagctgtctcatcttccacatcagcata

SEQ ID NO: 6867965 - DNA, 74 bp, Homo sapiens
aagtgttctctgtggagttgtaaattttctttcatggctggggtggacggattttacttccatggttagtgttt

SEQ ID NO: 6867966 - DNA, 65 bp, Homo sapiens
tctacttgtcagtcttcaaatcagagaaaatcaggatcaatatctgctttgggaaagacaggaga

SEQ ID NO: 6867967 - DNA, 59 bp, Homo sapiens
taggaaaatatctcttattgggaacacaagtaaaaaatgtgtaaagggatatcgtccta

SEQ ID NO: 6867968 - DNA, 55 bp, Homo sapiens
ggagatggtgtgcccgcaggaagcccttccaccttcctaggcatgctgagtctcc

SEQ ID NO: 6867969 - DNA, 67 bp, Homo sapiens
tccccgcagtggaagcctctttaagcaagtctctcttctctgcatatgtaggctttagctctgggga

SEQ ID NO: 6867970 - DNA, 62 bp, Homo sapiens
ggcttacacttcatctcatccaggagcatctgtcttgggggcccctgggatgagggtgggcc

SEQ ID NO: 6867971 - DNA, 71 bp, Homo sapiens
acctataacggccctctccaactctgttccaagtagatctgaacttggtagaatgggaatgaggggtgggt

SEQ ID NO: 6867972 - DNA, 60 bp, Homo sapiens
tgagctccggcatatggaattagcatgatagaaccatgacatgccaagtgccgggagcca

SEQ ID NO: 6867973 - DNA, 65 bp, Homo sapiens
tgttgctaaaagattaattgcagaaggtgggtcgatttgattaaggcaattaatttttggttaca

SEQ ID NO: 6867974 - DNA, 91 bp, Homo sapiens
tctcagaaggaattttattctaatgttctttcaaataataaaaccttttgtttgaaaggaattaggatgacaaaaacctaagattatgaga

SEQ ID NO: 6867975 - DNA, 55 bp, Homo sapiens
gggatgtgggagtgaaggtcaaatcccaagagagaccagcattccacactgtccc

SEQ ID NO: 6867976 - DNA, 66 bp, Homo sapiens
tttcatatgagcatgacacctaccatattaagtcacaaacacacgtgactgtcatgccagatgaga

SEQ ID NO: 6867977 - DNA, 130 bp, Homo sapiens
cactgatgcccggggtcaaagggctcttgcagtcacctggtagtagaagccttaagaagtgcatggtagtagattttcttctagggatctgctgctgttttgttgctgccctccccactcggcttcaatg

SEQ ID NO: 6867978 - DNA, 81 bp, Homo sapiens
ctgcccaagttggcagcccagcaccaatcaataagtcctgcatggaagagtgatgtgcgaggtgcttgtcagcatggatag

SEQ ID NO: 6867979 - DNA, 62 bp, Homo sapiens
ttcaggcccatcccattctgaaagatagttgaaatttattagaaaggcttatggtgccttag

SEQ ID NO: 6867980 - DNA, 81 bp, Homo sapiens
tacttgtgtaaacatcagtacaaagactaaaagctcattgtaatgaatatgttagttaattgactatgttgcatacaggta

SEQ ID NO: 6867981 - DNA, 92 bp, Homo sapiens
gatttattaggctggtacaaaagtagttgcggtttttgccgttactttcaatggcaagaaccgcaattacttttgcaccaacctaatgattc

SEQ ID NO: 6867982 - DNA, 115 bp, Homo sapiens
cattttctgccagctctgctgttgtctgtaccatttggggtctggcccactccctgatgagaggagcccccactgggctcaccccagccctgccagcagcctctgcccggatgtg

SEQ ID NO: 6867983 - DNA, 68 bp, Homo sapiens
aggaatttgtaggcagaggtatggtaaggactgctaagtgattactggtatccctcctttcttttcct

SEQ ID NO: 6867984 - DNA, 59 bp, Homo sapiens
ttgccctagggtcttatcctccacattccaccacactgggtgctggtgagaccgggcag

SEQ ID NO: 6867985 - DNA, 74 bp, Homo sapiens
aggcggggaggggaatgctgaataataagattactcagagctactaacgatcttgattcagtaattttctgctt

SEQ ID NO: 6867986 - DNA, 77 bp, Homo sapiens
gatcaaacaagttctctaggaagtataaaggtttttactctaattcttttggcttaaagagaatgtatatttagatc

SEQ ID NO: 6867987 - DNA, 86 bp, Homo sapiens
atatggggtgatgaaggactcctattttatattttacacacttccaaactatttgaatgatatgtgaaaaggaacatgcctcatgt

SEQ ID NO: 6867988 - DNA, 112 bp, Homo sapiens
gaaataatagataattcatgctttttaacgaaggaaggaaacaagaagtgaatgagaacttcaattctcagaacttcagttttcttaatgaaggtgatattatctattattc

SEQ ID NO: 6867989 - DNA, 58 bp, Homo sapiens
gatggtacatagtttaaataaggcagacttatatcttgtctatgatctgtgtgctatt

SEQ ID NO: 6867990 - DNA, 129 bp, Homo sapiens
tgataatgtgtcgtagctgtctgggagcagagctccgggaacgcatggggcacatacgaaagccaggctgtctgtgcctcaccctgctcttggcggctctggggccagggctctgaatcacattactgg

SEQ ID NO: 6867991 - DNA, 58 bp, Homo sapiens
taattttgtcacagtgacatgccctgtcacagggcgtatgtgttctgttatacagttg

SEQ ID NO: 6867992 - DNA, 63 bp, Homo sapiens
gacagtagtgccatgacctacagcccactgcccgcccgggctgtagaagaatcacttgctgtc

SEQ ID NO: 6867993 - DNA, 65 bp, Homo sapiens
ggggctggtgtgggctgaagcacccagcttggggacatgcttgtgtaagaagcctatgtcatccc

SEQ ID NO: 6867994 - DNA, 113 bp, Homo sapiens
aggaagataatgctattatgttgaaccatatgaaattgtcatattttataggtcagaaatggttgaatcttggcagtttcatgtgattcaactgaatactattgcattttgct

SEQ ID NO: 6867995 - DNA, 86 bp, Homo sapiens
gctaaattttaccaaggtcttttaagtcctttggctgaaacaggtattcaggacagtataggctttaggagaatatggtatttggt

SEQ ID NO: 6867996 - DNA, 55 bp, Homo sapiens
aactcacagtctcaagatgctggtgctaatgtacattgcagctgacactggagtt

SEQ ID NO: 6867997 - DNA, 130 bp, Homo sapiens
gtgggccttagggcaatgggctgaggaggccactcagcctttatttagttttggcttaggccagaggtgctgggagaggtctgtagttcaagtgggctcctgggcagctcacctgggccagggggtccac

SEQ ID NO: 6867998 - DNA, 69 bp, Homo sapiens
tcagattgggattaagaatttaacttattcattcaagaatgaattcaagttgttgagccatatttctga

SEQ ID NO: 6867999 - DNA, 129 bp, Homo sapiens
acttggtcatgggtctgtgatctccattctcactgttgactgggctgcctggttcttctaccagatgtctggtggagggcaggagctcaggaaataagtgtgagtgggatgcacatgtaactgaagagt

SEQ ID NO: 6868000 - DNA, 66 bp, Homo sapiens
ctgtttctcactttccagacttttcaaaattatcagtaatttatgaagggtggagaagagcaatgg

SEQ ID NO: 6868001 - DNA, 77 bp, Homo sapiens
cccatgcttctgcctcctccatccttctcatgcagggtgccccagggagtgggaagatggagtgacaggcagcaggg

SEQ ID NO: 6868002 - DNA, 59 bp, Homo sapiens
tcagactctcatctggttcctcagatcaccctgaggacatttcaatactgagggtctga

SEQ ID NO: 6868003 - DNA, 61 bp, Homo sapiens
gccattatccaggaagaggtgtgttgggaaagattgatttctctgaacttcctggaaaggc

SEQ ID NO: 6868004 - DNA, 106 bp, Homo sapiens
ctttgtcccatagagatgcagatgttgtgaggctggtaaacagactacaacccaacagttagttttattaccctatgcggcactaaccagtttttatgtaatttag

SEQ ID NO: 6868005 - DNA, 121 bp, Homo sapiens
ggggttatatttatttgcccaagtttgtgcagttagttattaggtggcagagctgggattttaatccagtttctaccaaaactctgctcttaatgtgcatgggtgaatggatagaaatttc

SEQ ID NO: 6868006 - DNA, 65 bp, Homo sapiens
catcggcagggatttgtttaagacgagaaggctgttggcctacgtgcaaggtccctgcccctgtg

SEQ ID NO: 6868007 - DNA, 76 bp, Homo sapiens
ctcgacaagtatagcacactggggagatacaaagatggagtagctgcaccccttccccaggtgctcactgtctggg

SEQ ID NO: 6868008 - DNA, 77 bp, Homo sapiens
gcaaaagagtgcttaaattgtgtgatccagtgcttaaagtgggacagagcatttaattacagtttaattatctttgc

SEQ ID NO: 6868009 - DNA, 55 bp, Homo sapiens
aagctgtgctcttatgatttgtgcactttatgcatgtcatatttcaatacagttt

SEQ ID NO: 6868010 - DNA, 111 bp, Homo sapiens
gcagaggtagcaattggttagatggtgagtcaggaggccatacaggcctcacctctcagagggctgcagcttggcctctgcaatggattcacctgataagtttgcctttgt

SEQ ID NO: 6868011 - DNA, 58 bp, Homo sapiens
gggcccggggatgctacactccgccgttcccgtcgaccctgtggtttcccggcggcct

SEQ ID NO: 6868012 - DNA, 66 bp, Homo sapiens
cacagattatgagacgagatactgggtataaactgatgaacaaactctcatggtttctggtttgtg

SEQ ID NO: 6868013 - DNA, 86 bp, Homo sapiens
ggaaagaaatgtaaccttgtgagtgacagttcccttggttcaaagcaattactagggattacactgtattcagaaggcagaaatcc

SEQ ID NO: 6868014 - DNA, 71 bp, Homo sapiens
agagaggtttgctggaagattctgagaataaagcttcctttattatgaaaaatctttcagacaatttctct

SEQ ID NO: 6868015 - DNA, 59 bp, Homo sapiens
ggcagggtggtaccagcatctagtgagtagaggccagggatgccgctacacatcctgct

SEQ ID NO: 6868016 - DNA, 87 bp, Homo sapiens
ataaaagattgatataattagatggggcttggtaacaaatactattacattatgtctgaatcttatttaaatatattggccttttat

SEQ ID NO: 6868017 - DNA, 79 bp, Homo sapiens
ggtggctggggtgaggcaggtggctgctgaggagcaagagggatctacagttgtcccctgccctatgagaagggccacc

SEQ ID NO: 6868018 - DNA, 56 bp, Homo sapiens
ccgatttggcagggttcttgctgaaactagattttacaaggaagtgcacagatggg

SEQ ID NO: 6868019 - DNA, 98 bp, Homo sapiens
gtattgaaatgcagattgcattgatttgctccaagttattgcaaggtaagaggaaacagttatcttagggtaaatcaatataatctacattaaagtac

SEQ ID NO: 6868020 - DNA, 77 bp, Homo sapiens
cctcaactaaaagacgagaacatgaagtctccaagagttaaatgacttacacacagtcctcagtcagtttggtgggg

SEQ ID NO: 6868021 - DNA, 63 bp, Homo sapiens
gaggtgaagcctgtagtgaccagaagacatgaaaattccctgagcttcatcaggcttttcctc

SEQ ID NO: 6868022 - DNA, 62 bp, Homo sapiens
ttaagtttgagtgcctctgggatttccaggtagagattcccagtgggtgactggaggcttgg

SEQ ID NO: 6868023 - DNA, 61 bp, Homo sapiens
ggctgggctgctgggtcagagcccttctccttccagcatcccgtgacctggcagtgcggtc

SEQ ID NO: 6868024 - DNA, 90 bp, Homo sapiens
tgtatgtatgtgtgtatatatatacacatatatgtgtgtgtgtatatatatacatatatgtgtgtgtgtatatatacacacacatatata

SEQ ID NO: 6868025 - DNA, 68 bp, Homo sapiens
agtgctatgcagctgacattttcatgttctgacttgatagaactggattattcagttgctgcttcact

SEQ ID NO: 6868026 - DNA, 61 bp, Homo sapiens
gtcctctacggacctcatctccaggcaccactgagatgcttttggtccaagagtccatgac

SEQ ID NO: 6868027 - DNA, 97 bp, Homo sapiens
cccaggcctctggctctggggtgtgatttggctagagatggatccaggactctttcccctttaggtccctgcccaaagcccttggggcagaggtggg

SEQ ID NO: 6868028 - DNA, 82 bp, Homo sapiens
gtgcttacttttgctcatccatgaccgtgtttcccaagcaaccgatacttggtaggcgttgaatgaataaataaataagtac

SEQ ID NO: 6868029 - DNA, 90 bp, Homo sapiens
gagtcctttgtgaaagcagcatgttcattacattattcagtatcaaattattagacaaaatgaaatatgttgccttctgccatagggctc

SEQ ID NO: 6868030 - DNA, 75 bp, Homo sapiens
ggtctaggatgggatcagggctcaggtgcggagagacagagttcctccaggtagctaagtcctggggcttggacc

SEQ ID NO: 6868031 - DNA, 89 bp, Homo sapiens
gagtgggtaagtattccagtgagaacagagacaggggagctacatacataaaataactctttcattcattctttctgaatatattcatc

SEQ ID NO: 6868032 - DNA, 59 bp, Homo sapiens
ttttcattgaatatcttctttgtgccatctgctacacttttgggatatatcagtgaaga

SEQ ID NO: 6868033 - DNA, 130 bp, Homo sapiens
gcaagtggctatttggagtacaaaatttaaggaggcactcactctcagggtcacagagctcagagtcggcaccctcaggacccgaaagtgagcacctccttaaatattgtacgccaggtgtctcgcttgc

SEQ ID NO: 6868034 - DNA, 69 bp, Homo sapiens
aggtctggaatcagacctaatcccagcctctctgctagtttgctgggattaggtctgattccagaactt

SEQ ID NO: 6868035 - DNA, 74 bp, Homo sapiens
aggtgaaagtgttttgcgtactgaagaatgcaattgtatttattgcattcatcttcatgaaagcacattcattt

SEQ ID NO: 6868036 - DNA, 65 bp, Homo sapiens
gggtacaaggagtgaaggtttggaaaggggagcaggtttccaaagagtcaagcctccctcttccc

SEQ ID NO: 6868037 - DNA, 55 bp, Homo sapiens
ggctttttggctttggttcctggagcagcttcagagccataaaggtgaaagagtc

SEQ ID NO: 6868038 - DNA, 64 bp, Homo sapiens
tccctgcagagttgatgcaagtactgagctgcctttgaagtcagcttgcatcatctttgatgga

SEQ ID NO: 6868039 - DNA, 130 bp, Homo sapiens
aaattaagtggaaaatgagtatatttggattgcccttaatgactgtaccaaggcttcatgtgctaaacagagtggctggtcttgtggggtcacctgggccttgtttttcagcctccctttcttataactt

SEQ ID NO: 6868040 - DNA, 59 bp, Homo sapiens
ttgcagttgctgtatttaaggaataaatttgaccttgagtttcctgacagcgaaggtaa

SEQ ID NO: 6868041 - DNA, 60 bp, Homo sapiens
ctctgttgaccagcagatgtggaacatttgcagcttcacagaaagttctgctggacagag

SEQ ID NO: 6868042 - DNA, 65 bp, Homo sapiens
ccatgctctgggcttttgaagtggctgatgacatcactagtttgtttactcagataaatgcatgg

SEQ ID NO: 6868043 - DNA, 58 bp, Homo sapiens
agaagttatggtgcccagcctctgtgtgcaagacagagacaccgcgcatcatggctct

SEQ ID NO: 6868044 - DNA, 76 bp, Homo sapiens
taatagggaaccaaattctcttactgtttgacataacaaagttatgagtttgttatgagagtttggttccatatta

SEQ ID NO: 6868045 - DNA, 75 bp, Homo sapiens
acatttaggttcttactgtcttcaatgtctagctctgtggaggctgacaatacagagagagcaaaaactaagtgt

SEQ ID NO: 6868046 - DNA, 129 bp, Homo sapiens
ttagcttttcattatgactgcttttctctgtgttacttaattagaatctgcagcttttggcaggaaaatagtcaaccaagcagatttctaataagcaatgtctttaggggagaaagtcgaagtgagcaa

SEQ ID NO: 6868047 - DNA, 107 bp, Homo sapiens
ctgcatgcttgtttgtatcacccattccacagatgaaaattaagtttgttcaaaacctgcagtttttattctgagacaggggaaggtgaaacaaagaaagtatgtgg

SEQ ID NO: 6868048 - DNA, 76 bp, Homo sapiens
ccttccaggaaagcaggaaattcccgaggtcacacttcagattgatctcagaaaacctctttcttgatagtgaagg

SEQ ID NO: 6868049 - DNA, 56 bp, Homo sapiens
gtagcttgaagaagattgtagagcagagctgcagtacaattgatggcttaagttgc

SEQ ID NO: 6868050 - DNA, 89 bp, Homo sapiens
gctgcttaggaagcgggacctgtgcagccctgcattgtctccagattgctgttaccaacaggttcccacttccgcttcccgccagcagc

SEQ ID NO: 6868051 - DNA, 63 bp, Homo sapiens
ctatattggcttcatcaaaggggtttttcacacaagaagaagtctattgatggcagtccatgg

SEQ ID NO: 6868052 - DNA, 60 bp, Homo sapiens
catgttccatgaagcattatgttatttacttagacattttaaaatgcatttatggagatg

SEQ ID NO: 6868053 - DNA, 128 bp, Homo sapiens
ggggacccctgttcgtgtcatccacagggtgctgtgggcccagaagcgcccatgcctgagagcgtccaggaccaggcagagctgggccttaagggcccttggaccagtgtctgtctgcagggagcccc

SEQ ID NO: 6868054 - DNA, 102 bp, Homo sapiens
gagggagggttggagctgctgggcagagcaggggcaatgtgttgcaagcacagggtaatgctgcctcacattggaccctgctaggccctttccacctcactc

SEQ ID NO: 6868055 - DNA, 65 bp, Homo sapiens
atgcagtaaatgttaagaaaaagaagatagcaattatgagttgtatttcttagcttttgctgcgt

SEQ ID NO: 6868056 - DNA, 95 bp, Homo sapiens
gcagcagggctggatgcaggtggccagggagctgtgctggagcccggctgctcaaaccacagatttggcccagccaatgcccctcagctctgcgc

SEQ ID NO: 6868057 - DNA, 71 bp, Homo sapiens
ttttgctggtttatctctattagttggttttcctcttcagtcacctttctaaaagtggataagctgtagga

SEQ ID NO: 6868058 - DNA, 61 bp, Homo sapiens
gggggatgaagctatttggttggcactacataaagagcccacctttggttttatggctccc

SEQ ID NO: 6868059 - DNA, 73 bp, Homo sapiens
gtcttgatatgagaaattatacctaggtttgcacttctttcgcaaggctaattattggtttctcaaacaaaac

SEQ ID NO: 6868060 - DNA, 61 bp, Homo sapiens
tcagacatgggatatgaagctctgagaacttctgactcatttgtttggatcccctgttaga

SEQ ID NO: 6868061 - DNA, 65 bp, Homo sapiens
ccgcctcgggaagtgccctcttcaggagaaagtcctatttctctgtaagctgccttctcgtgtgg

SEQ ID NO: 6868062 - DNA, 76 bp, Homo sapiens
tctcctatttcttgactgcttaggaatgcagcaactcatactggtgcattctgagcaattaagaagttatgggaga

SEQ ID NO: 6868063 - DNA, 60 bp, Homo sapiens
tgtggatggtttgagatatgcaatgtgaatgttggattccagactctaaagccctccaca

SEQ ID NO: 6868064 - DNA, 77 bp, Homo sapiens
ggcagaggaagcagctggcctgagcggtggcgggtgagggcaacacgctgtcactgggaggggcagcagtccctgct

SEQ ID NO: 6868065 - DNA, 55 bp, Homo sapiens
ctgccctctagaggaggactgaaaaagggattagccagatttctttgcagggcag

SEQ ID NO: 6868066 - DNA, 76 bp, Homo sapiens
gaaatgaaggcttgtttgttccttcttggccaatcaaagtagaagactcagaggaccaaaaggaaagcaacatttt

SEQ ID NO: 6868067 - DNA, 71 bp, Homo sapiens
ggaggcctacgtagatccatcacctgagcacttgcttgttgactaggtctcatcttgttcatctacccttc

SEQ ID NO: 6868068 - DNA, 120 bp, Homo sapiens
ggaagttggacaagttgacctttattgcagtttctacctatgaggacaaacatgggatcttaccatctcagtttgctcataggtgagggtgagaactggcagcaatgatgtctaagttcc

SEQ ID NO: 6868069 - DNA, 86 bp, Homo sapiens
gtccaggagagtacagttgaaacaagtcaactgtactaactgtactctaaacaagttgacttgtttcaactgtactctcactggat

SEQ ID NO: 6868070 - DNA, 60 bp, Homo sapiens
tcagttctgaagttctgcctcccttgatgtgtcatactcggagacactcttaagaactga

SEQ ID NO: 6868071 - DNA, 60 bp, Homo sapiens
gattaccagcctccatctctgagtgaaggttttaatgcaaagtgcgaggttgctgtaatt

SEQ ID NO: 6868072 - DNA, 71 bp, Homo sapiens
tgtttacaaatgcacagagccttagagataatacattagtgagtttcaggtaaatgtgtatgatgataaca

SEQ ID NO: 6868073 - DNA, 55 bp, Homo sapiens
tgacacactgccaggcgctcggaaactatttacgggttgcctgaagctgctgtca

SEQ ID NO: 6868074 - DNA, 65 bp, Homo sapiens
gggcatggaggtctgtctgcagaggcccgggcctgggcacaaagggagagaggcctccattgtcc

SEQ ID NO: 6868075 - DNA, 64 bp, Homo sapiens
gtcccaggtgggctccacctctgccctctgtgatgtggagtaggggctggggctccttgggtac

SEQ ID NO: 6868076 - DNA, 69 bp, Homo sapiens
ggataatcctagaatatttgtggaggttcccagactgtcttgggacctagagctatattttgggtgttc

SEQ ID NO: 6868077 - DNA, 55 bp, Homo sapiens
tcgatcatcttttatatgtcaagtacatatgtactgggtatacaaagatgaatga

SEQ ID NO: 6868078 - DNA, 100 bp, Homo sapiens
ctaccatacccagcctgtcttttaaattggaaacttcctaacttctttcgttatattatcaaagaatagttaagtttagggcatgttgtgggtagtgtgg

SEQ ID NO: 6868079 - DNA, 115 bp, Homo sapiens
aagatgaaatcttacaagtctttttcatgtcttctgagggctgagatataactttgaagtagagcccaaacatgaagatcatgaagacggcttcttctccaaatgatgttatctt

SEQ ID NO: 6868080 - DNA, 83 bp, Homo sapiens
ctgtactctttaaagtaaaatttgtctctatccaataaagctattaggggcattgttgattactttcacttcaaagaggttag

SEQ ID NO: 6868081 - DNA, 65 bp, Homo sapiens
tttgatggaaggagaaataagcattccatctatatctgattggtccttccttttccttcgtcaaa

SEQ ID NO: 6868082 - DNA, 62 bp, Homo sapiens
ctgcatccaggccaggtcacagaaggggcccagtcaccccgagacctgtgtctgggatgcgg

SEQ ID NO: 6868083 - DNA, 77 bp, Homo sapiens
tgctagtcagtttgactcagtgttatattatccactagtgattataaccctttgaggcagattgatatatattagta

SEQ ID NO: 6868084 - DNA, 56 bp, Homo sapiens
gtggtcttttaagtgagtttgggatctggttacctttaattcgcctcccaggccgc

SEQ ID NO: 6868085 - DNA, 98 bp, Homo sapiens
tctgtgaccacatgcacatcatttaagctctcattattattatttcgttatctataaaatggggagggtaagacttaaatgatatgtatgtttgaaga

SEQ ID NO: 6868086 - DNA, 78 bp, Homo sapiens
cctgtcctggcccagcgaggccacctacaggtgagacgtcccctgtagacggggttcctggtgtcaggaggtatcagg

SEQ ID NO: 6868087 - DNA, 92 bp, Homo sapiens
gcacctggggctttgcagggtttagcacctgtagctgctctcatgggctgggctggtgttgagtgcctgtagcttttccgtacatggggtgt

SEQ ID NO: 6868088 - DNA, 62 bp, Homo sapiens
tccaagggcagcagccatagcccacctccaccccatgagggcctggtgcctgttgtcctgga

SEQ ID NO: 6868089 - DNA, 59 bp, Homo sapiens
ggtcagcccctgctcaaggccggccctcatcctgccttctgaccagcagggacatgacc

SEQ ID NO: 6868090 - DNA, 63 bp, Homo sapiens
ggttctaagacagcatgataggcctctaggcctggcctggactctggctcagtgttgcttacc

SEQ ID NO: 6868091 - DNA, 75 bp, Homo sapiens
atcagctcacattaatgggatgaggtggaaagttggacacactacctcacagtctgcctttcccttgtgctaggt

SEQ ID NO: 6868092 - DNA, 58 bp, Homo sapiens
ggtggtgagctggaaggggctttggtttcccatcaaggcattctcaccaactctcccc

SEQ ID NO: 6868093 - DNA, 63 bp, Homo sapiens
ttggctggaggtcatgtaatatggaagctctttagccttctttgtacatgcacttcttttcaa

SEQ ID NO: 6868094 - DNA, 64 bp, Homo sapiens
tagactagggaatcattcttggattgcaaaattcagcccaaatcaaggaaaatttcctagtttg

SEQ ID NO: 6868095 - DNA, 81 bp, Homo sapiens
tcgtagctacttagagccgttcttaatgtttgccttacacattaaaattagagggggagagaatgtgcgttaataatacga

SEQ ID NO: 6868096 - DNA, 78 bp, Homo sapiens
tgacttaattttctggcagtggatgagggcagcctggtcacaacatctgctacccttttgattgccagggttgattca

SEQ ID NO: 6868097 - DNA, 105 bp, Homo sapiens
aaggagctctgtcaaggatccttaaacactacacatttatttcttgtgagaaaatgctttaactcattgaagcacaggggaaataagttgttgatagaccttctt

SEQ ID NO: 6868098 - DNA, 66 bp, Homo sapiens
ggctgttttctgctcttctcacactacaatggcaggatgtgagtagctgaagcagaacatatggcc

SEQ ID NO: 6868099 - DNA, 86 bp, Homo sapiens
atgtcatgttctgtaaggagaactacattattcctacaaggattcaaattggatcccatgtaggagaatgttacagatcagcacat

SEQ ID NO: 6868100 - DNA, 100 bp, Homo sapiens
ggaaattcggctttggtatgtacagccttgttctctttatcctgcctgccctggcctggaagaacaagcagtgctttcctttcaagggctattgatttct

SEQ ID NO: 6868101 - DNA, 65 bp, Homo sapiens
ctgactcagggatagctctcattcatgcttccaaggatcaatgagaatagctttccttaatttag

SEQ ID NO: 6868102 - DNA, 117 bp, Homo sapiens
tacttaaagcttatgattcttcttaagcaagtgatgatggcaacttcagaatacataccttttagaatttgaatttgaatgattacttctgaatttagaattacatgagctaaggta

SEQ ID NO: 6868103 - DNA, 65 bp, Homo sapiens
agggctggttgttgccagcatggaggtcgcagtctttgtgtcagcccgagcacacagccagcctt

SEQ ID NO: 6868104 - DNA, 56 bp, Homo sapiens
ttctttctttaattttccaactgaggggattatttgtcagtgaattaaggcaggaa

SEQ ID NO: 6868105 - DNA, 55 bp, Homo sapiens
cgctggctcccatgagctctcacggttttgctgtgctttgttgatgacggccacg

SEQ ID NO: 6868106 - DNA, 82 bp, Homo sapiens
cctcaactgtggaccaggggcgcactccctgcacacaagggtgtccagtaggggcggagtcccagggtctccggcagtgagg

SEQ ID NO: 6868107 - DNA, 67 bp, Homo sapiens
tgacccatagttgttcttgcagtgagtattcttctctaatacttatagccagaattaattatgttca

SEQ ID NO: 6868108 - DNA, 60 bp, Homo sapiens
gcctggatcccagggagtcaggctatgtcattagatggaagatgcccttgagatgcaggc

SEQ ID NO: 6868109 - DNA, 87 bp, Homo sapiens
gctcaggagggatggagggcccaggagctgggagctttggtcatctgcagtccagtcatggtgtcctcacaaccgctttgtctgagt

SEQ ID NO: 6868110 - DNA, 73 bp, Homo sapiens
gcccctagtagctgttctctgtaaattggagttaataaatccctatgagaagtggctggtatataacgggtgc

SEQ ID NO: 6868111 - DNA, 81 bp, Homo sapiens
gggggttctttggaataagtcaagctgttggaagctttgtctgggcaaagtgtgtagctgacatctaaaggaactattccc

SEQ ID NO: 6868112 - DNA, 66 bp, Homo sapiens
tgtagtcttagcaacttaaggggctgaggtgggaggatctcttgagtccatgagttagagactata

SEQ ID NO: 6868113 - DNA, 66 bp, Homo sapiens
aaataagttagcagattccagtacattctttggaatgaaggcaggatagggatatgctgagtattt

SEQ ID NO: 6868114 - DNA, 62 bp, Homo sapiens
atcacatagtcatatacctttgcattccaggcacttaaaaagaatgcaaatggctgtttgat

SEQ ID NO: 6868115 - DNA, 60 bp, Homo sapiens
gcctgtttctaatctcatttctttattataacttgagagaaaatgggatgagaaaagggt

SEQ ID NO: 6868116 - DNA, 61 bp, Homo sapiens
agctcaagggttaagatcaagctttgtcagaagacagagctaaatttcaatcccaggtgct

SEQ ID NO: 6868117 - DNA, 92 bp, Homo sapiens
aatggggaactcataataaaactggtaataaaatggattattcaggtgatgctgttttattacagtctcattatgattatataatccttatt

SEQ ID NO: 6868118 - DNA, 60 bp, Homo sapiens
gcagcagcccacagctggaggcctaggagtgtccatgggcatggactgtggagccgctgc

SEQ ID NO: 6868119 - DNA, 71 bp, Homo sapiens
gctgggcatgtaaggaggagtgggccatcaggggatggaggccatacctcctgacatggaataaactgggc

SEQ ID NO: 6868120 - DNA, 73 bp, Homo sapiens
ttgagagcaacaggtgatggggctgtgagcattgaagactttgctggcaggccctggccctgctgtctctcag

SEQ ID NO: 6868121 - DNA, 60 bp, Homo sapiens
tctgtggcagagttgctgactagaatgtgctacgtatttaagttttcctttgctcatggg

SEQ ID NO: 6868122 - DNA, 80 bp, Homo sapiens
gactttttcagtgaaagctactgttaggcatgacatttacaggcaactgaaactgatcagatgcatttattaagaaggtt

SEQ ID NO: 6868123 - DNA, 56 bp, Homo sapiens
catcactggcatcatgggagggctcccatatggggtgctgccatcatgcagagatg

SEQ ID NO: 6868124 - DNA, 76 bp, Homo sapiens
tcatcatgggcattcttggaagccctctgcaagatcctgtttcaagttctgcaagtttggggtccaacctgtgtga

SEQ ID NO: 6868125 - DNA, 81 bp, Homo sapiens
ggcttccttacatgtattcaagtttaatcctgaccacaccacggtcttgtaaatcaggaaggaaacttggaggaggaagct

SEQ ID NO: 6868126 - DNA, 90 bp, Homo sapiens
gttatttggctaaaaatatttgtgttgggtgatgtccctaccctgtccttgcacccaggaactttactcaacaaatatttattaaatgat

SEQ ID NO: 6868127 - DNA, 61 bp, Homo sapiens
gcaatgacagagctgtgcggctggtattcggaaccatcctcacagtgttcgtgtcagatgc

SEQ ID NO: 6868128 - DNA, 64 bp, Homo sapiens
aaacatttgcaactcggtttgggggtttcaacaaagtgccacttaaacttgacaggcaaagttt

SEQ ID NO: 6868129 - DNA, 56 bp, Homo sapiens
ccagctagctcctcgatcaatgcacacttctttaaagtgctgcaggatgctgctgg

SEQ ID NO: 6868130 - DNA, 74 bp, Homo sapiens
ctggaggaccaagtgcactcttagggccccacactgcgagagcacagggccaggagctgcacagggctctgcag

SEQ ID NO: 6868131 - DNA, 57 bp, Homo sapiens
ttcaggaatataggcattgacaagattttcttgtctgcaaagaaatgccttcttgaa

SEQ ID NO: 6868132 - DNA, 65 bp, Homo sapiens
gcagtcatggaaaaatgtatacctacagaggcaggagcagggggaagatattttttcaatgttgc

SEQ ID NO: 6868133 - DNA, 60 bp, Homo sapiens
cagtggacacttcctctacaatgtttgccagtttctgttagttgggagaagtgtcagctg

SEQ ID NO: 6868134 - DNA, 80 bp, Homo sapiens
tcttctgtcctagttaggacttgtagatatttcattgcaactgttcttggaatgttgcataagatctgagtgatagagga

SEQ ID NO: 6868135 - DNA, 66 bp, Homo sapiens
ggagcacagctggaggtagcatttccatctgaacatgatgtcagagcagctgacagcctgccatcc

SEQ ID NO: 6868136 - DNA, 88 bp, Homo sapiens
gctgaaatctggcttttcaaagggagagtatccagaaacagaagatgctgctctgagaggctcttcctaatagaactgctgcttcagt

SEQ ID NO: 6868137 - DNA, 120 bp, Homo sapiens
cccattggtaaaactagaggggtggtggtctccatcagcatgcaggctgttccagctcaattttgatgagcctaatgtgctggttgcagatcatttaccaccacagtgagagactagggg

SEQ ID NO: 6868138 - DNA, 98 bp, Homo sapiens
catccttctctcaagacagctctcggggcgtggatggtcagtgcaggccggcagcaccgcctgtctcccatccaccccgagcctgttcatccagggtg

SEQ ID NO: 6868139 - DNA, 101 bp, Homo sapiens
agggtgagttttagacttaaattgcttttaactaatcagggcaagatcatttgatgttgctcttaattccattagacttgaaagtttggggtctttacctt

SEQ ID NO: 6868140 - DNA, 67 bp, Homo sapiens
cttggatagggaaggcaggcctgtcacatccagtgttagggcctgaggcttccctaatgcttctgag

SEQ ID NO: 6868141 - DNA, 56 bp, Homo sapiens
ctctgtgagggtctgtacagaacttgtttatctttgtgcccctccccaccacaggg

SEQ ID NO: 6868142 - DNA, 114 bp, Homo sapiens
ctgaggatgaggtgagctggcagccaaggaagtaccctcgggcttaggagtggaggctccattgttcagccccggggaactggctcttctacctaagcccacccagttcctcag

SEQ ID NO: 6868143 - DNA, 59 bp, Homo sapiens
tgctctgttgccttgatacagttgaaggcacttttcaagagtggcagtaaaatagagca

SEQ ID NO: 6868144 - DNA, 96 bp, Homo sapiens
gtcaccagatggggcctcaccattctcagggcagatattggtaaagcaaagggagtgtgagccctggagtggtgcggtttgggttctagtcttgac

SEQ ID NO: 6868145 - DNA, 74 bp, Homo sapiens
ccagatttggccaggtgtccagcccagggccaattagttctggccagggcctgggtcatctggctcaaacatgg

SEQ ID NO: 6868146 - DNA, 57 bp, Homo sapiens
ttccaggctcttccaggctgtccctgtttttagagggacgactgaggatgcttggga

SEQ ID NO: 6868147 - DNA, 60 bp, Homo sapiens
ccaaagcctgggcggactggagagggggcctacctgccaggagtcaggccaggcagttgg

SEQ ID NO: 6868148 - DNA, 67 bp, Homo sapiens
agacaaacccagtggctgtttttgtttgtttgcttcaataaaataagtgaaagccctgggtatgttt

SEQ ID NO: 6868149 - DNA, 57 bp, Homo sapiens
cttgcttgtccagtgtagcaggcccagacattttgacacaaagactggaaaagcaag

SEQ ID NO: 6868150 - DNA, 126 bp, Homo sapiens
gggccttgagcattgtgcctttctttagcacggatgtgacaggcagtggcatcaggtcccattttcctgccttgtgcagaacctgtgccactgccctgccacgccaggcaaaggactcgaaggccc

SEQ ID NO: 6868151 - DNA, 100 bp, Homo sapiens
gtttttgcataaagttggttttccagttatctgtgctgcatatgttgttgagaaatatgagacacacattctggagagaaggagttgcatttgcaaaagc

SEQ ID NO: 6868152 - DNA, 55 bp, Homo sapiens
gccctgcaaggcctggccgcagcccctcctcgctgtcctccaggacctgcagggc

SEQ ID NO: 6868153 - DNA, 65 bp, Homo sapiens
ttttcctctgttattagtgtgaaggcttttactccccagcaatttatcatcacttcagaggaaaa

SEQ ID NO: 6868154 - DNA, 59 bp, Homo sapiens
ttggctgtgcagatcttgcctacttcataaagaatttgaagtaggttacagccagccag

SEQ ID NO: 6868155 - DNA, 63 bp, Homo sapiens
acctctgggaaaagtatggaaaataagaatcagagttttagaaacatacggaattttagaggt

SEQ ID NO: 6868156 - DNA, 81 bp, Homo sapiens
cagtattatctttgcattctatgatatcaaaacaaaataatatccttgttgatagtctcctagaatgacaggtttttgctg

SEQ ID NO: 6868157 - DNA, 85 bp, Homo sapiens
caggttttagtctaggaatttttgtaatggtactttaaccctccaaaagagtatttacataaagaaattcaatggatagagcctg

SEQ ID NO: 6868158 - DNA, 70 bp, Homo sapiens
tcttcagggacagggatcatttgcttctacaatgtaaaggtttatggacatatctctggtcctttaaaga

SEQ ID NO: 6868159 - DNA, 62 bp, Homo sapiens
aggagaaagactggacagccaacctcaggagttcactgggtttgaatgaagtctttctgcct

SEQ ID NO: 6868160 - DNA, 77 bp, Homo sapiens
gtgtgagctcttactgcttgatctagcatggcttggatagtaatgtaagtattttgcttagttagttgtgcttatac

SEQ ID NO: 6868161 - DNA, 69 bp, Homo sapiens
cccaactatgcccagcttaaagtacacagcttgtacacagcttgtacacagcttgcggctataggtggg

SEQ ID NO: 6868162 - DNA, 62 bp, Homo sapiens
gcatgtctgtgtacacatgcacacagcatgtctgaatgtgtgtctgtgtatacacggcatgt

SEQ ID NO: 6868163 - DNA, 61 bp, Homo sapiens
aaagctgctttggtttctggaatctaagaaaacacttacctcattgaattaaagctgcttt

SEQ ID NO: 6868164 - DNA, 85 bp, Homo sapiens
tcattggctcaacaaatatttactgagtgcctgttatcctccaaggtctttaagaggcattagagacatagcagtgagccaaaga

SEQ ID NO: 6868165 - DNA, 60 bp, Homo sapiens
gtttctctgttcctcagtgatcagatttgactctgatttgatttcaaatgcagagaacac

SEQ ID NO: 6868166 - DNA, 65 bp, Homo sapiens
agtcacacagacataaatcaccaaaccattgctgtggctacagtgctttatgatctgctgtccct

SEQ ID NO: 6868167 - DNA, 89 bp, Homo sapiens
atctttttctttcagggaatatccattaaagatggctctaatgaggaagtagcattctttggaattctctgcagcccacgatatgagat

SEQ ID NO: 6868168 - DNA, 55 bp, Homo sapiens
taactcttttgtctccttctactgctttaaaatgctggcggggatgagggagtta

SEQ ID NO: 6868169 - DNA, 101 bp, Homo sapiens
gcattccaaggcctctgtggactcaggcactcagccctcgccagggccccgcgggtggggctgctgtgacctttgtcttccacatgaaggcgctggagtgc

SEQ ID NO: 6868170 - DNA, 76 bp, Homo sapiens
aggaactagtgcaacaggagcgagacctcagaatagatacagaactaagctcaattctcttattgcattagtttct

SEQ ID NO: 6868171 - DNA, 78 bp, Homo sapiens
ctctagaaacaaacaattagttgtgtggaagaaatgaaataatagagtccagactgtcctgactgtttgttcctgggg

SEQ ID NO: 6868172 - DNA, 67 bp, Homo sapiens
ttcctagtccttattctttcaatttgactactggtaatgcccacatagtatgcaagaagattaggaa

SEQ ID NO: 6868173 - DNA, 58 bp, Homo sapiens
ccacgaattaatatccattagtggtcatccatatggtgacaatggatattagttgtgg

SEQ ID NO: 6868174 - DNA, 78 bp, Homo sapiens
tctgatatttcatcctcacagcttttcaaagtggatattggcatcctctttttagagttgaggctcagagaaattagg

SEQ ID NO: 6868175 - DNA, 68 bp, Homo sapiens
tagtcattaaacagtaattgtaaaatgtagtgagattatcagcccatgcaaacaactgtttaatgctg

SEQ ID NO: 6868176 - DNA, 96 bp, Homo sapiens
aacaccagttagttcttttacatcttaagattgccttaattagataatggtattttagttatggagtaattttaagcagttttaaatagctgtgtt

SEQ ID NO: 6868177 - DNA, 76 bp, Homo sapiens
catccagccctgggatgtgctgcatgggacggtctgcccagggccttccaagtggggcacgtgccaccgctctgtg

SEQ ID NO: 6868178 - DNA, 64 bp, Homo sapiens
aggtgtgagtatctgctattccagattaaaatagaaatcgttggcaatggcagatgccatatct

SEQ ID NO: 6868179 - DNA, 70 bp, Homo sapiens
acaaagggccttgatcccctatatggcctatattccaaggaatgggccaggggtttgaaggtcttcatgt

SEQ ID NO: 6868180 - DNA, 61 bp, Homo sapiens
gcaggagctttgcttactgctgagatgaatataaaaatgagtagtaagatacagcccctgc

SEQ ID NO: 6868181 - DNA, 89 bp, Homo sapiens
ggcccatgccctccttggcccgccggaagaagatgtcctcggcgctctcgctggcgtctcctgcgggcgggacggcgttcacccgggcc

SEQ ID NO: 6868182 - DNA, 55 bp, Homo sapiens
gtattttaagtgactactaggttttaatctactgcctcatagtccttgaggtcac

SEQ ID NO: 6868183 - DNA, 73 bp, Homo sapiens
cttcttcgtggatggctgttcctgggagttctagctcctcactagatgctcatgagtcagccagtatgagagg

SEQ ID NO: 6868184 - DNA, 56 bp, Homo sapiens
gttacagagctgctatgtgtgcgtgcccacggccccaacacaccagtgcctgtgac

SEQ ID NO: 6868185 - DNA, 69 bp, Homo sapiens
aagtaatagtacttggcatgtgttggtacatagtgcttgactgtctttttgtgccaaaactgtttgctt

SEQ ID NO: 6868186 - DNA, 67 bp, Homo sapiens
gagttatatgtgaaaacacgtatgtgtgtgtgtatgtatatatgtgtaaattttataaaattaagtc

SEQ ID NO: 6868187 - DNA, 76 bp, Homo sapiens
gagaattacagaggctgggttttcagggacccaggacactgaaatccctggaactgccaagcctcagtagtttctt

SEQ ID NO: 6868188 - DNA, 95 bp, Homo sapiens
tgtattttacctggcaactctagttatatgcaaataccttggactatctctaaagataatctggtctttgtatgagttaacagatgatttttata

SEQ ID NO: 6868189 - DNA, 69 bp, Homo sapiens
atcatgtagcactggaacatggtaagcactcattaaacctgagccattccatgtgctacacataatgat

SEQ ID NO: 6868190 - DNA, 62 bp, Homo sapiens
ctgcttctgcaccatgatggagcctcattagattgtctctagggtcccttccatggtgccag

SEQ ID NO: 6868191 - DNA, 94 bp, Homo sapiens
taacactccatttagtcacccttgataatgttcttctttccagaggtgtagtgagagaagcagctttcaaggtgatttctctgcatggaggtta

SEQ ID NO: 6868192 - DNA, 66 bp, Homo sapiens
atgcccatcccagaattgtttgcatgcctccaaatacaaaatacatgagaacaataggatgtgtat

SEQ ID NO: 6868193 - DNA, 57 bp, Homo sapiens
tgtccaccggtcctgtgatgggccctgtagggaactctggattcacaggctggggca

SEQ ID NO: 6868194 - DNA, 79 bp, Homo sapiens
ggttcatccatattgcagcatgtgtcagaaattcctgtattttaaaaggctgaataattttctgttgtatggatgtacc

SEQ ID NO: 6868195 - DNA, 65 bp, Homo sapiens
tggaacaaacatggtgatggctacaagtgacttgggaatcacaagcgtcctatgatttgttcaca

SEQ ID NO: 6868196 - DNA, 83 bp, Homo sapiens
ggcacagggtcttgcccatggtgggggcctaacaaatgcattgattctagtaaactcccactgtgaatccaaggcctggttcc

SEQ ID NO: 6868197 - DNA, 80 bp, Homo sapiens
gtccttggtggctgtggggatctctggtggtggtcacccccaaaggataatgaccagtttccccactgtcctgctcggtc

SEQ ID NO: 6868198 - DNA, 83 bp, Homo sapiens
agaaagatctgaattcaaagactagaattttgccaccttgactgggttctgtaaagaagtttttgaatgcatgggaccttttt

SEQ ID NO: 6868199 - DNA, 67 bp, Homo sapiens
gcaggagagagatgaacaacactggatattctgcattatccagttctaggtcactctctgggtctgc

SEQ ID NO: 6868200 - DNA, 55 bp, Homo sapiens
caagcccacgttgaaccgcttacagatgcccgcatcgtgcagcagctgaggcttg

SEQ ID NO: 6868201 - DNA, 68 bp, Homo sapiens
gttgatctaggatggatggtttggtaggctgaataacaacctccaaatatattcacgtcctagtagac

SEQ ID NO: 6868202 - DNA, 74 bp, Homo sapiens
tttatggggtggtgggaaccaagtagtggcatctcactggggttttgttattctctactcatcactcctataga

SEQ ID NO: 6868203 - DNA, 86 bp, Homo sapiens
agaatagcacatctgcagggatgtgaggggtgagccgaagattcacttatggagttactcgtcatcttcctcagggtcgctgatct

SEQ ID NO: 6868204 - DNA, 66 bp, Homo sapiens
ttcacatgtgaccctgcaggcagctaaccaaggctaaggaatgtgctctgggcagggcacatggaa

SEQ ID NO: 6868205 - DNA, 55 bp, Homo sapiens
ccattttgtctgacttcttgctacttctgctctttaggaaaggtcgataaggtgg

SEQ ID NO: 6868206 - DNA, 55 bp, Homo sapiens
ggtgcctttggcccctggctagagagccatgttccttcccggggccacaggcacc

SEQ ID NO: 6868207 - DNA, 55 bp, Homo sapiens
taagtgtccctattgtgattttagatgtgtctttcccccactgtgggggcattta

SEQ ID NO: 6868208 - DNA, 64 bp, Homo sapiens
tggtctgctggcagaatttcttcttgctcagggtagagcgaggtttgttctattcagtacttca

SEQ ID NO: 6868209 - DNA, 57 bp, Homo sapiens
gagcagagcttctcaaagtaaaactagccgtgttgctacaaagggaaattctggctc

SEQ ID NO: 6868210 - DNA, 70 bp, Homo sapiens
gagttaaagtgagctactttaggtaagcaaggtgagcttcagtgagcctaagcagaagctatttgaattt

SEQ ID NO: 6868211 - DNA, 65 bp, Homo sapiens
tgatgccatttcaaaataagatttaaaatgactctgtatgtgagcttgtagtgtgaatggtatca

SEQ ID NO: 6868212 - DNA, 58 bp, Homo sapiens
tctgcagggaagttgtaatgtaatgttagagtagtgacatctaattatttccctgaga

SEQ ID NO: 6868213 - DNA, 128 bp, Homo sapiens
tgaatagatgtcattgttaagccgattaaatgtgtaacatatgtaaaagcacctgcacagtgatgggcctagagtaggtgctcaatatatgtgtgctaaatttgaatctacaatcattcattcattca

SEQ ID NO: 6868214 - DNA, 66 bp, Homo sapiens
aatctgcaatataattcatatattcatcggtcccctgtatgtcttgtgaattgtagttaaaggatt

SEQ ID NO: 6868215 - DNA, 64 bp, Homo sapiens
caggtacattttttttcctccttattttgaggcagaagctattggaggaaaaaggaatgacttg

SEQ ID NO: 6868216 - DNA, 80 bp, Homo sapiens
ggaggggaggactctctgagaagccttgatggggatgtggactcctcctccatacttgcttcacaagagactctgcctcc

SEQ ID NO: 6868217 - DNA, 75 bp, Homo sapiens
ggacagactgacggctgggggcagtggtcaggccactgtttgtctggctacttccaggggccttaagaactgacc

SEQ ID NO: 6868218 - DNA, 78 bp, Homo sapiens
ctgtgcaccacttttcagatgcaatgtaaactaaattcctagttgtcagattccatgtctctgaaatgtggtagacag

SEQ ID NO: 6868219 - DNA, 79 bp, Homo sapiens
attgatcagattggctgctatttccatatttattacaaggagacaagagtagaaatggggaagtagttaggagagaggt

SEQ ID NO: 6868220 - DNA, 70 bp, Homo sapiens
aactgcatgctttgagaagatgaatggttcttaggtgttttatgcataagaatcttccagggcatgtgtt

SEQ ID NO: 6868221 - DNA, 119 bp, Homo sapiens
acaatgtcaagtatatcatgacctctgaaatcaataattggtgattggtaattataatggtacagcacttaataacagtagctaaattattttcatggtgagtgcactactagacttgt

SEQ ID NO: 6868222 - DNA, 130 bp, Homo sapiens
ctgtccctaaatatttgtcgagtatgttttgcaaatgttttcagccatgtgattatctgtactgtgtcttccatatcagatgaactgtgactgaaaatgctgggcagctttatgattatttagcaatcag

SEQ ID NO: 6868223 - DNA, 102 bp, Homo sapiens
aggtgccctccttcacgtgtaacaaagtgcgtttagagttgtaaaccacagggttacaactgcacatctgaatcactgcatatttgtaagtagagactacct

SEQ ID NO: 6868224 - DNA, 77 bp, Homo sapiens
gccatggcctccctccactgccctgagctccaggtggagtagaaagaaggcactgggccctgggcaggcacataggc

SEQ ID NO: 6868225 - DNA, 74 bp, Homo sapiens
tctccctcagctcatatttatgcccttttgtgccgcttttaactttcacatggtgctcatatgggtgggggaga

SEQ ID NO: 6868226 - DNA, 129 bp, Homo sapiens
gacccactcccggtagttctgggtggtgccgggcgggcgctggggtgccgacagggagggcacgtagtctgatgccctccacagtggctccaccccgtaccggttcctgttgagcactgtaggtgggac

SEQ ID NO: 6868227 - DNA, 61 bp, Homo sapiens
ttaggtgctagaaaacctgggtttcaaattcaactcagccctaactaattctagggcctaa

SEQ ID NO: 6868228 - DNA, 78 bp, Homo sapiens
tcgcccttaggggcaaattggcaggttgtcccctgctcctcctggcccacacagccttgcttatttgtctctgtgtga

SEQ ID NO: 6868229 - DNA, 72 bp, Homo sapiens
gggaagtcagccgtccgggcctggtgtggctgctcagcagcacaaagtccccagggacccagtttccttccc

SEQ ID NO: 6868230 - DNA, 60 bp, Homo sapiens
gttacaactgaagctaatgtgctgatgggctcagttcccaccagtagatcagtttgtaat

SEQ ID NO: 6868231 - DNA, 63 bp, Homo sapiens
agagaaaccagcatttaaaccaggaaccgctgaaaagcaggattcaaaatggtgtgtttgtct

SEQ ID NO: 6868232 - DNA, 58 bp, Homo sapiens
gcagtgtagactttagttgatgattccggtggggagaccaaagtgaaatttacattgc

SEQ ID NO: 6868233 - DNA, 60 bp, Homo sapiens
gaatcatagaacattaatagaagtgctctcctaggtctctattcaaatgttctttgattt

SEQ ID NO: 6868234 - DNA, 58 bp, Homo sapiens
cctgagagccagtgcctgcccatcctacaacaggaaacagtgcatcaaagctctcagg

SEQ ID NO: 6868235 - DNA, 90 bp, Homo sapiens
gtcttctcaaaaatatttgtcgtaacacatgtctgggatgtgaattgtggccaatttttcctgaagcagtagttatgattttgtagaggc

SEQ ID NO: 6868236 - DNA, 67 bp, Homo sapiens
ggtatttatatttcttttgttttcatttctgcacacatgtatgactgagaactcaagagaaaaggcc

SEQ ID NO: 6868237 - DNA, 75 bp, Homo sapiens
ggggaaggagcaaagtttcttgggtagaatattctggagttcttccaattagaatatttgggcatctctttctcc

SEQ ID NO: 6868238 - DNA, 76 bp, Homo sapiens
ggaaaaccctaaggtagattatcaatagtggtagctggaactattactgtcattagcattaactttaggggatttt

SEQ ID NO: 6868239 - DNA, 76 bp, Homo sapiens
tgggaagcaatttagaatcagaagcacaggggttcaaatcccagctctgggactttctaaatgtgctctttttcca

SEQ ID NO: 6868240 - DNA, 70 bp, Homo sapiens
tggaatgtgtagaacgtgttcacctgtttgttccatttggctagaactttggatcatgttcttggcacca

SEQ ID NO: 6868241 - DNA, 66 bp, Homo sapiens
tttcagagtaagaatagaaacattctcctttagaaatggtggatgtatacttttctttctctgggg

SEQ ID NO: 6868242 - DNA, 81 bp, Homo sapiens
ctggacagtttccactctccagtcaatttcagttctgagattcactactggtatggcctggagaatgcagaccctgtccag

SEQ ID NO: 6868243 - DNA, 59 bp, Homo sapiens
tggaggtgctagccctgtagtcagaaactgagctgggagcagaagtggctacatctcca

SEQ ID NO: 6868244 - DNA, 77 bp, Homo sapiens
tcgcttgaatccaggtggcggaggttgtggtgagccaagattgcaccattgcactccagcctgggcaacaagatcga

SEQ ID NO: 6868245 - DNA, 87 bp, Homo sapiens
gtgttccagagtccatgggcagatacacaaaagtctagtgagggcggactctgcctcagaatttgtgtgctgtcttgaagagaacac

SEQ ID NO: 6868246 - DNA, 58 bp, Homo sapiens
acccaggctggagtgcagtgatgggatctcggctcactgcaagctccgcctcccgggt

SEQ ID NO: 6868247 - DNA, 55 bp, Homo sapiens
ctattgtagtaagggaaagccatgctggtcaggcaggcttttctgagtatagtag

SEQ ID NO: 6868248 - DNA, 79 bp, Homo sapiens
gtttcctcattcctggtggcatcttgagatggtttggtaacatccaagctgtgcagatgttaccacggagcatggaggc

SEQ ID NO: 6868249 - DNA, 61 bp, Homo sapiens
aggtggtttttgtactgggtccaattgtcttgataaatagtggaactggtgaaaacctcct

SEQ ID NO: 6868250 - DNA, 58 bp, Homo sapiens
gttgcaaatgggaagatggttaacagctgaaaggaggttcatctttcaaatttgtgac

SEQ ID NO: 6868251 - DNA, 63 bp, Homo sapiens
tggctgatatgtcatctttcttataatgctgtactaaattgtcggaatgatacataatagtta

SEQ ID NO: 6868252 - DNA, 85 bp, Homo sapiens
tccctgggatgaaagacccaggcctggggcttaaggtggaaaaacaactcattcctcgaggcccggagtcgggcgtcccgggaga

SEQ ID NO: 6868253 - DNA, 62 bp, Homo sapiens
tagaaactcaggatactcttccatggaaagagatggcagagaaagttttgtcctcagttcta

SEQ ID NO: 6868254 - DNA, 100 bp, Homo sapiens
tattaatttaagaaccattactatgttactcgtttggatgtttcatggcactgcatgaaacattcatatgagaaacctagtaatggttcttaaattaatg

SEQ ID NO: 6868255 - DNA, 65 bp, Homo sapiens
tatctaacacaatcgtaaatgaatagtctctgactcagagcagtcatttacagactgtgtgggtg

SEQ ID NO: 6868256 - DNA, 55 bp, Homo sapiens
gaacagataatttaattaatgcattttcagaatgcatgtgtgaattatttgactc

SEQ ID NO: 6868257 - DNA, 90 bp, Homo sapiens
ggtttcacatttgacattgacagtccattaactgtgttaacagcagtaattgctttagagcagtttaatggaagatgtttatgtgtggct

SEQ ID NO: 6868258 - DNA, 56 bp, Homo sapiens
gtgtccttttgagggtccacaggggactttctcatgtccttgggtttgaaggacat

SEQ ID NO: 6868259 - DNA, 57 bp, Homo sapiens
cctgggaggctgtttccagcctcagcgcctccgctactgctgttccagctgcccggg

SEQ ID NO: 6868260 - DNA, 101 bp, Homo sapiens
aatgtgttatttgactttgcatctggctagcttatggaaattaaatgtattatctctgaagtacatgtaattttcatagtaagctagtagcttaatatatt

SEQ ID NO: 6868261 - DNA, 76 bp, Homo sapiens
ttatgttatattggcagaagagaagatgatagctgtgaaaaatgtagccttctttgattttgttactaagacatga

SEQ ID NO: 6868262 - DNA, 104 bp, Homo sapiens
aggcttgcctgccccagccaggttcggtggagtcgggagcctcgagggttttccctgctgaggctcttcctcccctgctcctcctggggcagtggacacagcct

SEQ ID NO: 6868263 - DNA, 102 bp, Homo sapiens
agacttttaaaaggtatgagcatgataggtatttaattaaataaaaagatgtaggcatcatttaaaatgagtacctctcgttgtttattatttataaaatct

SEQ ID NO: 6868264 - DNA, 63 bp, Homo sapiens
tgtttgtgagtgcacatgcccacacttacatgcacacatgttgtgtgtgtgtacttctaaata

SEQ ID NO: 6868265 - DNA, 81 bp, Homo sapiens
tctcagagacatcatgttgagtgaaagaagccagattcaacagaactgtactctgtcatttcattcatatgaagtttgaga

SEQ ID NO: 6868266 - DNA, 59 bp, Homo sapiens
caggcttagagggacgaataagccctggccagaggcctggccagtcctctttgggcctg

SEQ ID NO: 6868267 - DNA, 103 bp, Homo sapiens
gctggaccattcacgccctctgtgaagtttagggaagtctgagcgctgccttcccagccagccacttcccagactggccagcagagggcacccagctgccagt

SEQ ID NO: 6868268 - DNA, 82 bp, Homo sapiens
acattttatgttttcatgtggttcttatattttaattgcctataagattgagaaaacattgagggccataaatattttatgt

SEQ ID NO: 6868269 - DNA, 77 bp, Homo sapiens
ggaaagaatatttgggctcaatatttgggctcaatattttgggctcaataatttgggctcaataaggaggactttcc

SEQ ID NO: 6868270 - DNA, 78 bp, Homo sapiens
cacgcatgtggatcagatgaagggacatttgcgtatttcccctgctcttcaatttgtataatccatatgtaacaagtg

SEQ ID NO: 6868271 - DNA, 59 bp, Homo sapiens
gctggttgtccctggacttagagaaggtaaggctgagagaggttccagccacaaccagc

SEQ ID NO: 6868272 - DNA, 84 bp, Homo sapiens
cctgactctctgggagctcctggcagtgacagaggcacagatagacagtgtcacttcattgggaccagggctgtgatgggcagg

SEQ ID NO: 6868273 - DNA, 60 bp, Homo sapiens
gggctggcagctctactcagagcctgtcctaaggcaatgctgtggtgaagctgccttccc

SEQ ID NO: 6868274 - DNA, 64 bp, Homo sapiens
ctggtggaatctgcttagagctttgaggagagaattcccagagccaagctatggatggtactag

SEQ ID NO: 6868275 - DNA, 76 bp, Homo sapiens
gaccctataggcaccatgggggcatgtgttacccatattatgggtcccttcagctctcatggagacccacggggtt

SEQ ID NO: 6868276 - DNA, 67 bp, Homo sapiens
ctctgagcacagctgtctgaagcaggagtcctgacccaggaaactcaaatggacagttgggccagag

SEQ ID NO: 6868277 - DNA, 101 bp, Homo sapiens
ccagggttccagtaggcgggtggtgggagtccattagtcactcaccttctgccctttctggtctcagctgggctcttatcacctgtacctgggcctcctgg

SEQ ID NO: 6868278 - DNA, 80 bp, Homo sapiens
cttcacaacctactctgagcgcctccgcatctgccagatgtttgttgggatgcggagccccaagcttgaagagtgtgagg

SEQ ID NO: 6868279 - DNA, 82 bp, Homo sapiens
gtggccatcccaactgtggccagcaggtggctgtgtgttcacacagacctcactgcaggccccctgcagggtgggagggcac

SEQ ID NO: 6868280 - DNA, 79 bp, Homo sapiens
ggtaagcttaaagtctttacaacctaagttgaagctggggttcacatttgaggaacttaggttgaaggaagcaagggcc

SEQ ID NO: 6868281 - DNA, 57 bp, Homo sapiens
actgtgggttaacttctttcccatctgtaaaatgggcatgatattagtacctagggt

SEQ ID NO: 6868282 - DNA, 56 bp, Homo sapiens
gttaatattccttttaaagagttacagtagtctgtgatgagtgaggaatatttgac

SEQ ID NO: 6868283 - DNA, 77 bp, Homo sapiens
tgattagggtgcttagctgttaactaagtgtttgtgggtttaagtcccattggtctagtaagggcttagcttaatta

SEQ ID NO: 6868284 - DNA, 64 bp, Homo sapiens
cagcactctggcttcgttaagttgtgggtgttatgtggttcgcgtttggaagcagagggtgttg

SEQ ID NO: 6868285 - DNA, 78 bp, Homo sapiens
tctttgtgaaatcttctaggtatggcattctttttgctggggacaggaggagctcttgatgcttgagggagtcttgga

SEQ ID NO: 6868286 - DNA, 65 bp, Homo sapiens
aaggactgctaaacctctctgagagctgccagatgttcctgcctagcctcaggttgttggttctt

SEQ ID NO: 6868287 - DNA, 66 bp, Homo sapiens
atgttcccagcactgagtaacaccaaagaaatatacgacaggagttgtctcagctttggagaagat

SEQ ID NO: 6868288 - DNA, 93 bp, Homo sapiens
tgaagtaaagcagattctggaatcagcctgcctgcctatgagtcacacaagttgtgtgactttgggtaagttgattaatctctctgggcttca

SEQ ID NO: 6868289 - DNA, 65 bp, Homo sapiens
tttcctttcctcttattttcccagtgatgtcttctgagatatgacaggcccaggagaaaagggaa

SEQ ID NO: 6868290 - DNA, 69 bp, Homo sapiens
ggctctgagaggtgcagcagtaaaataagtactaaattttacttagacaagcattttagactcagagct

SEQ ID NO: 6868291 - DNA, 55 bp, Homo sapiens
gttctgcttccttgcttgcgcatgcagtaaacagccccaagttatccagcagaat

SEQ ID NO: 6868292 - DNA, 102 bp, Homo sapiens
tgagacagagtttcgctcttgttgcccaggctggagtgcagtggtgtcatctcggctcactgcaacctccaccttccgggttcaagtgattctcctgcctca

SEQ ID NO: 6868293 - DNA, 78 bp, Homo sapiens
tcctgcctctaggtggcagccttggctctgtaaaacccaggtctgtttttggtgccctggttcccacccttggctggg

SEQ ID NO: 6868294 - DNA, 55 bp, Homo sapiens
tgcctgtgccctttgctgggaggctaatcagaatccaggaacgagaggctgggca

SEQ ID NO: 6868295 - DNA, 99 bp, Homo sapiens
gaatttgagtatattgaactttttgacccctgtgtaagatggagataacaataaatttttgcaagggtgttttgaggtgtaaatcaattcacatagttc

SEQ ID NO: 6868296 - DNA, 61 bp, Homo sapiens
atacctcccctccagcaaaaacataatttgttgcatagtcaaaatgctggaggcggggtat

SEQ ID NO: 6868297 - DNA, 55 bp, Homo sapiens
aggttccatcacctgcagtggagagcaagtgctgtcctctgcagtgaggtggcct

SEQ ID NO: 6868298 - DNA, 65 bp, Homo sapiens
ctgtcagtgtccttatttctgtctctcactttggggtgagagattaggataagtgatatctgcag

SEQ ID NO: 6868299 - DNA, 106 bp, Homo sapiens
cctggaggaaacgccccatggagatacgggcagagcctggtatttggcaccaaacacacctgagtgcctgataccctctgtctctcactggctgtgtgaccccagg

SEQ ID NO: 6868300 - DNA, 73 bp, Homo sapiens
gacattcccaggtacatcattagccaactgggactcaataaggatcccttggaaggtgagtccctgggttgtt

SEQ ID NO: 6868301 - DNA, 75 bp, Homo sapiens
atgtattttccaggaaaacagttggaagtttcgactttgtggtttacttttggctgtgttttatggaaatcacat

SEQ ID NO: 6868302 - DNA, 64 bp, Homo sapiens
ggtgggaggtggggctgaggtcagagctcgggtctgcatgacttcaaaggctctactcctaacc

SEQ ID NO: 6868303 - DNA, 65 bp, Homo sapiens
ttgtttttaagcatgctcttggggggtctcattctttactctcaaagtatatcccttcgaaacaa

SEQ ID NO: 6868304 - DNA, 68 bp, Homo sapiens
tagggctggcgtgctcagggaaggtagatgaaatgttctgagggtcctatggatgcactccacctcta

SEQ ID NO: 6868305 - DNA, 90 bp, Homo sapiens
gctgaggacactgatgaggctcagagtggttaaataactttttcaaagttacttaacaagacttgagtccaaggtatcaaatgtcaaagc

SEQ ID NO: 6868306 - DNA, 103 bp, Homo sapiens
gcccagtgagggctggtttccaagtggtgagagggtcattagattctggtctgtggctcaattgcctactgacactggagacacaatagcacctccacttggt

SEQ ID NO: 6868307 - DNA, 66 bp, Homo sapiens
tcatcagctatgacagtcaaaggtattcagttgattatgacaagagtaaaactgtcaaagtgatga

SEQ ID NO: 6868308 - DNA, 70 bp, Homo sapiens
gcaaggtcatatggaagttgttgcttaatttttcaagaaattgccaaattgttttccagagtgactatgc

SEQ ID NO: 6868309 - DNA, 88 bp, Homo sapiens
tgactcttctttggtcctgtaagcacctactctagaatgtaaggaagtgttagagcaggagttgacagatttttcatgtgaagggtca

SEQ ID NO: 6868310 - DNA, 95 bp, Homo sapiens
cattccttctaccaatactgctcatttagcctttggagcgcaacctgatggttgcatcagaggatagctgcagtgatcagtcacgtagagttgtg

SEQ ID NO: 6868311 - DNA, 65 bp, Homo sapiens
tctaagtaagggctgagggccactttctgtgtctgtgcattgtggccattttttcctagcacagg

SEQ ID NO: 6868312 - DNA, 81 bp, Homo sapiens
gaagagtcaactgcctttgcactccacatgactctgagacacatggggatgtggcccagcggtcaggctgtctgatgtttc

SEQ ID NO: 6868313 - DNA, 101 bp, Homo sapiens
acgatcgtattgtagtctctcaaagtgctctagaaattgtcagtggtttacatgaagtggccatgggtgtctggagcaccctgaaactgcaccaaagttgt

SEQ ID NO: 6868314 - DNA, 57 bp, Homo sapiens
tcctccttgtattctatttcacttctgcagacaagaagtgtgaagccctcaggagga

SEQ ID NO: 6868315 - DNA, 87 bp, Homo sapiens
tggattgttgaaaatggtttggctctgtcagcacttgccatggagatacaggccttgtcactttggccaagccattgcaatatccca

SEQ ID NO: 6868316 - DNA, 65 bp, Homo sapiens
cccctccctcctgctcctcctgctgtgtgatgcccagcagtgtggaagctgaggggcagctgggg

SEQ ID NO: 6868317 - DNA, 84 bp, Homo sapiens
ctgctgagggctattctctgtttccaagatgaaactttttggtaaatccttggaggggaggaatgctgtgtcctcaaatggcag

SEQ ID NO: 6868318 - DNA, 60 bp, Homo sapiens
gagcacatacttgtgtgtacatatgtatgcatgcacgcatgtgtgtttgagtgtgtggtc

SEQ ID NO: 6868319 - DNA, 65 bp, Homo sapiens
tggtgatgttgaattcttttgtattccctcctggggccaggggtcagaattcccaagcatgacca

SEQ ID NO: 6868320 - DNA, 101 bp, Homo sapiens
gatagcttgttagaaatacacattcttggactccactctaggccgctcaaatcagaaattctgagggtggggtccagcaatctatgtttcaacaagctatc

SEQ ID NO: 6868321 - DNA, 96 bp, Homo sapiens
acagtgggagcctcatgggataagagatggggtccttgcagctgtctgtacgtgcatctgtaactgctatcatctccactgaaaggcccagactgt

SEQ ID NO: 6868322 - DNA, 99 bp, Homo sapiens
tattattttaagaggagagcaacgaggtgatactagaagaatgtttttctgaccataagtgtcactttttgcattacgtcattctttcatgaagtagta

SEQ ID NO: 6868323 - DNA, 60 bp, Homo sapiens
atgggttcaagtgattctcctgcttcagtctcccaagtagctggaattacaggagcccat

SEQ ID NO: 6868324 - DNA, 105 bp, Homo sapiens
agggctgggcctggaatccatggcttgggaagggccctgtgtacaaccactgaccgttggaagtgaatattgtccttctccaccacccgtgccaggcctgccact

SEQ ID NO: 6868325 - DNA, 65 bp, Homo sapiens
cctacagggctcgtcgggccctcggggtcggcggctgctggaggcgcccaggggagtcctgctgg

SEQ ID NO: 6868326 - DNA, 120 bp, Homo sapiens
gacttgactgacctgaccctcggggatccatccacgtggcccacccaagtaatgcaccttttagaatatttgctgaaataactgccacctggtggcatcttctgggtcaatgtcactgtc

SEQ ID NO: 6868327 - DNA, 72 bp, Homo sapiens
ctgtttccatgtctttttggcagcctgcttcattcttcactttggccatagctgctacttcatggaaaatag

SEQ ID NO: 6868328 - DNA, 76 bp, Homo sapiens
ctgggacttgcctcgagggctgccagaaacttgagtttgtccactcacatcactgcatcccgtggagaagtcccag

SEQ ID NO: 6868329 - DNA, 83 bp, Homo sapiens
gtacagatgtattttggttatcctgtcggtaattcatgctagataatcatgaacccagcagttaatgacctctactctgatac

SEQ ID NO: 6868330 - DNA, 57 bp, Homo sapiens
agtgatagaaaatgcctggcaagcgtgacatcaactcttgacctgcaagtcatcatt

SEQ ID NO: 6868331 - DNA, 63 bp, Homo sapiens
gtcatctagtttgtttccatttattgtttttaatattaagacagtgatgtaagcaggagtgac

SEQ ID NO: 6868332 - DNA, 56 bp, Homo sapiens
aggggtgggaccaggaatgtttgagtttcaatctcagctattcctgattcatcttt

SEQ ID NO: 6868333 - DNA, 59 bp, Homo sapiens
gcagccatccaagagacatttgtgaatgtgcatagctttcataattatcttaggactgc

SEQ ID NO: 6868334 - DNA, 67 bp, Homo sapiens
gggagactggctcatgtgatgagggcaactgtgcttgctaattgtccattactgaagttgggctcct

SEQ ID NO: 6868335 - DNA, 97 bp, Homo sapiens
cttgggatgggtgtgggaagaagcctgcaggtgggcccaaccagttcagagacactctgggaggcccaggcctggcaggaactcaacccttcttagg

SEQ ID NO: 6868336 - DNA, 59 bp, Homo sapiens
acatgtttggctctatgctatacactggagctcagagatcagagtagagacagacatgt

SEQ ID NO: 6868337 - DNA, 55 bp, Homo sapiens
tgagcagagtcgctccagagtgagccatgggtgctgatctgggcgatctctctta

SEQ ID NO: 6868338 - DNA, 70 bp, Homo sapiens
agttcctcccgtgcctgctgcagagtcgctgtggggacagggcctcgaaggcagagggatggagtgagct

SEQ ID NO: 6868339 - DNA, 123 bp, Homo sapiens
tcagcatccgtatcctgtttgattgcaaacttgctaaaggtaggtattgtttgtcttggacttcgctgccagtccttagaacagtgcctgggacacagtgtgttctcaaatatttgttgctgg

SEQ ID NO: 6868340 - DNA, 62 bp, Homo sapiens
gcctctcagagagatgaaacttccaaagggctggagggttcccctatttgtgatgactaggc

SEQ ID NO: 6868341 - DNA, 68 bp, Homo sapiens
ctgtggctgaggctggagtgcagtggcacaatcttggtcaactgcaacctccacctcccaggttccag

SEQ ID NO: 6868342 - DNA, 87 bp, Homo sapiens
ggctactaggtcaggaacttctaggaaagctgcggatgggctgctgctattccactgaggggttcaaatcagctgagtctaggagtc

SEQ ID NO: 6868343 - DNA, 87 bp, Homo sapiens
tgctttaaaaatctcttttcggatagactggatatttgtagtctccatgtcacagatgaggaatttatttggtgtagagatttagta

SEQ ID NO: 6868344 - DNA, 121 bp, Homo sapiens
ttgtggcctcttgagtgttggagctggaggaggcgctgtgaatcctgtttgcccagccaatttacaaatgagacagtgaggcagagcttccgtggccactaccgtcttgcagaggccatga

SEQ ID NO: 6868345 - DNA, 56 bp, Homo sapiens
ttacattttgcacagatgtccccagccggcaggtagggccattagtcaagatgtaa

SEQ ID NO: 6868346 - DNA, 80 bp, Homo sapiens
taatgcaattctctgcacaagtaagggtttaatcttcttgatgctgaagacctgaacttccctatatgtgttttgtatta

SEQ ID NO: 6868347 - DNA, 76 bp, Homo sapiens
gggagcaacagaggattatttcagaatctacgcaaataaaattctgtgtgttggtgaagtctctctgctgccactc

SEQ ID NO: 6868348 - DNA, 67 bp, Homo sapiens
atgaggtcatcttgaagtagggtgtgccccaatccaatatggggtcctcctaagaggatggccacgt

SEQ ID NO: 6868349 - DNA, 92 bp, Homo sapiens
caatctcacagaatcctaggcagtattattgcaattcctttctctacctcagacattctgaaaggcattagttgtaaagtattgttgagttg

SEQ ID NO: 6868350 - DNA, 70 bp, Homo sapiens
aggtagtgcgtgtggaatgagagtgtggagaggttggctgtgtcacacttcagctccacaaacattagtt

SEQ ID NO: 6868351 - DNA, 80 bp, Homo sapiens
ttgtcattttaatttgtctacaaagttttgttctagttagattttcaccctgcatgctgtgtggtcaagttaatttgcaa

SEQ ID NO: 6868352 - DNA, 118 bp, Homo sapiens
taggtgatggggaaagtctgcccatgacttcggaagtctgagtttagtagatgatgctacccatcagaatttagagacaggcttcccaaggagtggtagctatcactccatctcccta

SEQ ID NO: 6868353 - DNA, 65 bp, Homo sapiens
tgtccatggaatgtgaacatgatggcattctgtgagtgagttatgccagcgcatccaaatgaaca

SEQ ID NO: 6868354 - DNA, 81 bp, Homo sapiens
gcaggattatatgctcattttattgagaatgaccttaagcagattaggtagttctcaagtttgaatgagctttaatttggc

SEQ ID NO: 6868355 - DNA, 73 bp, Homo sapiens
gacagtcatgacagaggagctggaatgattctgtttttcagatctgttctttttctctctgcatttgaacgtt

SEQ ID NO: 6868356 - DNA, 90 bp, Homo sapiens
catcaattgattagtagtggcttcctggagtgctgacttgacaagaagtcatgctgcgttggcaggaaagcacactatgattggttagtg

SEQ ID NO: 6868357 - DNA, 55 bp, Homo sapiens
catagaaaagagtaggtaatgtaaggcaaacccaacacatcctatctttactatg

SEQ ID NO: 6868358 - DNA, 68 bp, Homo sapiens
attagaggagctgggaccctgtcatctgatcttagttcagtgtccagagcccatggcccaaaactaat

SEQ ID NO: 6868359 - DNA, 55 bp, Homo sapiens
agagtgactgcttttctgagagtcttttacctactcccagaaagttatttactct

SEQ ID NO: 6868360 - DNA, 120 bp, Homo sapiens
gggactcaaggcattggctcaatggggcaccttgttctgtttactcttgttttggtcagcaccgattgccctagggctaagcaggactgccaccacagactcagttgccaagagtatccc

SEQ ID NO: 6868361 - DNA, 79 bp, Homo sapiens
atgtcacattttcacagtattcatgaacatggaatgggagcctccaatttctgtaatcaagatatttgagagttgatgt

SEQ ID NO: 6868362 - DNA, 80 bp, Homo sapiens
ggccaccactgatctgtttccatacaggtttttggatatttctagaatatcatatgaagagactcacttagtatgtggcc

SEQ ID NO: 6868363 - DNA, 111 bp, Homo sapiens
ctgagagtataaggcactcactagtagagcacatgtggagagtctgggcccagtccttgctctgggatctgcctcattctcgcgtgtgtttctgtcaaccctctctcttag

SEQ ID NO: 6868364 - DNA, 79 bp, Homo sapiens
gcctgggcttattgggtaggtgccaggaattagctttgacaaagatggtgttctgtgcacttggcccaagctgacaggc

SEQ ID NO: 6868365 - DNA, 77 bp, Homo sapiens
gccagcctgccaagctgcagaccccctgtctcatggaggctatcttgagggaggggaatgtgtgcagagcaggaggc

SEQ ID NO: 6868366 - DNA, 65 bp, Homo sapiens
caggccaggtggcaggcaaaacagtcaagtagatcagggttgtttgtagtgccacctgccccctg

SEQ ID NO: 6868367 - DNA, 56 bp, Homo sapiens
caagagcttttgggaacgctgcagcaggagacttgcaggtgtgcagagggctcttg

SEQ ID NO: 6868368 - DNA, 70 bp, Homo sapiens
aggcttaataggtcaatgggaggcagaacttggactactaattgaaagaatgtttcccctgaccaagcct

SEQ ID NO: 6868369 - DNA, 59 bp, Homo sapiens
caagctgaaactaacaggaatgagttatgtatagattatccactttagtttcagtattg

SEQ ID NO: 6868370 - DNA, 58 bp, Homo sapiens
tctgtataaagtaccggtggcatgtgtattagtggagatgcagcctgtgctctgcaga

SEQ ID NO: 6868371 - DNA, 59 bp, Homo sapiens
ggtgggggcctgtaatcccagctactcaggaggctgaggcagggagaatagcttgaacc

SEQ ID NO: 6868372 - DNA, 62 bp, Homo sapiens
agtgaggctcaacccacaggggttgcttgggaactgttgcccgtgaggagttgggtgttatt

SEQ ID NO: 6868373 - DNA, 59 bp, Homo sapiens
taaatgcaaggattttgttaggccaatcatgttaacgtaaaaggctatttttgcatttg

SEQ ID NO: 6868374 - DNA, 55 bp, Homo sapiens
tgcactagccacatttcaaatgctcaacagccacatgggagtggtggctactgta

SEQ ID NO: 6868375 - DNA, 64 bp, Homo sapiens
aactgaacagaactcagagattgtaaattcagtaattgaacaagatttcaggttgtgttctgtt

SEQ ID NO: 6868376 - DNA, 57 bp, Homo sapiens
ctcaccttgtgatccacccgcctcggcctcccgaagtgctgagattacaggtgtgag

SEQ ID NO: 6868377 - DNA, 62 bp, Homo sapiens
ttctccctgtgcctctgaagggcggacggcgttgtgtctgcgcagtcctgcaggcgggagaa

SEQ ID NO: 6868378 - DNA, 56 bp, Homo sapiens
ttttggtgaatttaagtgctgtgaatactcttcccacagttcgtgagttcctaaga

SEQ ID NO: 6868379 - DNA, 62 bp, Homo sapiens
cggggtagcagagggcccaggtaactccagcactggagtcacagggggcccctgcaactccg

SEQ ID NO: 6868380 - DNA, 61 bp, Homo sapiens
gcccctgggctatgtatagctggacagtataaaggaagcagctggagagccaggcaggggc

SEQ ID NO: 6868381 - DNA, 62 bp, Homo sapiens
aaccacttgaaacttagtggcataaagtatcattaattttatgcccatggattcggtaggtt

SEQ ID NO: 6868382 - DNA, 65 bp, Homo sapiens
gagctcttacttgaagtttaatggtagattcctgtaacaccagggtactgttggatttttagctc

SEQ ID NO: 6868383 - DNA, 56 bp, Homo sapiens
ggtctcacaggactaaaagcaaagtgtcagaaaggctgtgtttcctcctggaggct

SEQ ID NO: 6868384 - DNA, 108 bp, Homo sapiens
cccatgccagatgttaccataagctttgttattgtttcttgatcaaaccaagactatggtaattaggaaactgaatgtcagaactgtgttattattgattaaaatggg

SEQ ID NO: 6868385 - DNA, 109 bp, Homo sapiens
ggattttctctagaagacatactggcctttttagaaaacagcttctggcatgcaccaagatattttgtgactctcagctctttgagaaggcagtgtgtctcagaaagcc

SEQ ID NO: 6868386 - DNA, 89 bp, Homo sapiens
ggtcagtaaagtgtctccagctggtgaggactcctccagggtgggccagctcactcagaggaaaccctcctaggcatctcgtaatggct

SEQ ID NO: 6868387 - DNA, 80 bp, Homo sapiens
agtcttcaacatttctgagaatatcagtttgaataagataggcctgggagctaaataatcttagaaaatgctggaagatt

SEQ ID NO: 6868388 - DNA, 77 bp, Homo sapiens
agggtctcctctatgagctcagcgtgggtctgttttaagctaattcaaaacccttccaaatgagcttattagattct

SEQ ID NO: 6868389 - DNA, 59 bp, Homo sapiens
gcatccaggactatatgatgatgttcaaaaactgcatatttttatgtcctttctggagc

SEQ ID NO: 6868390 - DNA, 78 bp, Homo sapiens
atcactctgtctctcaggctggagtgcagtggctggatcttggctcactgcaacctctgcctcttgggttcaagtgat

SEQ ID NO: 6868391 - DNA, 104 bp, Homo sapiens
cacaggttactcaatagcccagaggaggaaatggttgttcaggtgggccggggaaggcttcccggaggaagctgtttctgtgctgggttcctgaaggacaagtg

SEQ ID NO: 6868392 - DNA, 59 bp, Homo sapiens
tcagtggttggatgatggtcgcccacagtagtacgggtgatctttactcagcctactga

SEQ ID NO: 6868393 - DNA, 82 bp, Homo sapiens
tttagagtgaataaacaaatatgtgtgataataccttgaaaagttgcaatttattatcagagctatttggaattaatctgag

SEQ ID NO: 6868394 - DNA, 71 bp, Homo sapiens
gcttctgttcttcacattttggggtcacggactcgtttgagcatctgatgagtcttgtgaagaatggatgc

SEQ ID NO: 6868395 - DNA, 70 bp, Homo sapiens
gcttaaagaatgaagccaggtagaagagaatgctgacattttctgattgctttttggttttccattaagc

SEQ ID NO: 6868396 - DNA, 70 bp, Homo sapiens
tgaaatgcaaaagagtgagtggtaatctttaaaagattaaagagcccttccatgactcttctacatttta

SEQ ID NO: 6868397 - DNA, 68 bp, Homo sapiens
tttggctgtgttaccacttcatgtctaccctccaggagagtttataagggttggctgggacagccgag

SEQ ID NO: 6868398 - DNA, 60 bp, Homo sapiens
taactttgaagggaattttactcaagtaaattattatagtgggattctaatttagagttg

SEQ ID NO: 6868399 - DNA, 66 bp, Homo sapiens
cacctgcagggcttagaaatggtggctataatcagaaagcatgtagcaatagaagccttgcagctg

SEQ ID NO: 6868400 - DNA, 62 bp, Homo sapiens
agggaatgctacatagatacaaaaatgaaaagcttcttttgtaatgatatggagcaatctct

SEQ ID NO: 6868401 - DNA, 104 bp, Homo sapiens
ctgacattgaaacagtgcctttgatttggacagaaagaacatggttgaaaaatacagctttgaaaatccaaattacaaggtatgggctgttattaggatgttag

SEQ ID NO: 6868402 - DNA, 88 bp, Homo sapiens
ttttggctcaagaaaggcaaaagctgtcttcacgatgtatctgttgcatgctgagataaggctttagtcattctactatgaattaaaa

SEQ ID NO: 6868403 - DNA, 68 bp, Homo sapiens
agatagacactggtcatgcctgggtgtttggcagcagtgggaacccaggcctactggcccctctgtct

SEQ ID NO: 6868404 - DNA, 80 bp, Homo sapiens
tcagataaagcacattctttcacagttctgaaaccctttgttttaggctttgcaagagtgaaaaatattgttctatctga

SEQ ID NO: 6868405 - DNA, 129 bp, Homo sapiens
tcaagcactgtatgtaatgtaatggcagaagcacaaatttagttaggggaaaaacgacaggggtcctctgactcttttcttctaattgttctgcctctagcattaccattatcagtataattagcttaa

SEQ ID NO: 6868406 - DNA, 58 bp, Homo sapiens
cattccatggaataaattccttattgaaggtaactttcagaattatttttatgggatg

SEQ ID NO: 6868407 - DNA, 60 bp, Homo sapiens
agttactgcatggtggagtggagcttggcagggaacgggttttatgccatcatgcaagct

SEQ ID NO: 6868408 - DNA, 62 bp, Homo sapiens
gatactgtaagtatctaatttaatccttttgacagtcagaggaaggaggtcctaacagtatc

SEQ ID NO: 6868409 - DNA, 68 bp, Homo sapiens
attgtgccttattgactggtgtattccaagggtttgaaatagtacttggaacacagtaaatgcacaat

SEQ ID NO: 6868410 - DNA, 76 bp, Homo sapiens
tgtcatatgttcgtagatctttggttggaaacacaatgcaaataactattccaatcagctcctatgagaatagaca

SEQ ID NO: 6868411 - DNA, 82 bp, Homo sapiens
gcatactttaaattcattccaacttttgacaaaaaggagaagggaatttgtgtgaaggtatgatgagtttaaagaaacatgc

SEQ ID NO: 6868412 - DNA, 60 bp, Homo sapiens
cccactgtggaagaaaggggaggtcccacggtacttgccttggcctttcttcccagaggg

SEQ ID NO: 6868413 - DNA, 78 bp, Homo sapiens
tttgctacttctatttaagcatttggggcaagttactcaattcctctatgcctcttgtttccttacatggaaagtaaa

SEQ ID NO: 6868414 - DNA, 60 bp, Homo sapiens
agtctcttcctcatgcatatgtactttcctccacattgtacgctgcatgaggaggggcct

SEQ ID NO: 6868415 - DNA, 83 bp, Homo sapiens
tcagattcccaggagtgtcgggtcactaggtctccaggccatctggaggaagcttggcatctcactgactcttgggaatagga

SEQ ID NO: 6868416 - DNA, 56 bp, Homo sapiens
aaaagaatgtctgaacagctggctgaataaatcagccaaagttgaaacactctttt

SEQ ID NO: 6868417 - DNA, 68 bp, Homo sapiens
atccaagattaattcaggatcaggaaataaggtaatttggttctagtgacactgaattgagtcaggat

SEQ ID NO: 6868418 - DNA, 97 bp, Homo sapiens
tgttacactagcatacctttgctaggtaggtattggaagacatgacaattccagaattgcctgcttagtaagtcttggaatcgtactagcagtagca

SEQ ID NO: 6868419 - DNA, 57 bp, Homo sapiens
atgatttgaggggaaatactgcatagagtgggatcctacaactgccccctcaaacat

SEQ ID NO: 6868420 - DNA, 66 bp, Homo sapiens
gagatgccttcctttctgcttttaggtaatgaacatttattactgtggcaaagaagcaggctcctc

SEQ ID NO: 6868421 - DNA, 70 bp, Homo sapiens
gacagaaggcatagatgaaggccttagtctaggagaatggatagttaggctgaacatttatcctgctgtt

SEQ ID NO: 6868422 - DNA, 65 bp, Homo sapiens
gcctgaggttcagagacctcaaattatttccttacaaggagaggagctaggatttgacctcaggt

SEQ ID NO: 6868423 - DNA, 83 bp, Homo sapiens
ggaagttattggtggagagcactggtgttcctggctaatgtggggtctgtgattcagtgttctcccaggtcagtgctgcttcc

SEQ ID NO: 6868424 - DNA, 87 bp, Homo sapiens
gtggatgcacctctacaggagccccaggctgacaataaccttcctgatctggtttcaaccctggatgcttttacctggtgcatccat

SEQ ID NO: 6868425 - DNA, 59 bp, Homo sapiens
cccagccgccagttccttccctgggccactgtgttctggtccctgagagctggggaggg

SEQ ID NO: 6868426 - DNA, 95 bp, Homo sapiens
agtcactatatatcaagtgttttctccccaccaggctgatttgaacaccagcttttctggggtggatgaacatgcaccgataagctatgaggact

SEQ ID NO: 6868427 - DNA, 70 bp, Homo sapiens
atgcagttagtgtgactgaggaatgcagtttccacttttactgaattgcaattagttttactaactatat

SEQ ID NO: 6868428 - DNA, 68 bp, Homo sapiens
tcccaatttctcgaactctaatccaggaccttagtactcagtctggagatgggtcagggaaaatgaga

SEQ ID NO: 6868429 - DNA, 59 bp, Homo sapiens
tagtgccatatgtgactagaaccagagagtaaggcatggttctgtctctcttggagcta

SEQ ID NO: 6868430 - DNA, 81 bp, Homo sapiens
aggcatttgcatctagggcaacccagagcttccctagccttaagctttcctttagctggttgttctggatgggcagggttt

SEQ ID NO: 6868431 - DNA, 71 bp, Homo sapiens
tttgaactcaggcagtctgactccggaggctatatacatttaccctccttggtacactgctttttttcaaa

SEQ ID NO: 6868432 - DNA, 67 bp, Homo sapiens
agactaaagaagctagcaatctatattgccccaaccaaggtattatgttaagagacttctttgctct

SEQ ID NO: 6868433 - DNA, 59 bp, Homo sapiens
tccaggctgccacagtgcaacgacaggtaaaaggtgggactgtttcgggcacgtctgga

SEQ ID NO: 6868434 - DNA, 64 bp, Homo sapiens
ctgtgtgcagggcacaatggaagtaaacaccacccactatatatcccctgtgcctggcatacag

SEQ ID NO: 6868435 - DNA, 69 bp, Homo sapiens
tagacacttagcagagttgaatgtactgtatacatgttattttccagatatagtaaatgctaaggtctg

SEQ ID NO: 6868436 - DNA, 56 bp, Homo sapiens
gctccctgaaaagaacaaagtccacattattgttacttgttttggttttagggggc

SEQ ID NO: 6868437 - DNA, 77 bp, Homo sapiens
tccagggcctagggtgctgagtgagctagaggctgctgggaggacagcagctagctattcagaccgtgggctatgga

SEQ ID NO: 6868438 - DNA, 61 bp, Homo sapiens
cttgagaggctggctgctgtgctcacaagccttcatttacacagcaagccttcctttcagg

SEQ ID NO: 6868439 - DNA, 75 bp, Homo sapiens
tagcttgacttttctcagctgcactgtattacacctgagtcatttgaattgcagctgggaaagaaaaatcagttg

SEQ ID NO: 6868440 - DNA, 60 bp, Homo sapiens
atggaatgctccctggggacatggggccgaccctctccctttcgaggggcagcagtccat

SEQ ID NO: 6868441 - DNA, 67 bp, Homo sapiens
gacaagccaaggggttcagaaagaggtgagccaccattcgcttactaaatttctcaaagcccttgtc

SEQ ID NO: 6868442 - DNA, 70 bp, Homo sapiens
tctgttggctggaggtttcacctgagtttcacagggaaggccaggaggaacttttagtcaaagcagcaga

SEQ ID NO: 6868443 - DNA, 97 bp, Homo sapiens
ccctttatttgaaagaactagaatgttttcattatcctaactgtatcctgacagatatcagaggtattgcaaaagcctagattccaagtacaaaggg

SEQ ID NO: 6868444 - DNA, 97 bp, Homo sapiens
gcctgctcattggaattgcctggagagctggttcaaagcagactctgattccgcagatctggaataaccctgcttccaagtgatttccatgggctgc

SEQ ID NO: 6868445 - DNA, 76 bp, Homo sapiens
agatcggccgggggccgccagaagccaggaggaggcaaggaaggatgttccccaggtcctgtcggctccttgattt

SEQ ID NO: 6868446 - DNA, 59 bp, Homo sapiens
agttttctgcctctggatgcgtaaagcttcaacctgctggcttttagagggagaggact

SEQ ID NO: 6868447 - DNA, 75 bp, Homo sapiens
gtgcagggtttgaggtcttatagcacctacataaattctaccagggatctaagggaacagcttcaaactcagcac

SEQ ID NO: 6868448 - DNA, 93 bp, Homo sapiens
ccccatacctctgccaacccgtattggtgcccatgcattcctccgtccctttccagcactggcatccatcgtggggttggacagaaggcgggg

SEQ ID NO: 6868449 - DNA, 79 bp, Homo sapiens
ggaaaatgtaaggagctgatgtgacaaaacataggtttccagggatcctatttttacacacacttaatgccaaatttct

SEQ ID NO: 6868450 - DNA, 61 bp, Homo sapiens
catgctgattcttcctgagctttaactctgtgatcctcacagctcatgggaggaaggcatg

SEQ ID NO: 6868451 - DNA, 71 bp, Homo sapiens
gtgatggcacatgaccttgatggatgatatgggttcactgaaatgattcatgggggtctatgtgagaacat

SEQ ID NO: 6868452 - DNA, 70 bp, Homo sapiens
cttctgagaggggctaggagcagattttagtatattaaggtgtctacagagctccaagcccctttagagg

SEQ ID NO: 6868453 - DNA, 65 bp, Homo sapiens
tccccacagtttataaaatgctttttccaactcagagaaagtgaccttgaaaactggttgggtga

SEQ ID NO: 6868454 - DNA, 77 bp, Homo sapiens
ctgtgtgacccaggacaaaataaccaggtgattttcttctgagtttaatctgaatgtcttgtctgtggtaaacatag

SEQ ID NO: 6868455 - DNA, 76 bp, Homo sapiens
ctttcatgcttttttctagtataaataagcaataatagcaaagtcagatttaaaactggaaggaagcttcagagag

SEQ ID NO: 6868456 - DNA, 67 bp, Homo sapiens
ccatctcctcgcaggccagaacacgccacgtcactccaggacggttcgccacctttgagaagagagg

SEQ ID NO: 6868457 - DNA, 57 bp, Homo sapiens
ctgcccttctccagctcatgcctctgtatctggacatgctgtggggagtgagggtag

SEQ ID NO: 6868458 - DNA, 58 bp, Homo sapiens
gatagaaaggtgttgaaatccatcagggaagacttcctggataaaggcacttttcatc

SEQ ID NO: 6868459 - DNA, 74 bp, Homo sapiens
gattcacagggtttaattgcttgttgtcacacaatgataagtggcacaatcagtatttagacccaggtgtattc

SEQ ID NO: 6868460 - DNA, 64 bp, Homo sapiens
ctctcagcagaggagagaagatgcatgtgtgtggcttgggtcatctcttgcttctgaaagagag

SEQ ID NO: 6868461 - DNA, 100 bp, Homo sapiens
gaggcagaagaatcacttgaaccccgggaggcggaggttgcagtgagtggagatcacgccactgcactccagcctgggtgacagagtgagactccgtctc

SEQ ID NO: 6868462 - DNA, 64 bp, Homo sapiens
ggaagtgaagcccatttttagctgtgacagtctcacagttgacaaaggaatggtattcatttcc

SEQ ID NO: 6868463 - DNA, 73 bp, Homo sapiens
gacatcaccacagctttgcaccaggtgtgcggccaccactagctgagcttttgcccctgcagctgggtgggtc

SEQ ID NO: 6868464 - DNA, 59 bp, Homo sapiens
tgcacacacgcggcacatctgtggagccattattgctgctggatagctgtgtttgtgta

SEQ ID NO: 6868465 - DNA, 87 bp, Homo sapiens
ctttggcacgaaggtcctcaatacttctaccggggaatctaccctcctcttctctccaagatgttgcaagggactcttctgtttggg

SEQ ID NO: 6868466 - DNA, 89 bp, Homo sapiens
gacctgaacatatttaatttgctcattgtgataggcttggccaaaccacaagactgaatctcatatgaataaattagtctttgttagtc

SEQ ID NO: 6868467 - DNA, 125 bp, Homo sapiens
agcgccacaaaatcccctggggcctgtgagaacacagatgttggggcacctccccagcatttctgattcaggagggctgggcagggcctgagaatctgcatttccaatgagtccagggtggcgct

SEQ ID NO: 6868468 - DNA, 55 bp, Homo sapiens
ggctgcggccgcgggtctgtgcagcagccggtgcagggaccgtggagtagcagct

SEQ ID NO: 6868469 - DNA, 81 bp, Homo sapiens
tttcctccaggttctgtgcttacctgcccaggtgagtcaatgagctcatctgaggtttgaggcagttgtcctggaaagaga

SEQ ID NO: 6868470 - DNA, 72 bp, Homo sapiens
gctggttccttccagaggctctaggggagaatccatgtcatgcttctttcctagtttctggtggctgccagc

SEQ ID NO: 6868471 - DNA, 59 bp, Homo sapiens
gtagagattcttaaggggatcctttacaaaagcacttgtgatccttgaggtatctctat

SEQ ID NO: 6868472 - DNA, 81 bp, Homo sapiens
gggcagggcatccctgagcgggtgcaggtgccccaccaccaccgtggccctccgcctccgctcctccctgtgcttctgctc

SEQ ID NO: 6868473 - DNA, 85 bp, Homo sapiens
tcctagactgtgcagagcttctccatctgcccagagagggtgcttagctcatcagggactgcagagggaagctcagccaagagga

SEQ ID NO: 6868474 - DNA, 108 bp, Homo sapiens
gaggtgcttcgctgcagctcaactccatggctttcgcatctgcaatgaaaataataaacaagagaagttattgcaggaggccccatggaaccgaccagcagagctctc

SEQ ID NO: 6868475 - DNA, 66 bp, Homo sapiens
gcccactctcagaccacacagcccctgccttactctggaagtgggcagttcaattctgggaggggt

SEQ ID NO: 6868476 - DNA, 65 bp, Homo sapiens
gagtggttagaagtagtgtggctggaaatatctagttcgcccagacatttctgcttcaatcattt

SEQ ID NO: 6868477 - DNA, 55 bp, Homo sapiens
cctggcggccttggtcggcccacagcttcctcaagccaagctccccaggcccagg

SEQ ID NO: 6868478 - DNA, 62 bp, Homo sapiens
tacctcatagggctgttgtgaggattaaatgagttaattcaagtagcacacctagaatggta

SEQ ID NO: 6868479 - DNA, 85 bp, Homo sapiens
gggcaagattccggaggtggaacacagaacggtgtgcagcaggaacaagctacgcttctggttctggctttaggacttcaagccc

SEQ ID NO: 6868480 - DNA, 70 bp, Homo sapiens
gtatatacagttcgtgctgctaggagatgttcccactgcaggggagcaaattcagaagcagaatggttac

SEQ ID NO: 6868481 - DNA, 87 bp, Homo sapiens
cagcctctcctttccaaagatcccaaagagcacacctctgcaaaccagtgtctccagggagcttggaaagacccgggaggaagactg

SEQ ID NO: 6868482 - DNA, 80 bp, Homo sapiens
ctagactccttatgtaagtggagtcatatagcacttacttcctgtgactggcttatttcacttagcataatatcttcaag

SEQ ID NO: 6868483 - DNA, 111 bp, Homo sapiens
taagcatgttttcaaggtccagctatgttatagcatgtatcagtatttcatttcttcttatagctgaataatattctatgatatggatataccatattgggcatttgcttg

SEQ ID NO: 6868484 - DNA, 63 bp, Homo sapiens
ctcatagagttgttgtgagaagaaagttatttaatacatgtggcacttacaacaattcatgag

SEQ ID NO: 6868485 - DNA, 64 bp, Homo sapiens
gtggtaaggaggcagatgcttggctgtagggagaatcctcagagtaagcacttgcctttatcac

SEQ ID NO: 6868486 - DNA, 63 bp, Homo sapiens
ggtacagaagagagtagtccagttttgtttaacagacatacaagctggtacctcctccgtacc

SEQ ID NO: 6868487 - DNA, 60 bp, Homo sapiens
gtgactcggcacttgtcttggagtgtttccatgatggcactctgacaagtgcttggtgac

SEQ ID NO: 6868488 - DNA, 82 bp, Homo sapiens
caggcttctctgcttctgggacatctggacagtttcatttggaggcttctacgtggtcccagggtcttctgcagtaagtttg

SEQ ID NO: 6868489 - DNA, 59 bp, Homo sapiens
gccctgtgtgatcacatgaacatctttaaatattgtttttcaaaatgtggtccagaggc

SEQ ID NO: 6868490 - DNA, 98 bp, Homo sapiens
tatctggcaagattcctgacaatttagcaattgattctcataagccggttctatctggctctaagaaatcattgcttataggtactctagtcaaggta

SEQ ID NO: 6868491 - DNA, 86 bp, Homo sapiens
atcaactgctcagagtggtgacagggacgaggcttcaggcattggaaggaggtgctggctttctgtccctggcatttgatagtgat

SEQ ID NO: 6868492 - DNA, 83 bp, Homo sapiens
gacgatgcccggttgtgcctgggacacgagattttcagtgctgaagctgggggagtcccaggcaaaccagagtgggcgaggtc

SEQ ID NO: 6868493 - DNA, 66 bp, Homo sapiens
ctcatcgacttggctcacaaggacggttgctacgaagcagtattctcctgtggtggaggaaatggg

SEQ ID NO: 6868494 - DNA, 72 bp, Homo sapiens
ggtgtagactcaggcatatagtaggtgctcaatgaattcttattaaacagagatgcctgggtctgggacacc

SEQ ID NO: 6868495 - DNA, 70 bp, Homo sapiens
gtcctttttgaccctctgattgggaacacactcagtgaccttgggagtgttttactcaaagaaagaggac

SEQ ID NO: 6868496 - DNA, 66 bp, Homo sapiens
ccactgggtctgaaggacagagcatcaaaccaaagaggattgttcttgagcctttagacctaatgg

SEQ ID NO: 6868497 - DNA, 112 bp, Homo sapiens
tatgtggctccgtgggctaggagaagaatctgaaggcacctctggtcagtcactgcccatctgaaagacccagagaactgtgccttgagggccttagatcatcagtcacatg

SEQ ID NO: 6868498 - DNA, 83 bp, Homo sapiens
gtgcagagtgttgctagatgccctcgctgctgttttcttttgcccaggtctggtgggggaggctgtctagcagggcttcgcat

SEQ ID NO: 6868499 - DNA, 79 bp, Homo sapiens
cacaaatgttagaggcaggcctgcttcttacccttcaggccaaccctggacagtattgtgaagcaggcagatgtttgtg

SEQ ID NO: 6868500 - DNA, 58 bp, Homo sapiens
gataaggcagtcccttaacaaggctcagtatctggatcaaggtcttgtactgcttttc

SEQ ID NO: 6868501 - DNA, 63 bp, Homo sapiens
ttgttcttgtctttgccttcacctaagaaaataatgaagggtggtaaacaaggataagaagga

SEQ ID NO: 6868502 - DNA, 84 bp, Homo sapiens
cttcactcacccagtcttccactgtcccgcctccacgctggggacaggcaggcttgggacgagctggaggaaggggaggggagg

SEQ ID NO: 6868503 - DNA, 80 bp, Homo sapiens
aaggctgtggtggagactgttgttttgcccactggtgtcccctcctttgggcacacagctagattaccattctcagcctt

SEQ ID NO: 6868504 - DNA, 59 bp, Homo sapiens
ggcttgcctggatggtccccagagataaagcatcttatattcatgggggtccaggtacc

SEQ ID NO: 6868505 - DNA, 80 bp, Homo sapiens
ggacaatgctaagtattattaatgacacaacagttccttcctgcaggggatgggtggttcctggttcacttggcagctct

SEQ ID NO: 6868506 - DNA, 61 bp, Homo sapiens
tgaagtatcccaagatttacagtcacaatggggtggctggagggatgtagggtgtatttca

SEQ ID NO: 6868507 - DNA, 59 bp, Homo sapiens
aaggagcgcttagggggcagaatctaacccagattttgctgccctcaaaggtcctcttt

SEQ ID NO: 6868508 - DNA, 89 bp, Homo sapiens
atgaaaaaagcaataaaagaaatagaagaggccagaagagtatgtgatgtattcaatgggggtttctagttgttttgtttctttttcat

SEQ ID NO: 6868509 - DNA, 85 bp, Homo sapiens
gcctggtctcctccagatgtttataactcatgagtgccaggactagacctggtactaggaagcagctgcattggatttaccaggc

SEQ ID NO: 6868510 - DNA, 70 bp, Homo sapiens
ctgttgggactgtactatttaagcctggataacaactttgaattttccagggagtgttatattccatcag

SEQ ID NO: 6868511 - DNA, 118 bp, Homo sapiens
ctttgcatccaccagcttctgctgcagttctctgtgtttaaatattttgtccagatgctaagaaaaataaagtgtacatagaaagcttggtttattattggtgcttaaaaatgcaaag

SEQ ID NO: 6868512 - DNA, 79 bp, Homo sapiens
aagattctcagagtgaaagaatctataatcctgttacataagcataataggcaactgttcttccactctatggagtctt

SEQ ID NO: 6868513 - DNA, 86 bp, Homo sapiens
ggcaggggagcctctcacccggcctctttccaatcccacagcacagaccttggcagtgtggagggagagagcctggttcttctgcc

SEQ ID NO: 6868514 - DNA, 68 bp, Homo sapiens
gtcattcctatccatttgatactgtttgccaccacaagatgacagggtcagggttcaaaggaactgat

SEQ ID NO: 6868515 - DNA, 55 bp, Homo sapiens
cagtgggtaaataagtgggtaagtactcaactgaatactcaaaagttaccttctg

SEQ ID NO: 6868516 - DNA, 57 bp, Homo sapiens
ttatgctttcacctccttgactactgagctcaagggtcacaaaggtgagggacatga

SEQ ID NO: 6868517 - DNA, 102 bp, Homo sapiens
ttactgttgaatgggagcgaactacttgttgatcagttgttaaactttccttccccagaaagatgtcaattctgcagcccaacagtagtttgcttgtggtga

SEQ ID NO: 6868518 - DNA, 100 bp, Homo sapiens
gctggcatggaaggggaggctgttacctttagggacccttttggagttgctcctgctaataagagcctccctagaggtgaaggatcccagaacagccagc

SEQ ID NO: 6868519 - DNA, 64 bp, Homo sapiens
gtagaacttgaatgccaatatctccttcttgtccaggaggtagaacattgccatttacatctac

SEQ ID NO: 6868520 - DNA, 62 bp, Homo sapiens
gaatgtgtgtcagagtctccatggttcgatggaagaggactcacaggactctgcatatagtc

SEQ ID NO: 6868521 - DNA, 79 bp, Homo sapiens
agggtaactgttgtagctgcgctgcttcagagcttggcattctgagttcttggacggtggggttgacagcagtatccct

SEQ ID NO: 6868522 - DNA, 55 bp, Homo sapiens
cttcctcccggcccatgctctggcctcaggctagggtgtgtgtgctgggtggagg

SEQ ID NO: 6868523 - DNA, 60 bp, Homo sapiens
tatctttggacggtcccaactgacaatgttaaatttgtaagacacccgactccagagatg

SEQ ID NO: 6868524 - DNA, 70 bp, Homo sapiens
gtcctggtgtcatatcccgaaggaggatgcatttcatcagcatctatcgcttggctatgattttagtgac

SEQ ID NO: 6868525 - DNA, 73 bp, Homo sapiens
agctgggcagcggggaagcctcagtgactggcccctacctagactgggccatttccccagctgccagccagct

SEQ ID NO: 6868526 - DNA, 74 bp, Homo sapiens
tacaacatgggccagaactttgggccaggcttaggtggagcctctgctcagtgtgttcaagggctcatcatgtg

SEQ ID NO: 6868527 - DNA, 125 bp, Homo sapiens
gtcagatataaatcaacgttacagcactctttccaagaatgtgttagaatgtgcatgtgtttggggagcagacatggtatttctattataattttgtttgttaggtgtgatctgaattgtttggc

SEQ ID NO: 6868528 - DNA, 59 bp, Homo sapiens
ccagctttgtgcaatgcagtctctaaacactcctctagggatgacaattcaagggctgg

SEQ ID NO: 6868529 - DNA, 74 bp, Homo sapiens
gtctgtcttccagtcttcccagctgctgcgatgccactgagctggctgggtcccagctgggaggaggagcagac

SEQ ID NO: 6868530 - DNA, 81 bp, Homo sapiens
gaggaaaggctcagggcgcgagggacgtggcgggcaccgacaggaagtgcaatctcatttctcttcgctgagcttctcttt

SEQ ID NO: 6868531 - DNA, 87 bp, Homo sapiens
taaagcatgcagttcacaaattcttatgttcagggacattgtaaaaggcattgtctttgtttaagggatacaacttgcaaagtttta

SEQ ID NO: 6868532 - DNA, 98 bp, Homo sapiens
tggggttcaaggtcaacatgtaaaccattgtgagcatcagtgcaatgctgcacaagatggtcaccagtgttctttgcagaatgacaaatcaagcccta

SEQ ID NO: 6868533 - DNA, 69 bp, Homo sapiens
catttcccactgggttctgtttggccactgcctggcttcgcagctgtgctgattgctcagtagggaatg

SEQ ID NO: 6868534 - DNA, 56 bp, Homo sapiens
ttctaaatgggtcagctcacaaaataaagtggaatgtgtgctgatacattggagaa

SEQ ID NO: 6868535 - DNA, 60 bp, Homo sapiens
gagaagcagggtcttcctcagttggtgggaagcctgccaggggagtggacactgtgtctc

SEQ ID NO: 6868536 - DNA, 122 bp, Homo sapiens
atggggtttcaccatgttggccaggctgctgtgacctcaggtgatccaactgcctcagcctcccaaagtgttggaattacaggtgtgagccaccgcacctggcccctcctgtgaagtcttgt

SEQ ID NO: 6868537 - DNA, 84 bp, Homo sapiens
gttgaggaaaagaaatgcaagctcagttccaaggtttttcccttgctaaaactcttaaaattttggcttgcttatttccttaac

SEQ ID NO: 6868538 - DNA, 57 bp, Homo sapiens
ctgctgttaggttggtgcaaaagcaattgcagtttttgccattacttttaacggcag

SEQ ID NO: 6868539 - DNA, 84 bp, Homo sapiens
agcactttttatcatgacactgggacaggagagaaaatgaattcaagctctaccagggttccagtgttaaacttggaaggtgct

SEQ ID NO: 6868540 - DNA, 66 bp, Homo sapiens
ggccataggggcttacatagttattaaaattgcatcataaatttggctctgagcttcctggtggcc

SEQ ID NO: 6868541 - DNA, 58 bp, Homo sapiens
gagcagctccagccgcatgacttcacggcacaggcaaagtcaaaggcaaggagagctc

SEQ ID NO: 6868542 - DNA, 61 bp, Homo sapiens
tatgctttctggtgcctttggaactgacagcaccctctaattaaaggcagtgggtggcgtg

SEQ ID NO: 6868543 - DNA, 74 bp, Homo sapiens
gctcagtcatattgtagtaataaacaacccacacatttcagtggcttgaaaatgttaacaaaggttggctgggc

SEQ ID NO: 6868544 - DNA, 73 bp, Homo sapiens
ttgcctctctggagttctcatgaggaactctgttttatgccaagagacctaagcatgtactccagggttgtaa

SEQ ID NO: 6868545 - DNA, 75 bp, Homo sapiens
tggtagctgggtccctctgctgatgggcacagcattaaacggcgtggccactcagcacagtggatgcagcctcca

SEQ ID NO: 6868546 - DNA, 70 bp, Homo sapiens
atgtgtgcatttgtcctataattttttagaataaatttctagaagattccagaggcaaagctaacagcat

SEQ ID NO: 6868547 - DNA, 56 bp, Homo sapiens
tagggatggaaacccgttttctagacactctaacacacataaggtttccattttta

SEQ ID NO: 6868548 - DNA, 56 bp, Homo sapiens
gaggcgtttattctcttcacgctgagagctcagtgtttagtcaagtaagacgcgtt

SEQ ID NO: 6868549 - DNA, 69 bp, Homo sapiens
aggagcatgatgtagaatcactggagaaactgtaaaatcaatatctctagggttttcaacactgtactt

SEQ ID NO: 6868550 - DNA, 66 bp, Homo sapiens
aaatgtgatcttggcccttaattactttctatgattggtatggtctggggaccgagggttacattt

SEQ ID NO: 6868551 - DNA, 123 bp, Homo sapiens
gtgaagcgtttagatgagcagaatttgatatctgcagcttactttcacatgattcagcaaaatattaatcatcggtgaatccagctgctaggtatttaggtgttcattgtactaatctttcac

SEQ ID NO: 6868552 - DNA, 72 bp, Homo sapiens
ggctcccagcggatcccccagcccgggctgcaggctgagccaaggctgtgcagggtccatattggtcaggcc

SEQ ID NO: 6868553 - DNA, 62 bp, Homo sapiens
ggaacggctgtggctggcggcagcggcagcgggcggctgctgtggcctggcgcagagctgcc

SEQ ID NO: 6868554 - DNA, 69 bp, Homo sapiens
ttctttttctccctttcctggaagattggaaacctttaggtttttataagcaagaaagggaaaaatgaa

SEQ ID NO: 6868555 - DNA, 67 bp, Homo sapiens
ggctctgactctctggacttccacctctatttccaggaagtagaacaaagttccagaaaagagagcc

SEQ ID NO: 6868556 - DNA, 61 bp, Homo sapiens
ccatggcaggggcgggacatgcactgagccagtctactgggttttctgcccctgtcagagg

SEQ ID NO: 6868557 - DNA, 104 bp, Homo sapiens
atgaagggctaccattgcttgagtgctcagagctctggtgcaggtgtttctcctacagtctccacaacagccctgataagtaggtagtactgttaccctattat

SEQ ID NO: 6868558 - DNA, 75 bp, Homo sapiens
caggccccacgatgttttgggagagtgtttagcacaggaaaatgcgcagaatacacgcacgacacgggggcactg

SEQ ID NO: 6868559 - DNA, 61 bp, Homo sapiens
cccagtctgatacagagacctcagcccaacctctacaatgtgtccttcagtcagatctggg

SEQ ID NO: 6868560 - DNA, 60 bp, Homo sapiens
ggcaaagatatgtctccaaagagatttgtgcatcaaatttctaggttcacatgtgtttct

SEQ ID NO: 6868561 - DNA, 56 bp, Homo sapiens
gcttctcgggcctgatgtcgtcctcgatgatgagttcgatgccagcctcagaacgc

SEQ ID NO: 6868562 - DNA, 55 bp, Homo sapiens
tcctgagtggttgttttcttcccactgaccaaagctggagagggatccctcagga

SEQ ID NO: 6868563 - DNA, 125 bp, Homo sapiens
agagtcccagtgcagaagctgaacttaatacctttgacatttaaggcagtcacttaatcagattactctctctggttatagcctatgggaattcacaggtgttaaattagcttcagaaggactct

SEQ ID NO: 6868564 - DNA, 60 bp, Homo sapiens
ggggtcctggtgccacctgcgggatgggagtgcccagcctgagtctgcacatagaacccc

SEQ ID NO: 6868565 - DNA, 57 bp, Homo sapiens
ctttctcagtgttaattactttgatcttcacaacaatcctgtattacactgagagag

SEQ ID NO: 6868566 - DNA, 89 bp, Homo sapiens
acatgacctgggagtttgttagaaatgtagattctcagacccactggattagaatcttcattttgacaagattcccaggggattcatgt

SEQ ID NO: 6868567 - DNA, 67 bp, Homo sapiens
tcattttggtccatctcttgagcccacatgaatactgtcatggatggaggaggaaggaccaggctgg

SEQ ID NO: 6868568 - DNA, 72 bp, Homo sapiens
cccttcttacactgacagctgaaaagcaggctgatagtcactgctccacagcagtttttagtgttcgatggg

SEQ ID NO: 6868569 - DNA, 65 bp, Homo sapiens
ttgttctgtggagtgacctgggctttgggatatttaaagtctcccaagatcactctactgtgcag

SEQ ID NO: 6868570 - DNA, 70 bp, Homo sapiens
cagaacagagtcaaaagtatgtgcaatgtcattattaattattgtaaacataaattggattctcgttttg

SEQ ID NO: 6868571 - DNA, 92 bp, Homo sapiens
gcattatttcagatttggtacacaaagtgagacttgataatcttaggttgcaggttttcagatgtgtgttgctccaaatttgcatgaaatgc

SEQ ID NO: 6868572 - DNA, 93 bp, Homo sapiens
gtttagccagaaagggatgtattcagctgtttcttccagatgtagagaaaagagccttggactcaggaagaaagcagctggttctggtgctac

SEQ ID NO: 6868573 - DNA, 82 bp, Homo sapiens
aaggctgtaagtccaagatcaaggtgccagtagggttgatttctcctgaggcctttctccttggcttgtgggctgcagcctt

SEQ ID NO: 6868574 - DNA, 80 bp, Homo sapiens
ggtggtaggttgctgtcagggttattaaaaccaaaagaatgatgttctgtaaataggtctgatagtataccttgaaaacc

SEQ ID NO: 6868575 - DNA, 61 bp, Homo sapiens
tgacttgaatcaggcatttcaagttaatccaaaagtttgagttaactggtgccttcagtca

SEQ ID NO: 6868576 - DNA, 59 bp, Homo sapiens
tcccagggacaccaagctgtttctgattgcaactgtaacagcctgtgtaccagctggga

SEQ ID NO: 6868577 - DNA, 91 bp, Homo sapiens
ggagagttctgatgaatacaatgttctacatatacataactgtatccatttgtgttttgcagagcattgaaatcatatagcagcatcatcc

SEQ ID NO: 6868578 - DNA, 80 bp, Homo sapiens
tcttttgataagtttcacagagggttagacgcagtttccacccagctgttgtccagtgttctctgaaatcaatcaaaaga

SEQ ID NO: 6868579 - DNA, 55 bp, Homo sapiens
gttctctcagcctttgttattattaatgcttaattttaaaggaagaagggaggat

SEQ ID NO: 6868580 - DNA, 117 bp, Homo sapiens
gttctaacccaaatagacataaagaataacacttatagataataataggatgtacaatagaattgtgaacatctgtttactcctgatatatttttgagggctgtaaggaaagagaac

SEQ ID NO: 6868581 - DNA, 96 bp, Homo sapiens
ggcacgacagcataacagtatgagactgtgagtgagaaataaccacaaaggttcatttctcactcacagtccatgtccactgtgtgctctggagcc

SEQ ID NO: 6868582 - DNA, 56 bp, Homo sapiens
aaggtcctgtagccacagagccagacaaggatcaaggttctgtggtcccaggcctt

SEQ ID NO: 6868583 - DNA, 61 bp, Homo sapiens
tggttgtatgtttcagtgtttgactggctaaataccaagtaaatgctccatacatacacca

SEQ ID NO: 6868584 - DNA, 94 bp, Homo sapiens
tactgaagccactgaataatggtctgtgatcttatcaattttcataaattaagcaggttgaaactggccaatgtttagctagcaaattttagta

SEQ ID NO: 6868585 - DNA, 68 bp, Homo sapiens
ccacatcagagcaggatttatattccattcaccaaccctcagaggaatttcccctgtctctgatttgg

SEQ ID NO: 6868586 - DNA, 68 bp, Homo sapiens
gaaggcttccaggtgcttctgtaagaaagacacctgtgatctccccttctaagtaccttaagctgctc

SEQ ID NO: 6868587 - DNA, 86 bp, Homo sapiens
gatggcaggatggaggtgggtatcatgagagattactaacatttgttcatttcttgctatgcgccacgcacttaacgcctgttatc

SEQ ID NO: 6868588 - DNA, 69 bp, Homo sapiens
ttccagaccattccacgggagacgtgcttcaagacctgtagtaacttgggcttctgtggaaggatggaa

SEQ ID NO: 6868589 - DNA, 65 bp, Homo sapiens
ggtgactcagccctgagcacgcaggaggcagcctgcctgtgcccggcccagggccctgggtttcc

SEQ ID NO: 6868590 - DNA, 77 bp, Homo sapiens
tccagcggcctatggatgtgcacagatcaataaggcctggggaatctcaggtagtgcacacgcatgtagcagttggg

SEQ ID NO: 6868591 - DNA, 56 bp, Homo sapiens
gtaaggaccctctaagtcatgttcgctatttttactggccttgagagtctccttgc

SEQ ID NO: 6868592 - DNA, 97 bp, Homo sapiens
gggagcttggttaaaatgtaggttcctgggtccctgccagagatggattcaggatctctggggtagggcccaggaccctgcattttcacaagcttcc

SEQ ID NO: 6868593 - DNA, 95 bp, Homo sapiens
gataaattcaccatgctatttgtacagcattcgagttgttttcccctagattaagcaatttgcttctctctggcaaatgccatgtgaaccatatt

SEQ ID NO: 6868594 - DNA, 76 bp, Homo sapiens
tctgcttccttggtattttggctgggccctcgcaactcattgaattattttgcagggctgaatgcagagaagcaga

SEQ ID NO: 6868595 - DNA, 63 bp, Homo sapiens
agtgtattttattttcacaaaagaaaagtgatttcactgaactgtgtggaaaaaggagacatt

SEQ ID NO: 6868596 - DNA, 90 bp, Homo sapiens
gttttcttttccttgccatctaaccagactgcctcataaagataaaggaaggagagaggtagcatctttggatgttattaagaaaaaaac

SEQ ID NO: 6868597 - DNA, 119 bp, Homo sapiens
gaaagtgaaaacaattcttaccttgtgggccttaaaaaagcaggcagcaggctggatttggcatgcaagccggtttgctgacctctgctctacacttgggtttttttgtcttttttttc

SEQ ID NO: 6868598 - DNA, 65 bp, Homo sapiens
ccttgttcttgaatagtgtgtgtgatgatttgttagaatgagagagcatcatctatggagtgagg

SEQ ID NO: 6868599 - DNA, 79 bp, Homo sapiens
aaagtaggagccagagggttgtcaggcgccttgtcaccatgtggacagaggatcccatcagctcttcctctccctcttt

SEQ ID NO: 6868600 - DNA, 74 bp, Homo sapiens
cataggttccagcttgacaaatgattttatgatattaagtatgaaaatatttctaacagttggttatgcctgtg

SEQ ID NO: 6868601 - DNA, 100 bp, Homo sapiens
gcatgatggtggttgcctgtaatctcagctactcgggaggctgaagcaggagaattgcttgaacctgggaggtggaggttgcagtgagccaagatcatgc

SEQ ID NO: 6868602 - DNA, 68 bp, Homo sapiens
cacaaagttgcccttttctggaatgcaaggctcctaaattagctgcaggctggaggagggactaagtg

SEQ ID NO: 6868603 - DNA, 130 bp, Homo sapiens
tgggatgtttaatagcaagggaagtaactgtgcgtctgttttaaactcaaccatgattaaatagggagaggaagcaggccgcttctaaagcttccctttagttctccaatcttatgctatttactcttca

SEQ ID NO: 6868604 - DNA, 76 bp, Homo sapiens
tggtaactttggacatcacttctacctgaaagagaccttcgagcaattcttctcaggtaaaagggtatctactcca

SEQ ID NO: 6868605 - DNA, 56 bp, Homo sapiens
tagggatgagccagtgggtagtaagtagagcaattctgccagactgattcacctta

SEQ ID NO: 6868606 - DNA, 83 bp, Homo sapiens
gtcactgaagtccttgattcctcagtttcttttccctagtattagagaggggaaaacaggaattaacaggttctttatgtcac

SEQ ID NO: 6868607 - DNA, 66 bp, Homo sapiens
tgaaggcagctgtgaggactggattcttggcctgtggatttccagtgactctcacaggtggcagca

SEQ ID NO: 6868608 - DNA, 88 bp, Homo sapiens
ccccactcaggaaaccttgacttctgaattcctatcaggtccagagggtggaaggccctggcaggaagcaggaggaggaggagagggg

SEQ ID NO: 6868609 - DNA, 58 bp, Homo sapiens
cccatctgtcagctggagatggcatgggagcttccatgccaggcagtcgatgcatggg

SEQ ID NO: 6868610 - DNA, 93 bp, Homo sapiens
gagagccaacgaaggcgtcgggcaggtactggggagtgaagatgtgatgtagctctcactccccacgcgcctacacatgactgttggcctctc

SEQ ID NO: 6868611 - DNA, 79 bp, Homo sapiens
aggaatactagaccaagtgtcaggagacttggattctactcctggctctgccactaacttggtatttcctggtttttct

SEQ ID NO: 6868612 - DNA, 87 bp, Homo sapiens
gaatgagtaattcagtatatgccagagagatagctacaccttatagattttgtagttccttacatgtactgttaacaatgcttattt

SEQ ID NO: 6868613 - DNA, 64 bp, Homo sapiens
cccaagaccagccgagagagcctgacctcggagatccctggctctgccacttcttggctgtggg

SEQ ID NO: 6868614 - DNA, 110 bp, Homo sapiens
gaataagattcactgatgagctgctgagagtggcttggctgcactacagggctagccagttgccatgtggcctgtggtcaagtcagagggagcagctgtgaatcctattt

SEQ ID NO: 6868615 - DNA, 74 bp, Homo sapiens
gccgaggtgagaggatcatttgagcctaggagtttgagaacagcctgggcaacatagtgagaccccatctcggc

SEQ ID NO: 6868616 - DNA, 80 bp, Homo sapiens
ttgtaaaaattccagggtacctctgatttctggtaaatttagccaatcataaattaaatgagttcttggaagctcaacaa

SEQ ID NO: 6868617 - DNA, 71 bp, Homo sapiens
gttcatctctggctccacttcatcctccaattggctgctcactgggagagtcagaactggtgcagatgaat

SEQ ID NO: 6868618 - DNA, 116 bp, Homo sapiens
tgaggatgaggagcaggagcgactgcggtctgagatttttaataggcagggctgtaaaatgttggccaggcctaagtcacagatgcaccacagagctctttcaagcccttattcca

SEQ ID NO: 6868619 - DNA, 90 bp, Homo sapiens
cagcctcatttccctaacaatcagcagggaggctctgtgccctgcgggtgggtggggctatcggggccttgtctgcagaggagggggctg

SEQ ID NO: 6868620 - DNA, 55 bp, Homo sapiens
gtaggcactcagataatgaatgatggaaagaatctacaatcgaatgaatgcctat

SEQ ID NO: 6868621 - DNA, 73 bp, Homo sapiens
cagggtggggttaggaaacatcatttttgctgtcatttgtgacctgggtaaggtctttcctggtttcactgtg

SEQ ID NO: 6868622 - DNA, 62 bp, Homo sapiens
tcagcgctggctggcgctccttcctgggaggctgactgccggaagaggcccagccctgctga

SEQ ID NO: 6868623 - DNA, 63 bp, Homo sapiens
ggggctccagtcttcacattttctaaatgtccttaaggaggagaaatggtgagtgagagcccc

SEQ ID NO: 6868624 - DNA, 84 bp, Homo sapiens
cgggattgccgccagcctccagtagctgaagagacgggaaacagatcgtcccctgcagtttctggagggaatgtggccctgccg

SEQ ID NO: 6868625 - DNA, 86 bp, Homo sapiens
gggcatatgccaggcacagtgttgctgttcaataaataaataatctccatccatattgactttaatttttgcctaacgcaatgccc

SEQ ID NO: 6868626 - DNA, 62 bp, Homo sapiens
agcggtgggaatttcaagaccaaatgttaaaacttaaaacagccttgcctgttcctacagct

SEQ ID NO: 6868627 - DNA, 71 bp, Homo sapiens
tttagtagaaatatttgggcctatggattgagagtgagtaagtctccacctttccagatgtttctgccaga

SEQ ID NO: 6868628 - DNA, 58 bp, Homo sapiens
tgccatttagtgcatcattagtttaatagagacttatgctctagtgtaccaaatggta

SEQ ID NO: 6868629 - DNA, 97 bp, Homo sapiens
caggaagggctgtgtagggagtgcgtgagatctatgtggcaaggtcctgggaccaggaccctgaggtctcctgtgagctagactgcctccctttctg

SEQ ID NO: 6868630 - DNA, 58 bp, Homo sapiens
gtctagggtctgtagtgcatgtctgcaatccatcagatctcatgagctgcccctagac

SEQ ID NO: 6868631 - DNA, 70 bp, Homo sapiens
cccttctcattctgggcctcccagtctgtgaaatgtgggagctggctcaagaggtccagaggagcagggg

SEQ ID NO: 6868632 - DNA, 74 bp, Homo sapiens
tctatgggggctcacagcagaccactactagtaggaggcttgcctcttacctctgcctggtccttttttgtaga

SEQ ID NO: 6868633 - DNA, 67 bp, Homo sapiens
ggcctctggtcaagacaagcatctatcagtttacctatccaagagctcgagtctttgccaggtagcc

SEQ ID NO: 6868634 - DNA, 82 bp, Homo sapiens
gctgtggctgatctgacaggaggcagagctcaggtggtaatgttggcttgcccactgctctcctactgcaatgcagcccagt

SEQ ID NO: 6868635 - DNA, 64 bp, Homo sapiens
tccatggttagaaatagcggaccctcggggaaggggtctccagcccactctagatattcgtgga

SEQ ID NO: 6868636 - DNA, 93 bp, Homo sapiens
ttttgttctttcggtcctgtacttgatgagatagaaacagatgacaagaaaacgtgttgatattggaatttagttagagaattaagaacaaaa

SEQ ID NO: 6868637 - DNA, 65 bp, Homo sapiens
tgaaggttgtctaagttcctctgcatgtgaactaacacctgcagagttgctttgatagtccctca

SEQ ID NO: 6868638 - DNA, 130 bp, Homo sapiens
tctttatgggagcaccatcttttttggtgatcacacctctggaaatgatgttataagaccaggaaattgatttcctgcattgcaaaatcattcccagggtcatcagtatcaaagccaagtggttcatgga

SEQ ID NO: 6868639 - DNA, 83 bp, Homo sapiens
ggcagaatgttttatcagagttttgaagctggtctggaggtccatcctgggctacagtgactgtgacagagcaaaatttggcc

SEQ ID NO: 6868640 - DNA, 85 bp, Homo sapiens
tcttggtgtctctccttttcctttggcttctctttcaagtcactggtgtcttagccaatctggggagacgggagaggcccagaga

SEQ ID NO: 6868641 - DNA, 93 bp, Homo sapiens
tgagaatctaactaagcccgatgatctgaggtacatgaaactgttccacctcagttcatgttagttagattcatcaccttagttagattctca

SEQ ID NO: 6868642 - DNA, 84 bp, Homo sapiens
tgtggaaaaaggaggctttgcgtgtgtgcatgtgtatcacacatgcatgtgtgtattcagagactatccttggacagatccaca

SEQ ID NO: 6868643 - DNA, 67 bp, Homo sapiens
taccttgggctattatctttgactttcattaaattttgcagacctcaggatattgtgtgccaaggtg

SEQ ID NO: 6868644 - DNA, 74 bp, Homo sapiens
aaatttatgcatgtgaaacttagcagtttctccatggacccatggaatgagtggctaagattcaaactgaattt

SEQ ID NO: 6868645 - DNA, 118 bp, Homo sapiens
cgccgaggtgcttgtgggacaggcccggggggccttggaggagaaggactttcagaaagcagaagggctgctgctccgggcccagagaccaggcctggccctcaattattataaggtg

SEQ ID NO: 6868646 - DNA, 87 bp, Homo sapiens
ggagaatcgcttgaacctgggaggcggaggttgtagtgagccaagattgcgccactgcactccagcctagcaacagagagagactcc

SEQ ID NO: 6868647 - DNA, 61 bp, Homo sapiens
gacgtgctcatatattcctcacatagctgttattaactagctgtgtgaattagggcatgtt

SEQ ID NO: 6868648 - DNA, 126 bp, Homo sapiens
gtcagggagcagctgggcttggcgcctggaacttagggtctctgagcctccggtgtccatggagactgagaggaaattgagactatctatgggctctggggccagggaaggtgctccctcagggac

SEQ ID NO: 6868649 - DNA, 84 bp, Homo sapiens
ctggtttgccctcctttgcttctgcgagctgctcagatagcactagatctctgcagcttgcacaggcaggccaaattcaaccag

SEQ ID NO: 6868650 - DNA, 80 bp, Homo sapiens
cgggggcttggaggaaggggctcttctgatgggatctgcagtaccccctggaagtgcccactgcctagtgagagcccctg

SEQ ID NO: 6868651 - DNA, 91 bp, Homo sapiens
tgtgtgtgggattcatcctctatgatatgtatgggtagtggtgcattatcccatagggttatcatagggactaagtgagttatttcacata

SEQ ID NO: 6868652 - DNA, 76 bp, Homo sapiens
gtctcttgactgccacctggtggtcctggaagtgaattcaccctctaggagaaccatcagggaggtggccagaggc

SEQ ID NO: 6868653 - DNA, 86 bp, Homo sapiens
agagtcttgctctgttgcccagggtggagtgcagcggcgtgatcacggctcactgcaacctccgcctcccgggttcaagcgattct

SEQ ID NO: 6868654 - DNA, 128 bp, Homo sapiens
gtgactctgtttcttgtggatataatttcggtgggtgcaaatggtgatggcaaataattgccctcagggagataattgctgttacaattatttacccatccaagttagctctgttaaaaatttaacac

SEQ ID NO: 6868655 - DNA, 56 bp, Homo sapiens
catgggaagtatcatttggcctggtatcaagatcagagagagagatatatcccttg

SEQ ID NO: 6868656 - DNA, 85 bp, Homo sapiens
gaatgtggtggcagtgaagtttgtcagttttggggtccaggcttgaagacaatggcagattcccctcctgtctctcgtaatattc

SEQ ID NO: 6868657 - DNA, 66 bp, Homo sapiens
gttgaaccatatggaattgctgtacagcttcaacagctgaatactggcaatttcatatggtgcaac

SEQ ID NO: 6868658 - DNA, 83 bp, Homo sapiens
tggctcaccccacttccctccctaccctccagctgaccaaaaccttccctgctgactggccgtccctagagatggggttgcca

SEQ ID NO: 6868659 - DNA, 66 bp, Homo sapiens
gtcaagaggtttcttaggggcttcctcttgtatgaggtaagaggtaagcctggaggcttctatggc

SEQ ID NO: 6868660 - DNA, 67 bp, Homo sapiens
gtgggttgacctatgctaggtgctcaatgagcgcatgcacattcagcatgcaattaggtaatcacac

SEQ ID NO: 6868661 - DNA, 130 bp, Homo sapiens
ttaggggagccatggcagggagagtgccttccaccctgaggccacccagacctggaggagatgcaggccccagctctgctaaagggcctttgaggtgggtgggactgtctcccagttgggcagctcttga

SEQ ID NO: 6868662 - DNA, 65 bp, Homo sapiens
cctgagccactgtggtcctcccatgatatgaacagagtctgtcgtggagctcacagtgtgccagg

SEQ ID NO: 6868663 - DNA, 55 bp, Homo sapiens
gcctggtctatatagacagagaccatgtctcatttgtttaggtagcaccatttgc

SEQ ID NO: 6868664 - DNA, 81 bp, Homo sapiens
gaagtctcttaaagatgacatgacttcagattttcttccttctgttagaactttgaagggtggagtgtgaaatctggcttc

SEQ ID NO: 6868665 - DNA, 75 bp, Homo sapiens
gtaatctccaagggttgtgggtggtcacatgccagcattacaagtagctactctcaaggcctatatggaggttgc

SEQ ID NO: 6868666 - DNA, 80 bp, Homo sapiens
tccatgcaggttaagaagctagagatgaacacgcagagtttatatactttggaagaatcgtgtcactggctctgtaggga

SEQ ID NO: 6868667 - DNA, 55 bp, Homo sapiens
gggggataggtttggaagaggtggccataagccattcattagagcttagtcctct

SEQ ID NO: 6868668 - DNA, 129 bp, Homo sapiens
aaccttactttcattgacatcataaaatctaacacttttggcacgatttgcaattttactttgcagtataattgaatatattgcattgtattgtaaatgtttgccactatgagagcaggagagaagatt

SEQ ID NO: 6868669 - DNA, 55 bp, Homo sapiens
cctcatttccagtctttctggagcaccggaggcagactgtgcgggaagagtgagg

SEQ ID NO: 6868670 - DNA, 79 bp, Homo sapiens
agtctcatactagatgctgcagggatgctagaggtaagacccacttcttctctcttgttctttgcctggtagggggatt

SEQ ID NO: 6868671 - DNA, 68 bp, Homo sapiens
tgtttcagatcagtaagaggaagaatggggtatggcatttcacaggcttttttggctgatgtggcaca

SEQ ID NO: 6868672 - DNA, 81 bp, Homo sapiens
ggtgtctctgtggccctagggtagggctctactgcagccctagggtagagagctaggccactggggcttccagattgcacc

SEQ ID NO: 6868673 - DNA, 55 bp, Homo sapiens
ctggctgtattagtttgatcctgggagggattaaagaccaaataactacagtcag

SEQ ID NO: 6868674 - DNA, 70 bp, Homo sapiens
gatagcaaatcgactgtagagacttggcggcggtggcattgccccaggtcgtcagcagtgtggtattatc

SEQ ID NO: 6868675 - DNA, 130 bp, Homo sapiens
cctaggattgttgtaaaaattaagtttatataatatatcagtatctatgtatttgtgtaggtatccacacatctagataaatagagaggtatagataggttagtgtttagcttaacgtaacagttcaagg

SEQ ID NO: 6868676 - DNA, 75 bp, Homo sapiens
ttgtttaagcccaggagttggaggctgcagtgagctgtgatcacaccactgcactccagcctgggcacagagcaa

SEQ ID NO: 6868677 - DNA, 76 bp, Homo sapiens
ggttgcaattgactgttcactgtctatgcccatgcattttatacaaggctgggcagtatgaatattcaaagcatcc

SEQ ID NO: 6868678 - DNA, 56 bp, Homo sapiens
tcagtgggctcagaactggcaggcggtgcaagctctgcttccctgggccacactga

SEQ ID NO: 6868679 - DNA, 79 bp, Homo sapiens
acttgaaatcttccaatggtcacatcaatctgaaatcactgattcattctaaatggtgtgccatatggagctttcctgt

SEQ ID NO: 6868680 - DNA, 75 bp, Homo sapiens
accgcagaatgtgaccttatttggaaatagggttattgaaaatataattaatttcagatgaggtcataatgaggt

SEQ ID NO: 6868681 - DNA, 74 bp, Homo sapiens
ctaagtaaatggttctcagttggtggcagttttgcccctcagggacatttgtcaataactggagtcattattgg

SEQ ID NO: 6868682 - DNA, 72 bp, Homo sapiens
tgaaaaacttgacttcaaacagttaaaggctatgattttcatagcttgagactgtatgagggaaaaggttca

SEQ ID NO: 6868683 - DNA, 76 bp, Homo sapiens
gtggggtggcaggttccgagatgaggaggaaccgcactgagaagcctcctctgcatccgaacccgccaccggtcac

SEQ ID NO: 6868684 - DNA, 85 bp, Homo sapiens
cagcacatgcgtcgacagaaaagcggtcaggaccctcattggggccactgaggagatcagcttttctggaacacatggtgagctg

SEQ ID NO: 6868685 - DNA, 77 bp, Homo sapiens
ttcatttttccaaattagaagtagagagggaaatttgaggtatgaaattaaaatagtctcacttctagaaagatgga

SEQ ID NO: 6868686 - DNA, 83 bp, Homo sapiens
ttagaggtggaaaggatggagttctggtctagaatgtcggaggtggaaggaatggtagggctaggattttaacccacctctga

SEQ ID NO: 6868687 - DNA, 59 bp, Homo sapiens
aagccaggaatggagtcttcgccagagaccaaatcagccggcaccttgttcttggactt

SEQ ID NO: 6868688 - DNA, 75 bp, Homo sapiens
acggctttctctgagtttctccagtgctagttgtcatgtaaagtgacaaggttcttgtggaggaattaaggctgt

SEQ ID NO: 6868689 - DNA, 59 bp, Homo sapiens
caaggcacagggccactttcccagtaaaagtattttcagcttttggggccttgtccttg

SEQ ID NO: 6868690 - DNA, 68 bp, Homo sapiens
ggccgtgccctgggggagttcagccgcactcatgagcacctccccccgagctgcccctgggcactgcc

SEQ ID NO: 6868691 - DNA, 59 bp, Homo sapiens
gcataagcctctctctccatctgctcattttccacaaaagtagacagacaggtttgtgc

SEQ ID NO: 6868692 - DNA, 122 bp, Homo sapiens
tctcctttctgccttttattacctgcgtgacctgagatattttacttgttatttttctcatctttaaaatgaagataagaacagtgtctgtctcacagggctagtgtgatgcagcagggaga

SEQ ID NO: 6868693 - DNA, 111 bp, Homo sapiens
cctgtggcccattagacaagctgaggctgacagttgtacctgcccctctggagaccatcacttcttagagggcggaagctgtgtcccagctatctttatatgcaaagcagg

SEQ ID NO: 6868694 - DNA, 79 bp, Homo sapiens
tgacatggacagagtatattgaagcagtcagggggataaattcagtctcttgatggaagatgtggctatgtcacatgca

SEQ ID NO: 6868695 - DNA, 94 bp, Homo sapiens
ggctataaagtcagccagagaacatctctgagacctcagctggggagaagctatcccctgaccgctgagattcaagaccctctggagaactgcc

SEQ ID NO: 6868696 - DNA, 60 bp, Homo sapiens
ggggaagaatggcagaaaacatcaccagagaagccagtgaaaaacatgccattctttctc

SEQ ID NO: 6868697 - DNA, 56 bp, Homo sapiens
agcagggctgcggccccaccacttactcactatgtgattcggagcctcagtttgct

SEQ ID NO: 6868698 - DNA, 81 bp, Homo sapiens
gataagaatattggttcctatgaccttccttgctagatggtaaatttcataaggccaaggggccatagtctcatttttatc

SEQ ID NO: 6868699 - DNA, 78 bp, Homo sapiens
agcttttcccaggcagtagaaagaagaggaagatggcctatgttttgcccaaggcctcattctttctgtgccgaagct

SEQ ID NO: 6868700 - DNA, 112 bp, Homo sapiens
ggcagagctgagcctggagcccctaggtggagtgtgcagggagagcagcagccctgagctgcctacagctatcctgcagcacccagccctgcttggggcatcggctgctgcc

SEQ ID NO: 6868701 - DNA, 69 bp, Homo sapiens
cataatactgtacgtcccagataggagctccttcttcaatttggctcccaggatgaagacagtgttgtg

SEQ ID NO: 6868702 - DNA, 74 bp, Homo sapiens
attgtgagctactttaattgcgaggaaggggagagagggtcttaactgcaccatcaaattagagaagccatgat

SEQ ID NO: 6868703 - DNA, 60 bp, Homo sapiens
cggggtttggagaaaggggaagacgggataggaaccatgcattctctgtgctagactctg

SEQ ID NO: 6868704 - DNA, 68 bp, Homo sapiens
gctctgcctaggacctaaaatcttataggacatttcctaatcataaagagtttagagtcttgcagagt

SEQ ID NO: 6868705 - DNA, 65 bp, Homo sapiens
ccacagctctctagggagctggttgcagatttgattcctacagcctcttccctggagtggattgg

SEQ ID NO: 6868706 - DNA, 130 bp, Homo sapiens
tctgtattttgtctggtgttatttcccctttaaatgcatctggaagcccagaaacctagtttcactatgtcctctggaggtttttaggtgataagagttttggagacctatacagacttccaatacagga

SEQ ID NO: 6868707 - DNA, 84 bp, Homo sapiens
gggagtctttgaagtcttgctttctggcccattattataataaatctgccagtttgatgatggcttagtggcagggcgagtccc

SEQ ID NO: 6868708 - DNA, 90 bp, Homo sapiens
gattaggtgggataactttatgagactgttttacacactagtacaatacaattattgagtgaatctgtctgcatcatgtcctttcttatt

SEQ ID NO: 6868709 - DNA, 103 bp, Homo sapiens
gcctgcaggtaaaaaatgtggctggttcagctagtgctgtttgtaaaactagactggccatgtttcttaaatgcctactgaaaccagttacatgcttgcaagc

SEQ ID NO: 6868710 - DNA, 70 bp, Homo sapiens
caactgcaaagattttcagtgcctaaaacaagctcacctgtcttggttcttctgaaacacgtagcagttg

SEQ ID NO: 6868711 - DNA, 57 bp, Homo sapiens
agatgccctcgcagccctttcgcgcttcccagtggagctgggctccaagagggatct

SEQ ID NO: 6868712 - DNA, 63 bp, Homo sapiens
aatacaccttaatcatatgtgtctggtatattatgtgccaagcatatagtgttaaggtgtatt

SEQ ID NO: 6868713 - DNA, 55 bp, Homo sapiens
ttggctgcttgaaataagacattgtggcacatcaacctctcttcttggcagtcaa

SEQ ID NO: 6868714 - DNA, 89 bp, Homo sapiens
atacaacaacttattcattttattatgatggacaccttcgctgttttcaattgggggctattatagtgtttccatgaatatccttgtat

SEQ ID NO: 6868715 - DNA, 88 bp, Homo sapiens
cctatgaactgtcctgtctagggtctgccccaccagtttatcatgcatatctaggtaggcctgagccctagtagtggacattcttagg

SEQ ID NO: 6868716 - DNA, 65 bp, Homo sapiens
cctctggacatacatctctggaaaaaaaatgaagttttatcctcagaaatgtatgttctaatagg

SEQ ID NO: 6868717 - DNA, 78 bp, Homo sapiens
ggctgattaaaagcagctgtcctttccctgactgcgtctgaagctcccacaaggcttatagttgctttttgttgtgtc

SEQ ID NO: 6868718 - DNA, 84 bp, Homo sapiens
cagaatacctaattcagactggctacattttcatggtgctcaatagctatatggagctaatggccactggattggatagcactg

SEQ ID NO: 6868719 - DNA, 62 bp, Homo sapiens
tttaccagtgttaaacaccagcagaaactgaaatcatgtggggtgcaagagaggctggtaga

SEQ ID NO: 6868720 - DNA, 77 bp, Homo sapiens
attgttaagtccccatattattagtagcttgttgctattaggtacataagttatggataaaatgtttactgaatgat

SEQ ID NO: 6868721 - DNA, 56 bp, Homo sapiens
cccttggcctccagagactgggcaggggcatagccctgctaggctggccttgaggg

SEQ ID NO: 6868722 - DNA, 77 bp, Homo sapiens
agggatagagccagagagccccaggttctactgccagctctgtcgctgtatgtgtgaccttgggcctcagtttcctt

SEQ ID NO: 6868723 - DNA, 55 bp, Homo sapiens
ccttcaatgaaagctgctcccatcgcctgagcggtccagagctagttcattgcgg

SEQ ID NO: 6868724 - DNA, 86 bp, Homo sapiens
tcaagtaattcctagcaagtcaaagactagaactagttagccattaattataaaaactattttagattattgactggaatgactga

SEQ ID NO: 6868725 - DNA, 61 bp, Homo sapiens
cagacctgggtaaggggctgacaaagattctttgcttgaccaaactttactcaggctcctg

SEQ ID NO: 6868726 - DNA, 59 bp, Homo sapiens
agttctctttagctcatatggttttctttaaaaattagtgatatcagctaaatggaact

SEQ ID NO: 6868727 - DNA, 58 bp, Homo sapiens
ctctgaaaatgtggtggggaaagggaaatcctgagtctgaattatctcattttcagag

SEQ ID NO: 6868728 - DNA, 67 bp, Homo sapiens
gagtcacgtcactgtctggcttgggctttctactgaggatctggcccccacctgcagtgacgagctt

SEQ ID NO: 6868729 - DNA, 67 bp, Homo sapiens
gctctgtgctgaagtgaaattcatcaataatggcctattttgttggtcttttcagttagcacttggc

SEQ ID NO: 6868730 - DNA, 58 bp, Homo sapiens
tttctttggcacagtctcatttgatgttcacatcagctctggctgagttagtcagaaa

SEQ ID NO: 6868731 - DNA, 93 bp, Homo sapiens
ggtttaatgctaatgccactatccttactgttctgtgagtatttgttcagccacgggtgattcaagagagttggggtatcagcatgtgcagcc

SEQ ID NO: 6868732 - DNA, 61 bp, Homo sapiens
agacttatctatgagtgggttttcttataaaagaaaagaaggctgccaaaatagataatct

SEQ ID NO: 6868733 - DNA, 59 bp, Homo sapiens
gcatctgcctttgtcattggctacaaaaagaatgggccacctggactctgggcaggtgc

SEQ ID NO: 6868734 - DNA, 103 bp, Homo sapiens
tgggaggtttttaaaatagcaaagggtaagggagggaaataacatgtatttaacccacactatgtgctaaacaccttccatatgcctttgcttagtcctctca

SEQ ID NO: 6868735 - DNA, 67 bp, Homo sapiens
tgcttctttgtgtaaatagctttcattttctccatctggaagtgatttctgcctgcatgttggagca

SEQ ID NO: 6868736 - DNA, 79 bp, Homo sapiens
tctcaatgctttgacatgggaagtgcttgattgatgtctattaaaatgaatcaacattgttttaagtcaagcaatgagg

SEQ ID NO: 6868737 - DNA, 75 bp, Homo sapiens
gattttgttagtattatgtattgtgttagtattatgtattgttagtattatgcatttgttagtattaataggatc

SEQ ID NO: 6868738 - DNA, 76 bp, Homo sapiens
gtgaggggctgggggtaaacgggaaaggaggtgggtgcaggaaacaccttctctgagttctcctccagccccacgc

SEQ ID NO: 6868739 - DNA, 72 bp, Homo sapiens
tctaattgaggtagtacttattattggaagcctatgcaaaggtattggaatggggattattttgcaattgga

SEQ ID NO: 6868740 - DNA, 72 bp, Homo sapiens
tttgttgcatattcttgtcttttccagaaattcaaacgatacctgaaactggaggcagggagatgtgataaa

SEQ ID NO: 6868741 - DNA, 116 bp, Homo sapiens
ggtttgtttctggggctcgttttcattcagcccatcagctttctatgattgtaaatggaggaatcgggggacagtgtggggtgagatggaactagcaccagtcttggagacagact

SEQ ID NO: 6868742 - DNA, 56 bp, Homo sapiens
tttacaaggctttaaataaccgtaaagttagaaactttgcagtatagcctagtaga

SEQ ID NO: 6868743 - DNA, 93 bp, Homo sapiens
gagttttccaattctgtaaaaggaatgcattacttcttgtcccagggatatgtggggctggaagctaacatccttttcccagaggcttaactt

SEQ ID NO: 6868744 - DNA, 73 bp, Homo sapiens
gcagctgtagctttgtgtcctgatttagctgacctaaaattcatgcactcccagatcacagagcattggctgc

SEQ ID NO: 6868745 - DNA, 64 bp, Homo sapiens
aatacttatgtgacctcattttgtgccctgaggccccgggacattcaggttacataactgtgtt

SEQ ID NO: 6868746 - DNA, 64 bp, Homo sapiens
tctataccaaaaaaattcttgtctgcctaaatttaggaagatggatttagatttttttggaaga

SEQ ID NO: 6868747 - DNA, 70 bp, Homo sapiens
gaatggtatactctgggtctaagaatgacaaacagatgatgtggtggtcacttaccagagtattttattt

SEQ ID NO: 6868748 - DNA, 76 bp, Homo sapiens
taaatgtgtaaaactgaatacatactgagggcaacaagctgtaggagtgtatttcagttaaaaagccatacgttta

SEQ ID NO: 6868749 - DNA, 60 bp, Homo sapiens
ctgtcacactgatatcaggcttgaccacatgattttcttggcctgatgaaatgtgagtag

SEQ ID NO: 6868750 - DNA, 76 bp, Homo sapiens
tcctaattatgacttgtagatgataatttctagatactctcctactagaaatgaatgtttaaaagtcctaagagga

SEQ ID NO: 6868751 - DNA, 104 bp, Homo sapiens
tggtggcagttgcagcacagtggccctggtggaagcctgggctcagacctcacatacctagatttgagttctggctccatggtcagaattttgtaacttcatca

SEQ ID NO: 6868752 - DNA, 60 bp, Homo sapiens
tgggtgacttatattgagcccagccctggttaagttgcaaagagtcatgtaagtcaccca

SEQ ID NO: 6868753 - DNA, 130 bp, Homo sapiens
ttattgtttttcacagcatatcttatggtacaatgatggatagtggcgaatatttatctcttcattatctcttaaaatcggcgtcacatctccatgtgttgttcattgctatatctgatgtctacaataa

SEQ ID NO: 6868754 - DNA, 95 bp, Homo sapiens
gatttgcaaacaaatctgagttatttgtagggattatatgtttaactaatagcaaatgttctaaattacatgtgatggatttgtttagtcaaatc

SEQ ID NO: 6868755 - DNA, 58 bp, Homo sapiens
gataagtgcccaaaatgaaaggaaatatgggttccttggcagcagggagcatgatatc

SEQ ID NO: 6868756 - DNA, 67 bp, Homo sapiens
gtgtccaccgttcagcaccagaggcagccgtaactcctgcctttggggtaagagagaggtggttagc

SEQ ID NO: 6868757 - DNA, 75 bp, Homo sapiens
ctgtttggggctgtgattttggcttttggtcagtctttcatgaccacagcttcttatatcactgggtccctgtag

SEQ ID NO: 6868758 - DNA, 96 bp, Homo sapiens
cctcttgaactaaggaatcactgaggggaaaggaatgcaagcaggtctgacaggatctgcagctttcccctgatttattgcaccttgctttagagg

SEQ ID NO: 6868759 - DNA, 62 bp, Homo sapiens
ctgcatcccagggagcaatgggttgaataggctaagagaaaatgttttgtggggccttgcag

SEQ ID NO: 6868760 - DNA, 68 bp, Homo sapiens
tgttgtgcacctagggcattttccaagctggtttccaggaaaatggaggttgcactaggtgatttgca

SEQ ID NO: 6868761 - DNA, 57 bp, Homo sapiens
tgttccaggatggagacactagtagttctcacggttttgctagtgcacgtccgaata

SEQ ID NO: 6868762 - DNA, 55 bp, Homo sapiens
actccccaaaactaaccatgcatattggcaaagtgtggtttaacttttggtgggt

SEQ ID NO: 6868763 - DNA, 59 bp, Homo sapiens
tggttgtttctgtttctgaccaattagacatttagaggcaacagcagctgaagcagcca

SEQ ID NO: 6868764 - DNA, 79 bp, Homo sapiens
ctttcaaagctatacttcgatggagtttcctatactagtgaaatctgttttaaatgaacatcaagaatagccttgaaag

SEQ ID NO: 6868765 - DNA, 64 bp, Homo sapiens
ttaaagcaaccatttgtctcaattctacgttttatcagcatgaaagtcaatatggtagctttga

SEQ ID NO: 6868766 - DNA, 60 bp, Homo sapiens
ccagtgacttgccaggtggatcttcagagaaagctgcacctggcactgctgaagtcctgg

SEQ ID NO: 6868767 - DNA, 71 bp, Homo sapiens
ctgtgttgaatcagcctgctgctgagtcacagggagtaactgcagctgcctagggctggcttctagcatgg

SEQ ID NO: 6868768 - DNA, 57 bp, Homo sapiens
ggcgtgagcctcggtgcaccaggaggcacttcccgcgggaggcgctgggctcgcgct

SEQ ID NO: 6868769 - DNA, 128 bp, Homo sapiens
ggactagggtaaggcaagccagggtgcagaatttaaggaggccttcactctcaggcttgtgcaaattcagaagcagcattaagagtgagtgcctccttaatgtttgtgccctgagtgcaccctagtct

SEQ ID NO: 6868770 - DNA, 64 bp, Homo sapiens
cagccagaaaaacaccaagaggatttacactatgatattttctagtctacttgatttttggctg

SEQ ID NO: 6868771 - DNA, 89 bp, Homo sapiens
caggaccattttgtcacccaggctggagtgcagtggcgcgatctcggctcactgcaagctcagcctcccaggttcacaccattctcctg

SEQ ID NO: 6868772 - DNA, 130 bp, Homo sapiens
atttgtactctgtaattttgccaggagacataacatgcatatacttaaatatgtcagaggtgaatagttacacattatatattcatgagtattgcattcctgtgttggcaacaatggtattgtacataat

SEQ ID NO: 6868773 - DNA, 70 bp, Homo sapiens
tatttttttctcctttcctttggcttatctttccttgcactggaatgctaggaaaggaagaactttgata

SEQ ID NO: 6868774 - DNA, 87 bp, Homo sapiens
tcaggtatgtctttatcagtagtgtgaaaacagactaatatagtaaattgtaccagtagagtggggcactgctgtaaagatacctga

SEQ ID NO: 6868775 - DNA, 98 bp, Homo sapiens
ctgtcaaatgacctggtatcatggagattttcccagattgatttttgaaagatgtccaactctgaagaagacttccagacttcagggcatctgaacag

SEQ ID NO: 6868776 - DNA, 78 bp, Homo sapiens
tcctggcattttcacatatcaactctatcctctctgtacaactatggaggaaaatgttaatatggaaaataacatgga

SEQ ID NO: 6868777 - DNA, 88 bp, Homo sapiens
cccagcagcagcagaaagccaaggggtgttttcaggactcagctgccaaagtttcttgaagcagctctgctcaaaggcatatgctggg

SEQ ID NO: 6868778 - DNA, 62 bp, Homo sapiens
tgaagatttgggtccaggttgctgagtttaatgtgaattctcagcaaaatgcaagattttca

SEQ ID NO: 6868779 - DNA, 71 bp, Homo sapiens
agtgttaaaaccgttttaccatttgtaactctaatctgatttggaagtgtgcagtttaaaatgttaacact

SEQ ID NO: 6868780 - DNA, 72 bp, Homo sapiens
tgggagctgaataggactgtcatctctttgctgtgtcacacactagtgatggaagcctgcagaattctccca

SEQ ID NO: 6868781 - DNA, 60 bp, Homo sapiens
cctcttctgctctgacttgcaaggaactcaagctgttctgcattccagggccaggagagg

SEQ ID NO: 6868782 - DNA, 71 bp, Homo sapiens
cttctataaactgtgatctttcttccaattttaacttgaatgtcaggcaataggatcacagttccaagaag

SEQ ID NO: 6868783 - DNA, 72 bp, Homo sapiens
ttaaggattcatgaggttagagtgggtccacctggataatctaggctaatcctccaatctcatggcccttaa

SEQ ID NO: 6868784 - DNA, 129 bp, Homo sapiens
gcctccctgggccctgaggacggagcgggttacacaggctccctggaatgttggctgcccccaggagtagccgcctgttcttgggaattctgtgctgaccgcggcagccccgcaggggcccggggttgc

SEQ ID NO: 6868785 - DNA, 70 bp, Homo sapiens
ggccagcaaaagagggaaacagatgggttgtgggagatgaccctgcccccatgctgtttttgttctggct

SEQ ID NO: 6868786 - DNA, 76 bp, Homo sapiens
gtgtatactcagctcctggccgcattcttggatgtgtctttctgaggaccagtatgagagcatctggggtgtacac

SEQ ID NO: 6868787 - DNA, 57 bp, Homo sapiens
cacactgttctttgcactgagaacaatgtgacaagttttaagcaaaagaatggtgtg

SEQ ID NO: 6868788 - DNA, 66 bp, Homo sapiens
ctttctggacatttggtaggatagagatggagatccaaatcttttagactgaatgatcctagaaag

SEQ ID NO: 6868789 - DNA, 68 bp, Homo sapiens
gatgctatatggggcagccatggctccaatcatgaggtagggacacactggctgtgcccatagagctc

SEQ ID NO: 6868790 - DNA, 78 bp, Homo sapiens
atgggaagtgaagtcagggaggaggaagatgtcactgataacacctgaaaattctaatcttccgacttgatttctcat

SEQ ID NO: 6868791 - DNA, 111 bp, Homo sapiens
gaagagaaagagggagaagggggggagagagagagagagagagagagaggcatttcagctttagcttaattggcttatttcctcaaacccattgctttgtcgcgtttcttt

SEQ ID NO: 6868792 - DNA, 76 bp, Homo sapiens
gatttcagactttgtggggccctcccgaagcctgggtggcagaactagggctggaagctccagaaagtctggcttc

SEQ ID NO: 6868793 - DNA, 68 bp, Homo sapiens
ctctcagtgccacacagccattcctgcctctcatcaagcaggttatgatgggcacggcagtctgagag

SEQ ID NO: 6868794 - DNA, 82 bp, Homo sapiens
gaccctggggatctaaagtgtttcatgaaagattaatgtccttgatctgtttgtaagtgttttggaaaaatcttccatggtc

SEQ ID NO: 6868795 - DNA, 62 bp, Homo sapiens
tgggaaggttgatcatgataactaagtttaaatgcttttctgtcattttaatcacctttcca

SEQ ID NO: 6868796 - DNA, 104 bp, Homo sapiens
gagagctgcccagacaatgagctgttgggtgagtactcggagtgctttggagatgatccacactcctgaagtattgtttgagtaaaagcagtgtctgagttctc

SEQ ID NO: 6868797 - DNA, 56 bp, Homo sapiens
ttggaaacgtcaccttttcctttagatgctaatatgcataaggggatgtcctccaa

SEQ ID NO: 6868798 - DNA, 56 bp, Homo sapiens
ttttctaatggcccaatggcgtaggacaatgccaagttgtttttggccagggaaag

SEQ ID NO: 6868799 - DNA, 82 bp, Homo sapiens
ggttgcaagtctttgctgttgtgaacagtgccgcaataaacatacgtgtgcatgtgtctttatagtagaatgatttataatc

SEQ ID NO: 6868800 - DNA, 63 bp, Homo sapiens
atccaagaaatctatactcagctaaccttctaattgtgagggtagaatacaggtattttggat

SEQ ID NO: 6868801 - DNA, 84 bp, Homo sapiens
gatcagacatggggagccagaaaagctgcctgacttaggtacgagagagtcagggcaggcttctggcaggaagtgatattgatc

SEQ ID NO: 6868802 - DNA, 120 bp, Homo sapiens
tgctgactcacaggctaataaatgcatgtgttaaattacttggacatttagcagacatggtgatctgtatatagccatgccttatagtccacagtggagcatacatttcctgagagcgta

SEQ ID NO: 6868803 - DNA, 65 bp, Homo sapiens
gtgagcgagccgcacctgggcgcctacatcaacgcctgcgaggagctcaggtagggctcgcccgc

SEQ ID NO: 6868804 - DNA, 63 bp, Homo sapiens
ggtaccactgtgagacacagtcctgcttgattcctgggcacagcaccttttcacattggtacc

SEQ ID NO: 6868805 - DNA, 63 bp, Homo sapiens
tcacctttattttccatgtgaagcagatggcaaagccaccttcccacagcgaagacaaggtgg

SEQ ID NO: 6868806 - DNA, 66 bp, Homo sapiens
agctccaggcagcatagtggatgtggtaactaaagccatggtccctagcacagctgtcctagagct

SEQ ID NO: 6868807 - DNA, 55 bp, Homo sapiens
gtcatgttaacctagagtgcctatcgctgactaggtacttaagaaactctatgac

SEQ ID NO: 6868808 - DNA, 59 bp, Homo sapiens
tttggcgtgttatagttgggttgggtggctgtgcctctccctgaacatgacacaccaga

SEQ ID NO: 6868809 - DNA, 77 bp, Homo sapiens
gaaaaaaaagttaaagttaatcttggaagttagttttttcaaggttccaagtgaaagtagctttgttctttcatttc

SEQ ID NO: 6868810 - DNA, 61 bp, Homo sapiens
gcttctcccttcttctgattgagatggggagtcactagaggaattgaagcagaggagaggc

SEQ ID NO: 6868811 - DNA, 83 bp, Homo sapiens
ggaaagaatggaaagtcttcacggcactagtgttcagcttctaggtttacatgtggtcaatctgtgtaggatgaattctttct

SEQ ID NO: 6868812 - DNA, 85 bp, Homo sapiens
ctcaggctgtgacactctagagggaagcgctttctgttgtctgaaagaaaggaaagtgcatccttttagagtgttactgtttgag

SEQ ID NO: 6868813 - DNA, 79 bp, Homo sapiens
gcttgatatatttttaaaattggtcttagctgttatacagggataatccataattgagaccttaaaaggtatgtcatgt

SEQ ID NO: 6868814 - DNA, 86 bp, Homo sapiens
ggagacccccaccctcacctgcccacctgcttccacacttttctgtcccacagaggcctccgaaaggtgggctgtgtgtgggctcc

SEQ ID NO: 6868815 - DNA, 103 bp, Homo sapiens
ctgagatggagttttgctcttttgcctaggctggagtgtagtggtgtgatcttcgctcactgcaacctctgccttctggtttcaagcgattctcctgcctcag

SEQ ID NO: 6868816 - DNA, 102 bp, Homo sapiens
aggcaagagaggtagtaaagtgcaaatttaagaaggcatacttgcatgaccttgggagtgagtgcctccttaaattctgcacctagacaacctctcctgctt

SEQ ID NO: 6868817 - DNA, 71 bp, Homo sapiens
caagtgtcactctgtgctttcagtcacatgttatatacagaaacatgtaaggatggtacagtgtacacttg

SEQ ID NO: 6868818 - DNA, 59 bp, Homo sapiens
ggaggttccagcccaatatggcctcggaggtggccaagatgcccctggtagggatctcc

SEQ ID NO: 6868819 - DNA, 80 bp, Homo sapiens
ggtggaaacttctctgtgggggagaggcagctgctctgcattgccagggctgtgcttcgcaactccaaggtgaggccacc

SEQ ID NO: 6868820 - DNA, 66 bp, Homo sapiens
cttattataaaatcctgtttgactatgggtcaaattgcttgtggaaaaaatagaatttttaataag

SEQ ID NO: 6868821 - DNA, 70 bp, Homo sapiens
gccccattttcagcccccactcgtggcagtacagtatcttcctgctgggaatcgaggtgtggaaaggggt

SEQ ID NO: 6868822 - DNA, 68 bp, Homo sapiens
aatacagtaaacatgtgagtgtgcatatatgtgtaaatatgtgtgacacattgatatgtgcatgtgtt

SEQ ID NO: 6868823 - DNA, 66 bp, Homo sapiens
ccaaagaatttggaaaatctgatggtgtgagcagcagccgttagtatcagggtttcccattcttgg

SEQ ID NO: 6868824 - DNA, 129 bp, Homo sapiens
gacattttctttggttaaattgaggttgtgcatttttggtaagaatataatggaagtgatattgtttcctgatcagtgcattctaccaaaaggcacatgatattgatttgtcctgttgctggtaatgtt

SEQ ID NO: 6868825 - DNA, 80 bp, Homo sapiens
gagggtaagtaggttagcttctgggccaaggagggctcctgcaggcttgttctgggtaaaagctggtctccttgaacctc

SEQ ID NO: 6868826 - DNA, 127 bp, Homo sapiens
agataaaaactaattggctatcattgttgtgataatcttactcatgtcttcacccattctaaaaatagtttggggtgtgtgaaattatgtcatttggcaatgatgccttatttcagtaaatttattt

SEQ ID NO: 6868827 - DNA, 93 bp, Homo sapiens
gaatcatcctttagggctcataccctgttctggagtgaatgtattacatcatgtatttggaaggggttttgttgagtgcctgagtgatggttt

SEQ ID NO: 6868828 - DNA, 64 bp, Homo sapiens
caatgtgtctggcatggctctattccatttattttagatcatggaatacgcaccagatgcactg

SEQ ID NO: 6868829 - DNA, 89 bp, Homo sapiens
ggatcatatttgggtctatcacctttctggcaatgaggaaagtaaagctcagtggtcagatttatgtggctaggctcattgatgtattc

SEQ ID NO: 6868830 - DNA, 68 bp, Homo sapiens
tcagtgtaagccaagtctaaaattaaatgaactaatatgtacaccataattacttggctttttcctgg

SEQ ID NO: 6868831 - DNA, 62 bp, Homo sapiens
tgttggtcactagtacatcccagcaccttgcagagggcctggcagatagtaagtgatcaata

SEQ ID NO: 6868832 - DNA, 61 bp, Homo sapiens
gaaaatgaacaagtatttgcatgagcagtagtttgactgcttattatactttgctcttttc

SEQ ID NO: 6868833 - DNA, 73 bp, Homo sapiens
cccacagtgtgctgagcaggtgggggtgtgttctagactgatcacatcctcacattctcaggacaaccttggg

SEQ ID NO: 6868834 - DNA, 60 bp, Homo sapiens
tacagaggctgacaaaatattgcttcagttaggcaagcataacctgtacagccttctgtg

SEQ ID NO: 6868835 - DNA, 74 bp, Homo sapiens
gcttcagtgcaatgttgtgggtggttccaactgcctttgaactaggtgttgacagaaaaataacatagcacagc

SEQ ID NO: 6868836 - DNA, 60 bp, Homo sapiens
aagaggtctgcatggcagctgggtccacggccaggtaatccagcagctcaaggatctctt

SEQ ID NO: 6868837 - DNA, 74 bp, Homo sapiens
ggaaaacataatttagctctaccagtgcatttgtgcatacaaatgtgtataagggagagctaaataactttttc

SEQ ID NO: 6868838 - DNA, 75 bp, Homo sapiens
gtgtttggaattctgcagctcatgtcagcatctcaataaacatcactgagcagaagttgtaaatttcatctttac

SEQ ID NO: 6868839 - DNA, 66 bp, Homo sapiens
gtcttcagtgcggaggtggaattatcgctaaactgcttttaacttaccagctgtgcactgaacggc

SEQ ID NO: 6868840 - DNA, 59 bp, Homo sapiens
ggggagaatcatgtgcatgtttcaggtcttgttcaaaagcagcttagggaattctccct

SEQ ID NO: 6868841 - DNA, 129 bp, Homo sapiens
cgggggagcttagtgagcagcggcagggccctgcagcccgtcacacgctagcatccaccgggttgagtggctgcgcacgaccgcggcgggcgggcgggcgcgctgccggaacgctctaggcctcctgcg

SEQ ID NO: 6868842 - DNA, 99 bp, Homo sapiens
attgtaatctatatgtatgtatgtgtggttatagttttttatatgtgtgtgcagttcttggcacgtgtaatgatcaccacaatcagaatatagaacagt

SEQ ID NO: 6868843 - DNA, 112 bp, Homo sapiens
aagccccctttcacattttagtcatttgttacagtggcactccactccaagtaccaaagtctgtggtcgttttctattgctctgtaacaaattgacatgtaattagtggctt

SEQ ID NO: 6868844 - DNA, 86 bp, Homo sapiens
taagttctacggtacatatgcacaacatgcaggtttgttacatatgtatacatgtgccatgttggtgtgctgcacctattaacttg

SEQ ID NO: 6868845 - DNA, 93 bp, Homo sapiens
cctcactgcctgtgggtggtagggtgctgacctgttctctcaagaatggccagggaagaaaatccatcgctgccagctctagtgcccgtgagg

SEQ ID NO: 6868846 - DNA, 97 bp, Homo sapiens
tttcttggtttcttgaaagaggaaggagatgtattaattagcttttctgttaatctgtagtaatgatatttcccatttctctcacacagccaaggaa

SEQ ID NO: 6868847 - DNA, 89 bp, Homo sapiens
cctctgctgagatgatgttcaggctcatggtggcttcaggattatcataagcaccctttgtctggacatgtcctgaaactcagcagagg

SEQ ID NO: 6868848 - DNA, 60 bp, Homo sapiens
gatcctacagcaaacactgtgggccaatttttaacttgttgcatgttatgctgtagtatc

SEQ ID NO: 6868849 - DNA, 80 bp, Homo sapiens
agaaaagagcatctcaggttggtacctgaaacttggtagactccaccccaagtcacatggccaactgatgtgttacttct

SEQ ID NO: 6868850 - DNA, 76 bp, Homo sapiens
tgcaatccaataaaaggttttgagtacaaatatttaagagaaatctttatattagatgaggaacttattggtagta

SEQ ID NO: 6868851 - DNA, 68 bp, Homo sapiens
gaggcgggcggatcatttgaggtcaggagttcgagaccagcttgatctacatagtgaaaccccgtctc

SEQ ID NO: 6868852 - DNA, 65 bp, Homo sapiens
gccggctccctggaggatgtgaacttgaagcagaaatcaggaaagacattccagggagagacagc

SEQ ID NO: 6868853 - DNA, 60 bp, Homo sapiens
gatgagatagtatgtagcacctgaaaacagcagagtgtcaggtgtgcggactgctgagtc

SEQ ID NO: 6868854 - DNA, 116 bp, Homo sapiens
atttatagttagcctcagggagagtttatgatattttatgagattatcacatttcaggtagaatgtattcctcatgcaagagtcggccaaattcatccaggagtttgaaaatgaat

SEQ ID NO: 6868855 - DNA, 102 bp, Homo sapiens
gagaatacaggcagagccaatactgctgcctgcaaattatactcagtgagattataatctctgcaatggcacagtctttgctttgctcagttctgtattttc

SEQ ID NO: 6868856 - DNA, 61 bp, Homo sapiens
cagcttgaagttttgaggagaattacagtcacttcctctcagtattgaactttataagctg

SEQ ID NO: 6868857 - DNA, 71 bp, Homo sapiens
tctccttggagccagccctgtcccccacatccaggggtctgggcgaggcccagggctgcgttcctgggaga

SEQ ID NO: 6868858 - DNA, 59 bp, Homo sapiens
cccacatagcagaggactgagcagagaagtcattattctgtcaggaactggtgtctggg

SEQ ID NO: 6868859 - DNA, 56 bp, Homo sapiens
gacagactggttccagaccatttgctaccccaggaaatggctgggcaaggtctctc

SEQ ID NO: 6868860 - DNA, 60 bp, Homo sapiens
tgagggtaacaggcatctagaaaaatgaaaaaaccaggcgctagctgcctgttacctcca

SEQ ID NO: 6868861 - DNA, 55 bp, Homo sapiens
gctggctttatcgtcagactccggaaatgctagaacctgatcataagagaccagt

SEQ ID NO: 6868862 - DNA, 97 bp, Homo sapiens
gcggctagcatttcttgagcacttactgtcaggccccgtggagggagctggtatgctgggtcttggccagggggcttggtgaggccatgatggcggt

SEQ ID NO: 6868863 - DNA, 56 bp, Homo sapiens
gtgtaaggccccaggttctttacctgtgaaatgggattaacgatggctccttgcgc

SEQ ID NO: 6868864 - DNA, 106 bp, Homo sapiens
gacagtaaggataccagtgattactgtgcttttggtaccttcgctttcagtgccttcagcggaggcatttccaccaatgagcaagtcatcaatgttaccctctgtc

SEQ ID NO: 6868865 - DNA, 77 bp, Homo sapiens
ccttgatggtcatactctttgagtggaggtaggaggatgcattgcttctagctaacagaatatggaaatggttaagg

SEQ ID NO: 6868866 - DNA, 60 bp, Homo sapiens
ccctgcacactcgtgtcttgactcacgtggccttcatgatcgataccacgaggtgggggg

SEQ ID NO: 6868867 - DNA, 96 bp, Homo sapiens
ttgaaaaatttaactactaggagtttgtgaagatatcacctcatgggttcattgataaatgacaggtgattttatgctttcctgagataggttcaa

SEQ ID NO: 6868868 - DNA, 55 bp, Homo sapiens
aagcatggagcaatagaatgacactagatcatttcattctttcccttcagtgctt

SEQ ID NO: 6868869 - DNA, 67 bp, Homo sapiens
aatgctagagtgcaggagtagaattcctggtttggataccagctgtagcccatgcagctctgtcatt

SEQ ID NO: 6868870 - DNA, 111 bp, Homo sapiens
ggttggtaatgaccgtgagccttttctcccaactctggaagccagtgtccccgcaattggcttgtacggttgggagaaaactttgagaccaggagtcacctctatctgatc

SEQ ID NO: 6868871 - DNA, 58 bp, Homo sapiens
ggggagcatgctggcctgttggtgtgtctgattttcacggaaggcctagtccctctct

SEQ ID NO: 6868872 - DNA, 58 bp, Homo sapiens
gtcagcctggtgaagcccctcatgctggtcacagactgtgcccggggctccacctgat

SEQ ID NO: 6868873 - DNA, 56 bp, Homo sapiens
gttccagacttgccagtggaagggacttgcacaagattaaagggaagtgctgggac

SEQ ID NO: 6868874 - DNA, 76 bp, Homo sapiens
tcattcacgttttttgttggtttcagatgggttgaaacagtttaacaaatctggaattaagagaaagtgaagatga

SEQ ID NO: 6868875 - DNA, 59 bp, Homo sapiens
atttcaagaaggcagcagtggttaaaattggtacatgctgccaagttgtcaattgaaat

SEQ ID NO: 6868876 - DNA, 56 bp, Homo sapiens
gtgcaggacacagggattgtctgcgtgggcatgttttacagtccagctgtttgtac

SEQ ID NO: 6868877 - DNA, 62 bp, Homo sapiens
tcgcggtggctcatgcctgtaatcccagcactttgggaggccaagacaggcagatcacctga

SEQ ID NO: 6868878 - DNA, 77 bp, Homo sapiens
gccccagccgctggcccctccctccagggctgcagctgggctgagcctccaggaggggggtgctgtggtgactgggc

SEQ ID NO: 6868879 - DNA, 81 bp, Homo sapiens
aaggaagctccaaataggagggatgctgagcaggggcccctcccttgatgctccctgcttgtttcccttcaggggaccctt

SEQ ID NO: 6868880 - DNA, 69 bp, Homo sapiens
gtttctactctcagaagaatcagcagctattgccaatgtccatttagctgccagtcttctgaaagaaac

SEQ ID NO: 6868881 - DNA, 64 bp, Homo sapiens
tctcagaagggtggtgctggagccccaagaagcagacaagaaggggagcccagatcctttggga

SEQ ID NO: 6868882 - DNA, 57 bp, Homo sapiens
ggagaaggaagaaagctactatggccaaggccatcctcagtactcactcccatttcc

SEQ ID NO: 6868883 - DNA, 66 bp, Homo sapiens
gcccaatagtgtcatgaaaagtacactatatgagagatcatgtggctaacaaacaagacattaggc

SEQ ID NO: 6868884 - DNA, 130 bp, Homo sapiens
tgctcgccctttctttgtccttttccaaggccaggatacttactgtaaagaccttcgacaggcttccttgtgggagagtttgtttagagtgagtttggaggagcttaggatgaaggaggggttggaggca

SEQ ID NO: 6868885 - DNA, 72 bp, Homo sapiens
ggtttcctctcactgggacatattgctagtgttggctgacaatcagttgccatgtgtacctgagataaagcc

SEQ ID NO: 6868886 - DNA, 58 bp, Homo sapiens
tctctggggcctttctacatcactccctggttctgtaattaagttaggtacctagaga

SEQ ID NO: 6868887 - DNA, 59 bp, Homo sapiens
gaaatggattgtgtttgcctttgtatcagagataagccaggtggccacaaatctgtttc

SEQ ID NO: 6868888 - DNA, 55 bp, Homo sapiens
aagagctcaggatttcatccatgtgtccttggacaaggaactttttctgactctt

SEQ ID NO: 6868889 - DNA, 56 bp, Homo sapiens
tcattagcagctatgtcagcagaggccacactcctgacaagaagacctggtaatga

SEQ ID NO: 6868890 - DNA, 58 bp, Homo sapiens
gagcgcaccagccacatctcaatacatagcactgaaaaaatgggctatggtgctgttt

SEQ ID NO: 6868891 - DNA, 63 bp, Homo sapiens
ggctgccgagtggtgggtattgccttatagctgctctgccctgcaaggcctatcatggcagct

SEQ ID NO: 6868892 - DNA, 59 bp, Homo sapiens
gaatagaattgcataattttagggttttaagcaccctcagtaatcgtgcagtttagttt

SEQ ID NO: 6868893 - DNA, 76 bp, Homo sapiens
gtgggttgttccccaagtccacattgctaaccattaagctacgtgtctctgtgtggggttgggagaatcaacaaac

SEQ ID NO: 6868894 - DNA, 58 bp, Homo sapiens
gatggccttgttttctcccttctctctatttaatgacttttgaggagttgaggctatt

SEQ ID NO: 6868895 - DNA, 63 bp, Homo sapiens
tcaagtttttcacattgctgttgtacttttttcatagataataactcctgttgaagaacttga

SEQ ID NO: 6868896 - DNA, 69 bp, Homo sapiens
gagccctgtgtggggctgggcagtgcagggaaggaaggaggctgagcttgcagtgccagccttgggctc

SEQ ID NO: 6868897 - DNA, 62 bp, Homo sapiens
gggagggggcgccgagagggagctgggagtctctcctcctctttccttttcgcctctctccc

SEQ ID NO: 6868898 - DNA, 56 bp, Homo sapiens
gttaagagacaaaaggaaatctggagagatctagatccattttctgtctctggaac

SEQ ID NO: 6868899 - DNA, 98 bp, Homo sapiens
gcgtcactctcgccctcctgctttccgcgctctcacccgctcccgcctcctgagggcacgacttgtggaggagcgcgggcggcggggcgtgagcgagc

SEQ ID NO: 6868900 - DNA, 90 bp, Homo sapiens
caaaattttgcgtgtggtctgtgtagatacatatgtatatccgtatatacatatgtatatgtacacagtcattattatgtatatattttg

SEQ ID NO: 6868901 - DNA, 74 bp, Homo sapiens
cttgtgctgcagtttccctgcttgaaaacgtggtccctcatgggagcgttgcatgggtactggggacacacaag

SEQ ID NO: 6868902 - DNA, 62 bp, Homo sapiens
ggacaaaggtagacagtctctgcagggctctaaaaactcctttagaagaggccctgccttcc

SEQ ID NO: 6868903 - DNA, 93 bp, Homo sapiens
ccctctattaaagtaaacgccttgagccttgcctgaatttatctgaatggtggaacagaaatcatttagggctctattctaatggattctggg

SEQ ID NO: 6868904 - DNA, 56 bp, Homo sapiens
cctcagcctctgaggcaggctggacagcagaatggagtcttctccagaggctgggg

SEQ ID NO: 6868905 - DNA, 66 bp, Homo sapiens
tgaggggcggcctgcagaggccacacttaaactctcttgtgggcttctctgtccagctgcacccca

SEQ ID NO: 6868906 - DNA, 67 bp, Homo sapiens
ctgtcttatctctgctagccttcttcagggcagaaaccagctctgcagcaggacaggagggggacag

SEQ ID NO: 6868907 - DNA, 77 bp, Homo sapiens
ggagaggaatttccctcccccagcctggcagggctctgagtagggctgagctgggaagggtagggcaacacctctcc

SEQ ID NO: 6868908 - DNA, 90 bp, Homo sapiens
cgcattttattaaaataagaacaagaacacctacagttctagattcagaaagctggattgtagttgtgtccttgtaacttaaaagatgtg

SEQ ID NO: 6868909 - DNA, 65 bp, Homo sapiens
ctgaattacaaagtgagacaagcttctccaaagagagaacattcagtctggctcacttgtgacag

SEQ ID NO: 6868910 - DNA, 102 bp, Homo sapiens
gttctactgttgaaggaaggcaaaggtatcctctgattaaaattgagctattgggctctgtaatgatgaactcagagggaaccagcccattcagtgtaagac

SEQ ID NO: 6868911 - DNA, 92 bp, Homo sapiens
gtgcctagcatgtatgataacctgttgtagtttgatttgggggcagacaggatagactataaatttgggttttctttaaaaagctactgcat

SEQ ID NO: 6868912 - DNA, 58 bp, Homo sapiens
cactcttgctctctgaggtgcgtgttatattccagtacatttcccagtcccaggagtg

SEQ ID NO: 6868913 - DNA, 76 bp, Homo sapiens
agaaaggccatgaggtggttagataagacctgactgaacaattcagttcttcttgttaacacataatcacatttct

SEQ ID NO: 6868914 - DNA, 78 bp, Homo sapiens
ggccctgggttcagagtctgtgtacagatccacgtcatcctgagtggagaagtaggtaccgcgcagcagggccgggcc

SEQ ID NO: 6868915 - DNA, 91 bp, Homo sapiens
ttggactacttagtatctatgatcctttatatctctcaattttcatcatgtgagtaaaggattagagatgtcacccaggagtgttgtccag

SEQ ID NO: 6868916 - DNA, 82 bp, Homo sapiens
agggtaggatgggggtgtattcagatcttcacatatttctcctactccttgaaaagctcttcttgccaccattcactgccct

SEQ ID NO: 6868917 - DNA, 78 bp, Homo sapiens
gcctccagcaaggcttatagcttatatttaaggcttatagccctgaaacataggctctaagcagagagtggctggggc

SEQ ID NO: 6868918 - DNA, 68 bp, Homo sapiens
ttgtatattgcaatccctagtgaccttgcaggaccactagagcaaagtcatggggatgcaggtcataa

SEQ ID NO: 6868919 - DNA, 85 bp, Homo sapiens
ggggcccctattcagtaagattgaattgcagcctttggaaggcctgtctgtttctgattcaaccttagttgcagggtgcagccct

SEQ ID NO: 6868920 - DNA, 75 bp, Homo sapiens
ctgagaggccctgaagcccacagagagaggccaagatactctcactgactctgggtggcttcagaggccactgag

SEQ ID NO: 6868921 - DNA, 80 bp, Homo sapiens
agtgtgtaatgttgtcagcatcatcacacaaaacctcaatttatttggatgatgacttatgtttacaaatgttacagtct

SEQ ID NO: 6868922 - DNA, 59 bp, Homo sapiens
ttagagaaagggtttgattccgttatttgaaaggatgtctctccaagccctttctataa

SEQ ID NO: 6868923 - DNA, 85 bp, Homo sapiens
gatgacttaacgcagggcaaccttaagattcactgcagggcatttagtactgctatgcagagggaaaaggtgctcctgaggcatt

SEQ ID NO: 6868924 - DNA, 58 bp, Homo sapiens
tgggccacttctagtgcctcagacactccgcggtctgcacactgctagatgtggtgca

SEQ ID NO: 6868925 - DNA, 77 bp, Homo sapiens
tgacctaacctctctgtgcctcagtttccttttctgtgaaatggatttactgataacaatctcaaaaggtctggtca

SEQ ID NO: 6868926 - DNA, 75 bp, Homo sapiens
gcttcagctccttgtcacgagacctgccttctccatagggctccttgaaagtgtcttcatgatgtggcagctagc

SEQ ID NO: 6868927 - DNA, 74 bp, Homo sapiens
gacatgcatggagggaaaatgtcagtgcataatgtacaacatttcatttaggatgttttccctctatgcatctc

SEQ ID NO: 6868928 - DNA, 70 bp, Homo sapiens
ccctactccagctcttaactgcggaagctttcattgatttgatttgtttttagcaaaggagggagaaggg

SEQ ID NO: 6868929 - DNA, 93 bp, Homo sapiens
taaatccccctttcttgttctcttgggaggaaagagagaaggaaaaaaagtctttcctcaattttttccaagacaatttttgggggtggtttg

SEQ ID NO: 6868930 - DNA, 65 bp, Homo sapiens
ttgcccggtgttgtggaagatgctatggttcctttctgtggtatgcctacctcagccgctggcaa

SEQ ID NO: 6868931 - DNA, 90 bp, Homo sapiens
ctttctgttttccaactacagtgagtaagtagacagcttacctggggaaaaggtggtttgctctaatgtagtccttggaaagacactagg

SEQ ID NO: 6868932 - DNA, 80 bp, Homo sapiens
ggaaaagagagcggaggggtatattgtggggtcagataaatcacagcacatttggccagacactaccccccttcatttcc

SEQ ID NO: 6868933 - DNA, 68 bp, Homo sapiens
ggatagccctttccctgtaccaggccttgcccattcagtgctaccaggcctagggagatgggactgcc

SEQ ID NO: 6868934 - DNA, 74 bp, Homo sapiens
tttacagagataattagtttaagatgaggttattagaatgggtcctcatccagtatgactggtgtctttataaa

SEQ ID NO: 6868935 - DNA, 60 bp, Homo sapiens
gagcacttaatcctgttattcacaaaggtaagtaacctactgggagaggataagatgctc

SEQ ID NO: 6868936 - DNA, 59 bp, Homo sapiens
gctgttgaaggtgctaattccaaatgagtcctcattggcatattggctactttcattgc

SEQ ID NO: 6868937 - DNA, 68 bp, Homo sapiens
gcaaggcatagggaagagtcattagattaccccatctgcctgctctccggatccctgatatgccttgt

SEQ ID NO: 6868938 - DNA, 75 bp, Homo sapiens
acagtcagtcagccaagtactctcaccaaagcttgttggggcaagattggtcttcagtattgctgcccagactgt

SEQ ID NO: 6868939 - DNA, 62 bp, Homo sapiens
atgtttgctttaggtatagaatccatctgagctatctttgaaggaatcagccaaagtagcat

SEQ ID NO: 6868940 - DNA, 75 bp, Homo sapiens
atactcaagtttatatagtaagttattctcattatcactttctgtgaatgagtttggctgctgttcttgaagtat

SEQ ID NO: 6868941 - DNA, 56 bp, Homo sapiens
tagcaaatgggcttgttttccagttttctaacctgcaagaacaaggttatttggta

SEQ ID NO: 6868942 - DNA, 91 bp, Homo sapiens
agtgtggtggttacatgaatgcatacatttgtcaagactcatcaaagtgtatgcttcagatctgtgcattttcttacatgtaaattatact

SEQ ID NO: 6868943 - DNA, 130 bp, Homo sapiens
ttttcaagtagcttttgttcaatgtagaattctggtaacagtataaactcctaaaagccaggcagtcctaggttttaatttcagtttttattagtttccagggatgctataacaaattgccaccttttaa

SEQ ID NO: 6868944 - DNA, 119 bp, Homo sapiens
ttgggccagataattctttgtggagggttctcttggtgtgttgtcgggcatttagtaacattccctctacccacagaatgccaatgagacctcccgaccatgaccagttgtgaccacaa

SEQ ID NO: 6868945 - DNA, 57 bp, Homo sapiens
ctctgggcttcctttgtgggttctctcaagcactgctacacaaagcgtggtccagag

SEQ ID NO: 6868946 - DNA, 62 bp, Homo sapiens
gtctgtgtgagttactcttctcatttataaaagaaggataataatagtgctcactcacagac

SEQ ID NO: 6868947 - DNA, 85 bp, Homo sapiens
atgtttggggatcaataatggcaggtgtttgtcaaaatcatgtagtgttaagtgtaaactcctgctgcatattattttcaaacat

SEQ ID NO: 6868948 - DNA, 62 bp, Homo sapiens
gggccagacccttggcgatctgagaaagaaagactgagtccggatgtcaagaggcctgggcc

SEQ ID NO: 6868949 - DNA, 64 bp, Homo sapiens
gggaatacaggcaggtggctgtgctgatgcagttctggtgagccctggaacttgcctgtacctc

SEQ ID NO: 6868950 - DNA, 67 bp, Homo sapiens
acctgggttggagctatcattagtggcagaataaagttccttccaggttttggctccattccaaggt

SEQ ID NO: 6868951 - DNA, 56 bp, Homo sapiens
accagaggatgatctggcctctctcggtttcctgccagggaggcctcacctgtggt

SEQ ID NO: 6868952 - DNA, 63 bp, Homo sapiens
gctggagggacaaggtatgcattttttgaataagtaatgtttcatttagttgtctcctcctgt

SEQ ID NO: 6868953 - DNA, 69 bp, Homo sapiens
tcaggtgggacctgctaggacaggtataactttggccacctgcattgcataaacgtcccttttgcttga

SEQ ID NO: 6868954 - DNA, 71 bp, Homo sapiens
tggagtgtgtgcccaggggacttggagccttggcttgctcacatgggctcctgcctcctggcacctctcca

SEQ ID NO: 6868955 - DNA, 68 bp, Homo sapiens
aagtctttgctattgtgagtagtgccacaataaacatgtgtgcatgtgtctttatagcagcatgattt

SEQ ID NO: 6868956 - DNA, 56 bp, Homo sapiens
gtgaaggaggggccacagatattcaaaataattgtgtctgctggccaaaacttcac

SEQ ID NO: 6868957 - DNA, 62 bp, Homo sapiens
attgtcatgcctgtgggaaaaacttgttgccttggtaacgtacccatgacaggcctgtcaat

SEQ ID NO: 6868958 - DNA, 56 bp, Homo sapiens
caggcgcctcgcatggcacactcagaccgctgggagggtggccgcatgggtgcgtg

SEQ ID NO: 6868959 - DNA, 63 bp, Homo sapiens
ggctcagagacccctggcatggtggtggggagacctcgcttcctgtctctgggtcttggggcc

SEQ ID NO: 6868960 - DNA, 63 bp, Homo sapiens
ttatgtctgtattagtcagcattctccagagaaggagaagcaataggacatatatagacatag

SEQ ID NO: 6868961 - DNA, 93 bp, Homo sapiens
ttcctctaaatctcaccagagcctggagcctgcactgatggtaaggtaaatgtctaggcagttctagttctggaaggaaaatttttaaaggga

SEQ ID NO: 6868962 - DNA, 58 bp, Homo sapiens
gaggctcacctccccgtgaccgtgcagcgtgctgctggtcctgccaacggtgcccctc

SEQ ID NO: 6868963 - DNA, 95 bp, Homo sapiens
cctagccctcaataagttttatatttgaattgggacatatatatgtaacggttatgaccagagagtaggaggcattattgagtggtaaaagtagg

SEQ ID NO: 6868964 - DNA, 55 bp, Homo sapiens
ctttgctgccagaacccagcaggacccacctcggtgctgacctggctcagcaaag

SEQ ID NO: 6868965 - DNA, 112 bp, Homo sapiens
aaaaaatttaaaacaagtaaattaatgcattcacatgatcacttcttgaaaatggttcaaagcatgttttcctgatggtgggattgtttaaatgacatgttttaaagttttt

SEQ ID NO: 6868966 - DNA, 55 bp, Homo sapiens
ctctaggagaatattatagtagtgtgccatcatacagcatggtgatcttctgaag

SEQ ID NO: 6868967 - DNA, 62 bp, Homo sapiens
atgaggttgctctgtgccttccaacatttgagacctggatgtgtgcacagagcaagtttcat

SEQ ID NO: 6868968 - DNA, 66 bp, Homo sapiens
tgccttttcttcattgatgtcaggtggctttttcatcggccgcatttccaatgaggcaaagtggca

SEQ ID NO: 6868969 - DNA, 77 bp, Homo sapiens
ttagattattgagcatccactgtcttccttcactcttttctctactaggaagataaagtgggagctcactaatttaa

SEQ ID NO: 6868970 - DNA, 65 bp, Homo sapiens
aatggccacagatgttagtatctgaagttaataattttcaaaagagaaaaatatctgggcacatt

SEQ ID NO: 6868971 - DNA, 58 bp, Homo sapiens
ctctccccttgaggaataatgaggagtcagtgatgacagcaatatcaataagggggag

SEQ ID NO: 6868972 - DNA, 82 bp, Homo sapiens
gatggtagaaagggcaaggctttggagcttgtcatgtgacatgagcaggctgccttccaaagcctcagtcttctcagctgtc

SEQ ID NO: 6868973 - DNA, 69 bp, Homo sapiens
agcttattagagttgtgttctgttacctgctactatgacagcaaaaacaaggaatattctaatgcagct

SEQ ID NO: 6868974 - DNA, 61 bp, Homo sapiens
ttcttgggtgataacattgctatgcaaggagagtttgctgcaacattttataactcaagag

SEQ ID NO: 6868975 - DNA, 62 bp, Homo sapiens
tcagagaaagtaaacactaaaatgactgcgtgacctcattcagtcatgtttttacactttga

SEQ ID NO: 6868976 - DNA, 97 bp, Homo sapiens
cctactcactcctcaacgcactccagtctggtgtccatccagaggccaccatggagactgctccaaggaggcccctagtggtccccacactggaagg

SEQ ID NO: 6868977 - DNA, 72 bp, Homo sapiens
atgccatctcttcattttatagatgaggcactagctacatactcacagggctatagaattagatgaaggcat

SEQ ID NO: 6868978 - DNA, 55 bp, Homo sapiens
tgctgtcaagaaaacaagcaatggcaagagaatctggcttgttttcacaatagca

SEQ ID NO: 6868979 - DNA, 76 bp, Homo sapiens
ccccagtctgaatgatgagtgggactctgaattcctttgacagaggtggacccattcaatcatcagtgaaatgggg

SEQ ID NO: 6868980 - DNA, 85 bp, Homo sapiens
gccttagcagagaatatgctttcagaaagcattggcctacattccaacttgtagggcctgtgcttcctgagataactgcttttgc

SEQ ID NO: 6868981 - DNA, 69 bp, Homo sapiens
gggaggattgaaatataaatatgtgttgtcctaactgctgacataaccatcactgtttcacatctttcc

SEQ ID NO: 6868982 - DNA, 129 bp, Homo sapiens
ttataaaaagtaaggacaatgttaacgtctatctgacagtgctgtcaaatatgttttcatatatgaaatacttaaaacattgtttggcagtaggtaagtacttgataaatattatcttctcttttatga

SEQ ID NO: 6868983 - DNA, 79 bp, Homo sapiens
ggtatttgtcagctcaaatgagtgactcacacaggatttgtccttttgtgaccagctcatttcactcagcacaaagtcc

SEQ ID NO: 6868984 - DNA, 56 bp, Homo sapiens
aggagccagatgctattgctggaaagaaaattttctcagctcagcatctgggtctt

SEQ ID NO: 6868985 - DNA, 67 bp, Homo sapiens
ggggcgcacgggaagagcacgaatatggagacctgaaggtcttctggaagttttctcctgtggtcct

SEQ ID NO: 6868986 - DNA, 76 bp, Homo sapiens
ttggcctgtgagccttagtttatagattctcacctgtatggaactatgtaaagagaaggcttataaagtggcacaa

SEQ ID NO: 6868987 - DNA, 79 bp, Homo sapiens
tatcttagagcagttcacagccatgttcatgtgcaaggccttcctgcactggtacgtaggttggggcatggatgagatg

SEQ ID NO: 6868988 - DNA, 87 bp, Homo sapiens
atctgaagttcccatggagagaggcaagtcaaagtgcaaatgttgaagctgccgtttttctccatcagctttcttgggaattgaggt

SEQ ID NO: 6868989 - DNA, 96 bp, Homo sapiens
ggtcatgtgggaaaaaattagcttattttttctgttgtcgcccaaagaatgtcactggtgatataaagaagtggaaaatgagaaaactccatgatc

SEQ ID NO: 6868990 - DNA, 76 bp, Homo sapiens
aggacttaaagattaactctcagaaaagaggagcaaaagccagacgtctcttttggtgaggttaaaattttttcct

SEQ ID NO: 6868991 - DNA, 122 bp, Homo sapiens
tttgctggttattaaaaatatatgattgcctctaaaatagcagtgacagccgctctgctgggcagagccaggtgctgctgtttgaaggctactgaatgatgtggaatgaatgcccgggcaaa

SEQ ID NO: 6868992 - DNA, 98 bp, Homo sapiens
ggcgatgccgcgcgccccctcgcctttgttccagcccgagggcgctgatgagcaaactcaaggcgacctgggtgggggtgactggagccgggctcgcc

SEQ ID NO: 6868993 - DNA, 56 bp, Homo sapiens
aggcagggtgatgataatgatttgcgtaagtattcattggcaggtcatgttgacct

SEQ ID NO: 6868994 - DNA, 61 bp, Homo sapiens
gttctagactttatcttaaaacctctgcagagattgatgggttttaagtgggagaaggagc

SEQ ID NO: 6868995 - DNA, 91 bp, Homo sapiens
cctttaaagacaagcagcattgacctagggaaaggacagggcaaatgactccccttctaccctgagtcgtttccctggtcatgtgaaaagg

SEQ ID NO: 6868996 - DNA, 75 bp, Homo sapiens
ggattttatttgcgatgcaacagcttggcggaggattgttcctagcagatctcgcgctgtagccgcgcagagtcc

SEQ ID NO: 6868997 - DNA, 73 bp, Homo sapiens
gctaagcacagacacaaaaggctttcctggtgccttgccctgatcgggaaaaataagccatgtctgtgctagc

SEQ ID NO: 6868998 - DNA, 61 bp, Homo sapiens
gaggacacctcacagcctcacacctgctgcagctggaacggcaggaaggtggggagtcttt

SEQ ID NO: 6868999 - DNA, 71 bp, Homo sapiens
gggatatgctggattgagagcaaggggtcccaccatcagaatatgactccacctttccctatcctgttccc

SEQ ID NO: 6869000 - DNA, 59 bp, Homo sapiens
ggcagggacagaaatggtggctaccattccccacaggcagctcacagttctgtcctgtc

SEQ ID NO: 6869001 - DNA, 82 bp, Homo sapiens
catttgtaatgctctttgaatttgtcagaaagaaagacccattacatactgaagtctgcatccccaaagagcattacaaatg

SEQ ID NO: 6869002 - DNA, 105 bp, Homo sapiens
cacctgggagatgtgacaaaatacagattccagggtcttaccccagagagtcagcaattctgaaatgaggctcaagaatctgcattttaataaacctcccaggtg

SEQ ID NO: 6869003 - DNA, 63 bp, Homo sapiens
gtgtgtgtttgtgtgtgtatctaatgtctcttctcactgaaggtacacattatagaaatagac

SEQ ID NO: 6869004 - DNA, 62 bp, Homo sapiens
agctgggtctagggagcaggaggacagggacgagctggtccttgagcctcccagactcagtt

SEQ ID NO: 6869005 - DNA, 85 bp, Homo sapiens
acaagctagataagatagtccagcacaatctgataaagaaaaccatgggcagagtgtgtatatctggatatctattaagtagtgt

SEQ ID NO: 6869006 - DNA, 76 bp, Homo sapiens
cctgagcttggtctataggagagattgtaatgggtgaagaaatatgtcacaatgctccctgtagtcaggattcagg

SEQ ID NO: 6869007 - DNA, 60 bp, Homo sapiens
gaggagatgggtaggtaagagggttagaacaaattgcttcctttagttacacgtttcctc

SEQ ID NO: 6869008 - DNA, 57 bp, Homo sapiens
gtttagtggagtagaaaccaaagaagcctcttttctgcttctcataccccgctaagc

SEQ ID NO: 6869009 - DNA, 83 bp, Homo sapiens
aggcttttaaagagccattgtatggttttgggagaacatatgcccatagataaaagtaatggttactttatagtgttgagcct

SEQ ID NO: 6869010 - DNA, 63 bp, Homo sapiens
aggcctgggtctcgtgcctacccctgaatctagtgtggctgaggctagccagacccagatcct

SEQ ID NO: 6869011 - DNA, 70 bp, Homo sapiens
caccatcagccagtttgattctatttgtttctcaagtcccccaagaacagaacctggcacagagatggtg

SEQ ID NO: 6869012 - DNA, 78 bp, Homo sapiens
ccgatgagccaggggctgctgattttcttggctgtttctaaggccaagaaatgtgtcgggcagcctcgggtactgagg

SEQ ID NO: 6869013 - DNA, 60 bp, Homo sapiens
cgccccagggctgtgaggagcggctgacgccctttgctgtcttcccgaggccctggagtg

SEQ ID NO: 6869014 - DNA, 60 bp, Homo sapiens
aaaaacctttcattgcaaatgtttgtgcctggatggatttagaattgcagaaaggttttt

SEQ ID NO: 6869015 - DNA, 82 bp, Homo sapiens
gtgtcttccagcgagccggcggcttgttatcaagaatccgtttagaatgtttgaactcagcctctgggggagctgggagcac

SEQ ID NO: 6869016 - DNA, 62 bp, Homo sapiens
attatcctcagaaaacatgtgataagcataaacctttcactgctatgattgctggggataat

SEQ ID NO: 6869017 - DNA, 78 bp, Homo sapiens
ggcctagatggaaagatttggtgatttcagttttttgcttatcagtcaactgtctttattagaatcttattcattgtc

SEQ ID NO: 6869018 - DNA, 79 bp, Homo sapiens
cccaaggatggaaaatggttgttgctgattcttcctgctgatagtagcctgaagaactaactgaccatgaattcctggg

SEQ ID NO: 6869019 - DNA, 65 bp, Homo sapiens
gcagcagtgccgaccatccttcccactgagcccttgcacgtgggaagctcttctcggaactctgc

SEQ ID NO: 6869020 - DNA, 94 bp, Homo sapiens
aaatttagaactgaaataatatctggatcaatcccttagtttaacagctaaggacactgtgggacaatccagctattatttcagttctaaattt

SEQ ID NO: 6869021 - DNA, 62 bp, Homo sapiens
aagtcaagcaagctgctttgtttatgtagggcatgtcaacaaagaaaattgttaatagactt

SEQ ID NO: 6869022 - DNA, 78 bp, Homo sapiens
tctccatctccatgagttcaattgtttcagtcattagtcccacaaatgagtgagaacatgtgaagtctgtcatgtaga

SEQ ID NO: 6869023 - DNA, 60 bp, Homo sapiens
ggaggtatttgtcaatctgtttcagtgtttcttaatgctactgagcactaaaatgcttcc

SEQ ID NO: 6869024 - DNA, 81 bp, Homo sapiens
ctaggtctgtggtgaggattcagcagggctgtggaagtagagctctcccagtgtctggcagtcagcatatcatagatctag

SEQ ID NO: 6869025 - DNA, 59 bp, Homo sapiens
tgcagatgaatgctgagacactctgctggaagtagattaaaaacttagacatctctgca

SEQ ID NO: 6869026 - DNA, 66 bp, Homo sapiens
gttggaggatggagttagcatctttgatgataatgaatggctctggattgcaattcctcttcaggc

SEQ ID NO: 6869027 - DNA, 72 bp, Homo sapiens
gtagtagaaagtgcattagatagaatgatgcttgtttggaagtgtttttctaattgtaatgcaatctactat

SEQ ID NO: 6869028 - DNA, 71 bp, Homo sapiens
acctgtcttcagagtgaaagtctgtgattcacggggtcagtggtctcatcttcatatctgaaagacagtgt

SEQ ID NO: 6869029 - DNA, 75 bp, Homo sapiens
ggagtcaaagctacaggcatttgagtagcccagggctggttaattcattgtatgcctgaggactttgaaagaacc

SEQ ID NO: 6869030 - DNA, 72 bp, Homo sapiens
gagttctgagtctgggctctgggtggcctgagcaagaaatctgctcctgggcacccgcggctgtgacggctc

SEQ ID NO: 6869031 - DNA, 68 bp, Homo sapiens
gtgtagcagaaagaaaattagacttgagtcagggaatctgaattgtagcctggtctctttcactacat

SEQ ID NO: 6869032 - DNA, 77 bp, Homo sapiens
aggagagtggcaggttagggagtagaatcagctgctatttaaagagacagtatttcctcttcttaacttactttcct

SEQ ID NO: 6869033 - DNA, 70 bp, Homo sapiens
gggggtttcaagtaacagggagaaccatttaacccctttgtggtttattcttatttactttggaatctcc

SEQ ID NO: 6869034 - DNA, 130 bp, Homo sapiens
gatgtctgatgtttggctaattattcgctgcattctaggcaatgtctggtggcaagggctagggccagatagaaaagaaggcaggaaaaaatataatttaagccccaaggcaagaatcagataaagaatt

SEQ ID NO: 6869035 - DNA, 58 bp, Homo sapiens
tacatgacctagacttgctaaaaatactaataattttcgaagggctttaggtggtgta

SEQ ID NO: 6869036 - DNA, 79 bp, Homo sapiens
ccagggaccttgggctgcctgctgggtgggtcagtgctaaatggccccctatgaagaagggcacagcttggggacctgg

SEQ ID NO: 6869037 - DNA, 73 bp, Homo sapiens
ccttggtgccataaggtttggggccatgcacaatggctgatgcctgtagtcccaacactttgggaggcggagg

SEQ ID NO: 6869038 - DNA, 101 bp, Homo sapiens
taactcttctctgtgttttgtccatttcaaatgatatgtgccctagtttgggttcactagaaacagatgtttttgaagaatcagacacacaagaagaatta

SEQ ID NO: 6869039 - DNA, 66 bp, Homo sapiens
aaggcaggatgggaaaagatttacagctgttgaagggttaaattaattagttcacgtcctgtgctt

SEQ ID NO: 6869040 - DNA, 64 bp, Homo sapiens
gtagcagtgccaaggatggcctgggaggttttgctcccccataatcttctttggcatctgctgc

SEQ ID NO: 6869041 - DNA, 84 bp, Homo sapiens
tgtgccttttaagttcaagtcttggatataaccagtcagaacctctgttataattatgagttggggatggggatagaaggcata

SEQ ID NO: 6869042 - DNA, 88 bp, Homo sapiens
agatttatatggctctggctctgccttgtcaggttaagaacagcttctcgtggtatagggcagagtgttttaggctgtttttaggtct

SEQ ID NO: 6869043 - DNA, 56 bp, Homo sapiens
accgggcagtgtggctccagagtctgtgcccttagctctgagtcacactgccctgt

SEQ ID NO: 6869044 - DNA, 68 bp, Homo sapiens
gttacacatatcttctgtggctgttctcgcattctggtgacagaactcagtgacagagactgtgtggc

SEQ ID NO: 6869045 - DNA, 64 bp, Homo sapiens
attgtgaataatgccgcaataaacatacgtgtgcatgtgtctttatagcagcatgatttatagt

SEQ ID NO: 6869046 - DNA, 55 bp, Homo sapiens
tacaaagtcaccagcttcttgcagtagccatgctggcattctgtttgattttgtg

SEQ ID NO: 6869047 - DNA, 73 bp, Homo sapiens
ctgttggagtttgtttactcttggacagacatgactttctgtttctccagagagaaaaacaagctttacacag

SEQ ID NO: 6869048 - DNA, 69 bp, Homo sapiens
ggcctgggcacctgagcactggggccgccctgggcagagctggggcggggtgctggggggcctggagct

SEQ ID NO: 6869049 - DNA, 67 bp, Homo sapiens
tggatatgggattggctagccagtgtctgccacaccaaggagagaccctgttagttccagtcttcca

SEQ ID NO: 6869050 - DNA, 86 bp, Homo sapiens
ctcagcttatctcacactgggtttgagggtcacttagcaaagagtgtgtggctccaccaaactcagggtgggagtaaagggctggg

SEQ ID NO: 6869051 - DNA, 86 bp, Homo sapiens
acaccatttattaaatagggtatcctttcccattgcttgtttttgtcaggtttgtcaaagatcagatgcttttagatgtgtggtgt

SEQ ID NO: 6869052 - DNA, 86 bp, Homo sapiens
gagtctcgctctgttgcctaggctggagtgcagtgacgctatcttggttcactgcaacctccacctcccgggttcaagcgattctc

SEQ ID NO: 6869053 - DNA, 78 bp, Homo sapiens
ggggacaatgcggccacatgggatgacctccgatggtctatccccactatccttgagttcaacctgtttggcatcccc

SEQ ID NO: 6869054 - DNA, 120 bp, Homo sapiens
ccctccctctgtgtcgagtgccaaggtcagtctaggtgtctgcagaggaacggttgtttgcccaaggaagacgcttgtgatattcctggcctggtgactggcagtcacgtggtgggaggg

SEQ ID NO: 6869055 - DNA, 62 bp, Homo sapiens
gtcaagcctaactttaatgggaccaggaagtatactcctcccatggaggtggtgggaatggc

SEQ ID NO: 6869056 - DNA, 56 bp, Homo sapiens
gctgcagagggtcttagagaggatttaacccagcctccctgagaccagagagcagc

SEQ ID NO: 6869057 - DNA, 76 bp, Homo sapiens
ttgtaagtattgcatctcttcatatctgttatgcaccaagcatagcactaagtgctggagatacaattgtgtacaa

SEQ ID NO: 6869058 - DNA, 59 bp, Homo sapiens
gcttgctgtgagattgctgcatttctgctgaaatgctctgcatctgatagacacaaagc

SEQ ID NO: 6869059 - DNA, 61 bp, Homo sapiens
gagttatatcctgagtcatattctatcttgtaaagtcctcccaatggctcaggaatggctt

SEQ ID NO: 6869060 - DNA, 59 bp, Homo sapiens
ttcagttttctttagaatgtagagaatgaaagaacttctgcattcttgaggaaatagaa

SEQ ID NO: 6869061 - DNA, 57 bp, Homo sapiens
acaggcctagctaatgctttcctttccatacagaattgcagtctagccaggctctgt

SEQ ID NO: 6869062 - DNA, 66 bp, Homo sapiens
attagagaataaacgagatttggcatgtttatttgtgttcatgttgaacttgttttgttttctaat

SEQ ID NO: 6869063 - DNA, 68 bp, Homo sapiens
tctctcttgccatgcctgtcagaagattgaacaaacagaacaaattctcaagtgagtggtaaatgaga

SEQ ID NO: 6869064 - DNA, 99 bp, Homo sapiens
taggaggtggggcctttgggaggtaattaggtcatgtagtcagcgacttcataaattagactaatggccttataaaagaggcccaagaaagacctctta

SEQ ID NO: 6869065 - DNA, 83 bp, Homo sapiens
gagctgctgaaggaccctgagcgggcatgccggaatgcggagtgggtgttgggatcctcctcagggtagcacagtatggactc

SEQ ID NO: 6869066 - DNA, 85 bp, Homo sapiens
gggggtcccaggggctggaggcctgcctggttagcctctgtttcccagacattgactcgaggcgcctccagtcctctcaaccccc

SEQ ID NO: 6869067 - DNA, 57 bp, Homo sapiens
ttaaccttttgtgtgtttgaattggggtgctaataatatcaaaacacaaatggttga

SEQ ID NO: 6869068 - DNA, 93 bp, Homo sapiens
atcctataaactagtagtgagtgcaataaactgttttctagtaatggcagttcctagaggacgttgttagctcacaagatggaattgtaggat

SEQ ID NO: 6869069 - DNA, 60 bp, Homo sapiens
gaggatgctagccagctctgtggagtctgtttctgagcagccagagctgctggcctcgtc

SEQ ID NO: 6869070 - DNA, 62 bp, Homo sapiens
tgctggagagtatttctcaagtcttcctgttgatttgaagagctgcttgataccctctagca

SEQ ID NO: 6869071 - DNA, 58 bp, Homo sapiens
cccatggccagcaagttcagaatttctgtaatcagaaaatgagacctcagctggtggg

SEQ ID NO: 6869072 - DNA, 55 bp, Homo sapiens
gtattgcctgtgtgccagccactcgcccagagtggcccgggctcagaggcagtgc

SEQ ID NO: 6869073 - DNA, 62 bp, Homo sapiens
tgccaggaggatcatcctgttttctctagtaagaggcaggtcagataatcttctttatggta

SEQ ID NO: 6869074 - DNA, 80 bp, Homo sapiens
tgttaaaaagatgtagtatctatatttcatggtcttgcacagagagcctcatgacattcaggtgctacatcatttgaaca

SEQ ID NO: 6869075 - DNA, 74 bp, Homo sapiens
cctgtgtgatgttctgcagaaagtcctgatagatggcccagataactatggactattgtatgacagagaacagg

SEQ ID NO: 6869076 - DNA, 56 bp, Homo sapiens
ggctactgggcagtccctccatttccccgtgcctctgaggctgcccagtctctgcc

SEQ ID NO: 6869077 - DNA, 79 bp, Homo sapiens
gcaggggtgtggctgtgtggcaaagggattacaggggcactaggagtgtgatgaggcccacacaggtaggcccctttgc

SEQ ID NO: 6869078 - DNA, 63 bp, Homo sapiens
ctgttggggggatctgaggccattctgagactccaggactggcagcagcagcccttgggtcag

SEQ ID NO: 6869079 - DNA, 72 bp, Homo sapiens
cttggccaatgttacataacccattgtcctgtcattgtgacatatggatctggtctgtgagcattatttaag

SEQ ID NO: 6869080 - DNA, 69 bp, Homo sapiens
tggagatggccagtgttgagatcaggcatgtaggatttctcccagcttctcagcccactgccatgttca

SEQ ID NO: 6869081 - DNA, 127 bp, Homo sapiens
aaatctttctgagtggtgactggagctttctggagtggaaaggtattgtaaatgaaagaaagacaggtgccacctctactccagggttatcgagagcttgtctgaaatactttgtaatgaatgattt

SEQ ID NO: 6869082 - DNA, 93 bp, Homo sapiens
gtttcctcctggactttctcagcttttcccaccccagcgccagtgggagggaggtggcctgacaagtgggaagaggctggggccagaggaaac

SEQ ID NO: 6869083 - DNA, 56 bp, Homo sapiens
cagggcagtaacgggaacatctgtgtcctctccacagatccaccgtgggcgccctg

SEQ ID NO: 6869084 - DNA, 126 bp, Homo sapiens
cttgaatttatttggcccagagggaggtagacaaggggcagttaatatgtctttgcatgttaagatgacagtttagagcatgatgaccagtttttagtcttcattgcagtctgggctggaggcagg

SEQ ID NO: 6869085 - DNA, 67 bp, Homo sapiens
gtacaagcaaaaggttacacttctggaatagcagactatctaattcagaccaacctcttgctggaac

SEQ ID NO: 6869086 - DNA, 63 bp, Homo sapiens
gccttccttcctctcctgatgtctcaggcctctagacctagactggggttctggcaaggaggc

SEQ ID NO: 6869087 - DNA, 62 bp, Homo sapiens
cagagtgctctctctcatcctctttccaccatatgaggatacaactagaagatggcagtctg

SEQ ID NO: 6869088 - DNA, 70 bp, Homo sapiens
tggctctgtgtctcccagcagcctgcactgctcacctgccctgtagatattgtggagaaccatagagtta

SEQ ID NO: 6869089 - DNA, 79 bp, Homo sapiens
ccactcagccaggtgggggtcgggaggctcccagtgctgtaccatacctgcctcttgaccccacaaagggactgaatgg

SEQ ID NO: 6869090 - DNA, 72 bp, Homo sapiens
gatttatagtgcaaggtctggatggggtccccacttgttatgggtccccccagccagcttgtagtagaagtc

SEQ ID NO: 6869091 - DNA, 74 bp, Homo sapiens
ggtagaggcgggtggatcatgaggtcaggagatcgagaccatcctggctaacaaggtgaaaccccgtctctact

SEQ ID NO: 6869092 - DNA, 73 bp, Homo sapiens
gttggtgacatgtggcccagatgagtgtgctaatggaatcatttgtaccctttctatgaggccaagcactagc

SEQ ID NO: 6869093 - DNA, 61 bp, Homo sapiens
ttcagggaggcagagaggaactggccatattctatggaagcctcagtttgccttctgggaa

SEQ ID NO: 6869094 - DNA, 99 bp, Homo sapiens
ttccccacactctcttataattcaggattcaaatgtggttcaggtcatcaatcagctacacttgcatgagtcttgaatccagaagtgagtcaggtggag

SEQ ID NO: 6869095 - DNA, 60 bp, Homo sapiens
cctcatatactcttggcaggtatgcaaattagtacaagaggttaaaagagtaatttgagg

SEQ ID NO: 6869096 - DNA, 76 bp, Homo sapiens
tgtggctttgcaggctttagccccatggctgctctcatgggctgggctggtgttgagtgcctgtagcttttccata

SEQ ID NO: 6869097 - DNA, 76 bp, Homo sapiens
gctgacaccacaaacagagttgaaaaataggggtctcatgtgcatcccttttgtcctgcttggtttcggtgtgggt

SEQ ID NO: 6869098 - DNA, 59 bp, Homo sapiens
gccttgatggtagggatactacaggatccatgcttgtttctgtggttcccaccacatgc

SEQ ID NO: 6869099 - DNA, 96 bp, Homo sapiens
caagtttggtcaaggggtgagtgtgtccgactccaaggagcatctccgtttctgagtgggaactctcatgacactgtgtcccttgcctcaggcttg

SEQ ID NO: 6869100 - DNA, 91 bp, Homo sapiens
gtgcaatggctaggccactggttctgatgttcttggcttcttccttatggtcacaagatggctgcttcagtaccagttcttatatctgcat

SEQ ID NO: 6869101 - DNA, 86 bp, Homo sapiens
ctaggctggtcctagcccagcaaaggggtttgagagtgaccagtaggattctctagcttttctttctgggcaatgacctggctcag

SEQ ID NO: 6869102 - DNA, 59 bp, Homo sapiens
cattctcaatgagacattactgggaacaaactctaattccaataatgttcatgagattg

SEQ ID NO: 6869103 - DNA, 77 bp, Homo sapiens
agtcagggcaaagagagcacatgctttgaaggagaatattcatcaaatcctaatagctgttatcttctgtcctttct

SEQ ID NO: 6869104 - DNA, 122 bp, Homo sapiens
agtcagtgtctgttatgaattcattggaaatagcaatgtgaaaagaggaatgaatattgtagatttctttcattgtcatatttgtaaattactgggtgggatttataaacaaattattgact

SEQ ID NO: 6869105 - DNA, 57 bp, Homo sapiens
ctatggtttctgccacaactactcatctctaccattgtagtgcaaaggcagccatag

SEQ ID NO: 6869106 - DNA, 72 bp, Homo sapiens
agggaagacatttgtaacacttgcacttttaaaaccatatttattatgcagcattgcaaagcagtctttcct

SEQ ID NO: 6869107 - DNA, 79 bp, Homo sapiens
ggaacctaagcaagaaagctattattatccttagagcagttacatgctttgaagtcaggctttctaccctttaaattcc

SEQ ID NO: 6869108 - DNA, 64 bp, Homo sapiens
gagtgtccagttcttgctctcagctactgaataacttgtaatgaaggtattacctgagatgctc

SEQ ID NO: 6869109 - DNA, 74 bp, Homo sapiens
gggtcctgggattttgaatgttataagagacaaaatatgtcaggctatttatgacattacaatatcaaggaacc

SEQ ID NO: 6869110 - DNA, 69 bp, Homo sapiens
ctgctatgtcctttcctccctccatcatttgaaaatttcacaacctgtgaggttgggaagcataggtag

SEQ ID NO: 6869111 - DNA, 115 bp, Homo sapiens
aaggcagtgcagggctggaggtcctggagggtggcggcgggtcgtcctaactagcaggctgaaaggtgctggaggggatgccttcactcagaggaagttcacagccacctgcctt

SEQ ID NO: 6869112 - DNA, 66 bp, Homo sapiens
ctatgacaacacatggtgctgaatttgtcagataagtacaatattcggatcatgtgtatgtgttag

SEQ ID NO: 6869113 - DNA, 81 bp, Homo sapiens
ttctgtacttccaagtgacattcatatctgtggcagcactggcaacaggaaatgtgtgaaggatgatatttggaggtagaa

SEQ ID NO: 6869114 - DNA, 65 bp, Homo sapiens
ccgtgacgtgcccagggccacagcaggagaggtgcctgtctggggcagcaaggcgcgcgttccgg

SEQ ID NO: 6869115 - DNA, 58 bp, Homo sapiens
accatcttttacattactgcccagagttctttttctgaagcaccggtaagatggtggt

SEQ ID NO: 6869116 - DNA, 74 bp, Homo sapiens
gtcatgcagcagctgttcttgggacagacaggctgggacactcacgtcaaggtctgccaggatagcatgcaggc

SEQ ID NO: 6869117 - DNA, 79 bp, Homo sapiens
ctcttacagccagatattcagaggtgaaagcgtctctaccataaggggaacttacgcttgggcctggcatgagtgagag

SEQ ID NO: 6869118 - DNA, 61 bp, Homo sapiens
ggggtgagtcatgattgttctgagtcagaataagtctaagtcaagcatggtgcctcacctc

SEQ ID NO: 6869119 - DNA, 58 bp, Homo sapiens
tgttgggtgttgttactttctccttttcaaggacctgttgctgaaagtgcacccaata

SEQ ID NO: 6869120 - DNA, 108 bp, Homo sapiens
gcacaagcccctttcctgccctctgcttgccattgctgctggaagattttctcttttccaggagagctctaaatggctgtagccagagggctgtgtgtgtgtgtgtgt

SEQ ID NO: 6869121 - DNA, 104 bp, Homo sapiens
tcacaggcctgcaatggtactgtctctggtggaggaatagacagcctagtttggcaaatttactttcttctacctctgagacttgtaactcaggctttttgtga

SEQ ID NO: 6869122 - DNA, 117 bp, Homo sapiens
ctcactaatacattgatttttgtagtagtctcgttcttttaaaatccgtcatcatcaatatggctcattaggaaaaagaggctggcaaggaaatttttcttaaatgttgaaagtgag

SEQ ID NO: 6869123 - DNA, 72 bp, Homo sapiens
taaagctgctgtgttggcattggatagaatggttaaggaattaactgtcactctggcaacccagtaatttta

SEQ ID NO: 6869124 - DNA, 62 bp, Homo sapiens
ggcctcgggagtgttcgcattagatccccgaggagggtctggtttatgaagatcccgttgcc

SEQ ID NO: 6869125 - DNA, 89 bp, Homo sapiens
gcatataaaggtagatgaggtaagaatgtaacacctctgtgatcttattctgaaaccaggtgttttctttcctcctatcataagtatgc

SEQ ID NO: 6869126 - DNA, 65 bp, Homo sapiens
cctgctgctgcctgtagccagggtgaccagtgggcttttaccttaagcagcaggtagacagtggg

SEQ ID NO: 6869127 - DNA, 55 bp, Homo sapiens
cattaggtatttaagcacacagagcaaggcctgtgtgctctttttgaagccaatg

SEQ ID NO: 6869128 - DNA, 55 bp, Homo sapiens
tctcctagtctaatacgccaggtgtcttcctgaaatatgtggcaggggtgggaga

SEQ ID NO: 6869129 - DNA, 64 bp, Homo sapiens
gtgtacctctgtggcctgcctcctcattttgttcacacagaaaagaaaggacatagagtagcat

SEQ ID NO: 6869130 - DNA, 63 bp, Homo sapiens
cggagggtggctgtccagccgggagcctctgatccacggggcttggaccagccaccccacccg

SEQ ID NO: 6869131 - DNA, 55 bp, Homo sapiens
ctgctgattcctcagttaaaaagaagaaaattcccttggaacagtggatcagcag

SEQ ID NO: 6869132 - DNA, 64 bp, Homo sapiens
aatacaacaaaatgaggaagtggtcagctatagagactgcatttctttaatgttttgttgtatt

SEQ ID NO: 6869133 - DNA, 59 bp, Homo sapiens
ggaggctgaggcaggcaggagttcaaggctgcagtgagctgtctgtgccacggcactcc

SEQ ID NO: 6869134 - DNA, 58 bp, Homo sapiens
actaccttatacaaaatgtaggtttcatacaaacacatgcattcttgtgtaaggtagt

SEQ ID NO: 6869135 - DNA, 64 bp, Homo sapiens
cccaggaaatcaggctttctagccagagtagaaactcctgcagaacttaccttgtttcctaggg

SEQ ID NO: 6869136 - DNA, 55 bp, Homo sapiens
acttggtctggccaagaaaatgtgacctgaccatgtgtaagtgccaggcacaagt

SEQ ID NO: 6869137 - DNA, 77 bp, Homo sapiens
gtgaaaaccacaatgtgctctccaaggaaaaaagtaggtttccctattgcttattcttgagagtcaaatagtttcat

SEQ ID NO: 6869138 - DNA, 100 bp, Homo sapiens
ccatggcacaagtgtggcagctgatgtggggtgaggtgtggtaatgccgaccctactggcaccaacatgtcctcacacagcccccacgctcacagcctgg

SEQ ID NO: 6869139 - DNA, 129 bp, Homo sapiens
tggtgggagagtaaaaagctcggtggattgcctttggagagtttgttaggggagactctccccatatgggaaacactccaagccagcaggccagtttcacactgtccaggctgcagttaactcccatca

SEQ ID NO: 6869140 - DNA, 59 bp, Homo sapiens
gctgggagagggggagggttgtagtcacttttgtggttgcagggtatccttgtctctgc

SEQ ID NO: 6869141 - DNA, 62 bp, Homo sapiens
aagtagtgttggtgtctgtttcatatgatttattatttttgtgacagtgacaatactgactt

SEQ ID NO: 6869142 - DNA, 58 bp, Homo sapiens
ccctggtgggaatgattgcaggaaggagtgggaaagactgcaggtgctgccatcaggg

SEQ ID NO: 6869143 - DNA, 80 bp, Homo sapiens
ttggggcactgtccccctccgagaccaggtgaggaatgctgagaaatatgtgggcctgggaaggtgacacacagccccga

SEQ ID NO: 6869144 - DNA, 74 bp, Homo sapiens
aaactatttctggtgtgttagagctcagggcagcatttgccaatgatgctttgatatgtactggcaatatgttt

SEQ ID NO: 6869145 - DNA, 59 bp, Homo sapiens
gaaggcacagatggcagtccacagcacctggctgaaacacagattggcctcttgtcttc

SEQ ID NO: 6869146 - DNA, 66 bp, Homo sapiens
tattgtacagagagagaggttttgttcatagcttcctgtgatctgtttcttactctgaaaacaata

SEQ ID NO: 6869147 - DNA, 69 bp, Homo sapiens
gcccctttcctctccaccaggaggtcttctggttcccagggtgccctctgctggaggaggctaggcagc

SEQ ID NO: 6869148 - DNA, 81 bp, Homo sapiens
gactctttcctctggagaactttaggaatgggacaggcaacatctatccaaacatatagtctctcttggaggcagggagtt

SEQ ID NO: 6869149 - DNA, 80 bp, Homo sapiens
gggcccaccagtgtcaccccaaccaggacaactggaccgtcagccagatcctgggcgagtggtggtacactctggggccc

SEQ ID NO: 6869150 - DNA, 56 bp, Homo sapiens
agcagtggtggaatgaggaattgtacccaaacaatctcaacctcagaactacagct

SEQ ID NO: 6869151 - DNA, 96 bp, Homo sapiens
cacagggcccagcttcagtgaatgttgagtaaggcttcagtgattgttagcgcttcatcttgttctatgtttgaaaccagaagttgcgcacctgtg

SEQ ID NO: 6869152 - DNA, 73 bp, Homo sapiens
tatcctatatgaatatgaagtagagaatgctctatagagctgcagattctctacttcatattcatataggata

SEQ ID NO: 6869153 - DNA, 79 bp, Homo sapiens
ggaattcctgaattccatgatagttgtcaatttaaggctctgattactgttacattgcaaattcatggatctgaattct

SEQ ID NO: 6869154 - DNA, 69 bp, Homo sapiens
tttgatctgttgctgaagggaaggtcttgaatgccaagctgttggcaagctactttcagaattatcaaa

SEQ ID NO: 6869155 - DNA, 91 bp, Homo sapiens
ggctgaaggtcttttatgagtttgcagtcaagatgttggacaaggctgcagtcatctgaaggtttgattggagctaaaagatcctccagcc

SEQ ID NO: 6869156 - DNA, 80 bp, Homo sapiens
tttgtgccaacaatgtgttcagcactgtggaaaacacccaaagagtctgtcctcaagtatgatcacgttgaatgtacaaa

SEQ ID NO: 6869157 - DNA, 88 bp, Homo sapiens
gtttgtgattactgggtgtattagtttgctataaactagactattttagattgctatagcaaagtactaccaactcggtggcttaaac

SEQ ID NO: 6869158 - DNA, 59 bp, Homo sapiens
aaggcaatgctaagaggtttggagcccaagatgcggccattcatctcagtcattgcttt

SEQ ID NO: 6869159 - DNA, 59 bp, Homo sapiens
tccagatgttcccccaaagctgctatggatcagtgtccaggcaagggaggagcatggga

SEQ ID NO: 6869160 - DNA, 98 bp, Homo sapiens
tgatatttttgagatggcacttatgatcctaaattgcaggtgatctaaacatcttgttataagagataatgggcttcatgtaatttcagtacatatca

SEQ ID NO: 6869161 - DNA, 108 bp, Homo sapiens
tacagtgcaatttgttctcgtttatgtggggtttacatggttttgagactgaaagtcacacattcttaaagcctgactgtggactacaaacgaatcttttgctctgta

SEQ ID NO: 6869162 - DNA, 89 bp, Homo sapiens
ggagggggaaggaactctgacctgcaggcacagcaatgtccctacattcaagttcttctgtctttgcagtcagtcaccctgctccttcc

SEQ ID NO: 6869163 - DNA, 65 bp, Homo sapiens
gatttaatggagggtaaaagactttggaattgattttctcagtgcttaaaaccctgcactagctc

SEQ ID NO: 6869164 - DNA, 91 bp, Homo sapiens
ggggtagagcatgtcccaggatcttttaatgtctccagattcaagcacaatatttggtatataataggtcttcaaatgctgttgttgccct

SEQ ID NO: 6869165 - DNA, 58 bp, Homo sapiens
gcatctacactgattaggtgaacatacaagaggggtctgttcatattagtgaggatgc

SEQ ID NO: 6869166 - DNA, 130 bp, Homo sapiens
catcaaagctgcttcgcaagccccctcattagcagggcttatctgggggagctgctcatggagtcctcgctgctcatgcccacagccctcccagagtgctatgcgagtggctgccgtgcagttgggggtg

SEQ ID NO: 6869167 - DNA, 58 bp, Homo sapiens
tgtttacacaatagtctctctcagctccgaggggccattagagttaattgggtgaata

SEQ ID NO: 6869168 - DNA, 63 bp, Homo sapiens
tccatgaagtcttgttagagtatcatgtcaacctattttgcccagcaagactttataacagga

SEQ ID NO: 6869169 - DNA, 61 bp, Homo sapiens
gctgaggatgaacgcttacaagctgcctgtctctttgcttttagctgcaagtgttcacagc

SEQ ID NO: 6869170 - DNA, 96 bp, Homo sapiens
gggaagggggtggtcagggtgaagagtgtgaggagcagggacaggagtgacggacgtgggttctgacttctctgcatctgccctcacccccatccc

SEQ ID NO: 6869171 - DNA, 62 bp, Homo sapiens
tggagagtttagcctactggaaaatgaaaccggaaaagtaggtggggtgggctgagcttcca

SEQ ID NO: 6869172 - DNA, 85 bp, Homo sapiens
ggtgaggggcagtcacagacagtatggtggggctgagaaacatatggcttcctcacttaatattgctgcacagttgtcccacacc

SEQ ID NO: 6869173 - DNA, 80 bp, Homo sapiens
ggccgacatgagaggtagaggctctgcttaagtccggatctagagggacagttaggtggtccgtgcttgtcaatccggtc

SEQ ID NO: 6869174 - DNA, 58 bp, Homo sapiens
gggtgtggctgaaatcaaggcaggccagggacaggcactgccgcctatagctatacct

SEQ ID NO: 6869175 - DNA, 58 bp, Homo sapiens
gattccagcttggtatttactctggctgggtgacgatgatgccaagctatctagaatc

SEQ ID NO: 6869176 - DNA, 56 bp, Homo sapiens
ctggaagaggggaaatgccatgtcttctgactggggaggctgcctttccttaccag

SEQ ID NO: 6869177 - DNA, 86 bp, Homo sapiens
ttccagcgagttctatcaggaaaattagcctgacatttagcagtctttagcaagagtcaaaatttaccagaatgaaccgtaaggag

SEQ ID NO: 6869178 - DNA, 124 bp, Homo sapiens
tgtaacagtagttttactccaacatatagtgttaaaaagatgtccaagtaaagttaaatatacaattatttaaaattgggacttttttccgtagcgtagtgggttttgtggaacacatgtacca

SEQ ID NO: 6869179 - DNA, 79 bp, Homo sapiens
acctgaaaccttcacatctactctacaggccccccaggctagagggctgttgttgcagggagggtgggaggtagtaggt

SEQ ID NO: 6869180 - DNA, 83 bp, Homo sapiens
gcctagggtagggcactggttctaaaattatggcccctggaccatatcactagagaagttgttaaaaatgccaattcttgggc

SEQ ID NO: 6869181 - DNA, 73 bp, Homo sapiens
ggctatatgcaaatattctgtcattttatataaagataatgagcatctacagattttggtatttgcaatggtc

SEQ ID NO: 6869182 - DNA, 102 bp, Homo sapiens
tcgtagggtccaggagggaacaggggcaggcaggaccctttggcccaggtccaaagacttctgtttccacttccaattatagcttcctttgtgaccctagga

SEQ ID NO: 6869183 - DNA, 94 bp, Homo sapiens
gctcatggagccagtcagtgactttattttcttttccattttcctacagacatgggtagactgacaaagtcaatgctgtcttggatatgtgagc

SEQ ID NO: 6869184 - DNA, 73 bp, Homo sapiens
acttaacaaatgattccttgaagcctcatgagagttcatgtatccctcttggttccagggaatcatagtaagt

SEQ ID NO: 6869185 - DNA, 96 bp, Homo sapiens
gcctgatattgatatcccgcggccccggccagggctctggagctgctcttccctgggctctgcagcttggggtcctgggccacctcagacgcaggc

SEQ ID NO: 6869186 - DNA, 56 bp, Homo sapiens
caggcagagtgaggtggtctaatttgaaggtgtttacttccaactgactcagcttg

SEQ ID NO: 6869187 - DNA, 90 bp, Homo sapiens
gtgccagaactaagactagaaaacaggtcatcggattcttctctgcaatctgccctaggaattctatggccaagtgttggtttggggcac

SEQ ID NO: 6869188 - DNA, 63 bp, Homo sapiens
ggaagaaagaacgttggttatcttagatatctcagtcataggaaggtccatgtcttatcttcc

SEQ ID NO: 6869189 - DNA, 66 bp, Homo sapiens
tgccaacagttcctccatcctctctttctctctcttgggattgtaaggaggggaggcattgaggca

SEQ ID NO: 6869190 - DNA, 89 bp, Homo sapiens
ggtgaacaaagccctcggagagctcacagctgtggcccagggaacacattccacctggctcagctgtgagttcttccttgcactgtgcc

SEQ ID NO: 6869191 - DNA, 63 bp, Homo sapiens
agtttattctctggtcttagtagttgcttaataattcattgattaagaactacagaataaact

SEQ ID NO: 6869192 - DNA, 64 bp, Homo sapiens
gtgcaggttgttgactgcatataggcacccacctagcctgtgcttcactcaacaagccgtgtac

SEQ ID NO: 6869193 - DNA, 71 bp, Homo sapiens
ctctgagaagaagctggggccagggccttggtctgaggggaaaggcccttccaccagtcctcgactctgag

SEQ ID NO: 6869194 - DNA, 58 bp, Homo sapiens
gaatcaggaagggaaaatagttcggggaatgcccccactgttttcttcatcctaggtc

SEQ ID NO: 6869195 - DNA, 77 bp, Homo sapiens
aattaacatgggacgttattttaatgactgattttaactagatcatgtgatttgaagtaatgggtctgtgtctgatt

SEQ ID NO: 6869196 - DNA, 80 bp, Homo sapiens
aaaaaaattatttcattgattggcttctatacatgttttcttgggaatatgtgggtgctaatcaaaatgatgattttttt

SEQ ID NO: 6869197 - DNA, 78 bp, Homo sapiens
ctaggtccccaaaggaaatactaatctggaatcatttaaaattaaattcaaggtttgaggttttcttttactacctag

SEQ ID NO: 6869198 - DNA, 85 bp, Homo sapiens
aaatcaaatatcatattttacatgacaggtgtttagtattgtaatacgtgctaactagcttggttatgtaaagttaaataggttt

SEQ ID NO: 6869199 - DNA, 62 bp, Homo sapiens
acctctgaagggccaagcaatgctaggagtcgtggatgcattgtttcatgtatcttcagggt

SEQ ID NO: 6869200 - DNA, 56 bp, Homo sapiens
ggagccttgggagtcgggtcctcaaggaaagacctatgggatcagcccagggctct

SEQ ID NO: 6869201 - DNA, 66 bp, Homo sapiens
acagctgtatgtgaggccacagtgaagtttgtatacagggttttgtttgccacacaaaacagttgt

SEQ ID NO: 6869202 - DNA, 129 bp, Homo sapiens
aatgagaagcctgcgatgactacaccctttttctggtccagtctttcccttctagacattggtgaaatgcctatctagccaaaggaagactagccagaataggggaaatcacatctggttttactcatt

SEQ ID NO: 6869203 - DNA, 105 bp, Homo sapiens
tcttgttcccctgccaccttatacagagagtacagcatccacatgagtgtccctcttgtggaggctttggctttcttccatgctccgtgtgccatgggagcaaga

SEQ ID NO: 6869204 - DNA, 81 bp, Homo sapiens
gcaccatttgtctagaagtctggttgcaaagcgctggcggctgcaagtgcttataccaaagactcttagctccagtggtgt

SEQ ID NO: 6869205 - DNA, 64 bp, Homo sapiens
gagagaaagtttattcctatctagcttgtgtgaaatcaaattggcagagaatgaactttggctt

SEQ ID NO: 6869206 - DNA, 63 bp, Homo sapiens
tccacacctgcttcaaggaggttgttagaacacacgtaaacaatgttctctgagttgtgtgga

SEQ ID NO: 6869207 - DNA, 63 bp, Homo sapiens
gcctattatcagagctagtgataattcgtaaagttcatctattattactcattctaaatgggc

SEQ ID NO: 6869208 - DNA, 58 bp, Homo sapiens
taacaacatgcaatttaaccttgagtgttataatatcaaggtggattaactgttgtta

SEQ ID NO: 6869209 - DNA, 101 bp, Homo sapiens
tgaggcatgagaattgtttgaacccgggaggcagaggttgtggtgagccaagattgcaccactgcactccagcctgggtgacaaagcaagactctgtctca

SEQ ID NO: 6869210 - DNA, 71 bp, Homo sapiens
acttagatgagcagtaggttcatggctgatattttagtcctgtatattagaatgaggctgtttctctaagt

SEQ ID NO: 6869211 - DNA, 71 bp, Homo sapiens
gggaacgtggaggggagagaggaacctgcaggctcctagagcctcagggttttgttgacactgcgattgcc

SEQ ID NO: 6869212 - DNA, 68 bp, Homo sapiens
agagaaaggcagccctggctcagcctggccctccgaccctgagcaggcatgagccaggcccctcctct

SEQ ID NO: 6869213 - DNA, 76 bp, Homo sapiens
ccagctgggccttgccaggggtgtctcgtgacccagtcccttagagaaacatgcagacatctcagcaaggagctgg

SEQ ID NO: 6869214 - DNA, 77 bp, Homo sapiens
gggcctcttgtcacggccatcctgtggcttggaaggcgactttccctactaaatagcaggttggctatcagagtccc

SEQ ID NO: 6869215 - DNA, 84 bp, Homo sapiens
tgagaaagccagacagaaagccagagagaaagggctcactttgttgcctcctgagtccataattctggtctttcctgggtccca

SEQ ID NO: 6869216 - DNA, 109 bp, Homo sapiens
ttccagtaccaattatcacacttaagcagtttttgaaaaagggtataattctctgctacagaaggcatgaccttttttcagaactctaaaggagatactcctactggga

SEQ ID NO: 6869217 - DNA, 73 bp, Homo sapiens
tcaaggaagtcttggctctgccttctgaagcatctggcagcttcacgaccatcagagcttagatgattcttga

SEQ ID NO: 6869218 - DNA, 83 bp, Homo sapiens
aagaaagtgcggtctgtagtgaattctaataaaaggaattagattacccatccccatcttattgtttactacagcactttctt

SEQ ID NO: 6869219 - DNA, 56 bp, Homo sapiens
gcttccggagccaaaaggccccggaagtggtcggccgcttgcgacgctccggaagt

SEQ ID NO: 6869220 - DNA, 61 bp, Homo sapiens
caggaacccccactctcagctctgccatgtcaaggctcagggcagagagggagggatcttg

SEQ ID NO: 6869221 - DNA, 57 bp, Homo sapiens
gtcaggcatcagtttccgggtgtttttcataatggatttcacaggagatgacctgac

SEQ ID NO: 6869222 - DNA, 68 bp, Homo sapiens
gccccatagtattttgcttttacagccaactggactactaagaacagttataagagcagactgtaggc

SEQ ID NO: 6869223 - DNA, 58 bp, Homo sapiens
ggggatcacgtggccctgcccccatgaccacagtcagtatgggggatcacgtggccct

SEQ ID NO: 6869224 - DNA, 59 bp, Homo sapiens
aagttcctaaagcatctgggcaaagccaggaaacaggcagggctcagctatgggaggtt

SEQ ID NO: 6869225 - DNA, 58 bp, Homo sapiens
ggggtctgctgcggagcagagagactgattattattttttaaatctccagttgacccc

SEQ ID NO: 6869226 - DNA, 75 bp, Homo sapiens
ccacaactacagtccctcatatgttggtaaatattggttgcaacaaaaagaccatcagctatgctggctgtgtgg

SEQ ID NO: 6869227 - DNA, 66 bp, Homo sapiens
ggggcaggatggctgtggagacaggctctgagccgcaggagccctggatggacagtttcccacccc

SEQ ID NO: 6869228 - DNA, 57 bp, Homo sapiens
tccctcaatgtgggtcaagaccagcaactgcaacaggttcatgtcagcattaaggga

SEQ ID NO: 6869229 - DNA, 84 bp, Homo sapiens
attgaattctttttgattgccttgtcagatttcttttgtattttatataaataagatatgacagtggcaaattagtttttcagt

SEQ ID NO: 6869230 - DNA, 65 bp, Homo sapiens
tctatttaaaatgtctctgactgcagtctgccctctagaatgtgtcagaagtacttttggaaaga

SEQ ID NO: 6869231 - DNA, 55 bp, Homo sapiens
tcctgggcactgtggtgctgaccctggaatgaatcagatccgagtgtgccaagga

SEQ ID NO: 6869232 - DNA, 87 bp, Homo sapiens
ttttcacaactgattgaaagtgttgtagagtactaatacaatgaattgtacagaaatcacatcgctttgagttaagaacagtgaaga

SEQ ID NO: 6869233 - DNA, 75 bp, Homo sapiens
ctagtgaggtaagaaaggagagggattgatttgagaggctcaaaatgctgctcagtccttatttgcctctaccag

SEQ ID NO: 6869234 - DNA, 65 bp, Homo sapiens
aaatggtgttgtatttagtctcccttaaactgactgccttgggaaaactaaagcaataactattt

SEQ ID NO: 6869235 - DNA, 61 bp, Homo sapiens
cacaacttcagggaaacatgaagcattgcattctgtgctaacggtgccccctggagttgtg

SEQ ID NO: 6869236 - DNA, 68 bp, Homo sapiens
ggggtagcagctgccctgccttgcccttagagcatctccttaaaagcacaacaggtaggccagaccct

SEQ ID NO: 6869237 - DNA, 90 bp, Homo sapiens
ttgggtgccctgtctgtgccaggcctgggctgggtatcaggaaacaccttcctgcccctcaaggcctggtgcgcacattcggatacccaa

SEQ ID NO: 6869238 - DNA, 72 bp, Homo sapiens
ggttcagatgtccgtccccagccacctgctgattgtgctaatcccgggagccttgggcacagacatggagcc

SEQ ID NO: 6869239 - DNA, 58 bp, Homo sapiens
cagctctgtgggagcgtatgtgtgtatatgtgtgtgtgtttgctctccatggttgttg

SEQ ID NO: 6869240 - DNA, 70 bp, Homo sapiens
cctgcctacccttgcttgcccagtcacaggcctggaaacacaggccttgccctgagcaggggtcagcggg

SEQ ID NO: 6869241 - DNA, 84 bp, Homo sapiens
gttctaaataagcagagagaattccgtgcctgctgttatgttgcccgacgtaatccaagagctggagttgtttatgatcagaac

SEQ ID NO: 6869242 - DNA, 71 bp, Homo sapiens
gtacatttctatgctagtcaggatagctaggttgttggctgggtcctatgctggtagagaagccattgtat

SEQ ID NO: 6869243 - DNA, 93 bp, Homo sapiens
gtttggtcagtaaggaagtaggttatagggtgatcacagaatattattttcatcgtttttgtacattctgaatctgtccttgccggcacgaac

SEQ ID NO: 6869244 - DNA, 55 bp, Homo sapiens
aggcagtgatgagtcatgaatatttccattcatgttaacaagcttctcattgttt

SEQ ID NO: 6869245 - DNA, 75 bp, Homo sapiens
ctctacttacaggtgtggaaattgagtaacagaaaaattaacttgccaagataacacagctagtaaatagtagag

SEQ ID NO: 6869246 - DNA, 56 bp, Homo sapiens
gttgctgtttagttgcctacatatcgcaggtggtaaaagaggtataaaatggtagc

SEQ ID NO: 6869247 - DNA, 73 bp, Homo sapiens
gggcttccccgcaggtgccggcagatggggtagcgaatggtcctgtgcctccacctgctccaggagggagtct

SEQ ID NO: 6869248 - DNA, 60 bp, Homo sapiens
atggacagattaacacagtagatgtattcagcaatagaacgacagtgttattctggccat

SEQ ID NO: 6869249 - DNA, 85 bp, Homo sapiens
atttgtggataaagtcgagttctgattttgccattgggatgatggttgtggcacattaactttggcaagtcagacttctgcaaat

SEQ ID NO: 6869250 - DNA, 73 bp, Homo sapiens
ccatttgtaccatgtgagtgtatacttacgtgtacatgtgtgtacacacgacacatcacatatgtaataatgg

SEQ ID NO: 6869251 - DNA, 59 bp, Homo sapiens
tggcaggcaggcagccttctgagctggggtccttttgagatggcttagcctggctccca

SEQ ID NO: 6869252 - DNA, 67 bp, Homo sapiens
gttatgtattgagaacctgcagcattatgtctgatactgtgataaatgctggaaattcaggcatgat

SEQ ID NO: 6869253 - DNA, 73 bp, Homo sapiens
gagagtttgggataagacagggacagggcacagttagttgtcagctgttatcactgtctgtccatggattttc

SEQ ID NO: 6869254 - DNA, 75 bp, Homo sapiens
gaacatttgagaaaaatactcttaagcaagtcttcttatgaagatgtagacaaagatgtatttttaccaaatgtc

SEQ ID NO: 6869255 - DNA, 68 bp, Homo sapiens
atctcccaaattagcctcttgattctgtcacaaactttcagaactcaaaggcttgtggttctgggaat

SEQ ID NO: 6869256 - DNA, 84 bp, Homo sapiens
aggtgcttggaataatggtcaaaaagatacgtaaagcatctatgtgtatattttgtgtatcttattgcagtattttttgtccct

SEQ ID NO: 6869257 - DNA, 58 bp, Homo sapiens
catttgtaggatgcttcttgtttgtaagctggcatacttgaagtagtcctaataaatg

SEQ ID NO: 6869258 - DNA, 56 bp, Homo sapiens
gggctccagtttggccaggaagagattttcttttcttatctgtgggccaggagccc

SEQ ID NO: 6869259 - DNA, 126 bp, Homo sapiens
ctggtgagtagggtagaggatggaggacattggggaaagtggccccccggcgagagaggtcgtgtgcactgagcgggagcagcttgagctggggctggctctcaggtcgcatcctgtggccaccag

SEQ ID NO: 6869260 - DNA, 70 bp, Homo sapiens
aaaacagcaaagcttctttctgatctgaggttgtggcaaacctaacctgggatctgacgggatgcgtttt

SEQ ID NO: 6869261 - DNA, 55 bp, Homo sapiens
ctaggaatcaccaagattctagatcgtactttctaggaatcttggtgattctgag

SEQ ID NO: 6869262 - DNA, 56 bp, Homo sapiens
agcacaggtacggagatgctaccctcttctaggtggtcatctggagaagctgtgct

SEQ ID NO: 6869263 - DNA, 81 bp, Homo sapiens
gaggatgaacattttaaggcttttgatacatgttgccaaaacgctcactagcaagtttgtatcaatttgctttatctcctc

SEQ ID NO: 6869264 - DNA, 71 bp, Homo sapiens
cctagcttcagtaaagtctctagagggtaggacaagtaactcctctctcagcattactcttactaggcagg

SEQ ID NO: 6869265 - DNA, 65 bp, Homo sapiens
ggagcagccctgtgcggagggccctgtgcggagtgccacaggtacccctttatgcaggtgcctcc

SEQ ID NO: 6869266 - DNA, 81 bp, Homo sapiens
ctgtactcttcctttggtaccaccccagagtgggactctagtgctccatctacttatgggtggtaccagcatattgtgcag

SEQ ID NO: 6869267 - DNA, 110 bp, Homo sapiens
tctatatatacctttccattataacatgacacaaagtttgtcagaaattacttggcacactgggagttcttgataattttgatggaatatgatgtaatggtatatatgga

SEQ ID NO: 6869268 - DNA, 118 bp, Homo sapiens
taatctacattcagaagatgagagaagactatgattttcatatgcttgatttcttgcatttgatttggtaggaaacaatgaaattcattcttcactgaattttcaaacatgttgattg

SEQ ID NO: 6869269 - DNA, 60 bp, Homo sapiens
aggcctatgagtaatattctgggctcagtgctttgtccactgggcccatatactcagtct

SEQ ID NO: 6869270 - DNA, 75 bp, Homo sapiens
agctgtgtgtcaggagggtatttttggcctttagtatgtcgtctaagttgctagtgcttttctgagattgtagtt

SEQ ID NO: 6869271 - DNA, 83 bp, Homo sapiens
gggcaggcctgccagaggctctgtttgctgtggtaccaagcaacaggcggcaagggtggcattcagaagagctggctctgccc

SEQ ID NO: 6869272 - DNA, 127 bp, Homo sapiens
ggcttgtggaactcatctgcctggtctattccttgagagcaacacgcagtagtatacgagcgtaacaagaacagctcagtacctggtgcttgacctcagaacatctcagctgaagtcccagcatgcc

SEQ ID NO: 6869273 - DNA, 59 bp, Homo sapiens
ttccagcttgtcctttctctgccgtgactgacgttggcctggatctaaggaagctggga

SEQ ID NO: 6869274 - DNA, 55 bp, Homo sapiens
gaacacaaggtcataccatttatgacgtttcaattatgtgtctgcctctgtgttc

SEQ ID NO: 6869275 - DNA, 76 bp, Homo sapiens
gcaaaactcttttatcagacaacatgttgggcatcacccaattactatcacatttgtctggctagaaagtttttgc

SEQ ID NO: 6869276 - DNA, 62 bp, Homo sapiens
gggcagggtgacccctcgcaaatagcagactcctgttattttgccacaggtgaccttctccc

SEQ ID NO: 6869277 - DNA, 58 bp, Homo sapiens
ttgccagggctttggtggcatcctgaagttcgggatggtatagtcagggacttggcag

SEQ ID NO: 6869278 - DNA, 129 bp, Homo sapiens
ggtgctgcagccctcagatctgcttcatctcatcccacccattcctctcctgagggatttgtcagcgaacctgggagggttggcatccccatcagagcagagggtggcatggagcctgaggccagcact

SEQ ID NO: 6869279 - DNA, 77 bp, Homo sapiens
ttcattggacattctactctctgattccctgggttcgactactctagggacctcatgtaagtggattccagagtgaa

SEQ ID NO: 6869280 - DNA, 62 bp, Homo sapiens
tttaaagtaatctgtgtgaatttatctttggaaaatggtgaacattcattggttgctttaga

SEQ ID NO: 6869281 - DNA, 60 bp, Homo sapiens
cttcacatttgcgaaggccaaagcctgttaggtcaggcctcctgttggctagtgtgatag

SEQ ID NO: 6869282 - DNA, 80 bp, Homo sapiens
ccagcagctaagtgctgacacatcattcccagcatccaccccggatgggaaagccagcagtgtcaccgcacgcatgctgg

SEQ ID NO: 6869283 - DNA, 68 bp, Homo sapiens
cttgtgttgcttatcattgctcttctcagaagatggaggaaaacatgagctctggagcagcaatcaag

SEQ ID NO: 6869284 - DNA, 71 bp, Homo sapiens
gtaaacaaaagttcggccgcagctgaggtggtgttcttctgcaagcctcagacacagtcaagcttttttac

SEQ ID NO: 6869285 - DNA, 63 bp, Homo sapiens
tgatccttctaatgtcatagcatcttctttagtaaagtggtttaatgaccaatagaaggaaca

SEQ ID NO: 6869286 - DNA, 67 bp, Homo sapiens
tcctgcctgttagtctagcagttagactgtgtgtctgcttcctccagttgactgatggtaaagaggg

SEQ ID NO: 6869287 - DNA, 59 bp, Homo sapiens
gcctcagtgttctcatctgtatgtcgagcactgcacagaatcggatcatgcgctgaggc

SEQ ID NO: 6869288 - DNA, 64 bp, Homo sapiens
ttcttcatcctaagaatgtttaaatgtcacaaaggattttaaagcaaaaactaggatggatgga

SEQ ID NO: 6869289 - DNA, 71 bp, Homo sapiens
ggctcagagaggtttgtgtcttgcttaaggttgtacagccaggaagtcagccaagcccaccttctggttcc

SEQ ID NO: 6869290 - DNA, 63 bp, Homo sapiens
gaccctagagaaatgtactagtctaactcctttgcaggatttggaaggcgtttctctgtagtc

SEQ ID NO: 6869291 - DNA, 69 bp, Homo sapiens
cagctaatctccgtcttctaagaaaattctgtacatagaagttacttgataaagaccgaataatggctg

SEQ ID NO: 6869292 - DNA, 55 bp, Homo sapiens
gcttcaaattaaggtgaatccctgaagacgtcagataggttcaaaaatttggggt

SEQ ID NO: 6869293 - DNA, 58 bp, Homo sapiens
gcctcacgcctgcccccaacctcccggtgtaggggtggggctctggcaggcctgaggt

SEQ ID NO: 6869294 - DNA, 76 bp, Homo sapiens
ttaggcatattctacatagtctcttggagctccccagtgggtttgagcctcagatgcctgtgaagaaatgcactga

SEQ ID NO: 6869295 - DNA, 55 bp, Homo sapiens
ctcctggagggccaaagaaataagaaccactggtctaggcctattattccaggag

SEQ ID NO: 6869296 - DNA, 55 bp, Homo sapiens
gcgggaggggtgtgcggagcgctgggctgtgctccggcaacttcactcctcccgc

SEQ ID NO: 6869297 - DNA, 78 bp, Homo sapiens
ggccctccctgcttgctctcagcccttggctgcctggggggcatgcagaaggagtgctgaaaggaagcggagatttcc

SEQ ID NO: 6869298 - DNA, 62 bp, Homo sapiens
tttggtgttggcttaaccagtttggccaaatgctgagctttttccaagccaacagtcccaaa

SEQ ID NO: 6869299 - DNA, 82 bp, Homo sapiens
gcctccgctagagggctggcttgggaaggaggtggaaagcttccataatgagattcccagcccggctcagtcaagcagaggc

SEQ ID NO: 6869300 - DNA, 73 bp, Homo sapiens
cttacatgacaattctactctttcttttcagaacgcctatcagtgtgttttgcatggagtgaatggcgtgagg

SEQ ID NO: 6869301 - DNA, 79 bp, Homo sapiens
tgagaaggtaaataacttgccaaaggtcacttagttttaaaatgatggagctgagacacactttggcaatactggctca

SEQ ID NO: 6869302 - DNA, 71 bp, Homo sapiens
tatttcacaagtttcaggattctgcagctttaggacagaatgttttcccagaaatctgaaatctagaaatg

SEQ ID NO: 6869303 - DNA, 61 bp, Homo sapiens
tttgaaagtctcaaagcacaggatgctccagggaagtgtttctggctttaggcttttcaag

SEQ ID NO: 6869304 - DNA, 63 bp, Homo sapiens
aagtagttgtccctgaggaacgagacttgaaatggggaaggatgaacccagggaccactgctt

SEQ ID NO: 6869305 - DNA, 65 bp, Homo sapiens
ccttggtagctatattttcgttttattataatatatttgattagctttgaatgtgctgccaaagg

SEQ ID NO: 6869306 - DNA, 91 bp, Homo sapiens
tgctgcaccgtggggctgctgccaccaggtggatgctggtgcctaggtgatggtcacctgtccacactggagggcactcgatgatgcagca

SEQ ID NO: 6869307 - DNA, 57 bp, Homo sapiens
aggtggttcacgcctgtaatcccagcactttgggaggccgaggtgggtggatcacct

SEQ ID NO: 6869308 - DNA, 57 bp, Homo sapiens
ctgtggagatgcagaccaggccagtaacattttggccagctttggtctgtctcctag

SEQ ID NO: 6869309 - DNA, 55 bp, Homo sapiens
ggggtggtggactcagcatcatgggcagtatagctcccagcctctcttccacccc

SEQ ID NO: 6869310 - DNA, 62 bp, Homo sapiens
ggccagctgtgggattttctgcttgggtgtaagcaatgggcaggtaagggacacacctggct

SEQ ID NO: 6869311 - DNA, 63 bp, Homo sapiens
tctggtacatttgatgataataggtagccaaatatatttgttaatgatccaaattgtatcggg

SEQ ID NO: 6869312 - DNA, 61 bp, Homo sapiens
cacaggtagatgccatgcagcagcctccagcgccctccctgtgcctggcatgtaacctgtg

SEQ ID NO: 6869313 - DNA, 72 bp, Homo sapiens
tttaggcagacatcagattgcttttccttaacacatgcttgtttagagctgtggaggagaagcaagcctaag

SEQ ID NO: 6869314 - DNA, 56 bp, Homo sapiens
gatttcaagcccccagagattctgattcactgggtttattgtggggcttgggaatc

SEQ ID NO: 6869315 - DNA, 67 bp, Homo sapiens
gcctcaaacccaggtctttggcttccaggaaataaacctgtaaccactccacctgcggccttgaggt

SEQ ID NO: 6869316 - DNA, 86 bp, Homo sapiens
aaaaccaaaaatacatgagcctgggaccaaggaatgaaagtggcaccttgctctcaaacctgctgtcttgttcataattttgtttt

SEQ ID NO: 6869317 - DNA, 58 bp, Homo sapiens
ttccctggaggagtagtgaaatgtgtgctctccataagcagtttgctccccagaggaa

SEQ ID NO: 6869318 - DNA, 103 bp, Homo sapiens
tgcttacaatataaagcttattctgtcagatcttactggatagtttactttttaacattgagaatattgtgacagtgtgagtgtgcgtgtgtttctgtatgca

SEQ ID NO: 6869319 - DNA, 73 bp, Homo sapiens
tctgaattgggaataacgtaataacatgcagctggggagctaggctgtgtttcttgcgttttcctctttcaga

SEQ ID NO: 6869320 - DNA, 97 bp, Homo sapiens
ctgcgaatctggagatgctcagggtccttggggagcctgaacttcaggggttgattgcagccatggtgcaggcttggatcacatctccttttggcag

SEQ ID NO: 6869321 - DNA, 65 bp, Homo sapiens
tctgggaaatgggcagcttcgccttggctgagcctggtcagaggggcatgcctacctttccttga

SEQ ID NO: 6869322 - DNA, 68 bp, Homo sapiens
cgtagcttgtgttgatgggacaaatggctcggaacaatatcagctttggtgctgtcacacaaactgcg

SEQ ID NO: 6869323 - DNA, 74 bp, Homo sapiens
caaggccagtttctcctagtcaaaaccaaatgtaacaagtaactcaatttttcactgggggacaatttgttttg

SEQ ID NO: 6869324 - DNA, 101 bp, Homo sapiens
cagaagggcagtagggtggagggctgatgttgccacctcaagtttccaatttgatttaggggtcgttcctgtgagctagccactcccttcctgcctctctg

SEQ ID NO: 6869325 - DNA, 67 bp, Homo sapiens
gccggcagcagccatccttagagaaagaggtaaactctcccctctgcagggggcttgactctacggc

SEQ ID NO: 6869326 - DNA, 62 bp, Homo sapiens
tagattctacagctcagctgtccaacaggtgcctattgaacatgtgagatgtggctggtctg

SEQ ID NO: 6869327 - DNA, 70 bp, Homo sapiens
gcttgaacccagggtggaggttgcagtgagccgagaccgtgccattgccctccagcctgggtgacaaagc

SEQ ID NO: 6869328 - DNA, 61 bp, Homo sapiens
ctctctgtgcacttctctttatttgtgaagcagttggctccagagattgagtgacagggag

SEQ ID NO: 6869329 - DNA, 98 bp, Homo sapiens
ggaaaccattgcagggaaggtcgataattagggttaagaaagaagatcagccattcctccagccatgattgtaaatagctctctgctttctggttttc

SEQ ID NO: 6869330 - DNA, 63 bp, Homo sapiens
gagtcagtgcatgcacacacatggtatacgtgtgtgtacgtgtgttcgtgtaagcactgtgtc

SEQ ID NO: 6869331 - DNA, 69 bp, Homo sapiens
ctgacttataatcagccaagtcatttcatttatggcttacatcaaattggaatgaaaggctctgatcag

SEQ ID NO: 6869332 - DNA, 70 bp, Homo sapiens
tctttccactgtactatattgcctagtgtttgtggtcaagtatggggctgtgtgtgcacatagggatgga

SEQ ID NO: 6869333 - DNA, 57 bp, Homo sapiens
gaaatcttttaaccattcatttcctcttgcctggagatgattgtgcagtaaggtttc

SEQ ID NO: 6869334 - DNA, 72 bp, Homo sapiens
aaagttgagtatcttatgtgcctttgggtgctgggacttgtagccatggcaaaggagatgttttctgacttt

SEQ ID NO: 6869335 - DNA, 70 bp, Homo sapiens
gctctcagaagagccaggctacaacaattgccctttagaaatgagatcaatggcctctcttgtgggtggc

SEQ ID NO: 6869336 - DNA, 66 bp, Homo sapiens
tgcacacctctccaccactctccactatatctccagtgcttgttgggtgggggtgggaggggtgca

SEQ ID NO: 6869337 - DNA, 62 bp, Homo sapiens
ggtaggaagagggaggagggcaaggaagggtactaatatgcaccttactccctctggatgcc

SEQ ID NO: 6869338 - DNA, 63 bp, Homo sapiens
gccagtgccaagagtgagccatgagaggattcacatgcctccactcactcatttggcacctgc

SEQ ID NO: 6869339 - DNA, 101 bp, Homo sapiens
ccagaccctacctctcagaaacctcagccttggccccaggcagtggtgggacaacacaaaccacacagcagagggcacaggagctggaggagaggttctgg

SEQ ID NO: 6869340 - DNA, 82 bp, Homo sapiens
gagacaatttctcctggctttgcgtctttgccacagtttgagttctggaacaagacagcatagagctcacagatattgtctc

SEQ ID NO: 6869341 - DNA, 129 bp, Homo sapiens
ggccacagccagaggttttgggggattagggcatggacgtctctgaggccatgattcagctggccgtggtcatctggagtgtctttccttgccccattctgatctcctctccttgctgttgtaatggcc

SEQ ID NO: 6869342 - DNA, 78 bp, Homo sapiens
gcagcttacatatttatggtgtgaagtacttaactccctacattttagttctcacatctgaaaaaatattgagcatgc

SEQ ID NO: 6869343 - DNA, 70 bp, Homo sapiens
ttagtaactgatcatgtgggaggatatgttccttagaacattaaaaatcattcatggttagtattactga

SEQ ID NO: 6869344 - DNA, 60 bp, Homo sapiens
ctgtatgtttacatttagtgcacagctatagtttgctagtgtagctcttgtaagcagaag

SEQ ID NO: 6869345 - DNA, 78 bp, Homo sapiens
tgggttgggacaaaagtaattgcagtttttgccattgaaagtaatggtaaaaaccgcaattacatttgcaccaaccta

SEQ ID NO: 6869346 - DNA, 130 bp, Homo sapiens
gccagcttgacctctaggcagggcgtctgcacgaggctggagagtccgtgctctgtccacctccaacaaaaacaggctgctgacttcatccagcttccagtcctttcccagacaggtcccagctctcggc

SEQ ID NO: 6869347 - DNA, 129 bp, Homo sapiens
agaagagggaaaaagcagggtgctggcggaaagccaggtttcaactaaatcaagaaggtggtgagaacaacctatgaagatgttgaggctgggaatttctctacacatgaagatgggttccagaggtct

SEQ ID NO: 6869348 - DNA, 86 bp, Homo sapiens
gcaccagaggtcccggactttcccgttgcaattccgccatctgctggtcggtctcaagatagcaggcaaggtccgtgcctcggagc

SEQ ID NO: 6869349 - DNA, 66 bp, Homo sapiens
actccatcactcatcactcattggacaacagaggcttcttgatgtttgctgaagtgatggtggggt

SEQ ID NO: 6869350 - DNA, 65 bp, Homo sapiens
tagagcacagtggatgacatccttttgcaaacagcatagtatgtatatccactgcccaatatcta

SEQ ID NO: 6869351 - DNA, 66 bp, Homo sapiens
atctattgtggtggttgtggtgatggtctagagctctgaatacactaaaaatcactttaaatgggt

SEQ ID NO: 6869352 - DNA, 65 bp, Homo sapiens
gaatttgtcccttgatataaaaagaatttactacctcacataagtaaaattaggggactcaattc

SEQ ID NO: 6869353 - DNA, 57 bp, Homo sapiens
gaaggtaggcccacagttagtgagagagttgccttgtctatctcctggcgtgccttc

SEQ ID NO: 6869354 - DNA, 84 bp, Homo sapiens
gtccatggactctggcctcatccctgaggaagaggacaactcctgattactggttttcagaggaggccacagccgcgagtggac

SEQ ID NO: 6869355 - DNA, 61 bp, Homo sapiens
tattttcaacatagatttttcttccctgggtttttcaataatgagactctgtgtgaaagta

SEQ ID NO: 6869356 - DNA, 66 bp, Homo sapiens
cctctaacccgtgggagacttttgcctctttcaagtggtttggcagttgttggccacgggtggggg

SEQ ID NO: 6869357 - DNA, 68 bp, Homo sapiens
taccacggaaagagcatttttgtggcatatcgactaagaaaataaccaggctgctctttcttgtggta

SEQ ID NO: 6869358 - DNA, 59 bp, Homo sapiens
ctctcacagccattgcagtacattgatctccatagagacagtgccagggcaggtgagag

SEQ ID NO: 6869359 - DNA, 57 bp, Homo sapiens
tgtcgagcagagcagagacgtctggtggagacagccgggtgctggagctctctgacg

SEQ ID NO: 6869360 - DNA, 129 bp, Homo sapiens
agtaattaatgaaatgaaataacttattatgataaatgcccactgacttcagggataaaaagtaattcatgttttggatatacctctgggtcatgtttgtttatatgaagagttttcagcagttgaact

SEQ ID NO: 6869361 - DNA, 122 bp, Homo sapiens
agtttgctagaactgctgtaacaaagtaccacagactgtgtggcttatacaatagaagttattttctcatggttctaaaggtcgcaagtttgagtttgaggtatcagcagtttgggtttcct

SEQ ID NO: 6869362 - DNA, 62 bp, Homo sapiens
agtggcttctatattgaattttcttcctttgttccggatgacagctccatgaagtagtcact

SEQ ID NO: 6869363 - DNA, 75 bp, Homo sapiens
cctccatccctgccacatggccactgtgttcatgagccaattgggcaatgacaggagtggctagtgggagagagg

SEQ ID NO: 6869364 - DNA, 111 bp, Homo sapiens
ctgggaaaaggctaattggaacaccagaaatgagtagaggatgctgcctgagcattttatagctcagcatgttctagttcattctgttctcctactgaggtaaaatcccag

SEQ ID NO: 6869365 - DNA, 60 bp, Homo sapiens
ggggcagggattcttgctcttatagttgaggaaactgaggcccgaggatctcctgactcc

SEQ ID NO: 6869366 - DNA, 61 bp, Homo sapiens
agtcttatgtttgtgaagaacttccatcattcaaaaggcaagcctcttcattgttaagact

SEQ ID NO: 6869367 - DNA, 84 bp, Homo sapiens
tattcggttggtgcaaaagtaattgcggtttttgccattaaaagtaattgcaaaaaccacaattacttttacaccaaccggata

SEQ ID NO: 6869368 - DNA, 68 bp, Homo sapiens
cacccagcaggtctcaatctgagcaggctctactcatgggacctgctcgtcttggacccagttgaatg

SEQ ID NO: 6869369 - DNA, 69 bp, Homo sapiens
agtccagagatggacagggaatttgaggatgctgcgcacagacacagtcttccttccatctctcaggct

SEQ ID NO: 6869370 - DNA, 60 bp, Homo sapiens
tgacacatttgcataatacctcatataatgttgatgtgaggattaagtaaatgatgtaca

SEQ ID NO: 6869371 - DNA, 91 bp, Homo sapiens
tgtgaaggcataagatttgggaggggccaggggcagaatgatatggtttggctctgtgtctccacccaaatctcatcttgtagctcccata

SEQ ID NO: 6869372 - DNA, 86 bp, Homo sapiens
tcgctgggattacaagtgtcaggtactggcacctggaaagcctggtgccagcgcctgacacttgtaacctccttcccttatggtga

SEQ ID NO: 6869373 - DNA, 66 bp, Homo sapiens
cagatggagaaaattgggggaagctgaaatatgtgctgaagttagagtccacaagattttccagtg

SEQ ID NO: 6869374 - DNA, 64 bp, Homo sapiens
ttagggtaacatgtgtgttatggattgaattgggtcctctcaaattcacatgttgaagtcctaa

SEQ ID NO: 6869375 - DNA, 55 bp, Homo sapiens
tccaagaggagacactgggatgagccccgacgggtggccatgtgttccttttggg

SEQ ID NO: 6869376 - DNA, 85 bp, Homo sapiens
gtccaaggtcacaccatgaaggagtgaaagggctagaacttgaaatcagggatgtctggctccactttcttcatttactggggac

SEQ ID NO: 6869377 - DNA, 73 bp, Homo sapiens
gcagacgtggctctgtttccctgtgtaaaaagaacatcatgcttgctgcagggatttcagagacacttagtgc

SEQ ID NO: 6869378 - DNA, 77 bp, Homo sapiens
gtttatcaaaccctagcgtagtgctggcacatggcaattctcagtgtgagcactggctgggaaagtgactgatgaac

SEQ ID NO: 6869379 - DNA, 57 bp, Homo sapiens
tgctgacactattctaaaaagcagataattttggttctgcttgaataatgaatagca

SEQ ID NO: 6869380 - DNA, 68 bp, Homo sapiens
tggagcacagccaaagtaagaaggacaatcagggctctaaagcatggcctcattatcactgtgttcta

SEQ ID NO: 6869381 - DNA, 78 bp, Homo sapiens
agtaggctttgcacagattaggttattggaaagtatagttatttgcttgtaaagtggcagttctgtgtcaaaattgct

SEQ ID NO: 6869382 - DNA, 71 bp, Homo sapiens
cactcatacacaagagcatgtaacaatagtaaggactctctgagtgcctgttgctgttattgtgatgattg

SEQ ID NO: 6869383 - DNA, 70 bp, Homo sapiens
ggcactctctgggtcactgtgggagggcagggaagccatgctaccctctcagtagacccagagcagctcc

SEQ ID NO: 6869384 - DNA, 55 bp, Homo sapiens
tgggttttaaacatggttaaagttcttatcccagagctctaaaccacaaagccca

SEQ ID NO: 6869385 - DNA, 95 bp, Homo sapiens
ggacgtgaaggaaacacaggggcgtggctcttactctctatttgtgtgtgtgcatgtcccgtggcgagtcacgtgtcctgtggggccttcactcc

SEQ ID NO: 6869386 - DNA, 86 bp, Homo sapiens
ctcttctctctttcacagggcagatcatttctgtcttagtacaaataagaaaatagataggaaagggccttgggaccagtgaaggg

SEQ ID NO: 6869387 - DNA, 69 bp, Homo sapiens
atatttaaacagggtaccaatataagtttttcttctgaatggcttactgatgggtaccttgctagatat

SEQ ID NO: 6869388 - DNA, 80 bp, Homo sapiens
gtttcactccagtgcaatgcagatgacaccaagccaacacgcagaggcatggccggagtgttgtcactgtgagttggggc

SEQ ID NO: 6869389 - DNA, 70 bp, Homo sapiens
gctgtatttaagtgttcattttagagtatcagtttactgacctattcagctgatggtatttaaatgcagc

SEQ ID NO: 6869390 - DNA, 120 bp, Homo sapiens
ggagcagaaaagtgcaaggtagtaggagtctgagaaagaattctggggaagcaattttggtctgtatctgcctattttcatgtaatttcttatcatactacctttgtacttaattactcc

SEQ ID NO: 6869391 - DNA, 56 bp, Homo sapiens
agagcaggtggtagacttaactctttcttggctgggagtatgatccactctgctct

SEQ ID NO: 6869392 - DNA, 97 bp, Homo sapiens
gagtgctttagaagagagctgtttcattcgtgttatggggtgcctagcactttgcaatacttaatacaaatgaaactataatagcttttttgtactc

SEQ ID NO: 6869393 - DNA, 66 bp, Homo sapiens
ttaattaactagccaaccactagtcctggtcacattggctaagagggtttggaggctagtgattaa

SEQ ID NO: 6869394 - DNA, 87 bp, Homo sapiens
taagaaaggccaccagcctgcctgaattcaattcctggcttggtcactttcaagccatatgactttggcaagtggtgttatttcttg

SEQ ID NO: 6869395 - DNA, 58 bp, Homo sapiens
gaaaatttctgccacatgtgtgtatacatgcaagtgaaattagcagaatcatgttttc

SEQ ID NO: 6869396 - DNA, 57 bp, Homo sapiens
ggattagcatagccattgaaatatgtgtcaaacatctcaaaggttaattgcttctcc

SEQ ID NO: 6869397 - DNA, 58 bp, Homo sapiens
ctagtaacaacttcactgaagtggctgagatccacagtgtgtcaggaggtgtttctag

SEQ ID NO: 6869398 - DNA, 69 bp, Homo sapiens
tggggtttttcttcaattgctaacaaggaagaatgcagtatcttctttatcaggtgaagagggactcca

SEQ ID NO: 6869399 - DNA, 70 bp, Homo sapiens
ctggtgggaagaggagcactggaatgggagttaggcgctctacattctccccggcttcctccccaactag

SEQ ID NO: 6869400 - DNA, 71 bp, Homo sapiens
ttgtcacatttgctatcccactccttagggcgtcttctcttaataaccaggcagtggtggtaacatgtcaa

SEQ ID NO: 6869401 - DNA, 94 bp, Homo sapiens
tgatattcctgcctcagatttactgtgtctttcctactttgtgggcaacatgttcacagggatggaatagaaataagaaaaggctggaatatta

SEQ ID NO: 6869402 - DNA, 64 bp, Homo sapiens
ggttaagaatttggcagtcagcagctcagactctgtcttcaggctcctggattcaaatcctgcc

SEQ ID NO: 6869403 - DNA, 96 bp, Homo sapiens
gtctgaggaaggaagaaggttggtgactatataaggttcaaagctttccaaaaggaagaacttacattatagagctgtactctttctccttcagat

SEQ ID NO: 6869404 - DNA, 66 bp, Homo sapiens
ggctgctggctgtgtaccatctcaagcttgctgaaacttgggggttcctaaacaagcacaccagcc

SEQ ID NO: 6869405 - DNA, 56 bp, Homo sapiens
gggcctgggcaccctatccccaggacacaggacctgggcacccagtacctaggccc

SEQ ID NO: 6869406 - DNA, 73 bp, Homo sapiens
cggagtttggagaatgaaggagagccctctgcaggattgcaatgccagtggcacttgtcatttctgagcttcg

SEQ ID NO: 6869407 - DNA, 88 bp, Homo sapiens
ttaatcatgctggttgcaaacttttgttgaaagaagatggtgcattttggcagccatctctgaaatcaaagctgtcctagatatttaa

SEQ ID NO: 6869408 - DNA, 85 bp, Homo sapiens
caggcatttccaccctgctcagtccccagatgtgtgctgtctttggaaaggcaagcacgtgggtttgagatctgggtgctgtctg

SEQ ID NO: 6869409 - DNA, 69 bp, Homo sapiens
atctacagaattcaacaaatggttaatgacattttctacgtaccagacacgtttctgaattctgaagat

SEQ ID NO: 6869410 - DNA, 95 bp, Homo sapiens
gctctttaacatggcattatggggttaaatttctcctagcacaaattctgggtcagattgagcccctggtgattgtctctttccagttggtaggc

SEQ ID NO: 6869411 - DNA, 81 bp, Homo sapiens
tgtcccagtttatctgggactgtcctggttttaaaatggaaaactcctgggaactcccttagtctggggcaaattgggata

SEQ ID NO: 6869412 - DNA, 111 bp, Homo sapiens
gattcataagaaagagtaaaaggaggtgtttgatagctgaaaagaataggcaagctttcctttctgataattttgtgaaatcacttcctttatatgacttaaaattggatt

SEQ ID NO: 6869413 - DNA, 73 bp, Homo sapiens
tttttgtaaatgtaagttgggtttagcattaggaaatcaattagtgcaattccccatactaacagattaaaaa

SEQ ID NO: 6869414 - DNA, 75 bp, Homo sapiens
gtaatttgggagtatatcgtgtatcatatgcatactcacatgtatcatatacatacagtatgattcgtaaattgc

SEQ ID NO: 6869415 - DNA, 98 bp, Homo sapiens
gggagtagaattgctgggtcatatggtaaatttatgtttaatgtttttaagacactgcccaactgttttccaaagtgactgcagcattttatattttc

SEQ ID NO: 6869416 - DNA, 57 bp, Homo sapiens
cttcctggctcggtgcctcaccctggagggtggcagtgtgggctgtgagatgggaag

SEQ ID NO: 6869417 - DNA, 62 bp, Homo sapiens
cagaaggatagagctgggagtttcccctatcactgggtgaggctactcagctgtccgaactg

SEQ ID NO: 6869418 - DNA, 75 bp, Homo sapiens
ccaagagcggggctggcgttagggaggcatccccgcagtgaaggatgcttggagaatcagtcccagctgccgtgg

SEQ ID NO: 6869419 - DNA, 67 bp, Homo sapiens
ggagaatctgttctgtctgtggttgttaaccctctcaataaagctacaaggtagcattagtttcttc

SEQ ID NO: 6869420 - DNA, 77 bp, Homo sapiens
ggagatgcagcggccctggggaagagcaggcatggccacgggctgggcagctcctttaggctgcaaagggcaattcc

SEQ ID NO: 6869421 - DNA, 105 bp, Homo sapiens
gtgaaccacatacttgaggatccagggcaggggatggggtggtcttctctgtccactcttgactgtaccaccttgctcttgtcttctcaccaccagcttctttac

SEQ ID NO: 6869422 - DNA, 83 bp, Homo sapiens
ttgttcaaaggattaagatgagattagcatttggtaaaccctttaaggtttacacagtgcttttatatcattaatcctaacaa

SEQ ID NO: 6869423 - DNA, 62 bp, Homo sapiens
ttgcagaatctcaggaaggagaaagttccaaggagggaacggtttggtgtctgaggctgcag

SEQ ID NO: 6869424 - DNA, 64 bp, Homo sapiens
aattcagacagtgtgatcagtctctgcaattcaatgagagctataacagcactgtacatgagtt

SEQ ID NO: 6869425 - DNA, 56 bp, Homo sapiens
gtccttagacctggcaaatggggagggtccaggccgtcactcgccggctaggtggc

SEQ ID NO: 6869426 - DNA, 78 bp, Homo sapiens
ttgtgcaaaggaggaggcattatggggaagacttagaatttgggacttcactcccactaatgcttttctcatttacaa

SEQ ID NO: 6869427 - DNA, 60 bp, Homo sapiens
agcattgtccataatttgaaaggtaaacctagttgttgagtactttcagatggatatgct

SEQ ID NO: 6869428 - DNA, 70 bp, Homo sapiens
gatctaatgaccggtcatacaagcagatacaacggtgctgtcagggctcagtgggataggtcagatggtc

SEQ ID NO: 6869429 - DNA, 87 bp, Homo sapiens
gaatttttgagcgggtaaaggtcgccctcaaggtgacccgcctactttgcgggatgcctgggagttgcgatctgcccgaccttattc

SEQ ID NO: 6869430 - DNA, 78 bp, Homo sapiens
tactcttgtcactgtttcctattatatttgggtgattcagtataacagaagaatgtaataggaaacgtgtggagggtg

SEQ ID NO: 6869431 - DNA, 71 bp, Homo sapiens
gctgatgttaaggtagtgagtttcctgtcactggagagatccaagcagaagttgatctaccatatatcagc

SEQ ID NO: 6869432 - DNA, 107 bp, Homo sapiens
tgggaagtgtctgggagccatgccttggagtgcctcactgatcacaaagccatccagtgtggcctttgattcctgggcccctggtgtcctgctcactttacccccca

SEQ ID NO: 6869433 - DNA, 58 bp, Homo sapiens
cctttgtgctcctctcagtatgtgcattaactgcatttgacagtgagtcacagcaagg

SEQ ID NO: 6869434 - DNA, 75 bp, Homo sapiens
cagactagggagctgctgttgggggagaagcatggtttctgagagccactgaacagcaacacagctctcttactg

SEQ ID NO: 6869435 - DNA, 88 bp, Homo sapiens
caaactatgctgaaatgaactggcctcaggtctttctcccaaatagcagagaactcaaatgaagagtcatttcattcccagcggtttg

SEQ ID NO: 6869436 - DNA, 103 bp, Homo sapiens
gcagttgggagctgtggggtctccaggtggcttctgcccgatgtcgtctgagaacacaacgagctccttccgcctcggggccctcacactgccgcgcccctgc

SEQ ID NO: 6869437 - DNA, 67 bp, Homo sapiens
cgccgctgggatatgtccagttctacctacctgtaacacaagtatgaacaaacacatcccagcagtg

SEQ ID NO: 6869438 - DNA, 73 bp, Homo sapiens
gcagggaggaactcttcagatatacagtactctcaagatctgaagatgggggtctgaaggtttacaaccttgt

SEQ ID NO: 6869439 - DNA, 96 bp, Homo sapiens
tggtgtcagacttcttaattctaaatgatgctttctttgcaatggtgctttgatgtaacatggagagttcatgtggagtggggaggatggcaacca

SEQ ID NO: 6869440 - DNA, 95 bp, Homo sapiens
ggcctacccttactgagtgtgacctcatcttaactggaacccatctgcaaagatcctatttccaaagaagttcacatttacgattactgggggtt

SEQ ID NO: 6869441 - DNA, 115 bp, Homo sapiens
tatagtcatttatcttgtgttcagtatttttttagtaccttgaagctaatgtgattgctaccaagaaaatctaggagaaacaactggaaaattataagaattcagtaagattata

SEQ ID NO: 6869442 - DNA, 109 bp, Homo sapiens
cgcttattagggtgtaaccgtggtcacagtacttaattctctaaatttgattcctgagcaacaaagtggggaatgatagtattggtgctgttactattatgataatgtg

SEQ ID NO: 6869443 - DNA, 63 bp, Homo sapiens
aggctggagtgctggagtgctggagtgcagtggtgccatctcagctcactatagcctccgcct

SEQ ID NO: 6869444 - DNA, 67 bp, Homo sapiens
gttgataagcagcattgagatctgccctcctaagaatgggccattaggtcttcaaagcttttacgat

SEQ ID NO: 6869445 - DNA, 101 bp, Homo sapiens
ggcaaagaaatgccttgttttagattattttgtgtcctgtttccctgtctataaggaaggaccctatagaaatcaggacaggactgaatcctaactttgcc

SEQ ID NO: 6869446 - DNA, 67 bp, Homo sapiens
gggtacagccgttggttgccgggggcgacactgtcaggaccggcagtcggcagccacggctgtgccc

SEQ ID NO: 6869447 - DNA, 119 bp, Homo sapiens
gcactgttctgggcacagcttctgctctccaggagctcagagtctactaggggatagaaatgagtagatagtcacctcttggagacataggggctggatttgaggtccataccatgtgc

SEQ ID NO: 6869448 - DNA, 62 bp, Homo sapiens
catttgcctttcgaatcaacaggaagtcacttcttcctcttgaatgccaggaaggacaggtg

SEQ ID NO: 6869449 - DNA, 97 bp, Homo sapiens
gaggtgttacccacacagcccgccctgaactttcgggtctcctaaaggaacccacgacgagtcatcagggcgactggaagtggctggacagcgcctc

SEQ ID NO: 6869450 - DNA, 57 bp, Homo sapiens
gaatcatgtctagaagcagtgggaaacatttctccagctgtccctctgcatagattc

SEQ ID NO: 6869451 - DNA, 55 bp, Homo sapiens
gggtgaatggattcagaaaatgtgttatatagacacaatagagtactattcagcc

SEQ ID NO: 6869452 - DNA, 71 bp, Homo sapiens
aaatgaaaatccctttagaaaactgccagacattcagccctggccaaatggatttgaaaggattgttattt

SEQ ID NO: 6869453 - DNA, 106 bp, Homo sapiens
agaggcaacctggttagctcccacatttggactcaaggatctcagaagagtgaagcacctgaaggtttctgggagtttctgtgggagctgcagaatctttgcttct

SEQ ID NO: 6869454 - DNA, 74 bp, Homo sapiens
tggtgtctacaggatggagtggctgagtctccagccttttctatggagcagagcctccctccaccttggaccca

SEQ ID NO: 6869455 - DNA, 79 bp, Homo sapiens
tgaacaattctccttccactctgagtccaccctgggtagcctccagtgtgataagggtggtgaggggaaactgagttca

SEQ ID NO: 6869456 - DNA, 100 bp, Homo sapiens
agaggagaggagagggaagaggagaagagagcgaatctggagaaggaaacagaacacgtctagtaccgttcactcccttgcccctcggcatccacccttt

SEQ ID NO: 6869457 - DNA, 55 bp, Homo sapiens
gtggtttttgggtttgcacctacagggagagttccagtgcattccaaagcaccat

SEQ ID NO: 6869458 - DNA, 71 bp, Homo sapiens
ttgctggccagtgtgcaagaggccaccagctgccctgttcagcttctggatgagctcacgctggcccgtaa

SEQ ID NO: 6869459 - DNA, 119 bp, Homo sapiens
ctttgcttgaggtcacatagctaggaaatggtggaggaaggcttaaagacaaggcagtctagtccagaggtggggcttctagccaccatcctatgctgaaagcatgataaggggtagag

SEQ ID NO: 6869460 - DNA, 123 bp, Homo sapiens
gacaccttgtaccaccctagcaccagcttgagccacccattcccgagccctatgaaccacaacatggaagggaacaggtgggtgtttgagaggctgtgctggcatccaagggtgcaaggtgtc

SEQ ID NO: 6869461 - DNA, 84 bp, Homo sapiens
ccatgcagtataataaccaggaagctgtctgatatgaaagccatcaatagcattttcaatcaaaacctttcagttaattgctgg

SEQ ID NO: 6869462 - DNA, 77 bp, Homo sapiens
cattttagccattctgataggtatgtagtgatatctcattgtagtttaaatatacttttcactaatggctaatgatg

SEQ ID NO: 6869463 - DNA, 79 bp, Homo sapiens
gccttctcccattgttgctgcttcaagatattgtgtcctacttcccaaggtaatgatgtgtgaggcaataacagggggc

SEQ ID NO: 6869464 - DNA, 71 bp, Homo sapiens
gttccaggtctggttggacaggttgaggctgacacacctgagagaatccggaatgccagagagcctggagc

SEQ ID NO: 6869465 - DNA, 60 bp, Homo sapiens
tgccaatggtgtaaagctcaagagcaggagaaatccagtttcagctcaagcactcaggca

SEQ ID NO: 6869466 - DNA, 58 bp, Homo sapiens
gcccaggaggcagaggttgtagtgagctgaaatcacaccactgcactccagcctcggc

SEQ ID NO: 6869467 - DNA, 77 bp, Homo sapiens
atgaatcaaaatcttgaacagggtcttgttttctaatatattttgatagaagatttgactctgattagcatgttcat

SEQ ID NO: 6869468 - DNA, 70 bp, Homo sapiens
ggaccaaacatgccatctttgtcaggagtgggcacgatcagaggctcctgaggagagggcagcgggatcc

SEQ ID NO: 6869469 - DNA, 81 bp, Homo sapiens
gctgctgctgctgacccttgcccatcccggagctcactttgagagctggctgagatcccaggcagggtggccagtggctgc

SEQ ID NO: 6869470 - DNA, 61 bp, Homo sapiens
gggctcccttcagtcttgtttgattcctcaccctaagggcggagttcagagactggggtcc

SEQ ID NO: 6869471 - DNA, 65 bp, Homo sapiens
tggtttacctggaaaagcgcattataacacagccttggaaattttgtgttcttctaggtcagcta

SEQ ID NO: 6869472 - DNA, 76 bp, Homo sapiens
gatccaaagaacattgctgagacctagatatacctttcccagatcaataaattcgggtccagtaggtctttgggtt

SEQ ID NO: 6869473 - DNA, 80 bp, Homo sapiens
tcctggccacctgcagggggagtcaagagtgggagaaactggctcctgctcctgctcctgcttgcaaggaaataccggga

SEQ ID NO: 6869474 - DNA, 74 bp, Homo sapiens
tccaggttcaagtgattctcctccctcagctacccaagtagctggcattacaggagcatgccaccatgcctgga

SEQ ID NO: 6869475 - DNA, 61 bp, Homo sapiens
ctgctttatattgagcttgaaaaacatccgatttcatgccccttattcaactgtgaagcag

SEQ ID NO: 6869476 - DNA, 85 bp, Homo sapiens
gcagaggggtccatgcaggctttccatggtaacttaaagggaaaccttcacagtgtcacaatgcctggagacctggacgtcctgc

SEQ ID NO: 6869477 - DNA, 55 bp, Homo sapiens
ctttattttgttctggctctggggctggctttcccaggaagccaaagaaatatag

SEQ ID NO: 6869478 - DNA, 60 bp, Homo sapiens
tgcaagtaaatagactgagtcatcacctaggataagtgacagcagtcttaacacattgca

SEQ ID NO: 6869479 - DNA, 58 bp, Homo sapiens
cagtaattgtaattaaaaattagcatagaaatgtgcttttaggagattaaaattattg

SEQ ID NO: 6869480 - DNA, 130 bp, Homo sapiens
cattagaatctcctggagggtttactaagccacacttcccttggcgctgctcccagagcttctgatgtagtaggtctgggatagggccagaacatgtgcgttttgaacaggttcccaggtgatactgacg

SEQ ID NO: 6869481 - DNA, 77 bp, Homo sapiens
gctggttggagtcatggtgtggtttctctttatctgtttatttgctcaaggtacatgcatttatgtctcccaccagc

SEQ ID NO: 6869482 - DNA, 85 bp, Homo sapiens
tcccatcccagctctgaatttgtgctttctccccctgaacttcagaattcttggccggaaaggtcagattctgactgtggtggga

SEQ ID NO: 6869483 - DNA, 87 bp, Homo sapiens
gctctctagaggaccatggaggtgctgcctagaaggagacaggtttgctgtttcctgggcctgtactccatccgtctttaggagagt

SEQ ID NO: 6869484 - DNA, 66 bp, Homo sapiens
catacattttgagaggccagttttctgaaaaataagccaggaaagcttagcattttcaaaatgatg

SEQ ID NO: 6869485 - DNA, 61 bp, Homo sapiens
gtcactgaggctggagtgcagtggtgcaatcgtggcttactgcaacctctgcctcctggac

SEQ ID NO: 6869486 - DNA, 70 bp, Homo sapiens
gtgtgtgtgcatctcttttattctaaaatcaggatttttatcatggattcaaaggagtatgttcatatgc

SEQ ID NO: 6869487 - DNA, 74 bp, Homo sapiens
ggcctgtggtttgattaagcattttaccttattttagaagggatgatgtctgtgagatcaaactaagacaggtc

SEQ ID NO: 6869488 - DNA, 56 bp, Homo sapiens
tgctcagtagagtttttggaataagtatttcatattttggaatcatttacagagca

SEQ ID NO: 6869489 - DNA, 81 bp, Homo sapiens
gtgcaggccccgcggacagcccccaatgtcagctcaggtctctggctgtgctggcggcagtggtgtctctgaggccctcac

SEQ ID NO: 6869490 - DNA, 84 bp, Homo sapiens
gtgagtggaaccagctggagggcatctacttagtcctctgaggacacatgaaggctgtgtggagcccccgagctgattactgac

SEQ ID NO: 6869491 - DNA, 68 bp, Homo sapiens
tggaaatctactttgggttagacactgtgataaatgtcagtgtctgaaaagcctggagttgatttcca

SEQ ID NO: 6869492 - DNA, 106 bp, Homo sapiens
agccaggagggctgacagtgctggagtggaccagtccgcggagctccgggggtctgaatgctccaggggtgtgtggatggcaatggccaggatggccctcctggtt

SEQ ID NO: 6869493 - DNA, 95 bp, Homo sapiens
gctgtgtaaggggaatagcggaatgtccttcttaaggtgtttggcacaatacagataaacactaaataaatattcctgtctgtcctccctacagc

SEQ ID NO: 6869494 - DNA, 56 bp, Homo sapiens
gcagttgtggtttcgtttccttttggaatcttcaaaggcagcgattttcatattgc

SEQ ID NO: 6869495 - DNA, 86 bp, Homo sapiens
gttttgactggctctatcaggataaattgacccttgcttcccatggtatttatggcatttatccttggggtagagccagtaccgac

SEQ ID NO: 6869496 - DNA, 59 bp, Homo sapiens
agcatgtggctatctttgggggccttattttgcctaccatattcatttagccacaagct

SEQ ID NO: 6869497 - DNA, 92 bp, Homo sapiens
ttaattaattggtttatgctgtactcttgggaagtgggtaaccagaccctcttcccaagactgtattgcaagattagacagggagtgattga

SEQ ID NO: 6869498 - DNA, 94 bp, Homo sapiens
tattcttactaaattcagaagtttgcaattgtttatttcagtgtgaaaccatttgtgtagtgattaattgtaaaaattctgaaatcagagaata

SEQ ID NO: 6869499 - DNA, 83 bp, Homo sapiens
gaagcaatgctgacatttgaactcagcttcagacaacaaattcaggtttgtttgtttgttttgctgaatacttcaattgcttc

SEQ ID NO: 6869500 - DNA, 130 bp, Homo sapiens
caggggagagacccgcccctctgccacctggccctcggagtccagctgccactcaccatcccactgcaaagcacaggtgggcagcagcgggcctgccggggcgccagcaggatggtggcctctccagctg

SEQ ID NO: 6869501 - DNA, 66 bp, Homo sapiens
atgtggcattttgttttatttgaatttgaaattttttttaagttttaaagctagagtctgccacat

SEQ ID NO: 6869502 - DNA, 89 bp, Homo sapiens
ctctggcattaggatagacaataagagttgattattaaaatggtaatactcttaatgttttatagattgaaatttatgatgcccaagag

SEQ ID NO: 6869503 - DNA, 102 bp, Homo sapiens
taagatgtttgctggagaaacctattgtttactgaaagcactcaatgaagtcaaattactgaagcttttgcctacatcttggtcttttatgtaaatatgtta

SEQ ID NO: 6869504 - DNA, 103 bp, Homo sapiens
agaaactgggaagtgtcatctagtccactgtcctgcctccagagagaaatttatcttcatcatgtgagacaggtggttcattagataaaacactctagcttct

SEQ ID NO: 6869505 - DNA, 62 bp, Homo sapiens
agtgctcacctgctccagggacgtctgacctcgggtctcgccctccctcccaggtgggtgtt

SEQ ID NO: 6869506 - DNA, 76 bp, Homo sapiens
gagcactatgtatggtgttttacaaaaatgtagttttcattacaatcttatatagatcataaatactatggtgctt

SEQ ID NO: 6869507 - DNA, 62 bp, Homo sapiens
gctgctctggctgggatgagtgcacagcagcagaatgtctaagcagccagccagagctcagc

SEQ ID NO: 6869508 - DNA, 55 bp, Homo sapiens
ggtaaaactgcagaacttggaggtcctgatgagaggtttctgtctgtgttttgcc

SEQ ID NO: 6869509 - DNA, 69 bp, Homo sapiens
aggtcttttttgtgcattcaagtaggagccacacaccatgttggctaactgccccctgtgtgaagacct

SEQ ID NO: 6869510 - DNA, 75 bp, Homo sapiens
gctggggcctcctgctctgttgaagtagaatagaccctctcaagggactgtgaaggcagagctggggcctcctgc

SEQ ID NO: 6869511 - DNA, 66 bp, Homo sapiens
gtaagggaagaggaccagagtctctgcctcgtaatccagagaattcttctggatcttgtccaagac

SEQ ID NO: 6869512 - DNA, 71 bp, Homo sapiens
ggctctctgaggaaacccttccagaaagggtcagaaggcaattcttaaatgtaatgggtgctttagaagtc

SEQ ID NO: 6869513 - DNA, 63 bp, Homo sapiens
ttttctccagggaacaaggtgaggaactgcaaaccacttacctttatagcaacctggtgaaaa

SEQ ID NO: 6869514 - DNA, 55 bp, Homo sapiens
gaggtcattgaagttattttcttgcccctgggcaagaggcactgacaggggcctt

SEQ ID NO: 6869515 - DNA, 67 bp, Homo sapiens
ttccatcatggctggcttcagtctgatttattgccatccactcctgaagccaagccagctgatggag

SEQ ID NO: 6869516 - DNA, 82 bp, Homo sapiens
ggcttgggcaggtggaacaaattttggggaccttgattctgaatgtcagtccaaatcttgtttcatatctctgtttaaagcc

SEQ ID NO: 6869517 - DNA, 58 bp, Homo sapiens
tctggctcatacaagcctgcaaaggtttgttcaatattcaggcattttgtgaaccaga

SEQ ID NO: 6869518 - DNA, 57 bp, Homo sapiens
aggtccctgaagatgcctgaggagatggtgtccaatattctataacttcagggattt

SEQ ID NO: 6869519 - DNA, 59 bp, Homo sapiens
aggattatggaggtctttatgtaaccaccggtttagggttatggaggtctttatatctt

SEQ ID NO: 6869520 - DNA, 60 bp, Homo sapiens
cttcagccctgagtgccagcagtgggccaaagagtctctcttgccagcattaggctgaag

SEQ ID NO: 6869521 - DNA, 62 bp, Homo sapiens
gtctatggctgctgttttgctacaatggcagaattgaattgttgcaacagacaccatatggc

SEQ ID NO: 6869522 - DNA, 88 bp, Homo sapiens
aatgctgaggaatttggtttatgtttatgtaggtaacgatgagcctgataagtgacacaaatcatgtttttcaattacctatcgtatt

SEQ ID NO: 6869523 - DNA, 123 bp, Homo sapiens
ggtctggcttttcatccaagtcaggcacacaggactattgaggacactgaggcctcaggtgagggctcgagtttccacagtttgcatgggtcctgtgagctggggagggtgggggttcaggct

SEQ ID NO: 6869524 - DNA, 70 bp, Homo sapiens
cagggtcgcggaaccagtggctccccaggctgtcacccggggtgagcgcctgcaccactctgcggccttg

SEQ ID NO: 6869525 - DNA, 74 bp, Homo sapiens
gcggaaggacttctcggccgtgtggatgcgctggtgccgcaccagcgaggagctatgccggaaggccttgccgc

SEQ ID NO: 6869526 - DNA, 67 bp, Homo sapiens
gtccttgtgctgagggtgttgctagcatgtgctttactcagtgagcagcagtgactcagcacagggc

SEQ ID NO: 6869527 - DNA, 124 bp, Homo sapiens
atttgggctttgaaaggatcctgcttgtctgtgtgccagcatcctggtggtggttgggggagtctgcatcaatcctgggtgctgttacctgaaaaaatagcaggtgttagacgaaagaacagat

SEQ ID NO: 6869528 - DNA, 124 bp, Homo sapiens
actaatcttagattttacaataatgatgttatttatgggagcaattggggaggttacaatccacgtgacctctggttacatgactcctgatacataatcttaaccttgtggctaatttgttagt

SEQ ID NO: 6869529 - DNA, 75 bp, Homo sapiens
gcctttttggattatctgtcacttgggattacttgtactgtgatcctgtctatgagtagataattgaatgttggc

SEQ ID NO: 6869530 - DNA, 69 bp, Homo sapiens
ctaggcaatcaaattgtataatgttccagctgcatgattagctaactgatgcatatttcattgacttag

SEQ ID NO: 6869531 - DNA, 82 bp, Homo sapiens
agttaatagtgattttctgaggcatagaggatgagactcagtgtctcttccctgtagccacgggttttactttcagatgact

SEQ ID NO: 6869532 - DNA, 82 bp, Homo sapiens
agcctgttgtcctgtttgttttcactgttattatgatttttaccacaaggtgtcagtacaggaaccaggcaggtcgattgct

SEQ ID NO: 6869533 - DNA, 59 bp, Homo sapiens
tctgcaggtctctgtgtgcattccgggtggcgggaggtgacatgaggaggcactgtgga

SEQ ID NO: 6869534 - DNA, 69 bp, Homo sapiens
aaatgcttcacatttctcatgaagctgaggtagcccagcattctctactttagaaatctggatgtattt

SEQ ID NO: 6869535 - DNA, 82 bp, Homo sapiens
ctttagactaaagaagcatgtgttaatgtcaaccagaaaagattgcttttttctgcttgcaggcacatagcttagttcgaag

SEQ ID NO: 6869536 - DNA, 82 bp, Homo sapiens
tgtatcccttaagtaagatttttttccacagactcagactcaaggctgggtcagaatcagagagttgctcttacagggtgcg

SEQ ID NO: 6869537 - DNA, 67 bp, Homo sapiens
agtcactctgaggtataggactagtgggtgacatttgcaacatatactggtcagtgcctctggggct

SEQ ID NO: 6869538 - DNA, 59 bp, Homo sapiens
ttcaatgggaggggagaattattgcatttttaggcaagaatagctacctcccatatgga

SEQ ID NO: 6869539 - DNA, 74 bp, Homo sapiens
atcttctacctccctgtggcaacaatattttctaattaaaggagtccttttgtgccacagggaggatttctgat

SEQ ID NO: 6869540 - DNA, 68 bp, Homo sapiens
aacactcccagtagcccactgtttggctgactgtacctatgccacagtgatccctgcctgcgagtgtt

SEQ ID NO: 6869541 - DNA, 69 bp, Homo sapiens
ttcaaaaagatagcattgtgctcctttcttggtggagtgaacaggtgaggattatactgtctttatgga

SEQ ID NO: 6869542 - DNA, 58 bp, Homo sapiens
gggtggccggagaaggaggatggccacgcggccctcagtcctcacgctccggcctccc

SEQ ID NO: 6869543 - DNA, 72 bp, Homo sapiens
agcccccaaatctcaaaggcttagcatctcacatccaatgtggagttgccagtggttgggagggtgggggct

SEQ ID NO: 6869544 - DNA, 77 bp, Homo sapiens
aaatccctcaccgtgtccacatactgagagatgcagctttatcagtcagttatccacacaccaggggtgagggattt

SEQ ID NO: 6869545 - DNA, 60 bp, Homo sapiens
agttgtaagctctcttgctgggacaacgcctgtgattccagtacttcggacgtttatact

SEQ ID NO: 6869546 - DNA, 65 bp, Homo sapiens
aagaaaggtgactgcagcagctattcactcaaccctgaaaggctgaaaatggggtcacctgtctt

SEQ ID NO: 6869547 - DNA, 57 bp, Homo sapiens
agggcagggggtagggcctgctgtctgcagagaaagcagccagagatcctcggccct

SEQ ID NO: 6869548 - DNA, 64 bp, Homo sapiens
acaggaagaaagtgcagtagattctcattattcacaagttctaaatttgcaaattcttccctgt

SEQ ID NO: 6869549 - DNA, 57 bp, Homo sapiens
gagggaccctggctggagctggcctggggtgtctgtgccctcctgccaggggctgtc

SEQ ID NO: 6869550 - DNA, 65 bp, Homo sapiens
aggcctgactcggccgctctcaggcaccgcttcctggtggtgtttgcatggggccagtttggcct

SEQ ID NO: 6869551 - DNA, 55 bp, Homo sapiens
tggcagccgtgttgaacttgagccaagcgtttagtcctcagctgaactgctgcca

SEQ ID NO: 6869552 - DNA, 65 bp, Homo sapiens
agtgagatactgagaacatctctgtgggatgctgtctcctttccattcattttcagtcatccact

SEQ ID NO: 6869553 - DNA, 83 bp, Homo sapiens
tttttagttccttcatgatcctaccacattgagagcacctctcacatttaaacaggaggattaaagatgaatgaagctaagaa

SEQ ID NO: 6869554 - DNA, 70 bp, Homo sapiens
ataggatctggggacctgttgttgctaagtatatgtaggaatgtgccaaattagagttcccaggctttgt

SEQ ID NO: 6869555 - DNA, 66 bp, Homo sapiens
ctcaagcctttcgagcaagattttccagctgaatccgttgtacataaagacttgcctgaaagtgag

SEQ ID NO: 6869556 - DNA, 64 bp, Homo sapiens
cacaagctgggcaagtgtatattcacctccatttcataacagaataaacaaatgctgagctgtg

SEQ ID NO: 6869557 - DNA, 62 bp, Homo sapiens
agctttattcatttcaatattctcaggattatatattttgggactggagcttggagagggct

SEQ ID NO: 6869558 - DNA, 71 bp, Homo sapiens
tctctctgccagcttctcttctatttgcaggatgagcacaatcagactgtctagggaatccggctgaggga

SEQ ID NO: 6869559 - DNA, 63 bp, Homo sapiens
tataagtgtgtcagcttccaactttactgattacagcagtttgtctatgctgatgcatttgtg

SEQ ID NO: 6869560 - DNA, 68 bp, Homo sapiens
gagacaatgacaccgcttcagtgtgaactctcatgaattgagtctagatccccagtgctgtccgtctc

SEQ ID NO: 6869561 - DNA, 91 bp, Homo sapiens
ctgagttattctatatcatggagattaacattccaagcttcatttccatttgtggaatggtaaacttccatgactgttaaaggtatttcag

SEQ ID NO: 6869562 - DNA, 59 bp, Homo sapiens
cccgggaggcgcccgctgcaccggcctctccgggtggcgcagggaccgcgacttctggg

SEQ ID NO: 6869563 - DNA, 76 bp, Homo sapiens
ggactacaggacagactagggtcagcagatcagttgtggaaattggcagccagacccagttcttcgttgtagtgcc

SEQ ID NO: 6869564 - DNA, 96 bp, Homo sapiens
aatacctgagagatagaatgatatagtatataggacaagtcccataatataattaaatatggcactgatgtttactgcattctatttgcttgtgtt

SEQ ID NO: 6869565 - DNA, 63 bp, Homo sapiens
tcactatgatgaggtcctgtatcaagtacaattaatctttgtactttacaatttacatagtga

SEQ ID NO: 6869566 - DNA, 67 bp, Homo sapiens
tctttgggaacactccagggcttggaagacataatttttccaggtgatggtcggagttcagtgaagg

SEQ ID NO: 6869567 - DNA, 91 bp, Homo sapiens
gccaggatggtctcgatctcctgacctcatgatccacctgccttggcctcccaaagtgctgggattagaggtgtgagccaccgtgcctggc

SEQ ID NO: 6869568 - DNA, 105 bp, Homo sapiens
tctttctgcaaaatcgaagctatctttgatgactaatgctttgaaactatctctgtgttggttataaagctctagtgttttggataattttagtcaaaagaaaga

SEQ ID NO: 6869569 - DNA, 82 bp, Homo sapiens
gctttgccaggacctgttcttgggcagaactgaatatatactcaattctgaggagggaagaggaaggtcatggctaaaaggt

SEQ ID NO: 6869570 - DNA, 59 bp, Homo sapiens
gtattcccacaatctgcgtgtgtatcagaatcaagatactgtactgattgtgaggatgc

SEQ ID NO: 6869571 - DNA, 73 bp, Homo sapiens
gagaaagtcttaatgtaagtttagtagagtccttggatggagaactaattatatcatacattgccgctttctc

SEQ ID NO: 6869572 - DNA, 60 bp, Homo sapiens
tgtcctttgagctgccctgtgtctatgctaaagacacataagggtctgctgggtaggaca

SEQ ID NO: 6869573 - DNA, 83 bp, Homo sapiens
gcaacttcctttcattagagagtttatgatatggttagggggataacttactaactcatgatttcctggttaaggactacggc

SEQ ID NO: 6869574 - DNA, 84 bp, Homo sapiens
ttggaagccatttgtcaaggttggcagggcagagatacagcctctgagtatctgatgacctgtcctgccagtcctggactccga

SEQ ID NO: 6869575 - DNA, 69 bp, Homo sapiens
ctttttaatctgtttaattcattttcacagatcagtgcatttgcaaaagtggagagcagagacatgagg

SEQ ID NO: 6869576 - DNA, 62 bp, Homo sapiens
agggctttttccttcactgatgtggggcccacttggctccatctgggtggggagaaggatct

SEQ ID NO: 6869577 - DNA, 72 bp, Homo sapiens
tattcctatactttattgctgtatcccctgtggccataactgcaccaggtacagagtaggtactgaggaata

SEQ ID NO: 6869578 - DNA, 64 bp, Homo sapiens
ccatgttgtcaaacttagagtagatgacctctcagtccctttctatttagttttacaaatgtgg

SEQ ID NO: 6869579 - DNA, 130 bp, Homo sapiens
gcggggcggggcctaggtcgcgggccatctgggctctggaaggaacccttagaggagcgggaggacgccacaggtcctcggcggggctccgctcccgtgagccgcatgtggctggtgagctctgaaacgt

SEQ ID NO: 6869580 - DNA, 109 bp, Homo sapiens
cgcacatcagcatttcactttctttcttcgtggaaattcccaggctagttggactcatttaatttggagagagaaacctttgtcagtgataatgttttgatcaggtgcg

SEQ ID NO: 6869581 - DNA, 69 bp, Homo sapiens
gtcaagggtacagcacgcttcttgatgcaaagccaatgctcagcagatgaagactgttgccacttgtac

SEQ ID NO: 6869582 - DNA, 109 bp, Homo sapiens
acaagggaatgagccttggaatcagaaagatttgggtctactctctgctatggcattaacattttgggaaagaccctgagtcttattgagacttagtatattcatctgt

SEQ ID NO: 6869583 - DNA, 79 bp, Homo sapiens
gctagaaccctctgctagattctagggaaataaagacaaataagctatggtcactggacttaaggcagagtttttgagc

SEQ ID NO: 6869584 - DNA, 73 bp, Homo sapiens
ggactgctgtcagtcaaggcgagcagtccttctatctggaggctccatatgatgctttttctaatagcagtcc

SEQ ID NO: 6869585 - DNA, 76 bp, Homo sapiens
gaaagctaaaaagttacataaatgtcctctagcaagcaggttccttgttctgagggctaatgtactgtagcaattc

SEQ ID NO: 6869586 - DNA, 57 bp, Homo sapiens
ttcctcctaccctgcagatacactcactcacatgtttgctgtttcaagtaggaggag

SEQ ID NO: 6869587 - DNA, 66 bp, Homo sapiens
ccctgccccttcgggcagcctcctcttgtatgtatggtcctggaaggaaggcctggagtggcaggg

SEQ ID NO: 6869588 - DNA, 105 bp, Homo sapiens
gaaaactcatagcgcaatgagagagcggtgcgatcctcccaggtttccgccaaaaaacccttcagatcacagcatcctttcctttccattgtgctctgagttttc

SEQ ID NO: 6869589 - DNA, 64 bp, Homo sapiens
cctacctctttgtaataagaattgaggcaaatttgtcatcaaatgctctttgcagagaggtagg

SEQ ID NO: 6869590 - DNA, 61 bp, Homo sapiens
tttctggtaactccctcagcttgtttctagtctttagatcccagctgggtgttagtggaga

SEQ ID NO: 6869591 - DNA, 113 bp, Homo sapiens
gtgtcaatcttgatgaaatcagtaatcttgccagtctctaaatcaatctgaatggtatcattcaccttgataaggggatcagggtagcagatggcgtgagtatcaagagtcac

SEQ ID NO: 6869592 - DNA, 63 bp, Homo sapiens
gagaccaccccaccaaggcaggactgaaaccagcactcactccttgccaggccaggtgtcctc

SEQ ID NO: 6869593 - DNA, 91 bp, Homo sapiens
ttcaacaaagattagcaaatatttacaaagttttagaactaggaagcaggcaaatacttttcttatagagcttaaagttaatctagttgaa

SEQ ID NO: 6869594 - DNA, 71 bp, Homo sapiens
ggtggtcaggacattctggcggtcaggacaccttggtgacgccgttccctgctgagagtgctctccccacc

SEQ ID NO: 6869595 - DNA, 81 bp, Homo sapiens
gatgggcagcccagggtggcgagggggagaaatgtgccccagagcagcagcttgtcccggtgctcacatagggtgtccttc

SEQ ID NO: 6869596 - DNA, 96 bp, Homo sapiens
tgtgaggacacacaatgaagactggaaggaacagagtttgaaacaatctcacatgctttccactctgttctctttgaatctttcgctgtttttaca

SEQ ID NO: 6869597 - DNA, 126 bp, Homo sapiens
ggaaggttctcctgagccagccaaggggcttcccgggtgacgtgctcctgttcctgggcgggcgcccctcccacaggctgctgcaggtcccgggctgagcccatggctgcatgctcttggccttcc

SEQ ID NO: 6869598 - DNA, 84 bp, Homo sapiens
tttttcagtactgtgttctgagcaggcagcgtgaattggttattttcaatggtcaaaagaaagctcagaacacatatagaaaaa

SEQ ID NO: 6869599 - DNA, 63 bp, Homo sapiens
gtctaatgtatcatggctctcagctctcattgatgagaaagcaggggaaggggtacttagtac

SEQ ID NO: 6869600 - DNA, 92 bp, Homo sapiens
ttcagagctggatccagggagcagcgctggggcctccagacacacacccttcccttgaggccacaatgactgccccttggctcggccctgga

SEQ ID NO: 6869601 - DNA, 81 bp, Homo sapiens
acatcttaagaaaggctgaaatgcaagtcaattgtgttatttatctctaggtggcttgcaaaattatttttctttacatgt

SEQ ID NO: 6869602 - DNA, 72 bp, Homo sapiens
aggttctcctaaaacatctgggttttccttgtgggagaaaatcctgcagtgaatttagatgttggtggacct

SEQ ID NO: 6869603 - DNA, 86 bp, Homo sapiens
tgtcatgggctctttcgggggagttccggacagcaccactgtgcaaaagattgtcctggcctccagaaagtcggctccaaatgaca

SEQ ID NO: 6869604 - DNA, 56 bp, Homo sapiens
ggctgggacggctcagtaagaagggtctgggctctctccctgccctgtcccatgcc

SEQ ID NO: 6869605 - DNA, 93 bp, Homo sapiens
ttatttctcagcttctctgaaatctgaagcatttattaagaaacaataaaataaatataaaggctttaaagaaccagaactagtgagttatga

SEQ ID NO: 6869606 - DNA, 56 bp, Homo sapiens
caacagtctctatagctccttgtcctgtttctgacaatggtgttataggatggttg

SEQ ID NO: 6869607 - DNA, 56 bp, Homo sapiens
gaggcagaggtaacatttctaggataccttctacaatgcaaaatactgtctgcctt

SEQ ID NO: 6869608 - DNA, 93 bp, Homo sapiens
gagtcagcagggcataggggaactggcacagggcaggggccacgggagagataacccagcccagagccagttcccgcttgctcgtcctgactc

SEQ ID NO: 6869609 - DNA, 64 bp, Homo sapiens
gtcctttataatacatcctttgctcatgaacaatcacttggcagaatgggctattataatgggc

SEQ ID NO: 6869610 - DNA, 55 bp, Homo sapiens
gctcctaccatgacactgccaggcatgggatgagcaggcagtcacggtcaggagc

SEQ ID NO: 6869611 - DNA, 92 bp, Homo sapiens
ctcttttcatagaagaatatcactgtcaggctgacttttagggtcatgttcctaaaggccaataaagacaagctgtgttctcatgacaacag

SEQ ID NO: 6869612 - DNA, 95 bp, Homo sapiens
gggacacactggtccagttgctgttgtccatctgttgccataagaacaaaaagaattagttctatagacttggacatatagtcactgttgtgccc

SEQ ID NO: 6869613 - DNA, 67 bp, Homo sapiens
gttaactttatgacatgtcttgcttattaagccacatggtgcaagtcagggatgtaatatggttaat

SEQ ID NO: 6869614 - DNA, 96 bp, Homo sapiens
gttcaattttgaaaaatcatttatttgactttggagtgatcatttaatatatacatgtcctatgttgaaggcaaagaatgatctttaattttgaac

SEQ ID NO: 6869615 - DNA, 58 bp, Homo sapiens
tctttttgggcctgaaattcccattttacttaaacctttaagttcaggctttcaagga

SEQ ID NO: 6869616 - DNA, 79 bp, Homo sapiens
gtttgaggggctttctgttgtattttttcccttccatatttgagagaaacacaggtactgcagaagtggttcagcagac

SEQ ID NO: 6869617 - DNA, 64 bp, Homo sapiens
cactacttacatgtggctactgggaaatggaaatgtgtgcccaaagtgatatgtgctgtaagtg

SEQ ID NO: 6869618 - DNA, 74 bp, Homo sapiens
ggcggctccccgccccatcagacgcagtcgcttagaccgctcggcgcgcccagtcgatggggaaagccttcgcc

SEQ ID NO: 6869619 - DNA, 70 bp, Homo sapiens
tttgtgtatgcttcacctagcccttttcacatcactctgtgggaagctaggctcagggaaccaacacaaa

SEQ ID NO: 6869620 - DNA, 64 bp, Homo sapiens
ggtttcaggccccagagccagggctttctgacagatgcatcacctggctgaggggccaaggacc

SEQ ID NO: 6869621 - DNA, 86 bp, Homo sapiens
ctgtcttctactctacaacgtttgtgcattttatccccaaagaccagagatgtctttggaatgcacagaggtgtagtgacacgcag

SEQ ID NO: 6869622 - DNA, 126 bp, Homo sapiens
ttccctaaacactcaggagtttaattgagtattattggatgattcacttggcagttaggatcttgctgtggaagagggtcaccagtatgaatattcactattgtgatgatgaaatgtataggtgag

SEQ ID NO: 6869623 - DNA, 56 bp, Homo sapiens
ctgcacagtaagcttcagagatgagaatccatttttctatttgcctgactgtgcgg

SEQ ID NO: 6869624 - DNA, 70 bp, Homo sapiens
aagacctgactttaaaagtttgtgcttgggagttaaatatttttaaacatatacattttgaagttctctt

SEQ ID NO: 6869625 - DNA, 81 bp, Homo sapiens
gcatctttgaataacactaaatgtatgtaacatatttctgcagcctgtgttgcgttttgaataggttagcaacatagatgt

SEQ ID NO: 6869626 - DNA, 112 bp, Homo sapiens
gagagatttatctcagaagggcattgtctctaagtgtgatcttcatttttatgagctgagcttgaagtccctgacatttagaaatgatagtgtgttgatgtgaggttctttc

SEQ ID NO: 6869627 - DNA, 68 bp, Homo sapiens
ctaggacctgtgactgtcaccctagggacccatcctgaaccctcatgctgccagcacatgtcttctag

SEQ ID NO: 6869628 - DNA, 60 bp, Homo sapiens
ctcatcagaaatacctgacaaatggatcattctcgcctactgttatggtgttctgatggg

SEQ ID NO: 6869629 - DNA, 67 bp, Homo sapiens
gtttcttttgtgatcaccaacctgccaattcctggagggttaatagaagtggtgaaattagaggagc

SEQ ID NO: 6869630 - DNA, 80 bp, Homo sapiens
tagcactgagacttcaacctggttttataagtgttctgaatcttagtttcctcatttgtaaaatgggttgatatctgctg

SEQ ID NO: 6869631 - DNA, 82 bp, Homo sapiens
tggcacaataaaaacttttggaatcatagatatattcactatcttgattgagtgatgatttcatgagtgcacgcgtgtgtca

SEQ ID NO: 6869632 - DNA, 128 bp, Homo sapiens
ccatttctattttgtttgctcaagagaagttatattgattggatggtgttggttttatttggtgaaatggcgatatattcaggcaaattgcttctctcttttgagaaagaataaactatgagagatgg

SEQ ID NO: 6869633 - DNA, 59 bp, Homo sapiens
cttctgcagagccctgaacctgccaatgtcgattggaaaggtcagcccagctctggaag

SEQ ID NO: 6869634 - DNA, 86 bp, Homo sapiens
gattatgtatatgtatatatttaaagtgcgttgtagaaggctatgatcttctaaagcaggagtgtatttgcatgtaaaatgtggtc

SEQ ID NO: 6869635 - DNA, 92 bp, Homo sapiens
gatcccggaagtggcagccaccggataggcacgttgccgccacagccagcatcggcgtctgttcaggtttcaggaaggtcacttcttggctc

SEQ ID NO: 6869636 - DNA, 71 bp, Homo sapiens
ctccctaacaagagcacctgggaatggttctaatacgctgcttggatggttactaaaagttctgtaggggg

SEQ ID NO: 6869637 - DNA, 110 bp, Homo sapiens
aaacaaaagtggtgtctatgttatcagtgaattacttgataggacattttaactattttacagttctgcttagcacaagaataaactggttccaaggtactacagtgttt

SEQ ID NO: 6869638 - DNA, 85 bp, Homo sapiens
tgtttagctctgagaccattaacatgattttggggaatcattttgattttcaggaaacatttaatggcattaaaaagactgaata

SEQ ID NO: 6869639 - DNA, 55 bp, Homo sapiens
gtgcctccaggctcgactagtccctagcactcgacaactgggtctctgaggtcac

SEQ ID NO: 6869640 - DNA, 63 bp, Homo sapiens
taaatctagatcttgtccaggtcagttcttttagaagacctctggagggcaatgtctcattta

SEQ ID NO: 6869641 - DNA, 111 bp, Homo sapiens
gaatggagaaaatgctatataacagaaacctccctgaatattttcctccagtctaagcagggaaaatctcattatcaggaagggactctctgtgtatatgctctctgcctc

SEQ ID NO: 6869642 - DNA, 67 bp, Homo sapiens
aggcaaagaaaagctgttgtatggcccttggcatatctgttagccaaggccacaaacagcctggcct

SEQ ID NO: 6869643 - DNA, 61 bp, Homo sapiens
gcttcccaggcacgtacccctttaagaggatctttctcaaaagccacgtggcctggggagc

SEQ ID NO: 6869644 - DNA, 85 bp, Homo sapiens
ctgagtgtagcgttcccagagggctgccctgagttcgtgacagccaggaggtcaggcagctcctcatcaacggaccaaacctcag

SEQ ID NO: 6869645 - DNA, 57 bp, Homo sapiens
ggggaggccagaatctgtgttggactggccagagtctagcctgtcatcagcctctcc

SEQ ID NO: 6869646 - DNA, 78 bp, Homo sapiens
gggggtgacagtccatggttctgactcatctagcagtagctgctagagttttctctaccactgggatgctgagctctt

SEQ ID NO: 6869647 - DNA, 55 bp, Homo sapiens
ggtgaaggcacaagagggcaagtggacatgtacaaggccttttaaagcctacact

SEQ ID NO: 6869648 - DNA, 75 bp, Homo sapiens
ttcacttctgttgccttgtgcaatgctgatctccactttattgtgattgccaaatgcaaggtaaaagagcatgaa

SEQ ID NO: 6869649 - DNA, 72 bp, Homo sapiens
tgaagtggtgggggaggcccgtgcaggcctacagctttgtcatctgcaacattcctctccccactttcttta

SEQ ID NO: 6869650 - DNA, 62 bp, Homo sapiens
ttgagtgtatatcctatatgtctttagaaagcatgtggcacaaagaaggaaatagcactcaa

SEQ ID NO: 6869651 - DNA, 67 bp, Homo sapiens
tgactggatcctgtgccccagaaccagccctttccttgaagcatgtctgggcagagggtcttagtca

SEQ ID NO: 6869652 - DNA, 123 bp, Homo sapiens
ctgaaattgtattactgtgaaatcgtaccagaagctttgctcataaccatctatgcatttcgcttacatgaatgttgcaaagactttttgatataatcagataaacacagaaaatatttaaag

SEQ ID NO: 6869653 - DNA, 56 bp, Homo sapiens
tgtttaaccatctgcttttatgtgtttgctcctagcattgaagttgtggttaaata

SEQ ID NO: 6869654 - DNA, 57 bp, Homo sapiens
gtctgcttttctgaattgcctgttcatagataggtataggcataaggttaggtagat

SEQ ID NO: 6869655 - DNA, 77 bp, Homo sapiens
gagacgacagctatattgttttctactgtattcctagcacatggcatacagaaaacataagtatatgttgttgactt

SEQ ID NO: 6869656 - DNA, 61 bp, Homo sapiens
aagtttctcaatggcaactgggttcgcttttttccaaacccaggtgtttaatgggaaactt

SEQ ID NO: 6869657 - DNA, 104 bp, Homo sapiens
cagaagaaatggatgtgactgctttacattaatttctactgatcccatccaaacagataatatcagaagaaatggatgtgactgctttacattaatttctactg

SEQ ID NO: 6869658 - DNA, 79 bp, Homo sapiens
gacaaaattggaagcatgaaggtcacttgcaaaccaaatgtttgcaagaatgacccatctacccaatgaggattctgtc

SEQ ID NO: 6869659 - DNA, 55 bp, Homo sapiens
ctgaaacatggttagattcaagccaaagagtggtttggatgtatttatgttttag

SEQ ID NO: 6869660 - DNA, 75 bp, Homo sapiens
gcctctcttgcctgcctgcatcccacagtggggactgaggccctgaggccccaaggggaagtggcgggcggatgc

SEQ ID NO: 6869661 - DNA, 77 bp, Homo sapiens
aaattaagtatgtttagtaggagtttaatacttgttgaagctccagttagtgatatttcttctacgcatcttgattt

SEQ ID NO: 6869662 - DNA, 81 bp, Homo sapiens
agtgactccagatggtgttcttatgtggcctactggtgccctctgcatgtggccaataggagcagctatcaatattccact

SEQ ID NO: 6869663 - DNA, 77 bp, Homo sapiens
gtgaatgcattggacaaaaatcagccatctctatacttaaccatttggatttgtgcatttttgtgcatgtaatttat

SEQ ID NO: 6869664 - DNA, 78 bp, Homo sapiens
gctaaagataatccatgaagtgaacaatctggatgaaagtaatccatcatgttactcttccatgggtgggtatatggc

SEQ ID NO: 6869665 - DNA, 65 bp, Homo sapiens
gtaaacaaaggactggatattaaagagtgaaataagtcacaaatttagtaactagtacctggtac

SEQ ID NO: 6869666 - DNA, 95 bp, Homo sapiens
ggtgggaggacggcttgagcccgggaggtgggggttgcagtgagccaagattgtgccactgtactccagccttggggacagagccagatcctgtc

SEQ ID NO: 6869667 - DNA, 98 bp, Homo sapiens
gcttactatggtgagactactgtagaagctagggtgccccagccaaccctggaggtctacagtgcaggcagttccaccaatgaagaatggtggtgagt

SEQ ID NO: 6869668 - DNA, 59 bp, Homo sapiens
gagttctggccggttcttggaccagacaaggcatggcccaagaaggtagatcagaattt

SEQ ID NO: 6869669 - DNA, 77 bp, Homo sapiens
cccgctagtgggcctaatttgcagtgaccccctttaccttaagtcatagtatctgcaacaaggcctcatttcttggg

SEQ ID NO: 6869670 - DNA, 71 bp, Homo sapiens
ggggcggctccccctccagccactcccaggctggaaaaccagaccgcgttgggggagccggaaatagcccc

SEQ ID NO: 6869671 - DNA, 59 bp, Homo sapiens
tggcttaccacaggccaaatttgaggttaattaaccatcagtcattgtcagtggggcca

SEQ ID NO: 6869672 - DNA, 56 bp, Homo sapiens
ccacttctccttgctgctattggtcatgtggaccaggaaatgcttggaggggctgg

SEQ ID NO: 6869673 - DNA, 86 bp, Homo sapiens
gttcaggagccaggtggcttggtagtggcaggaagcacagatgcatcttgcagaagaagctgccaagccctgactctcctgccagc

SEQ ID NO: 6869674 - DNA, 65 bp, Homo sapiens
gatgccacttggaagggaaccgagtttgctgatttagtacgtattcttttcccttttttagcatc

SEQ ID NO: 6869675 - DNA, 85 bp, Homo sapiens
gtagtttatttttaagaattccatatttcagccaatgctgtttatagtagtgcagttaggatggggaatttatgagagaacttac

SEQ ID NO: 6869676 - DNA, 94 bp, Homo sapiens
gtttgctcctctgtaaagtgaggataagaacagtacctaccacatagggctgttgtgaattccccaccttaaacatgaggaatctaatgcaaat

SEQ ID NO: 6869677 - DNA, 71 bp, Homo sapiens
tgtaaagatagaaagagtggttctttttacctagataaaatattgtataagtcattctttctattaagaca

SEQ ID NO: 6869678 - DNA, 81 bp, Homo sapiens
tttaaaactacagatgtcaggaccctactgcattgactaagtaagttttgaggttagaacctggaaatgtgtgtttttaaa

SEQ ID NO: 6869679 - DNA, 76 bp, Homo sapiens
acatggattttggggaaagtgtctaataatttgtgctcactttaaaacagaataaagatgttcccaaagttcacgt

SEQ ID NO: 6869680 - DNA, 70 bp, Homo sapiens
tcagcaggcagtgggtcacaattaactgaatcatctcaccactggttgattgtgatgaggtgccaattga

SEQ ID NO: 6869681 - DNA, 91 bp, Homo sapiens
gagaccgggttttataattgtaagatctcacttttgtgaattgctgattagaattcacaaaagttagatccatggtgcagtgcctcttctc

SEQ ID NO: 6869682 - DNA, 89 bp, Homo sapiens
gtaacttttttttctccctaacatgaatgtattgctcctttaattgtcacaataataatgaaacagaagatgttcatgtgggaagttat

SEQ ID NO: 6869683 - DNA, 85 bp, Homo sapiens
cctggcttgaaagtggctcatgtggcttctgccctgtggtttcactggcctggactcaggcacgtggccacatttcactgccagg

SEQ ID NO: 6869684 - DNA, 72 bp, Homo sapiens
tgtagaagaatggaagagtttgcatgtcttaacagttttcttagttcaagagcttcctctttcattgctata

SEQ ID NO: 6869685 - DNA, 76 bp, Homo sapiens
ttcctagcttcgcagaagtgtggacgttgattccagcttttcccaaacatttttggccttgaaatgaagctgggaa

SEQ ID NO: 6869686 - DNA, 85 bp, Homo sapiens
tcctctcaaagcagttccttttagtactcatagcttcaaactgctgtcttggtaattgtgtttattaaatgaattagtgagtgga

SEQ ID NO: 6869687 - DNA, 114 bp, Homo sapiens
ttcagtgagcctctgggatggccagtggctctgtgcttgggaaggtgttttcctaggagaagttagcaggtccagcatagaggcactggggacccctgagtgttctagcaggaa

SEQ ID NO: 6869688 - DNA, 65 bp, Homo sapiens
tccagtctattgcctaacagagaggtgacttcatcagagtttacctgtcttagggaaagactgga

SEQ ID NO: 6869689 - DNA, 65 bp, Homo sapiens
gaatggggaggggaggtggaggcttccacttaaaaattttcccctttgttttctcctgcccattc

SEQ ID NO: 6869690 - DNA, 103 bp, Homo sapiens
gcagtgttcgagagagtgagcagggggccacagtcacagccacagccacagctgctgttagtgagtccctgtgcccaacaccacctctgctcctatgcactgt

SEQ ID NO: 6869691 - DNA, 59 bp, Homo sapiens
gctgagccctagtctagtattatagccagggaaggtgtagggaggaaagggctcttggc

SEQ ID NO: 6869692 - DNA, 87 bp, Homo sapiens
ggagtcttgctctgtcaccaggctagagtgcagtggcgctatctcagctcactgcaacctccgcctcccaggttcaagcgattctcc

SEQ ID NO: 6869693 - DNA, 55 bp, Homo sapiens
ttgccagtgccagcccaggcagagtttagagcttgttctgaggtggaactggggg

SEQ ID NO: 6869694 - DNA, 110 bp, Homo sapiens
ttgtattcgtagagtcagtcctggaattgaggagaccagcgtgtcctttgaacgtgctagaaaatatgactgtgctccttaaaggataaaatacgactctgcgcctccaa

SEQ ID NO: 6869695 - DNA, 72 bp, Homo sapiens
tggcaatatagagagaaaattatgtaatacgcattcatctaattacataagcatatgtctctgtatctgtca

SEQ ID NO: 6869696 - DNA, 86 bp, Homo sapiens
gtaggatgtgctgctggatgcaactgcttctctcagctgatgctggctgagctctgggcaattgcaccctggtattttacttctat

SEQ ID NO: 6869697 - DNA, 80 bp, Homo sapiens
ctcactgacaatgtgtcagacacagccagagactgaaatacgagtagatgccagttctggacttgtctgccttaagtgag

SEQ ID NO: 6869698 - DNA, 93 bp, Homo sapiens
tttaatgaaattttggaacttgaccagtgtattatttgagaaattggcaatatagtcaagagtaatggactttaaggtataatttttaatgga

SEQ ID NO: 6869699 - DNA, 71 bp, Homo sapiens
tgtctcttctctcaggaaggacagggcttccacaatctggagggtcaccccttgctgaggcagaaggaata

SEQ ID NO: 6869700 - DNA, 92 bp, Homo sapiens
gacattttattggcttatggttctgcaggctgtacaggaagcataagtagcttctgcttctgggtaggcctcaggaaactttcaatcatgtc

SEQ ID NO: 6869701 - DNA, 65 bp, Homo sapiens
taccatggggaagagccagtgagctgaggtgtcaaatctcaactgatctatttcctaactgtgtg

SEQ ID NO: 6869702 - DNA, 62 bp, Homo sapiens
gtaaaaggtcaaggccaagtctggggtctgaatattttcctttcacgtgctgtgccttttgc

SEQ ID NO: 6869703 - DNA, 64 bp, Homo sapiens
ttgagatccccaggaaggacaacctgcctcatataacatgctgctgtttcagcctgggtctcaa

SEQ ID NO: 6869704 - DNA, 66 bp, Homo sapiens
ctccggcttctgccctatctgattcaagccaatgccatgttaattagtagagggagaagcttgggg

SEQ ID NO: 6869705 - DNA, 62 bp, Homo sapiens
gcaattagaggggctgctgaatgggaatagttcaattctctcaattctcctgtcccattagc

SEQ ID NO: 6869706 - DNA, 67 bp, Homo sapiens
ctgctctagaaggtctccctgccagtgtctctggatctggcctggtgggtgctgcctctgtgagcag

SEQ ID NO: 6869707 - DNA, 78 bp, Homo sapiens
caacaagatgttttgatatatgtgtatattaggggatgattaaatcaagctaattaacatattcatcacctcatgttg

SEQ ID NO: 6869708 - DNA, 123 bp, Homo sapiens
tgcctcagcctcccgagaagctgggactacaggtgctccaaggtgcttgagtttggaaacatgagacaaaaccagaaacagagaccctgggagagtctgtggtctccatttttccgctgagca

SEQ ID NO: 6869709 - DNA, 56 bp, Homo sapiens
acagcgagaaactaaacaggggaggcagaatcctggaaccactactttgttgctgt

SEQ ID NO: 6869710 - DNA, 62 bp, Homo sapiens
ggtaaggcctgaggatcagtaggtagtttgtgtccagctgcccagaagcttagagcttagcc

SEQ ID NO: 6869711 - DNA, 68 bp, Homo sapiens
tcaccacggaagcagcagagtagacagagccctgggtgagtccaggctgtccctgctgcactaggtga

SEQ ID NO: 6869712 - DNA, 87 bp, Homo sapiens
tttctcggcattttggtcgggaacacgggcacttgctggggtatttccgctagtacatgtggtcctggccagagatggtgacaggaa

SEQ ID NO: 6869713 - DNA, 79 bp, Homo sapiens
tatttatttaatgactctaagaattctagatgtcctcagtggagctgcgtttggcattagagttatttgttaataagtg

SEQ ID NO: 6869714 - DNA, 92 bp, Homo sapiens
gcattatctggaaaaggggaatgggtagactgttgaattcaggcacctgacctcatgttcacttcgtaaacccctcccatttccaatgttgc

SEQ ID NO: 6869715 - DNA, 84 bp, Homo sapiens
cagcagtcccattcctctggccagggattaactttccgcacagcaacgtgatgaagtttggccaaggagacatggagaaggctg

SEQ ID NO: 6869716 - DNA, 68 bp, Homo sapiens
tcctcgaagtgtttgtgggccacatttaggaagccacactgagtttggctccatgaaaattacgagga

SEQ ID NO: 6869717 - DNA, 112 bp, Homo sapiens
ggtgagccacggagcacgctcactaggcttgtcctgaggaattctgggagctgtagtcctggctggttctgtggggctgtgtgggcctgggagcgtgctctgtgggttcccc

SEQ ID NO: 6869718 - DNA, 58 bp, Homo sapiens
aaagatgtgtcaccccatgactgctttgcataactaaggtgtcagtgatacatgcttt

SEQ ID NO: 6869719 - DNA, 65 bp, Homo sapiens
gccagacagggtgatatgctggctctcgctgaagctgagagctgtgttcattctaccatcctggc

SEQ ID NO: 6869720 - DNA, 69 bp, Homo sapiens
gaagggactggggactggggagggaagcatggggttttagagttgcccaccttagtcttcagacacttt

SEQ ID NO: 6869721 - DNA, 85 bp, Homo sapiens
atagtacctattattgctatgagaattaaatgagctaacatatgtgaagtgcttaaaacactctctggcacataataaggtctat

SEQ ID NO: 6869722 - DNA, 70 bp, Homo sapiens
ggaatctctacactgtttttcatagtgattgtactagtttacattcccagcagcagtgtagaagtgttcc

SEQ ID NO: 6869723 - DNA, 77 bp, Homo sapiens
attccacagtgctgtcagttttatagatacacatgtgcctgaaaaggaggaatgtcatagtgtggtagcagtggagt

SEQ ID NO: 6869724 - DNA, 86 bp, Homo sapiens
agtgaaagctgaagttcatacaatggccattaaggctctacttgatttggtcccttgttgtgtccctgatatcacttccttccact

SEQ ID NO: 6869725 - DNA, 89 bp, Homo sapiens
gaggagcttcttggtaagtgtgatagtgtgtgtgagtgtgtgtgggaaatccatgcacatgcagactcattatctaagctgaagtcctc

SEQ ID NO: 6869726 - DNA, 130 bp, Homo sapiens
tgaagacttttctaggccaaaaccgagctaggctatgggaaccgaagtccagtcagaactcagcaccacagaggcctccttcttccctggtttgcatccccagctcattctgcgcctccggaacgtttca

SEQ ID NO: 6869727 - DNA, 65 bp, Homo sapiens
cagggaaataagtccagcccctgactcccaggccatgggccaggctgcaggagctggatgccttg

SEQ ID NO: 6869728 - DNA, 61 bp, Homo sapiens
gttcaaactgcttgaggccatttagagccaaagctgctagtggctgcagggctgtttgaat

SEQ ID NO: 6869729 - DNA, 60 bp, Homo sapiens
cgatggcagcagcagccagggatgcaacaagagtcacattcgctttgaaggctgcccttg

SEQ ID NO: 6869730 - DNA, 123 bp, Homo sapiens
ttttcacaatgaagccatgaaacatcaaatcctggactactgatactgccagtgaagcatatttcagatggtatatacagtagccacctccagttttttgtctcagtcttcatacccggaaaa

SEQ ID NO: 6869731 - DNA, 59 bp, Homo sapiens
tcatgaaaactgaaattcagagtggcagctgctgctggctgactctggtcccagtatga

SEQ ID NO: 6869732 - DNA, 100 bp, Homo sapiens
gtagtgttgttcacgaagaattttgttttattttcttctgtaattccttttttccccccggagtataatgacagccagattcttctctatcatctactgc

SEQ ID NO: 6869733 - DNA, 71 bp, Homo sapiens
ttttgctgaaattagggaaaacatttgcttttcacaagagaggtatgttatttcttgaaacctttgcagaa

SEQ ID NO: 6869734 - DNA, 65 bp, Homo sapiens
aggagtctcaaagtcgaatgaaactgtgttattcagctctgtattattcactctgaagccatcct

SEQ ID NO: 6869735 - DNA, 58 bp, Homo sapiens
ggcaccttggctagtgatcaaccgggatgatgttcccagatacacagcacagagggcc

SEQ ID NO: 6869736 - DNA, 57 bp, Homo sapiens
gtggtgggcgtggtgtatgccttcaccttctgaggacggcacaccctgcaccaccat

SEQ ID NO: 6869737 - DNA, 59 bp, Homo sapiens
ggcaagggttgaagataaggtagcaatgtctactttgtatttttggccttaactatgcc

SEQ ID NO: 6869738 - DNA, 69 bp, Homo sapiens
ggataccatgtcaagactgaagatccagacttgaggacttcctcctggattaaacagtttgatacttcc

SEQ ID NO: 6869739 - DNA, 84 bp, Homo sapiens
cattggttggtaatgcttacatcctctgtaaagaaagttatcaataccatttgtgcaagacatgctaagagatgaccaccaatg

SEQ ID NO: 6869740 - DNA, 70 bp, Homo sapiens
ggatgtagtgcaaggagtgaatttcatcagttctatataaaaagagatttcaccttgatcactgctgtct

SEQ ID NO: 6869741 - DNA, 76 bp, Homo sapiens
tgtgaatgtgggagagctggcaatgcagccaagtgatggcatgcctagaagttgaagctttcttatgtaaattaca

SEQ ID NO: 6869742 - DNA, 60 bp, Homo sapiens
tcttatgggcttaggtacctccctggtacaattaccaggtaatccttgagctacgtatga

SEQ ID NO: 6869743 - DNA, 69 bp, Homo sapiens
gacgtgatcccctattcttttcctcagggagtcttgctgggggaacagacagggggcagagatcaggtc

SEQ ID NO: 6869744 - DNA, 79 bp, Homo sapiens
actgtgtgccctgacgccagggactgtgcactttccccctacaccccccacaccatctggcagagtcagtgcacacagt

SEQ ID NO: 6869745 - DNA, 65 bp, Homo sapiens
ttttttttaagttctctgaaatgaaaaagtcttatagacttgtttttaggagaagttataggaga

SEQ ID NO: 6869746 - DNA, 93 bp, Homo sapiens
ctgaagtttctgctaatcagggccaggactaggatgaggtgagagaggtgactcagtgtcttcacctgagtcctggccctgctgctacatcag

SEQ ID NO: 6869747 - DNA, 67 bp, Homo sapiens
caagactgtgttttaaggggttagcctcaacatgattatatggacaatactttgaattacagccttg

SEQ ID NO: 6869748 - DNA, 75 bp, Homo sapiens
catgtcacaagctttccattacacacattccttctcctgaaaacctggtgagtgtggggagggctggtgaatttg

SEQ ID NO: 6869749 - DNA, 121 bp, Homo sapiens
tcgctgccgaaacgatcacccagtcgcagtcactttgctctgatacacattttaaaaatgttattggtgtcagtggtaaggttgggagtgtgtgtatatcgtgtgtttaggagggtagaga

SEQ ID NO: 6869750 - DNA, 64 bp, Homo sapiens
gctggaggaataatggcatcttgtacactttgcacctgtattaagtagccctatattgctctgc

SEQ ID NO: 6869751 - DNA, 92 bp, Homo sapiens
gtggctgtctcaggccgactgcccacagatatgtgcagtctgctctcaggatcaggcacacgactttgggggtcaggtacaagagtagccac

SEQ ID NO: 6869752 - DNA, 121 bp, Homo sapiens
gtgtgtggagaaaagcatgaaccaagagccatgtaatcctggggagatgaaggtggacagtcgagccacgttttatccctctggtttccatgaggtctgactatgcttccctaccacgtac

SEQ ID NO: 6869753 - DNA, 59 bp, Homo sapiens
gggcttttcccactatgccaggctgcctttactgatgttgggcatggtcggaagagctc

SEQ ID NO: 6869754 - DNA, 86 bp, Homo sapiens
ctgttttgttttgatgattacacttttaaaacagctttcagtatgctttagctgtttgaacagtgagacatctttttcatagatag

SEQ ID NO: 6869755 - DNA, 56 bp, Homo sapiens
gatttgaattctgtttgggccgcttagcaactgtgtgagtgagcctcagagttttc

SEQ ID NO: 6869756 - DNA, 57 bp, Homo sapiens
cagtggcatacttggctgatatatctggtcacagtagaatgggctgttatgtcattg

SEQ ID NO: 6869757 - DNA, 63 bp, Homo sapiens
gttggtttccagcagcctcataactaggcacatgtctgctgttgccacctgcatggatccagc

SEQ ID NO: 6869758 - DNA, 69 bp, Homo sapiens
cagctcttagagggagacagacctagactcttcttgaactggaaattagtgtgtctgtcagagaagctg

SEQ ID NO: 6869759 - DNA, 94 bp, Homo sapiens
atgttccacagtggggattcctgcaagatctttaaggaggcagctcttcctgcttcccagaattgttgggaactgcatgagtgagtgagagcat

SEQ ID NO: 6869760 - DNA, 80 bp, Homo sapiens
tcagtgtattctagttcttgctattattagctcacttgctaagtgagctcttgtagtatgcggtaatgaataatctttga

SEQ ID NO: 6869761 - DNA, 65 bp, Homo sapiens
ggctctttcattattgagtctccctttggctcttgtgccgcagggcagactaggatggaagtgcc

SEQ ID NO: 6869762 - DNA, 109 bp, Homo sapiens
ggcgggcgggaggtcactgtcctgcataccaggctaattggggtctggcagagtgcactctcagacagcaggcctggatgtgtagccctgcatgctgacctcccccgcc

SEQ ID NO: 6869763 - DNA, 93 bp, Homo sapiens
ggaactgcaaaagctatttattacagagaatgcatataagctctttttcacatgccaactgtattctattggtaagtgcttgctgcagcatcc

SEQ ID NO: 6869764 - DNA, 55 bp, Homo sapiens
gataccctggtttgaataatctgtgagaatctcagacctatagatcaagggtttc

SEQ ID NO: 6869765 - DNA, 72 bp, Homo sapiens
cccatgcctaatctggtgtgctctggacttgcaggatccctggagttgcagctaccagacatggtgcgtggg

SEQ ID NO: 6869766 - DNA, 114 bp, Homo sapiens
gcggcggcggcggcggcggcggcggcggctgggctgtttgttctggtctcccgcagccgaggagccgaagcagtggcggcggcagcggctgcggcggctgccggcggtgcccgc

SEQ ID NO: 6869767 - DNA, 57 bp, Homo sapiens
gggcagtcacagtgctggagcaagaaaaggtcgtgctcacagccttcctggctgccc

SEQ ID NO: 6869768 - DNA, 56 bp, Homo sapiens
aagtcaggagaaaatatcaggaagtgggggctctgcatttcctctttctcttactt

SEQ ID NO: 6869769 - DNA, 86 bp, Homo sapiens
ggcaccaccaagcactatcctaaaattgttcaatttctttccaaggaaagactgaattttgttgggttgggtttgttttgtttgcc

SEQ ID NO: 6869770 - DNA, 81 bp, Homo sapiens
ctctagcaaggcctctgccgttactaggtacatcagttaggatggctttgactgtaagtggtaggaggcttgaacaatgag

SEQ ID NO: 6869771 - DNA, 69 bp, Homo sapiens
tactaggccaactgatgtggctggatgattctctgaagagttcaccccctgtattagtagctaccagtg

SEQ ID NO: 6869772 - DNA, 130 bp, Homo sapiens
ctgcttagtactcccccactcccaggcttgatttattacccactatattgttccaagcacagacctttttatcactgtcacatatgtgggcctggtgatgagatatgcttggtagtggctggaggggcag

SEQ ID NO: 6869773 - DNA, 79 bp, Homo sapiens
gtcagcaggattcattctggaggcttgagcaaagaatctatcttcttagcttttccagcttctagaggccacctgcaac

SEQ ID NO: 6869774 - DNA, 80 bp, Homo sapiens
gaaagcaggagccctggcatgttcttccagcttccatatagcatgccggcaaagaccagtctccagggctcacctctttc

SEQ ID NO: 6869775 - DNA, 79 bp, Homo sapiens
tgtgtgcaatgagaatatattaaccaggggtagaaaaaggaaaaagggtctctggtgggtatacactctattgaggtca

SEQ ID NO: 6869776 - DNA, 80 bp, Homo sapiens
ctcttgagtctgggctggcctgtgactttaatcagtgcaatgcagaagtggttcagtgccagttctaagactacaaagag

SEQ ID NO: 6869777 - DNA, 66 bp, Homo sapiens
tggctcggccacctgccagccatggctctccacactcctcaaacatggctgacagtgccacagcca

SEQ ID NO: 6869778 - DNA, 130 bp, Homo sapiens
taaatacaaggaagcgacctgagatgaatgggatcatatctgtagcacactggagccaacttgaagggactcccattgccatagataggacaattagatcattaaaaggaataatgcctgcaatggttga

SEQ ID NO: 6869779 - DNA, 60 bp, Homo sapiens
tctcagtgcaaccaaagtgatctgtaaaaaatacagatcagatctccttttgcattagga

SEQ ID NO: 6869780 - DNA, 77 bp, Homo sapiens
agagggacagaatgagaagataatgtgggtaacactaaacagtgctacttttgaaatcttccttcctctgaacctct

SEQ ID NO: 6869781 - DNA, 98 bp, Homo sapiens
gtcagacacgatccctgctctcgaggagcttctggccacatgggggaggtggcagggacccagctctctgtggtgggaggctgagtagataggtcagc

SEQ ID NO: 6869782 - DNA, 77 bp, Homo sapiens
cgcggctgcggcggcttcgcgcccgccccgggcagaacaggttccttccagtttgggtgtgagctgcgcgcgcggcg

SEQ ID NO: 6869783 - DNA, 59 bp, Homo sapiens
ctggaccttctgcctcctcatgctgtaatatgcataagaggtgtcctagaagtattcag

SEQ ID NO: 6869784 - DNA, 80 bp, Homo sapiens
tttatgcagggtcaagaggcagagttcttggcaaggccagagctaggaactatggcctgtgcttttgatcctagcctaag

SEQ ID NO: 6869785 - DNA, 57 bp, Homo sapiens
agctacttctaggttaaattagattgtcgtggaccagtctagcttaggagcctagct

SEQ ID NO: 6869786 - DNA, 57 bp, Homo sapiens
cactttgcagggtggtgggaggctaaattattccacctctctcactgctgtggggtg

SEQ ID NO: 6869787 - DNA, 74 bp, Homo sapiens
ccacttattacgatgggaacagtactaggcttccatctgggagcagccactctcattccacgtggcaaaagtgg

SEQ ID NO: 6869788 - DNA, 68 bp, Homo sapiens
ctgaccaaggaggccctctccttctggaatctggggttccagttagtctagatgggtctcttggacag

SEQ ID NO: 6869789 - DNA, 80 bp, Homo sapiens
tcccaggctccatgcaaaggctgtttggaagctccatggatagaaagggccgagggcaggctgcatgggggaagctggga

SEQ ID NO: 6869790 - DNA, 61 bp, Homo sapiens
tctgaaattcctaggtatgatttttggcatttgtagccatcaattgtttgccaggagcaga

SEQ ID NO: 6869791 - DNA, 57 bp, Homo sapiens
aggcatgactggttttcttacaaaccaaaaactttgtgtgattcccagggtgtgcct

SEQ ID NO: 6869792 - DNA, 57 bp, Homo sapiens
cagtgggtcctaagtacagttcttatgctcatcttgctgctagacttggggcttctg

SEQ ID NO: 6869793 - DNA, 57 bp, Homo sapiens
aggaaggtgcagtagggtgtgccgggacttagttaacctggcactcccccacctcct

SEQ ID NO: 6869794 - DNA, 124 bp, Homo sapiens
gagtggcttgaaaagagtatgtgttcaatagcaaagtgtgagattaaaccgaatcattcaaatatgactgacacaggtcaaatctacttttgcagtgacctacgacacttttttcatgctattt

SEQ ID NO: 6869795 - DNA, 87 bp, Homo sapiens
acatgtattttggaaggtgcattttgggcaaatgatcaacatttgtttctttggctatgatttactgtttaattccaaaagtagtgt

SEQ ID NO: 6869796 - DNA, 55 bp, Homo sapiens
gggctgcccaaattggagtaacttgctgagaatgttctctccatatgcccagccc

SEQ ID NO: 6869797 - DNA, 66 bp, Homo sapiens
cctgctggccagtggagggctgtggaagaggtttgcacaggcctcgctgtccccgaggtcaccagg

SEQ ID NO: 6869798 - DNA, 75 bp, Homo sapiens
cagaaaggcacagtgatttctgcaagggctctgagtttgtaaatgacagagctgggattcatctatgtctttctg

SEQ ID NO: 6869799 - DNA, 84 bp, Homo sapiens
agggtgctgggagttagttctagaccagttaatagtgttcacttgggcactattaacattttggtttgggtaactctttactct

SEQ ID NO: 6869800 - DNA, 76 bp, Homo sapiens
ttgctctgttgcctaggctggagtgtagtggtgtgatctcggctcactgcaacctctgcctcccgggttcaagcga

SEQ ID NO: 6869801 - DNA, 69 bp, Homo sapiens
ggaagaggagaggagaccttctctgaagggtgaggccttttcagagctgggtgcttcttcctgctctcc

SEQ ID NO: 6869802 - DNA, 99 bp, Homo sapiens
ctctgctacagtacctggcatttagaggtgtttaaccaatgttagggaagaaaactaacactggttaaacacctctaaatgccaagtactataacagag

SEQ ID NO: 6869803 - DNA, 81 bp, Homo sapiens
gacctactccctgcccccattgccacacaacctctggctgaagccaggtggtccctataatgtgggatagggtagtaggtt

SEQ ID NO: 6869804 - DNA, 82 bp, Homo sapiens
cttcagtgggcaaggattaatagaatgaatcacctcttttcccctaaaggtttgacatagtgtgtgatttgtgcctgctaag

SEQ ID NO: 6869805 - DNA, 62 bp, Homo sapiens
tcaccaggactgagaccttggggtagtcacatcattctagacctcatgtctctcatctgtga

SEQ ID NO: 6869806 - DNA, 56 bp, Homo sapiens
agtatggattttctgttactgggctttaaatatgttaatgagagaatgttcatgct

SEQ ID NO: 6869807 - DNA, 63 bp, Homo sapiens
gctgcagcccgcagctccttgcagagatgtctacctgcttctctctggagctggggcatgagc

SEQ ID NO: 6869808 - DNA, 64 bp, Homo sapiens
agaaaggagaagggtttcccaccaaagccgggccatctgtgctgccagaatccttctctgttct

SEQ ID NO: 6869809 - DNA, 65 bp, Homo sapiens
tccttgtctgtttcgcgtaaagcattcctttctttaataagatgacagcagaagcggacgaagga

SEQ ID NO: 6869810 - DNA, 85 bp, Homo sapiens
gctatgcaatgtttctagctttttatgacaatcttggccaaagcaggctagatggcaataagaaagactagaattgttgcatggc

SEQ ID NO: 6869811 - DNA, 55 bp, Homo sapiens
tgtagagatatgtgtatttatttaaggtatgtaaattatgtcacatgactctgca

SEQ ID NO: 6869812 - DNA, 84 bp, Homo sapiens
acatcgtgtgttgtgacattcttggatgcatggatgggatattgaaacacatgtttgcatcttggatgacataactgtgtgtgt

SEQ ID NO: 6869813 - DNA, 57 bp, Homo sapiens
ctaaggtacttgatctcccagatcctggcaaccagggcctacagcttaagtccatag

SEQ ID NO: 6869814 - DNA, 55 bp, Homo sapiens
gcaagacctgagtaatgtcagggtgtcctccctccagggcagtggctgggtctgc

SEQ ID NO: 6869815 - DNA, 58 bp, Homo sapiens
ccacagctgaccgcaggtgagcctaacccttgaaggagcatttgctgagcggctgtgg

SEQ ID NO: 6869816 - DNA, 58 bp, Homo sapiens
ggtgtggacccgcgtctggagaacgagctgcatcgccaaggctgctgcgggtcgcacc

SEQ ID NO: 6869817 - DNA, 90 bp, Homo sapiens
atccatggtgccttgtgtcctggctgtggcaacctgcatgctgaactgagtccaacagcaggcaccaaggctatgacatccactgtgggt

SEQ ID NO: 6869818 - DNA, 61 bp, Homo sapiens
agggacagctgaaaccagggatctgggtggcccctgggctctgtgtttcagtttcttctct

SEQ ID NO: 6869819 - DNA, 110 bp, Homo sapiens
aggtccgtaatttaaccaacatgcaccagaatgatcatttggattaattgggcatctcttctaattggccagtgcttgtgattttctgtttgttgagtacttaggatcct

SEQ ID NO: 6869820 - DNA, 60 bp, Homo sapiens
gtgctgatggccacccctgttcctcccacagacacggccatggagcaggcacgtcagcac

SEQ ID NO: 6869821 - DNA, 98 bp, Homo sapiens
tgtagaagctaacacttataagaagttctgaaatcactgtgtctacctaagagtattgtgcatgcaatagatcacagagagctagtgttagtcttgca

SEQ ID NO: 6869822 - DNA, 66 bp, Homo sapiens
ctgcacagaggtcggtctgccatcctcttgcaagattaatgcctgtagtcccactctctgctgcag

SEQ ID NO: 6869823 - DNA, 92 bp, Homo sapiens
tgtctgaatatgtgtatgtgtgtgtgtgtgtatgttcatagggagaaaaatttcctctcctggaacacagatgcattacacatctatggata

SEQ ID NO: 6869824 - DNA, 72 bp, Homo sapiens
cagttgcagaggcagagtgctaagcttggcagaatatgtaaatgtggaagaagcatgtgcctctgacgactg

SEQ ID NO: 6869825 - DNA, 56 bp, Homo sapiens
cccaggctggatttcggtggcacgatctcggctcactgcaagctccgcctcccggg

SEQ ID NO: 6869826 - DNA, 64 bp, Homo sapiens
acactggggaaggagagagtgaagaccctccagttggttcctcagtcagctccgttcttggtgt

SEQ ID NO: 6869827 - DNA, 67 bp, Homo sapiens
acaaaaggcccagtgccattagttttggtcatacactggcctatggtgctatactgggctgctatgt

SEQ ID NO: 6869828 - DNA, 81 bp, Homo sapiens
acattgatgaaaaggtatcatttcccttactgttgtgaaaaaccggggacatcttacaataggttctttttcatcagctgt

SEQ ID NO: 6869829 - DNA, 78 bp, Homo sapiens
gcacttgtcagaggctgtggcatcacatcaggacaaccctgaaaccaggtcactgagaagagtaacagcaggcaaggc

SEQ ID NO: 6869830 - DNA, 72 bp, Homo sapiens
cgggagggtgggggcgcccagggcaggcagggagggggagtctgcgccaggccttggctccagccctttccg

SEQ ID NO: 6869831 - DNA, 63 bp, Homo sapiens
gagatgcacagtgaccctgccagtccctttggtaatgccaaaatgctgacgttacttgctctt

SEQ ID NO: 6869832 - DNA, 93 bp, Homo sapiens
gatggatggaaggagaactctgagtctgcagacaacttagaagcatgttgttgctcctttttgtctgtagacagggcatcctgtagttctgtc

SEQ ID NO: 6869833 - DNA, 69 bp, Homo sapiens
cgtttggtgagagactttggagccagactgcctgaattcaagtcctggctcccctacttcttattgacg

SEQ ID NO: 6869834 - DNA, 70 bp, Homo sapiens
accagcccttcatcacctaacttgtgatttacagacactgagcacattgcaggttgagaaggtgcttggt

SEQ ID NO: 6869835 - DNA, 79 bp, Homo sapiens
ttgcctgcctgtgggctgaaagtgctcccgattttagcatttgttttgagccacatctgcccactcgtcctgcaggcaa

SEQ ID NO: 6869836 - DNA, 55 bp, Homo sapiens
cattttgggtgagtttgaggcacatagtagtctgggacctgtttgcccacagatg

SEQ ID NO: 6869837 - DNA, 60 bp, Homo sapiens
aatggagatctgactagggaaagaggctgcttaaagccctttggcttttagatatccatt

SEQ ID NO: 6869838 - DNA, 57 bp, Homo sapiens
tgagtttagtgtgagacttatctgattaagtatagtttcataagccactagatctca

SEQ ID NO: 6869839 - DNA, 68 bp, Homo sapiens
ctcctcctggcagctcctccccggcgggcctcccctcatctcggctgggtagaggtgccgggtgtgag

SEQ ID NO: 6869840 - DNA, 56 bp, Homo sapiens
ccgtggtcacctgagctccttggcgtttcatctgacaggtgaggttggtgccatgg

SEQ ID NO: 6869841 - DNA, 74 bp, Homo sapiens
ggacactttttggtatggcatagccattctgcttatcaggggatgttagaactggcggctagaccactgttttc

SEQ ID NO: 6869842 - DNA, 60 bp, Homo sapiens
cctgtggtttacgtacagctccatgacgtatgaatggcagaagctgtgtatgtccacagg

SEQ ID NO: 6869843 - DNA, 90 bp, Homo sapiens
atagatagatgaaaattataggtccaatgcttgagaatgatggtatcatgttaaaagaaaacattgcacttctgcttttcctctgtctat

SEQ ID NO: 6869844 - DNA, 63 bp, Homo sapiens
taggggtggagctaagagtcccaaatctaatcctgccttggtctttctggtaaccagccccta

SEQ ID NO: 6869845 - DNA, 86 bp, Homo sapiens
ctggtgctctttccacctctcttcctatcaggttttgcactcaaccttccccagaaccaaatggatggtaagaggggcagcatcag

SEQ ID NO: 6869846 - DNA, 80 bp, Homo sapiens
gttgagttatcttgcacagcattcagtccgttcatgttcaaacagggcatgacacctaagctttgcatgataatgtcaac

SEQ ID NO: 6869847 - DNA, 77 bp, Homo sapiens
gggcgcgcaggacggccggtcccgggactctctgtccagcacctcggggtcctggctgccgtcgtcctgcggggcct

SEQ ID NO: 6869848 - DNA, 57 bp, Homo sapiens
ggcatgattttggctcactgcagcctccactttccaggttcaagccattctcctgcc

SEQ ID NO: 6869849 - DNA, 77 bp, Homo sapiens
ggtagcaacagcctgcaggaggccgtcagctgcacccaggagccaggacgacatggtcatcctcaggcacagctgcc

SEQ ID NO: 6869850 - DNA, 68 bp, Homo sapiens
agcattagaacattccatcactgggtattagacttatggtttacttgacttgatgaatgttctttgtt

SEQ ID NO: 6869851 - DNA, 71 bp, Homo sapiens
tccatggtgcgggtggcagctcatcccttctcaaactttttgaggaagctccccaagcctgccctagtgga

SEQ ID NO: 6869852 - DNA, 60 bp, Homo sapiens
agaggaatgtcaaggcagagcccagtctggaaccagaccccaggtggccttgacttctct

SEQ ID NO: 6869853 - DNA, 67 bp, Homo sapiens
cttttgctgaatttgctttgactgtcagcaagttggattggatttgtggctcagagtagggtaagag

SEQ ID NO: 6869854 - DNA, 75 bp, Homo sapiens
gagggtggagctcgtgtttgctcagggcatcccaggtctgacgtggggactgccttccacagacactcgaccctt

SEQ ID NO: 6869855 - DNA, 56 bp, Homo sapiens
cagagactgagggacagggcagtggaaaactccaaagccaaggttttttattactg

SEQ ID NO: 6869856 - DNA, 84 bp, Homo sapiens
cccaggttggattagggcacttcctctgggtccctggcaatttcctccaggttagggatcccaaggggtctctgccttcctggg

SEQ ID NO: 6869857 - DNA, 66 bp, Homo sapiens
cattttcaaagcaactgaaaaggaaggtatagatcaacctttttgtagattttgcatttgaaaatg

SEQ ID NO: 6869858 - DNA, 58 bp, Homo sapiens
accgccctgccgcctgcatatgggatgagtcctctcaaatagcagaagcagagggggt

SEQ ID NO: 6869859 - DNA, 56 bp, Homo sapiens
gcagagacagactaatgaaaagctttacaagacattttctcaactgtcttctctgc

SEQ ID NO: 6869860 - DNA, 68 bp, Homo sapiens
ctgttctagcacacttttggcatgtttggttcttatagaagagcctgtgctagcagtggtaagtttag

SEQ ID NO: 6869861 - DNA, 58 bp, Homo sapiens
agagcaaaaccgttgagattggtgtcctcaagaagtttaatggtgatggttatgttct

SEQ ID NO: 6869862 - DNA, 101 bp, Homo sapiens
tgttggtcaggctggtctcgaactcctgacctcgtaatctgcctgccttggcctcccaaagtgctaggattacaggcgggagccacagcgcctggccaata

SEQ ID NO: 6869863 - DNA, 84 bp, Homo sapiens
gtctgtctggtctagggggactcaactgggacagcttgtctttgttcgtcttggtctttcatccttcaacagactagcacaggc

SEQ ID NO: 6869864 - DNA, 79 bp, Homo sapiens
gactatgatacatgcttttcaatctatcttaaggtgaccttcacttgcacggaaagtctgaaaatgtacagtcagagtt

SEQ ID NO: 6869865 - DNA, 69 bp, Homo sapiens
ggcctagactaatatttggagttagtgagattctctatttcagaaggctctggaatgtgtagtcaggtc

SEQ ID NO: 6869866 - DNA, 84 bp, Homo sapiens
actgaagtccagccaggaaggttgtgtggctttgccagtggcaaatcctggaccagcctcttggcctgtggatctttgctcagt

SEQ ID NO: 6869867 - DNA, 62 bp, Homo sapiens
ttaaatgtgcaaacgtgcaaagtgtcgaatgcagtctggcaaatagcatgtagtacatgtaa

SEQ ID NO: 6869868 - DNA, 111 bp, Homo sapiens
cagggacgagggcctgggcgcagggctgaccttgtgctccgaggcgggcagcagcgaggggctgggggcccggcggagcagagggggccgcatctcgaactccacgccctg

SEQ ID NO: 6869869 - DNA, 74 bp, Homo sapiens
ggcagtggaggctcagggccggagggcatttgcctgagaccatggggcaggccaggccctgggcacttcgtgtt

SEQ ID NO: 6869870 - DNA, 96 bp, Homo sapiens
agttccatcaccaaaaagctcagagatatgttttgtgatcaaaggtactaattatatgagcctaaggtaataatctccctttttgtatgtgtgact

SEQ ID NO: 6869871 - DNA, 82 bp, Homo sapiens
catttccttttaggatatgcatttttatacatctgactttaactgataaatgactgtaaagaggtgtatctttatggaattg

SEQ ID NO: 6869872 - DNA, 56 bp, Homo sapiens
atgatgtcatagtgtcagcagtgtgtaattaccttcactgggacaatatgcattat

SEQ ID NO: 6869873 - DNA, 61 bp, Homo sapiens
gtcccatggctgcaattcttctggactgccaagttgatccagaatctgatagctgtggagc

SEQ ID NO: 6869874 - DNA, 74 bp, Homo sapiens
caaaggtaatggagtgagagtgccattattttaaatggtttgaggccaggcagtctgcaatttcattagctttg

SEQ ID NO: 6869875 - DNA, 60 bp, Homo sapiens
gcctcccccaggtgtgggcattgggcagagccagcagtggccaccaccagggtcagaggt

SEQ ID NO: 6869876 - DNA, 65 bp, Homo sapiens
ggagttcttacactcttaaaaatcattaatgaccctgaagagtttttggagtgtgagttacatct

SEQ ID NO: 6869877 - DNA, 57 bp, Homo sapiens
ggttatcgaagctggacattctaaatgttgtgcgtcaagtgtctggattttgtaacc

SEQ ID NO: 6869878 - DNA, 61 bp, Homo sapiens
tgcccgaatttcttcaatatgctaggccctggctgggctttgaggatacagaggaaaggca

SEQ ID NO: 6869879 - DNA, 76 bp, Homo sapiens
tgtatggagggttaaaaatgtgatatgagaaataatcttttagaagtcagatgttcacacttttagctgttctaca

SEQ ID NO: 6869880 - DNA, 63 bp, Homo sapiens
ctgcctgcctgcctgctggccgggactcctgagtcaggctctctggccctggggtgtgggcag

SEQ ID NO: 6869881 - DNA, 119 bp, Homo sapiens
gggttaaaatctactgaatttgaggttgtagccagagctcttctttcctttctctgtaattgatgaggaaacttcagagttttggtcttttcaaacttctcacagtacatgtaggaccc

SEQ ID NO: 6869882 - DNA, 89 bp, Homo sapiens
ggacaagtttcccgccctcccagagtttgtgttctagtggaagacacagagaataaacaaaggacaaggaggtgcaggagatgctgtct

SEQ ID NO: 6869883 - DNA, 119 bp, Homo sapiens
tcacagtggtctctttttaggaaatgcatattagcatgccaagcttttagaattccaagaaacacattttaggagatataaatctagaatgttttttgaaagggcgaaattcattgtga

SEQ ID NO: 6869884 - DNA, 75 bp, Homo sapiens
gccttctgtagacaatggctgcagggttcttatgcccaccccaccctgtagctccagcctgtctacacagaaggt

SEQ ID NO: 6869885 - DNA, 74 bp, Homo sapiens
cactgctttctgaggataacagtttaagatatttcttctgaaaaataatagctgttttcttctaggaagacatg

SEQ ID NO: 6869886 - DNA, 66 bp, Homo sapiens
ggaaactttagcattccatcttggacttgtgttttgcatcaatttcaagagatgctgtcagattct

SEQ ID NO: 6869887 - DNA, 59 bp, Homo sapiens
tttgcacactgtgaatttgcatatgtacatataaatttatgtaatttcataggtgtgaa

SEQ ID NO: 6869888 - DNA, 66 bp, Homo sapiens
gtcgagaagaaggacttggagttggataaggaagcccccagcactttccaggccttgttctcagat

SEQ ID NO: 6869889 - DNA, 70 bp, Homo sapiens
tgagtatcatagcataaagaatacatttctagcatttcagacttggtgattcttcctgctggcatactta

SEQ ID NO: 6869890 - DNA, 71 bp, Homo sapiens
tctgttgtgtctaagctagtttcatctttgaagaaatgcaagggaaaaaagctggctgggagcagaaggga

SEQ ID NO: 6869891 - DNA, 79 bp, Homo sapiens
cagggtctgctggtgtatctgtaccactgctgggactttggtagttcagtgttgtgcacatacaaaatgtatgcctctg

SEQ ID NO: 6869892 - DNA, 65 bp, Homo sapiens
tctgctaatttctgctattattctgctaatttttgcagaaactagatttgcagaaactagacagg

SEQ ID NO: 6869893 - DNA, 57 bp, Homo sapiens
tttcttgaagtcctaaccctcagtgtgatggtatttgggggcaaggcctttgggaag

SEQ ID NO: 6869894 - DNA, 79 bp, Homo sapiens
gagcccaggcagttccgagcctcgtgtgtcagccacggagagaatgcggccagccagggtttagcaagcctacaagctc

SEQ ID NO: 6869895 - DNA, 64 bp, Homo sapiens
tgtcacaggtgtcatgctatgcactttcctaagtcatctcatgtaacctgttttaatcctgaca

SEQ ID NO: 6869896 - DNA, 68 bp, Homo sapiens
acgtatcttcagaaactagtaacagctatcttctatatatggctagaatactgttttagaacttatgt

SEQ ID NO: 6869897 - DNA, 57 bp, Homo sapiens
ggagaagccagaccctgaaggcataaattaagaagcatggtcaccgtttggctttcc

SEQ ID NO: 6869898 - DNA, 81 bp, Homo sapiens
acccactctcaggagactgaacttttgcaccactgagagtcataagaatgggctcagaagatagtttccaaagaggagggt

SEQ ID NO: 6869899 - DNA, 105 bp, Homo sapiens
tgcaatctgtgatttgtgggaatttcttgctttctctccgttcagacaccccagtttgacagatggggcacaaagccacagagcaatccataactccagtttgta

SEQ ID NO: 6869900 - DNA, 58 bp, Homo sapiens
tggtcctcccttaacttgtcatgtgtggatttcatgattctaaacttaagggggagca

SEQ ID NO: 6869901 - DNA, 77 bp, Homo sapiens
ctttaaccactgtgttatgctttccatgggtaaagcaacctaaaaaggcccctggaatcagttacatgtggttggag

SEQ ID NO: 6869902 - DNA, 70 bp, Homo sapiens
cttcaaagggccactgggctgctgaagctaagcgcctctcatctgcatcagaattccagtttctttgaag

SEQ ID NO: 6869903 - DNA, 129 bp, Homo sapiens
tcaggactattggatgagccatgaaactgtttatgaacggttttttatgtttcttatgcttaactggcttagttgagcagccagtgcagaacacatggaaaatgttcttgcagcttaccacagttcaca

SEQ ID NO: 6869904 - DNA, 56 bp, Homo sapiens
tcttgattacttattttgtgccaggtcccgggccgggcctgcaaaggtgaataaga

SEQ ID NO: 6869905 - DNA, 82 bp, Homo sapiens
agattttaaattacttcagttacgttcctagggacactattaactcaggatgatgttaattgaagtttcagatttgatattt

SEQ ID NO: 6869906 - DNA, 56 bp, Homo sapiens
ccttggtgctatttcatttcatggtgttaccaagacctgtgaaatcagcacccagg

SEQ ID NO: 6869907 - DNA, 69 bp, Homo sapiens
tgtggctcaggatctaagcagaatgtggagctctgactcctgccattcagaatgccatcttgagctacg

SEQ ID NO: 6869908 - DNA, 55 bp, Homo sapiens
gcatctccagctggctgtgataaatctgcattttgtaccagcaagtagggagagt

SEQ ID NO: 6869909 - DNA, 83 bp, Homo sapiens
tagaacactgacatgggatcaatgaggcaggctatctaatccaggcagcctgctctggaatccatgtaaaaaccactgttttg

SEQ ID NO: 6869910 - DNA, 130 bp, Homo sapiens
tgaccctggcttccccttctgaaagagcagtgtagtggttgtaaggaataggggctaagaaaacagttaggcttctaatcccagctctactacttattagctgtgcagctttggggaagttatttagtcg

SEQ ID NO: 6869911 - DNA, 97 bp, Homo sapiens
ctggagtctacagatactatgggagctagagtttgtagggtagagcatcactgatctataggacaacttcaagactcctaataaagtaagactggag

SEQ ID NO: 6869912 - DNA, 59 bp, Homo sapiens
aggagggtctgtttaccacctctttcagaaaatgaacctgagagaccacagagctgcct

SEQ ID NO: 6869913 - DNA, 64 bp, Homo sapiens
gaaagggtgaagagtagatgaatgcagtgaacagttgattcctcaacatccattcttgcccttc

SEQ ID NO: 6869914 - DNA, 57 bp, Homo sapiens
gcatggcaatatgatgcactgtttgcgggagtcctgcgagggcacattgttccgtgc

SEQ ID NO: 6869915 - DNA, 106 bp, Homo sapiens
ggccttttaggcattggtgggtagaacaatactagctgcatttaaaggtcaaggcaactgggttttacaaagcactggtgaagttctagcttactaatgttaggcc

SEQ ID NO: 6869916 - DNA, 79 bp, Homo sapiens
ctggtctgtaactggacactggtctgtactggagtcagaactcagaacagaaacgttgttccattcatgtgaagagcag

SEQ ID NO: 6869917 - DNA, 70 bp, Homo sapiens
ttttgagcaccctatgtgtttacatattcataacatacgtgtttctgtgtggatgcaggtaaattcaaga

SEQ ID NO: 6869918 - DNA, 66 bp, Homo sapiens
cctgggaattatttctggtagtcccatggtgggactgtgtcattgatcagaaacaagttactcggg

SEQ ID NO: 6869919 - DNA, 86 bp, Homo sapiens
gttaaaacaagttcatccacatttactggatgctcaggctccacgtggaccaccctggcttccagtaggtgcgatgtggctgtgac

SEQ ID NO: 6869920 - DNA, 81 bp, Homo sapiens
gtgggggtcctgaaggaagcaggtggcctgtgttacttctgaatgttgtatcaggtgtttttgtttgtttcctatccttgc

SEQ ID NO: 6869921 - DNA, 58 bp, Homo sapiens
tctctgcccatcctcagtccactgcacccaccctttgctgtgtcaggatgtgcagggg

SEQ ID NO: 6869922 - DNA, 68 bp, Homo sapiens
ccaggggcaggagaaggtttggagtgcaggcagaaacttcctgaatcttccccttactcctgctatgg

SEQ ID NO: 6869923 - DNA, 83 bp, Homo sapiens
taagtagttctaagattcacattggttcttgatagctgtgctacacaagtagagtctcaaagtcagtgtcatggatttattta

SEQ ID NO: 6869924 - DNA, 69 bp, Homo sapiens
agtaccctgggttacactaattgatgctttagaaattaaagcagtcactccagtgtgatgcaggtgact

SEQ ID NO: 6869925 - DNA, 59 bp, Homo sapiens
ccaaagtccatagtttacattagggttcatttatggtgttgtacacactatggttttgg

SEQ ID NO: 6869926 - DNA, 64 bp, Homo sapiens
ctttctgatgtaaggaactaggcgaatgcgaatggctcttggctgtttctttgctgtcagagag

SEQ ID NO: 6869927 - DNA, 69 bp, Homo sapiens
caagacgcagcgaggtgaagggtacaagctcattcataccagggctttcccctcttctcgtggtccttg

SEQ ID NO: 6869928 - DNA, 75 bp, Homo sapiens
gaatatgagcagcccaagaagaaagacccaagttactgacatcagaactgagatttttgtctggctgtttgtttc

SEQ ID NO: 6869929 - DNA, 76 bp, Homo sapiens
aggtcagagttggctactctctgaggctttctgtcatgaatctgctggcggcctctcagggcagagaccctgacct

SEQ ID NO: 6869930 - DNA, 70 bp, Homo sapiens
gcagtgaagatggcaggttgggattgcataaccttgaccagcgcttgtccttccttccctcttcttctgt

SEQ ID NO: 6869931 - DNA, 62 bp, Homo sapiens
ggcatagagtgagaaggctcaatgcaagatgttgctcttgctggcatactctctttgttgtc

SEQ ID NO: 6869932 - DNA, 84 bp, Homo sapiens
ggaatttcctgaaccacaatgtgaagaaggaggtgctcctgattgggcttcttttctcagctttgtggttgtttatgaggttct

SEQ ID NO: 6869933 - DNA, 71 bp, Homo sapiens
ggagaaagaggccggaagatgaagtttggtcatgttttgtaatgtgctgctgtttctttcccctcttctcc

SEQ ID NO: 6869934 - DNA, 67 bp, Homo sapiens
agtgctgggattacaggagtgagccaccgcgcccggccttttagcttatcttgaaatccaccagcct

SEQ ID NO: 6869935 - DNA, 55 bp, Homo sapiens
gaaattattttcagaatggagaaggcagttgtcttcatcagggagaaataatttc

SEQ ID NO: 6869936 - DNA, 80 bp, Homo sapiens
tttggccaatatctctggcttggtgccttacttattacagaattgttattctgcaggatcagagccagaggcaggccaaa

SEQ ID NO: 6869937 - DNA, 90 bp, Homo sapiens
tctctttcccctttgttctccctggagtctgtggcttaggcttaatgaagctaacagactggggtggggaataggggttggggaaagaga

SEQ ID NO: 6869938 - DNA, 72 bp, Homo sapiens
tgatgcctgatattagaaaggtatctctgcatacttactgggttgctgagagtgctctttgatgtcacatca

SEQ ID NO: 6869939 - DNA, 75 bp, Homo sapiens
ccaatttcctgccagtaccttccattggccaaacccaatagaaaggtagcaactgtagaatcctaggaaattcgg

SEQ ID NO: 6869940 - DNA, 94 bp, Homo sapiens
acttcctttcgattgtgcatacacacatcaaatgtttaaaactagctaagaatattggacaaatgtatgtgttatgattcagtctgcaggaggt

SEQ ID NO: 6869941 - DNA, 56 bp, Homo sapiens
tctcatggccagatgtctctggagctagtggcatggctatacagaatggccagagg

SEQ ID NO: 6869942 - DNA, 57 bp, Homo sapiens
gagttgctttcctgttaatatcgaaaacatttcttggtaatatcagacatgcaactc

SEQ ID NO: 6869943 - DNA, 59 bp, Homo sapiens
gtggatctgatgtttttcgccactttgctgtcttgtggtttagagttgtgttagtccat

SEQ ID NO: 6869944 - DNA, 75 bp, Homo sapiens
gttcatgagtagattgaaccttttgaataaggaccaaagatttcctttggtcttgggtgaggtgcttgcatgaat

SEQ ID NO: 6869945 - DNA, 62 bp, Homo sapiens
acaatgtctggacagagattctcaatctgagactgagttattattggacagatgcttattgt

SEQ ID NO: 6869946 - DNA, 69 bp, Homo sapiens
ggagcttgctactatgcctggctaattttttaagtttttagtatgttgcctaggctggtcttgaactcc

SEQ ID NO: 6869947 - DNA, 81 bp, Homo sapiens
tcatttcaatgtagtttcctcctatagttaaatcaccatttcaaaatttaacattgagttagggagcgtatagataaatga

SEQ ID NO: 6869948 - DNA, 55 bp, Homo sapiens
gtcctagtgcctggaagctgggactcacgaccgtccagctgcctgcactttggac

SEQ ID NO: 6869949 - DNA, 55 bp, Homo sapiens
gccagggaattcataagcccccttttgctgtggcctgggagctgaggtctttggt

SEQ ID NO: 6869950 - DNA, 85 bp, Homo sapiens
tcttaaatggatacctcatgcttgtctatactagatgctgcaataggatggtatctggtttagtatgatgttatatgttttaaga

SEQ ID NO: 6869951 - DNA, 67 bp, Homo sapiens
gttctccaccacatggcttctccgtgtggctaggttgggctcgtggagaggccatgtggaggacaac

SEQ ID NO: 6869952 - DNA, 61 bp, Homo sapiens
agctggtctggctacccagcgaatcccacagcagggagtccctctgggagcaggactgact

SEQ ID NO: 6869953 - DNA, 68 bp, Homo sapiens
gagatagtttggccaatctttgcctcccatcccaactaggatactggagagccttgtccacatatctc

SEQ ID NO: 6869954 - DNA, 56 bp, Homo sapiens
agtgaagactgggtatcagggaagtaaaaactacccaaatgaattcaatctgcact

SEQ ID NO: 6869955 - DNA, 81 bp, Homo sapiens
gcagcttgaacgggggcaggtctggaactttgatgtaggaaaaaccacaattcacttttcaaaccttctcctggaaggtgc

SEQ ID NO: 6869956 - DNA, 79 bp, Homo sapiens
ttttgggataggtaggtagttacacagcaatgtatctggaacatacacatctggtgtgactgccagccccttaccgaga

SEQ ID NO: 6869957 - DNA, 82 bp, Homo sapiens
tggtcttgatctcttgacctcgtgatccgcccgctttggcctcccaaagtgctgggattacaggcttgtaatttctggacta

SEQ ID NO: 6869958 - DNA, 59 bp, Homo sapiens
cttagtagaacgtggatgggaagatataaacagcatctccctcactacgtttttctaag

SEQ ID NO: 6869959 - DNA, 80 bp, Homo sapiens
tgtctttgtgccactatcacactgttttaattactttggtttttcaatgtgtcttgcggcagttggtaacaagaaaggca

SEQ ID NO: 6869960 - DNA, 57 bp, Homo sapiens
gctaaccctggcatcattctcacctccagcaaggagatcaggagtccaggggttagc

SEQ ID NO: 6869961 - DNA, 61 bp, Homo sapiens
gcacttctcagttctgccgcaagtattccagtaaaaactgggttgatctgagctgaagtgt

SEQ ID NO: 6869962 - DNA, 57 bp, Homo sapiens
tctcactttgcacagccagaattccagtggcacagggctgggctgtgccaggtgaga

SEQ ID NO: 6869963 - DNA, 129 bp, Homo sapiens
ggaatggtttgatgccttgtgtactagtatgttcagaacaggagctgctttggtgcggtttgagtcatgagtcactctgacaaaaggcagcttatgatatggatatgtaaggtgttctcttagtgtttt

SEQ ID NO: 6869964 - DNA, 91 bp, Homo sapiens
cccgccgccgccgcgctcacgggctgccgggtggcggctgaggttggcagtgccgagctgccccgaggcggcgggaagcgcgcggcgcggg

SEQ ID NO: 6869965 - DNA, 59 bp, Homo sapiens
caagggcaaggtatttggaactggaccagtcaagctcaaaatttcagcactagcccttg

SEQ ID NO: 6869966 - DNA, 110 bp, Homo sapiens
cctgctgtcagaccggcgcttgtgtggagccaggggctgtaggtaccccggctgagtagcctctcagatgtccatggtcctggctgcacgccagcgtgggggcaggcagg

SEQ ID NO: 6869967 - DNA, 81 bp, Homo sapiens
tttgattgcgtgcctgctgcatgtaggtcagaactcctgccctccaggaactcacatcacatgacagtaggccgcatcaga

SEQ ID NO: 6869968 - DNA, 71 bp, Homo sapiens
aatccattagtgtggagagttttagacccttgagctacttctagcacctagcacctctcacatagtgggtt

SEQ ID NO: 6869969 - DNA, 117 bp, Homo sapiens
atcttcaaggcagagctggggaaagggtattttatcatttctgcaaacaacatagcatggctccagtgttgcagtaaaaatggagaggaatccagtagtcttcggcaaggtggagat

SEQ ID NO: 6869970 - DNA, 64 bp, Homo sapiens
gtgctcacaatttcttcagccactccaaactggggccttgggggtcctgggggtggctgggcac

SEQ ID NO: 6869971 - DNA, 59 bp, Homo sapiens
gccctgcttctggcatgcagaaagcaatcccactgtttttgcatagcaagtagcatggc

SEQ ID NO: 6869972 - DNA, 66 bp, Homo sapiens
tagggctcgggcacaggacaggcgatttgacatcagaaaatcctgcaggggctggcctggcctcta

SEQ ID NO: 6869973 - DNA, 88 bp, Homo sapiens
ccattgagctagggctgagctcctctccaggattcattccttttgtgcttcagagcatcctggaggctggaggcttgctcctcagtgg

SEQ ID NO: 6869974 - DNA, 79 bp, Homo sapiens
ctttgggccttgttcctgccaagccaagccttggcaaactctggtgggaagctgagggggttggccaggaacttcagag

SEQ ID NO: 6869975 - DNA, 63 bp, Homo sapiens
ggcaggttgggacattatcagtctgcaggccagctgccaacttgccacctgagtctacctgcc

SEQ ID NO: 6869976 - DNA, 65 bp, Homo sapiens
gggcaggggggttacctaattcaacttgtaatatgccctgacaggttctcttatcatctctgccc

SEQ ID NO: 6869977 - DNA, 61 bp, Homo sapiens
gggtgtcctctggtgtgtgcggtcagtcttcttctgactgtggatgccaaaggggaggccc

SEQ ID NO: 6869978 - DNA, 60 bp, Homo sapiens
gaccagctaagaaggaactcagaggctttgggaaaattactcttctgggcttcagtggtc

SEQ ID NO: 6869979 - DNA, 59 bp, Homo sapiens
gctttctgattgcgaaaacaaagctagtgtttttggaatgtgctttccaaatagaaagt

SEQ ID NO: 6869980 - DNA, 65 bp, Homo sapiens
ggtccaaagagttagaagatgtggttcctgccctcagggagctaaatcacttattctttcatgcc

SEQ ID NO: 6869981 - DNA, 76 bp, Homo sapiens
ggctttctgaggctactgttggacttttcaaggtctgattattaggccatttaaagggtcagctcctgcctgagcc

SEQ ID NO: 6869982 - DNA, 101 bp, Homo sapiens
tgagacaggagaattacttgaatccaggaggcggaggttgtggtgagccgagattacaccactgcactccagcctgggtgacagagtgagactccttctca

SEQ ID NO: 6869983 - DNA, 55 bp, Homo sapiens
gaatacttctcactgtgaaataggtctttattatgttttaaagtgactggtattt

SEQ ID NO: 6869984 - DNA, 92 bp, Homo sapiens
tattaggatgtcataggttatgtactttttaaatcttgtaatagattgccagattgaactaaaggttatatcattttatgtatctcctagta

SEQ ID NO: 6869985 - DNA, 60 bp, Homo sapiens
ggtacacattgtgactgtattagccagtagactatggaagtgatgagttacgatgtgtcc

SEQ ID NO: 6869986 - DNA, 62 bp, Homo sapiens
gttgggtcagctttcaggtagtaggataccagtactttctacagccatgtcgctgatttaac

SEQ ID NO: 6869987 - DNA, 68 bp, Homo sapiens
ttttctgtaggacttctgccaactctcctgtaaggaggcaaagtctctggaagtaaacctgcaggggg

SEQ ID NO: 6869988 - DNA, 80 bp, Homo sapiens
ctggatccaagcaagtcactctgtggaagattccaggcgtttgaaaatagacttcactttcgacaggagttgctatccag

SEQ ID NO: 6869989 - DNA, 89 bp, Homo sapiens
ggtgagattgtggcaaataatgcttatgctctcatgattgctaagacccagagcaagaatatttctgccactgaatgatgatctttacc

SEQ ID NO: 6869990 - DNA, 98 bp, Homo sapiens
ccccctcccccctcatgcatcccctaggggctggaggctccacttccctggagggccagatcccaggaggaactgtggggtggaaaaaacggaggggg

SEQ ID NO: 6869991 - DNA, 58 bp, Homo sapiens
gccaggcatggggctgcagtcaggtctccagacccgcgctgtgccctctgccccccgc

SEQ ID NO: 6869992 - DNA, 74 bp, Homo sapiens
ttttgatcatgttatttatccattaaacatcctggtgacacttgtgtagtgggctgaataatgggttcccaaaa

SEQ ID NO: 6869993 - DNA, 60 bp, Homo sapiens
ttgggtttttgggagacattttctcaaaaaaatgagattctgtcatttcaagaaaaacaa

SEQ ID NO: 6869994 - DNA, 97 bp, Homo sapiens
ccctccgcccccagctccttggcctgggtcacaccagggtcccggtcggatttagccgggctgctccgggtcgggtgaggcactgggtgcgtgtggg

SEQ ID NO: 6869995 - DNA, 65 bp, Homo sapiens
tgttactgcaaaaagtttgcaatggccagctcgtgagttccatttggcaaacattttacagagca

SEQ ID NO: 6869996 - DNA, 78 bp, Homo sapiens
aggtcagtggcaaggctggaatggaacctaggtctttagtttctggcacagcatttgttccgctttgtcatctgtctt

SEQ ID NO: 6869997 - DNA, 66 bp, Homo sapiens
cagccaacacctgcaggattcaagggacacagataaactgtcaagtcctgcaggagttgtactctg

SEQ ID NO: 6869998 - DNA, 61 bp, Homo sapiens
aatggagtgggctgacagagatatgatccttttctccccttatctcctgctaccacccatt

SEQ ID NO: 6869999 - DNA, 72 bp, Homo sapiens
ggctctggttcccggatctccatgtcccgctccaccagctacctgagcagcatgggttccgggggcctggcc

SEQ ID NO: 6870000 - DNA, 113 bp, Homo sapiens
tcctaaaatccctaattctttaaaactgcctgtgtttcattataaaaagttggctttgtgtaattacaccgagccatacaacctataaagtgaaaatactgcagattttagga

SEQ ID NO: 6870001 - DNA, 68 bp, Homo sapiens
ttctctgtcatttctttagcaatgggaacattaaaacaatggctacccaaagaagaagatgaagggaa

SEQ ID NO: 6870002 - DNA, 64 bp, Homo sapiens
gccatagaccccccaggactccctcacactaatgaggggtgctgcagggaagtcggggggtggt

SEQ ID NO: 6870003 - DNA, 126 bp, Homo sapiens
atattactcaaatttattcatggtcacacaggtaggaattgggagtcaggttcaaatccaagcctggtttgcttcataagcttgcctcttaatcacctcatgtgtacttcattaaagagataatgt

SEQ ID NO: 6870004 - DNA, 61 bp, Homo sapiens
gcacttttccaaataaatcagttctaattcttatgtaagaatatgatggttggagaattgc

SEQ ID NO: 6870005 - DNA, 64 bp, Homo sapiens
tggagattctaagtcgttggttagtggtactcattaacagttaaacaattggctagaatcatca

SEQ ID NO: 6870006 - DNA, 79 bp, Homo sapiens
accacactcaaatgtgtacatgacagatagaaagattatagtattttttaatgtttgagtcagtatatttattggtggt

SEQ ID NO: 6870007 - DNA, 70 bp, Homo sapiens
agggaagggagtttcaattatattattatgtatgttccaagcattttagaatattggagcaaacttctct

SEQ ID NO: 6870008 - DNA, 77 bp, Homo sapiens
gaagctgcacattgtcctctgatgccttccctggatttgtgcagagactgggagggctttcagggaggatcagtgtc

SEQ ID NO: 6870009 - DNA, 92 bp, Homo sapiens
atttatatggtttcctgtattctaaagggaaaggtatatgcacttgtcttctttttaaacttttcctcttatgaatcagtagcagtatgaat

SEQ ID NO: 6870010 - DNA, 67 bp, Homo sapiens
gtacttattttaatgtttagttgtcatcagttcatgcctaagaggacaaagcacttgaaatgtgtac

SEQ ID NO: 6870011 - DNA, 73 bp, Homo sapiens
tagctagcaaggcgtggcactcaaatgtggacttgagtctgaagaatttgaaagccaccgctcctgtgtgcta

SEQ ID NO: 6870012 - DNA, 97 bp, Homo sapiens
cctggtttcgggctccctgctgttctctccctcataacccttgtttgtatctgagccaggtctgagcaggggagaacagacatccagagcttcaagg

SEQ ID NO: 6870013 - DNA, 60 bp, Homo sapiens
ggaagcaagggtgctgctatcaggaagcctgtctggtctggtcatagcatccttgactcc

SEQ ID NO: 6870014 - DNA, 69 bp, Homo sapiens
tctatcagacttcgttgcaggtctgacttgtgaaggagagagaaaaggaaggaaggaagtttgcatgga

SEQ ID NO: 6870015 - DNA, 76 bp, Homo sapiens
ggctgagacaggtggatcacttgaggtcaggagtttgagaccaacctgaccaacatggtgaaaccttgtctctact

SEQ ID NO: 6870016 - DNA, 56 bp, Homo sapiens
gcctggaggggacagtctctggggtgggcttcacaggataggtcagttttccaggc

SEQ ID NO: 6870017 - DNA, 76 bp, Homo sapiens
ggggtcacctctctggccgtctaccttccacactgacaagggccgtggggacgtagctggccagacaggtgacccc

SEQ ID NO: 6870018 - DNA, 62 bp, Homo sapiens
ggagcaaggctgtcagcacagccatggccaccagatggcaggctcaggttaccagtccctcc

SEQ ID NO: 6870019 - DNA, 57 bp, Homo sapiens
gtggggtcacccttcccttccatgagtccctatcatgaagacccgtggtgtccccac

SEQ ID NO: 6870020 - DNA, 76 bp, Homo sapiens
ctctggcaccagcctgtctgagtcgtgggacacctggcttcagccacaatccactctgcccagacaggctgcagag

SEQ ID NO: 6870021 - DNA, 62 bp, Homo sapiens
aggtgtgaagtcactgagtaaatccaaatgccttattggattatccagtgcacttcacagct

SEQ ID NO: 6870022 - DNA, 130 bp, Homo sapiens
tcagtttaccttccctattttttaccatttgtaaaactaaggctcagtgatgtaaaatataacacattctgtgctgtggcataactgcagcttaggtttttatattcaagacaagcagaggtatagctga

SEQ ID NO: 6870023 - DNA, 64 bp, Homo sapiens
tgccagtcacagttctcaaagagctattctcttcctcccttcctcattcaggctgtgcctggta

SEQ ID NO: 6870024 - DNA, 92 bp, Homo sapiens
gggctctcacatgagtggagaggcttcccgcccatgctggactgtggcttccagtcctgcagccttgggctggagcctgccgctctgagccc

SEQ ID NO: 6870025 - DNA, 61 bp, Homo sapiens
tgctttgcacagtagcgcgtgattgtagaaatgacaatacaatctgaaattatgcaaagtg

SEQ ID NO: 6870026 - DNA, 57 bp, Homo sapiens
aggtgaggctgctgaatggcatgaggagatgctcaagccttgtggaggctctcattt

SEQ ID NO: 6870027 - DNA, 80 bp, Homo sapiens
gacatttttaccgttgaaatcagaatcgtggtgtttgcctcatgacctctgaaacttaatctattgggtaaaaaattgtt

SEQ ID NO: 6870028 - DNA, 106 bp, Homo sapiens
gacacaggggcttggctgttctgttacagcagtgggaaggagtcagccaagcaggagaatggctgcgcctatttgctcttgagagaacatcaccagctgctgtgtc

SEQ ID NO: 6870029 - DNA, 78 bp, Homo sapiens
aagccctttagatcatatttaccacagtataagtttccttctttttcccctgtgctgttgttttggtttaaattgctt

SEQ ID NO: 6870030 - DNA, 63 bp, Homo sapiens
agagctatagatgtttacatacttttagatcattttaaaaatgtgtgaattgtcagtagtttt

SEQ ID NO: 6870031 - DNA, 60 bp, Homo sapiens
gctcacagcctacacagtagattcttaggagacaggaagacaatctgtgtgctgtgctgc

SEQ ID NO: 6870032 - DNA, 74 bp, Homo sapiens
accagttctttagaagttgatggtattggttttacattatttctcattttgcttcaaaggttatttgtactggt

SEQ ID NO: 6870033 - DNA, 61 bp, Homo sapiens
gaacaaatgttctttttatccagttgttttaaaactgtgtggttaaaagacacatctgttt

SEQ ID NO: 6870034 - DNA, 59 bp, Homo sapiens
ctaaggcagtttgggccaccatcttatgcatttctcaagagccctaaaccctgccttgg

SEQ ID NO: 6870035 - DNA, 58 bp, Homo sapiens
gtgggtgttggtgatgtggctggcatgaagtttctgtcaggagccaccagcactccgc

SEQ ID NO: 6870036 - DNA, 69 bp, Homo sapiens
tctacaagccaaggagagaggcctcatcagaaaccagccctgctgacaccttgatcttggactttcaga

SEQ ID NO: 6870037 - DNA, 67 bp, Homo sapiens
ctgcaccccattttctgtctttggtcctgtctgttattggtttataaagtcacccaaaggcatgcag

SEQ ID NO: 6870038 - DNA, 75 bp, Homo sapiens
ggggttaaaagtgcttacaactttattgaggaatttttgaattcctcaatgtcttgtctgtgggatttttatccc

SEQ ID NO: 6870039 - DNA, 88 bp, Homo sapiens
agacactcagtgcagtggtaggagcctgagtcacagtgcctgggttcacatccagcaccatcgggttcttgctttgggatgggtgtct

SEQ ID NO: 6870040 - DNA, 60 bp, Homo sapiens
ggcagctcctcctagtctgcccctcccgtggctgccacagactccaggagggaggctgct

SEQ ID NO: 6870041 - DNA, 129 bp, Homo sapiens
cactggctgtctgcagtggtaacaaccatggcctagttccaggggcagcagtgatggtgctggggcagcatctgaagtgttgtcacctgggtttgggctaatgcttcaccacccagtgttcagcctctg

SEQ ID NO: 6870042 - DNA, 55 bp, Homo sapiens
gactggagtcaatgagcagcacctggtggcagatgtgttttgtgtgacccagctc

SEQ ID NO: 6870043 - DNA, 57 bp, Homo sapiens
cctggcagaatattaaagtgcaagaaccagtttttcttgctctttacccctgcaagg

SEQ ID NO: 6870044 - DNA, 101 bp, Homo sapiens
ctgtttgtaagcaagattttttaacaggttatattgtacaggatcaatattttgctttttaacaaggatatttgtgtaataagaaactttgccttaggcag

SEQ ID NO: 6870045 - DNA, 93 bp, Homo sapiens
agccttttctgaagttctcagctttctcttctatcgatatttcccatgtcagttaaagtgtttgtagagacagctgatgcgtttattgaggtt

SEQ ID NO: 6870046 - DNA, 60 bp, Homo sapiens
caaagtgctgggattagtgctgggattacactcgtgagccactgtgcccaggccactttg

SEQ ID NO: 6870047 - DNA, 57 bp, Homo sapiens
taccagttgatgttttaaatagtattcctttgaatcctatgccattgtcatctggta

SEQ ID NO: 6870048 - DNA, 56 bp, Homo sapiens
agagtcagtgtctgttgaaggcctgctgcctgcctggttcacagacagctgtcttt

SEQ ID NO: 6870049 - DNA, 58 bp, Homo sapiens
ggccgacgcccgtgtccctgtgggttcctgtccttcctcagaacatgagcatcgagcc

SEQ ID NO: 6870050 - DNA, 78 bp, Homo sapiens
tcttggatacagataaattttaagtagaaagaaattcaaaatcaagttttctaaaataagtttatctggtatctagga

SEQ ID NO: 6870051 - DNA, 74 bp, Homo sapiens
tagcatatgttcttaagactggaagttactgggtcaaacaccatgtgcatttcaagtcttgaaagatgtggcta

SEQ ID NO: 6870052 - DNA, 60 bp, Homo sapiens
gaagtgtaccttcctttccagcattcctagctcaacatgtggcacctggggaaggtcttc

SEQ ID NO: 6870053 - DNA, 90 bp, Homo sapiens
atcaacataattgtgcagagtggagtttttcagcgggcttgaagaaagttcctaaaatgtgattccacttttataacacaagttcttgat

SEQ ID NO: 6870054 - DNA, 98 bp, Homo sapiens
ggagactgattttctccattgtaaattctgtggaagttctggagaataatttcatcactaccacccagcagtatgcaatctagaaatttcagctttcc

SEQ ID NO: 6870055 - DNA, 130 bp, Homo sapiens
caatgatagttcccacatagccctggcaggtctgaaccagttatgcctgcctactgagttttatatttcatgagtcatgagccatgggcaggtactgggggatgtagctggtaaagtgggacatgcattg

SEQ ID NO: 6870056 - DNA, 67 bp, Homo sapiens
agccctgaagcttagtttacgctccaaagtttccctgtggagtcaggctaaaggctgttcttgggct

SEQ ID NO: 6870057 - DNA, 72 bp, Homo sapiens
ctctgcctgtgtcactcactgcgttatgtcccatgctgggatttgggcatttagtgcaggacacacacagag

SEQ ID NO: 6870058 - DNA, 84 bp, Homo sapiens
tgttagtattcctggattcctaacctttcacacgtgcagccatcactgtgggaacactgaggacttcaggaatggctcttgaca

SEQ ID NO: 6870059 - DNA, 57 bp, Homo sapiens
ctggaggagaatttatggtcgaataaaatctgtgcttatttcccattcctccttcag

SEQ ID NO: 6870060 - DNA, 65 bp, Homo sapiens
ctgttctgctgcataaaaacttgaacactccgatgaatggtttttattctttgcagcagctccag

SEQ ID NO: 6870061 - DNA, 92 bp, Homo sapiens
gggtgggcacatgaccagatctgggccaatcctagtaccacacctgcccctggtgcagtcattggcccaggggtgggcacgtggcctaaccc

SEQ ID NO: 6870062 - DNA, 101 bp, Homo sapiens
tgtcatattacagatgaagaaattgtggttcaaagagttaagtgtccgctaagtttaagtatggacacatttatggatcgcagaaactcgtctgaatgata

SEQ ID NO: 6870063 - DNA, 130 bp, Homo sapiens
cagtctaacttttcttttgctagagaacatctccttccaacaaaaggtcaccctacaaaagtccacaagccaaatcgtagcaaagtgctcctgttgcaaggaggtctctttcctgagatccgtgaataag

SEQ ID NO: 6870064 - DNA, 56 bp, Homo sapiens
agtccaggtctctgagtcacaacagaagaaaactgctgaacaagagcacctggatt

SEQ ID NO: 6870065 - DNA, 64 bp, Homo sapiens
tcagttatgtcagccgatatttgtcatgctaatgagttgtggtaagcttggctgatgttattgg

SEQ ID NO: 6870066 - DNA, 55 bp, Homo sapiens
ggcagtgctgagaggtgatcggaggaagaccttttatatcccttccagcacctcc

SEQ ID NO: 6870067 - DNA, 66 bp, Homo sapiens
gcctctgcagagggcccttatagggagatccatctgtatcttcttcagtgcccctctagtagaggc

SEQ ID NO: 6870068 - DNA, 82 bp, Homo sapiens
accagcctactagtgcagcacatataaacaaagagaaaacacattttctcaatcaaacatgtctgactgtctagatagtggt

SEQ ID NO: 6870069 - DNA, 117 bp, Homo sapiens
cactcggtgctgaggggtatgctctgcctctgtctcctctgaggtgccagcagagcctgtcctggcctcactctggcctggggagtgggggtgctgtatcctctacagggctgactg

SEQ ID NO: 6870070 - DNA, 76 bp, Homo sapiens
tggctatccacagggaacatgacagccttatatctgttggatatattggcctaatttgtttttctctgttttgcca

SEQ ID NO: 6870071 - DNA, 80 bp, Homo sapiens
taataaacatttcttagtatcttttgatacatagaacagactcttgcttgagtattaggaaatatgaagaaagtttattg

SEQ ID NO: 6870072 - DNA, 85 bp, Homo sapiens
tatttttaaagatgcttctggcagccctaaaaagacgaaatataagaagttagagacgggatgccagagagtatcatggagagta

SEQ ID NO: 6870073 - DNA, 65 bp, Homo sapiens
ttggccggtgggtgaagagtacagagggatgttactatacttaatttgattcttcctctccccag

SEQ ID NO: 6870074 - DNA, 83 bp, Homo sapiens
gttttgggtacttggagacattgatcttttgcaaatctgagaagccagcacagcccgtgtctcctttaagtgaatcctacgat

SEQ ID NO: 6870075 - DNA, 87 bp, Homo sapiens
gcttgcttaaaatttgcattcccaaaagacacttacccaatcaggaccttggagagtgaggcctgggaatctaattttgaagcaggt

SEQ ID NO: 6870076 - DNA, 55 bp, Homo sapiens
cagggctggctgtggcaatctctcatctccaggttaccacttgttgccagctctg

SEQ ID NO: 6870077 - DNA, 58 bp, Homo sapiens
tgattatcttttactgccagaggccagggaagaactgagaggcagtgaaaagagatca

SEQ ID NO: 6870078 - DNA, 66 bp, Homo sapiens
tcagtggagattgcatgcaagaagtttgtacactttaaactgattcaagttatgcatcttcaatga

SEQ ID NO: 6870079 - DNA, 77 bp, Homo sapiens
cagaaagaagggtggctgagtagatggaagagcatagtatggcctttccctctgtgccagcttctccgtccctgctg

SEQ ID NO: 6870080 - DNA, 106 bp, Homo sapiens
aaaatatgtgtgtgcatgtgtgtgtatgtgtatgagatatagatatagatatagatatagatcattgatacttgcatcatactttacattttataaggcatatttt

SEQ ID NO: 6870081 - DNA, 60 bp, Homo sapiens
caaacacagacatagtgattacaggagccaggtaggcaactgaaatcagtctagtgggtg

SEQ ID NO: 6870082 - DNA, 102 bp, Homo sapiens
tttctagttatggcactttggacacattatttatcttctctgtgcttcagatatcccattgtaaagtggagataataatagtgaccagcaacataatagaaa

SEQ ID NO: 6870083 - DNA, 69 bp, Homo sapiens
gctggcactaatgcctgctgcatcgctgacccactcagcttcagtgttttggccattagtgtgatcagc

SEQ ID NO: 6870084 - DNA, 64 bp, Homo sapiens
cccagtgctatttggacacagggaacaagggctcctctctcctcctttgttgagataaattggg

SEQ ID NO: 6870085 - DNA, 59 bp, Homo sapiens
actaagagagctatttgtctaccatttcttgggatattggagtacaaggctttagtggt

SEQ ID NO: 6870086 - DNA, 56 bp, Homo sapiens
gggtgtctgggtggctgcagggaggcttccagagtttcctgcagtcgctagcgccc

SEQ ID NO: 6870087 - DNA, 73 bp, Homo sapiens
tcttcatatgagatctccaagtcaatatcactggccaggtccctgacactggttggctgagatccataggaga

SEQ ID NO: 6870088 - DNA, 101 bp, Homo sapiens
ggtccctaagccaggtgtttggcatccttctcattcccaagcttgaaactagtagggacaagcttgtggaggtggtgccccctgcctggccctcagagacc

SEQ ID NO: 6870089 - DNA, 65 bp, Homo sapiens
gtccagattgaaatacatgtttgatttggaaagtaattaaatcttacaccgaatttaaactggat

SEQ ID NO: 6870090 - DNA, 96 bp, Homo sapiens
gcaaccctttgagacagggtctatttttatcatctttacttttcagatacaaaaactggaggcccagagaggtgaagtgacctgtctcaaggcagc

SEQ ID NO: 6870091 - DNA, 61 bp, Homo sapiens
agtgagatcatgcaatatttgtctttctgtccctgactgatttcaaatagcatgatgtcct

SEQ ID NO: 6870092 - DNA, 56 bp, Homo sapiens
gtgtttgctattaaaaagcttcttgaaatcaattagtctgagttactggcaaatac

SEQ ID NO: 6870093 - DNA, 91 bp, Homo sapiens
ctctagcttcttctgcagtatctgtaaacacccgtaagctttcctgggggaaatttgcatggtgatacacttctgctaggagagttcagag

SEQ ID NO: 6870094 - DNA, 58 bp, Homo sapiens
actcctggccatccagcctggggaagttactgcttcactttgcaaatggcacgggagt

SEQ ID NO: 6870095 - DNA, 64 bp, Homo sapiens
gttagtggtgaatggttgtgaacatctttaatcagacttttaaagatgtgagtattcatatggc

SEQ ID NO: 6870096 - DNA, 63 bp, Homo sapiens
ttctcagctgagtcctaccaataaagatctactcttcatttgagtacaaactcagcctgagag

SEQ ID NO: 6870097 - DNA, 75 bp, Homo sapiens
gggagcaggatgggagtggggtggaaagtcccttattagcctggaggctgggatgccctgaccctctggaatccc

SEQ ID NO: 6870098 - DNA, 69 bp, Homo sapiens
ctcttagtcctgtattctcaccacatttctttttacctgagaacccagaggatatgggaaagatgggag

SEQ ID NO: 6870099 - DNA, 64 bp, Homo sapiens
tgccagatgcaggaggtaaggctggaggttcgtgaccagtttggacatagctgctgctctggta

SEQ ID NO: 6870100 - DNA, 114 bp, Homo sapiens
gctctccaccctgccctgtctggctgcctcagtgtccctgcacgccctgggggggtgctcacaggtgaccctgggcagcccttggatcagagggcctgaagatgggtggggagc

SEQ ID NO: 6870101 - DNA, 81 bp, Homo sapiens
ttctctgcttaacagaaggtattcattccttcggggaacaaagtcttaaagggcctgccagctcttcatgtgagcagagaa

SEQ ID NO: 6870102 - DNA, 130 bp, Homo sapiens
aaaggttccttttccaattgtgggggttagtgagacaaagtgtatgaaaagcataaacgctgaagtgccatgttggtattgcttagcaacactttgttcacactgtcacgtattgcactgcatttccttt

SEQ ID NO: 6870103 - DNA, 56 bp, Homo sapiens
ggcaggcagaggctgagacaggagtctggtgtcctggtagccagcctgggcctgtc

SEQ ID NO: 6870104 - DNA, 60 bp, Homo sapiens
cagaagtctttctgtttcacctttaatttgaggttaagaacagtatatggaaagcttctg

SEQ ID NO: 6870105 - DNA, 73 bp, Homo sapiens
taaaatggtgagcccttgacatcgcccactgtctctgaggacatcctgggcctcagaggtgtgtcccatttta

SEQ ID NO: 6870106 - DNA, 66 bp, Homo sapiens
gattctgagctacatagtactgggtgtcaaaaggttacagagacatccctataccagctgagagtc

SEQ ID NO: 6870107 - DNA, 79 bp, Homo sapiens
ggtgaaagggcttccagctggctaaggaacttggactcattcataggtaccaaggagtcactggagataaccttctacc

SEQ ID NO: 6870108 - DNA, 61 bp, Homo sapiens
gaagattttctcctttaaatgatcccagtacatatgcatggctcttaaagaagaggatctc

SEQ ID NO: 6870109 - DNA, 70 bp, Homo sapiens
agctgccagatgacagtgctattgggctgctcctaactatgatcactccttagcctgtcctcgggtagct

SEQ ID NO: 6870110 - DNA, 66 bp, Homo sapiens
tgaaggcattgatgaaggaatccttagggccccttctagttccaaatttccacgtctatgccttta

SEQ ID NO: 6870111 - DNA, 55 bp, Homo sapiens
tgtggtgacgaccagggtggactaggggcctgtctcccattctgtctctgccaca

SEQ ID NO: 6870112 - DNA, 56 bp, Homo sapiens
ctgactgctccacaccgtccatactcctccagaggagctcggggcggagccgtcag

SEQ ID NO: 6870113 - DNA, 88 bp, Homo sapiens
ggaaaggattctgtcttggccagccatctgggctgattgcactccatccttcagccaggggagtggcgggccaggcagtttccattcc

SEQ ID NO: 6870114 - DNA, 80 bp, Homo sapiens
gaggagccaaggtatgtgtgttgtggtttgacctcctgaatcctactgagcctgaaaactttacatcccttggcattttc

SEQ ID NO: 6870115 - DNA, 65 bp, Homo sapiens
tcccttcttcctgaaagctggctcttccttcaggcaggagcatctgaacagggagaagtatagga

SEQ ID NO: 6870116 - DNA, 78 bp, Homo sapiens
tgcagtagagatatattttaatgagaaatgacttaagttatgttgtaactggtagctgattaagtatagttccctgca

SEQ ID NO: 6870117 - DNA, 70 bp, Homo sapiens
gtggtcatgtggtttcactgtaatagttaggtgctgatgtacaccttcctcagcacaaagccaagatcat

SEQ ID NO: 6870118 - DNA, 113 bp, Homo sapiens
gtgcagtgggggccaagtggactcagtccatgattctgtgacaccctgcggaaggtgcggccggcaggggctggatcaggagttgggtccctagaagaggccctcagctgcac

SEQ ID NO: 6870119 - DNA, 81 bp, Homo sapiens
tatcgagggtgcttgtgcttttaccagctccacctggggaagtaaatctcgctgagctagaaaaggaccacactcttcata

SEQ ID NO: 6870120 - DNA, 81 bp, Homo sapiens
ccttcacctttgtattttctaattggctgtcagggaggtcatttccatggctctagagattgaaaagcatatggggctggg

SEQ ID NO: 6870121 - DNA, 57 bp, Homo sapiens
cagtagcaggcactcagcacgtggcaattctccttccactgccagccttgtctactg

SEQ ID NO: 6870122 - DNA, 58 bp, Homo sapiens
cccaccacgtgctttgctggagcctttccttctttacttcagctcttaccctggtggg

SEQ ID NO: 6870123 - DNA, 61 bp, Homo sapiens
tctcagagacctgaactccctgaaacccactttcagagaacagtaaggcaggtttctgagg

SEQ ID NO: 6870124 - DNA, 58 bp, Homo sapiens
tgctgtgtgaggtgaaaaaaggacacagaaacctgtgcccttcagaacttacatagta

SEQ ID NO: 6870125 - DNA, 61 bp, Homo sapiens
ctagagctgttctgtgcactcagctttccaacattaagcaagatgtgaggacatgctctgg

SEQ ID NO: 6870126 - DNA, 56 bp, Homo sapiens
ggctttactatatggtacattttgccccagtgagtagaattcataccattgaggcc

SEQ ID NO: 6870127 - DNA, 78 bp, Homo sapiens
gggtcagcgacttgttacaggtcctagtggctgcctaaatggtcctgacctgggcctgtaacacagggtgattgaccc

SEQ ID NO: 6870128 - DNA, 72 bp, Homo sapiens
ggaggcaagtctggctccactctccaggagtttctggccaggaagcctgctgtgcagccaaatgtagcctcc

SEQ ID NO: 6870129 - DNA, 106 bp, Homo sapiens
tcccaccaaaggggcaattgatgctgatgcctgccagaagcactgcttcaagttccagtgtttacccatattagcatcaagtctgccactattcattttggaggga

SEQ ID NO: 6870130 - DNA, 67 bp, Homo sapiens
gttatttataaggtgtaactcctcactgtagcagatgttgcttgtgttagtttcagttttaggtgac

SEQ ID NO: 6870131 - DNA, 74 bp, Homo sapiens
agaatctctcattaattgccgatgagaatgcaaaagagtgcagccactttggaagacagttgatgggagtttct

SEQ ID NO: 6870132 - DNA, 62 bp, Homo sapiens
ggaactacagtatgtccaaagaatgtgaaatatatttgtaataaaagacctactgtatttcc

SEQ ID NO: 6870133 - DNA, 64 bp, Homo sapiens
tagcacttaacttgcagggatgttctgaatcttaattgaggtaagacactttgcgagtgagctg

SEQ ID NO: 6870134 - DNA, 61 bp, Homo sapiens
aacattctttagctcttcctgcacttcctcaccgtgtaggctccatgatggcagagatgtt

SEQ ID NO: 6870135 - DNA, 84 bp, Homo sapiens
gacctggagtgcatcaggatctgaccagataggagtttttgcctcgtgtctgggtgctacgattttgtgccgttctctgaggtc

SEQ ID NO: 6870136 - DNA, 58 bp, Homo sapiens
ggttggtgctgctcacatctggaggtaaacaagaattgcttgtgagcacgtatcatcc

SEQ ID NO: 6870137 - DNA, 69 bp, Homo sapiens
agtgatgctagctctgggcacacatgagctcagcttaatcctcatgacaacctgtgagctggtatgatt

SEQ ID NO: 6870138 - DNA, 63 bp, Homo sapiens
caatctggcaaattaattgaagctaactttagatgatgtcagttagattgcctccttagattg

SEQ ID NO: 6870139 - DNA, 60 bp, Homo sapiens
ggcgttgtgagcttggtagacacttgtggctggcaagtggaagagccatgttccaacccc

SEQ ID NO: 6870140 - DNA, 63 bp, Homo sapiens
gagaaagattgtccttcaggggacatgacatcaataggtttctggaatgagggactctttctc

SEQ ID NO: 6870141 - DNA, 61 bp, Homo sapiens
cgtgggagggaggaagggaggcttccttgggagtgaaggatgccccgtgtcttcctgagcg

SEQ ID NO: 6870142 - DNA, 88 bp, Homo sapiens
ctcccgtccaaattagattggttactcaatttgactgagtgcttagaaattagtcaataaggcaactaattaataatttgactggggg

SEQ ID NO: 6870143 - DNA, 88 bp, Homo sapiens
attttaaatttgagcctttatagttggtagcagtttatataaagtctccattagctgatataaaattacagaggagcagttttgaaat

SEQ ID NO: 6870144 - DNA, 113 bp, Homo sapiens
ggccattttcacaatcaacatagatacacaaggacactttgtggttgttgatagtccacaaaactacatacaattgcggtgtttttatgtctcttttcttttcttttttggct

SEQ ID NO: 6870145 - DNA, 59 bp, Homo sapiens
ttggagatggttcagaattataaagattatctgaatctttatctgtgagcagtctccaa

SEQ ID NO: 6870146 - DNA, 124 bp, Homo sapiens
gtttttatcagatccctgcctatggattatagagtactgcctcagttatgaataaagtggcatttgtttctcatttaggtagtgttttcctgttcatagctgttgggaccctgtgagtagagat

SEQ ID NO: 6870147 - DNA, 60 bp, Homo sapiens
ccgcctgcccagcgcggccattgtccggggctccagaggggctgtgttcagggcatgcgg

SEQ ID NO: 6870148 - DNA, 74 bp, Homo sapiens
cttgcaccctcacccaggctggaatgcaatggcgcgatctcggctcactgcaacctccgcctcgtaggttcaag

SEQ ID NO: 6870149 - DNA, 82 bp, Homo sapiens
aattccagtggcacacagtggcatcactcttgacgatccaccctacatcacctgctttgatgtcctggtgcttcttgggatt

SEQ ID NO: 6870150 - DNA, 94 bp, Homo sapiens
cgctggcaggttcaggctcaggagtgagatgcgatcacttgtcgagaaactgagaagtcacgtgtgtttcatccatgagactgtgatgcgagtg

SEQ ID NO: 6870151 - DNA, 80 bp, Homo sapiens
ggttctgctgtgtttgcaatgggaatgagagaagcagcgagcacaacctctctcaccctcagcagcaggctcagagcacc

SEQ ID NO: 6870152 - DNA, 63 bp, Homo sapiens
gagaagtctggaatggatcctcccctcacagccctcagaaggaaccaagccagccagcctctc

SEQ ID NO: 6870153 - DNA, 56 bp, Homo sapiens
ttcttaagcagtttggcatgtttacgtttcaaaactcggtcaagcttctttaagaa

SEQ ID NO: 6870154 - DNA, 64 bp, Homo sapiens
cctagggcctttcttgtcatggggctgaaatgaaccctcagctctcagacagggaggctctggg

SEQ ID NO: 6870155 - DNA, 129 bp, Homo sapiens
agagtttgacttacaactcagccattctctgctacttatataagagcaaagtcatgtcaaaaaagaagccaaaatgaaacggaatgttctttatcgcaagaatgactgaagtttcgccaattaaacttt

SEQ ID NO: 6870156 - DNA, 63 bp, Homo sapiens
tggctaaacatgacttaaagtgagcatttgcatggtatttcctttagtggttagtttaggcca

SEQ ID NO: 6870157 - DNA, 65 bp, Homo sapiens
gactggatcctttgcttggtagagattacatattaatgtcttgtgagagctggagagatgtggtt

SEQ ID NO: 6870158 - DNA, 56 bp, Homo sapiens
ggaggttttgtaagtgctcctcatttatgaaaattttgcagcacttgaaaatttct

SEQ ID NO: 6870159 - DNA, 71 bp, Homo sapiens
tggaaatgctgacagactattaactatagcagcactgctctaataaatggaatggcctgtcataatctcta

SEQ ID NO: 6870160 - DNA, 59 bp, Homo sapiens
ttcaaaaaggtatgttcaagtcctgacccccagtacctctgaatatgaccttatttgga

SEQ ID NO: 6870161 - DNA, 59 bp, Homo sapiens
gtaattcagacagttatttacttacctgttagtgaaaagtcttatattgtctgaattgc

SEQ ID NO: 6870162 - DNA, 93 bp, Homo sapiens
atttcaaaacatggcttttccaggcagcaaattttctgaatgtatcgcaaaagaagataaattgcatgtctatgtagatcatgtcaatgaaat

SEQ ID NO: 6870163 - DNA, 64 bp, Homo sapiens
agatggtaggtaacacatggaacatttacatgtttatgtaaatgaagtatgctttactttatct

SEQ ID NO: 6870164 - DNA, 89 bp, Homo sapiens
gattacatttcagttaattgggagtgaaagcgttgtgatcaagagtgagaacaatgcgtattttactccaatctagcttaagcctaatc

SEQ ID NO: 6870165 - DNA, 67 bp, Homo sapiens
tcctgtggttccctgagaatgcattcctagaagaatggggcatcctccatataggtgaatagcagga

SEQ ID NO: 6870166 - DNA, 82 bp, Homo sapiens
gtgtgagccatgatgtgtccagagctccccacataggatcgagttacctctgggaggatatggtacataatatggcatccac

SEQ ID NO: 6870167 - DNA, 75 bp, Homo sapiens
tcagctggatgatagctacttatcttccaagacttacattttctccaggaagatttcagttaagtatctatctga

SEQ ID NO: 6870168 - DNA, 62 bp, Homo sapiens
aaaagctctggtttggagcatttgatgatttccctggtataaacactcccaccaaagctttt

SEQ ID NO: 6870169 - DNA, 61 bp, Homo sapiens
gatcttagtcccatagcccaacttacaattatgccagttaggacacttgagggctaacatc

SEQ ID NO: 6870170 - DNA, 129 bp, Homo sapiens
ttcactgggcagttgggtatatgggcctggagctcagggagaagtctggtcagtcctaagctgtggcttggggctgcctgagcatctcctcctgcagatctggcctaatgctcagaggagaccagagag

SEQ ID NO: 6870171 - DNA, 67 bp, Homo sapiens
cttgagtgtgagtgtatgtgtgtgcgtgtgcgtgtgcgtgtgcgtgtgcgtgtgcatggccttcggg

SEQ ID NO: 6870172 - DNA, 72 bp, Homo sapiens
acatcatctggtgctaacaaatgtggaacacttcactgagtactctgaacattttttgcagcctatgattgt

SEQ ID NO: 6870173 - DNA, 106 bp, Homo sapiens
aagccggagtgctcgttgtcaacatattaattatgttctctgtttccacaggcttttcaggaggatttaatcagttggcatttatgagcctattttgaaaatgctt

SEQ ID NO: 6870174 - DNA, 69 bp, Homo sapiens
gggcgaggcgcaggagaggggagcccaggtttggatttgtcaaacttgagtcacttctcttccctcccc

SEQ ID NO: 6870175 - DNA, 70 bp, Homo sapiens
ttctgttagaaggtatgataggaaggaaacaacaggtgtagatccttatatctatagttttgcagcagga

SEQ ID NO: 6870176 - DNA, 59 bp, Homo sapiens
tgtgaaatttctctgagagttccttaacatttaaaggaatttcagtatgaagtttcaca

SEQ ID NO: 6870177 - DNA, 89 bp, Homo sapiens
gggcaggatgctgtggccactggctgcgatcttggcgcttcacaagctggagccgtcaggccctgagccactcggccgcgcagatgcct

SEQ ID NO: 6870178 - DNA, 110 bp, Homo sapiens
gcccatttcaattggtgatgtttatataaagataacttttcttcatgggatattttgtgataaagctatttttaattctgtttgactctcttttgaaattctcctggagc

SEQ ID NO: 6870179 - DNA, 61 bp, Homo sapiens
tggctgagtgatatttgcaaagagttccagcctaatatctctttttgtaaatcagcagtca

SEQ ID NO: 6870180 - DNA, 60 bp, Homo sapiens
tagaatcattgagaataacaggcttgtatgtgtctggtgatattttcagtgatcattctg

SEQ ID NO: 6870181 - DNA, 82 bp, Homo sapiens
atggtcttgatctcctcaccttgtgatcctcttgccttggcctcccaaagtgctgggattacaggcctgagtcaagatacat

SEQ ID NO: 6870182 - DNA, 77 bp, Homo sapiens
ggcttcacatataaatacagaggggtcacaattcactccataatgggtggatttgctaccttctgatatgaagggcc

SEQ ID NO: 6870183 - DNA, 78 bp, Homo sapiens
acgtgtgtgcatttgtgcatgcacatgtgtgtgcctattcatttgcatgtgttttgcatgcatcatgtgcacgcatgt

SEQ ID NO: 6870184 - DNA, 91 bp, Homo sapiens
cattttagtctttttatggttttatttatgttgagtcagtgagacaattcgcatgattcagattataaaaagtatgaaaggacttagagtg

SEQ ID NO: 6870185 - DNA, 83 bp, Homo sapiens
ccaggatagtttaaacagttttgaaatgaaagaaccaagtttgaatacttagattttctgattttaaaactgtaaaactatgg

SEQ ID NO: 6870186 - DNA, 83 bp, Homo sapiens
ggagtctcgctctgtcgcccaggctggagtgcagtgatctcggctcactgcaacctccatcttctgggttcaagcgattctcc

SEQ ID NO: 6870187 - DNA, 74 bp, Homo sapiens
tctgaacctgaggccagcttcagcagtggacaaagttgcagctccattccaggcacagagttggtcagttcaga

SEQ ID NO: 6870188 - DNA, 129 bp, Homo sapiens
cttcactacattctggaagcatatggtgtttggtaacagttacagtaacagtaatggtagttctgtatatatgtagctgtatatacattattttgtgttactttgatgtggggtaattggaataagtag

SEQ ID NO: 6870189 - DNA, 62 bp, Homo sapiens
aagcttattttggcaggatgtgcaaaaacacaaactacatgcctggccaatctgatagggtt

SEQ ID NO: 6870190 - DNA, 58 bp, Homo sapiens
acacacacaatacaggttgattcaaaagtcctgttttgccaaccatgaactgtggtgt

SEQ ID NO: 6870191 - DNA, 67 bp, Homo sapiens
ccaaaggcttgctgtgctggcttctaaaattgacccgaattatcagcagcccaatggcaagctctgg

SEQ ID NO: 6870192 - DNA, 78 bp, Homo sapiens
caaatgtttaagtttacagtgtcttgttgactgtacacgcaacattgtacagcagatctgtggagcttattcatcttg

SEQ ID NO: 6870193 - DNA, 60 bp, Homo sapiens
cactgaagtttcttatttcaactggaacattcttcttgaatgtgtgtgataggatcagtg

SEQ ID NO: 6870194 - DNA, 69 bp, Homo sapiens
gggagcatttccctgtgttgaaccattgacctacctctaaatgtactgtcagggcagtgggaggttcct

SEQ ID NO: 6870195 - DNA, 70 bp, Homo sapiens
tgctcaggcttttatgaatttcagtgttagtggcaagtttatcactccagtatctgtgaaagccactgca

SEQ ID NO: 6870196 - DNA, 55 bp, Homo sapiens
tgtcacagagcgtgcaacagaagggcctctccccaagatgcatgcgtctgtgata

SEQ ID NO: 6870197 - DNA, 69 bp, Homo sapiens
atcgtctgatgatggggccataacagcctggacactgatcacaggtgtgtgccttatcaaatgggtgat

SEQ ID NO: 6870198 - DNA, 100 bp, Homo sapiens
ctctgtttactctgcattgtcaattatgaggtagatatcacatgtgtttagccgaaaagataatgcacagtatctcataacagtgtagaacaagacgggg

SEQ ID NO: 6870199 - DNA, 65 bp, Homo sapiens
cccaaagtcctttccagtcctgtgattctcacactaatgaattgaaacagaaaaggattattggg

SEQ ID NO: 6870200 - DNA, 73 bp, Homo sapiens
cattgttctacctggaatagagtctctccagtcctctgcttgactggatttaggatgctcaggctgaagaatg

SEQ ID NO: 6870201 - DNA, 55 bp, Homo sapiens
ggtggctcacgcctgtaatcccagcactttgggaggccaaggtgggcggatcact

SEQ ID NO: 6870202 - DNA, 63 bp, Homo sapiens
ggtctaaggtcaggggaaagtttgggcacagaggcctgaagcgtgacccctcacctctgcgcc

SEQ ID NO: 6870203 - DNA, 97 bp, Homo sapiens
aaagggcactggtcttactttatatgcacatctaagattctctaaggaatcctctgagcattttaggtggtatctgcaggtttcgctttgcaccttt

SEQ ID NO: 6870204 - DNA, 80 bp, Homo sapiens
catgtgttattcatagaaagtgcttagattggtgcctgacacttagctaatatttactgagcacttcctgtgatattatg

SEQ ID NO: 6870205 - DNA, 57 bp, Homo sapiens
gggagcccctcccagcccgagtcctcatcgtatcctcggagctgggcagggcatccc

SEQ ID NO: 6870206 - DNA, 71 bp, Homo sapiens
ctgtgctgggctctggagttctagaaagaagaggaatccctctctctgggaattcacaagccctctaatag

SEQ ID NO: 6870207 - DNA, 65 bp, Homo sapiens
gtaattgaacattaagttgaaggaccagacccagaaaaaattctttcagcttatgtgtcacttgc

SEQ ID NO: 6870208 - DNA, 128 bp, Homo sapiens
ttcagtgatgtcagaagtggtggtgactggtttatttgtttttccgtcttagagatgtttactgttactctgaggtgtcacaaggccaggctaaccaggaacaacccttgcttaatattgtcatagaa

SEQ ID NO: 6870209 - DNA, 73 bp, Homo sapiens
gttattttgttctttttgtatatagaaacatttagtaagtatttactggattccattgtgcaaagagcatagc

SEQ ID NO: 6870210 - DNA, 71 bp, Homo sapiens
gtttgctaatgcctctgaaatcacaactttagctccatgtaaggctgctctgatagaagaggcttagaaat

SEQ ID NO: 6870211 - DNA, 74 bp, Homo sapiens
gagggctggggctgtgaggtgagaacttacctggcattgggactgccaggtacatccccaaagccacgcccctc

SEQ ID NO: 6870212 - DNA, 129 bp, Homo sapiens
ttttagtaaactatttttaaatatatgattcagtcagttttgattcctggttctcagtttggttgtggacatgtggcattaaaacatattttggttttattttatttcttagatagatcagcttaaata

SEQ ID NO: 6870213 - DNA, 75 bp, Homo sapiens
ctgcagcttgtctgctgcctggagccttttgtttctcagggaacatggagctgcctggcagtgggggagccctag

SEQ ID NO: 6870214 - DNA, 61 bp, Homo sapiens
cacagtagtattttagaaaaccatgaattctacaagatagattttatagactgctactgtg

SEQ ID NO: 6870215 - DNA, 98 bp, Homo sapiens
ctggtgtcagacaggaagcctaagcgcaggtatcactgaggaggatacacatgctaactacacgatcttcaccagacctgtgagcttccagccaccag

SEQ ID NO: 6870216 - DNA, 83 bp, Homo sapiens
tctagtcagtgttagtgtatgtctaacatacactagtctagtctagttagtgtatgtcaagtatatacactaactttggatga

SEQ ID NO: 6870217 - DNA, 60 bp, Homo sapiens
tttctgaaatctcttttgaggaactcacgttacttacaattatagaaggagattcagaaa

SEQ ID NO: 6870218 - DNA, 65 bp, Homo sapiens
agtgtgggccacgcagctgagcaaggacacatggtgacatggctgagtgttgctgaggcccagct

SEQ ID NO: 6870219 - DNA, 57 bp, Homo sapiens
ttgcagggtacattcttagaataggattgctggttcaaagaaaatgtgcttttgtaa

SEQ ID NO: 6870220 - DNA, 61 bp, Homo sapiens
cgcagtgtatttcaatggctgaagtggttaccgcttccagccatgcatgacaatcactgtg

SEQ ID NO: 6870221 - DNA, 102 bp, Homo sapiens
gctcttgtcgcccaggctggagtgcaatggcttgatcttggctcactacaacctcagtctcccaggttcaagcgattctcctgcctcagcctcccgagtagc

SEQ ID NO: 6870222 - DNA, 74 bp, Homo sapiens
ccatggtggctcatgactgtaagctcagggctttgggaggattgcttaaggccagcagtttgagaccagcatgg

SEQ ID NO: 6870223 - DNA, 83 bp, Homo sapiens
taggaaggagcaaaggccaagttagaagaggatacctgcctcctgactccttggggggctctctttttggcctgccctaccta

SEQ ID NO: 6870224 - DNA, 55 bp, Homo sapiens
agggacctgctcactgcctggcttcagccacctgaggccaggtaccaggtaccct

SEQ ID NO: 6870225 - DNA, 105 bp, Homo sapiens
tgttggaattttaactgttcaaactagttaaaagtcagaaatagtcaattcctatttggattgcttctaacgtttaactagtttgaatagttgtctgtgatgata

SEQ ID NO: 6870226 - DNA, 117 bp, Homo sapiens
tttttctgcaatacttagtttcattttcttgggttttctattgtctttggaaagtgatgtgaaggagaataagatggaaagtgcatggaagtcatgagatagagtttaaagggagaa

SEQ ID NO: 6870227 - DNA, 61 bp, Homo sapiens
tttgcattttctagctagtttacttgggaagagagctgagtaaaggctttagaatggcaaa

SEQ ID NO: 6870228 - DNA, 83 bp, Homo sapiens
gaattctgtatcacttcctagatacgagattgaaaataggccttttttcatgttggcatgtttttaggaggtagttggaattc

SEQ ID NO: 6870229 - DNA, 97 bp, Homo sapiens
aggtcaaggaggtctgctgggtgaggaagctttctggttacttcccaaggggctaggccaggctcttccatttgggtccagtttctacctccttcct

SEQ ID NO: 6870230 - DNA, 56 bp, Homo sapiens
tttccatcagtggagagcattataagacgtgagctttagaaatatcactgtggaaa

SEQ ID NO: 6870231 - DNA, 64 bp, Homo sapiens
ggagaacaggatgtcatttctcatgtcctgaaatggacaaaggagaaaaaacatacctagcttc

SEQ ID NO: 6870232 - DNA, 59 bp, Homo sapiens
taaaatatgcatttgtcagtatgaacaaactgaaataaatgtgacaaaggcatatttta

SEQ ID NO: 6870233 - DNA, 77 bp, Homo sapiens
gcttgcagagcagagaaagtctattcaggtgaaaaatggttcatttttgactcattgattttctctgctcattgagt

SEQ ID NO: 6870234 - DNA, 61 bp, Homo sapiens
ttttctggtagagtctgtgtgtgaaaatgtgccagctacacatggagactctaccagaaaa

SEQ ID NO: 6870235 - DNA, 68 bp, Homo sapiens
ctgtaatcccagctactcaggaagttgaggcaagagaatcgcttgaatctgggaggcggagattgcag

SEQ ID NO: 6870236 - DNA, 74 bp, Homo sapiens
tatgtaaatgtacttatgacagaattatgctaaatttaaaatgcagtatgcaaatgtcataagcatgttttgta

SEQ ID NO: 6870237 - DNA, 75 bp, Homo sapiens
tttttggcttgcagactgttattttaataggaatgtgttaaatatccatttgaaagaacagtccagagatagaaa

SEQ ID NO: 6870238 - DNA, 59 bp, Homo sapiens
catgtgtggtctgtggctatcttgtctcacaggctgctgatgccacacgatctcacatg

SEQ ID NO: 6870239 - DNA, 76 bp, Homo sapiens
agatgttctggtgccctctggctctactcccctctttaaggggcttgaggggcagtggggagagggcaaggcatct

SEQ ID NO: 6870240 - DNA, 72 bp, Homo sapiens
ggaactttgggtcttgtttaactgtcgttagttggtcaaccagctgtctaagttgagcaggaaagtgaggcc

SEQ ID NO: 6870241 - DNA, 81 bp, Homo sapiens
cttagcttgtgtcaggagagatcaggacagcactggggtagtgaagccatctgcatgttctgaatcttttctgcagctgag

SEQ ID NO: 6870242 - DNA, 68 bp, Homo sapiens
aaaggagaaaacatgatatcctaaaaagatcgttgtggcaaggatttttatcatgtttctagaccttt

SEQ ID NO: 6870243 - DNA, 61 bp, Homo sapiens
actagtggctgctgtgggtagagggatgcagaggcaggactcttctaatagtgttttaagt

SEQ ID NO: 6870244 - DNA, 60 bp, Homo sapiens
gatcacatgaatggaatagaaggttgaataataacatttcatttcccagtcgtgctgatc

SEQ ID NO: 6870245 - DNA, 62 bp, Homo sapiens
gctatgaaggagaggaaggttttgatgaagagagtcttctctaattcgcctccctttagagc

SEQ ID NO: 6870246 - DNA, 78 bp, Homo sapiens
ctgtgagaacccatcttgctgagattgtcgctggcagatttacttccagtgtgattgttgcaagaatttgtctaacag

SEQ ID NO: 6870247 - DNA, 69 bp, Homo sapiens
ttattcttttctccagaatcccagcctagccagaatccccaggcctcccacttcttgaggagagattag

SEQ ID NO: 6870248 - DNA, 55 bp, Homo sapiens
gcagtggtaataaagaggccttgaaaaattgtttttgtctataaattactactgc

SEQ ID NO: 6870249 - DNA, 57 bp, Homo sapiens
cccagggcacggagaagtcaccccccgggccgggggatgtgtgaatctggccctcgg

SEQ ID NO: 6870250 - DNA, 81 bp, Homo sapiens
gacaacttttaagaaaaattcacagtcaataggctcttttctgagagcctgtgggaggttctgtgagtcctctatagtttc

SEQ ID NO: 6870251 - DNA, 88 bp, Homo sapiens
tctcacattgggcctacatctggtctcctggaaatatgcccatatcctttgtctggacaatcctgagacagacccagcccaatgcaga

SEQ ID NO: 6870252 - DNA, 62 bp, Homo sapiens
ttgggcagttagccttgacccatatcttttaggggtcatcttcctagtgttaactaccccaa

SEQ ID NO: 6870253 - DNA, 55 bp, Homo sapiens
ggctgtgtatctctgtgggacagaaaatgaattttttgcctttgaggtaacagtc

SEQ ID NO: 6870254 - DNA, 94 bp, Homo sapiens
ctggcctgggtccccggtgcactcacccggtccttcccagtcctggacctcaacgtggactgggccaggtgtgggtgagtggagggacggccag

SEQ ID NO: 6870255 - DNA, 63 bp, Homo sapiens
cctctaaattgtttgaagttggtcccagcagcataaaatgggttggccccaaagggttggagg

SEQ ID NO: 6870256 - DNA, 87 bp, Homo sapiens
aaagcatccaatcacacccttcctcaacctctcacaccaagggggagcatctcctggaagccagagttgaggaggggagcatgcttt

SEQ ID NO: 6870257 - DNA, 68 bp, Homo sapiens
tctccttgtgctgggtccttccagtgccatgagttgggattcttgatgggcttagaaagcaagtggga

SEQ ID NO: 6870258 - DNA, 63 bp, Homo sapiens
tcacctgagagagtgagccctgacaccctcccctctgagtgtccccagctaactcttcagtga

SEQ ID NO: 6870259 - DNA, 77 bp, Homo sapiens
gttgatttgttgtgcactgacattttgacaactggttctcaatttgtctgtcgtagttaggcaacaacaaagccgac

SEQ ID NO: 6870260 - DNA, 108 bp, Homo sapiens
tggagtcgacaaagtagtggaacttcctcttgaacacgtccagggtgtggcccaggacctggcggtagtcggccttgccctgggcgatcaggttcagctgcttctcca

SEQ ID NO: 6870261 - DNA, 55 bp, Homo sapiens
gcagctgcaataggcatcaagctatgaaaagctctgaggagcactattgcagtgc

SEQ ID NO: 6870262 - DNA, 120 bp, Homo sapiens
ggcgcgggcgtgctgccacactcctggagctggctttgtgaacactgcgcagaactttcagagttggtggggtctttcgtcatcagtgggaaacaggacgtggtgcaggtcatgggtgcc

SEQ ID NO: 6870263 - DNA, 87 bp, Homo sapiens
ccacctgtgagcacccccacctgtgggctcctgcactgaaccccttgaaggtgggatgggaggacaggtgggagtaaggacagatgg

SEQ ID NO: 6870264 - DNA, 71 bp, Homo sapiens
ggcaacttgtgctggagccccaggctgtgcagacagagcccttctccacagaaggttccaggccggtggct

SEQ ID NO: 6870265 - DNA, 65 bp, Homo sapiens
tttctgcacatttctaaagttgaaaggaatgagtctatcatcccaaagtgagagaatggcagaaa

SEQ ID NO: 6870266 - DNA, 65 bp, Homo sapiens
ggactgagctgacatctgttggctaccagtactcccaccagctaggggaatgtgagcctcagtcc

SEQ ID NO: 6870267 - DNA, 98 bp, Homo sapiens
ggtgcagatgcagcaaggaatctgtccagtcatctcgggatgtccttgaggaccaaaggaaatctgggctggcacaggttgatttgtagctggtcatc

SEQ ID NO: 6870268 - DNA, 100 bp, Homo sapiens
gtcatcttgatccatggcccctgctatcctgcaccatgaatgcagggagcccagaatcccagcagcaaggtgagggtggaggtggttgggtgggggagac

SEQ ID NO: 6870269 - DNA, 56 bp, Homo sapiens
tatacacaaacaaggggttaagttcagagactataatcctattttgtgtgtgtatg

SEQ ID NO: 6870270 - DNA, 58 bp, Homo sapiens
cttttaaaaatggcaaacttcttccttctaaaaggaggaactgcttcatttttgaaag

SEQ ID NO: 6870271 - DNA, 69 bp, Homo sapiens
ttaagatttgggaggcaggccctctccagcttcagtttgcaggagtggcacccttttccctacccttga

SEQ ID NO: 6870272 - DNA, 81 bp, Homo sapiens
tctgtctctccctaggtggggctggaagtgtgccctcctgtctgcccctgacatccagcaccaccacagggaagatgcaga

SEQ ID NO: 6870273 - DNA, 70 bp, Homo sapiens
tcttcttgtagcttttatccactgcttttggttttgtatctagatctaggtatatgaaagcatattaaga

SEQ ID NO: 6870274 - DNA, 78 bp, Homo sapiens
tgatgattacactgagttaggcccctgctgatggcagcactcctgctgcagcggcatggtctttggggataatattca

SEQ ID NO: 6870275 - DNA, 67 bp, Homo sapiens
atgcatgcacacactgcattgcacccttggtttttatttagttccagtaatgtaggatggcctgtat

SEQ ID NO: 6870276 - DNA, 80 bp, Homo sapiens
aggagtcagcaaatttttttagtaaaagaccacatattaaatattttaggttttgcaggctatcctttgctgcaacttct

SEQ ID NO: 6870277 - DNA, 67 bp, Homo sapiens
gattgctttattgggtttactgccttgtttgcaaacaagacggttcgtaaacttagtgagtgccatt

SEQ ID NO: 6870278 - DNA, 86 bp, Homo sapiens
ttgttgcagaagtctaagacttcctaagattcaggaatgttagggcatctctttcatacccatctctaggagtgagtttgtaacaa

SEQ ID NO: 6870279 - DNA, 63 bp, Homo sapiens
gccaaattctagaaggcaaagcaagggaaggaagactttgcttgctgtaccattctgaatggc

SEQ ID NO: 6870280 - DNA, 68 bp, Homo sapiens
tcttctacccaatggcactgcccaaagagaaaaagacaagcattttgctttgtgcctttgggtggaga

SEQ ID NO: 6870281 - DNA, 62 bp, Homo sapiens
tccagagcctggggtttgtaacattgaagaaaaagaatacaaatcccctcaggctccctgga

SEQ ID NO: 6870282 - DNA, 84 bp, Homo sapiens
cagctgtccagagaagaaatctgagctgtgagttgcttaggatgagggtttgttcagtctatccagctcagatccttgcagctg

SEQ ID NO: 6870283 - DNA, 105 bp, Homo sapiens
ggcacaggcagcttcactggagaattctatgaaatatttaaaggataaataatgtcaatattccatgaactctttgaggaaacagtgaaagaagtaacacttgcc

SEQ ID NO: 6870284 - DNA, 74 bp, Homo sapiens
ggaaaagcaatggatgagaatctgtctgttcaatgcaatattttcctacagagataacaaccaattgcatttcc

SEQ ID NO: 6870285 - DNA, 79 bp, Homo sapiens
ggcctttgttttgtggcctcaaggctgccctcacttagaaaggatgagtgacggtagcagaagccagccaagcagggcc

SEQ ID NO: 6870286 - DNA, 101 bp, Homo sapiens
gcccctttcttggccacatcatattttaacagagtaaagatgcatatgtctttgagcattagatttgcctttgaagcatggtgaggctatggtaggccggc

SEQ ID NO: 6870287 - DNA, 83 bp, Homo sapiens
gctggctcagagtcacattaatttaattttatctgtgatccacatcagcctagaatgctattaattcggatttgactgccagc

SEQ ID NO: 6870288 - DNA, 81 bp, Homo sapiens
tatagcagcattattcattagagtcaaaaagtggaaacaaatgtccatcagctgatgaatggatgaataaaatgtggtata

SEQ ID NO: 6870289 - DNA, 85 bp, Homo sapiens
tgtctcatcattagctatttgggcaggtggatgttgatacaggttattcttaggcatcagtgccccatggctaatgctgtaggca

SEQ ID NO: 6870290 - DNA, 94 bp, Homo sapiens
tttcacagtaatttttatcatatgtcactcatgggcatatatgtgtgtctgtgtgtgtgtgtgtgtgtgtgtgtgtaagaaatactaagtgaaa

SEQ ID NO: 6870291 - DNA, 60 bp, Homo sapiens
tggcaactactaatcatttaacttttggttgtaagggcttagatgtttagaagtgggcca

SEQ ID NO: 6870292 - DNA, 56 bp, Homo sapiens
ggttcagccccatttcctggcagtgcagctcgcgcattccccaggaggctgacacc

SEQ ID NO: 6870293 - DNA, 110 bp, Homo sapiens
ctagttgtgtttgagtgccattagaatgtaaattccaagggcaggacatttctgcctgttttgtttctgcttttgtttgttatattcccagcacctaaaaccacacctag

SEQ ID NO: 6870294 - DNA, 58 bp, Homo sapiens
gaaggcctgttggcgtgggctctagagcgctggctccgacaccaacaggcatgacttc

SEQ ID NO: 6870295 - DNA, 85 bp, Homo sapiens
gaggggccggaggcaatgaggtggtccagagtaggaagtgaagggtgttctaacacaacccatggtgggcccctgtctccccttt

SEQ ID NO: 6870296 - DNA, 57 bp, Homo sapiens
gctccgtgacactttcttcatgccctccttgctggcaatacaagactggtcatgagc

SEQ ID NO: 6870297 - DNA, 55 bp, Homo sapiens
aacatctctctcacttcttttctgttgacttcaatatggcagtggaggggtagtt

SEQ ID NO: 6870298 - DNA, 76 bp, Homo sapiens
cgttgggagtttgcatagacaatattaatcttcacaaaccttctgtaaggtagatgttgtcatgcccattttaatg

SEQ ID NO: 6870299 - DNA, 81 bp, Homo sapiens
ctctttgtttcaacaaattcatatcgcagttcctgaattttaaaaagtgctgtgcaaatcgatttgttggctgataaaaag

SEQ ID NO: 6870300 - DNA, 103 bp, Homo sapiens
attaggagattgtcttggggtagttatcagtatgacaccagaggcaaagacactagaagctgttggaattaaaaggagaacttctcatgagcaatatcctaat

SEQ ID NO: 6870301 - DNA, 63 bp, Homo sapiens
gcatttctggcaaagcctgttggtttaattcagatgttaaatattttcagcagggtcaagtgc

SEQ ID NO: 6870302 - DNA, 61 bp, Homo sapiens
agtaatggctttggtctgggtcccagtataggcagtgtgggataggagtagagctgtggct

SEQ ID NO: 6870303 - DNA, 62 bp, Homo sapiens
tgatagtgagtcatagctgagttttcgtcagtttacccaattgaccagctgtctcattttca

SEQ ID NO: 6870304 - DNA, 84 bp, Homo sapiens
tggttcagggccttcagggcctggagtcagggaaagcaaggctggaccctggctgtgcctctttccaggccagggccttgtcca

SEQ ID NO: 6870305 - DNA, 129 bp, Homo sapiens
agatattttttttgtttcggatgtctgccctatgcagtgtacgatgtttagtagcatctctggcctccactcactaaatgtcagtagcacatgcaccacccagtcacttgtgacaagaaaaaaatatct

SEQ ID NO: 6870306 - DNA, 82 bp, Homo sapiens
gcctatcagactgtgagatccttgagggcaagaactatatgttatttatctttgcagctcagtggtcggcacagtttgtggc

SEQ ID NO: 6870307 - DNA, 56 bp, Homo sapiens
gggaagacttcctgggcttaaggatttccttaagtgcttcaagggaagctcatcct

SEQ ID NO: 6870308 - DNA, 55 bp, Homo sapiens
agtggctcctgcctgcaatcccagcactttagaaggctgaggcaggtggatcatt

SEQ ID NO: 6870309 - DNA, 62 bp, Homo sapiens
tgagggtatatattgtgtggagtgatcaaatgtaacctctcaaatactgggttatgccctca

SEQ ID NO: 6870310 - DNA, 63 bp, Homo sapiens
gcctgcttcacggacaggcctcttataggcatagatgacgaggggtctgtccgtgacagtggc

SEQ ID NO: 6870311 - DNA, 89 bp, Homo sapiens
tttttttgttctttctaaacatcataggcatgcatgatttgtatagcaaaaatcaaaatgctccagtgatggtgatgagaatttggaag

SEQ ID NO: 6870312 - DNA, 79 bp, Homo sapiens
agcttctcagcgcaggtgcccatgagctccatggcgatgaagacgtccgtctgcagggagaggggcacccgggggagct

SEQ ID NO: 6870313 - DNA, 83 bp, Homo sapiens
gtgtcttaactggattattgtaagacaaagtatgcacttttcatgtcgtattagtattttgttaataatccagtccatgatat

SEQ ID NO: 6870314 - DNA, 95 bp, Homo sapiens
ggagctgggaggaggtgctgactgccaggactgacgtcttcagactgattcgtctaagctcggccagcccctgccctgcttcctcttccacctcc

SEQ ID NO: 6870315 - DNA, 86 bp, Homo sapiens
gggctttatcttcctggcttcatactttgtacccatcctgttgcatgaatgtacgttgtagagtcatgatatgcggtgtatagctc

SEQ ID NO: 6870316 - DNA, 85 bp, Homo sapiens
ggagaatcggttgaacccaggaagtggaggtggcaataagctgagatcataccactgcactgcctgggtaacagagcaagactcc

SEQ ID NO: 6870317 - DNA, 76 bp, Homo sapiens
ccgtgtgctttggttttacaggatgtcaggagagctgcagagccatgtgagcatctgtaagtagcagagcccaggg

SEQ ID NO: 6870318 - DNA, 80 bp, Homo sapiens
ggactctgagaatataagactatttctgttcataaggagttattttttccccaagaaaagtcttttcctagggtaacccc

SEQ ID NO: 6870319 - DNA, 58 bp, Homo sapiens
gaactacatgtgtgttgccatgatgtttctcttgtccaggcctttgcacatgttgttc

SEQ ID NO: 6870320 - DNA, 75 bp, Homo sapiens
ctgtggcaggcaagttcatttccaggcagctgagtgtctgccccgtgctggcaactgtgtgccccagtgccacag

SEQ ID NO: 6870321 - DNA, 103 bp, Homo sapiens
gaaagtggaaagtaaatagatggaaagtcgtgaaggcccggaaccaggaaatggaaggtcaaggtcaccaggcaactatgtactccatcttgctcttcttttc

SEQ ID NO: 6870322 - DNA, 57 bp, Homo sapiens
ctggtggctacaaggtggctattctagattccctgtgtctggatggtgtggccgcag

SEQ ID NO: 6870323 - DNA, 56 bp, Homo sapiens
tcagggagggacctgaggctggaggcgttccaagctggagcctgggctctgcctgg

SEQ ID NO: 6870324 - DNA, 59 bp, Homo sapiens
ggggaagtctgagattccctttacctgagaaggaaagtcagttggccagatcactcccc

SEQ ID NO: 6870325 - DNA, 57 bp, Homo sapiens
tagtagttagtgtttgtttttgttattttttagcatttattacaaatacaactgctg

SEQ ID NO: 6870326 - DNA, 113 bp, Homo sapiens
tgcctgttcccaccgcctcatggcctggagaagtctatttcagtcttactagtctgttagaagcaacagtaattaaaatggatctgcaggcttctggggtctttggataggta

SEQ ID NO: 6870327 - DNA, 89 bp, Homo sapiens
cttcagggagtgatcgtattttaaaccagtcatggtggactatttctcctttgacagtgattggtttgggggtgaacacgtgactggag

SEQ ID NO: 6870328 - DNA, 63 bp, Homo sapiens
ccaagcagactaaaacaattaccatctaagagatactctgagtgttgctttagtctggtttgg

SEQ ID NO: 6870329 - DNA, 78 bp, Homo sapiens
gtgaggtgggaaagaagaagagccattttacaatgagctttgtggagatgtgtagtgcttttggccattggggatcac

SEQ ID NO: 6870330 - DNA, 68 bp, Homo sapiens
gtctgaatacgtacttgtgaaggcgtgtaaaccggccctttatgcttttacagccccttgtttcagac

SEQ ID NO: 6870331 - DNA, 104 bp, Homo sapiens
tagacagaagatggattgatagattggacctggagatgtaaataggatagtttatttaagctgcttagagtctcttcttatctatccatctatttatctatctg

SEQ ID NO: 6870332 - DNA, 62 bp, Homo sapiens
aatatgtagtgttgagaatgcttgctatcaaaatagcctgaagcacaaaagcacagcttatt

SEQ ID NO: 6870333 - DNA, 57 bp, Homo sapiens
aagctaagacttagtgacttagtgtctttccaggaagtacaagctaagacttagctt

SEQ ID NO: 6870334 - DNA, 70 bp, Homo sapiens
tttgaggccgctataagattggttagtatggacgtagtaactgacaaaacagtctctgtagtgcctgaga

SEQ ID NO: 6870335 - DNA, 69 bp, Homo sapiens
tggagagcagaggagatatgtgttaaggtagcttctgctggcatatgaaaatccttactttagctccca

SEQ ID NO: 6870336 - DNA, 81 bp, Homo sapiens
tacacaggcctggggttgagcgggtgtagtttcggtcaggaagccattctagtctgttctcctcactcctcaggcctggtg

SEQ ID NO: 6870337 - DNA, 68 bp, Homo sapiens
tcctaatggcagtaacagagggtttgcagatatgctcattgacagcatggcagggtcctgttacagga

SEQ ID NO: 6870338 - DNA, 75 bp, Homo sapiens
gtagactgcacagattaagttagatttagagaaaaatttttgttccttaatatgaatataagctgtgcagtttat

SEQ ID NO: 6870339 - DNA, 78 bp, Homo sapiens
ggtaatgcaaacattctcattgggatatgtgataaatataatattatgtagctagttcctgataatgcctgttttacc

SEQ ID NO: 6870340 - DNA, 81 bp, Homo sapiens
ggcagaggcctgaattgcaaactctagagacagagaaataaactctcttatctaagacactgtactttcagtctctttgtc

SEQ ID NO: 6870341 - DNA, 80 bp, Homo sapiens
gctggtattcccattgaggactggtggggagagccatcatcaccatggcagtccccacaccttgcaacctaagtacctgt

SEQ ID NO: 6870342 - DNA, 68 bp, Homo sapiens
ggaagagaatgatggctatgggaaatttatggatacatctatgcacataaaggcatctttctctatcc

SEQ ID NO: 6870343 - DNA, 58 bp, Homo sapiens
cctgtgcttcaaattgtatcttcttgccaggcctggtagacagctttaaagacacagg

SEQ ID NO: 6870344 - DNA, 95 bp, Homo sapiens
tcctgggactctcttcatgctgggctcttctcaccctgtttcagagaagacttgcggggagaaggggtcagagaggtgagtccacctgcccagga

SEQ ID NO: 6870345 - DNA, 56 bp, Homo sapiens
ccagagagaaaatggagggccaggtattttcaggctctttcaactagctctgctgg

SEQ ID NO: 6870346 - DNA, 85 bp, Homo sapiens
ggatatgtggtgacagatgaagctggggaccaggcccagccagtggaacctggtcatgccactctatctgatcagctatgatttc

SEQ ID NO: 6870347 - DNA, 62 bp, Homo sapiens
tcaacccaaagacatgaggcatgtaaccaggacaagaatttcagactgtactttggggttga

SEQ ID NO: 6870348 - DNA, 72 bp, Homo sapiens
gtcatgagtgagtttggtcagaatgtttttggctgcaaataacagaaactcaaattaaactagcttaatgat

SEQ ID NO: 6870349 - DNA, 66 bp, Homo sapiens
cgagaagaggtgattcatattgagactgcctaggtcaaggaatctaaagtgagtcatttcgacttg

SEQ ID NO: 6870350 - DNA, 60 bp, Homo sapiens
ggaagggaatccatctggttagagtttttccccactcccaccacctgcacttttctttcc

SEQ ID NO: 6870351 - DNA, 55 bp, Homo sapiens
ggcttctgtggttgtcacgactaggggagctcctggtgtggagtgggcggaggcc

SEQ ID NO: 6870352 - DNA, 55 bp, Homo sapiens
attctttattgctgatggttattgcattagatgatgacccttagctattaagagt

SEQ ID NO: 6870353 - DNA, 57 bp, Homo sapiens
taatacctactggtcattgcaatgtgtaaattgtgctgaccatcatgtgggatgtta

SEQ ID NO: 6870354 - DNA, 55 bp, Homo sapiens
gaaattgctgtcaagtcaccacacctcctgtctgtggctcgatttatagcatttc

SEQ ID NO: 6870355 - DNA, 74 bp, Homo sapiens
gcagaggctggaggtccttggggtctactgggaggtggcagtcacaggcccttgggtcctctccacagccttgc

SEQ ID NO: 6870356 - DNA, 74 bp, Homo sapiens
tccgaagcccagtttcacactgagactctcgagcatatgagattatgcctgtttcctgtgggaactcggctgga

SEQ ID NO: 6870357 - DNA, 55 bp, Homo sapiens
agaaggctttccagaaagtcttgaaacttgatttcagcccaggaatgagccttct

SEQ ID NO: 6870358 - DNA, 68 bp, Homo sapiens
ggaacaaaaatgtctgcaatttgcgttttagattacatatgtgaaagcaacctgtaacagtgagttct

SEQ ID NO: 6870359 - DNA, 70 bp, Homo sapiens
tttagcatccaaggttatgactgacatttgtacaaggtgatactggtcaagtaatcctgggtgtcatgaa

SEQ ID NO: 6870360 - DNA, 73 bp, Homo sapiens
gtagatgatttctgtagatttgatctaatagatctaaattctattagatttgtttctgtagatgtgatattac

SEQ ID NO: 6870361 - DNA, 82 bp, Homo sapiens
ctcttttcctagcctgcatacagctgccttctaactatgtcctcacatggccttttctcagtgtgtgttggggggaagagag

SEQ ID NO: 6870362 - DNA, 76 bp, Homo sapiens
ggtccaggaagcacatttggaaaacatggacttagactaattctccttcattgttctggccaaagttttctgttcc

SEQ ID NO: 6870363 - DNA, 75 bp, Homo sapiens
tctcttttcccaagaccgaacacagagaactcatgagagataaggcatgtacgttgagttcaaggtcaagagaga

SEQ ID NO: 6870364 - DNA, 56 bp, Homo sapiens
agagacccattgccggaatcacctattttgtggtcctgtcctcagtctgggtctct

SEQ ID NO: 6870365 - DNA, 71 bp, Homo sapiens
gacatcaggggaccagccctgccctgcccatgaaccacttccaaccagcaagcagactgggcccctgtgtt

SEQ ID NO: 6870366 - DNA, 73 bp, Homo sapiens
ctctgtcttcaaacagaagcgtgagtggatttaggtttcataagcctaacgtttaacgctttggaagagaggg

SEQ ID NO: 6870367 - DNA, 59 bp, Homo sapiens
tatggcttcttttgcaactacttaaccatttttgccatggtagtacaaaagcagccata

SEQ ID NO: 6870368 - DNA, 67 bp, Homo sapiens
ggccaggctggtctcagacttctgtcctcaagtgacccacccaaagtgctgggattagtcatgagcc

SEQ ID NO: 6870369 - DNA, 80 bp, Homo sapiens
gtacccaaaaacatacatctatttttttctgtccatctgtgttgagcaaatgtgagactaaaaagatgtgcatgtggtac

SEQ ID NO: 6870370 - DNA, 76 bp, Homo sapiens
ggtgggggcttaaagcaacaatagtcctggaaccgataacagtgttcctggaacattggcattttaaggcttcacc

SEQ ID NO: 6870371 - DNA, 61 bp, Homo sapiens
atgtgcatttaggtcacatgatgtcattcctatgaatgatgcaggtaatctaagggcagat

SEQ ID NO: 6870372 - DNA, 104 bp, Homo sapiens
ccaatgccacaacaatagaatacattacattcatgttttcttgcttcaagctctcatttctgagttctgcatgaaaagaactgaacaatgtattcatggaaggg

SEQ ID NO: 6870373 - DNA, 59 bp, Homo sapiens
ggcatctttgcaccctcaaaacctgagcaccgccccggcacagagtgggtgcagagacc

SEQ ID NO: 6870374 - DNA, 58 bp, Homo sapiens
gctccttctgcaggccttattttagtttgtgctcaagttaggtttggaggaaatatgc

SEQ ID NO: 6870375 - DNA, 57 bp, Homo sapiens
ggaagtttgggagctggtaatcaacatggaaacatgtatcaagccatcaaatattcc

SEQ ID NO: 6870376 - DNA, 82 bp, Homo sapiens
acaccaccacacagctgctcttctgttgaagttgttgctgcattaatgagcttccagacaaaggcatgactgtgtggtgtgt

SEQ ID NO: 6870377 - DNA, 81 bp, Homo sapiens
cttccttaaagtgagtttgggttcattgtgatgcaaagatatactgtaatcatggcctcaaattttataacacaaaggaag

SEQ ID NO: 6870378 - DNA, 119 bp, Homo sapiens
gtggattatgttgtttttcctctggatattttagtacttgaatttcttacataacaaattgtttatggagcaaggaaactatggagagatcctaaactaggggctacaaagctgtccac

SEQ ID NO: 6870379 - DNA, 72 bp, Homo sapiens
tctgtccatgcatgttgtctgctgagttctctcaaacatagccagcagtctttcacatagcattacgattga

SEQ ID NO: 6870380 - DNA, 97 bp, Homo sapiens
ctttaatttcaaggtgttgtctcttgtggatgttgggaagtattgtacttgaatatttgaagataaatatggagaaaagcagtggtgagaactaaag

SEQ ID NO: 6870381 - DNA, 60 bp, Homo sapiens
aaatcatgtatctggccctgcctgaagttccaccccactcaggtataagaaatgtgattt

SEQ ID NO: 6870382 - DNA, 76 bp, Homo sapiens
aggtcaaatcataggaaataaccagtatttaactctttctcaactatacaaatgccatcttcctgtggtttgatct

SEQ ID NO: 6870383 - DNA, 67 bp, Homo sapiens
ggtgcgaggctcaccatccctctgtgtagaaatgagcataggaagggtgtcatgagccctttgtact

SEQ ID NO: 6870384 - DNA, 62 bp, Homo sapiens
atcattttaataaagtgtaaagattctgaatatcggttgtctgggcaccttgttgacatgat

SEQ ID NO: 6870385 - DNA, 60 bp, Homo sapiens
tcctccagaccacttctgtgcggccttggcaaggttccctcagagtgtgggctggaagga

SEQ ID NO: 6870386 - DNA, 78 bp, Homo sapiens
ggaggctttcgtttgcttatataatagatcaatttcaaggtctcaaactgtgtattataattagcaatgcaaacctcc

SEQ ID NO: 6870387 - DNA, 60 bp, Homo sapiens
gtgtgctgctatgaacatctctccagaaccctttctgcacagctggtgttggcatcatac

SEQ ID NO: 6870388 - DNA, 80 bp, Homo sapiens
ggggctgatagtattactggcatcaagtgggtagaagccagggatgcttctgaacatccagcaatgcacaggacagcccc

SEQ ID NO: 6870389 - DNA, 78 bp, Homo sapiens
ctgggataaggtactaaagccaaagtaggtattcatgcctctgttcgccctgaccctgccttggactctttattccag

SEQ ID NO: 6870390 - DNA, 103 bp, Homo sapiens
tagaagcatgactttctacatatgtatgaaggtaatttagagaccaaatggagaaaatagctgaatctaaggccttcatgtcagtatcaaagaccctcttcta

SEQ ID NO: 6870391 - DNA, 88 bp, Homo sapiens
tcccttctgatgtcttggtcacaggcttgtgtgctggggtagcatgtctctaggcagcttaagccctggcccaggccctcagattgga

SEQ ID NO: 6870392 - DNA, 97 bp, Homo sapiens
gacattttgggttttggagttttatctgttctgcttgattttgaaacttattttcagaactaagttcttagaatgaataacttgaactcagcttgtt

SEQ ID NO: 6870393 - DNA, 75 bp, Homo sapiens
ctccgcgctggaagcccacgtttggtgatgtatgtgttatgatggccacgtgtccttcccccatcagcgacgggg

SEQ ID NO: 6870394 - DNA, 69 bp, Homo sapiens
gcctgccctggtctcttggctgccctaatggaaaggctccaagttgcagctttagaaacaagggctggc

SEQ ID NO: 6870395 - DNA, 108 bp, Homo sapiens
ctgttttgtaacactggagtctattgaaggcatgaaacttccaggggaagtcttggacagtaaattgtgcttaatttcagtcaattttagctgttaacatgaaagcag

SEQ ID NO: 6870396 - DNA, 99 bp, Homo sapiens
gggatgatagtagcaatctatattttgaaaggtatttaggacatacatatatgcatttgtctaaactctgcaaatgtggatttaatgcttttgcatttt

SEQ ID NO: 6870397 - DNA, 103 bp, Homo sapiens
atagaataaagagataattttatagcaaagaggagacctaggcagcttttcctagctgtttatgtgcctcttctttttaatattgaagctcttaaatttttat

SEQ ID NO: 6870398 - DNA, 65 bp, Homo sapiens
tcccaaagtgctggaattacaggtgtgagccactgcgcctggcccccagtactttgtcaaatgga

SEQ ID NO: 6870399 - DNA, 72 bp, Homo sapiens
tggagtttcattaccagttttgccatttgctagttaatatgacttgcaggtgcagctggtgaaatggctcta

SEQ ID NO: 6870400 - DNA, 86 bp, Homo sapiens
tggtggccctaccagtggacatgggtgaggaagcatgcatttttcagaagcttctggcagctatcctctggccataagggaagcca

SEQ ID NO: 6870401 - DNA, 75 bp, Homo sapiens
gtgccacccagttgccaggaaacctgcgccatccagactcacttgtgctgaggacagctcctggcacggtggcac

SEQ ID NO: 6870402 - DNA, 59 bp, Homo sapiens
atttcctattggtccttttctctggagaaccctggctgattcaaggaccaacaggaaat

SEQ ID NO: 6870403 - DNA, 56 bp, Homo sapiens
tttcttccccactgcaggctctcaaggctgagatagtcctgagttgggtgaagaga

SEQ ID NO: 6870404 - DNA, 70 bp, Homo sapiens
taacctctgagctccagcttctaactcaagccctgtctgggcatggaccaaaggctcgggcccagagttg

SEQ ID NO: 6870405 - DNA, 94 bp, Homo sapiens
ttactcaatggtgtacctcccaaacaaaatgcctaatgaccttttacaagggtctaggtgtaattgtttactaaaatgtgcacctgttgactaa

SEQ ID NO: 6870406 - DNA, 58 bp, Homo sapiens
agcatgcttggcatttgtcagagacgactagatctgatttaaatacatgagcactgct

SEQ ID NO: 6870407 - DNA, 70 bp, Homo sapiens
ttctgatttatattttatcttgccacattgcatgcatttttttggaaggtaggatgaaagtgagtgagaa

SEQ ID NO: 6870408 - DNA, 88 bp, Homo sapiens
gtttaataagttgcctgttgaatcataagttatatgggagaataaaagcaaaaatatagagagaatggtgttaatatgcaacttttgc

SEQ ID NO: 6870409 - DNA, 68 bp, Homo sapiens
gcctttttaagatgaatgcgcaaaaaggggaagaggaatctgaaaagcagttcgtcttagaaaatggc

SEQ ID NO: 6870410 - DNA, 65 bp, Homo sapiens
tcttttgtctcagtgtcacctccagctgcaatcattgccagaaggttagtgctgggattctaaga

SEQ ID NO: 6870411 - DNA, 70 bp, Homo sapiens
gctgttattagctgctttcttgttgcatcttaattattaggttgaaaagaaagggcagacttttataagc

SEQ ID NO: 6870412 - DNA, 57 bp, Homo sapiens
tggcagcacggcatccactctctcaatttgatccagagtgaaagcatgttgcagcca

SEQ ID NO: 6870413 - DNA, 71 bp, Homo sapiens
cagttacagatatagggcgagcttagggtaaacataaatgttgaaactgcagccacctatatattgtgctg

SEQ ID NO: 6870414 - DNA, 57 bp, Homo sapiens
tctagacattggggatacagcaatgaacgaaacacatagcatctctactgtcataga

SEQ ID NO: 6870415 - DNA, 62 bp, Homo sapiens
ctaggtcatctcagcagtgaccttttattcctattggactagaatcctctgagatggaatag

SEQ ID NO: 6870416 - DNA, 91 bp, Homo sapiens
gctgatgttggagggcagccaggcctggtgaccaaagctcttgacagtttcctgcctggtctggtctcagtcctggctttgcagcctcagc

SEQ ID NO: 6870417 - DNA, 89 bp, Homo sapiens
ttctttcattagaatcttcagcaattctcttcactactgtctagatttatcagttttacaggtgggaaaactaagcttcagagagagaa

SEQ ID NO: 6870418 - DNA, 68 bp, Homo sapiens
gttcccagatgtgggccgcggcctttcctctttctggaggaatgacaggcctcccgcagaggaggagc

SEQ ID NO: 6870419 - DNA, 64 bp, Homo sapiens
gcatgcgggcctgggcttggcagggtcccatcattcttttttctgcagccattcagccctatgc

SEQ ID NO: 6870420 - DNA, 74 bp, Homo sapiens
gcaaagggcactaaatgatgaagtgcttcaagttattttgtaagttagtggagagttattatcagcccttctgc

SEQ ID NO: 6870421 - DNA, 66 bp, Homo sapiens
atcctggttcaaatatttggggcactcagaattggaggaataaattgaagtgtgttgagccaggat

SEQ ID NO: 6870422 - DNA, 60 bp, Homo sapiens
tttccagccgtcagatgtgccgcagcctgctgggagctccggtaggtttgaggccggaga

SEQ ID NO: 6870423 - DNA, 69 bp, Homo sapiens
agcctgactcacttcagaaccactcagcagcccctgatcagctctgcagattggcctgatgttcaggct

SEQ ID NO: 6870424 - DNA, 96 bp, Homo sapiens
taaggtgtctctttcccagtgatgtgtacctccttttgttttctagcattactggaactgacctggcatggatcactgggtgagcaggcaatctta

SEQ ID NO: 6870425 - DNA, 98 bp, Homo sapiens
ggaagagctgtctagtgctagaggtggcgtggtgccttgtccagcagatagctacatttgatttccactcatctttgacaccactgagaaggctttct

SEQ ID NO: 6870426 - DNA, 58 bp, Homo sapiens
atgtatgtagtgtacatatacagtgtgtatatgcacacacatatgtacacatatatat

SEQ ID NO: 6870427 - DNA, 85 bp, Homo sapiens
tttgttgttcagcttcatttgtctttatgctacatctcccatctcctcaccctttgagtattaagctgcagctgatcataacaaa

SEQ ID NO: 6870428 - DNA, 84 bp, Homo sapiens
ctctgaaaggtggtgggcagcctcctttattttcctgttttcatgctggaagatggaaaatgggttggatcacactcttcagag

SEQ ID NO: 6870429 - DNA, 55 bp, Homo sapiens
tgcattgggttgacatactaaagactgagtctctaggactttgtcatctaatgca

SEQ ID NO: 6870430 - DNA, 57 bp, Homo sapiens
atgctgggtgagcattaatagaggttcccttttccccttgcactatcaccctggcat

SEQ ID NO: 6870431 - DNA, 63 bp, Homo sapiens
ctagccttccttttaccaccagccactagcctttgctgattggggtggagacagggaggatgg

SEQ ID NO: 6870432 - DNA, 91 bp, Homo sapiens
tagggcttcactgaagactgggggattctggaggggatgattttctggcacattcaggcttctagaaccctctattctttccccagctctg

SEQ ID NO: 6870433 - DNA, 60 bp, Homo sapiens
gattgccgtttaagctccaggttaaagaaaatcctgatattcctggggcaaactgcactc

SEQ ID NO: 6870434 - DNA, 62 bp, Homo sapiens
ctatgtaccatgcctgatgttaagcatgcatatatatatgtaagcacaggtaggtaacatag

SEQ ID NO: 6870435 - DNA, 57 bp, Homo sapiens
ggtctccattccttcatctcacttcatggggactgaatgagatccaggggtgaggcc

SEQ ID NO: 6870436 - DNA, 108 bp, Homo sapiens
tgtttgtttaaaaccttccacatttcagtattattttatgacaaatgatatatttggcaattgctaaatgtcctgttttcattaatactggtgaatggagaacatata

SEQ ID NO: 6870437 - DNA, 66 bp, Homo sapiens
tcctcgcacagtgggacccaagatgcatttgggcacagcaggagggaatgtcctggtgtgtgagga

SEQ ID NO: 6870438 - DNA, 86 bp, Homo sapiens
ctcttacctggtgctcctcgctaccaggtgtgggatctcccatagtcctgggtgtgcaaggcagatacaaacatgccaggtcagag

SEQ ID NO: 6870439 - DNA, 58 bp, Homo sapiens
tgacagggctgttctgttttagcctgtggaaggagaagttatagctagcagccctgca

SEQ ID NO: 6870440 - DNA, 59 bp, Homo sapiens
ctagtttactgatgtatctccagcacctctaatagtgcttgggacaccagaagaacaag

SEQ ID NO: 6870441 - DNA, 57 bp, Homo sapiens
gtggacacagggcaacctctgggagactgtcaagggctcctatgatgctctgcccac

SEQ ID NO: 6870442 - DNA, 86 bp, Homo sapiens
tttgttcatggtaatggctgggatttcctttgcgttctatttctatttaatgcatctttgtaaactcagctattaactataataag

SEQ ID NO: 6870443 - DNA, 66 bp, Homo sapiens
gacttagggaactctcatcgtgaagaacttctccctgtgcttctgttaatagttccctgaaaggtt

SEQ ID NO: 6870444 - DNA, 69 bp, Homo sapiens
tgctattttttatctcataggtcaagttacaggaagtaaagcacttgaaaccctgagatgataatagca

SEQ ID NO: 6870445 - DNA, 57 bp, Homo sapiens
gggccatgcactttgctgggtgctggggacacagcaaagatcaagtaggcatggcct

SEQ ID NO: 6870446 - DNA, 90 bp, Homo sapiens
gcatgtgaacacccagttttctgattgaagagcctatcctttccccatcacgtattttggatgctcttgtcaaaaattagttgactatgt

SEQ ID NO: 6870447 - DNA, 64 bp, Homo sapiens
ggattggatagtcgaatttcagaaggtagcattgcctagattcagaaaaagaccattgcaatcc

SEQ ID NO: 6870448 - DNA, 84 bp, Homo sapiens
tctgtgaccaatgaattagaattttttttaactgcaatttctcaggttagtatgtagatggaattaactgatattggtcaaaga

SEQ ID NO: 6870449 - DNA, 60 bp, Homo sapiens
gtctcccccgatggaattctttggcttggttatggaagatttcagagtttgggggaagac

SEQ ID NO: 6870450 - DNA, 76 bp, Homo sapiens
ttgtgtaatgaacacagaatttcactttgggataatgaaaaagttttgaagtcagaggatgatgttggttgcacaa

SEQ ID NO: 6870451 - DNA, 56 bp, Homo sapiens
agcttttctatggtcttaggaaagggcacatgtgactcctgagacctgggaaggtt

SEQ ID NO: 6870452 - DNA, 130 bp, Homo sapiens
tcaattcattaagcaaatgaatattagtttttatttgtctgcatgtcatgtctggctgtggtgtacactataccaattctattttggattgattgctgacagagaaatcattcattatgcatgtgaggaa

SEQ ID NO: 6870453 - DNA, 68 bp, Homo sapiens
tcttatgggatgtgacagaggcatctcggaattttatctgaaggaaatctttgtaacatcttttcaga

SEQ ID NO: 6870454 - DNA, 95 bp, Homo sapiens
agggttggagagtgtcaggattttaaaatcccagttagaataaacagatactgtatctacttggattaattttgagatgccaaatttccagaact

SEQ ID NO: 6870455 - DNA, 76 bp, Homo sapiens
atcctagatggagagttcacttctaagttgtgtaataacattgttttcaagtttagtggtggtgttccatggggat

SEQ ID NO: 6870456 - DNA, 63 bp, Homo sapiens
actttaccagagaggcaaaactccttccatttgtaaaagcataaatgtagttgcctctgaagt

SEQ ID NO: 6870457 - DNA, 64 bp, Homo sapiens
cattctgtgctttggggcttcagatgggactgactagggctgggacacccagagctgcagagtg

SEQ ID NO: 6870458 - DNA, 95 bp, Homo sapiens
agatcataggggcaaaatgggagtgcaggagtaggagagggctttctgggaaagatacttattttaattttgcatgcattgagtttttgaggttt

SEQ ID NO: 6870459 - DNA, 55 bp, Homo sapiens
atggcttctgccttgattgttctctctctaggagcactcatgctgcagaagtcat

SEQ ID NO: 6870460 - DNA, 125 bp, Homo sapiens
agctctggcatccaggagcctcaagggccttttaagccacttcccagtgattgaacatccctgggcatacagcacaggatgaggcactgggggaagctggtcctggcccaggccacaaaagagct

SEQ ID NO: 6870461 - DNA, 60 bp, Homo sapiens
ttctgggagagaaagggccttgaatgtaggatcaagggacataggctttttcttgcagga

SEQ ID NO: 6870462 - DNA, 71 bp, Homo sapiens
ttctgatctcagggagccagctccaccatcctcctcacgtggagttggggtagagccgcgccctgggggaa

SEQ ID NO: 6870463 - DNA, 65 bp, Homo sapiens
cgcatcgcccagctcatctcccacaaccaggcggtggtggacgatgcccagctggacaacgtgcg

SEQ ID NO: 6870464 - DNA, 55 bp, Homo sapiens
ggttctaggtctggggataatgatgttatccttcattatctgagatcatgatacc

SEQ ID NO: 6870465 - DNA, 77 bp, Homo sapiens
agttacatcatctacagaatggagggtcagagatacctgaatacgtatttaagatctatcccattttgtatgttact

SEQ ID NO: 6870466 - DNA, 73 bp, Homo sapiens
gaatttcagtgtgtcagtttcagcagggaaatcacatctccagcctcccttgacctcaagatccactgaattc

SEQ ID NO: 6870467 - DNA, 66 bp, Homo sapiens
tacaatactctgttgggacatgaacatttttagaagagagtggacaaccatgctgagattattgta

SEQ ID NO: 6870468 - DNA, 61 bp, Homo sapiens
tttgtccttgtcctacatcggtgcccagaagcctgcttctgatggcaggagaagccacaag

SEQ ID NO: 6870469 - DNA, 128 bp, Homo sapiens
ggtctcttgactgcatcctggctcctctagtggtttctctgttatctaggctcccagtgggagcccaagcataggagggaggcaacagaggactgggcttattctacatgtccttccaagagtcaacc

SEQ ID NO: 6870470 - DNA, 56 bp, Homo sapiens
tgggcaacttagtgttctcaaatactcttcctatttagggggcagtgggatgctta

SEQ ID NO: 6870471 - DNA, 64 bp, Homo sapiens
tggctagcccagagcctgagtagggaaggcttgattttacgtctgctttaactctgggaagcca

SEQ ID NO: 6870472 - DNA, 72 bp, Homo sapiens
tgagttgtaaaagcactttctgtattctggatccaagtcctctgttagaaatgtgcttgcttttgcaactta

SEQ ID NO: 6870473 - DNA, 92 bp, Homo sapiens
gctacctggaggcatagaaagagtaaagtacttggaatacccagaactcctggatttgcatttcatttctgcttctttctagctatggtggt

SEQ ID NO: 6870474 - DNA, 66 bp, Homo sapiens
ctcgtagactcaaggtggtagaaggtagaggtgactaaggctttctggagcctgggggaacatgag

SEQ ID NO: 6870475 - DNA, 64 bp, Homo sapiens
cgcagtggaggccacattacttggtgggtggcttgcttgccacctgtttgggcaaaccactgtg

SEQ ID NO: 6870476 - DNA, 77 bp, Homo sapiens
ggcagctccctagggttgcaggggccatgcccaggctgtgctttctgggccccagaccctgcagctctgaaactgcc

SEQ ID NO: 6870477 - DNA, 81 bp, Homo sapiens
catactacatcagaaactctggaagtggggccaaccgatttgtgattgcataggctctccaggtgactctgatgtatcttg

SEQ ID NO: 6870478 - DNA, 81 bp, Homo sapiens
gggtgagggagctccaaaataagataaggaagttggtagactacatgttttgttaattcttatgttagagtgccttctcct

SEQ ID NO: 6870479 - DNA, 62 bp, Homo sapiens
agagctcagggctccaggaccgctcagatcctccttccagggccccaatagcccttggctct

SEQ ID NO: 6870480 - DNA, 102 bp, Homo sapiens
gcagtcctgtcgctttaaacagagcaaggcagctttcactgcttttgaatcccgaccgagcggggcactgccgtgctttgttttctttgcctttaagagtgc

SEQ ID NO: 6870481 - DNA, 62 bp, Homo sapiens
tttgtgtaccttgtacatttgtattgtcaacttcactagcgaacagattcatggtgcacaga

SEQ ID NO: 6870482 - DNA, 59 bp, Homo sapiens
ttctctttatgtatttagtgggtttgaaatttacagtcccaacttggtcataaagagga

SEQ ID NO: 6870483 - DNA, 57 bp, Homo sapiens
cctatagtgctaacagtgctgctattaggaaaatggcagtaaaggtgacaatatagg

SEQ ID NO: 6870484 - DNA, 80 bp, Homo sapiens
ttagcagggaaagacaaaaggtacctaacatttgagtgtctatggcaggcagtatgctgggtgctttcttttccttatag

SEQ ID NO: 6870485 - DNA, 73 bp, Homo sapiens
tagccatcttaacaggtctctgagggtcaatatcctttgactatccctctagctttgttggtcatgatggcta

SEQ ID NO: 6870486 - DNA, 62 bp, Homo sapiens
ctgtattagcttctactgctactgtaccacaaatttagtagcttggaacaatgcaaatacag

SEQ ID NO: 6870487 - DNA, 64 bp, Homo sapiens
ttcagtttgccagtattttattgatgatttttgcatcaatgttcatcagggatattggcctgaa

SEQ ID NO: 6870488 - DNA, 86 bp, Homo sapiens
tgccagagagagccttcagctgaccaaatgcctacagttatcagagatagaaggacacctatggtgcaagctgaggtttgttggca

SEQ ID NO: 6870489 - DNA, 77 bp, Homo sapiens
ttttggaagcttcccagccctgcataaatcagttggtacaaatagactgaggagtgtggggtgcagggagcccaaaa

SEQ ID NO: 6870490 - DNA, 94 bp, Homo sapiens
atgcagggatcttcccatacttcctgcttccctgatctgaaccaagattggaaagaggcaggcagcagagaagatgcccaagaaactctgacat

SEQ ID NO: 6870491 - DNA, 77 bp, Homo sapiens
gagataaggaagctgaatctgaaaataggggaaaatacttagcaattaaccttaggatgaaatctctttcttgtctt

SEQ ID NO: 6870492 - DNA, 71 bp, Homo sapiens
gttagttaacctttggccaggcagcgttcctgggcgttcgggacactgcactcggccgaaagggtgcaaac

SEQ ID NO: 6870493 - DNA, 88 bp, Homo sapiens
tggggagacagtaccatggaaggctttatgactcaaagcgtacaccttgacctgtgagtcagaattcctttctaagggttgtccccca

SEQ ID NO: 6870494 - DNA, 62 bp, Homo sapiens
tcagagaaaggccaaaatatcatcacctttgttttacttggtaagaaatggcctgtttctga

SEQ ID NO: 6870495 - DNA, 94 bp, Homo sapiens
tgcatctgatcaggcgtgttcagtggcttgggtgattgtcatttgggtggattcaaggtgaatgcctgaggcctctggatctcacacaggtgca

SEQ ID NO: 6870496 - DNA, 60 bp, Homo sapiens
ggcagctttctgtttagtctggcagtgaccaaacgggcctgcaagaatcaggaagctgcc

SEQ ID NO: 6870497 - DNA, 128 bp, Homo sapiens
ttttcaagtgtttaagttctgcttcctctttgattaacacttctgtctttatgtcatttctctctcttgcattttacaataggcagtcaagagaagcaaagcctcaccttcaacactttgcttgaaaa

SEQ ID NO: 6870498 - DNA, 105 bp, Homo sapiens
tttgacttctgtggtcagaatctttccctcttttatgagcatgagatacttcctgctaacttatgtaaaacggaaagggaattgatgtcataccacagtgttgaa

SEQ ID NO: 6870499 - DNA, 63 bp, Homo sapiens
ctgtgctgtcttttcttgctgtggtcatggttaccagatgtggtagttgaagggaaggtacgg

SEQ ID NO: 6870500 - DNA, 70 bp, Homo sapiens
gtttgctttctgtatgtaccaaattagtcatttttttaaagtgtgacatagtcccatccggtaagcaagc

SEQ ID NO: 6870501 - DNA, 64 bp, Homo sapiens
atgtgcactgtaatagcattataagtgactcactggagtgcaattatcagtatagttgccacat

SEQ ID NO: 6870502 - DNA, 113 bp, Homo sapiens
ggtcttctcactctgtcacaccctggttggagtgcagcttgtgcgatcagcagtgagccatgattgcacatctgcactacagcctgggtgtgacagtgtgacacacaaagatc

SEQ ID NO: 6870503 - DNA, 62 bp, Homo sapiens
gcactagtagaaggtttatgtgggcataataagagtgcccaaggtggccttttactctgtgc

SEQ ID NO: 6870504 - DNA, 59 bp, Homo sapiens
gagttatcttctgtgctgttaaagctttcttctgttgtaacatccacattagatgattc

SEQ ID NO: 6870505 - DNA, 57 bp, Homo sapiens
gcccagtggtaaaagcaggcctgcatggggagcccggctctgcttttaccactgggt

SEQ ID NO: 6870506 - DNA, 73 bp, Homo sapiens
aggctggagtgcagtggtgggatctcagctcactgcaacctctgcctcctggattcacaccattctcctgcct

SEQ ID NO: 6870507 - DNA, 69 bp, Homo sapiens
gtgggcttaccaggtcccaagggctacacagctctgttcaagcagcatgcccagggacctgagctccat

SEQ ID NO: 6870508 - DNA, 62 bp, Homo sapiens
agggccgtgtgaattagagacgctcctgaataagaatgagagctccatgttcatgctgtctt

SEQ ID NO: 6870509 - DNA, 59 bp, Homo sapiens
tcactgtccctgtcctcttatctgtagaaagaggtgagtgtgacagagggggcaggtga

SEQ ID NO: 6870510 - DNA, 112 bp, Homo sapiens
tcatcatggtaccctagagcttaagctgctcagtggaagactcagctctcccaatttcctccatggggggctgctgactgttacatagccaggcgaggggttgccctgaaga

SEQ ID NO: 6870511 - DNA, 71 bp, Homo sapiens
acaccttgccacatttgttacattcgtaaggtttttctccagtatgaattgtccgatgttgtgcaaggtgt

SEQ ID NO: 6870512 - DNA, 79 bp, Homo sapiens
gctgtgggccaggaggcctcagtggctccaggataccagggggacctgctccctgcactcaggcccacctgcctatagc

SEQ ID NO: 6870513 - DNA, 112 bp, Homo sapiens
agcaaaaaagacaagagagaggaaaggaggatctttgaatttctctatgctctaattatcatgttgggaaatcaggggtgttgctttcttgttttctttgtttgttttagct

SEQ ID NO: 6870514 - DNA, 94 bp, Homo sapiens
gcatgtgtatacaacctgcatgttctgcacatgtatgtaacaaacctgcatgttctgcacgtgtgtttaacaaacctgcatgttctgcacatgt

SEQ ID NO: 6870515 - DNA, 55 bp, Homo sapiens
gagtggatttgttgtcttctgctctcctgccatatgaagacacagagttcatctc

SEQ ID NO: 6870516 - DNA, 125 bp, Homo sapiens
cactgtcctgtcacaggtttcatgggttttgagaggtgaggcatgaggcatccattttgctcatgcatgtggtcacggtgccacagcctcatgattttagagtcctggttgtggcagtggcagtg

SEQ ID NO: 6870517 - DNA, 66 bp, Homo sapiens
cggagagctgtgtctcatccgcctctggctggggctggcacagagggcatgggtcacgattctccg

SEQ ID NO: 6870518 - DNA, 97 bp, Homo sapiens
gccctgcttcctcagaagagctggcaacgctagatgccactcccacatagcaacaattagagggagcccagtcatagctgcccttctgggacagggc

SEQ ID NO: 6870519 - DNA, 89 bp, Homo sapiens
gtgtgtgagggtgaagaaacaaactggtaggtagggtcgggtcttggaggactttggacgccatgctgtttggattttaacttataggc

SEQ ID NO: 6870520 - DNA, 56 bp, Homo sapiens
gggacctgccattgctcacaggatgactgtggacatcagaggcactggcaggtcct

SEQ ID NO: 6870521 - DNA, 90 bp, Homo sapiens
tgagtggtttggcagggatggtaaatatgtaaagtaaggtgtaaaacggaggattgtgctttacctaaatgcctttcctaaaaccattta

SEQ ID NO: 6870522 - DNA, 72 bp, Homo sapiens
cagtggatctgaatttgaccaggaaaggaggatggtgaggaatagcattcccaatggtgggcagagacactg

SEQ ID NO: 6870523 - DNA, 81 bp, Homo sapiens
ttctctttgctcctctctgcttggtgtatgtgagtctatgtgtgacggggtgtgtgagagcagaattgaggggtgaaggag

SEQ ID NO: 6870524 - DNA, 70 bp, Homo sapiens
aggatgcagcaagaaggcactgtctgtgaggaagtgggctctcaccagacagcaaatctgcttgcatctt

SEQ ID NO: 6870525 - DNA, 73 bp, Homo sapiens
gccagctgtgtcctttccgggcctggaggcttggcccctcctctcccaagcctggcaggggcactggcccggc

SEQ ID NO: 6870526 - DNA, 55 bp, Homo sapiens
aaggtcttatctccaaatacagtcacattctgagggtactggggatcaggacttt

SEQ ID NO: 6870527 - DNA, 82 bp, Homo sapiens
caccaataatattcccagttgtggtgagtagactcaaaagtgaccccaatgaccctacaaagtaccacagactgggtggctg

SEQ ID NO: 6870528 - DNA, 130 bp, Homo sapiens
ttccagaaacttcggttccagttcttctgttccatgagctgcagggcttgggtttccccggaggagttggaggaggtgagtggggcctggggaggtggaggaggtggggaggaatcaggtgggctggagg

SEQ ID NO: 6870529 - DNA, 64 bp, Homo sapiens
cctgggtggttccggcaaggagagctccactgtgagagccaaaggcttgtctgcaatccccagg

SEQ ID NO: 6870530 - DNA, 73 bp, Homo sapiens
tcttttcaagccttatttctacttgatgaagtggctttcaagagtatattcagaagagtaatagggtgagaga

SEQ ID NO: 6870531 - DNA, 130 bp, Homo sapiens
ttattagtgtttgtactttaatttggtatgtttgttttggcatcactccagcagtaggtccaattataaaaatagaaacaattagattcactgtggtgactgatataagcattccaagcttagcttttaa

SEQ ID NO: 6870532 - DNA, 114 bp, Homo sapiens
tccatttcataaagaagaaaacatagattttaggttagatcgacccagatttgaaacctactagctgggtcgctctaacctaaaatctatacttttctttaaagaataaatgga

SEQ ID NO: 6870533 - DNA, 60 bp, Homo sapiens
ggtcacgtcacccatcagcctactgggtatgatttcaggtgctgaactggtgaggtctcc

SEQ ID NO: 6870534 - DNA, 90 bp, Homo sapiens
ttagttgtttgcatttcctatttctgagtttcccacttggtgtgtgtttattaagtgagctagcagaagtgacttgatgtaagcaagtga

SEQ ID NO: 6870535 - DNA, 58 bp, Homo sapiens
cttctctatgatgttctaaggtctttgtagacctcaaggaaaatctagacagttgaag

SEQ ID NO: 6870536 - DNA, 130 bp, Homo sapiens
cgcccccgccccgccgcgcttcctcctccgctccagagtccccagcggcgcgggccgaggttcctggcccgccccgggcaggggcgcgggccggggaggggccgaggtgcagcccgggggtggcgggatg

SEQ ID NO: 6870537 - DNA, 62 bp, Homo sapiens
ctgagctgaaacttgagaggctacacactacaggaaaaataggcctcacagaattagttcag

SEQ ID NO: 6870538 - DNA, 76 bp, Homo sapiens
tcttctcgttcaggtagagctccaccaccttcaggcagacgtcatcgctcacgaggtggtgcagctggcgggagga

SEQ ID NO: 6870539 - DNA, 77 bp, Homo sapiens
cacactccccaagagcatccagcccacgataaagaggatggccattgaggtgctggcgatgtgggatggggacggtg

SEQ ID NO: 6870540 - DNA, 64 bp, Homo sapiens
gcagttgaagatccgtgaggtgcccagaagattatgcagtcatcagtcccacggagcagcccgc

SEQ ID NO: 6870541 - DNA, 69 bp, Homo sapiens
aagctgcatgaagttgagtagaacaccagaacctcatctacaaaattactgttcaaatttatgtagctt

SEQ ID NO: 6870542 - DNA, 66 bp, Homo sapiens
tggccaggtagctgatttcaatacttgaacccaattgggaaagaattggtcacatgctacaagcca

SEQ ID NO: 6870543 - DNA, 61 bp, Homo sapiens
ggtggtgttgggagcaagtggtatatatttctaagctatttgtaagagccccacacctgcc

SEQ ID NO: 6870544 - DNA, 86 bp, Homo sapiens
tccctcttctcctgtgataccgtttggaagctatcctactatcccctggaagggggagctcttcctaattcctgggaggtgaggga

SEQ ID NO: 6870545 - DNA, 62 bp, Homo sapiens
ccagggaagaaagatgaagtgcctggtggctccaaggcagccacctcatttatcctctttgg

SEQ ID NO: 6870546 - DNA, 91 bp, Homo sapiens
gttgatttcagcttgctgcagcagcacaggaagatgggtccgcatcacaggctcctggctaatgctgctgatggcgaaatgctggagaaac

SEQ ID NO: 6870547 - DNA, 94 bp, Homo sapiens
gcatgcaattaggcagaaatgagcttaggttcaggttgggccatctgtgaatggaacattcttgggcaagttactaaatctctctaattcgtgt

SEQ ID NO: 6870548 - DNA, 77 bp, Homo sapiens
ctcagagtgtggtccacaggcagcaaaatcagcctcaccagtgagcttgaagtgctgaatctgagaacccacctgag

SEQ ID NO: 6870549 - DNA, 58 bp, Homo sapiens
taaatgtgtctatggacccgcctggtagtaagttccctgccacccaaggacacatttg

SEQ ID NO: 6870550 - DNA, 64 bp, Homo sapiens
gatttgctggtgaatgtatagctgggcctagaagcaaagccttaaatgttcaacctggcacttc

SEQ ID NO: 6870551 - DNA, 86 bp, Homo sapiens
ttgaacatttttctccccaggggtatgggtattatgttcacacataagtcacatttttaacccttttaggaggagccaaatgtcaa

SEQ ID NO: 6870552 - DNA, 129 bp, Homo sapiens
ttctcagaattactatctaggatatagacagagcagagaaatccaaatcttcacacataacatacccacttacttatatcttatcatctaggcttgggtttttttgcctaggtagaatatttttcagag

SEQ ID NO: 6870553 - DNA, 99 bp, Homo sapiens
gagcctatcagccacaccagctgttctccgatgaccccgtgtgcctggtgccacgctgggctggtggagcagcggttaagagtgggcttcacagtgctc

SEQ ID NO: 6870554 - DNA, 71 bp, Homo sapiens
aagtctaagatccacataatgctgttcattgtttggcaaaaacaaacaagttagattttgtgtcttgactt

SEQ ID NO: 6870555 - DNA, 59 bp, Homo sapiens
gatgatgttagtgaccaaatctttctcttgaagtagggatagtggtcacgtgacagttc

SEQ ID NO: 6870556 - DNA, 63 bp, Homo sapiens
actgctgatcaccagtttcaggtgttacctattatgaggctgcctttcactggtgccggctgt

SEQ ID NO: 6870557 - DNA, 76 bp, Homo sapiens
atcctattgggtctctcgccctccaccagagcccttctccaaggggagagggtgagtggagggagggatccaggat

SEQ ID NO: 6870558 - DNA, 60 bp, Homo sapiens
agcctgccaggagctggtgctgcaactctgtcttagtgcccatcattctcctggttggct

SEQ ID NO: 6870559 - DNA, 58 bp, Homo sapiens
gtttcttcctctgtaaaaggtgaccatagcatggatatggttcatgtgaggaaggaac

SEQ ID NO: 6870560 - DNA, 120 bp, Homo sapiens
ggcacctggggcttcctgggcttcgatcctcagtggtggggagggaccctgccagcccaggttggggtctgtggccagccctcttcccacactagctgcgggtgcaggaacccctttgtc

SEQ ID NO: 6870561 - DNA, 129 bp, Homo sapiens
cagaaatgttactattgtggcacagataattacgtcaaattgttgagcataaattatcgagggaaatacattttgattgtgagcatcaatcaattttatgtgttatgaaattgccaccatttgagtttg

SEQ ID NO: 6870562 - DNA, 65 bp, Homo sapiens
tagttagctgccagccaggccaggtaggcagctctgcttctgtggattggctggcttgttggctg

SEQ ID NO: 6870563 - DNA, 57 bp, Homo sapiens
cacatggccagccacaatataaagtacatttcctgagtacccaagtgtggccatgtg

SEQ ID NO: 6870564 - DNA, 81 bp, Homo sapiens
ccttcttacagaatgtgcagtgcctgaagcatgcatttaaatggatgacatgtttttttcctgtggaaaatttgaagaggg

SEQ ID NO: 6870565 - DNA, 81 bp, Homo sapiens
ggtcacccagcagttttatgaaggcccttaaggtgcttcaagtaccaggtggccccagcgtggtttaactgtctgggggcc

SEQ ID NO: 6870566 - DNA, 75 bp, Homo sapiens
ttacaaaaacattgtgctatctcctcggagaatctgtcatacagacagttcccacttggtgcactatgattgtga

SEQ ID NO: 6870567 - DNA, 66 bp, Homo sapiens
cttcctttgaaggggacctgggcagcacatctccacagaaactctgtagggtcctgttcttggaag

SEQ ID NO: 6870568 - DNA, 65 bp, Homo sapiens
ctgagaaaccaggtgctctgatttgcaactctagacagggagaacttagagctctggttctacag

SEQ ID NO: 6870569 - DNA, 59 bp, Homo sapiens
tgagggaatggtgtgcaagaggttacttgaatccaaattaattgactcaccatttccca

SEQ ID NO: 6870570 - DNA, 71 bp, Homo sapiens
atgactaatgggtatcggtttatttttgggataatgaaaatgtcctggaattagatggtgatgatggttat

SEQ ID NO: 6870571 - DNA, 68 bp, Homo sapiens
gtccccaagttagcatctcctccagtctattctgcagaattctggttctcaggaatgctaataggggc

SEQ ID NO: 6870572 - DNA, 72 bp, Homo sapiens
tttctatactgatttgtctatactctaggaagtccattctcccaaagaagtagtagacaagactcggagaaa

SEQ ID NO: 6870573 - DNA, 84 bp, Homo sapiens
tttcctgggaatatgtgcatttatgagtgtgcatttgtgattggaggtgctttgacactcatgtgtgcatgttacttcaggaga

SEQ ID NO: 6870574 - DNA, 68 bp, Homo sapiens
gcctatttatgttgtttctactaataggccagtacttcgctacttataaggaggcacacaaaaaaggc

SEQ ID NO: 6870575 - DNA, 77 bp, Homo sapiens
tgttgcctgtctttatttcactttactgctggtacattttgctgcagaaatatggatgtgatagattatgggtgaca

SEQ ID NO: 6870576 - DNA, 86 bp, Homo sapiens
gctgggcaggtggggaggggtccaggaggcacttaccagcttctggcaccaggtgcagccgggccccgactcgatgcattcccggc

SEQ ID NO: 6870577 - DNA, 59 bp, Homo sapiens
gtgtattagtgagaaggaagatctgcatcactcactgcacatccagctcacagatgggc

SEQ ID NO: 6870578 - DNA, 69 bp, Homo sapiens
aaggaatggagggtcttcactgcccccagttccatgggggtcttggcatgaacactctacccatttttt

SEQ ID NO: 6870579 - DNA, 69 bp, Homo sapiens
tgatttcaaggagttttcacagtggaaatgtacagacagcaagtatactttgcagagccccttgaaaca

SEQ ID NO: 6870580 - DNA, 121 bp, Homo sapiens
gagggcagagatggcagcaagcattccttggctgaggcctgcattgaactagaaggctgttgataaggcttatcatggggactgcagcctagcctcggatagctcctccatccttctcctc

SEQ ID NO: 6870581 - DNA, 55 bp, Homo sapiens
agtctggagtgcggcggcaggatcatagctcactgtagcctcaatctcccaggct

SEQ ID NO: 6870582 - DNA, 61 bp, Homo sapiens
ccaggaacccctccaggtctgaacagctgctctgtgtttatctgttcctcttggaggctgg

SEQ ID NO: 6870583 - DNA, 73 bp, Homo sapiens
ggatgctgtctgaccagggtctctcagaatgactgagtccaggtggaccttggccagatttgaaccagcaccc

SEQ ID NO: 6870584 - DNA, 78 bp, Homo sapiens
agactggtaagtagggacttgttttactagtattcaaatatcactagcacatgaacagtcattcctagaagccagtct

SEQ ID NO: 6870585 - DNA, 86 bp, Homo sapiens
gggatgagtaataggttgtgcagggcgaggacctgacattaaaataagtctcagatttcttcttgcaacggctgcagatttatgtc

SEQ ID NO: 6870586 - DNA, 57 bp, Homo sapiens
tctctttcacccaagattggtttaagaaagagtttttaaacttgttggtggatgagg

SEQ ID NO: 6870587 - DNA, 72 bp, Homo sapiens
tcctttgtcagagcactgagttgtgggccttttccggtaaggcccttataaaatgtgttctgttttgaagga

SEQ ID NO: 6870588 - DNA, 130 bp, Homo sapiens
gtctcctgtcagcagcttccactcacccacgcggatggcagcctgcacggcggtgttccagatgccaaagccgccctccagggagccatgctgggcatggttgtagagtgggtcaatgttgtgcaggatc

SEQ ID NO: 6870589 - DNA, 70 bp, Homo sapiens
ggtaaagacagagctgtaggggaaagcctaaaatgttaactctatcttctaaagctctctctaccatacc

SEQ ID NO: 6870590 - DNA, 58 bp, Homo sapiens
aggcacaggaggtggtaagaagaaatgcaggtcagatttaacgacatgcctagtgcct

SEQ ID NO: 6870591 - DNA, 59 bp, Homo sapiens
ctctggctgaatcctagtctcatagtttattttcattgctatagtgacatcggtcaggg

SEQ ID NO: 6870592 - DNA, 88 bp, Homo sapiens
ccccacacatgctcctcgtagccatggctctggcacagtgccaggtgctggcctcagagggtcatggtggtgctggcgctgtctgggg

SEQ ID NO: 6870593 - DNA, 57 bp, Homo sapiens
ggggacaccccaccttgtgctcatctttgtagaatctgggcaagtttgggggtcctc

SEQ ID NO: 6870594 - DNA, 91 bp, Homo sapiens
ggagaacatgaatcatctttggtaatctgagggcagagtatggtgttcatgctccagcatgaccctcaatgattcctctttcatgtttttc

SEQ ID NO: 6870595 - DNA, 57 bp, Homo sapiens
gtggggacctggacagcggcacagggtgtgaagtccgtgcctgcccaggtcctgcac

SEQ ID NO: 6870596 - DNA, 76 bp, Homo sapiens
gctttgctgcttgtttctccatttttgtcattattgttcgtaagcaaatagacaagatggcaggaagtatcaaagc

SEQ ID NO: 6870597 - DNA, 80 bp, Homo sapiens
agtgcctcactgtcacctcatttaatcccactcaaccctccaaggtgggtggtggtccacaaatgggtacactgaggcct

SEQ ID NO: 6870598 - DNA, 79 bp, Homo sapiens
gtaaatttagttattaacatttctgccctgaactgcattacaatggattagttaagaaatgttagcaagtagctaatgc

SEQ ID NO: 6870599 - DNA, 74 bp, Homo sapiens
gattaggggcagatgttatatgatctgagacattttcctggcctcagcttttgataatgtctgaaattttaatc

SEQ ID NO: 6870600 - DNA, 64 bp, Homo sapiens
gctttcctgtggcacagtctgaaattttgatatatacctgttagaggcggcctgtgtgaccagc

SEQ ID NO: 6870601 - DNA, 62 bp, Homo sapiens
gccgcctcttcctgaccgtgtgccaacgctccaggcagccagcagggcttagaggacaaggc

SEQ ID NO: 6870602 - DNA, 70 bp, Homo sapiens
ggcagacatttccccacccaggacaggccagatgtgctccctgagctgttgcctgtgctgggtgtttgcc

SEQ ID NO: 6870603 - DNA, 59 bp, Homo sapiens
cacagagtgttagcgctggttgggagcagttaggtttccaatgagcaaaaatatctgtg

SEQ ID NO: 6870604 - DNA, 118 bp, Homo sapiens
actcattactccgtcaaggatttggcatttcaatcgatgggaaatgatgtgtgatcattctaatttattatacatcatttcccatcaatcgacgaactaaagccttgacgtaataagt

SEQ ID NO: 6870605 - DNA, 59 bp, Homo sapiens
attattcctatggccactgctactactatcaaggtatggtcgcagatacatggaataat

SEQ ID NO: 6870606 - DNA, 64 bp, Homo sapiens
ccctttatcccccacgtctgtgaggctcaatgatgcaggcaggacaggctctggggatgctggg

SEQ ID NO: 6870607 - DNA, 81 bp, Homo sapiens
tgctgtcattcacatttgttcctctgcacttagcacaataccttgctcctaataagtacgcaataaatgtttgtggaagta

SEQ ID NO: 6870608 - DNA, 81 bp, Homo sapiens
tcccctttacccaacacagatggattttgtaggctgatcatggtaaggtcaaatgcacagaaccattaagggttgggggga

SEQ ID NO: 6870609 - DNA, 58 bp, Homo sapiens
aggcaggggaatgcagatgggctgctcctagctgcccaactgaaatctccacctgcct

SEQ ID NO: 6870610 - DNA, 70 bp, Homo sapiens
tgtttaaggtgttcttcagtagaggtcatattcctaagtgtgcagacctaaaatagaacgctttctgaca

SEQ ID NO: 6870611 - DNA, 80 bp, Homo sapiens
cgtggcaattctgactcattgcagctccagcaacaggctccacaatgagctgtaagcatgacagtgggtccaatgctatg

SEQ ID NO: 6870612 - DNA, 96 bp, Homo sapiens
tagtttggtataaaaaatgttcattaagggcctgttggctgcagtctcctttcaaaatagcaaaccggccaaaactgaatgttagtgtccatccta

SEQ ID NO: 6870613 - DNA, 63 bp, Homo sapiens
tcttccaagatgctaaaaaatccttggtctgctgacagcaacagggagctgcgtcttgaaaga

SEQ ID NO: 6870614 - DNA, 61 bp, Homo sapiens
cagaggaagagatacaagccctctgtgaaatacaaaccagggggcttagtattgatccttg

SEQ ID NO: 6870615 - DNA, 79 bp, Homo sapiens
ggcaccagagggagtttctgaggttgcagaggtgactgggcaatatcttccaagctccctggtgtattctggtttggcc

SEQ ID NO: 6870616 - DNA, 58 bp, Homo sapiens
ccactatggattcactattggaaagagaatggaaaagtctctcctggatccatggtgg

SEQ ID NO: 6870617 - DNA, 71 bp, Homo sapiens
cccacccctctcgcgtgtgcctttccgctccactgttcgccggtgagctaggtggcgcgagagcggagggg

SEQ ID NO: 6870618 - DNA, 63 bp, Homo sapiens
accatatgtgtcaggtacactcattagctcaactttgctgatgaggatatagatacacaaggt

SEQ ID NO: 6870619 - DNA, 99 bp, Homo sapiens
tagttagagtatcttgagggcatctgttttgtgaattgatatatattctcaattgaaaaagaagtagtgtgctccagcggtgagtttgtaatctaattg

SEQ ID NO: 6870620 - DNA, 70 bp, Homo sapiens
cagatataccatccatgggaatctctgtattttcacaatctaacccagggcttcgatggatggatggatg

SEQ ID NO: 6870621 - DNA, 61 bp, Homo sapiens
agctcaggcagatttgctgccctccatcaatgctggtggaggaaaccaagtcggccctgct

SEQ ID NO: 6870622 - DNA, 130 bp, Homo sapiens
gcgcagtttgatttgaatttcagataaacattgaataattttttcgtataagtatgtcatgtgcaatgcttaggacatgcttgtactaaaaaaatatttattgtgtatctgaaattcaaatttagctggc

SEQ ID NO: 6870623 - DNA, 65 bp, Homo sapiens
atcaaatagtgtgcagcctttaaatatagagggtgtgtccctatggtttatgtcacacttttgat

SEQ ID NO: 6870624 - DNA, 68 bp, Homo sapiens
caggcattcatgaattctacaggatggagttccctgctgggacaccaaagtagaattaatgtagtttg

SEQ ID NO: 6870625 - DNA, 58 bp, Homo sapiens
cttggccacaggacctctggggaacattgctttagctttctgagctctgtggcacaag

SEQ ID NO: 6870626 - DNA, 85 bp, Homo sapiens
gtgggggtgtcgtctgggcccttcctgctctcttagctgcctgagtgactgggcagggcagggcctgggccactgacaccccctc

SEQ ID NO: 6870627 - DNA, 72 bp, Homo sapiens
ggagaagattggaattaagcactggaagctttttatttattttacatgctttattcctacaagattttctgc

SEQ ID NO: 6870628 - DNA, 78 bp, Homo sapiens
gagagataccatgaagataagaccaggctggaaaaatcaatttgcacagtgtctggctattttctttgcacttctttc

SEQ ID NO: 6870629 - DNA, 55 bp, Homo sapiens
ggtggctcacgcctgtaatcccagcacttagggaggccgaggcaggtggatcact

SEQ ID NO: 6870630 - DNA, 65 bp, Homo sapiens
aatccttttgttcatgtcttttacttatgccaagctgtcacactgtgtgcatgaactgagggatt

SEQ ID NO: 6870631 - DNA, 63 bp, Homo sapiens
ctgcctgctttctcctcaactcaaaaaagcaaatctatgttctgagaaaagtaggaaaggcag

SEQ ID NO: 6870632 - DNA, 60 bp, Homo sapiens
tgcaaaatgacttctgaaaagagtcaacatctatgatgctgtaacagatatcatttagca

SEQ ID NO: 6870633 - DNA, 78 bp, Homo sapiens
acagtgtgtgcctctgtgggcagagctgcctgtcgtagaagggccagggcagcatgcagcgggggtgagggcttctgt

SEQ ID NO: 6870634 - DNA, 79 bp, Homo sapiens
gactgggcttgcagtaaattcaggtacaactaggtttacccaatcctcatttctggttctggttcttactgctccagtc

SEQ ID NO: 6870635 - DNA, 55 bp, Homo sapiens
caggacattgatccattggcactgcttcgagacagaacagtggacaaatgacctg

SEQ ID NO: 6870636 - DNA, 78 bp, Homo sapiens
gtgaggtctgtggcctgtgaggagcgggcagggatgcaggtgtgcctgacctagccctgctcctctctgcagtcccac

SEQ ID NO: 6870637 - DNA, 65 bp, Homo sapiens
ttttggaaccaacagtgcacctggacaaagcagaaaaaaattgcaatcagggcgactgaccaaag

SEQ ID NO: 6870638 - DNA, 73 bp, Homo sapiens
ctttgcctcaccttcccaactctcagtcagggaaggatttctcaagtaggttgtggaagggagatggcaacag

SEQ ID NO: 6870639 - DNA, 89 bp, Homo sapiens
gggattgtctccatcctgcctttagggaaaagcaagctacccatctagggtctgggtagagcaccccgggaagagcaaggagacatccc

SEQ ID NO: 6870640 - DNA, 60 bp, Homo sapiens
gacagtgcagaaagctctaccagcttctgttggtggcagcgtctatctgacatcactgtc

SEQ ID NO: 6870641 - DNA, 58 bp, Homo sapiens
aggaatcagaattcttagaattgctcataggtaaataactgggagtattgactttcct

SEQ ID NO: 6870642 - DNA, 64 bp, Homo sapiens
ctcatggagttacaggcccccttggaattctgagccaagctccaatcaactctggactcctgag

SEQ ID NO: 6870643 - DNA, 86 bp, Homo sapiens
gtaagctgtcacactgaggaagacagcagctgtgttattccatgatttatagaacagatttgcatttccttgcctttgaagcttgc

SEQ ID NO: 6870644 - DNA, 81 bp, Homo sapiens
ggtctctgtcatttgcacgtttgtcgagcaccatctgctgcacagggtggtgtcaggcactagcatgcactttacgattcc

SEQ ID NO: 6870645 - DNA, 74 bp, Homo sapiens
tggcttgttctttggattctggtttcttcatctgtaaaatgagttgaattagctgacctctaaggagccttcca

SEQ ID NO: 6870646 - DNA, 73 bp, Homo sapiens
ctcaatcattttgcttttgcatcattgatgaaacttccttcctttctttcttgcaagagcagaaagaactgag

SEQ ID NO: 6870647 - DNA, 94 bp, Homo sapiens
cccctgaggagagcaggttaaggtgtggtagtttagttctgcaggaaaatcataggcagagctcgaggccaacacttctctgcctctgttgggg

SEQ ID NO: 6870648 - DNA, 76 bp, Homo sapiens
cccaagaatcaacattatttagtggaaaaaagtatcaactagtagaaattattaagtaatgtttggggggcttggg

SEQ ID NO: 6870649 - DNA, 96 bp, Homo sapiens
ctcataaatagcataagtatgcaaggttaagcttcagaacgcaatgatgccttgctttcctggcgtctccactgggggttaaccaagcatagtgag

SEQ ID NO: 6870650 - DNA, 57 bp, Homo sapiens
tctgaggctgtcaggagaatctgccccgggctccccctgactcctggcagcctcagg

SEQ ID NO: 6870651 - DNA, 78 bp, Homo sapiens
catgtgatgacttgggctcagttggatggcctatcagtgatgggccactaccttctctggatcccctcttatcatttg

SEQ ID NO: 6870652 - DNA, 83 bp, Homo sapiens
gctccccagatgtaggactctggtgtcagaagtgccccaggactgagggcagttcccccagggtcaccagcactgtcctgagc

SEQ ID NO: 6870653 - DNA, 55 bp, Homo sapiens
tgggaacagcatgattgatcctcagcttcatctctgagtcatctcactgtgccca

SEQ ID NO: 6870654 - DNA, 63 bp, Homo sapiens
aagataacaggaggagtttgtatagcagaagaaaataggtaaggctctcttcttctgtgtctt

SEQ ID NO: 6870655 - DNA, 56 bp, Homo sapiens
ttttcctgcatttttggggggtgttgaaataagtaaactgggaaggtgcaggggaa

SEQ ID NO: 6870656 - DNA, 75 bp, Homo sapiens
agctattctcatgttaccaaattctatctgcgcatatgtttttgtataacatttcggtgacagtgggagtcggtt

SEQ ID NO: 6870657 - DNA, 59 bp, Homo sapiens
ctgtagtctaggtattgtcctcctcgtgaggtggacacaggtaaataccactgatacag

SEQ ID NO: 6870658 - DNA, 68 bp, Homo sapiens
gctcagttgggaaagtctgtagttctttgtcataggtaattgattcagacattaccctggacatgagc

SEQ ID NO: 6870659 - DNA, 62 bp, Homo sapiens
gtgatccaagagagaggaagggggaaactgctatgttatttctgcattgtcctcttggttac

SEQ ID NO: 6870660 - DNA, 67 bp, Homo sapiens
accagcctggcacacagcaggctctcaggaacactgctgaaagcacaagtggcctaggtgtcctggt

SEQ ID NO: 6870661 - DNA, 76 bp, Homo sapiens
cccctgagtgcttccagagtcatgggagtccagccatttttcccctttttcatgacatcctgaagctgcacagggg

SEQ ID NO: 6870662 - DNA, 68 bp, Homo sapiens
agtggtggcagtagacagtgcatctacaggagaagtggccctttggaatgcatggctctgtgacggct

SEQ ID NO: 6870663 - DNA, 85 bp, Homo sapiens
gcttgtgttttctgagattatcatacaacatctgacatgtgactcgtgcctgaagtggtctgtagtagtagagaaagagacaggc

SEQ ID NO: 6870664 - DNA, 57 bp, Homo sapiens
gatgtagaaatctggaaatcagatcctaagttacctctgagccagtcaagctacatt

SEQ ID NO: 6870665 - DNA, 129 bp, Homo sapiens
gcttgtctaccctccagcattggaaccctcttagaaggctaatcaattcccatcgtggcaacttctccccagtgccacagttgtttgtgctctagaggactctaacactgctccttttagaaactttgc

SEQ ID NO: 6870666 - DNA, 64 bp, Homo sapiens
acagtgttgtatttagtttgatagatacaattacatctatctagccagataattacagtactgt

SEQ ID NO: 6870667 - DNA, 63 bp, Homo sapiens
catctgtcagcaaagtattcatttataacatcgtttggaagatgggtaattgatggcagtatg

SEQ ID NO: 6870668 - DNA, 68 bp, Homo sapiens
atgaccctctgaggagaaaggtactgacaatcctttgggtacaaagtgctctgatctccttgggttgt

SEQ ID NO: 6870669 - DNA, 72 bp, Homo sapiens
ggcttgggaactgaggtatcttcgcccccaggaatccagctccttcccctgccagaagcccagatcccagcc

SEQ ID NO: 6870670 - DNA, 83 bp, Homo sapiens
tctatggggtatggttagcagatgcatgtacagtgttgctttaaacatagaagcaaatggatttctgaacctaacttcataga

SEQ ID NO: 6870671 - DNA, 77 bp, Homo sapiens
ttaggatttgcttttccattgtagtatctgttttagttccttaggactggaaaactgagtgggattgcatctattga

SEQ ID NO: 6870672 - DNA, 69 bp, Homo sapiens
ctgaagcccaatcctgtgttcctccaccccagccacccagccccatggtgaggacacagggagcttagg

SEQ ID NO: 6870673 - DNA, 71 bp, Homo sapiens
agagactggagggcaagctttgaacatcagcagctgtatcagatgctgccagggctctgcccacattctct

SEQ ID NO: 6870674 - DNA, 64 bp, Homo sapiens
ctcaggtgggagtagaatgctaggctctcacgttgtatcagattcctgtttcttcctacctgag

SEQ ID NO: 6870675 - DNA, 70 bp, Homo sapiens
aatgtgggtaaatctcttttcatggctttcagctctgaaggccgtcagccccgatttgccactccacatt

SEQ ID NO: 6870676 - DNA, 62 bp, Homo sapiens
gtgaactattgggtatcataaaagcacttagtgtgcaccagtctgtgttctaaatagttcac

SEQ ID NO: 6870677 - DNA, 68 bp, Homo sapiens
tcgcttgaacctgggaggcagaggttgcagtgagccgagatcgcaccactgaattccagcctgggcga

SEQ ID NO: 6870678 - DNA, 77 bp, Homo sapiens
gcatgtggccaaggggattgcagaagcagctgcagctgagtttgctgttctctgatttcccactaaactccacttgc

SEQ ID NO: 6870679 - DNA, 57 bp, Homo sapiens
atgcagggaggtaagaggtgccataagaggctttactcattgctacctctgtgtcat

SEQ ID NO: 6870680 - DNA, 67 bp, Homo sapiens
tggaaaggagggcctgaaacaacacttgatggagggcccactggatgcttgatggctcttctttcta

SEQ ID NO: 6870681 - DNA, 56 bp, Homo sapiens
ctgtgggatggttttgccagaattccaagcacgactcgatcagatccatcccacag

SEQ ID NO: 6870682 - DNA, 63 bp, Homo sapiens
gtctggaagacttgctgcatccttgctggagtgattgagaagggaacaagcaagctgctagtc

SEQ ID NO: 6870683 - DNA, 128 bp, Homo sapiens
gtgcggtgagagcagagggggctccatcccgccccagctccaggcagcattaataaaatgcaggtgttttgtgtatgtatagctgcttgagggaggagggagaaagagccttgactgcagcagcgcat

SEQ ID NO: 6870684 - DNA, 62 bp, Homo sapiens
tactctgttttgtgcagtgtcatatcctaagcatctagggcagtgtctgcatatagcaggtg

SEQ ID NO: 6870685 - DNA, 89 bp, Homo sapiens
cctgagcttttccacaaaatcaatggttcccaagtaattcattctaaaactaatgcttgagacacatatgaatttggaggaaccttagg

SEQ ID NO: 6870686 - DNA, 72 bp, Homo sapiens
ttccctgctcaaccttaatagtaaacagcaagggcagaagccacagactgttaacggtatgatgctcggggg

SEQ ID NO: 6870687 - DNA, 72 bp, Homo sapiens
ggagaccttaggaacagcctcaaattagtatcattctaactgtgcaaccttgggcaaatcactaacgtctcc

SEQ ID NO: 6870688 - DNA, 81 bp, Homo sapiens
gtttcttttgtattaatagttcctactttgcactaataggatattcctatttgaaaggggactattgcaaacaacaggaat

SEQ ID NO: 6870689 - DNA, 77 bp, Homo sapiens
gctaaatcagatgcaagagatggacttgtgttctattattagaatataaatttcttgtctttctgtatatgattagc

SEQ ID NO: 6870690 - DNA, 84 bp, Homo sapiens
aaatgctgagtaatttcttacggagaccttacagatacagttcttttttctattgtttccccggaattattcagaaaagcattt

SEQ ID NO: 6870691 - DNA, 58 bp, Homo sapiens
gctcggggcaaactcgctcttggacttggttgtctttggtcaggcatgtgccctgagc

SEQ ID NO: 6870692 - DNA, 55 bp, Homo sapiens
acctttcccatcctctccctgggcttcagtttgcccctgaagacaatggagaggt

SEQ ID NO: 6870693 - DNA, 124 bp, Homo sapiens
gctgcttccgagttgggccagggttttaaagcccgggctgcagggagctgaggtcacatacaaaaggggtggctcacaggactctctgggcctgggaggggcttccggtgcagcaggagggagt

SEQ ID NO: 6870694 - DNA, 98 bp, Homo sapiens
gtctcttgccctggtctcctaattcaggttcgagtctgttaatcgtatttctcctccattgacaacagccactgatactgaatagccaaatcagagac

SEQ ID NO: 6870695 - DNA, 57 bp, Homo sapiens
tgaatgagaacactgaaagaggattattgcattggacttttagtgtcttcttattca

SEQ ID NO: 6870696 - DNA, 109 bp, Homo sapiens
caccgctcattatgatgacagagtcatgggccgtcaggcaggggcatttgtttttggacgcacttggctgcccatagtccttgactctagtgtgcttagtgtggcggtg

SEQ ID NO: 6870697 - DNA, 76 bp, Homo sapiens
tcctgcctgcctattccctgggccgagagcactcatgtcatggagatcatggcaccaggaggatggccagcatggg

SEQ ID NO: 6870698 - DNA, 62 bp, Homo sapiens
tggcagagcaggctccaggcaaaatttcggagcacaaaactgtatcttctgggcctttccca

SEQ ID NO: 6870699 - DNA, 103 bp, Homo sapiens
aggatagtgacagctctgaggcttttctctaaatagtggtcagtttacaaagcctatgtcagccactgagaccttttggaggagtgtcatccagctttctcct

SEQ ID NO: 6870700 - DNA, 75 bp, Homo sapiens
cacatcaaagggcctgtggtgcagcctcttcaaataccaggattcttgcacttaacacaggcactctttgtcttg

SEQ ID NO: 6870701 - DNA, 78 bp, Homo sapiens
ataaatgtttgttgaatgaataaacgagccccatttgcagaagggtatccactatgcattcattcaatcagcttttat

SEQ ID NO: 6870702 - DNA, 102 bp, Homo sapiens
cccttcagtgccacgaccttcctgtgccaatcatgggtatgatgtcagttcatctaatccttgagctgcagttagccccagatgaggaaacagactggaggg

SEQ ID NO: 6870703 - DNA, 72 bp, Homo sapiens
tcttagcagcatctggattctttggtccctggctaaccttgccagagaggagacttatccagattggtaaga

SEQ ID NO: 6870704 - DNA, 55 bp, Homo sapiens
cctggattctgctggccactttatatttccactaaggagtggctcaagatccagg

SEQ ID NO: 6870705 - DNA, 88 bp, Homo sapiens
catagacttactagaggaacagtttcaggttttgatgctaatcagtgttgtgtcctaaagttgtcctttgtgcctttaaaaagttttg

SEQ ID NO: 6870706 - DNA, 96 bp, Homo sapiens
gaaaagaaaaagaagcctaaatgatgctattatggcggctaattaaatttcttcttgctgttacaatgcattcatttttgaggatcattacttttc

SEQ ID NO: 6870707 - DNA, 70 bp, Homo sapiens
cctctctgattcatgaaaaggcagtttttctttcccttgggatgctgtatttatatgaaggcatgggagg

SEQ ID NO: 6870708 - DNA, 104 bp, Homo sapiens
attttgtttttcatcagagcctctttgattgagtttctgatgcttgccaatatgttgctgtggttgagattctcaacaaagagtagcaatgatgactccaagat

SEQ ID NO: 6870709 - DNA, 56 bp, Homo sapiens
gaaaagttctagacacaggtgtctaagtgtggcaagcagggtgttaagagctgttc

SEQ ID NO: 6870710 - DNA, 114 bp, Homo sapiens
ttgctatttgcatagtcatttcattggatagtttatgaaaaatggaagggaaagtattttcttacagtgccatttttcacaagactcacttcctgatgagaacatgagaagcag

SEQ ID NO: 6870711 - DNA, 56 bp, Homo sapiens
gtgttcggcttcttttcgggggggaaaacaactgccctcccttccaagttgaggac

SEQ ID NO: 6870712 - DNA, 60 bp, Homo sapiens
gtgaggagctctttgactcacgaggccttgttaccacttgtgtctgcactgagtcctcac

SEQ ID NO: 6870713 - DNA, 67 bp, Homo sapiens
gttaagaggtctggggttctgtggaaatccttgatttcttctgacttgcagtccagatgcttttaac

SEQ ID NO: 6870714 - DNA, 130 bp, Homo sapiens
taaagttaataagtatcagagatagtaatcaagatggtccagtagcagggataccagcatcgtatgataggaaaaaaggtattggtagatattgagactatttaataaatttctgttctcatatattttg

SEQ ID NO: 6870715 - DNA, 70 bp, Homo sapiens
gtaagagcatatttcttgtgtagcaagtccatgaaaccaaagggctgatccatacataaatgtgtgatac

SEQ ID NO: 6870716 - DNA, 76 bp, Homo sapiens
cggagacagggtggggatggtgagcttagcccagggccttcctgacgaggagaagtcccctccccatcctgctgtg

SEQ ID NO: 6870717 - DNA, 88 bp, Homo sapiens
tgcattgcagaactcactcactgaagagcgtgctatgctcacttgaaagtgggtgtaattaagttcttccctgagcagctgcagagca

SEQ ID NO: 6870718 - DNA, 83 bp, Homo sapiens
gaataataaaactgaatgtgttgcatagaactattatttagcaattgagttttataaaggcacctcagtctagattgttattc

SEQ ID NO: 6870719 - DNA, 95 bp, Homo sapiens
ttcagaaaggaacacagtggcattgggatgagaagtgcgagggttgaatgaatcagctttaggaaaaccttcatttttctctctccattctagaa

SEQ ID NO: 6870720 - DNA, 91 bp, Homo sapiens
aaaaccatgatcctcatttatgtaatgattaaggcaacttgacttttagtagtttctccttagtcagtgctgggtataaaagggtggtttt

SEQ ID NO: 6870721 - DNA, 122 bp, Homo sapiens
gctgatttcatttgagtttatagttgctgctcattatgttcagcatctgctttattaaatgaatcaataaatcagttatgaccatagagcatgagctagcaaaagagcaaaaattctaaagc

SEQ ID NO: 6870722 - DNA, 56 bp, Homo sapiens
agcaactgtaatattggaagatcagtccttctgtattatattgtataatagttgct

SEQ ID NO: 6870723 - DNA, 85 bp, Homo sapiens
gcctggggttggagcgagcagtggaattagtcctcttccacattcagacagggacacaagccacagctctagctccctcccaggc

SEQ ID NO: 6870724 - DNA, 63 bp, Homo sapiens
tctagagacaaaggaaggagggctctggacaggagatacagcctcttccttctttgtcgtaga

SEQ ID NO: 6870725 - DNA, 62 bp, Homo sapiens
ctttttatctcttaatgatgttaaggaaaggtcaaagcatctaacagatgggagatggaaag

SEQ ID NO: 6870726 - DNA, 57 bp, Homo sapiens
gcctttgtgatgggcgggcaccaggagaacgaggatctgtgcctgccccgtaagggt

SEQ ID NO: 6870727 - DNA, 109 bp, Homo sapiens
gaagcacccctgggcctcatgagctaacccttgcatcccatgtgtggccatccaggggaagtcggcctgtgcacatgtgcaggaaagcacgggggcccccggggtggtc

SEQ ID NO: 6870728 - DNA, 58 bp, Homo sapiens
tgtaaaggtaggtgcaaaatgatgccttttataagagaaattgccacttacctataca

SEQ ID NO: 6870729 - DNA, 82 bp, Homo sapiens
gcctcttgggaaacagctctttggggctgtctgtccttctcccttcaaggactacaggagctgctgtttacccatgtcaggc

SEQ ID NO: 6870730 - DNA, 98 bp, Homo sapiens
cagttcctgcaaatgctacccaggaccctgaggctgcccagggccaggtgtccaccccacctccctcgccgtccactctggtcgcgtcccaggagctg

SEQ ID NO: 6870731 - DNA, 71 bp, Homo sapiens
cagaggctgctctgggtggcatgctgcagctcaaaaccaacagagaggcctcactccagagacggcctctg

SEQ ID NO: 6870732 - DNA, 130 bp, Homo sapiens
aaaacatgtataggagaatctaaataaaagttacttggatgaaaaatgagaattttccctctgaagcagaactagagagaagacgtgtttcattcatttgttctttgattcattcatttattcaacagct

SEQ ID NO: 6870733 - DNA, 65 bp, Homo sapiens
gctagccaatagattgaagctatgttggcacaatatcctacatcctcccgatctactggctgagc

SEQ ID NO: 6870734 - DNA, 81 bp, Homo sapiens
gagaatgaagagattggttataagagatttctggtgtgagaaccaaaaggagttttgtataactaccttcaaaatattctc

SEQ ID NO: 6870735 - DNA, 77 bp, Homo sapiens
tccagctttatttccaaaggctaaactcagtttgacagacagagcccttcacagactgttgtcattggagagctgga

SEQ ID NO: 6870736 - DNA, 127 bp, Homo sapiens
ttgaaagaaggagcgttttgctgcctttgatctgtttccactgggcacggggccagcggtgtaggagctatctcactgccctgtgcacaggaaactgaagatggagtttctcgcctgtcgttttcag

SEQ ID NO: 6870737 - DNA, 89 bp, Homo sapiens
gggacaggattaaggtgaggggagtaaagccatgttacagagaaaaaaacatacagtaatcaagatgcttccctcacttcacctggccc

SEQ ID NO: 6870738 - DNA, 61 bp, Homo sapiens
catgtctgggcttagggacatggcagagcgaagtgtatgcacctgccctgtgcccatgctg

SEQ ID NO: 6870739 - DNA, 66 bp, Homo sapiens
tctagaattcccttttgacaatcctcgaaatggcagttggtctcatgaaagggaatgaactttgga

SEQ ID NO: 6870740 - DNA, 126 bp, Homo sapiens
tcaacaaaacagaaatgcactagttcaaattttgaaggttatctttttctaatggaaggtatggaaactttgttctattttagagatgaaagcttagagtctagagtattatgattatggtgctga

SEQ ID NO: 6870741 - DNA, 56 bp, Homo sapiens
ggtggagactcagatttgttgctgaaagttcagtaacacagtcctggtctttggcc

SEQ ID NO: 6870742 - DNA, 82 bp, Homo sapiens
aggctgaggctgagggatgggggcagcaggtcctctttcagagggggctctgggtcgtgtctccatgtccacaccaaagcct

SEQ ID NO: 6870743 - DNA, 108 bp, Homo sapiens
gagctttgaatgggggctgggagaggtggtgggaagtatgcagcaagtcaggtttatagagctgcccatactttcacccctctctcaggcctcattatctcatctctc

SEQ ID NO: 6870744 - DNA, 78 bp, Homo sapiens
cagtagatcagaagttaattcctgaaattctcctgttgctttcaggttgcagaattgctggaatttgctttatccatg

SEQ ID NO: 6870745 - DNA, 59 bp, Homo sapiens
aggggcactggcagtcggggacgctgggggtcagctcctggcgtcctgcccctgcccct

SEQ ID NO: 6870746 - DNA, 77 bp, Homo sapiens
ctgatctggacagggtctgatggtcctcacttgacctaagctgagctctcccaggctgtgagcatccccaaggtcag

SEQ ID NO: 6870747 - DNA, 59 bp, Homo sapiens
cttcctgaagtcacctagtttattaattaatgtcagagctaggaatcggacccaggaag

SEQ ID NO: 6870748 - DNA, 87 bp, Homo sapiens
ggggccaagcagggctccctggggactcggggctggggaaggaaagccccaaaggctggagtctgcggtttggagtcctgtgactct

SEQ ID NO: 6870749 - DNA, 55 bp, Homo sapiens
tgtgaaagattatctgcaatgagggctgctagaaagtcagcctgctgatctcaca

SEQ ID NO: 6870750 - DNA, 100 bp, Homo sapiens
gaatgttttggcagaaatttttcagatatcattaatttagtagcaaaaatgctatgaaatgtgatgatattatgaaagtatagttctactcataacattt

SEQ ID NO: 6870751 - DNA, 92 bp, Homo sapiens
gtaaaagcactttatgaagtgagtgaaaatgcagaatacaaaattgtgcctatactgtgttttcaccactgtttagattctatgcacattgc

SEQ ID NO: 6870752 - DNA, 116 bp, Homo sapiens
aggcagtcagtctgatgccagagaccacattcttaattgccatgctgtattaactcctaaaattaaacctagggcatgaggatggttgctgcatccagtacaaatgctgagggcct

SEQ ID NO: 6870753 - DNA, 75 bp, Homo sapiens
tgctccatatgagagaggaaagattttaaaatatgtctacattttaactgttgtattattttctttatggttgca

SEQ ID NO: 6870754 - DNA, 78 bp, Homo sapiens
aagcctgatgatccgtctatttctcttggctctgtgtacagcattcaagagacaggacgtgtttcatttccaaggctt

SEQ ID NO: 6870755 - DNA, 82 bp, Homo sapiens
gctattgcggtgcagagctgcagcgaggcctgggtcacacagtgctccgggtgtctgcaggctgcaggccgagcccagtggc

SEQ ID NO: 6870756 - DNA, 60 bp, Homo sapiens
gaagtcttttagcaaaacgaacgtggctgcagcctttttcgtctttctaaaagaatcttt

SEQ ID NO: 6870757 - DNA, 61 bp, Homo sapiens
ggcaggtgggcacagctggggctgaggaattcacaggcagctctgcagtgcccaccttgcc

SEQ ID NO: 6870758 - DNA, 61 bp, Homo sapiens
cttcctgtttttgtaatcgactctgctcaccttctagagagtgcattccagacatgggagg

SEQ ID NO: 6870759 - DNA, 82 bp, Homo sapiens
catggggagtagggtgtgagatttgcagacaaaggttggtattccagaatgttgtgacctctctgcattcagccacccgatg

SEQ ID NO: 6870760 - DNA, 102 bp, Homo sapiens
cgtggggtgggtggggtaggggcagggatgggatctgtggccaggcggatagggatgaagcatagctcccagatttcagccttgtgccccactcagcccatg

SEQ ID NO: 6870761 - DNA, 57 bp, Homo sapiens
ctgtatccattagtaatcctgcaggttcttaaagggacactgcattgatggaaacag

SEQ ID NO: 6870762 - DNA, 79 bp, Homo sapiens
tgatctgtggtgatattctgataataagattttgatctaacggaggatacagttctagtcaaaaatcacctatagatca

SEQ ID NO: 6870763 - DNA, 69 bp, Homo sapiens
gtatggttttaggcctataattatttactctatttaagcccaggtatggttctaggcctataattatat

SEQ ID NO: 6870764 - DNA, 57 bp, Homo sapiens
ggaagcctagccttgctgttgtccaggccctggagacacccacattgctgggtgccc

SEQ ID NO: 6870765 - DNA, 79 bp, Homo sapiens
ggctgtcacctctttcagctataacattgagactttccccataggaaagcttttgatttttagtttgatggaacatgcc

SEQ ID NO: 6870766 - DNA, 72 bp, Homo sapiens
gtagagtcacgtgggtgagtgtcctcccatggtttcctccctggaagcggtgctggcccatggggactgtac

SEQ ID NO: 6870767 - DNA, 57 bp, Homo sapiens
cacgggtgggaaagaacatttttcacccaaatcaagagtggtctttttcacccagtg

SEQ ID NO: 6870768 - DNA, 66 bp, Homo sapiens
tgttctgatggccattttttcaaaccactctcagtttgactgtagatgtgaaatatcatcagagca

SEQ ID NO: 6870769 - DNA, 73 bp, Homo sapiens
gctcctaaacaaacatcctgccctaatccagagactaggttggtgcttattggggggcggtgagtgggggagc

SEQ ID NO: 6870770 - DNA, 60 bp, Homo sapiens
aatggtctgaaggtggatttgagactcaagaaaggtatctactcctctttcagatgcgtt

SEQ ID NO: 6870771 - DNA, 55 bp, Homo sapiens
ctgggaagcttcgagcaggaaatgaagaaatctaaagtctggttcagtgtcccag

SEQ ID NO: 6870772 - DNA, 61 bp, Homo sapiens
ttcctcaagtcagggaggcaggatgatgaccaaattttcccctctctgctgcatagaggaa

SEQ ID NO: 6870773 - DNA, 77 bp, Homo sapiens
gaacggcccagggaatgagtggtaccgcgggcgcccggcgcacccagcaggtgccatcactctggatgggccagttc

SEQ ID NO: 6870774 - DNA, 72 bp, Homo sapiens
ctgtgtcttctcttgatagttcccaaacagtagaggctcagcctttgggatggggctaacgagagagcagag

SEQ ID NO: 6870775 - DNA, 62 bp, Homo sapiens
ggatgtgaaagaagatttagatgcccagaaatttcagcatctaaaattcatcatttacgttc

SEQ ID NO: 6870776 - DNA, 82 bp, Homo sapiens
caaccttcttctataagtatcctggtaaatgcttaggagtttaagtgtgtattgtttatgctgcaagaagcatatgaggttg

SEQ ID NO: 6870777 - DNA, 92 bp, Homo sapiens
gcttaagattttgattactgacacaggtagaataaagtactattaggagaggtaatgctttaaatcctagtgtaaatgaagactctgaaagc

SEQ ID NO: 6870778 - DNA, 56 bp, Homo sapiens
tgcagcatccatatattattagactgagcttttctaatagggataaacgtgctgca

SEQ ID NO: 6870779 - DNA, 55 bp, Homo sapiens
gctctataaggcccagtaaggtctccataatagggaccttcaggaacttatcagc

SEQ ID NO: 6870780 - DNA, 102 bp, Homo sapiens
acacagatatttatgagttgaaagggaacttttcattgtttgtacatgcatgtgtacatgtcttcgctacaatgaaaaggattccttccaattcacctgtgt

SEQ ID NO: 6870781 - DNA, 76 bp, Homo sapiens
ctctctctgggcccaacagcactggtcccgcaagcctcaggccccctaagggctggtcggtgctgcacagagagag

SEQ ID NO: 6870782 - DNA, 55 bp, Homo sapiens
caaagtgctggtattacaggtgtgagccactgcacccaacctgagccacattttg

SEQ ID NO: 6870783 - DNA, 130 bp, Homo sapiens
tgagtactcaaaaaaaaaaaaaaagatgtcttgaaacagcagagtggagatgagcacctcctttgatggtaccagcctgggtgctgatcttcacttggctgcctgagaccctgagcttttctgagattca

SEQ ID NO: 6870784 - DNA, 80 bp, Homo sapiens
gtggctgcagctggagaggatcccaaagccacgctcactggggctggctttctcacagaccacctccatgcagatcccac

SEQ ID NO: 6870785 - DNA, 75 bp, Homo sapiens
ttgtttgtttttgagatggagtcttgctctgtagctcaggctggagtgcaatggcaccatctcagctcactgcaa

SEQ ID NO: 6870786 - DNA, 56 bp, Homo sapiens
ccttgtgctcagtagcctgagaaggacggtaacaggtcaaggctgctgggccaggg

SEQ ID NO: 6870787 - DNA, 84 bp, Homo sapiens
gcctttctgcgcctgcgcaaaggtttctgtcaaaacggacagctctagctgcctatcaggagccagcgtgaggcgggggcgggc

SEQ ID NO: 6870788 - DNA, 75 bp, Homo sapiens
gaaattgcgcacatttctccgttgctgcattaatactagaaagggagtgaactgaacagagaaagtgccaatttc

SEQ ID NO: 6870789 - DNA, 61 bp, Homo sapiens
gagggtgtgctgtgtacttggcaatgggaaaacaaccatgaacaagacaaagcccatcttc

SEQ ID NO: 6870790 - DNA, 66 bp, Homo sapiens
gttgacagtgaccctgaaagcatggagcgagagctgctcaccaaactcccagggtgactgttcaac

SEQ ID NO: 6870791 - DNA, 88 bp, Homo sapiens
gctactagagaaacagttcaaagatcaatgggtctgttatcttgagtttcataaacagaacatggatttttgaagttctcacagttgc

SEQ ID NO: 6870792 - DNA, 58 bp, Homo sapiens
gctagaatattgggtaggcaagtagcagcatctacaacagtctaatgcagtattcggt

SEQ ID NO: 6870793 - DNA, 56 bp, Homo sapiens
cttgacattagttatgcagataaggcaaccgggtgctctcttaactaatggtcaag

SEQ ID NO: 6870794 - DNA, 88 bp, Homo sapiens
gggttcaagagagatgtctttgaggctcactgctgcctagtccactacctgcaaagtgtggcacaagtcacatctgttattgaaaccc

SEQ ID NO: 6870795 - DNA, 82 bp, Homo sapiens
ggccagggatagttctggatattttaagcatgttattttatttaacagtcatgcaaaatatgcaaaagaggtatagctgacc

SEQ ID NO: 6870796 - DNA, 55 bp, Homo sapiens
gctggttacttcattaggtcctctcattgattgaaccctgctgaagtgatgcagc

SEQ ID NO: 6870797 - DNA, 73 bp, Homo sapiens
gagccatggggttttcggtcatttggcctggcttattctctgccccatcaccagctccgtgagcctcgggctc

SEQ ID NO: 6870798 - DNA, 121 bp, Homo sapiens
ttgaatccaatattttttcttctcggaatcccaggcatatctacattatccaaggtgtggatggagatgtattttggaaggatttagagatgtctgttcttattgaaaaaataaaattcaa

SEQ ID NO: 6870799 - DNA, 107 bp, Homo sapiens
ggattgctgagcgcgtctagagaaagttcacacatccacatggattaatactttgcaaattcatggattcctatgtgaacttcctcctcaggagcatcaagcaattc

SEQ ID NO: 6870800 - DNA, 71 bp, Homo sapiens
aataaagggagggcaccagaagagccagatgagttactcatgagctcttttcgtggcttctaatctttatt

SEQ ID NO: 6870801 - DNA, 72 bp, Homo sapiens
tccctctcagattgtttgcctcgcagtttgcaattccctagcaaaacggcgagctccaatctgagctgcgga

SEQ ID NO: 6870802 - DNA, 60 bp, Homo sapiens
acttgatggagtttcactgtattatgttcatgatgggccccagtgaactccatatcaggt

SEQ ID NO: 6870803 - DNA, 76 bp, Homo sapiens
agagtaaatataaatttttatcagtacagtaagtgttcataatactgactgtcagtggaaggctatataatacttt

SEQ ID NO: 6870804 - DNA, 78 bp, Homo sapiens
ggatccttctccagtttctctgtgtcccctgtccacctacactgggcctgtacagagaaaactgatcaataaggattt

SEQ ID NO: 6870805 - DNA, 115 bp, Homo sapiens
catttagcaatatatgtagtcaataaacatttatgattgaggtaaatatacactagtcactcaataaatgcccaatgaatgaatgaatgaatggctgattatatgtttctgaatg

SEQ ID NO: 6870806 - DNA, 70 bp, Homo sapiens
ggctggcaatggaggcagcaccccagcagcttattatctgattgaggtagtggcctccaaatgaatggct

SEQ ID NO: 6870807 - DNA, 79 bp, Homo sapiens
ggggtttgttattttgttacagcgaatactgagattataaagggaatttctgtaatcagagtagcagataatatttccc

SEQ ID NO: 6870808 - DNA, 79 bp, Homo sapiens
tgaaaagctccagtaggctgtgtgaggctagagagctgaaccaaaagatctgccgactataagccaactagttttgcca

SEQ ID NO: 6870809 - DNA, 79 bp, Homo sapiens
acttaccctatctggcatcattgttttcatacataaaatggagtttataatgtctgtgccaaaattgattcagggaagt

SEQ ID NO: 6870810 - DNA, 81 bp, Homo sapiens
gagaataagtaacttgtgtcttaaagattaaatggcaaatttgctattaaatgtgaaagacataaaatggaattattgctt

SEQ ID NO: 6870811 - DNA, 64 bp, Homo sapiens
aatggctgggagtgtattttgggtaattttcatataatgcaccaaaaccagctccccagtaatt

SEQ ID NO: 6870812 - DNA, 55 bp, Homo sapiens
tggaggcaggaggaaccacaaagggggaactgcttcggtgaccagctgtccttca

SEQ ID NO: 6870813 - DNA, 62 bp, Homo sapiens
gcctgtgttaaatatattgagttttcttaaagagggaaaacctgtgaatagttaactcaggc

SEQ ID NO: 6870814 - DNA, 87 bp, Homo sapiens
ggcaagctagagctatcagcacgttttactaaacctccatacactagaatgagataggatttaaaactgtttgtaactgagtttgcc

SEQ ID NO: 6870815 - DNA, 124 bp, Homo sapiens
ggggtctcccaagggctggtgcttaccctgtcctgctgtgttcctcctgcatctccaaaagggctcagggcttgggtgatcgggggatggggtaggggtgtggacacaacccgcaggagaaact

SEQ ID NO: 6870816 - DNA, 91 bp, Homo sapiens
tcaccacagggcacagtttgccttctcttccctgggagctcttgttcatttgtcaggagacctaaaagaaggctactatgtacagtggtgg

SEQ ID NO: 6870817 - DNA, 73 bp, Homo sapiens
gggtctctggctttggatttgaagggtggaaataggcttgaggacactctttggggatagaaccagatgattc

SEQ ID NO: 6870818 - DNA, 68 bp, Homo sapiens
ttctgcattctgctctccctcttgtctcctccctgctctactggcagccctcgagggcagaggcggaa

SEQ ID NO: 6870819 - DNA, 130 bp, Homo sapiens
tcccagtagacttctatccccaggacatgagtggtgcccacctgagcctgagaccacagttgcttttcagatgtctctcagcagggttccacatcgtcatgccctggcacaagcacagaggttaagggga

SEQ ID NO: 6870820 - DNA, 79 bp, Homo sapiens
gccttccagatgatctgtcacttatcacatttaagtttgtagatggattagatgctgattgaatagatttctgaaaggc

SEQ ID NO: 6870821 - DNA, 59 bp, Homo sapiens
ggggtgagggatgagccttcttcggcatcgtcagaaaaggctctcactccctccgttcc

SEQ ID NO: 6870822 - DNA, 72 bp, Homo sapiens
ccagagtgggagagtagcagaaggatgagagagtgtcctctctcatttctccgacctgctgtccctttttgg

SEQ ID NO: 6870823 - DNA, 59 bp, Homo sapiens
ggacccgctgccagggaattcacaagcccgcttctgctgtggcctgggagctgaggtct

SEQ ID NO: 6870824 - DNA, 65 bp, Homo sapiens
gctgcagggccatgggttctatagaacagaatacagagctataggatatacaaggttctgtgagt

SEQ ID NO: 6870825 - DNA, 58 bp, Homo sapiens
gagagctgcattctcagacacacaagaacccaaacagtgttgtttggttgcctctctc

SEQ ID NO: 6870826 - DNA, 95 bp, Homo sapiens
ctgaactatagttaaattgatgtgactgaagtgtctagacctgtacattttatatagaggtttcaaattctagccacacgatgattataattcag

SEQ ID NO: 6870827 - DNA, 55 bp, Homo sapiens
gagaaggatgaggaaatggtatgagggaaactgtggaatcacgctttaccttctc

SEQ ID NO: 6870828 - DNA, 88 bp, Homo sapiens
gagcactgttcaaaatcagtgggcggtgaggacttcccagaataggtaactgggagatatccggcctccgtgagtttagacaaggctc

SEQ ID NO: 6870829 - DNA, 84 bp, Homo sapiens
ccttagcgcttcaagatccatagatattgctttgaattttagctctgcaaaatgtaatacctatgtgatcttaggtaacttagg

SEQ ID NO: 6870830 - DNA, 67 bp, Homo sapiens
gagatgatccctagtgagtcattggtgttgctgtggccaccaccattgttgttactgggagagtttt

SEQ ID NO: 6870831 - DNA, 103 bp, Homo sapiens
gcaggtgctttctgactgagactgggaacctgtgctaggaggggctcccatcacctccaggccttgcaggttaactggatgcccagtatagtttgacatttgc

SEQ ID NO: 6870832 - DNA, 85 bp, Homo sapiens
ttatgaatttccctgaagtttgtatgaatgttttatgctaaccaaatttacaagagattatctacagatgagggtcagtttataa

SEQ ID NO: 6870833 - DNA, 66 bp, Homo sapiens
gtcctggcccactatgccagcatctgccagcagaatggcattgtgctcatcgtggagcctgaggat

SEQ ID NO: 6870834 - DNA, 59 bp, Homo sapiens
tgaaaaatgccggccatacagttgattaaagttgaagacagtggaatcggtgtttttta

SEQ ID NO: 6870835 - DNA, 63 bp, Homo sapiens
gagctgctctatctaaaagtcctggatctgaatccgtttttaggcctagagatgggggagctc

SEQ ID NO: 6870836 - DNA, 55 bp, Homo sapiens
gagtctgagaactgggctcagtccacgggaacaacagccacaaatctcaggcctc

SEQ ID NO: 6870837 - DNA, 103 bp, Homo sapiens
gggttgggaagaatggggaaatcatctgggatctctgattggtcactcgaattcagtaggtgtggcaggtagagttctgagatggcccccacgattcctaccc

SEQ ID NO: 6870838 - DNA, 67 bp, Homo sapiens
gctgggtgggcacccagcctgggctgtgggcacagggacagccatcccaggctggggctcctccagc

SEQ ID NO: 6870839 - DNA, 67 bp, Homo sapiens
acagtattgtcagccagattggctgtaaccattattataacctttactatatctgctgacattctgt

SEQ ID NO: 6870840 - DNA, 68 bp, Homo sapiens
gtatgtagggaatgtgagatggcctttagatatcattgccaacttattgaacattctcgaattcatac

SEQ ID NO: 6870841 - DNA, 77 bp, Homo sapiens
ttctttaattgtggaagagcagccttcactgataataaatttaactcaagctgttgttctccctaacaattactgga

SEQ ID NO: 6870842 - DNA, 65 bp, Homo sapiens
tgactaaggaggacagctagttagatagaaagtgttccattgttaaacagctgtcttcttcagca

SEQ ID NO: 6870843 - DNA, 57 bp, Homo sapiens
ggtggacagtgttagctctgggttccagttccacaccaggttaaacaaatttctacc

SEQ ID NO: 6870844 - DNA, 58 bp, Homo sapiens
agttactgtttcccgtgatactctgtctggactgaattcatcttgggaaatggtaact

SEQ ID NO: 6870845 - DNA, 113 bp, Homo sapiens
aggataatatccaaattttacccatgtttaagtctccagaaactgacctatagttgacccccactaaatgtttctggagtgactataactggtagattttggcttaaaatttt

SEQ ID NO: 6870846 - DNA, 63 bp, Homo sapiens
tgtgctgctgtcagagcaatgaggttcagcagttgtggtgacaaattagttttgacaagctta

SEQ ID NO: 6870847 - DNA, 126 bp, Homo sapiens
ctgttacaatttttgcaaaggcagtttcacagtcaaggtggaccagaaaaattcagtaaatagtctgaaaaatatggaatactccacttttatttcttagttgttgctttttaaaaggagtaccag

SEQ ID NO: 6870848 - DNA, 75 bp, Homo sapiens
ggtccagcaggcctgggtagggccagagatgctgtgcttctaacaagctcctgggccaagcccatgctgctgacc

SEQ ID NO: 6870849 - DNA, 68 bp, Homo sapiens
ctggcctggcagaggtggcgcgccatccctgccacagactggcaggaatgggtcccctccaggtgtag

SEQ ID NO: 6870850 - DNA, 79 bp, Homo sapiens
acaggtagcaccagtgctcttctcaacatttgttatcactaatgatagaagcctttggaagagcaaagggttactctgt

SEQ ID NO: 6870851 - DNA, 60 bp, Homo sapiens
gtgggattaatgtgcagtaattagcctgttttggtctaggatgactgatagtgattccat

SEQ ID NO: 6870852 - DNA, 56 bp, Homo sapiens
gggcagcatcaggaggggctttctgggcacacccagtacccgtctctgagctttcc

SEQ ID NO: 6870853 - DNA, 58 bp, Homo sapiens
aggtgaggagcttctctttgctggtagagcactgcccaaatgaagaaccttctcacct

SEQ ID NO: 6870854 - DNA, 57 bp, Homo sapiens
tctccctcaattctttgcctcactttttttgacaggtgcagcagatttgggggaaga

SEQ ID NO: 6870855 - DNA, 66 bp, Homo sapiens
tactcttttcatgtcatgtccttgaggcaaacctccccagcatcttgtctctcactgaagagagta

SEQ ID NO: 6870856 - DNA, 102 bp, Homo sapiens
gttgcttttcatagtgcagctgcttgcctggttaggaagacagattggtgacccgcagtcatacacattgattaggtgacagcctgtattctgaacagtagc

SEQ ID NO: 6870857 - DNA, 113 bp, Homo sapiens
atgggtaacaaaatgatttgtttctctccatctctctctgctccctggtggagcttctataaaagataggcttcagaggagaagagggtggaaaaagtctccagatatcccat

SEQ ID NO: 6870858 - DNA, 66 bp, Homo sapiens
cgcgacgcgcggccttgtggggcttgtagtccgcgacgcgcggccttgtggggcttgtagtccgcg

SEQ ID NO: 6870859 - DNA, 62 bp, Homo sapiens
gtaggcactgcagaaagaaggtttgggcaagtttcaagtctgtttcattgcatgttgtttat

SEQ ID NO: 6870860 - DNA, 80 bp, Homo sapiens
aacacttacttgtgcatctgagattttaaataatatggtattctggaatgtttgaagctccggtgtataggaatggtgtt

SEQ ID NO: 6870861 - DNA, 114 bp, Homo sapiens
gctctctggaccaggccttgtgttaagtcctgaagacacagaaaaggctaaaacagcccctggtcttaaggactcacagatcatgaggaggcgatagatactggaatagaaggc

SEQ ID NO: 6870862 - DNA, 76 bp, Homo sapiens
acagaagggtgcctggaagccactcacagaacctcgtatctgccatctgctgaagcttctgcacctgcttcactgt

SEQ ID NO: 6870863 - DNA, 108 bp, Homo sapiens
gccatctagattggcaatcaggggacagcccgtgtcatcagctgctgactcccagggcagctcagcaacggggctgagagcccttgactcccacttctgttgataggc

SEQ ID NO: 6870864 - DNA, 80 bp, Homo sapiens
aggttggtgcaaaagtaattgctgtttttgcattactttttaaaaaatggcaaaaactgcaattacttttgcactaacct

SEQ ID NO: 6870865 - DNA, 59 bp, Homo sapiens
tctgtagcattcaccagccctgctgcccaccccttccagagctggggaatggatattga

SEQ ID NO: 6870866 - DNA, 60 bp, Homo sapiens
gcttggtactcccttgggatggttcagtagagatgaggcaggcagaaggaagtaccaggc

SEQ ID NO: 6870867 - DNA, 62 bp, Homo sapiens
gctgcccggggtcatgtagtccctgtgtggcttcaaacttaggcttctgctgtccccgacgc

SEQ ID NO: 6870868 - DNA, 75 bp, Homo sapiens
tattaggttggtacaagagtatttgcggttttcaccacaattaaaaaccacaattacttttgcaccaatgtaata

SEQ ID NO: 6870869 - DNA, 74 bp, Homo sapiens
cggcttagttcctggcactctgaggtccacctccttcctgaggctggtggttaccgtgctaatgagctaggccg

SEQ ID NO: 6870870 - DNA, 88 bp, Homo sapiens
acaatacagcattttgcttgttcaagatttctgtgtaaaaatttacacgttttctagagaatatgcagaaagtgaaaactgtaaatgt

SEQ ID NO: 6870871 - DNA, 110 bp, Homo sapiens
gcagtttttaacagtttatgattttcactgaatgtgtgtgtgtgttgtgtgtgtgtgcatacatgcatacgtgtgtttaaaacaaatttgaagtcaactgcagaaaacgc

SEQ ID NO: 6870872 - DNA, 55 bp, Homo sapiens
caggacactacagatgggagggccgacaggcagacatttacttctcactgtcctg

SEQ ID NO: 6870873 - DNA, 55 bp, Homo sapiens
cagatttcaagaaccctgaaagaacattcactgtgtccagggtagatgaattctg

SEQ ID NO: 6870874 - DNA, 61 bp, Homo sapiens
ctgtccagcgactaggggatggagccaatgccgtgcgagcaaatcccttgtcgctaggcgg

SEQ ID NO: 6870875 - DNA, 66 bp, Homo sapiens
ggtgttgtaactgggaacatctgaatgctgaggcttagtccagtgttctctctcccttaccactcc

SEQ ID NO: 6870876 - DNA, 130 bp, Homo sapiens
ggttgggggcggctggaggcctcggggtggcggccacgctcgggcagggcaggagatctgcgctcagtcctggagcccttcttggcctttgtggccctgtcactcttttcacccctggctggccctagcc

SEQ ID NO: 6870877 - DNA, 55 bp, Homo sapiens
ctttctctgtgtggtaaagggctggcattggggtccgccctacctgtagaggcag

SEQ ID NO: 6870878 - DNA, 89 bp, Homo sapiens
gtagagcatatacagttacatcacttactgacatctgtaactaagctaaggcactgtcaggaaaagagtgttaactgtaaatgtagtac

SEQ ID NO: 6870879 - DNA, 63 bp, Homo sapiens
gtatggttatactgacctacaactgctcgttatcagtccatcctatgtgtaggataaccatac

SEQ ID NO: 6870880 - DNA, 57 bp, Homo sapiens
gcatgaagggaggtggcagtcaggaaggccacactgattgggccacactgattcagc

SEQ ID NO: 6870881 - DNA, 69 bp, Homo sapiens
gaacaagccatactgggtgaaatcaaagcacgtgtaaaggacgactgacacccagaccatggtttattc

SEQ ID NO: 6870882 - DNA, 62 bp, Homo sapiens
aggatagttgcatcatgtcagttgtatcatgttaggcacaactattaccatgttattgtctt

SEQ ID NO: 6870883 - DNA, 74 bp, Homo sapiens
tcaccacctctcatgtgccagtaatttctagggcccctatagaaatctgactgctgtgcacatagagggactga

SEQ ID NO: 6870884 - DNA, 68 bp, Homo sapiens
gtggaggtgaacaggatggtggaaagtttctgctgatgagagtagcctattgcatcctccacctcgat

SEQ ID NO: 6870885 - DNA, 69 bp, Homo sapiens
ggcccagacaggaacacacatctccctaaattctgactaaaaggcgtggtgaaccctgctctgtcggcc

SEQ ID NO: 6870886 - DNA, 68 bp, Homo sapiens
gctgggagaactgggtggagcatcttgtggactgacagacacgagttggaaccctggttcttccacgc

SEQ ID NO: 6870887 - DNA, 59 bp, Homo sapiens
gtagaagattctgccaagagcgctccagttctgatatgtggcgttagttgaatttctgc

SEQ ID NO: 6870888 - DNA, 130 bp, Homo sapiens
cacgcctggctaatttttgtatttttagtagagatggggttttgccaggctggtctcgatctcccgacctcaggtgatccacttgcctcggcttcccaacgtgctggagttacaggtgtcagccaccgtg

SEQ ID NO: 6870889 - DNA, 59 bp, Homo sapiens
ttgccatttcaagtggccactgtataggaagagtcccagggctaaaaatgaagtgacga

SEQ ID NO: 6870890 - DNA, 67 bp, Homo sapiens
ctgaccacatgcgtcctaggccccagcagctctgaactgcttcctgggacaggctatgtgctgtcag

SEQ ID NO: 6870891 - DNA, 73 bp, Homo sapiens
tcagtaagtgccaggctcttgcagtgtgtcctgagtttctcatggcacttagcacagtcctcacacttactgg

SEQ ID NO: 6870892 - DNA, 60 bp, Homo sapiens
gatgaagcttttccatggcaggcaggcagcaggagctgtccagagtacggaagagtcatc

SEQ ID NO: 6870893 - DNA, 107 bp, Homo sapiens
tgtgtggcctggtgattcagtgtcctgtgcggtgcagcatgcaagtgtggctgtctctctttctcagggcactgcagcatcaccttatgacgttaaaggtacgcaca

SEQ ID NO: 6870894 - DNA, 124 bp, Homo sapiens
ctttcactctttccatctgtatgtgtgtgtatttttatgtgtgtgtgtgtgtgtgtgtgtgtttgtgtattaagtacagcaccatgagcacagggaaatagcaatatgagggtaagggtaagag

SEQ ID NO: 6870895 - DNA, 97 bp, Homo sapiens
gtattttctattaaaaatacccatagcttagtatattttgttgcaattcaaatagagcaaagttttgaagataaattgtactgaagataggaaatgc

SEQ ID NO: 6870896 - DNA, 55 bp, Homo sapiens
ttatgagacacatgtcttgaggcatttcaaatgattcttggcaggtgtatcataa

SEQ ID NO: 6870897 - DNA, 129 bp, Homo sapiens
gcactgctgacgtttgggacattagtcgtggggactgtcctgtgcaccgtgggatgtttagtcattcctgaactccacactgggtgccagcagcattctccctcccctgattgtgacaggcagcagtgt

SEQ ID NO: 6870898 - DNA, 67 bp, Homo sapiens
gtgccagtggagatgagtatatggctggtggacacacaagaccctatgcaacatttcacctaggcac

SEQ ID NO: 6870899 - DNA, 80 bp, Homo sapiens
agttaagaaagtgtggagattgaactaaaacttaggccttctggcttctaatttagttctatctttatagttacattact

SEQ ID NO: 6870900 - DNA, 85 bp, Homo sapiens
gttgcgaggggctgtcttgtatgttgtaggacacttagcagcatccctggcgtccatccattgaatataatagttcccctccagc

SEQ ID NO: 6870901 - DNA, 130 bp, Homo sapiens
agtctcccttcagtggctggaggaggtgtggcacagtgggagagccccagactcagaggcagtcagagatctgctactgggactctatcaccctggaccttcatttcctctttgcaaaatgaggggctct

SEQ ID NO: 6870902 - DNA, 77 bp, Homo sapiens
gggcaggccaggcacgggggcatggcctcttttttcctgggagagcagtcacccctctgtcacctgaccagctgccc

SEQ ID NO: 6870903 - DNA, 65 bp, Homo sapiens
ttcttggtttggaaacttggatggaaaacctcgaatttttttgagttgattggtttccctaagaa

SEQ ID NO: 6870904 - DNA, 58 bp, Homo sapiens
tcagggtcaggacccagctgttccaaccaccccgtggcagaggtggcctgacctctga

SEQ ID NO: 6870905 - DNA, 64 bp, Homo sapiens
tccatacagatcacagtcctaggccacagaaaagggtgggaaactggggactgaatctgaagga

SEQ ID NO: 6870906 - DNA, 56 bp, Homo sapiens
gagagagtttttactggagggcatcttagtgatgggctgccccttaagagtttctc

SEQ ID NO: 6870907 - DNA, 70 bp, Homo sapiens
atccaagattggagattcctggtctgtgtagagtatatggttttgcacgaaatctttctagtcttgtgat

SEQ ID NO: 6870908 - DNA, 83 bp, Homo sapiens
gattaacttcatcatggtcgtgagctccctaatgtttttctttgaaatgtctcggctctaaacgatcgtgacccaaggcaatt

SEQ ID NO: 6870909 - DNA, 61 bp, Homo sapiens
atgaggagtctgagaccgagggatgctcgatgaatcaccccaggtctccaggctctggcat

SEQ ID NO: 6870910 - DNA, 96 bp, Homo sapiens
gcctcagttttcactctgtcaatatgtaataactgaatctgtctttgtggtgaggattcagtgagttaacatatttgaagtgcttaaaaatgaggc

SEQ ID NO: 6870911 - DNA, 66 bp, Homo sapiens
catttctgctgatttcaggttttctttcagtggtgaatgacaaagacatgcaattagcaaggaatg

SEQ ID NO: 6870912 - DNA, 70 bp, Homo sapiens
tggacatttccccagtggagaagtatttgaaatactgcatttcctgttgcttttgccactgctgctgcca

SEQ ID NO: 6870913 - DNA, 73 bp, Homo sapiens
tctcattccatgcttccaacagttctgtgaagtaaagttatctacattctacagataggaatatgaatgcaga

SEQ ID NO: 6870914 - DNA, 129 bp, Homo sapiens
ctgtcattaatccaacacagctctactccaactcttttctgggtcagcacattcagattttcccacatgtagcttggcctcagcaagagtcgatgactcaagtttctgttgtataaatatgaaggtttg

SEQ ID NO: 6870915 - DNA, 122 bp, Homo sapiens
tagttttcgttctcaggcacaggagaacctcataaaggcacacttgttgtttatcctaataggcatttagtaagtgtttattatgacttaggtcctgtgctaaccactggggataagagctg

SEQ ID NO: 6870916 - DNA, 87 bp, Homo sapiens
gcctaaatggcaggatcagtttctgcatctttctctgcttgaaccaaagacattttaatagtgcagggctataactccattctgggc

SEQ ID NO: 6870917 - DNA, 94 bp, Homo sapiens
gccgctgctttgtctttgtcctggggcgacttggggcccaggaaacagactcagaattcagggctcccgtctctagggcaggaatatcaggggt

SEQ ID NO: 6870918 - DNA, 76 bp, Homo sapiens
gagtctctgttgcctaggctggagtgcagtggtgtgatcttggttcactgcaacacctcctgggttcaagtgattc

SEQ ID NO: 6870919 - DNA, 64 bp, Homo sapiens
cataatctgttgttaatattgacttgaagaaaaatcgagttaataggtcttcaagagcattatg

SEQ ID NO: 6870920 - DNA, 67 bp, Homo sapiens
gagaagggactggaaagatcaccttacctggactgacattcagtggagggaaatccagtcacttttc

SEQ ID NO: 6870921 - DNA, 70 bp, Homo sapiens
gtccatccgtggtagcatggatcagtacttccttcctatttttagctgagtaatgttactttgtatggat

SEQ ID NO: 6870922 - DNA, 81 bp, Homo sapiens
cttacagagaaaaaggcactatagaagaaaacattttggattgagatttagaagttcaggtctgtaatctggttttgtgag

SEQ ID NO: 6870923 - DNA, 115 bp, Homo sapiens
gtcctaaaatcaaggtgtcagcaggactgcattccttctggaggctctaagggacaatctgtttccttgtctttcccagcttctagaggctgcctgcattctttggtttgtagac

SEQ ID NO: 6870924 - DNA, 55 bp, Homo sapiens
gtctttgtactttaggttgggtaatgcctactagcctgacttcaagttcagtgac

SEQ ID NO: 6870925 - DNA, 55 bp, Homo sapiens
tggccttggctgagagatttaaagaattctctttaacccctttcctccggggcca

SEQ ID NO: 6870926 - DNA, 60 bp, Homo sapiens
aacataagggagcttcaaaactttagattcctggagtattgaaaagctactttacatgtt

SEQ ID NO: 6870927 - DNA, 60 bp, Homo sapiens
cttttactgtgccctgggtcagaactttgatgattagttacaggaaagggccaggaagag

SEQ ID NO: 6870928 - DNA, 80 bp, Homo sapiens
ttaagatttaaatgctttaagcaagggttcatggtttatcatgctactctgccacataaaggtagatatttaatttttaa

SEQ ID NO: 6870929 - DNA, 107 bp, Homo sapiens
ggcccagagggagagagacatacagggaggctgcagtggagcagggcaacctcacacttctgcttccagctctctgtaaggtctgacttcacttctctcgttgggtc

SEQ ID NO: 6870930 - DNA, 66 bp, Homo sapiens
tgcatatatttgagattatggcttttcagttttctgccatcaccaataagttttgaaatatatgcg

SEQ ID NO: 6870931 - DNA, 69 bp, Homo sapiens
attatgtgttttttcgatatccacatttgtgtatgtgtacaaatgtctatgaaatgaaagggacatagt

SEQ ID NO: 6870932 - DNA, 108 bp, Homo sapiens
tagttaccaaattagaatgtgggcttggatgctgtctaagctgaggacttcctttcaccttctcagatcccagtttgatgtattctttcattttcaatttggaatcta

SEQ ID NO: 6870933 - DNA, 62 bp, Homo sapiens
gtctctgaattggcattttagacttgatgaaataaggtcctgtgcaggctggttgtagagat

SEQ ID NO: 6870934 - DNA, 56 bp, Homo sapiens
tgcaggctgtagacaccaaactatactttatagaacatgtgaaaatatagcctgta

SEQ ID NO: 6870935 - DNA, 77 bp, Homo sapiens
ggcaacaaggacgtcacttccacggtgcaaacatgcttgccaagctgaagtgtggagtgacagtttttggctgagcc

SEQ ID NO: 6870936 - DNA, 119 bp, Homo sapiens
catgtaggtgttctgagcagagtttcagcataggcaatctagacttcatggaagtggtgacatttaatgaaagtgaaggtttactaagcacttactttgtataagcattgtgctgcatg

SEQ ID NO: 6870937 - DNA, 86 bp, Homo sapiens
atcccctgggagcttgttggagcagctcaggctctgtcccagacctattcaagccaaatctggatttagcaagactctcgagggat

SEQ ID NO: 6870938 - DNA, 98 bp, Homo sapiens
gatccacctgccttggcctcccaaagtgctgggattacaggcttgagccaccatgcccagcctatccaagcgctttggaaggccaaggtgggtggatc

SEQ ID NO: 6870939 - DNA, 58 bp, Homo sapiens
gctggtataataatgtttttcagcctgacctttggcaaaaggcactatgtctgctagc

SEQ ID NO: 6870940 - DNA, 59 bp, Homo sapiens
aacatgcccgctgtatgccattcctactggacaggagtcctcgctgtcagctgcatgtt

SEQ ID NO: 6870941 - DNA, 110 bp, Homo sapiens
cattcagagataatggaaaaataatggataagccgctcctgtccttcatcctccctagcttcctggagaggttggtgaggggacacggtgtccccattatgcttagaatg

SEQ ID NO: 6870942 - DNA, 74 bp, Homo sapiens
gcagccaggcattatctgtagtcagaataatttttcatacaaataatttttcaagtacagattgaacctgctgt

SEQ ID NO: 6870943 - DNA, 75 bp, Homo sapiens
acagatacataaacacttctagggcacacagattttcatgtatgtgtgtactatggtgttaatgcagaattctgt

SEQ ID NO: 6870944 - DNA, 64 bp, Homo sapiens
cctccccagtgtgaacctcaccaccctccccaatgtgaagggatggcaagttaacctgaggagg

SEQ ID NO: 6870945 - DNA, 94 bp, Homo sapiens
cctcaacattgttttgagacaaccagtgagtatttgtaacagagatgagagagtttcgcttgccaccttactgacggttacagaaaatgtgagg

SEQ ID NO: 6870946 - DNA, 91 bp, Homo sapiens
ttgatccggtattttcagtttcaaatcctggatgcactagcagcatgatgatgtgttcatggaatttgcaattgagataatgaggaatcaa

SEQ ID NO: 6870947 - DNA, 67 bp, Homo sapiens
acataacatagttgacattttttctgctgcgtgcatatagccaggagtggatttgctgtgttactgt

SEQ ID NO: 6870948 - DNA, 57 bp, Homo sapiens
cataaagggacattatgggacatagtaaaatcataatgtcacaaaagtcccattatg

SEQ ID NO: 6870949 - DNA, 80 bp, Homo sapiens
gaagggaaggaagtgaagtggcagctagaaatcaggctgtgagcctgaagtttcacgcgtcattcaatgtccaatctttc

SEQ ID NO: 6870950 - DNA, 55 bp, Homo sapiens
gtgagtgggtgacattaggaaatagagtggatgattcgtagggtcagctcaccat

SEQ ID NO: 6870951 - DNA, 57 bp, Homo sapiens
ggattgcaacaagctagtttaggaaccgctggcggactagaaagaatgttgtcgtct

SEQ ID NO: 6870952 - DNA, 125 bp, Homo sapiens
aaggtgccagatgcagtggctcatgcctgtagtcctcaacttgggaggctgaggcaagaggatcgcttgagcccaggagtatgaggctgcagtaagccatgattgtgccactgcactccagcctt

SEQ ID NO: 6870953 - DNA, 68 bp, Homo sapiens
gacttattacgtctctttagagggactagttcctgaagggtagagccctctctttagagatctgagtt

SEQ ID NO: 6870954 - DNA, 82 bp, Homo sapiens
cattttagtcgacatatgtttgttatcagagagaggtgctgtgaacacacagccattttcttagcagctttttgactgtatg

SEQ ID NO: 6870955 - DNA, 72 bp, Homo sapiens
cgttttgtctttttgtctggcagaggtcacttttgacagtgcctttgtgtttcagcagaaatggataatctg

SEQ ID NO: 6870956 - DNA, 126 bp, Homo sapiens
caaagattaagtatcaggcacacaggtttttaatgcctagattattctgtttttataataaattagtaaatgagattctagccattacaaatctgtgtgttgttgaaaactgtcatttgatctatg

SEQ ID NO: 6870957 - DNA, 56 bp, Homo sapiens
ggagtcatgagcagttagtgtcagctcaggagcagccacaactgtccacatgctcc

SEQ ID NO: 6870958 - DNA, 79 bp, Homo sapiens
tgaactgtatcttaaaggcttcggatcagaaggtaaaacattttactttaatatatgtgaagttctgagactcaactca

SEQ ID NO: 6870959 - DNA, 65 bp, Homo sapiens
tactcaaattctctactgtatgaattatgctttaagtagaattcagtgccaaggagaacttggtg

SEQ ID NO: 6870960 - DNA, 63 bp, Homo sapiens
tgggtttcacatgaaagtaggaaaggactctctggagtctttaccatctttatgtgagaaaca

SEQ ID NO: 6870961 - DNA, 67 bp, Homo sapiens
ttgacacaaaaggaagagaaaagctgcctctcggttataaaaagtatcttttcctttctgtgtgcaa

SEQ ID NO: 6870962 - DNA, 65 bp, Homo sapiens
cttgtggaacagatgtgggccaagcgtgagaaagaaccactgtggagtcaccttagttccaaaag

SEQ ID NO: 6870963 - DNA, 62 bp, Homo sapiens
gacaaattagcccaggaaaacagggcaggaaaaaactgtctttacttctgcttgttattgtc

SEQ ID NO: 6870964 - DNA, 84 bp, Homo sapiens
tgttctgccgaggacttaatcgaagcttaatggattgacctaacattcgatttcctgacttccattgaggcggcggcagcagca

SEQ ID NO: 6870965 - DNA, 56 bp, Homo sapiens
ggctgctgtactgatgtcagtttttatttattgagtgcttagcaggcatagtagct

SEQ ID NO: 6870966 - DNA, 62 bp, Homo sapiens
ttggttctccttgagtgtcccaggggaggcaactgctgtgctgattctcaggtgagagctgg
